United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 12

SEQ ID NO: 495542 - DNA, 16 bp, R. norvegicus
ctatgtagctaaagat

SEQ ID NO: 495543 - DNA, 16 bp, R. norvegicus
ctatgtagctcaggtt

SEQ ID NO: 495544 - DNA, 16 bp, R. norvegicus
ctatgtagctctgact

SEQ ID NO: 495545 - DNA, 16 bp, R. norvegicus
ctatgtagtccagact

SEQ ID NO: 495546 - DNA, 16 bp, R. norvegicus
ctatgtagtcctggct

SEQ ID NO: 495547 - DNA, 21 bp, R. norvegicus
ctatgtatttgctgtattctg

SEQ ID NO: 495548 - DNA, 16 bp, R. norvegicus
ctatgtgactaaatgc

SEQ ID NO: 495549 - DNA, 16 bp, R. norvegicus
ctatgtggatgttccc

SEQ ID NO: 495550 - DNA, 16 bp, R. norvegicus
ctatgtgtgtgagtgt

SEQ ID NO: 495551 - DNA, 16 bp, R. norvegicus
ctatgtttaaaaaaaa

SEQ ID NO: 495552 - DNA, 16 bp, R. norvegicus
ctatgtttaggtatgg

SEQ ID NO: 495553 - DNA, 16 bp, R. norvegicus
ctattaaaaatgactt

SEQ ID NO: 495554 - DNA, 16 bp, R. norvegicus
ctattacctgagtttt

SEQ ID NO: 495555 - DNA, 16 bp, R. norvegicus
ctattacttcccctac

SEQ ID NO: 495556 - DNA, 16 bp, R. norvegicus
ctattatgaacaaagc

SEQ ID NO: 495557 - DNA, 16 bp, R. norvegicus
ctattcccagcaccca

SEQ ID NO: 495558 - DNA, 16 bp, R. norvegicus
ctattcctctcttggg

SEQ ID NO: 495559 - DNA, 16 bp, R. norvegicus
ctattccttccaggac

SEQ ID NO: 495560 - DNA, 16 bp, R. norvegicus
ctattgacttgctgta

SEQ ID NO: 495561 - DNA, 16 bp, R. norvegicus
ctattgctctggaata

SEQ ID NO: 495562 - DNA, 16 bp, R. norvegicus
ctattggatggttttg

SEQ ID NO: 495563 - DNA, 18 bp, R. norvegicus
ctattggtacagagacag

SEQ ID NO: 495564 - DNA, 16 bp, R. norvegicus
ctattgtgaaggatat

SEQ ID NO: 495565 - DNA, 16 bp, R. norvegicus
ctattgtgaatgatgt

SEQ ID NO: 495566 - DNA, 16 bp, R. norvegicus
ctatttatgtccttcc

SEQ ID NO: 495567 - DNA, 16 bp, R. norvegicus
ctatttcaaaacaaaa

SEQ ID NO: 495568 - DNA, 16 bp, R. norvegicus
ctatttccttagggga

SEQ ID NO: 495569 - DNA, 16 bp, R. norvegicus
ctatttctactttcat

SEQ ID NO: 495570 - DNA, 16 bp, R. norvegicus
ctatttctcttgctct

SEQ ID NO: 495571 - DNA, 16 bp, R. norvegicus
ctatttgatggttttg

SEQ ID NO: 495572 - DNA, 16 bp, R. norvegicus
ctatttgcctctgcct

SEQ ID NO: 495573 - DNA, 16 bp, R. norvegicus
ctatttggggatggct

SEQ ID NO: 495574 - DNA, 16 bp, R. norvegicus
ctatttggtgttctct

SEQ ID NO: 495575 - DNA, 16 bp, R. norvegicus
ctatttttaattggat

SEQ ID NO: 495576 - DNA, 16 bp, R. norvegicus
ctatttttgtggaata

SEQ ID NO: 495577 - DNA, 16 bp, R. norvegicus
ctcaaaaaccaaggtg

SEQ ID NO: 495578 - DNA, 16 bp, R. norvegicus
ctcaaaacaaaacaga

SEQ ID NO: 495579 - DNA, 16 bp, R. norvegicus
ctcaaaacaaaagcca

SEQ ID NO: 495580 - DNA, 16 bp, R. norvegicus
ctcaaaactgcaaagc

SEQ ID NO: 495581 - DNA, 16 bp, R. norvegicus
ctcaaaagatgaaaca

SEQ ID NO: 495582 - DNA, 16 bp, R. norvegicus
ctcaaaagcaggcccc

SEQ ID NO: 495583 - DNA, 16 bp, R. norvegicus
ctcaaaaggggtcagg

SEQ ID NO: 495584 - DNA, 16 bp, R. norvegicus
ctcaaaagtaaacaaa

SEQ ID NO: 495585 - DNA, 16 bp, R. norvegicus
ctcaaaatacaaggtg

SEQ ID NO: 495586 - DNA, 16 bp, R. norvegicus
ctcaaaatagaagaaa

SEQ ID NO: 495587 - DNA, 16 bp, R. norvegicus
ctcaaaatatccagga

SEQ ID NO: 495588 - DNA, 16 bp, R. norvegicus
ctcaaaatgaaataaa

SEQ ID NO: 495589 - DNA, 16 bp, R. norvegicus
ctcaaacaaaacaaag

SEQ ID NO: 495590 - DNA, 16 bp, R. norvegicus
ctcaaacaaggtggaa

SEQ ID NO: 495591 - DNA, 16 bp, R. norvegicus
ctcaaacacatgggca

SEQ ID NO: 495592 - DNA, 16 bp, R. norvegicus
ctcaaacagcaccacc

SEQ ID NO: 495593 - DNA, 16 bp, R. norvegicus
ctcaaacaggacagaa

SEQ ID NO: 495594 - DNA, 16 bp, R. norvegicus
ctcaaacatatacaca

SEQ ID NO: 495595 - DNA, 16 bp, R. norvegicus
ctcaaactcagatcca

SEQ ID NO: 495596 - DNA, 16 bp, R. norvegicus
ctcaaagagatctacc

SEQ ID NO: 495597 - DNA, 16 bp, R. norvegicus
ctcaaagagggcagga

SEQ ID NO: 495598 - DNA, 16 bp, R. norvegicus
ctcaaagcacatatta

SEQ ID NO: 495599 - DNA, 16 bp, R. norvegicus
ctcaaagcagccagga

SEQ ID NO: 495600 - DNA, 16 bp, R. norvegicus
ctcaaagccccacccc

SEQ ID NO: 495601 - DNA, 16 bp, R. norvegicus
ctcaaagccccagtgt

SEQ ID NO: 495602 - DNA, 16 bp, R. norvegicus
ctcaaagcctacctcc

SEQ ID NO: 495603 - DNA, 16 bp, R. norvegicus
ctcaaagctctgagtg

SEQ ID NO: 495604 - DNA, 16 bp, R. norvegicus
ctcaaaggacctgaaa

SEQ ID NO: 495605 - DNA, 16 bp, R. norvegicus
ctcaaaggagaagggg

SEQ ID NO: 495606 - DNA, 16 bp, R. norvegicus
ctcaaaggataaagag

SEQ ID NO: 495607 - DNA, 16 bp, R. norvegicus
ctcaaaggcccagaaa

SEQ ID NO: 495608 - DNA, 16 bp, R. norvegicus
ctcaaaggggaaaaaa

SEQ ID NO: 495609 - DNA, 20 bp, R. norvegicus
ctcaaagtacctcctgccat

SEQ ID NO: 495610 - DNA, 16 bp, R. norvegicus
ctcaaataaacccttt

SEQ ID NO: 495611 - DNA, 16 bp, R. norvegicus
ctcaaatccaaccaga

SEQ ID NO: 495612 - DNA, 16 bp, R. norvegicus
ctcaaatgatgtccca

SEQ ID NO: 495613 - DNA, 16 bp, R. norvegicus
ctcaaattcacagaga

SEQ ID NO: 495614 - DNA, 16 bp, R. norvegicus
ctcaacaaaggaaaaa

SEQ ID NO: 495615 - DNA, 18 bp, R. norvegicus
ctcaacagaggaatggat

SEQ ID NO: 495616 - DNA, 16 bp, R. norvegicus
ctcaacagattcagaa

SEQ ID NO: 495617 - DNA, 16 bp, R. norvegicus
ctcaacaggtacaaga

SEQ ID NO: 495618 - DNA, 16 bp, R. norvegicus
ctcaacaggtgacaag

SEQ ID NO: 495619 - DNA, 16 bp, R. norvegicus
ctcaacatcctcacca

SEQ ID NO: 495620 - DNA, 16 bp, R. norvegicus
ctcaaccactgagcca

SEQ ID NO: 495621 - DNA, 16 bp, R. norvegicus
ctcaaccttcatcaga

SEQ ID NO: 495622 - DNA, 16 bp, R. norvegicus
ctcaaccttcctgatg

SEQ ID NO: 495623 - DNA, 16 bp, R. norvegicus
ctcaactactgagcca

SEQ ID NO: 495624 - DNA, 16 bp, R. norvegicus
ctcaactcccaataaa

SEQ ID NO: 495625 - DNA, 16 bp, R. norvegicus
ctcaactggaagcagg

SEQ ID NO: 495626 - DNA, 16 bp, R. norvegicus
ctcaactgtgaccttg

SEQ ID NO: 495627 - DNA, 16 bp, R. norvegicus
ctcaagaaaattctgg

SEQ ID NO: 495628 - DNA, 16 bp, R. norvegicus
ctcaagaaactaaaaa

SEQ ID NO: 495629 - DNA, 16 bp, R. norvegicus
ctcaagaaactaaaca

SEQ ID NO: 495630 - DNA, 16 bp, R. norvegicus
ctcaagaacttagacc

SEQ ID NO: 495631 - DNA, 16 bp, R. norvegicus
ctcaagaagaagaaga

SEQ ID NO: 495632 - DNA, 16 bp, R. norvegicus
ctcaagaagaagaatg

SEQ ID NO: 495633 - DNA, 16 bp, R. norvegicus
ctcaagaagaagggag

SEQ ID NO: 495634 - DNA, 16 bp, R. norvegicus
ctcaagaagcttacca

SEQ ID NO: 495635 - DNA, 16 bp, R. norvegicus
ctcaagaataaagaaa

SEQ ID NO: 495636 - DNA, 16 bp, R. norvegicus
ctcaagaatttagacc

SEQ ID NO: 495637 - DNA, 16 bp, R. norvegicus
ctcaagaatttggaaa

SEQ ID NO: 495638 - DNA, 16 bp, R. norvegicus
ctcaagacacaggcac

SEQ ID NO: 495639 - DNA, 16 bp, R. norvegicus
ctcaagacacaggcca

SEQ ID NO: 495640 - DNA, 17 bp, R. norvegicus
ctcaagacacaggccca

SEQ ID NO: 495641 - DNA, 16 bp, R. norvegicus
ctcaagaccaagtgga

SEQ ID NO: 495642 - DNA, 16 bp, R. norvegicus
ctcaagactgaggaag

SEQ ID NO: 495643 - DNA, 16 bp, R. norvegicus
ctcaagagcagccaga

SEQ ID NO: 495644 - DNA, 16 bp, R. norvegicus
ctcaagaggaagaaag

SEQ ID NO: 495645 - DNA, 16 bp, R. norvegicus
ctcaagaggaccctgg

SEQ ID NO: 495646 - DNA, 16 bp, R. norvegicus
ctcaagaggctgaagc

SEQ ID NO: 495647 - DNA, 16 bp, R. norvegicus
ctcaagaggctggagg

SEQ ID NO: 495648 - DNA, 16 bp, R. norvegicus
ctcaagatctggatca

SEQ ID NO: 495649 - DNA, 16 bp, R. norvegicus
ctcaagatgagatttt

SEQ ID NO: 495650 - DNA, 16 bp, R. norvegicus
ctcaagcccaagtgga

SEQ ID NO: 495651 - DNA, 16 bp, R. norvegicus
ctcaagctctactgca

SEQ ID NO: 495652 - DNA, 16 bp, R. norvegicus
ctcaagctgtcctctg

SEQ ID NO: 495653 - DNA, 16 bp, R. norvegicus
ctcaaggaaccagctc

SEQ ID NO: 495654 - DNA, 16 bp, R. norvegicus
ctcaaggagaaggaag

SEQ ID NO: 495655 - DNA, 17 bp, R. norvegicus
ctcaaggagagaggaat

SEQ ID NO: 495656 - DNA, 16 bp, R. norvegicus
ctcaaggtcacacagc

SEQ ID NO: 495657 - DNA, 16 bp, R. norvegicus
ctcaaggtcatctttg

SEQ ID NO: 495658 - DNA, 16 bp, R. norvegicus
ctcaaggtttcttctg

SEQ ID NO: 495659 - DNA, 16 bp, R. norvegicus
ctcaagtcccagtgga

SEQ ID NO: 495660 - DNA, 16 bp, R. norvegicus
ctcaagtctggaaatt

SEQ ID NO: 495661 - DNA, 16 bp, R. norvegicus
ctcaagtgcttggatt

SEQ ID NO: 495662 - DNA, 16 bp, R. norvegicus
ctcaagttaataaaca

SEQ ID NO: 495663 - DNA, 16 bp, R. norvegicus
ctcaagttccagagga

SEQ ID NO: 495664 - DNA, 16 bp, R. norvegicus
ctcaagttctcactgg

SEQ ID NO: 495665 - DNA, 16 bp, R. norvegicus
ctcaagttgtttatca

SEQ ID NO: 495666 - DNA, 16 bp, R. norvegicus
ctcaataaaactcatt

SEQ ID NO: 495667 - DNA, 22 bp, R. norvegicus
ctcaataaacagaccttgacaa

SEQ ID NO: 495668 - DNA, 16 bp, R. norvegicus
ctcaataaatatttat

SEQ ID NO: 495669 - DNA, 16 bp, R. norvegicus
ctcaataaatatttgt

SEQ ID NO: 495670 - DNA, 16 bp, R. norvegicus
ctcaatcagcaaagtg

SEQ ID NO: 495671 - DNA, 16 bp, R. norvegicus
ctcaatgaaaagatca

SEQ ID NO: 495672 - DNA, 16 bp, R. norvegicus
ctcaatgaagaaaatg

SEQ ID NO: 495673 - DNA, 16 bp, R. norvegicus
ctcaatgacaaagaca

SEQ ID NO: 495674 - DNA, 16 bp, R. norvegicus
ctcaatgataactttg

SEQ ID NO: 495675 - DNA, 16 bp, R. norvegicus
ctcaatgccacagtgt

SEQ ID NO: 495676 - DNA, 16 bp, R. norvegicus
ctcaattaaattctgg

SEQ ID NO: 495677 - DNA, 16 bp, R. norvegicus
ctcaattccccaacaa

SEQ ID NO: 495678 - DNA, 16 bp, R. norvegicus
ctcaattctgttccat

SEQ ID NO: 495679 - DNA, 16 bp, R. norvegicus
ctcaattgagaaattg

SEQ ID NO: 495680 - DNA, 16 bp, R. norvegicus
ctcacaacaaagtcaa

SEQ ID NO: 495681 - DNA, 16 bp, R. norvegicus
ctcacaaccatctgtg

SEQ ID NO: 495682 - DNA, 16 bp, R. norvegicus
ctcacaaccccctgta

SEQ ID NO: 495683 - DNA, 16 bp, R. norvegicus
ctcacaactgcttgta

SEQ ID NO: 495684 - DNA, 16 bp, R. norvegicus
ctcacaagcatctata

SEQ ID NO: 495685 - DNA, 16 bp, R. norvegicus
ctcacaaggccatcct

SEQ ID NO: 495686 - DNA, 16 bp, R. norvegicus
ctcacacaaacacata

SEQ ID NO: 495687 - DNA, 16 bp, R. norvegicus
ctcacacaataataat

SEQ ID NO: 495688 - DNA, 16 bp, R. norvegicus
ctcacacacacactca

SEQ ID NO: 495689 - DNA, 16 bp, R. norvegicus
ctcacacacagacatg

SEQ ID NO: 495690 - DNA, 16 bp, R. norvegicus
ctcacacacagactca

SEQ ID NO: 495691 - DNA, 16 bp, R. norvegicus
ctcacacacctgtccc

SEQ ID NO: 495692 - DNA, 16 bp, R. norvegicus
ctcacacagcccctcc

SEQ ID NO: 495693 - DNA, 16 bp, R. norvegicus
ctcacacagtccctcc

SEQ ID NO: 495694 - DNA, 16 bp, R. norvegicus
ctcacacatattcaca

SEQ ID NO: 495695 - DNA, 16 bp, R. norvegicus
ctcacaccagagagaa

SEQ ID NO: 495696 - DNA, 16 bp, R. norvegicus
ctcacaccagggagaa

SEQ ID NO: 495697 - DNA, 16 bp, R. norvegicus
ctcacaccggtgagaa

SEQ ID NO: 495698 - DNA, 16 bp, R. norvegicus
ctcacacggtggctca

SEQ ID NO: 495699 - DNA, 16 bp, R. norvegicus
ctcacactcacattca

SEQ ID NO: 495700 - DNA, 16 bp, R. norvegicus
ctcacagaaagaaaaa

SEQ ID NO: 495701 - DNA, 16 bp, R. norvegicus
ctcacagaaagggacc

SEQ ID NO: 495702 - DNA, 16 bp, R. norvegicus
ctcacagaaatctacc

SEQ ID NO: 495703 - DNA, 16 bp, R. norvegicus
ctcacagaagaagggg

SEQ ID NO: 495704 - DNA, 16 bp, R. norvegicus
ctcacagaagagaaag

SEQ ID NO: 495705 - DNA, 16 bp, R. norvegicus
ctcacagaagcagagg

SEQ ID NO: 495706 - DNA, 16 bp, R. norvegicus
ctcacagaagcaggtg

SEQ ID NO: 495707 - DNA, 16 bp, R. norvegicus
ctcacagaaggagagc

SEQ ID NO: 495708 - DNA, 16 bp, R. norvegicus
ctcacagacacacaaa

SEQ ID NO: 495709 - DNA, 16 bp, R. norvegicus
ctcacagacacagatg

SEQ ID NO: 495710 - DNA, 16 bp, R. norvegicus
ctcacagacatgtaca

SEQ ID NO: 495711 - DNA, 16 bp, R. norvegicus
ctcacagagacagaag

SEQ ID NO: 495712 - DNA, 16 bp, R. norvegicus
ctcacagagactgaag

SEQ ID NO: 495713 - DNA, 16 bp, R. norvegicus
ctcacagagatcacct

SEQ ID NO: 495714 - DNA, 16 bp, R. norvegicus
ctcacagagatccaat

SEQ ID NO: 495715 - DNA, 16 bp, R. norvegicus
ctcacagagatccatg

SEQ ID NO: 495716 - DNA, 16 bp, R. norvegicus
ctcacagagatcctgc

SEQ ID NO: 495717 - DNA, 16 bp, R. norvegicus
ctcacagagcagtgct

SEQ ID NO: 495718 - DNA, 16 bp, R. norvegicus
ctcacagagctccatc

SEQ ID NO: 495719 - DNA, 16 bp, R. norvegicus
ctcacagaggacctgg

SEQ ID NO: 495720 - DNA, 16 bp, R. norvegicus
ctcacagaggctgaag

SEQ ID NO: 495721 - DNA, 16 bp, R. norvegicus
ctcacagagttcttcc

SEQ ID NO: 495722 - DNA, 16 bp, R. norvegicus
ctcacagatgtgccca

SEQ ID NO: 495723 - DNA, 16 bp, R. norvegicus
ctcacagcagctgtgg

SEQ ID NO: 495724 - DNA, 16 bp, R. norvegicus
ctcacagcagctgtgt

SEQ ID NO: 495725 - DNA, 16 bp, R. norvegicus
ctcacagccatctgtg

SEQ ID NO: 495726 - DNA, 16 bp, R. norvegicus
ctcacagctctgagtg

SEQ ID NO: 495727 - DNA, 16 bp, R. norvegicus
ctcacagctctgcctg

SEQ ID NO: 495728 - DNA, 16 bp, R. norvegicus
ctcacagctgctgctg

SEQ ID NO: 495729 - DNA, 16 bp, R. norvegicus
ctcacaggagcagaaa

SEQ ID NO: 495730 - DNA, 16 bp, R. norvegicus
ctcacagtagctgtgg

SEQ ID NO: 495731 - DNA, 16 bp, R. norvegicus
ctcacagtccttggag

SEQ ID NO: 495732 - DNA, 16 bp, R. norvegicus
ctcacagtgacacacc

SEQ ID NO: 495733 - DNA, 16 bp, R. norvegicus
ctcacagtgggctgga

SEQ ID NO: 495734 - DNA, 16 bp, R. norvegicus
ctcacagtgttcccgg

SEQ ID NO: 495735 - DNA, 16 bp, R. norvegicus
ctcacagttcctcatc

SEQ ID NO: 495736 - DNA, 16 bp, R. norvegicus
ctcacagttctgaagg

SEQ ID NO: 495737 - DNA, 16 bp, R. norvegicus
ctcacatacatactca

SEQ ID NO: 495738 - DNA, 16 bp, R. norvegicus
ctcacatatacacaga

SEQ ID NO: 495739 - DNA, 16 bp, R. norvegicus
ctcacatcatggctgc

SEQ ID NO: 495740 - DNA, 16 bp, R. norvegicus
ctcacatcttcctggg

SEQ ID NO: 495741 - DNA, 16 bp, R. norvegicus
ctcaccacatcatggt

SEQ ID NO: 495742 - DNA, 16 bp, R. norvegicus
ctcaccaccatctgct

SEQ ID NO: 495743 - DNA, 16 bp, R. norvegicus
ctcaccatcatctgct

SEQ ID NO: 495744 - DNA, 16 bp, R. norvegicus
ctcaccatcctggcat

SEQ ID NO: 495745 - DNA, 16 bp, R. norvegicus
ctcacccccagtgaca

SEQ ID NO: 495746 - DNA, 16 bp, R. norvegicus
ctcaccctgggctcca

SEQ ID NO: 495747 - DNA, 16 bp, R. norvegicus
ctcacctgtgagcctg

SEQ ID NO: 495748 - DNA, 16 bp, R. norvegicus
ctcaccttccaccttg

SEQ ID NO: 495749 - DNA, 16 bp, R. norvegicus
ctcacctttaacccca

SEQ ID NO: 495750 - DNA, 16 bp, R. norvegicus
ctcactaaacctgaag

SEQ ID NO: 495751 - DNA, 16 bp, R. norvegicus
ctcactatggagacca

SEQ ID NO: 495752 - DNA, 16 bp, R. norvegicus
ctcactatgtaatcct

SEQ ID NO: 495753 - DNA, 16 bp, R. norvegicus
ctcactcaacaggaaa

SEQ ID NO: 495754 - DNA, 16 bp, R. norvegicus
ctcactcacccactca

SEQ ID NO: 495755 - DNA, 16 bp, R. norvegicus
ctcactccaacctcaa

SEQ ID NO: 495756 - DNA, 16 bp, R. norvegicus
ctcactccctcctgcc

SEQ ID NO: 495757 - DNA, 16 bp, R. norvegicus
ctcactcgctcgctca

SEQ ID NO: 495758 - DNA, 16 bp, R. norvegicus
ctcactctatagacca

SEQ ID NO: 495759 - DNA, 16 bp, R. norvegicus
ctcactctctcactct

SEQ ID NO: 495760 - DNA, 16 bp, R. norvegicus
ctcactctgcagacca

SEQ ID NO: 495761 - DNA, 16 bp, R. norvegicus
ctcactctgcagtcca

SEQ ID NO: 495762 - DNA, 16 bp, R. norvegicus
ctcactctgtggccca

SEQ ID NO: 495763 - DNA, 16 bp, R. norvegicus
ctcactgaacctggaa

SEQ ID NO: 495764 - DNA, 16 bp, R. norvegicus
ctcactgaactggaag

SEQ ID NO: 495765 - DNA, 16 bp, R. norvegicus
ctcactgaatccagag

SEQ ID NO: 495766 - DNA, 16 bp, R. norvegicus
ctcactgaggcccaac

SEQ ID NO: 495767 - DNA, 16 bp, R. norvegicus
ctcactgataaatgga

SEQ ID NO: 495768 - DNA, 16 bp, R. norvegicus
ctcactgcaaacctga

SEQ ID NO: 495769 - DNA, 16 bp, R. norvegicus
ctcactgccatgtttg

SEQ ID NO: 495770 - DNA, 16 bp, R. norvegicus
ctcactgcctggacag

SEQ ID NO: 495771 - DNA, 16 bp, R. norvegicus
ctcactggaaaggacc

SEQ ID NO: 495772 - DNA, 16 bp, R. norvegicus
ctcactggacctggag

SEQ ID NO: 495773 - DNA, 16 bp, R. norvegicus
ctcactggaggaaata

SEQ ID NO: 495774 - DNA, 16 bp, R. norvegicus
ctcactggatggagaa

SEQ ID NO: 495775 - DNA, 16 bp, R. norvegicus
ctcactggcaagtcca

SEQ ID NO: 495776 - DNA, 16 bp, R. norvegicus
ctcactggccagccag

SEQ ID NO: 495777 - DNA, 16 bp, R. norvegicus
ctcactggctgtagca

SEQ ID NO: 495778 - DNA, 16 bp, R. norvegicus
ctcactgggacctgga

SEQ ID NO: 495779 - DNA, 16 bp, R. norvegicus
ctcactgggacctggg

SEQ ID NO: 495780 - DNA, 16 bp, R. norvegicus
ctcactgtccagccag

SEQ ID NO: 495781 - DNA, 16 bp, R. norvegicus
ctcactgtctctgcct

SEQ ID NO: 495782 - DNA, 16 bp, R. norvegicus
ctcactgtgatgtcac

SEQ ID NO: 495783 - DNA, 16 bp, R. norvegicus
ctcactgtgcagacca

SEQ ID NO: 495784 - DNA, 16 bp, R. norvegicus
ctcactgtgcagccct

SEQ ID NO: 495785 - DNA, 16 bp, R. norvegicus
ctcactgtgtagtcct

SEQ ID NO: 495786 - DNA, 16 bp, R. norvegicus
ctcacttcctaggtct

SEQ ID NO: 495787 - DNA, 16 bp, R. norvegicus
ctcacttctggggagt

SEQ ID NO: 495788 - DNA, 16 bp, R. norvegicus
ctcactttgtgttttc

SEQ ID NO: 495789 - DNA, 16 bp, R. norvegicus
ctcagaaaagactgaa

SEQ ID NO: 495790 - DNA, 16 bp, R. norvegicus
ctcagaaaatactttc

SEQ ID NO: 495791 - DNA, 16 bp, R. norvegicus
ctcagaaaatggaaag

SEQ ID NO: 495792 - DNA, 16 bp, R. norvegicus
ctcagaaaattggaaa

SEQ ID NO: 495793 - DNA, 16 bp, R. norvegicus
ctcagaaagaacaaga

SEQ ID NO: 495794 - DNA, 16 bp, R. norvegicus
ctcagaaagacaaaca

SEQ ID NO: 495795 - DNA, 16 bp, R. norvegicus
ctcagaaagcacttcc

SEQ ID NO: 495796 - DNA, 16 bp, R. norvegicus
ctcagaaatggacaga

SEQ ID NO: 495797 - DNA, 16 bp, R. norvegicus
ctcagaacctttggaa

SEQ ID NO: 495798 - DNA, 16 bp, R. norvegicus
ctcagaactcaggtaa

SEQ ID NO: 495799 - DNA, 16 bp, R. norvegicus
ctcagaagaaaaacaa

SEQ ID NO: 495800 - DNA, 16 bp, R. norvegicus
ctcagaagaagagaaa

SEQ ID NO: 495801 - DNA, 16 bp, R. norvegicus
ctcagaagacagaaag

SEQ ID NO: 495802 - DNA, 16 bp, R. norvegicus
ctcagaagacagttgt

SEQ ID NO: 495803 - DNA, 16 bp, R. norvegicus
ctcagaagagaaaggg

SEQ ID NO: 495804 - DNA, 16 bp, R. norvegicus
ctcagaagagaagagg

SEQ ID NO: 495805 - DNA, 16 bp, R. norvegicus
ctcagaagaggaaata

SEQ ID NO: 495806 - DNA, 16 bp, R. norvegicus
ctcagaagatggaaaa

SEQ ID NO: 495807 - DNA, 16 bp, R. norvegicus
ctcagaagatgggaag

SEQ ID NO: 495808 - DNA, 16 bp, R. norvegicus
ctcagaaggcagagag

SEQ ID NO: 495809 - DNA, 16 bp, R. norvegicus
ctcagaaggggaaaca

SEQ ID NO: 495810 - DNA, 16 bp, R. norvegicus
ctcagaagtgcaaaca

SEQ ID NO: 495811 - DNA, 16 bp, R. norvegicus
ctcagacacagacaca

SEQ ID NO: 495812 - DNA, 16 bp, R. norvegicus
ctcagacaccagaaga

SEQ ID NO: 495813 - DNA, 16 bp, R. norvegicus
ctcagacatcctcaga

SEQ ID NO: 495814 - DNA, 16 bp, R. norvegicus
ctcagaccaagccaat

SEQ ID NO: 495815 - DNA, 16 bp, R. norvegicus
ctcagaccagctcctg

SEQ ID NO: 495816 - DNA, 16 bp, R. norvegicus
ctcagaccctgagcca

SEQ ID NO: 495817 - DNA, 16 bp, R. norvegicus
ctcagactctgagcca

SEQ ID NO: 495818 - DNA, 16 bp, R. norvegicus
ctcagactgaaaggct

SEQ ID NO: 495819 - DNA, 16 bp, R. norvegicus
ctcagactggcctcaa

SEQ ID NO: 495820 - DNA, 16 bp, R. norvegicus
ctcagagaacacaaat

SEQ ID NO: 495821 - DNA, 16 bp, R. norvegicus
ctcagagaagaagagg

SEQ ID NO: 495822 - DNA, 16 bp, R. norvegicus
ctcagagaagaaggag

SEQ ID NO: 495823 - DNA, 16 bp, R. norvegicus
ctcagagaagaggagg

SEQ ID NO: 495824 - DNA, 16 bp, R. norvegicus
ctcagagaagagtgag

SEQ ID NO: 495825 - DNA, 16 bp, R. norvegicus
ctcagagactgaagca

SEQ ID NO: 495826 - DNA, 16 bp, R. norvegicus
ctcagagatccatcca

SEQ ID NO: 495827 - DNA, 16 bp, R. norvegicus
ctcagagatctccctg

SEQ ID NO: 495828 - DNA, 16 bp, R. norvegicus
ctcagagatctgctta

SEQ ID NO: 495829 - DNA, 16 bp, R. norvegicus
ctcagagatggaaaga

SEQ ID NO: 495830 - DNA, 16 bp, R. norvegicus
ctcagagcaagctggc

SEQ ID NO: 495831 - DNA, 16 bp, R. norvegicus
ctcagagcagaagtgt

SEQ ID NO: 495832 - DNA, 16 bp, R. norvegicus
ctcagagcctgcccca

SEQ ID NO: 495833 - DNA, 16 bp, R. norvegicus
ctcagagctctcagag

SEQ ID NO: 495834 - DNA, 16 bp, R. norvegicus
ctcagagctggagagg

SEQ ID NO: 495835 - DNA, 16 bp, R. norvegicus
ctcagaggaaaagggg

SEQ ID NO: 495836 - DNA, 16 bp, R. norvegicus
ctcagaggacagccac

SEQ ID NO: 495837 - DNA, 16 bp, R. norvegicus
ctcagaggacagcctt

SEQ ID NO: 495838 - DNA, 16 bp, R. norvegicus
ctcagaggacagttgt

SEQ ID NO: 495839 - DNA, 16 bp, R. norvegicus
ctcagaggagaagggg

SEQ ID NO: 495840 - DNA, 16 bp, R. norvegicus
ctcagaggagaatggg

SEQ ID NO: 495841 - DNA, 16 bp, R. norvegicus
ctcagaggaggagagg

SEQ ID NO: 495842 - DNA, 16 bp, R. norvegicus
ctcagaggctggagag

SEQ ID NO: 495843 - DNA, 16 bp, R. norvegicus
ctcagagggagaggat

SEQ ID NO: 495844 - DNA, 16 bp, R. norvegicus
ctcagaggttagagca

SEQ ID NO: 495845 - DNA, 16 bp, R. norvegicus
ctcagagtctcctgtg

SEQ ID NO: 495846 - DNA, 16 bp, R. norvegicus
ctcagagttctccaag

SEQ ID NO: 495847 - DNA, 16 bp, R. norvegicus
ctcagatattaaaaat

SEQ ID NO: 495848 - DNA, 16 bp, R. norvegicus
ctcagatccagggctt

SEQ ID NO: 495849 - DNA, 16 bp, R. norvegicus
ctcagatgaccttgaa

SEQ ID NO: 495850 - DNA, 16 bp, R. norvegicus
ctcagatgagctcctg

SEQ ID NO: 495851 - DNA, 16 bp, R. norvegicus
ctcagatggatgcaga

SEQ ID NO: 495852 - DNA, 16 bp, R. norvegicus
ctcagatgtgtaggtg

SEQ ID NO: 495853 - DNA, 16 bp, R. norvegicus
ctcagattcccaggcc

SEQ ID NO: 495854 - DNA, 17 bp, R. norvegicus
ctcagcaacagtgcctc

SEQ ID NO: 495855 - DNA, 16 bp, R. norvegicus
ctcagcaagagcagca

SEQ ID NO: 495856 - DNA, 16 bp, R. norvegicus
ctcagcaccagcatca

SEQ ID NO: 495857 - DNA, 16 bp, R. norvegicus
ctcagcacccacacaa

SEQ ID NO: 495858 - DNA, 19 bp, R. norvegicus
ctcagcaccctcgttgaca

SEQ ID NO: 495859 - DNA, 16 bp, R. norvegicus
ctcagcacctacatgg

SEQ ID NO: 495860 - DNA, 16 bp, R. norvegicus
ctcagcacctctggaa

SEQ ID NO: 495861 - DNA, 16 bp, R. norvegicus
ctcagcactcaggagg

SEQ ID NO: 495862 - DNA, 16 bp, R. norvegicus
ctcagcactcgggaga

SEQ ID NO: 495863 - DNA, 16 bp, R. norvegicus
ctcagcactgtggagg

SEQ ID NO: 495864 - DNA, 16 bp, R. norvegicus
ctcagcacttggaagg

SEQ ID NO: 495865 - DNA, 16 bp, R. norvegicus
ctcagcacttgggaga

SEQ ID NO: 495866 - DNA, 16 bp, R. norvegicus
ctcagcagaaggagaa

SEQ ID NO: 495867 - DNA, 16 bp, R. norvegicus
ctcagcagcatcctca

SEQ ID NO: 495868 - DNA, 16 bp, R. norvegicus
ctcagcagtgaagagc

SEQ ID NO: 495869 - DNA, 16 bp, R. norvegicus
ctcagcagttaagagt

SEQ ID NO: 495870 - DNA, 16 bp, R. norvegicus
ctcagccacctcagtc

SEQ ID NO: 495871 - DNA, 16 bp, R. norvegicus
ctcagccacctctcca

SEQ ID NO: 495872 - DNA, 16 bp, R. norvegicus
ctcagccagtttatca

SEQ ID NO: 495873 - DNA, 16 bp, R. norvegicus
ctcagccattctgcat

SEQ ID NO: 495874 - DNA, 16 bp, R. norvegicus
ctcagcccagctcagc

SEQ ID NO: 495875 - DNA, 16 bp, R. norvegicus
ctcagcccagggcagt

SEQ ID NO: 495876 - DNA, 16 bp, R. norvegicus
ctcagcccctcctgca

SEQ ID NO: 495877 - DNA, 16 bp, R. norvegicus
ctcagcccctctcctc

SEQ ID NO: 495878 - DNA, 16 bp, R. norvegicus
ctcagcccctgggctg

SEQ ID NO: 495879 - DNA, 16 bp, R. norvegicus
ctcagccccttctcca

SEQ ID NO: 495880 - DNA, 16 bp, R. norvegicus
ctcagccctcagccct

SEQ ID NO: 495881 - DNA, 16 bp, R. norvegicus
ctcagcctcagtttcc

SEQ ID NO: 495882 - DNA, 16 bp, R. norvegicus
ctcagcctcccaagga

SEQ ID NO: 495883 - DNA, 16 bp, R. norvegicus
ctcagcctctcaagtg

SEQ ID NO: 495884 - DNA, 16 bp, R. norvegicus
ctcagcctgcctctgc

SEQ ID NO: 495885 - DNA, 16 bp, R. norvegicus
ctcagcctggtctccc

SEQ ID NO: 495886 - DNA, 16 bp, R. norvegicus
ctcagccttcctaaca

SEQ ID NO: 495887 - DNA, 16 bp, R. norvegicus
ctcagccttctgagta

SEQ ID NO: 495888 - DNA, 16 bp, R. norvegicus
ctcagcctttgagaaa

SEQ ID NO: 495889 - DNA, 17 bp, R. norvegicus
ctcagccttttggctaa

SEQ ID NO: 495890 - DNA, 16 bp, R. norvegicus
ctcagctacaaagtga

SEQ ID NO: 495891 - DNA, 67 bp, R. norvegicus
ctcagctaccacaatgggcacagcctgaaggacaaggccaagaacaggctctcactcagggatgcaa

SEQ ID NO: 495892 - DNA, 16 bp, R. norvegicus
ctcagctactgttcca

SEQ ID NO: 495893 - DNA, 16 bp, R. norvegicus
ctcagctcacacatgt

SEQ ID NO: 495894 - DNA, 16 bp, R. norvegicus
ctcagctcactttctt

SEQ ID NO: 495895 - DNA, 16 bp, R. norvegicus
ctcagctccatctcca

SEQ ID NO: 495896 - DNA, 16 bp, R. norvegicus
ctcagctcctccagca

SEQ ID NO: 495897 - DNA, 16 bp, R. norvegicus
ctcagctcctcctgaa

SEQ ID NO: 495898 - DNA, 16 bp, R. norvegicus
ctcagctcctcctgtg

SEQ ID NO: 495899 - DNA, 16 bp, R. norvegicus
ctcagctctgagtgcc

SEQ ID NO: 495900 - DNA, 16 bp, R. norvegicus
ctcagctcttaaaaac

SEQ ID NO: 495901 - DNA, 16 bp, R. norvegicus
ctcagctcttcctgca

SEQ ID NO: 495902 - DNA, 16 bp, R. norvegicus
ctcagctgcagagaag

SEQ ID NO: 495903 - DNA, 16 bp, R. norvegicus
ctcagctgccacccag

SEQ ID NO: 495904 - DNA, 16 bp, R. norvegicus
ctcagctgcctctcca

SEQ ID NO: 495905 - DNA, 16 bp, R. norvegicus
ctcagctgcctttctt

SEQ ID NO: 495906 - DNA, 17 bp, R. norvegicus
ctcagctgctcttcatg

SEQ ID NO: 495907 - DNA, 16 bp, R. norvegicus
ctcagctgcttttcat

SEQ ID NO: 495908 - DNA, 16 bp, R. norvegicus
ctcagctgggcagtgg

SEQ ID NO: 495909 - DNA, 16 bp, R. norvegicus
ctcagctggtagagct

SEQ ID NO: 495910 - DNA, 16 bp, R. norvegicus
ctcagctggtgtatgt

SEQ ID NO: 495911 - DNA, 16 bp, R. norvegicus
ctcagctgtcctggag

SEQ ID NO: 495912 - DNA, 16 bp, R. norvegicus
ctcagctgttaaaaat

SEQ ID NO: 495913 - DNA, 16 bp, R. norvegicus
ctcagcttctccagcc

SEQ ID NO: 495914 - DNA, 16 bp, R. norvegicus
ctcagctttccaagtg

SEQ ID NO: 495915 - DNA, 16 bp, R. norvegicus
ctcagctttttctctt

SEQ ID NO: 495916 - DNA, 16 bp, R. norvegicus
ctcaggaaacagagac

SEQ ID NO: 495917 - DNA, 16 bp, R. norvegicus
ctcaggaaccaccaca

SEQ ID NO: 495918 - DNA, 16 bp, R. norvegicus
ctcaggaagaacagcc

SEQ ID NO: 495919 - DNA, 16 bp, R. norvegicus
ctcaggaagaggaagt

SEQ ID NO: 495920 - DNA, 16 bp, R. norvegicus
ctcaggaagcagaagc

SEQ ID NO: 495921 - DNA, 16 bp, R. norvegicus
ctcaggaagcagaggc

SEQ ID NO: 495922 - DNA, 16 bp, R. norvegicus
ctcaggaagctgggaa

SEQ ID NO: 495923 - DNA, 16 bp, R. norvegicus
ctcaggacacaaagag

SEQ ID NO: 495924 - DNA, 16 bp, R. norvegicus
ctcaggacacagaaag

SEQ ID NO: 495925 - DNA, 16 bp, R. norvegicus
ctcaggacacaggccc

SEQ ID NO: 495926 - DNA, 16 bp, R. norvegicus
ctcaggacctggaaga

SEQ ID NO: 495927 - DNA, 16 bp, R. norvegicus
ctcaggacgcagaggc

SEQ ID NO: 495928 - DNA, 16 bp, R. norvegicus
ctcaggactgtctgca

SEQ ID NO: 495929 - DNA, 16 bp, R. norvegicus
ctcaggagaagaagat

SEQ ID NO: 495930 - DNA, 16 bp, R. norvegicus
ctcaggagacaactgt

SEQ ID NO: 495931 - DNA, 16 bp, R. norvegicus
ctcaggagacagatgc

SEQ ID NO: 495932 - DNA, 16 bp, R. norvegicus
ctcaggagacagcaat

SEQ ID NO: 495933 - DNA, 16 bp, R. norvegicus
ctcaggaggcaaagac

SEQ ID NO: 495934 - DNA, 16 bp, R. norvegicus
ctcaggaggcagaaga

SEQ ID NO: 495935 - DNA, 16 bp, R. norvegicus
ctcaggaggcaggagc

SEQ ID NO: 495936 - DNA, 16 bp, R. norvegicus
ctcaggaggtggaggc

SEQ ID NO: 495937 - DNA, 16 bp, R. norvegicus
ctcaggagtctgaggc

SEQ ID NO: 495938 - DNA, 16 bp, R. norvegicus
ctcaggagttaagagc

SEQ ID NO: 495939 - DNA, 16 bp, R. norvegicus
ctcaggatagtatttt

SEQ ID NO: 495940 - DNA, 16 bp, R. norvegicus
ctcaggatcctcctgc

SEQ ID NO: 495941 - DNA, 16 bp, R. norvegicus
ctcaggatgacatttc

SEQ ID NO: 495942 - DNA, 16 bp, R. norvegicus
ctcaggcaacaacaga

SEQ ID NO: 495943 - DNA, 16 bp, R. norvegicus
ctcaggcacaccagaa

SEQ ID NO: 495944 - DNA, 16 bp, R. norvegicus
ctcaggcaccatccac

SEQ ID NO: 495945 - DNA, 16 bp, R. norvegicus
ctcaggcagaaaccag

SEQ ID NO: 495946 - DNA, 16 bp, R. norvegicus
ctcaggcagttcattg

SEQ ID NO: 495947 - DNA, 16 bp, R. norvegicus
ctcaggccaaggacac

SEQ ID NO: 495948 - DNA, 16 bp, R. norvegicus
ctcaggccaggcccag

SEQ ID NO: 495949 - DNA, 16 bp, R. norvegicus
ctcaggcctccacaca

SEQ ID NO: 495950 - DNA, 16 bp, R. norvegicus
ctcaggcctctggaag

SEQ ID NO: 495951 - DNA, 16 bp, R. norvegicus
ctcaggctcctctcca

SEQ ID NO: 495952 - DNA, 16 bp, R. norvegicus
ctcaggctcttcttca

SEQ ID NO: 495953 - DNA, 16 bp, R. norvegicus
ctcaggctggtctgga

SEQ ID NO: 495954 - DNA, 16 bp, R. norvegicus
ctcaggctgtcctgga

SEQ ID NO: 495955 - DNA, 16 bp, R. norvegicus
ctcagggaaaggggag

SEQ ID NO: 495956 - DNA, 16 bp, R. norvegicus
ctcagggaagcaaaga

SEQ ID NO: 495957 - DNA, 16 bp, R. norvegicus
ctcagggagaaccagt

SEQ ID NO: 495958 - DNA, 16 bp, R. norvegicus
ctcagggagagaagat

SEQ ID NO: 495959 - DNA, 16 bp, R. norvegicus
ctcagggagagaggaa

SEQ ID NO: 495960 - DNA, 16 bp, R. norvegicus
ctcagggagctgaggc

SEQ ID NO: 495961 - DNA, 16 bp, R. norvegicus
ctcagggatcctgtcc

SEQ ID NO: 495962 - DNA, 16 bp, R. norvegicus
ctcagggatgcaagga

SEQ ID NO: 495963 - DNA, 16 bp, R. norvegicus
ctcagggatgcagaga

SEQ ID NO: 495964 - DNA, 16 bp, R. norvegicus
ctcagggccagatggt

SEQ ID NO: 495965 - DNA, 16 bp, R. norvegicus
ctcagggccatctctc

SEQ ID NO: 495966 - DNA, 16 bp, R. norvegicus
ctcagggctcttctgc

SEQ ID NO: 495967 - DNA, 16 bp, R. norvegicus
ctcaggggagaccaca

SEQ ID NO: 495968 - DNA, 16 bp, R. norvegicus
ctcaggggcttctctg

SEQ ID NO: 495969 - DNA, 16 bp, R. norvegicus
ctcaggtaattttgat

SEQ ID NO: 495970 - DNA, 16 bp, R. norvegicus
ctcaggtcaccaagct

SEQ ID NO: 495971 - DNA, 16 bp, R. norvegicus
ctcaggtccctgtgct

SEQ ID NO: 495972 - DNA, 16 bp, R. norvegicus
ctcaggtcctcatgtg

SEQ ID NO: 495973 - DNA, 16 bp, R. norvegicus
ctcaggtcctctgaag

SEQ ID NO: 495974 - DNA, 16 bp, R. norvegicus
ctcaggtcctctggaa

SEQ ID NO: 495975 - DNA, 16 bp, R. norvegicus
ctcaggtctccaggct

SEQ ID NO: 495976 - DNA, 16 bp, R. norvegicus
ctcaggtcttcttgct

SEQ ID NO: 495977 - DNA, 16 bp, R. norvegicus
ctcaggttaataaaga

SEQ ID NO: 495978 - DNA, 16 bp, R. norvegicus
ctcaggttctctgtaa

SEQ ID NO: 495979 - DNA, 16 bp, R. norvegicus
ctcagtacaccagtac

SEQ ID NO: 495980 - DNA, 16 bp, R. norvegicus
ctcagtattttgtaaa

SEQ ID NO: 495981 - DNA, 16 bp, R. norvegicus
ctcagtcaacaaagtg

SEQ ID NO: 495982 - DNA, 16 bp, R. norvegicus
ctcagtcatcatcaga

SEQ ID NO: 495983 - DNA, 16 bp, R. norvegicus
ctcagtccagtggttg

SEQ ID NO: 495984 - DNA, 16 bp, R. norvegicus
ctcagtccattgtggg

SEQ ID NO: 495985 - DNA, 16 bp, R. norvegicus
ctcagtcccacaaggc

SEQ ID NO: 495986 - DNA, 16 bp, R. norvegicus
ctcagtctccctagtg

SEQ ID NO: 495987 - DNA, 16 bp, R. norvegicus
ctcagtctcctgaggg

SEQ ID NO: 495988 - DNA, 16 bp, R. norvegicus
ctcagtctctccagtg

SEQ ID NO: 495989 - DNA, 16 bp, R. norvegicus
ctcagtctgtttctgg

SEQ ID NO: 495990 - DNA, 16 bp, R. norvegicus
ctcagtggccagccag

SEQ ID NO: 495991 - DNA, 16 bp, R. norvegicus
ctcagtggctaagagc

SEQ ID NO: 495992 - DNA, 16 bp, R. norvegicus
ctcagtgggagagaaa

SEQ ID NO: 495993 - DNA, 16 bp, R. norvegicus
ctcagtgggtaaaagc

SEQ ID NO: 495994 - DNA, 29 bp, R. norvegicus
ctcagtggtagagcgcttgcctaggaagc

SEQ ID NO: 495995 - DNA, 21 bp, R. norvegicus
ctcagtggtagagcgcttgct

SEQ ID NO: 495996 - DNA, 16 bp, R. norvegicus
ctcagtggtgaagagt

SEQ ID NO: 495997 - DNA, 16 bp, R. norvegicus
ctcagtggtggagtgt

SEQ ID NO: 495998 - DNA, 16 bp, R. norvegicus
ctcagtggttaaggct

SEQ ID NO: 495999 - DNA, 16 bp, R. norvegicus
ctcagtgtagccttgg

SEQ ID NO: 496000 - DNA, 16 bp, R. norvegicus
ctcagtgtctctctgt

SEQ ID NO: 496001 - DNA, 16 bp, R. norvegicus
ctcagtgtggttttga

SEQ ID NO: 496002 - DNA, 16 bp, R. norvegicus
ctcagttacttctcca

SEQ ID NO: 496003 - DNA, 16 bp, R. norvegicus
ctcagttcaatctgct

SEQ ID NO: 496004 - DNA, 16 bp, R. norvegicus
ctcagttccaggggat

SEQ ID NO: 496005 - DNA, 17 bp, R. norvegicus
ctcagttccccaagcat

SEQ ID NO: 496006 - DNA, 16 bp, R. norvegicus
ctcagttccctcatct

SEQ ID NO: 496007 - DNA, 16 bp, R. norvegicus
ctcagttccctctctc

SEQ ID NO: 496008 - DNA, 16 bp, R. norvegicus
ctcagttcctccagca

SEQ ID NO: 496009 - DNA, 16 bp, R. norvegicus
ctcagttctgcctgca

SEQ ID NO: 496010 - DNA, 16 bp, R. norvegicus
ctcagttgaggaaatg

SEQ ID NO: 496011 - DNA, 16 bp, R. norvegicus
ctcagttgctgaggag

SEQ ID NO: 496012 - DNA, 16 bp, R. norvegicus
ctcagtttgctccttt

SEQ ID NO: 496013 - DNA, 16 bp, R. norvegicus
ctcagtttggtgattt

SEQ ID NO: 496014 - DNA, 16 bp, R. norvegicus
ctcagtttgtttgttt

SEQ ID NO: 496015 - DNA, 16 bp, R. norvegicus
ctcataaaactccaaa

SEQ ID NO: 496016 - DNA, 16 bp, R. norvegicus
ctcataccagtgagaa

SEQ ID NO: 496017 - DNA, 16 bp, R. norvegicus
ctcatagacagcactc

SEQ ID NO: 496018 - DNA, 16 bp, R. norvegicus
ctcatatataataaat

SEQ ID NO: 496019 - DNA, 16 bp, R. norvegicus
ctcatatatgtatgta

SEQ ID NO: 496020 - DNA, 16 bp, R. norvegicus
ctcatcaaagggaaaa

SEQ ID NO: 496021 - DNA, 16 bp, R. norvegicus
ctcatcaacagacaga

SEQ ID NO: 496022 - DNA, 18 bp, R. norvegicus
ctcatccaggaagagggg

SEQ ID NO: 496023 - DNA, 16 bp, R. norvegicus
ctcatccctgcccaca

SEQ ID NO: 496024 - DNA, 16 bp, R. norvegicus
ctcatcctagctgcca

SEQ ID NO: 496025 - DNA, 16 bp, R. norvegicus
ctcatccttctgcctc

SEQ ID NO: 496026 - DNA, 16 bp, R. norvegicus
ctcatctatacctatt

SEQ ID NO: 496027 - DNA, 16 bp, R. norvegicus
ctcatctcagctgctg

SEQ ID NO: 496028 - DNA, 16 bp, R. norvegicus
ctcatctcagtcagca

SEQ ID NO: 496029 - DNA, 16 bp, R. norvegicus
ctcatctccaaattct

SEQ ID NO: 496030 - DNA, 16 bp, R. norvegicus
ctcatctctgtgtgtg

SEQ ID NO: 496031 - DNA, 30 bp, R. norvegicus
ctcatcttttgtcatcacagaaattctggc

SEQ ID NO: 496032 - DNA, 16 bp, R. norvegicus
ctcatgaagaacattt

SEQ ID NO: 496033 - DNA, 16 bp, R. norvegicus
ctcatgaagctcaaga

SEQ ID NO: 496034 - DNA, 16 bp, R. norvegicus
ctcatgagcagaagat

SEQ ID NO: 496035 - DNA, 16 bp, R. norvegicus
ctcatgcacatataca

SEQ ID NO: 496036 - DNA, 16 bp, R. norvegicus
ctcatgcctgtaatcc

SEQ ID NO: 496037 - DNA, 16 bp, R. norvegicus
ctcatggaggcccaca

SEQ ID NO: 496038 - DNA, 16 bp, R. norvegicus
ctcatggagtgagcct

SEQ ID NO: 496039 - DNA, 24 bp, R. norvegicus
ctcatggatctccttgcttagcat

SEQ ID NO: 496040 - DNA, 16 bp, R. norvegicus
ctcatggattcacagg

SEQ ID NO: 496041 - DNA, 16 bp, R. norvegicus
ctcatggcatttctgt

SEQ ID NO: 496042 - DNA, 16 bp, R. norvegicus
ctcatggctggcttct

SEQ ID NO: 496043 - DNA, 16 bp, R. norvegicus
ctcatgggggttgggg

SEQ ID NO: 496044 - DNA, 16 bp, R. norvegicus
ctcatgggttggcagg

SEQ ID NO: 496045 - DNA, 16 bp, R. norvegicus
ctcatggttttggagg

SEQ ID NO: 496046 - DNA, 16 bp, R. norvegicus
ctcattctgttttcac

SEQ ID NO: 496047 - DNA, 16 bp, R. norvegicus
ctcattgaacatgaag

SEQ ID NO: 496048 - DNA, 16 bp, R. norvegicus
ctcattgaagaattgg

SEQ ID NO: 496049 - DNA, 16 bp, R. norvegicus
ctcattggcacaggca

SEQ ID NO: 496050 - DNA, 16 bp, R. norvegicus
ctcattgtcaggtgct

SEQ ID NO: 496051 - DNA, 16 bp, R. norvegicus
ctcattgtgggtggtg

SEQ ID NO: 496052 - DNA, 16 bp, R. norvegicus
ctcattgttgtgacaa

SEQ ID NO: 496053 - DNA, 16 bp, R. norvegicus
ctcatttaaagaagaa

SEQ ID NO: 496054 - DNA, 16 bp, R. norvegicus
ctcatttattttatgt

SEQ ID NO: 496055 - DNA, 26 bp, R. norvegicus
ctcatttcctggtatgacaatgaata

SEQ ID NO: 496056 - DNA, 16 bp, R. norvegicus
ctcatttgtagcatgc

SEQ ID NO: 496057 - DNA, 16 bp, R. norvegicus
ctccaaaaagaagctg

SEQ ID NO: 496058 - DNA, 16 bp, R. norvegicus
ctccaaaacaggtgta

SEQ ID NO: 496059 - DNA, 16 bp, R. norvegicus
ctccaaaatgctgctg

SEQ ID NO: 496060 - DNA, 16 bp, R. norvegicus
ctccaaactacctcca

SEQ ID NO: 496061 - DNA, 16 bp, R. norvegicus
ctccaaagccagagcc

SEQ ID NO: 496062 - DNA, 16 bp, R. norvegicus
ctccaaatacaaaggc

SEQ ID NO: 496063 - DNA, 16 bp, R. norvegicus
ctccaaatggaagggc

SEQ ID NO: 496064 - DNA, 16 bp, R. norvegicus
ctccaacaaactgaag

SEQ ID NO: 496065 - DNA, 16 bp, R. norvegicus
ctccaacaagatcaca

SEQ ID NO: 496066 - DNA, 16 bp, R. norvegicus
ctccaacagtgccaca

SEQ ID NO: 496067 - DNA, 16 bp, R. norvegicus
ctccaacatataaaaa

SEQ ID NO: 496068 - DNA, 16 bp, R. norvegicus
ctccaacatataacaa

SEQ ID NO: 496069 - DNA, 16 bp, R. norvegicus
ctccaacattcccctg

SEQ ID NO: 496070 - DNA, 16 bp, R. norvegicus
ctccaacccaaggagg

SEQ ID NO: 496071 - DNA, 16 bp, R. norvegicus
ctccaacccccaaggg

SEQ ID NO: 496072 - DNA, 16 bp, R. norvegicus
ctccaacccttcccat

SEQ ID NO: 496073 - DNA, 16 bp, R. norvegicus
ctccaactcagaaatc

SEQ ID NO: 496074 - DNA, 16 bp, R. norvegicus
ctccaagagcagccag

SEQ ID NO: 496075 - DNA, 16 bp, R. norvegicus
ctccaagagttcttca

SEQ ID NO: 496076 - DNA, 16 bp, R. norvegicus
ctccaagatcaagaat

SEQ ID NO: 496077 - DNA, 16 bp, R. norvegicus
ctccaagatccatgac

SEQ ID NO: 496078 - DNA, 16 bp, R. norvegicus
ctccaagatctctcag

SEQ ID NO: 496079 - DNA, 16 bp, R. norvegicus
ctccaagatgacaatt

SEQ ID NO: 496080 - DNA, 17 bp, R. norvegicus
ctccaagcgacctgcct

SEQ ID NO: 496081 - DNA, 16 bp, R. norvegicus
ctccaaggaaacagca

SEQ ID NO: 496082 - DNA, 16 bp, R. norvegicus
ctccaaggcccagaaa

SEQ ID NO: 496083 - DNA, 16 bp, R. norvegicus
ctccaataaagccaca

SEQ ID NO: 496084 - DNA, 16 bp, R. norvegicus
ctccaatggggaccca

SEQ ID NO: 496085 - DNA, 16 bp, R. norvegicus
ctccaatgtggacccc

SEQ ID NO: 496086 - DNA, 16 bp, R. norvegicus
ctccaattcctccaat

SEQ ID NO: 496087 - DNA, 16 bp, R. norvegicus
ctccacaacacagggc

SEQ ID NO: 496088 - DNA, 16 bp, R. norvegicus
ctccacactgattttc

SEQ ID NO: 496089 - DNA, 16 bp, R. norvegicus
ctccacagtgctgaga

SEQ ID NO: 496090 - DNA, 16 bp, R. norvegicus
ctccacagtgctggga

SEQ ID NO: 496091 - DNA, 16 bp, R. norvegicus
ctccacatcctgacca

SEQ ID NO: 496092 - DNA, 16 bp, R. norvegicus
ctccacatcctgccag

SEQ ID NO: 496093 - DNA, 16 bp, R. norvegicus
ctccacatgaaagaac

SEQ ID NO: 496094 - DNA, 16 bp, R. norvegicus
ctccacatgccttgcc

SEQ ID NO: 496095 - DNA, 16 bp, R. norvegicus
ctccacattcagtgag

SEQ ID NO: 496096 - DNA, 16 bp, R. norvegicus
ctccacctcccacaat

SEQ ID NO: 496097 - DNA, 16 bp, R. norvegicus
ctccacctcctcagtg

SEQ ID NO: 496098 - DNA, 16 bp, R. norvegicus
ctccacctcctgggtg

SEQ ID NO: 496099 - DNA, 16 bp, R. norvegicus
ctccacctctccagtg

SEQ ID NO: 496100 - DNA, 16 bp, R. norvegicus
ctccaccttattccct

SEQ ID NO: 496101 - DNA, 18 bp, R. norvegicus
ctccacgacacctgttga

SEQ ID NO: 496102 - DNA, 16 bp, R. norvegicus
ctccactcactctcca

SEQ ID NO: 496103 - DNA, 16 bp, R. norvegicus
ctccactcagcagctg

SEQ ID NO: 496104 - DNA, 16 bp, R. norvegicus
ctccactgggattcct

SEQ ID NO: 496105 - DNA, 16 bp, R. norvegicus
ctccactgtcacagga

SEQ ID NO: 496106 - DNA, 16 bp, R. norvegicus
ctccagaagtcctttt

SEQ ID NO: 496107 - DNA, 16 bp, R. norvegicus
ctccagacccaaatcc

SEQ ID NO: 496108 - DNA, 25 bp, R. norvegicus
ctccagactgatttccagaatgatt

SEQ ID NO: 496109 - DNA, 25 bp, R. norvegicus
ctccagactgatttccagaatggct

SEQ ID NO: 496110 - DNA, 25 bp, R. norvegicus
ctccagactgatttccagaatggtt

SEQ ID NO: 496111 - DNA, 16 bp, R. norvegicus
ctccagagaaagcaga

SEQ ID NO: 496112 - DNA, 16 bp, R. norvegicus
ctccagagatcctgag

SEQ ID NO: 496113 - DNA, 16 bp, R. norvegicus
ctccagagccagctcc

SEQ ID NO: 496114 - DNA, 16 bp, R. norvegicus
ctccagagctcccaga

SEQ ID NO: 496115 - DNA, 16 bp, R. norvegicus
ctccagaggaagacca

SEQ ID NO: 496116 - DNA, 16 bp, R. norvegicus
ctccagaggagaggaa

SEQ ID NO: 496117 - DNA, 21 bp, R. norvegicus
ctccagaggtcctgagttcaa

SEQ ID NO: 496118 - DNA, 16 bp, R. norvegicus
ctccagagtgagttct

SEQ ID NO: 496119 - DNA, 16 bp, R. norvegicus
ctccagagtgcaggga

SEQ ID NO: 496120 - DNA, 16 bp, R. norvegicus
ctccagatacaccaga

SEQ ID NO: 496121 - DNA, 26 bp, R. norvegicus
ctccagatcaagatgtgcctgcttca

SEQ ID NO: 496122 - DNA, 16 bp, R. norvegicus
ctccagattttatctc

SEQ ID NO: 496123 - DNA, 16 bp, R. norvegicus
ctccagattttattct

SEQ ID NO: 496124 - DNA, 16 bp, R. norvegicus
ctccagcaacagcaga

SEQ ID NO: 496125 - DNA, 16 bp, R. norvegicus
ctccagcaccatgctt

SEQ ID NO: 496126 - DNA, 16 bp, R. norvegicus
ctccagcactcaggag

SEQ ID NO: 496127 - DNA, 16 bp, R. norvegicus
ctccagcactgtctgc

SEQ ID NO: 496128 - DNA, 16 bp, R. norvegicus
ctccagcagaaagaca

SEQ ID NO: 496129 - DNA, 16 bp, R. norvegicus
ctccagcagccacaga

SEQ ID NO: 496130 - DNA, 16 bp, R. norvegicus
ctccagcatataacaa

SEQ ID NO: 496131 - DNA, 16 bp, R. norvegicus
ctccagcatgcttctt

SEQ ID NO: 496132 - DNA, 16 bp, R. norvegicus
ctccagccagctgcag

SEQ ID NO: 496133 - DNA, 16 bp, R. norvegicus
ctccagcccaggctcc

SEQ ID NO: 496134 - DNA, 16 bp, R. norvegicus
ctccagccccaaaaca

SEQ ID NO: 496135 - DNA, 16 bp, R. norvegicus
ctccagccccaagcct

SEQ ID NO: 496136 - DNA, 16 bp, R. norvegicus
ctccagccccacatct

SEQ ID NO: 496137 - DNA, 16 bp, R. norvegicus
ctccagccccagctct

SEQ ID NO: 496138 - DNA, 16 bp, R. norvegicus
ctccagccccaggctt

SEQ ID NO: 496139 - DNA, 16 bp, R. norvegicus
ctccagccccagggaa

SEQ ID NO: 496140 - DNA, 16 bp, R. norvegicus
ctccagccccattttt

SEQ ID NO: 496141 - DNA, 16 bp, R. norvegicus
ctccagcccccaatct

SEQ ID NO: 496142 - DNA, 16 bp, R. norvegicus
ctccagcccccagaat

SEQ ID NO: 496143 - DNA, 16 bp, R. norvegicus
ctccagcccccagagt

SEQ ID NO: 496144 - DNA, 16 bp, R. norvegicus
ctccagcccccattta

SEQ ID NO: 496145 - DNA, 16 bp, R. norvegicus
ctccagccccccagaa

SEQ ID NO: 496146 - DNA, 16 bp, R. norvegicus
ctccagccccctcctt

SEQ ID NO: 496147 - DNA, 16 bp, R. norvegicus
ctccagccccctgcct

SEQ ID NO: 496148 - DNA, 16 bp, R. norvegicus
ctccagccccctgctt

SEQ ID NO: 496149 - DNA, 19 bp, R. norvegicus
ctccagcccctcaccagct

SEQ ID NO: 496150 - DNA, 16 bp, R. norvegicus
ctccagcccctctgcc

SEQ ID NO: 496151 - DNA, 16 bp, R. norvegicus
ctccagcccctcttcc

SEQ ID NO: 496152 - DNA, 16 bp, R. norvegicus
ctccagcccctcttct

SEQ ID NO: 496153 - DNA, 16 bp, R. norvegicus
ctccagcccctgcttc

SEQ ID NO: 496154 - DNA, 16 bp, R. norvegicus
ctccagcccctggagt

SEQ ID NO: 496155 - DNA, 16 bp, R. norvegicus
ctccagccccttcctg

SEQ ID NO: 496156 - DNA, 16 bp, R. norvegicus
ctccagccctatttct

SEQ ID NO: 496157 - DNA, 16 bp, R. norvegicus
ctccagccctggattt

SEQ ID NO: 496158 - DNA, 16 bp, R. norvegicus
ctccagccctggcctt

SEQ ID NO: 496159 - DNA, 16 bp, R. norvegicus
ctccagcccttctcct

SEQ ID NO: 496160 - DNA, 16 bp, R. norvegicus
ctccagcccttgtctt

SEQ ID NO: 496161 - DNA, 16 bp, R. norvegicus
ctccagcccttgtttc

SEQ ID NO: 496162 - DNA, 16 bp, R. norvegicus
ctccagccgcatgtgt

SEQ ID NO: 496163 - DNA, 16 bp, R. norvegicus
ctccagcctcagcctc

SEQ ID NO: 496164 - DNA, 16 bp, R. norvegicus
ctccagcctcagcttc

SEQ ID NO: 496165 - DNA, 16 bp, R. norvegicus
ctccagcctccagcct

SEQ ID NO: 496166 - DNA, 16 bp, R. norvegicus
ctccagcctccctgcc

SEQ ID NO: 496167 - DNA, 16 bp, R. norvegicus
ctccagcctctccagc

SEQ ID NO: 496168 - DNA, 16 bp, R. norvegicus
ctccagctccagagag

SEQ ID NO: 496169 - DNA, 16 bp, R. norvegicus
ctccagctccagaggc

SEQ ID NO: 496170 - DNA, 16 bp, R. norvegicus
ctccagctccagctcc

SEQ ID NO: 496171 - DNA, 16 bp, R. norvegicus
ctccagctccaggaag

SEQ ID NO: 496172 - DNA, 16 bp, R. norvegicus
ctccagctccaggagt

SEQ ID NO: 496173 - DNA, 16 bp, R. norvegicus
ctccagctccagggac

SEQ ID NO: 496174 - DNA, 16 bp, R. norvegicus
ctccagctccatgtct

SEQ ID NO: 496175 - DNA, 16 bp, R. norvegicus
ctccagctcctggaga

SEQ ID NO: 496176 - DNA, 16 bp, R. norvegicus
ctccagctccttcagt

SEQ ID NO: 496177 - DNA, 16 bp, R. norvegicus
ctccagctctgagccc

SEQ ID NO: 496178 - DNA, 16 bp, R. norvegicus
ctccagctgcatttgt

SEQ ID NO: 496179 - DNA, 16 bp, R. norvegicus
ctccagctgctcctgg

SEQ ID NO: 496180 - DNA, 16 bp, R. norvegicus
ctccagcttcagcctc

SEQ ID NO: 496181 - DNA, 16 bp, R. norvegicus
ctccagcttcagggaa

SEQ ID NO: 496182 - DNA, 16 bp, R. norvegicus
ctccagcttctcccag

SEQ ID NO: 496183 - DNA, 16 bp, R. norvegicus
ctccaggaacagacca

SEQ ID NO: 496184 - DNA, 16 bp, R. norvegicus
ctccaggaagccttct

SEQ ID NO: 496185 - DNA, 16 bp, R. norvegicus
ctccaggaatgccaga

SEQ ID NO: 496186 - DNA, 16 bp, R. norvegicus
ctccaggagcaggtga

SEQ ID NO: 496187 - DNA, 16 bp, R. norvegicus
ctccaggccagccagg

SEQ ID NO: 496188 - DNA, 16 bp, R. norvegicus
ctccaggctccaggct

SEQ ID NO: 496189 - DNA, 16 bp, R. norvegicus
ctccaggctggcctgg

SEQ ID NO: 496190 - DNA, 16 bp, R. norvegicus
ctccaggcttgtctcc

SEQ ID NO: 496191 - DNA, 16 bp, R. norvegicus
ctccagggatccacct

SEQ ID NO: 496192 - DNA, 16 bp, R. norvegicus
ctccaggggctgggga

SEQ ID NO: 496193 - DNA, 16 bp, R. norvegicus
ctccagggtgtcctca

SEQ ID NO: 496194 - DNA, 16 bp, R. norvegicus
ctccaggtccagggga

SEQ ID NO: 496195 - DNA, 16 bp, R. norvegicus
ctccagtcctgaggac

SEQ ID NO: 496196 - DNA, 16 bp, R. norvegicus
ctccagtgaggccaca

SEQ ID NO: 496197 - DNA, 16 bp, R. norvegicus
ctccagtgagtatttt

SEQ ID NO: 496198 - DNA, 16 bp, R. norvegicus
ctccagtggagggaca

SEQ ID NO: 496199 - DNA, 16 bp, R. norvegicus
ctccagtggtgaacaa

SEQ ID NO: 496200 - DNA, 16 bp, R. norvegicus
ctccagtgtcccctct

SEQ ID NO: 496201 - DNA, 16 bp, R. norvegicus
ctccagttcaaggaga

SEQ ID NO: 496202 - DNA, 16 bp, R. norvegicus
ctccagttcaagggga

SEQ ID NO: 496203 - DNA, 16 bp, R. norvegicus
ctccagttccaagaaa

SEQ ID NO: 496204 - DNA, 16 bp, R. norvegicus
ctccagttccagaaga

SEQ ID NO: 496205 - DNA, 16 bp, R. norvegicus
ctccagttccagagca

SEQ ID NO: 496206 - DNA, 16 bp, R. norvegicus
ctccagttccaggaca

SEQ ID NO: 496207 - DNA, 16 bp, R. norvegicus
ctccagttccagggga

SEQ ID NO: 496208 - DNA, 16 bp, R. norvegicus
ctccagttccaggggt

SEQ ID NO: 496209 - DNA, 16 bp, R. norvegicus
ctccagttcctgagga

SEQ ID NO: 496210 - DNA, 16 bp, R. norvegicus
ctccagttctagctcc

SEQ ID NO: 496211 - DNA, 16 bp, R. norvegicus
ctccagttctgcttct

SEQ ID NO: 496212 - DNA, 16 bp, R. norvegicus
ctccagttgaaccagg

SEQ ID NO: 496213 - DNA, 16 bp, R. norvegicus
ctccataagaacaaca

SEQ ID NO: 496214 - DNA, 16 bp, R. norvegicus
ctccatagttggtggg

SEQ ID NO: 496215 - DNA, 16 bp, R. norvegicus
ctccatattcctcagc

SEQ ID NO: 496216 - DNA, 16 bp, R. norvegicus
ctccatcacagagagg

SEQ ID NO: 496217 - DNA, 16 bp, R. norvegicus
ctccatcaccatcctc

SEQ ID NO: 496218 - DNA, 16 bp, R. norvegicus
ctccatcacctccatc

SEQ ID NO: 496219 - DNA, 16 bp, R. norvegicus
ctccatcagactgacc

SEQ ID NO: 496220 - DNA, 16 bp, R. norvegicus
ctccatcagattggct

SEQ ID NO: 496221 - DNA, 16 bp, R. norvegicus
ctccatcagtttcaat

SEQ ID NO: 496222 - DNA, 16 bp, R. norvegicus
ctccatccacagttct

SEQ ID NO: 496223 - DNA, 16 bp, R. norvegicus
ctccatccagcagctg

SEQ ID NO: 496224 - DNA, 16 bp, R. norvegicus
ctccatcccaggcatg

SEQ ID NO: 496225 - DNA, 16 bp, R. norvegicus
ctccatcccctctggt

SEQ ID NO: 496226 - DNA, 16 bp, R. norvegicus
ctccatcctcctcagc

SEQ ID NO: 496227 - DNA, 16 bp, R. norvegicus
ctccatcctcctgctt

SEQ ID NO: 496228 - DNA, 16 bp, R. norvegicus
ctccatctcccaagtg

SEQ ID NO: 496229 - DNA, 16 bp, R. norvegicus
ctccatctccctggtg

SEQ ID NO: 496230 - DNA, 16 bp, R. norvegicus
ctccatctctgtctct

SEQ ID NO: 496231 - DNA, 16 bp, R. norvegicus
ctccatctctgtgttt

SEQ ID NO: 496232 - DNA, 16 bp, R. norvegicus
ctccatctgacaggca

SEQ ID NO: 496233 - DNA, 16 bp, R. norvegicus
ctccatgaccacagca

SEQ ID NO: 496234 - DNA, 16 bp, R. norvegicus
ctccatgacttgctca

SEQ ID NO: 496235 - DNA, 17 bp, R. norvegicus
ctccatgagacccagct

SEQ ID NO: 496236 - DNA, 16 bp, R. norvegicus
ctccatgagatggagc

SEQ ID NO: 496237 - DNA, 16 bp, R. norvegicus
ctccatgcctgctgtc

SEQ ID NO: 496238 - DNA, 16 bp, R. norvegicus
ctccatggacaggaag

SEQ ID NO: 496239 - DNA, 16 bp, R. norvegicus
ctccatggcctctgca

SEQ ID NO: 496240 - DNA, 17 bp, R. norvegicus
ctccatggctgatgtca

SEQ ID NO: 496241 - DNA, 16 bp, R. norvegicus
ctccatgggctctgca

SEQ ID NO: 496242 - DNA, 16 bp, R. norvegicus
ctccatggtggcccag

SEQ ID NO: 496243 - DNA, 16 bp, R. norvegicus
ctccatgtgggtcccc

SEQ ID NO: 496244 - DNA, 16 bp, R. norvegicus
ctccatttcacttcca

SEQ ID NO: 496245 - DNA, 16 bp, R. norvegicus
ctccatttccagagga

SEQ ID NO: 496246 - DNA, 16 bp, R. norvegicus
ctccatttcctccaga

SEQ ID NO: 496247 - DNA, 16 bp, R. norvegicus
ctccatttgtttctat

SEQ ID NO: 496248 - DNA, 16 bp, R. norvegicus
ctccattttaggacca

SEQ ID NO: 496249 - DNA, 16 bp, R. norvegicus
ctccattttatagatg

SEQ ID NO: 496250 - DNA, 16 bp, R. norvegicus
ctccattttggataga

SEQ ID NO: 496251 - DNA, 16 bp, R. norvegicus
ctcccaaactcctgga

SEQ ID NO: 496252 - DNA, 16 bp, R. norvegicus
ctcccaaagtccctcc

SEQ ID NO: 496253 - DNA, 16 bp, R. norvegicus
ctcccaacaggattcc

SEQ ID NO: 496254 - DNA, 16 bp, R. norvegicus
ctcccaaccactgagc

SEQ ID NO: 496255 - DNA, 16 bp, R. norvegicus
ctcccaagaggctctg

SEQ ID NO: 496256 - DNA, 16 bp, R. norvegicus
ctcccaaggctcaggg

SEQ ID NO: 496257 - DNA, 16 bp, R. norvegicus
ctcccaagtgctggca

SEQ ID NO: 496258 - DNA, 16 bp, R. norvegicus
ctcccaagtgctggta

SEQ ID NO: 496259 - DNA, 16 bp, R. norvegicus
ctcccaagtggtggga

SEQ ID NO: 496260 - DNA, 16 bp, R. norvegicus
ctcccacatcaatcac

SEQ ID NO: 496261 - DNA, 16 bp, R. norvegicus
ctcccacccaggttcc

SEQ ID NO: 496262 - DNA, 16 bp, R. norvegicus
ctcccacctcactgct

SEQ ID NO: 496263 - DNA, 16 bp, R. norvegicus
ctcccacctggaaaag

SEQ ID NO: 496264 - DNA, 16 bp, R. norvegicus
ctcccaccttgacaag

SEQ ID NO: 496265 - DNA, 16 bp, R. norvegicus
ctcccactcctgcctc

SEQ ID NO: 496266 - DNA, 16 bp, R. norvegicus
ctcccactgtctgtgg

SEQ ID NO: 496267 - DNA, 16 bp, R. norvegicus
ctcccacttctcagag

SEQ ID NO: 496268 - DNA, 16 bp, R. norvegicus
ctcccagaagccatca

SEQ ID NO: 496269 - DNA, 16 bp, R. norvegicus
ctcccagaattcctca

SEQ ID NO: 496270 - DNA, 16 bp, R. norvegicus
ctcccagacactgagc

SEQ ID NO: 496271 - DNA, 16 bp, R. norvegicus
ctcccagaccccatgg

SEQ ID NO: 496272 - DNA, 16 bp, R. norvegicus
ctcccagaccttcaca

SEQ ID NO: 496273 - DNA, 16 bp, R. norvegicus
ctcccagatcctcctc

SEQ ID NO: 496274 - DNA, 16 bp, R. norvegicus
ctcccagatgtgtctg

SEQ ID NO: 496275 - DNA, 16 bp, R. norvegicus
ctcccagcagcacctg

SEQ ID NO: 496276 - DNA, 16 bp, R. norvegicus
ctcccagcagcagcca

SEQ ID NO: 496277 - DNA, 16 bp, R. norvegicus
ctcccagccaaccact

SEQ ID NO: 496278 - DNA, 16 bp, R. norvegicus
ctcccagccactcagg

SEQ ID NO: 496279 - DNA, 16 bp, R. norvegicus
ctcccagccctgggac

SEQ ID NO: 496280 - DNA, 16 bp, R. norvegicus
ctcccagcctctccca

SEQ ID NO: 496281 - DNA, 16 bp, R. norvegicus
ctcccagctcccagcc

SEQ ID NO: 496282 - DNA, 16 bp, R. norvegicus
ctcccagctcctctcc

SEQ ID NO: 496283 - DNA, 16 bp, R. norvegicus
ctcccagctctcccag

SEQ ID NO: 496284 - DNA, 16 bp, R. norvegicus
ctcccagctctgcctg

SEQ ID NO: 496285 - DNA, 16 bp, R. norvegicus
ctcccagctgctggga

SEQ ID NO: 496286 - DNA, 16 bp, R. norvegicus
ctcccaggaatgctga

SEQ ID NO: 496287 - DNA, 16 bp, R. norvegicus
ctcccaggagattgga

SEQ ID NO: 496288 - DNA, 16 bp, R. norvegicus
ctcccaggctgaggtg

SEQ ID NO: 496289 - DNA, 16 bp, R. norvegicus
ctcccagggctcccag

SEQ ID NO: 496290 - DNA, 16 bp, R. norvegicus
ctcccaggtactggga

SEQ ID NO: 496291 - DNA, 16 bp, R. norvegicus
ctcccaggtctcagaa

SEQ ID NO: 496292 - DNA, 16 bp, R. norvegicus
ctcccagtcccatcct

SEQ ID NO: 496293 - DNA, 16 bp, R. norvegicus
ctcccagtccttcccc

SEQ ID NO: 496294 - DNA, 16 bp, R. norvegicus
ctcccagtgcagggga

SEQ ID NO: 496295 - DNA, 16 bp, R. norvegicus
ctcccagttcctcctc

SEQ ID NO: 496296 - DNA, 16 bp, R. norvegicus
ctcccagttccttctc

SEQ ID NO: 496297 - DNA, 16 bp, R. norvegicus
ctcccagttcttcccc

SEQ ID NO: 496298 - DNA, 16 bp, R. norvegicus
ctcccatcacttaata

SEQ ID NO: 496299 - DNA, 16 bp, R. norvegicus
ctcccatggatatcaa

SEQ ID NO: 496300 - DNA, 16 bp, R. norvegicus
ctccccaaagttgtcc

SEQ ID NO: 496301 - DNA, 16 bp, R. norvegicus
ctccccacatccctgg

SEQ ID NO: 496302 - DNA, 17 bp, R. norvegicus
ctccccacgggctctct

SEQ ID NO: 496303 - DNA, 16 bp, R. norvegicus
ctccccactccctgtg

SEQ ID NO: 496304 - DNA, 16 bp, R. norvegicus
ctccccactcctgcct

SEQ ID NO: 496305 - DNA, 16 bp, R. norvegicus
ctccccactgatgcac

SEQ ID NO: 496306 - DNA, 16 bp, R. norvegicus
ctccccagagctgccc

SEQ ID NO: 496307 - DNA, 16 bp, R. norvegicus
ctccccagagttccca

SEQ ID NO: 496308 - DNA, 16 bp, R. norvegicus
ctccccagcactggga

SEQ ID NO: 496309 - DNA, 16 bp, R. norvegicus
ctccccagcatttgct

SEQ ID NO: 496310 - DNA, 16 bp, R. norvegicus
ctccccagccctgaga

SEQ ID NO: 496311 - DNA, 16 bp, R. norvegicus
ctccccagccctggaa

SEQ ID NO: 496312 - DNA, 16 bp, R. norvegicus
ctccccagctccccag

SEQ ID NO: 496313 - DNA, 16 bp, R. norvegicus
ctccccagctctggga

SEQ ID NO: 496314 - DNA, 16 bp, R. norvegicus
ctccccaggacaaaca

SEQ ID NO: 496315 - DNA, 16 bp, R. norvegicus
ctccccaggctgcttt

SEQ ID NO: 496316 - DNA, 16 bp, R. norvegicus
ctccccagggggctgg

SEQ ID NO: 496317 - DNA, 16 bp, R. norvegicus
ctccccagtgctggaa

SEQ ID NO: 496318 - DNA, 16 bp, R. norvegicus
ctcccccagcagcctg

SEQ ID NO: 496319 - DNA, 16 bp, R. norvegicus
ctcccctcctatgaat

SEQ ID NO: 496320 - DNA, 16 bp, R. norvegicus
ctcccctgtcaatcac

SEQ ID NO: 496321 - DNA, 16 bp, R. norvegicus
ctcccctgtgtctgct

SEQ ID NO: 496322 - DNA, 16 bp, R. norvegicus
ctccccttctttattg

SEQ ID NO: 496323 - DNA, 16 bp, R. norvegicus
ctcccctttgcttctg

SEQ ID NO: 496324 - DNA, 16 bp, R. norvegicus
ctcccgagtgctggaa

SEQ ID NO: 496325 - DNA, 16 bp, R. norvegicus
ctcccgctctgcagcc

SEQ ID NO: 496326 - DNA, 16 bp, R. norvegicus
ctcccggaaacagcag

SEQ ID NO: 496327 - DNA, 16 bp, R. norvegicus
ctcccggggctgggga

SEQ ID NO: 496328 - DNA, 16 bp, R. norvegicus
ctccctcaactccgcc

SEQ ID NO: 496329 - DNA, 16 bp, R. norvegicus
ctccctcacaggattt

SEQ ID NO: 496330 - DNA, 16 bp, R. norvegicus
ctccctccaaactctc

SEQ ID NO: 496331 - DNA, 16 bp, R. norvegicus
ctccctccagtctccc

SEQ ID NO: 496332 - DNA, 16 bp, R. norvegicus
ctccctccatctgctt

SEQ ID NO: 496333 - DNA, 16 bp, R. norvegicus
ctccctccattgctgc

SEQ ID NO: 496334 - DNA, 16 bp, R. norvegicus
ctccctccctccatgt

SEQ ID NO: 496335 - DNA, 16 bp, R. norvegicus
ctccctccctctgtta

SEQ ID NO: 496336 - DNA, 16 bp, R. norvegicus
ctccctcctgagtgct

SEQ ID NO: 496337 - DNA, 16 bp, R. norvegicus
ctccctctcccagcag

SEQ ID NO: 496338 - DNA, 16 bp, R. norvegicus
ctccctctctgactct

SEQ ID NO: 496339 - DNA, 16 bp, R. norvegicus
ctccctctgcctccca

SEQ ID NO: 496340 - DNA, 16 bp, R. norvegicus
ctccctctgtgtgtgt

SEQ ID NO: 496341 - DNA, 16 bp, R. norvegicus
ctccctctgtttctgt

SEQ ID NO: 496342 - DNA, 16 bp, R. norvegicus
ctccctcttctcccag

SEQ ID NO: 496343 - DNA, 16 bp, R. norvegicus
ctccctcttctggtct

SEQ ID NO: 496344 - DNA, 16 bp, R. norvegicus
ctccctgaagctggag

SEQ ID NO: 496345 - DNA, 16 bp, R. norvegicus
ctccctgaagttgctt

SEQ ID NO: 496346 - DNA, 16 bp, R. norvegicus
ctccctgaggatccag

SEQ ID NO: 496347 - DNA, 16 bp, R. norvegicus
ctccctgaggcatttg

SEQ ID NO: 496348 - DNA, 16 bp, R. norvegicus
ctccctgcagcggcag

SEQ ID NO: 496349 - DNA, 16 bp, R. norvegicus
ctccctgcctctgtct

SEQ ID NO: 496350 - DNA, 16 bp, R. norvegicus
ctccctgcctgcctgc

SEQ ID NO: 496351 - DNA, 16 bp, R. norvegicus
ctccctgcctggcatt

SEQ ID NO: 496352 - DNA, 16 bp, R. norvegicus
ctccctgcctttgcct

SEQ ID NO: 496353 - DNA, 16 bp, R. norvegicus
ctccctgctctggggg

SEQ ID NO: 496354 - DNA, 16 bp, R. norvegicus
ctccctgctgcctgtg

SEQ ID NO: 496355 - DNA, 16 bp, R. norvegicus
ctccctggagatgact

SEQ ID NO: 496356 - DNA, 16 bp, R. norvegicus
ctccctggagctggag

SEQ ID NO: 496357 - DNA, 16 bp, R. norvegicus
ctccctgggaccaagg

SEQ ID NO: 496358 - DNA, 16 bp, R. norvegicus
ctccctgtagaccagg

SEQ ID NO: 496359 - DNA, 16 bp, R. norvegicus
ctccctgtcagagtct

SEQ ID NO: 496360 - DNA, 16 bp, R. norvegicus
ctccctgtcagcagct

SEQ ID NO: 496361 - DNA, 16 bp, R. norvegicus
ctccctgtgtgtgctg

SEQ ID NO: 496362 - DNA, 16 bp, R. norvegicus
ctccctttgcctctga

SEQ ID NO: 496363 - DNA, 16 bp, R. norvegicus
ctccgaaaaaaaagaa

SEQ ID NO: 496364 - DNA, 16 bp, R. norvegicus
ctccgaagaaaagaaa

SEQ ID NO: 496365 - DNA, 16 bp, R. norvegicus
ctccgagatctctcag

SEQ ID NO: 496366 - DNA, 16 bp, R. norvegicus
ctccgataaaaagaaa

SEQ ID NO: 496367 - DNA, 16 bp, R. norvegicus
ctccgcacccaaatcc

SEQ ID NO: 496368 - DNA, 39 bp, R. norvegicus
ctccggctccggctccggctccggctccggctccggctc

SEQ ID NO: 496369 - DNA, 16 bp, R. norvegicus
ctccgggggtctttca

SEQ ID NO: 496370 - DNA, 16 bp, R. norvegicus
ctcctaaagcaggagc

SEQ ID NO: 496371 - DNA, 16 bp, R. norvegicus
ctcctaaatctgataa

SEQ ID NO: 496372 - DNA, 16 bp, R. norvegicus
ctcctaatgatattct

SEQ ID NO: 496373 - DNA, 16 bp, R. norvegicus
ctcctacagggtcacc

SEQ ID NO: 496374 - DNA, 16 bp, R. norvegicus
ctcctacctcagcctc

SEQ ID NO: 496375 - DNA, 16 bp, R. norvegicus
ctcctacctctgcttc

SEQ ID NO: 496376 - DNA, 16 bp, R. norvegicus
ctcctacctctgtctc

SEQ ID NO: 496377 - DNA, 16 bp, R. norvegicus
ctcctacttctgcctc

SEQ ID NO: 496378 - DNA, 16 bp, R. norvegicus
ctcctagggacagaag

SEQ ID NO: 496379 - DNA, 16 bp, R. norvegicus
ctcctaggtttctgtg

SEQ ID NO: 496380 - DNA, 16 bp, R. norvegicus
ctcctcagagaaaggg

SEQ ID NO: 496381 - DNA, 16 bp, R. norvegicus
ctcctcagagctgggt

SEQ ID NO: 496382 - DNA, 16 bp, R. norvegicus
ctcctcagcttcttca

SEQ ID NO: 496383 - DNA, 16 bp, R. norvegicus
ctcctcagcttcttct

SEQ ID NO: 496384 - DNA, 16 bp, R. norvegicus
ctcctcagtgctggaa

SEQ ID NO: 496385 - DNA, 16 bp, R. norvegicus
ctcctcagtgctggga

SEQ ID NO: 496386 - DNA, 16 bp, R. norvegicus
ctcctcagtgctgtgc

SEQ ID NO: 496387 - DNA, 16 bp, R. norvegicus
ctcctcagtttcctcc

SEQ ID NO: 496388 - DNA, 16 bp, R. norvegicus
ctcctcattgaggaaa

SEQ ID NO: 496389 - DNA, 16 bp, R. norvegicus
ctcctcattgtggatg

SEQ ID NO: 496390 - DNA, 16 bp, R. norvegicus
ctcctccaagtccctc

SEQ ID NO: 496391 - DNA, 16 bp, R. norvegicus
ctcctccaattttgat

SEQ ID NO: 496392 - DNA, 16 bp, R. norvegicus
ctcctccacctgccct

SEQ ID NO: 496393 - DNA, 16 bp, R. norvegicus
ctcctccacggcctct

SEQ ID NO: 496394 - DNA, 16 bp, R. norvegicus
ctcctccagcaaagcc

SEQ ID NO: 496395 - DNA, 16 bp, R. norvegicus
ctcctccagcagatag

SEQ ID NO: 496396 - DNA, 16 bp, R. norvegicus
ctcctccagcctcctc

SEQ ID NO: 496397 - DNA, 16 bp, R. norvegicus
ctcctccagctccatg

SEQ ID NO: 496398 - DNA, 16 bp, R. norvegicus
ctcctccagctcctcc

SEQ ID NO: 496399 - DNA, 16 bp, R. norvegicus
ctcctccagttcttct

SEQ ID NO: 496400 - DNA, 16 bp, R. norvegicus
ctcctccatcggggtc

SEQ ID NO: 496401 - DNA, 16 bp, R. norvegicus
ctcctccatctaccca

SEQ ID NO: 496402 - DNA, 16 bp, R. norvegicus
ctcctccattgatgcc

SEQ ID NO: 496403 - DNA, 16 bp, R. norvegicus
ctcctcccacaaggcc

SEQ ID NO: 496404 - DNA, 16 bp, R. norvegicus
ctcctcccagacccac

SEQ ID NO: 496405 - DNA, 16 bp, R. norvegicus
ctcctcccagcagctg

SEQ ID NO: 496406 - DNA, 16 bp, R. norvegicus
ctcctcccagtaccct

SEQ ID NO: 496407 - DNA, 16 bp, R. norvegicus
ctcctcccagttcttc

SEQ ID NO: 496408 - DNA, 16 bp, R. norvegicus
ctcctcccatcctgca

SEQ ID NO: 496409 - DNA, 16 bp, R. norvegicus
ctcctcccatgtctcc

SEQ ID NO: 496410 - DNA, 16 bp, R. norvegicus
ctcctccccagagtgg

SEQ ID NO: 496411 - DNA, 16 bp, R. norvegicus
ctcctccctcagctcc

SEQ ID NO: 496412 - DNA, 16 bp, R. norvegicus
ctcctcctccaacaag

SEQ ID NO: 496413 - DNA, 16 bp, R. norvegicus
ctcctcctccagcacc

SEQ ID NO: 496414 - DNA, 16 bp, R. norvegicus
ctcctcctcctctgag

SEQ ID NO: 496415 - DNA, 16 bp, R. norvegicus
ctcctcctgagactga

SEQ ID NO: 496416 - DNA, 16 bp, R. norvegicus
ctcctcctgcaccacg

SEQ ID NO: 496417 - DNA, 16 bp, R. norvegicus
ctcctcctgctgcctg

SEQ ID NO: 496418 - DNA, 16 bp, R. norvegicus
ctcctcctgcttctac

SEQ ID NO: 496419 - DNA, 16 bp, R. norvegicus
ctcctcctgcttttat

SEQ ID NO: 496420 - DNA, 16 bp, R. norvegicus
ctcctcctggaccatg

SEQ ID NO: 496421 - DNA, 16 bp, R. norvegicus
ctcctcctgggtgtgt

SEQ ID NO: 496422 - DNA, 16 bp, R. norvegicus
ctcctcctgtctgcct

SEQ ID NO: 496423 - DNA, 16 bp, R. norvegicus
ctcctccttcctccag

SEQ ID NO: 496424 - DNA, 16 bp, R. norvegicus
ctcctctcagatgtcc

SEQ ID NO: 496425 - DNA, 16 bp, R. norvegicus
ctcctctcagatgtct

SEQ ID NO: 496426 - DNA, 16 bp, R. norvegicus
ctcctctccagcacca

SEQ ID NO: 496427 - DNA, 16 bp, R. norvegicus
ctcctctcccacccag

SEQ ID NO: 496428 - DNA, 16 bp, R. norvegicus
ctcctctcccagctga

SEQ ID NO: 496429 - DNA, 16 bp, R. norvegicus
ctcctctcccttcaaa

SEQ ID NO: 496430 - DNA, 16 bp, R. norvegicus
ctcctctgaccccaag

SEQ ID NO: 496431 - DNA, 16 bp, R. norvegicus
ctcctctgagcagatg

SEQ ID NO: 496432 - DNA, 16 bp, R. norvegicus
ctcctctgagctggtg

SEQ ID NO: 496433 - DNA, 16 bp, R. norvegicus
ctcctctgccttccca

SEQ ID NO: 496434 - DNA, 16 bp, R. norvegicus
ctcctctggtagagga

SEQ ID NO: 496435 - DNA, 16 bp, R. norvegicus
ctcctctgtgtcccac

SEQ ID NO: 496436 - DNA, 16 bp, R. norvegicus
ctcctcttccctcaga

SEQ ID NO: 496437 - DNA, 16 bp, R. norvegicus
ctcctcttcttctata

SEQ ID NO: 496438 - DNA, 16 bp, R. norvegicus
ctcctcttgctgtgcc

SEQ ID NO: 496439 - DNA, 16 bp, R. norvegicus
ctcctcttgcttttgc

SEQ ID NO: 496440 - DNA, 16 bp, R. norvegicus
ctcctcttggctgcct

SEQ ID NO: 496441 - DNA, 16 bp, R. norvegicus
ctcctgaaagttgtcc

SEQ ID NO: 496442 - DNA, 16 bp, R. norvegicus
ctcctgaactcctgag

SEQ ID NO: 496443 - DNA, 16 bp, R. norvegicus
ctcctgaagtcctttt

SEQ ID NO: 496444 - DNA, 16 bp, R. norvegicus
ctcctgaatactggga

SEQ ID NO: 496445 - DNA, 16 bp, R. norvegicus
ctcctgaccactgagc

SEQ ID NO: 496446 - DNA, 16 bp, R. norvegicus
ctcctgactgctggga

SEQ ID NO: 496447 - DNA, 16 bp, R. norvegicus
ctcctgagagcctcag

SEQ ID NO: 496448 - DNA, 16 bp, R. norvegicus
ctcctgagagttgggc

SEQ ID NO: 496449 - DNA, 16 bp, R. norvegicus
ctcctgagccatcttg

SEQ ID NO: 496450 - DNA, 16 bp, R. norvegicus
ctcctgagcttcctcc

SEQ ID NO: 496451 - DNA, 16 bp, R. norvegicus
ctcctgaggcagcaga

SEQ ID NO: 496452 - DNA, 16 bp, R. norvegicus
ctcctgaggctgaaga

SEQ ID NO: 496453 - DNA, 16 bp, R. norvegicus
ctcctgaggttctctc

SEQ ID NO: 496454 - DNA, 16 bp, R. norvegicus
ctcctgagtgctgcca

SEQ ID NO: 496455 - DNA, 16 bp, R. norvegicus
ctcctgagtgtgtgaa

SEQ ID NO: 496456 - DNA, 16 bp, R. norvegicus
ctcctgatcttcctga

SEQ ID NO: 496457 - DNA, 16 bp, R. norvegicus
ctcctgcacctaaggc

SEQ ID NO: 496458 - DNA, 16 bp, R. norvegicus
ctcctgcagaagaccc

SEQ ID NO: 496459 - DNA, 16 bp, R. norvegicus
ctcctgcagcagatga

SEQ ID NO: 496460 - DNA, 16 bp, R. norvegicus
ctcctgcaggctgtcc

SEQ ID NO: 496461 - DNA, 16 bp, R. norvegicus
ctcctgcatcagcttc

SEQ ID NO: 496462 - DNA, 16 bp, R. norvegicus
ctcctgcatgttcttc

SEQ ID NO: 496463 - DNA, 16 bp, R. norvegicus
ctcctgccagcatgca

SEQ ID NO: 496464 - DNA, 16 bp, R. norvegicus
ctcctgccccatgcct

SEQ ID NO: 496465 - DNA, 16 bp, R. norvegicus
ctcctgccctggcttc

SEQ ID NO: 496466 - DNA, 16 bp, R. norvegicus
ctcctgcctagaatcc

SEQ ID NO: 496467 - DNA, 16 bp, R. norvegicus
ctcctgcctcacagcc

SEQ ID NO: 496468 - DNA, 16 bp, R. norvegicus
ctcctgcctcaccacc

SEQ ID NO: 496469 - DNA, 16 bp, R. norvegicus
ctcctgcctcaccact

SEQ ID NO: 496470 - DNA, 16 bp, R. norvegicus
ctcctgcctcacctcc

SEQ ID NO: 496471 - DNA, 16 bp, R. norvegicus
ctcctgcctcactgtc

SEQ ID NO: 496472 - DNA, 16 bp, R. norvegicus
ctcctgcctcacttcc

SEQ ID NO: 496473 - DNA, 16 bp, R. norvegicus
ctcctgcctcagcatc

SEQ ID NO: 496474 - DNA, 16 bp, R. norvegicus
ctcctgcctcagccct

SEQ ID NO: 496475 - DNA, 16 bp, R. norvegicus
ctcctgcctcagcctc

SEQ ID NO: 496476 - DNA, 16 bp, R. norvegicus
ctcctgcctcaggctt

SEQ ID NO: 496477 - DNA, 16 bp, R. norvegicus
ctcctgcctcagtccc

SEQ ID NO: 496478 - DNA, 16 bp, R. norvegicus
ctcctgcctcagtgct

SEQ ID NO: 496479 - DNA, 16 bp, R. norvegicus
ctcctgcctccacttc

SEQ ID NO: 496480 - DNA, 16 bp, R. norvegicus
ctcctgcctccagcct

SEQ ID NO: 496481 - DNA, 16 bp, R. norvegicus
ctcctgcctcctccag

SEQ ID NO: 496482 - DNA, 16 bp, R. norvegicus
ctcctgcctctccacc

SEQ ID NO: 496483 - DNA, 16 bp, R. norvegicus
ctcctgcctctgctct

SEQ ID NO: 496484 - DNA, 16 bp, R. norvegicus
ctcctgcctctgggtt

SEQ ID NO: 496485 - DNA, 16 bp, R. norvegicus
ctcctgctactctctg

SEQ ID NO: 496486 - DNA, 16 bp, R. norvegicus
ctcctgctccagcacc

SEQ ID NO: 496487 - DNA, 16 bp, R. norvegicus
ctcctgctccctgtgc

SEQ ID NO: 496488 - DNA, 16 bp, R. norvegicus
ctcctgctcctgctct

SEQ ID NO: 496489 - DNA, 16 bp, R. norvegicus
ctcctgctccttctgc

SEQ ID NO: 496490 - DNA, 16 bp, R. norvegicus
ctcctgctctgatgtc

SEQ ID NO: 496491 - DNA, 16 bp, R. norvegicus
ctcctgctgacttgtg

SEQ ID NO: 496492 - DNA, 16 bp, R. norvegicus
ctcctgctgcctgtgg

SEQ ID NO: 496493 - DNA, 16 bp, R. norvegicus
ctcctgctgccttcag

SEQ ID NO: 496494 - DNA, 16 bp, R. norvegicus
ctcctgctgctcctgc

SEQ ID NO: 496495 - DNA, 16 bp, R. norvegicus
ctcctgctgctgccca

SEQ ID NO: 496496 - DNA, 16 bp, R. norvegicus
ctcctgctggctgcct

SEQ ID NO: 496497 - DNA, 16 bp, R. norvegicus
ctcctgctgggtgtat

SEQ ID NO: 496498 - DNA, 16 bp, R. norvegicus
ctcctgcttcagcctc

SEQ ID NO: 496499 - DNA, 17 bp, R. norvegicus
ctcctgcttcctgacct

SEQ ID NO: 496500 - DNA, 16 bp, R. norvegicus
ctcctgcttctcctga

SEQ ID NO: 496501 - DNA, 16 bp, R. norvegicus
ctcctgcttctgcctc

SEQ ID NO: 496502 - DNA, 16 bp, R. norvegicus
ctcctgcttctgctcc

SEQ ID NO: 496503 - DNA, 16 bp, R. norvegicus
ctcctgcttctgtttc

SEQ ID NO: 496504 - DNA, 16 bp, R. norvegicus
ctcctggaagaccagc

SEQ ID NO: 496505 - DNA, 16 bp, R. norvegicus
ctcctggagaccagct

SEQ ID NO: 496506 - DNA, 16 bp, R. norvegicus
ctcctggagctggagc

SEQ ID NO: 496507 - DNA, 16 bp, R. norvegicus
ctcctggaggtcctgg

SEQ ID NO: 496508 - DNA, 16 bp, R. norvegicus
ctcctggagttggagt

SEQ ID NO: 496509 - DNA, 16 bp, R. norvegicus
ctcctggcagaccagc

SEQ ID NO: 496510 - DNA, 16 bp, R. norvegicus
ctcctggccctcaggg

SEQ ID NO: 496511 - DNA, 16 bp, R. norvegicus
ctcctggcctctgtgg

SEQ ID NO: 496512 - DNA, 16 bp, R. norvegicus
ctcctggctgtcctgg

SEQ ID NO: 496513 - DNA, 16 bp, R. norvegicus
ctcctggcttcctttc

SEQ ID NO: 496514 - DNA, 16 bp, R. norvegicus
ctcctgggagtatttg

SEQ ID NO: 496515 - DNA, 16 bp, R. norvegicus
ctcctgggattaaagg

SEQ ID NO: 496516 - DNA, 16 bp, R. norvegicus
ctcctgggcaggtggt

SEQ ID NO: 496517 - DNA, 16 bp, R. norvegicus
ctcctgggccctcatc

SEQ ID NO: 496518 - DNA, 16 bp, R. norvegicus
ctcctgggccctcctc

SEQ ID NO: 496519 - DNA, 16 bp, R. norvegicus
ctcctgggccttcccc

SEQ ID NO: 496520 - DNA, 16 bp, R. norvegicus
ctcctggtcctcctgc

SEQ ID NO: 496521 - DNA, 16 bp, R. norvegicus
ctcctggtgtccctct

SEQ ID NO: 496522 - DNA, 16 bp, R. norvegicus
ctcctggttctgcctc

SEQ ID NO: 496523 - DNA, 16 bp, R. norvegicus
ctcctggtttcccagg

SEQ ID NO: 496524 - DNA, 16 bp, R. norvegicus
ctcctgtaatgctggg

SEQ ID NO: 496525 - DNA, 16 bp, R. norvegicus
ctcctgtagccaggtg

SEQ ID NO: 496526 - DNA, 16 bp, R. norvegicus
ctcctgtcagcacgca

SEQ ID NO: 496527 - DNA, 16 bp, R. norvegicus
ctcctgtcagctcttc

SEQ ID NO: 496528 - DNA, 16 bp, R. norvegicus
ctcctgtcaggactgt

SEQ ID NO: 496529 - DNA, 16 bp, R. norvegicus
ctcctgtcagtaagta

SEQ ID NO: 496530 - DNA, 16 bp, R. norvegicus
ctcctgtcatcaagca

SEQ ID NO: 496531 - DNA, 16 bp, R. norvegicus
ctcctgtctcaacctc

SEQ ID NO: 496532 - DNA, 16 bp, R. norvegicus
ctcctgtctcaacttc

SEQ ID NO: 496533 - DNA, 16 bp, R. norvegicus
ctcctgtctccactcc

SEQ ID NO: 496534 - DNA, 16 bp, R. norvegicus
ctcctgtctcccacct

SEQ ID NO: 496535 - DNA, 16 bp, R. norvegicus
ctcctgtctctgtctg

SEQ ID NO: 496536 - DNA, 16 bp, R. norvegicus
ctcctgtcttcacctc

SEQ ID NO: 496537 - DNA, 16 bp, R. norvegicus
ctcctgtgaatgtttt

SEQ ID NO: 496538 - DNA, 16 bp, R. norvegicus
ctcctgtgtccacctc

SEQ ID NO: 496539 - DNA, 16 bp, R. norvegicus
ctcctgtgtccacttc

SEQ ID NO: 496540 - DNA, 16 bp, R. norvegicus
ctcctgtgtctacagc

SEQ ID NO: 496541 - DNA, 16 bp, R. norvegicus
ctcctgtgtgctggga

SEQ ID NO: 496542 - DNA, 16 bp, R. norvegicus
ctcctgtgtgtctctg

SEQ ID NO: 496543 - DNA, 16 bp, R. norvegicus
ctcctgtgtgtgtttg

SEQ ID NO: 496544 - DNA, 16 bp, R. norvegicus
ctcctgttccaggccc

SEQ ID NO: 496545 - DNA, 16 bp, R. norvegicus
ctcctgttcctcctgc

SEQ ID NO: 496546 - DNA, 16 bp, R. norvegicus
ctcctgttgctgctgt

SEQ ID NO: 496547 - DNA, 16 bp, R. norvegicus
ctcctgttggtgctgt

SEQ ID NO: 496548 - DNA, 16 bp, R. norvegicus
ctcctgtttcagcctc

SEQ ID NO: 496549 - DNA, 16 bp, R. norvegicus
ctcctgtttctttgtg

SEQ ID NO: 496550 - DNA, 16 bp, R. norvegicus
ctccttcaactccttc

SEQ ID NO: 496551 - DNA, 16 bp, R. norvegicus
ctccttcaagcctttc

SEQ ID NO: 496552 - DNA, 16 bp, R. norvegicus
ctccttcagccccttc

SEQ ID NO: 496553 - DNA, 16 bp, R. norvegicus
ctccttcagtcctccc

SEQ ID NO: 496554 - DNA, 16 bp, R. norvegicus
ctccttccaccatgta

SEQ ID NO: 496555 - DNA, 16 bp, R. norvegicus
ctccttccagtcccac

SEQ ID NO: 496556 - DNA, 16 bp, R. norvegicus
ctccttcctcagcttc

SEQ ID NO: 496557 - DNA, 16 bp, R. norvegicus
ctccttcctcccaaga

SEQ ID NO: 496558 - DNA, 16 bp, R. norvegicus
ctccttcctgccccag

SEQ ID NO: 496559 - DNA, 16 bp, R. norvegicus
ctccttcctgtgtggg

SEQ ID NO: 496560 - DNA, 16 bp, R. norvegicus
ctccttctaaaacctc

SEQ ID NO: 496561 - DNA, 16 bp, R. norvegicus
ctccttctattctgta

SEQ ID NO: 496562 - DNA, 16 bp, R. norvegicus
ctccttctccagcccc

SEQ ID NO: 496563 - DNA, 16 bp, R. norvegicus
ctccttctcccagcag

SEQ ID NO: 496564 - DNA, 16 bp, R. norvegicus
ctccttctcctgcacc

SEQ ID NO: 496565 - DNA, 16 bp, R. norvegicus
ctccttctctggggtc

SEQ ID NO: 496566 - DNA, 16 bp, R. norvegicus
ctccttctgcctcctg

SEQ ID NO: 496567 - DNA, 16 bp, R. norvegicus
ctccttctgtgagcaa

SEQ ID NO: 496568 - DNA, 16 bp, R. norvegicus
ctccttctgttgtctg

SEQ ID NO: 496569 - DNA, 16 bp, R. norvegicus
ctccttctgtttacct

SEQ ID NO: 496570 - DNA, 16 bp, R. norvegicus
ctccttgctggctcct

SEQ ID NO: 496571 - DNA, 16 bp, R. norvegicus
ctccttgcttctctac

SEQ ID NO: 496572 - DNA, 16 bp, R. norvegicus
ctccttggtggtcttt

SEQ ID NO: 496573 - DNA, 16 bp, R. norvegicus
ctccttggttgatttc

SEQ ID NO: 496574 - DNA, 16 bp, R. norvegicus
ctccttgttcagctgt

SEQ ID NO: 496575 - DNA, 16 bp, R. norvegicus
ctcctttaaaaaaatt

SEQ ID NO: 496576 - DNA, 16 bp, R. norvegicus
ctcctttccaagctga

SEQ ID NO: 496577 - DNA, 16 bp, R. norvegicus
ctcctttgtgctgaga

SEQ ID NO: 496578 - DNA, 16 bp, R. norvegicus
ctcctttttcttcagt

SEQ ID NO: 496579 - DNA, 16 bp, R. norvegicus
ctcgctcagcctgctt

SEQ ID NO: 496580 - DNA, 16 bp, R. norvegicus
ctcgctctcgctctca

SEQ ID NO: 496581 - DNA, 16 bp, R. norvegicus
ctcgctggccagccag

SEQ ID NO: 496582 - DNA, 16 bp, R. norvegicus
ctcggagctctggttg

SEQ ID NO: 496583 - DNA, 17 bp, R. norvegicus
ctcggatcccggcccgc

SEQ ID NO: 496584 - DNA, 31 bp, R. norvegicus
ctcggctacatacgatggcaccgaacccaga

SEQ ID NO: 496585 - DNA, 16 bp, R. norvegicus
ctcgggaggaaggagg

SEQ ID NO: 496586 - DNA, 16 bp, R. norvegicus
ctcgggtcctcaggct

SEQ ID NO: 496587 - DNA, 16 bp, R. norvegicus
ctcggtgtggctttaa

SEQ ID NO: 496588 - DNA, 16 bp, R. norvegicus
ctcgtccagaggtcct

SEQ ID NO: 496589 - DNA, 16 bp, R. norvegicus
ctcgtggagacagggg

SEQ ID NO: 496590 - DNA, 16 bp, R. norvegicus
ctctaacaacaaaata

SEQ ID NO: 496591 - DNA, 16 bp, R. norvegicus
ctctaacaccatgtct

SEQ ID NO: 496592 - DNA, 16 bp, R. norvegicus
ctctaacagagcctct

SEQ ID NO: 496593 - DNA, 16 bp, R. norvegicus
ctctaagaccaagaat

SEQ ID NO: 496594 - DNA, 16 bp, R. norvegicus
ctctaagatcaagtat

SEQ ID NO: 496595 - DNA, 16 bp, R. norvegicus
ctctaagatcagcaat

SEQ ID NO: 496596 - DNA, 16 bp, R. norvegicus
ctctaagttcaaggcc

SEQ ID NO: 496597 - DNA, 16 bp, R. norvegicus
ctctaatcccaacact

SEQ ID NO: 496598 - DNA, 16 bp, R. norvegicus
ctctaatcccagcact

SEQ ID NO: 496599 - DNA, 16 bp, R. norvegicus
ctctacaagaagacca

SEQ ID NO: 496600 - DNA, 16 bp, R. norvegicus
ctctacacaaaaggga

SEQ ID NO: 496601 - DNA, 16 bp, R. norvegicus
ctctacacagccctgg

SEQ ID NO: 496602 - DNA, 16 bp, R. norvegicus
ctctacatcctctcca

SEQ ID NO: 496603 - DNA, 16 bp, R. norvegicus
ctctacatcttcacca

SEQ ID NO: 496604 - DNA, 16 bp, R. norvegicus
ctctaccactcagcta

SEQ ID NO: 496605 - DNA, 16 bp, R. norvegicus
ctctaccactgagcca

SEQ ID NO: 496606 - DNA, 24 bp, R. norvegicus
ctctaccactgagctaaatcccca

SEQ ID NO: 496607 - DNA, 24 bp, R. norvegicus
ctctaccactgagctaaatcctca

SEQ ID NO: 496608 - DNA, 21 bp, R. norvegicus
ctctaccactgagctaaatcg

SEQ ID NO: 496609 - DNA, 16 bp, R. norvegicus
ctctaccactgagctt

SEQ ID NO: 496610 - DNA, 16 bp, R. norvegicus
ctctacccactgagcc

SEQ ID NO: 496611 - DNA, 16 bp, R. norvegicus
ctctacccagaagctg

SEQ ID NO: 496612 - DNA, 24 bp, R. norvegicus
ctctaccgctgagctaaatcccca

SEQ ID NO: 496613 - DNA, 16 bp, R. norvegicus
ctctacctccagagtg

SEQ ID NO: 496614 - DNA, 16 bp, R. norvegicus
ctctacctcctgaatg

SEQ ID NO: 496615 - DNA, 16 bp, R. norvegicus
ctctacctgcaggtgg

SEQ ID NO: 496616 - DNA, 16 bp, R. norvegicus
ctctacctgctgagcc

SEQ ID NO: 496617 - DNA, 24 bp, R. norvegicus
ctctactactgagctaaatcccca

SEQ ID NO: 496618 - DNA, 16 bp, R. norvegicus
ctctactatgttcaca

SEQ ID NO: 496619 - DNA, 16 bp, R. norvegicus
ctctactccatctttg

SEQ ID NO: 496620 - DNA, 52 bp, R. norvegicus
ctctacttcagacagcagctgcatgaagcaaacacacacctgtctgaacatt

SEQ ID NO: 496621 - DNA, 16 bp, R. norvegicus
ctctacttcccagaga

SEQ ID NO: 496622 - DNA, 16 bp, R. norvegicus
ctctacttcctgagtg

SEQ ID NO: 496623 - DNA, 16 bp, R. norvegicus
ctctagaagagcagaa

SEQ ID NO: 496624 - DNA, 16 bp, R. norvegicus
ctctagagaaacagaa

SEQ ID NO: 496625 - DNA, 16 bp, R. norvegicus
ctctagcagagcctct

SEQ ID NO: 496626 - DNA, 16 bp, R. norvegicus
ctctagctccagagga

SEQ ID NO: 496627 - DNA, 16 bp, R. norvegicus
ctctagctccagggga

SEQ ID NO: 496628 - DNA, 16 bp, R. norvegicus
ctctagctgtcctgga

SEQ ID NO: 496629 - DNA, 16 bp, R. norvegicus
ctctagctgtgtctct

SEQ ID NO: 496630 - DNA, 16 bp, R. norvegicus
ctctaggacatgccag

SEQ ID NO: 496631 - DNA, 16 bp, R. norvegicus
ctctaggtgtttctca

SEQ ID NO: 496632 - DNA, 16 bp, R. norvegicus
ctctagtttgtgttaa

SEQ ID NO: 496633 - DNA, 16 bp, R. norvegicus
ctctatactgtgttct

SEQ ID NO: 496634 - DNA, 16 bp, R. norvegicus
ctctatctgttgtaag

SEQ ID NO: 496635 - DNA, 16 bp, R. norvegicus
ctctatgaatgtgatc

SEQ ID NO: 496636 - DNA, 16 bp, R. norvegicus
ctctatgaattcaagg

SEQ ID NO: 496637 - DNA, 16 bp, R. norvegicus
ctctatgagtctgagg

SEQ ID NO: 496638 - DNA, 17 bp, R. norvegicus
ctctatgagtgttcccc

SEQ ID NO: 496639 - DNA, 16 bp, R. norvegicus
ctctatgattttgttg

SEQ ID NO: 496640 - DNA, 16 bp, R. norvegicus
ctctatggctgctgga

SEQ ID NO: 496641 - DNA, 16 bp, R. norvegicus
ctctatttcttccttg

SEQ ID NO: 496642 - DNA, 16 bp, R. norvegicus
ctctcaaatgttgtgc

SEQ ID NO: 496643 - DNA, 16 bp, R. norvegicus
ctctcaaattcatggc

SEQ ID NO: 496644 - DNA, 16 bp, R. norvegicus
ctctcaacatcaacgg

SEQ ID NO: 496645 - DNA, 16 bp, R. norvegicus
ctctcaacatcaatga

SEQ ID NO: 496646 - DNA, 16 bp, R. norvegicus
ctctcaaccctcacca

SEQ ID NO: 496647 - DNA, 16 bp, R. norvegicus
ctctcaactcctccag

SEQ ID NO: 496648 - DNA, 16 bp, R. norvegicus
ctctcaactgctgaac

SEQ ID NO: 496649 - DNA, 16 bp, R. norvegicus
ctctcaacttcaatgg

SEQ ID NO: 496650 - DNA, 16 bp, R. norvegicus
ctctcaagcatccact

SEQ ID NO: 496651 - DNA, 16 bp, R. norvegicus
ctctcaccatcaagtt

SEQ ID NO: 496652 - DNA, 16 bp, R. norvegicus
ctctcaccatcaggct

SEQ ID NO: 496653 - DNA, 16 bp, R. norvegicus
ctctcacctcctcctg

SEQ ID NO: 496654 - DNA, 16 bp, R. norvegicus
ctctcactaggctatt

SEQ ID NO: 496655 - DNA, 16 bp, R. norvegicus
ctctcactcactctca

SEQ ID NO: 496656 - DNA, 16 bp, R. norvegicus
ctctcactgaacctgg

SEQ ID NO: 496657 - DNA, 16 bp, R. norvegicus
ctctcactgggatctg

SEQ ID NO: 496658 - DNA, 16 bp, R. norvegicus
ctctcactgtcttcct

SEQ ID NO: 496659 - DNA, 16 bp, R. norvegicus
ctctcagaagacaccc

SEQ ID NO: 496660 - DNA, 16 bp, R. norvegicus
ctctcagaagacagcc

SEQ ID NO: 496661 - DNA, 16 bp, R. norvegicus
ctctcagaagacatct

SEQ ID NO: 496662 - DNA, 16 bp, R. norvegicus
ctctcagaagagaaag

SEQ ID NO: 496663 - DNA, 16 bp, R. norvegicus
ctctcagaagccagaa

SEQ ID NO: 496664 - DNA, 16 bp, R. norvegicus
ctctcagaccaccacg

SEQ ID NO: 496665 - DNA, 16 bp, R. norvegicus
ctctcagagaagggga

SEQ ID NO: 496666 - DNA, 16 bp, R. norvegicus
ctctcagaggagaaga

SEQ ID NO: 496667 - DNA, 16 bp, R. norvegicus
ctctcagatattctgt

SEQ ID NO: 496668 - DNA, 16 bp, R. norvegicus
ctctcagatgctggga

SEQ ID NO: 496669 - DNA, 16 bp, R. norvegicus
ctctcagcaaagcaaa

SEQ ID NO: 496670 - DNA, 16 bp, R. norvegicus
ctctcagcactgggga

SEQ ID NO: 496671 - DNA, 16 bp, R. norvegicus
ctctcagcagtggaca

SEQ ID NO: 496672 - DNA, 16 bp, R. norvegicus
ctctcagccaaccatt

SEQ ID NO: 496673 - DNA, 16 bp, R. norvegicus
ctctcagccccttctc

SEQ ID NO: 496674 - DNA, 16 bp, R. norvegicus
ctctcagctcagcctg

SEQ ID NO: 496675 - DNA, 16 bp, R. norvegicus
ctctcagctcccgaag

SEQ ID NO: 496676 - DNA, 16 bp, R. norvegicus
ctctcagctcctgctc

SEQ ID NO: 496677 - DNA, 16 bp, R. norvegicus
ctctcagctgctgagc

SEQ ID NO: 496678 - DNA, 16 bp, R. norvegicus
ctctcagctgcttgtt

SEQ ID NO: 496679 - DNA, 16 bp, R. norvegicus
ctctcagctgttcctg

SEQ ID NO: 496680 - DNA, 16 bp, R. norvegicus
ctctcagcttcctctc

SEQ ID NO: 496681 - DNA, 16 bp, R. norvegicus
ctctcagcttctctag

SEQ ID NO: 496682 - DNA, 16 bp, R. norvegicus
ctctcagcttcttctc

SEQ ID NO: 496683 - DNA, 16 bp, R. norvegicus
ctctcaggagaaagct

SEQ ID NO: 496684 - DNA, 16 bp, R. norvegicus
ctctcaggagacacac

SEQ ID NO: 496685 - DNA, 16 bp, R. norvegicus
ctctcaggagacagcc

SEQ ID NO: 496686 - DNA, 16 bp, R. norvegicus
ctctcagggccctagc

SEQ ID NO: 496687 - DNA, 16 bp, R. norvegicus
ctctcagtatcaatgg

SEQ ID NO: 496688 - DNA, 16 bp, R. norvegicus
ctctcagttcctcctc

SEQ ID NO: 496689 - DNA, 16 bp, R. norvegicus
ctctcatgagaacagc

SEQ ID NO: 496690 - DNA, 16 bp, R. norvegicus
ctctcatgctcttctc

SEQ ID NO: 496691 - DNA, 16 bp, R. norvegicus
ctctcatgttcatgga

SEQ ID NO: 496692 - DNA, 16 bp, R. norvegicus
ctctcattctctgcac

SEQ ID NO: 496693 - DNA, 16 bp, R. norvegicus
ctctcattctctttgt

SEQ ID NO: 496694 - DNA, 16 bp, R. norvegicus
ctctccaaaatggctt

SEQ ID NO: 496695 - DNA, 16 bp, R. norvegicus
ctctccaattagtttg

SEQ ID NO: 496696 - DNA, 16 bp, R. norvegicus
ctctccaatttcttca

SEQ ID NO: 496697 - DNA, 16 bp, R. norvegicus
ctctccacagatgctt

SEQ ID NO: 496698 - DNA, 16 bp, R. norvegicus
ctctccagaggtcctg

SEQ ID NO: 496699 - DNA, 16 bp, R. norvegicus
ctctccagagtgctgc

SEQ ID NO: 496700 - DNA, 16 bp, R. norvegicus
ctctccagcacccaca

SEQ ID NO: 496701 - DNA, 16 bp, R. norvegicus
ctctccagcccaaaag

SEQ ID NO: 496702 - DNA, 16 bp, R. norvegicus
ctctccagcccaagca

SEQ ID NO: 496703 - DNA, 16 bp, R. norvegicus
ctctccagcccagccc

SEQ ID NO: 496704 - DNA, 16 bp, R. norvegicus
ctctccagcccagtca

SEQ ID NO: 496705 - DNA, 16 bp, R. norvegicus
ctctccagcccagtcc

SEQ ID NO: 496706 - DNA, 16 bp, R. norvegicus
ctctccagcccatgga

SEQ ID NO: 496707 - DNA, 16 bp, R. norvegicus
ctctccagcccattgt

SEQ ID NO: 496708 - DNA, 16 bp, R. norvegicus
ctctccagccccaagc

SEQ ID NO: 496709 - DNA, 16 bp, R. norvegicus
ctctccagccccacct

SEQ ID NO: 496710 - DNA, 16 bp, R. norvegicus
ctctccagccccagtc

SEQ ID NO: 496711 - DNA, 16 bp, R. norvegicus
ctctccagccccccaa

SEQ ID NO: 496712 - DNA, 16 bp, R. norvegicus
ctctccagccccccag

SEQ ID NO: 496713 - DNA, 16 bp, R. norvegicus
ctctccagccccctac

SEQ ID NO: 496714 - DNA, 16 bp, R. norvegicus
ctctccagccccgtgg

SEQ ID NO: 496715 - DNA, 16 bp, R. norvegicus
ctctccagcccctcaa

SEQ ID NO: 496716 - DNA, 16 bp, R. norvegicus
ctctccagcccctgct

SEQ ID NO: 496717 - DNA, 16 bp, R. norvegicus
ctctccagcccctgta

SEQ ID NO: 496718 - DNA, 16 bp, R. norvegicus
ctctccagcccgacag

SEQ ID NO: 496719 - DNA, 16 bp, R. norvegicus
ctctccagccctaaat

SEQ ID NO: 496720 - DNA, 16 bp, R. norvegicus
ctctccagccctacct

SEQ ID NO: 496721 - DNA, 16 bp, R. norvegicus
ctctccagccctagaa

SEQ ID NO: 496722 - DNA, 16 bp, R. norvegicus
ctctccagccctccct

SEQ ID NO: 496723 - DNA, 16 bp, R. norvegicus
ctctccagccctctct

SEQ ID NO: 496724 - DNA, 16 bp, R. norvegicus
ctctccagccctgtgg

SEQ ID NO: 496725 - DNA, 16 bp, R. norvegicus
ctctccagcccttcca

SEQ ID NO: 496726 - DNA, 16 bp, R. norvegicus
ctctccagcctcccag

SEQ ID NO: 496727 - DNA, 16 bp, R. norvegicus
ctctccagcctcctcc

SEQ ID NO: 496728 - DNA, 16 bp, R. norvegicus
ctctccagctccacat

SEQ ID NO: 496729 - DNA, 16 bp, R. norvegicus
ctctccagctcccagc

SEQ ID NO: 496730 - DNA, 16 bp, R. norvegicus
ctctccagctcctctc

SEQ ID NO: 496731 - DNA, 16 bp, R. norvegicus
ctctccagctccttca

SEQ ID NO: 496732 - DNA, 16 bp, R. norvegicus
ctctccagctcctttc

SEQ ID NO: 496733 - DNA, 16 bp, R. norvegicus
ctctccagctcttctc

SEQ ID NO: 496734 - DNA, 16 bp, R. norvegicus
ctctccaggccctgct

SEQ ID NO: 496735 - DNA, 16 bp, R. norvegicus
ctctccagtcccaaat

SEQ ID NO: 496736 - DNA, 16 bp, R. norvegicus
ctctccagtcccagca

SEQ ID NO: 496737 - DNA, 16 bp, R. norvegicus
ctctccagtcccagga

SEQ ID NO: 496738 - DNA, 16 bp, R. norvegicus
ctctcccacgggattt

SEQ ID NO: 496739 - DNA, 16 bp, R. norvegicus
ctctcccactgatgcc

SEQ ID NO: 496740 - DNA, 16 bp, R. norvegicus
ctctcccctgctcacc

SEQ ID NO: 496741 - DNA, 16 bp, R. norvegicus
ctctccctcccaaggg

SEQ ID NO: 496742 - DNA, 16 bp, R. norvegicus
ctctccctctctcaga

SEQ ID NO: 496743 - DNA, 16 bp, R. norvegicus
ctctccctgagcctgg

SEQ ID NO: 496744 - DNA, 16 bp, R. norvegicus
ctctccctgctgcctg

SEQ ID NO: 496745 - DNA, 16 bp, R. norvegicus
ctctccctgctgggag

SEQ ID NO: 496746 - DNA, 16 bp, R. norvegicus
ctctccgaggcagcag

SEQ ID NO: 496747 - DNA, 16 bp, R. norvegicus
ctctcctaccaccatg

SEQ ID NO: 496748 - DNA, 16 bp, R. norvegicus
ctctcctcagagtccc

SEQ ID NO: 496749 - DNA, 16 bp, R. norvegicus
ctctcctcagcttctt

SEQ ID NO: 496750 - DNA, 16 bp, R. norvegicus
ctctcctcccagtgca

SEQ ID NO: 496751 - DNA, 16 bp, R. norvegicus
ctctcctcctgttgat

SEQ ID NO: 496752 - DNA, 16 bp, R. norvegicus
ctctcctctgcccagc

SEQ ID NO: 496753 - DNA, 16 bp, R. norvegicus
ctctcctgagacacac

SEQ ID NO: 496754 - DNA, 16 bp, R. norvegicus
ctctcctgctcccatg

SEQ ID NO: 496755 - DNA, 16 bp, R. norvegicus
ctctcctggcctccat

SEQ ID NO: 496756 - DNA, 16 bp, R. norvegicus
ctctcctggtccaccc

SEQ ID NO: 496757 - DNA, 16 bp, R. norvegicus
ctctcctgtaataaaa

SEQ ID NO: 496758 - DNA, 16 bp, R. norvegicus
ctctcctgtctctgtg

SEQ ID NO: 496759 - DNA, 16 bp, R. norvegicus
ctctccttcagtctct

SEQ ID NO: 496760 - DNA, 16 bp, R. norvegicus
ctctccttcagttcct

SEQ ID NO: 496761 - DNA, 16 bp, R. norvegicus
ctctccttccaccaag

SEQ ID NO: 496762 - DNA, 16 bp, R. norvegicus
ctctccttccaccagg

SEQ ID NO: 496763 - DNA, 16 bp, R. norvegicus
ctctccttgctgcctg

SEQ ID NO: 496764 - DNA, 16 bp, R. norvegicus
ctctcctttcactatg

SEQ ID NO: 496765 - DNA, 16 bp, R. norvegicus
ctctcggggctgggga

SEQ ID NO: 496766 - DNA, 16 bp, R. norvegicus
ctctctacccagagcc

SEQ ID NO: 496767 - DNA, 16 bp, R. norvegicus
ctctctacctggagcc

SEQ ID NO: 496768 - DNA, 16 bp, R. norvegicus
ctctctatctctgtct

SEQ ID NO: 496769 - DNA, 16 bp, R. norvegicus
ctctctcacacacaca

SEQ ID NO: 496770 - DNA, 16 bp, R. norvegicus
ctctctcaccagttct

SEQ ID NO: 496771 - DNA, 16 bp, R. norvegicus
ctctctcagaggtcct

SEQ ID NO: 496772 - DNA, 16 bp, R. norvegicus
ctctctcagcatctaa

SEQ ID NO: 496773 - DNA, 16 bp, R. norvegicus
ctctctcagctgcttg

SEQ ID NO: 496774 - DNA, 16 bp, R. norvegicus
ctctctcaggctcctc

SEQ ID NO: 496775 - DNA, 16 bp, R. norvegicus
ctctctccccacagga

SEQ ID NO: 496776 - DNA, 16 bp, R. norvegicus
ctctctccccagccct

SEQ ID NO: 496777 - DNA, 16 bp, R. norvegicus
ctctctccctcccaag

SEQ ID NO: 496778 - DNA, 16 bp, R. norvegicus
ctctctcctccacagg

SEQ ID NO: 496779 - DNA, 16 bp, R. norvegicus
ctctctcctgctgcct

SEQ ID NO: 496780 - DNA, 17 bp, R. norvegicus
ctctctctcacacacac

SEQ ID NO: 496781 - DNA, 16 bp, R. norvegicus
ctctctctcccctgtg

SEQ ID NO: 496782 - DNA, 16 bp, R. norvegicus
ctctctctctcctgac

SEQ ID NO: 496783 - DNA, 16 bp, R. norvegicus
ctctctctctccttgg

SEQ ID NO: 496784 - DNA, 16 bp, R. norvegicus
ctctctctctctcatg

SEQ ID NO: 496785 - DNA, 16 bp, R. norvegicus
ctctctctctctccag

SEQ ID NO: 496786 - DNA, 16 bp, R. norvegicus
ctctctctctgaaaat

SEQ ID NO: 496787 - DNA, 16 bp, R. norvegicus
ctctctctctgaattt

SEQ ID NO: 496788 - DNA, 16 bp, R. norvegicus
ctctctctctgcattg

SEQ ID NO: 496789 - DNA, 16 bp, R. norvegicus
ctctctctctgcctgc

SEQ ID NO: 496790 - DNA, 16 bp, R. norvegicus
ctctctctctgtccac

SEQ ID NO: 496791 - DNA, 16 bp, R. norvegicus
ctctctctctgtctca

SEQ ID NO: 496792 - DNA, 16 bp, R. norvegicus
ctctctctctgtctgc

SEQ ID NO: 496793 - DNA, 16 bp, R. norvegicus
ctctctctctgtgctg

SEQ ID NO: 496794 - DNA, 16 bp, R. norvegicus
ctctctctctgtgtct

SEQ ID NO: 496795 - DNA, 16 bp, R. norvegicus
ctctctctgcatcctg

SEQ ID NO: 496796 - DNA, 16 bp, R. norvegicus
ctctctctgcctgtgg

SEQ ID NO: 496797 - DNA, 16 bp, R. norvegicus
ctctctctgctctgtg

SEQ ID NO: 496798 - DNA, 16 bp, R. norvegicus
ctctctctgcttcctg

SEQ ID NO: 496799 - DNA, 16 bp, R. norvegicus
ctctctctgtctctca

SEQ ID NO: 496800 - DNA, 16 bp, R. norvegicus
ctctctctttcccaga

SEQ ID NO: 496801 - DNA, 16 bp, R. norvegicus
ctctctcttttccaga

SEQ ID NO: 496802 - DNA, 16 bp, R. norvegicus
ctctctctttttaaaa

SEQ ID NO: 496803 - DNA, 16 bp, R. norvegicus
ctctctgaacctcagt

SEQ ID NO: 496804 - DNA, 16 bp, R. norvegicus
ctctctgaagaattga

SEQ ID NO: 496805 - DNA, 16 bp, R. norvegicus
ctctctgaccctctgt

SEQ ID NO: 496806 - DNA, 16 bp, R. norvegicus
ctctctgactctcttt

SEQ ID NO: 496807 - DNA, 16 bp, R. norvegicus
ctctctgagccctgca

SEQ ID NO: 496808 - DNA, 16 bp, R. norvegicus
ctctctgagcctggca

SEQ ID NO: 496809 - DNA, 16 bp, R. norvegicus
ctctctgagtttgaga

SEQ ID NO: 496810 - DNA, 16 bp, R. norvegicus
ctctctgatgactcta

SEQ ID NO: 496811 - DNA, 16 bp, R. norvegicus
ctctctgatggctcta

SEQ ID NO: 496812 - DNA, 16 bp, R. norvegicus
ctctctgcacatctac

SEQ ID NO: 496813 - DNA, 16 bp, R. norvegicus
ctctctgcagaccagg

SEQ ID NO: 496814 - DNA, 16 bp, R. norvegicus
ctctctgcccagctct

SEQ ID NO: 496815 - DNA, 16 bp, R. norvegicus
ctctctgcctatggat

SEQ ID NO: 496816 - DNA, 16 bp, R. norvegicus
ctctctgcctcccacc

SEQ ID NO: 496817 - DNA, 16 bp, R. norvegicus
ctctctgcctccttca

SEQ ID NO: 496818 - DNA, 16 bp, R. norvegicus
ctctctgcctctctca

SEQ ID NO: 496819 - DNA, 16 bp, R. norvegicus
ctctctgcctctgtcc

SEQ ID NO: 496820 - DNA, 16 bp, R. norvegicus
ctctctgcctttgtct

SEQ ID NO: 496821 - DNA, 16 bp, R. norvegicus
ctctctgctcacagac

SEQ ID NO: 496822 - DNA, 16 bp, R. norvegicus
ctctctgctgtgctcc

SEQ ID NO: 496823 - DNA, 16 bp, R. norvegicus
ctctctgcttcctgtc

SEQ ID NO: 496824 - DNA, 16 bp, R. norvegicus
ctctctgcttctctgt

SEQ ID NO: 496825 - DNA, 16 bp, R. norvegicus
ctctctgcttgctgct

SEQ ID NO: 496826 - DNA, 16 bp, R. norvegicus
ctctctgctttctgat

SEQ ID NO: 496827 - DNA, 16 bp, R. norvegicus
ctctctggcctccaca

SEQ ID NO: 496828 - DNA, 16 bp, R. norvegicus
ctctctggctctctgt

SEQ ID NO: 496829 - DNA, 16 bp, R. norvegicus
ctctctgggtctgggt

SEQ ID NO: 496830 - DNA, 16 bp, R. norvegicus
ctctctgtatctttct

SEQ ID NO: 496831 - DNA, 16 bp, R. norvegicus
ctctctgtccttcctg

SEQ ID NO: 496832 - DNA, 16 bp, R. norvegicus
ctctctgtctgtatcc

SEQ ID NO: 496833 - DNA, 16 bp, R. norvegicus
ctctctgtctgtctgt

SEQ ID NO: 496834 - DNA, 16 bp, R. norvegicus
ctctctgtgagggcgg

SEQ ID NO: 496835 - DNA, 16 bp, R. norvegicus
ctctctgtgcctggct

SEQ ID NO: 496836 - DNA, 16 bp, R. norvegicus
ctctctgtgcttcctg

SEQ ID NO: 496837 - DNA, 16 bp, R. norvegicus
ctctctgtgtctttgt

SEQ ID NO: 496838 - DNA, 16 bp, R. norvegicus
ctctcttaaatccaaa

SEQ ID NO: 496839 - DNA, 16 bp, R. norvegicus
ctctcttactgtggac

SEQ ID NO: 496840 - DNA, 16 bp, R. norvegicus
ctctcttcaaacacac

SEQ ID NO: 496841 - DNA, 16 bp, R. norvegicus
ctctcttcaccatgga

SEQ ID NO: 496842 - DNA, 16 bp, R. norvegicus
ctctcttccataccta

SEQ ID NO: 496843 - DNA, 16 bp, R. norvegicus
ctctcttcccagcccc

SEQ ID NO: 496844 - DNA, 16 bp, R. norvegicus
ctctcttcctcctgta

SEQ ID NO: 496845 - DNA, 16 bp, R. norvegicus
ctctcttcctgatgcc

SEQ ID NO: 496846 - DNA, 16 bp, R. norvegicus
ctctcttcctgctctg

SEQ ID NO: 496847 - DNA, 16 bp, R. norvegicus
ctctcttcctgctgct

SEQ ID NO: 496848 - DNA, 16 bp, R. norvegicus
ctctcttcctgtctgt

SEQ ID NO: 496849 - DNA, 16 bp, R. norvegicus
ctctcttctttctaaa

SEQ ID NO: 496850 - DNA, 16 bp, R. norvegicus
ctctcttgaaaaacaa

SEQ ID NO: 496851 - DNA, 16 bp, R. norvegicus
ctctctttccctgtgt

SEQ ID NO: 496852 - DNA, 16 bp, R. norvegicus
ctctctttcctctgtg

SEQ ID NO: 496853 - DNA, 16 bp, R. norvegicus
ctctctttgcaacaga

SEQ ID NO: 496854 - DNA, 16 bp, R. norvegicus
ctctgaaaaaaaaaag

SEQ ID NO: 496855 - DNA, 16 bp, R. norvegicus
ctctgaaaaacagaaa

SEQ ID NO: 496856 - DNA, 16 bp, R. norvegicus
ctctgaaaactggaga

SEQ ID NO: 496857 - DNA, 16 bp, R. norvegicus
ctctgaaaagtctcca

SEQ ID NO: 496858 - DNA, 16 bp, R. norvegicus
ctctgaaactgggagc

SEQ ID NO: 496859 - DNA, 16 bp, R. norvegicus
ctctgaaccactgagc

SEQ ID NO: 496860 - DNA, 16 bp, R. norvegicus
ctctgaacccagagct

SEQ ID NO: 496861 - DNA, 16 bp, R. norvegicus
ctctgaagaaattgaa

SEQ ID NO: 496862 - DNA, 16 bp, R. norvegicus
ctctgaagaaggaaat

SEQ ID NO: 496863 - DNA, 16 bp, R. norvegicus
ctctgaagacaaaagt

SEQ ID NO: 496864 - DNA, 16 bp, R. norvegicus
ctctgaagacagaggc

SEQ ID NO: 496865 - DNA, 16 bp, R. norvegicus
ctctgaagagcagtca

SEQ ID NO: 496866 - DNA, 16 bp, R. norvegicus
ctctgaagatcctcct

SEQ ID NO: 496867 - DNA, 16 bp, R. norvegicus
ctctgaaggtttgata

SEQ ID NO: 496868 - DNA, 16 bp, R. norvegicus
ctctgaagttctctct

SEQ ID NO: 496869 - DNA, 16 bp, R. norvegicus
ctctgaatccttcaat

SEQ ID NO: 496870 - DNA, 16 bp, R. norvegicus
ctctgaatgtgtaagc

SEQ ID NO: 496871 - DNA, 16 bp, R. norvegicus
ctctgaatttgtcatg

SEQ ID NO: 496872 - DNA, 16 bp, R. norvegicus
ctctgacaccagagga

SEQ ID NO: 496873 - DNA, 16 bp, R. norvegicus
ctctgaccccataagt

SEQ ID NO: 496874 - DNA, 16 bp, R. norvegicus
ctctgaccccattggt

SEQ ID NO: 496875 - DNA, 16 bp, R. norvegicus
ctctgacctcatagtt

SEQ ID NO: 496876 - DNA, 16 bp, R. norvegicus
ctctgacctccaaaca

SEQ ID NO: 496877 - DNA, 16 bp, R. norvegicus
ctctgacctccaaata

SEQ ID NO: 496878 - DNA, 16 bp, R. norvegicus
ctctgacctctacatg

SEQ ID NO: 496879 - DNA, 16 bp, R. norvegicus
ctctgacctctacctg

SEQ ID NO: 496880 - DNA, 16 bp, R. norvegicus
ctctgacctctccaca

SEQ ID NO: 496881 - DNA, 16 bp, R. norvegicus
ctctgacctctgagag

SEQ ID NO: 496882 - DNA, 16 bp, R. norvegicus
ctctgacctctgcctc

SEQ ID NO: 496883 - DNA, 16 bp, R. norvegicus
ctctgacctgtaagcc

SEQ ID NO: 496884 - DNA, 16 bp, R. norvegicus
ctctgactccttcaac

SEQ ID NO: 496885 - DNA, 16 bp, R. norvegicus
ctctgactccttcaat

SEQ ID NO: 496886 - DNA, 16 bp, R. norvegicus
ctctgactctgactct

SEQ ID NO: 496887 - DNA, 16 bp, R. norvegicus
ctctgactctttctct

SEQ ID NO: 496888 - DNA, 16 bp, R. norvegicus
ctctgactgagcctct

SEQ ID NO: 496889 - DNA, 16 bp, R. norvegicus
ctctgactgtggtgat

SEQ ID NO: 496890 - DNA, 16 bp, R. norvegicus
ctctgagaagtggggt

SEQ ID NO: 496891 - DNA, 27 bp, R. norvegicus
ctctgagaatggaatcttagattcaga

SEQ ID NO: 496892 - DNA, 16 bp, R. norvegicus
ctctgagaccagcctg

SEQ ID NO: 496893 - DNA, 16 bp, R. norvegicus
ctctgagagacacagc

SEQ ID NO: 496894 - DNA, 16 bp, R. norvegicus
ctctgagagcctcaag

SEQ ID NO: 496895 - DNA, 16 bp, R. norvegicus
ctctgagagctctggg

SEQ ID NO: 496896 - DNA, 16 bp, R. norvegicus
ctctgagatcaagaat

SEQ ID NO: 496897 - DNA, 16 bp, R. norvegicus
ctctgagccctgcagc

SEQ ID NO: 496898 - DNA, 16 bp, R. norvegicus
ctctgagcctctctcc

SEQ ID NO: 496899 - DNA, 16 bp, R. norvegicus
ctctgagcctctgttt

SEQ ID NO: 496900 - DNA, 16 bp, R. norvegicus
ctctgagctccaggcc

SEQ ID NO: 496901 - DNA, 16 bp, R. norvegicus
ctctgaggaagaggat

SEQ ID NO: 496902 - DNA, 16 bp, R. norvegicus
ctctgaggagaaggag

SEQ ID NO: 496903 - DNA, 16 bp, R. norvegicus
ctctgaggagacagac

SEQ ID NO: 496904 - DNA, 16 bp, R. norvegicus
ctctgaggctgagact

SEQ ID NO: 496905 - DNA, 16 bp, R. norvegicus
ctctgagggcctgcag

SEQ ID NO: 496906 - DNA, 16 bp, R. norvegicus
ctctgaggggctggaa

SEQ ID NO: 496907 - DNA, 16 bp, R. norvegicus
ctctgaggtggcagca

SEQ ID NO: 496908 - DNA, 16 bp, R. norvegicus
ctctgagtcccagcct

SEQ ID NO: 496909 - DNA, 16 bp, R. norvegicus
ctctgagtgccagcag

SEQ ID NO: 496910 - DNA, 16 bp, R. norvegicus
ctctgagtgcctgcaa

SEQ ID NO: 496911 - DNA, 16 bp, R. norvegicus
ctctgagttcattgtg

SEQ ID NO: 496912 - DNA, 16 bp, R. norvegicus
ctctgagttgtgtttc

SEQ ID NO: 496913 - DNA, 16 bp, R. norvegicus
ctctgagtttaaggac

SEQ ID NO: 496914 - DNA, 16 bp, R. norvegicus
ctctgagtttgacttt

SEQ ID NO: 496915 - DNA, 16 bp, R. norvegicus
ctctgagttttaagga

SEQ ID NO: 496916 - DNA, 16 bp, R. norvegicus
ctctgagttttcagga

SEQ ID NO: 496917 - DNA, 16 bp, R. norvegicus
ctctgatcctgggcat

SEQ ID NO: 496918 - DNA, 16 bp, R. norvegicus
ctctgatgatgacaag

SEQ ID NO: 496919 - DNA, 16 bp, R. norvegicus
ctctgatgcttttgaa

SEQ ID NO: 496920 - DNA, 16 bp, R. norvegicus
ctctgatgtcttcttc

SEQ ID NO: 496921 - DNA, 16 bp, R. norvegicus
ctctgattctgttttt

SEQ ID NO: 496922 - DNA, 16 bp, R. norvegicus
ctctgcaaaagcagcc

SEQ ID NO: 496923 - DNA, 16 bp, R. norvegicus
ctctgcacccagaccc

SEQ ID NO: 496924 - DNA, 16 bp, R. norvegicus
ctctgcactcccagcc

SEQ ID NO: 496925 - DNA, 16 bp, R. norvegicus
ctctgcagacaccagg

SEQ ID NO: 496926 - DNA, 16 bp, R. norvegicus
ctctgcagatttgcag

SEQ ID NO: 496927 - DNA, 16 bp, R. norvegicus
ctctgcagcagcagca

SEQ ID NO: 496928 - DNA, 16 bp, R. norvegicus
ctctgcagcccaggct

SEQ ID NO: 496929 - DNA, 16 bp, R. norvegicus
ctctgcagccctggct

SEQ ID NO: 496930 - DNA, 16 bp, R. norvegicus
ctctgcagcctcagaa

SEQ ID NO: 496931 - DNA, 16 bp, R. norvegicus
ctctgcagcctcagca

SEQ ID NO: 496932 - DNA, 17 bp, R. norvegicus
ctctgcagcctcaggaa

SEQ ID NO: 496933 - DNA, 28 bp, R. norvegicus
ctctgcagcctcaggagtgcccacctga

SEQ ID NO: 496934 - DNA, 16 bp, R. norvegicus
ctctgcagcctcagta

SEQ ID NO: 496935 - DNA, 16 bp, R. norvegicus
ctctgcagcctctgga

SEQ ID NO: 496936 - DNA, 16 bp, R. norvegicus
ctctgcagcggcagct

SEQ ID NO: 496937 - DNA, 16 bp, R. norvegicus
ctctgcagcttcagga

SEQ ID NO: 496938 - DNA, 16 bp, R. norvegicus
ctctgcaggcactagg

SEQ ID NO: 496939 - DNA, 16 bp, R. norvegicus
ctctgcaggttctccc

SEQ ID NO: 496940 - DNA, 16 bp, R. norvegicus
ctctgcagtctcaaga

SEQ ID NO: 496941 - DNA, 16 bp, R. norvegicus
ctctgcatcagttcct

SEQ ID NO: 496942 - DNA, 16 bp, R. norvegicus
ctctgcatcggctcct

SEQ ID NO: 496943 - DNA, 16 bp, R. norvegicus
ctctgcatctgtttcc

SEQ ID NO: 496944 - DNA, 16 bp, R. norvegicus
ctctgcatcttcatgt

SEQ ID NO: 496945 - DNA, 16 bp, R. norvegicus
ctctgcatgtatgtta

SEQ ID NO: 496946 - DNA, 16 bp, R. norvegicus
ctctgccactctgcct

SEQ ID NO: 496947 - DNA, 16 bp, R. norvegicus
ctctgccagaacctga

SEQ ID NO: 496948 - DNA, 16 bp, R. norvegicus
ctctgccagaccatga

SEQ ID NO: 496949 - DNA, 16 bp, R. norvegicus
ctctgccagaccctga

SEQ ID NO: 496950 - DNA, 16 bp, R. norvegicus
ctctgccagagactta

SEQ ID NO: 496951 - DNA, 16 bp, R. norvegicus
ctctgccagtacctga

SEQ ID NO: 496952 - DNA, 16 bp, R. norvegicus
ctctgccatctccatg

SEQ ID NO: 496953 - DNA, 16 bp, R. norvegicus
ctctgcccacacatct

SEQ ID NO: 496954 - DNA, 16 bp, R. norvegicus
ctctgcccagcagctg

SEQ ID NO: 496955 - DNA, 16 bp, R. norvegicus
ctctgcccagtgcaga

SEQ ID NO: 496956 - DNA, 16 bp, R. norvegicus
ctctgcccctgagtgc

SEQ ID NO: 496957 - DNA, 16 bp, R. norvegicus
ctctgccctctgctct

SEQ ID NO: 496958 - DNA, 16 bp, R. norvegicus
ctctgccctctggcct

SEQ ID NO: 496959 - DNA, 16 bp, R. norvegicus
ctctgccctgagagga

SEQ ID NO: 496960 - DNA, 16 bp, R. norvegicus
ctctgccctttgtagc

SEQ ID NO: 496961 - DNA, 16 bp, R. norvegicus
ctctgcctcagactct

SEQ ID NO: 496962 - DNA, 16 bp, R. norvegicus
ctctgcctcagcccct

SEQ ID NO: 496963 - DNA, 16 bp, R. norvegicus
ctctgcctcagcctca

SEQ ID NO: 496964 - DNA, 16 bp, R. norvegicus
ctctgcctccaacttg

SEQ ID NO: 496965 - DNA, 16 bp, R. norvegicus
ctctgcctccacagtg

SEQ ID NO: 496966 - DNA, 16 bp, R. norvegicus
ctctgcctcccagctg

SEQ ID NO: 496967 - DNA, 16 bp, R. norvegicus
ctctgcctcccagttc

SEQ ID NO: 496968 - DNA, 16 bp, R. norvegicus
ctctgcctccctgtct

SEQ ID NO: 496969 - DNA, 16 bp, R. norvegicus
ctctgcctcctctcag

SEQ ID NO: 496970 - DNA, 16 bp, R. norvegicus
ctctgcctcctgctgg

SEQ ID NO: 496971 - DNA, 16 bp, R. norvegicus
ctctgcctcctgcttc

SEQ ID NO: 496972 - DNA, 16 bp, R. norvegicus
ctctgcctcctgggtg

SEQ ID NO: 496973 - DNA, 16 bp, R. norvegicus
ctctgcctcggcctct

SEQ ID NO: 496974 - DNA, 16 bp, R. norvegicus
ctctgcctctatctcc

SEQ ID NO: 496975 - DNA, 16 bp, R. norvegicus
ctctgcctctcaagag

SEQ ID NO: 496976 - DNA, 16 bp, R. norvegicus
ctctgcctctcaggag

SEQ ID NO: 496977 - DNA, 16 bp, R. norvegicus
ctctgcctctccagta

SEQ ID NO: 496978 - DNA, 16 bp, R. norvegicus
ctctgcctctctgtgt

SEQ ID NO: 496979 - DNA, 16 bp, R. norvegicus
ctctgcctctgaagtg

SEQ ID NO: 496980 - DNA, 16 bp, R. norvegicus
ctctgcctcttgtgtg

SEQ ID NO: 496981 - DNA, 16 bp, R. norvegicus
ctctgcctgctgcttg

SEQ ID NO: 496982 - DNA, 16 bp, R. norvegicus
ctctgcctgtctctct

SEQ ID NO: 496983 - DNA, 16 bp, R. norvegicus
ctctgcctgtctctgt

SEQ ID NO: 496984 - DNA, 16 bp, R. norvegicus
ctctgcctgtgcccag

SEQ ID NO: 496985 - DNA, 16 bp, R. norvegicus
ctctgcctgtgcctgt

SEQ ID NO: 496986 - DNA, 16 bp, R. norvegicus
ctctgccttccaactg

SEQ ID NO: 496987 - DNA, 16 bp, R. norvegicus
ctctgccttcccagag

SEQ ID NO: 496988 - DNA, 16 bp, R. norvegicus
ctctgccttcccaggg

SEQ ID NO: 496989 - DNA, 16 bp, R. norvegicus
ctctgccttccctgtg

SEQ ID NO: 496990 - DNA, 16 bp, R. norvegicus
ctctgccttccgagtg

SEQ ID NO: 496991 - DNA, 16 bp, R. norvegicus
ctctgccttcctgtct

SEQ ID NO: 496992 - DNA, 16 bp, R. norvegicus
ctctgccttctctgcc

SEQ ID NO: 496993 - DNA, 16 bp, R. norvegicus
ctctgccttctgccct

SEQ ID NO: 496994 - DNA, 16 bp, R. norvegicus
ctctgctacacatcca

SEQ ID NO: 496995 - DNA, 16 bp, R. norvegicus
ctctgctcatgactgg

SEQ ID NO: 496996 - DNA, 16 bp, R. norvegicus
ctctgctccacttttg

SEQ ID NO: 496997 - DNA, 16 bp, R. norvegicus
ctctgctcccaagccc

SEQ ID NO: 496998 - DNA, 16 bp, R. norvegicus
ctctgctcccagactc

SEQ ID NO: 496999 - DNA, 16 bp, R. norvegicus
ctctgctccctggctg

SEQ ID NO: 497000 - DNA, 16 bp, R. norvegicus
ctctgctcctccagca

SEQ ID NO: 497001 - DNA, 16 bp, R. norvegicus
ctctgctcctccccac

SEQ ID NO: 497002 - DNA, 16 bp, R. norvegicus
ctctgctcctgctcct

SEQ ID NO: 497003 - DNA, 16 bp, R. norvegicus
ctctgctctcagatgt

SEQ ID NO: 497004 - DNA, 16 bp, R. norvegicus
ctctgctctctgtctc

SEQ ID NO: 497005 - DNA, 16 bp, R. norvegicus
ctctgctgcaggctgc

SEQ ID NO: 497006 - DNA, 16 bp, R. norvegicus
ctctgctgcatatgca

SEQ ID NO: 497007 - DNA, 16 bp, R. norvegicus
ctctgctgcctcagga

SEQ ID NO: 497008 - DNA, 16 bp, R. norvegicus
ctctgctgctgagcta

SEQ ID NO: 497009 - DNA, 16 bp, R. norvegicus
ctctgctgctggtgct

SEQ ID NO: 497010 - DNA, 16 bp, R. norvegicus
ctctgctgcttctcct

SEQ ID NO: 497011 - DNA, 16 bp, R. norvegicus
ctctgctggcctccac

SEQ ID NO: 497012 - DNA, 16 bp, R. norvegicus
ctctgctggggcttct

SEQ ID NO: 497013 - DNA, 16 bp, R. norvegicus
ctctgctggtcttcct

SEQ ID NO: 497014 - DNA, 16 bp, R. norvegicus
ctctgctggtgtgtct

SEQ ID NO: 497015 - DNA, 16 bp, R. norvegicus
ctctgctgtcctggaa

SEQ ID NO: 497016 - DNA, 16 bp, R. norvegicus
ctctgctgtctgtctg

SEQ ID NO: 497017 - DNA, 16 bp, R. norvegicus
ctctgctgtgtgtgtg

SEQ ID NO: 497018 - DNA, 16 bp, R. norvegicus
ctctgcttccaaaccc

SEQ ID NO: 497019 - DNA, 16 bp, R. norvegicus
ctctgcttcccaactg

SEQ ID NO: 497020 - DNA, 16 bp, R. norvegicus
ctctgcttcccagtgc

SEQ ID NO: 497021 - DNA, 16 bp, R. norvegicus
ctctgcttccccagta

SEQ ID NO: 497022 - DNA, 16 bp, R. norvegicus
ctctgcttcccttcag

SEQ ID NO: 497023 - DNA, 16 bp, R. norvegicus
ctctgcttcctcctca

SEQ ID NO: 497024 - DNA, 16 bp, R. norvegicus
ctctgcttcctcctgc

SEQ ID NO: 497025 - DNA, 16 bp, R. norvegicus
ctctgcttcctgcctg

SEQ ID NO: 497026 - DNA, 16 bp, R. norvegicus
ctctgcttcctgcctt

SEQ ID NO: 497027 - DNA, 16 bp, R. norvegicus
ctctgcttcctgctcc

SEQ ID NO: 497028 - DNA, 16 bp, R. norvegicus
ctctgcttcctgctgc

SEQ ID NO: 497029 - DNA, 16 bp, R. norvegicus
ctctgcttcctgggtg

SEQ ID NO: 497030 - DNA, 16 bp, R. norvegicus
ctctgcttcctgtgat

SEQ ID NO: 497031 - DNA, 16 bp, R. norvegicus
ctctgcttctcctcag

SEQ ID NO: 497032 - DNA, 16 bp, R. norvegicus
ctctgcttctctctgt

SEQ ID NO: 497033 - DNA, 16 bp, R. norvegicus
ctctgcttctgtctct

SEQ ID NO: 497034 - DNA, 16 bp, R. norvegicus
ctctgcttgcctctgc

SEQ ID NO: 497035 - DNA, 16 bp, R. norvegicus
ctctgctttcctagtg

SEQ ID NO: 497036 - DNA, 16 bp, R. norvegicus
ctctgctttctgctct

SEQ ID NO: 497037 - DNA, 16 bp, R. norvegicus
ctctggaaaaaaagaa

SEQ ID NO: 497038 - DNA, 16 bp, R. norvegicus
ctctggaaaaagaaaa

SEQ ID NO: 497039 - DNA, 16 bp, R. norvegicus
ctctggaaagagcagt

SEQ ID NO: 497040 - DNA, 16 bp, R. norvegicus
ctctggaaatcaatat

SEQ ID NO: 497041 - DNA, 16 bp, R. norvegicus
ctctggaaatcaggct

SEQ ID NO: 497042 - DNA, 16 bp, R. norvegicus
ctctggaactggagtc

SEQ ID NO: 497043 - DNA, 16 bp, R. norvegicus
ctctggaagaagagca

SEQ ID NO: 497044 - DNA, 16 bp, R. norvegicus
ctctggaagagcagca

SEQ ID NO: 497045 - DNA, 16 bp, R. norvegicus
ctctggaagagcagct

SEQ ID NO: 497046 - DNA, 16 bp, R. norvegicus
ctctggaagagctgcc

SEQ ID NO: 497047 - DNA, 16 bp, R. norvegicus
ctctggaatcataagc

SEQ ID NO: 497048 - DNA, 16 bp, R. norvegicus
ctctggacagagggat

SEQ ID NO: 497049 - DNA, 16 bp, R. norvegicus
ctctggagaaccctga

SEQ ID NO: 497050 - DNA, 16 bp, R. norvegicus
ctctggagaagcagcc

SEQ ID NO: 497051 - DNA, 16 bp, R. norvegicus
ctctggagacaggtgt

SEQ ID NO: 497052 - DNA, 16 bp, R. norvegicus
ctctggagagctggcc

SEQ ID NO: 497053 - DNA, 16 bp, R. norvegicus
ctctggagaggcagag

SEQ ID NO: 497054 - DNA, 16 bp, R. norvegicus
ctctggagcaagaaga

SEQ ID NO: 497055 - DNA, 16 bp, R. norvegicus
ctctggagctgaggac

SEQ ID NO: 497056 - DNA, 16 bp, R. norvegicus
ctctggagctggagtt

SEQ ID NO: 497057 - DNA, 16 bp, R. norvegicus
ctctggaggagcagcc

SEQ ID NO: 497058 - DNA, 16 bp, R. norvegicus
ctctggaggagcagct

SEQ ID NO: 497059 - DNA, 16 bp, R. norvegicus
ctctggaggagcagtc

SEQ ID NO: 497060 - DNA, 16 bp, R. norvegicus
ctctggaggagcagtt

SEQ ID NO: 497061 - DNA, 16 bp, R. norvegicus
ctctggagggagaggc

SEQ ID NO: 497062 - DNA, 16 bp, R. norvegicus
ctctggagtcagaggc

SEQ ID NO: 497063 - DNA, 16 bp, R. norvegicus
ctctggagtctgactt

SEQ ID NO: 497064 - DNA, 16 bp, R. norvegicus
ctctggagtgctgaga

SEQ ID NO: 497065 - DNA, 16 bp, R. norvegicus
ctctggagtgctggga

SEQ ID NO: 497066 - DNA, 16 bp, R. norvegicus
ctctggcacagcctct

SEQ ID NO: 497067 - DNA, 17 bp, R. norvegicus
ctctggccagaacttca

SEQ ID NO: 497068 - DNA, 16 bp, R. norvegicus
ctctggccccagcagc

SEQ ID NO: 497069 - DNA, 16 bp, R. norvegicus
ctctggcctccaaatg

SEQ ID NO: 497070 - DNA, 16 bp, R. norvegicus
ctctggcctccacaga

SEQ ID NO: 497071 - DNA, 16 bp, R. norvegicus
ctctggcctcccaggc

SEQ ID NO: 497072 - DNA, 16 bp, R. norvegicus
ctctggcctcctctgc

SEQ ID NO: 497073 - DNA, 16 bp, R. norvegicus
ctctggcctctacaca

SEQ ID NO: 497074 - DNA, 16 bp, R. norvegicus
ctctggccttgaactc

SEQ ID NO: 497075 - DNA, 16 bp, R. norvegicus
ctctggctctctggct

SEQ ID NO: 497076 - DNA, 16 bp, R. norvegicus
ctctggctctggctct

SEQ ID NO: 497077 - DNA, 16 bp, R. norvegicus
ctctggctctgtctct

SEQ ID NO: 497078 - DNA, 17 bp, R. norvegicus
ctctggctggggtcctg

SEQ ID NO: 497079 - DNA, 16 bp, R. norvegicus
ctctggctgtcatgga

SEQ ID NO: 497080 - DNA, 16 bp, R. norvegicus
ctctggctgtcctgta

SEQ ID NO: 497081 - DNA, 17 bp, R. norvegicus
ctctggctgtggagctc

SEQ ID NO: 497082 - DNA, 16 bp, R. norvegicus
ctctggctgttctctc

SEQ ID NO: 497083 - DNA, 16 bp, R. norvegicus
ctctggctttgtctct

SEQ ID NO: 497084 - DNA, 16 bp, R. norvegicus
ctctgggaactctgct

SEQ ID NO: 497085 - DNA, 16 bp, R. norvegicus
ctctgggaactctggg

SEQ ID NO: 497086 - DNA, 16 bp, R. norvegicus
ctctgggactcacatg

SEQ ID NO: 497087 - DNA, 16 bp, R. norvegicus
ctctgggagctctgga

SEQ ID NO: 497088 - DNA, 16 bp, R. norvegicus
ctctgggaggcagagg

SEQ ID NO: 497089 - DNA, 16 bp, R. norvegicus
ctctgggccatctctc

SEQ ID NO: 497090 - DNA, 16 bp, R. norvegicus
ctctgggctcccttgg

SEQ ID NO: 497091 - DNA, 16 bp, R. norvegicus
ctctgggctctgtggg

SEQ ID NO: 497092 - DNA, 16 bp, R. norvegicus
ctctgggctgaaatca

SEQ ID NO: 497093 - DNA, 17 bp, R. norvegicus
ctctgggctgcatggcc

SEQ ID NO: 497094 - DNA, 16 bp, R. norvegicus
ctctgggcttgtctgt

SEQ ID NO: 497095 - DNA, 16 bp, R. norvegicus
ctctggggctggagag

SEQ ID NO: 497096 - DNA, 16 bp, R. norvegicus
ctctgggtggctcctg

SEQ ID NO: 497097 - DNA, 16 bp, R. norvegicus
ctctgggttcctgcag

SEQ ID NO: 497098 - DNA, 16 bp, R. norvegicus
ctctgggtttgatctc

SEQ ID NO: 497099 - DNA, 16 bp, R. norvegicus
ctctggtactttccag

SEQ ID NO: 497100 - DNA, 16 bp, R. norvegicus
ctctggtcccctgcat

SEQ ID NO: 497101 - DNA, 16 bp, R. norvegicus
ctctggtggtgtctgg

SEQ ID NO: 497102 - DNA, 16 bp, R. norvegicus
ctctggtgtgtgtgtg

SEQ ID NO: 497103 - DNA, 16 bp, R. norvegicus
ctctggttccagctac

SEQ ID NO: 497104 - DNA, 16 bp, R. norvegicus
ctctggttgtcttgga

SEQ ID NO: 497105 - DNA, 16 bp, R. norvegicus
ctctgtacaaagctca

SEQ ID NO: 497106 - DNA, 16 bp, R. norvegicus
ctctgtagaccaagct

SEQ ID NO: 497107 - DNA, 16 bp, R. norvegicus
ctctgtagatgaggct

SEQ ID NO: 497108 - DNA, 16 bp, R. norvegicus
ctctgtagctccagtt

SEQ ID NO: 497109 - DNA, 16 bp, R. norvegicus
ctctgtatatggtctc

SEQ ID NO: 497110 - DNA, 16 bp, R. norvegicus
ctctgtcagagcagca

SEQ ID NO: 497111 - DNA, 16 bp, R. norvegicus
ctctgtcagatgtgga

SEQ ID NO: 497112 - DNA, 16 bp, R. norvegicus
ctctgtccccacctta

SEQ ID NO: 497113 - DNA, 16 bp, R. norvegicus
ctctgtccctctgtcc

SEQ ID NO: 497114 - DNA, 16 bp, R. norvegicus
ctctgtcctctgccct

SEQ ID NO: 497115 - DNA, 16 bp, R. norvegicus
ctctgtcctctgcctc

SEQ ID NO: 497116 - DNA, 16 bp, R. norvegicus
ctctgtcctgtggttc

SEQ ID NO: 497117 - DNA, 16 bp, R. norvegicus
ctctgtccttcctgct

SEQ ID NO: 497118 - DNA, 16 bp, R. norvegicus
ctctgtccttctgtcc

SEQ ID NO: 497119 - DNA, 16 bp, R. norvegicus
ctctgtctccatcttg

SEQ ID NO: 497120 - DNA, 16 bp, R. norvegicus
ctctgtctccatttct

SEQ ID NO: 497121 - DNA, 16 bp, R. norvegicus
ctctgtctcccaaggg

SEQ ID NO: 497122 - DNA, 16 bp, R. norvegicus
ctctgtctcccaagtg

SEQ ID NO: 497123 - DNA, 16 bp, R. norvegicus
ctctgtctcctaaatg

SEQ ID NO: 497124 - DNA, 16 bp, R. norvegicus
ctctgtctcctcagtg

SEQ ID NO: 497125 - DNA, 16 bp, R. norvegicus
ctctgtctcctgtttc

SEQ ID NO: 497126 - DNA, 16 bp, R. norvegicus
ctctgtctctacctct

SEQ ID NO: 497127 - DNA, 16 bp, R. norvegicus
ctctgtctctactacc

SEQ ID NO: 497128 - DNA, 16 bp, R. norvegicus
ctctgtctctcactca

SEQ ID NO: 497129 - DNA, 16 bp, R. norvegicus
ctctgtctctctcact

SEQ ID NO: 497130 - DNA, 16 bp, R. norvegicus
ctctgtctctgcttcc

SEQ ID NO: 497131 - DNA, 16 bp, R. norvegicus
ctctgtctctggctct

SEQ ID NO: 497132 - DNA, 16 bp, R. norvegicus
ctctgtctctgtatct

SEQ ID NO: 497133 - DNA, 16 bp, R. norvegicus
ctctgtctctgtccct

SEQ ID NO: 497134 - DNA, 16 bp, R. norvegicus
ctctgtctctgttcct

SEQ ID NO: 497135 - DNA, 16 bp, R. norvegicus
ctctgtctctttctca

SEQ ID NO: 497136 - DNA, 16 bp, R. norvegicus
ctctgtctgcatcttc

SEQ ID NO: 497137 - DNA, 16 bp, R. norvegicus
ctctgtctgctgagcc

SEQ ID NO: 497138 - DNA, 16 bp, R. norvegicus
ctctgtctgctgcctg

SEQ ID NO: 497139 - DNA, 16 bp, R. norvegicus
ctctgtctggcctgga

SEQ ID NO: 497140 - DNA, 16 bp, R. norvegicus
ctctgtctgtcttgtg

SEQ ID NO: 497141 - DNA, 16 bp, R. norvegicus
ctctgtcttctctgtc

SEQ ID NO: 497142 - DNA, 16 bp, R. norvegicus
ctctgtctttgttccc

SEQ ID NO: 497143 - DNA, 16 bp, R. norvegicus
ctctgtcttttaaaaa

SEQ ID NO: 497144 - DNA, 16 bp, R. norvegicus
ctctgtgaactcaagg

SEQ ID NO: 497145 - DNA, 16 bp, R. norvegicus
ctctgtgaagccttgg

SEQ ID NO: 497146 - DNA, 16 bp, R. norvegicus
ctctgtgaagctgttc

SEQ ID NO: 497147 - DNA, 16 bp, R. norvegicus
ctctgtgaatttgaag

SEQ ID NO: 497148 - DNA, 16 bp, R. norvegicus
ctctgtgaccttgggc

SEQ ID NO: 497149 - DNA, 16 bp, R. norvegicus
ctctgtgactttgagg

SEQ ID NO: 497150 - DNA, 16 bp, R. norvegicus
ctctgtgagccccatg

SEQ ID NO: 497151 - DNA, 16 bp, R. norvegicus
ctctgtgagcccctct

SEQ ID NO: 497152 - DNA, 16 bp, R. norvegicus
ctctgtgagttcaaga

SEQ ID NO: 497153 - DNA, 16 bp, R. norvegicus
ctctgtgagtttgtgg

SEQ ID NO: 497154 - DNA, 16 bp, R. norvegicus
ctctgtgatgctctgt

SEQ ID NO: 497155 - DNA, 16 bp, R. norvegicus
ctctgtgcagccctgg

SEQ ID NO: 497156 - DNA, 16 bp, R. norvegicus
ctctgtgccctctggt

SEQ ID NO: 497157 - DNA, 16 bp, R. norvegicus
ctctgtgctccacact

SEQ ID NO: 497158 - DNA, 16 bp, R. norvegicus
ctctgtgctcctatgc

SEQ ID NO: 497159 - DNA, 16 bp, R. norvegicus
ctctgtgcttctctgt

SEQ ID NO: 497160 - DNA, 16 bp, R. norvegicus
ctctgtggagccctgg

SEQ ID NO: 497161 - DNA, 16 bp, R. norvegicus
ctctgtggattggctg

SEQ ID NO: 497162 - DNA, 16 bp, R. norvegicus
ctctgtggcagcagca

SEQ ID NO: 497163 - DNA, 16 bp, R. norvegicus
ctctgtggcagcccag

SEQ ID NO: 497164 - DNA, 16 bp, R. norvegicus
ctctgtggcttctcta

SEQ ID NO: 497165 - DNA, 16 bp, R. norvegicus
ctctgtgggcacacac

SEQ ID NO: 497166 - DNA, 16 bp, R. norvegicus
ctctgtgggggcagca

SEQ ID NO: 497167 - DNA, 16 bp, R. norvegicus
ctctgtgggtactgca

SEQ ID NO: 497168 - DNA, 16 bp, R. norvegicus
ctctgtggtctctgtg

SEQ ID NO: 497169 - DNA, 16 bp, R. norvegicus
ctctgtggtggcccag

SEQ ID NO: 497170 - DNA, 16 bp, R. norvegicus
ctctgtggttattcag

SEQ ID NO: 497171 - DNA, 16 bp, R. norvegicus
ctctgtggttgaatta

SEQ ID NO: 497172 - DNA, 16 bp, R. norvegicus
ctctgtgtagccatgg

SEQ ID NO: 497173 - DNA, 16 bp, R. norvegicus
ctctgtgtagtccagg

SEQ ID NO: 497174 - DNA, 16 bp, R. norvegicus
ctctgtgtatcctgaa

SEQ ID NO: 497175 - DNA, 16 bp, R. norvegicus
ctctgtgtccctgtct

SEQ ID NO: 497176 - DNA, 16 bp, R. norvegicus
ctctgtgtcctctcct

SEQ ID NO: 497177 - DNA, 16 bp, R. norvegicus
ctctgtgtctccctgt

SEQ ID NO: 497178 - DNA, 16 bp, R. norvegicus
ctctgtgtctctctgt

SEQ ID NO: 497179 - DNA, 16 bp, R. norvegicus
ctctgtgtcttctctc

SEQ ID NO: 497180 - DNA, 16 bp, R. norvegicus
ctctgtgtgcctgcag

SEQ ID NO: 497181 - DNA, 16 bp, R. norvegicus
ctctgtgtgtgttcat

SEQ ID NO: 497182 - DNA, 16 bp, R. norvegicus
ctctgtgttcagtgag

SEQ ID NO: 497183 - DNA, 16 bp, R. norvegicus
ctctgttccacatttt

SEQ ID NO: 497184 - DNA, 16 bp, R. norvegicus
ctctgttccatcccct

SEQ ID NO: 497185 - DNA, 16 bp, R. norvegicus
ctctgttccatctctt

SEQ ID NO: 497186 - DNA, 16 bp, R. norvegicus
ctctgttcccacctcc

SEQ ID NO: 497187 - DNA, 16 bp, R. norvegicus
ctctgttcccataaca

SEQ ID NO: 497188 - DNA, 16 bp, R. norvegicus
ctctgttcttgtgtct

SEQ ID NO: 497189 - DNA, 16 bp, R. norvegicus
ctctgttgcctgccat

SEQ ID NO: 497190 - DNA, 16 bp, R. norvegicus
ctctgttggtcttcct

SEQ ID NO: 497191 - DNA, 16 bp, R. norvegicus
ctctgtttaatatctg

SEQ ID NO: 497192 - DNA, 16 bp, R. norvegicus
ctctgttttaatctgt

SEQ ID NO: 497193 - DNA, 16 bp, R. norvegicus
ctcttaaaaacaaaca

SEQ ID NO: 497194 - DNA, 16 bp, R. norvegicus
ctcttaaaacacatga

SEQ ID NO: 497195 - DNA, 16 bp, R. norvegicus
ctcttaaacctgataa

SEQ ID NO: 497196 - DNA, 16 bp, R. norvegicus
ctcttaacactgcttt

SEQ ID NO: 497197 - DNA, 16 bp, R. norvegicus
ctcttaacatcaacgg

SEQ ID NO: 497198 - DNA, 16 bp, R. norvegicus
ctcttaactccaactg

SEQ ID NO: 497199 - DNA, 16 bp, R. norvegicus
ctcttaatgtcaatgg

SEQ ID NO: 497200 - DNA, 16 bp, R. norvegicus
ctcttaccatctggtt

SEQ ID NO: 497201 - DNA, 16 bp, R. norvegicus
ctcttacccattgagc

SEQ ID NO: 497202 - DNA, 16 bp, R. norvegicus
ctcttagcactgattt

SEQ ID NO: 497203 - DNA, 16 bp, R. norvegicus
ctcttagcactgctgt

SEQ ID NO: 497204 - DNA, 16 bp, R. norvegicus
ctcttagcagctgccc

SEQ ID NO: 497205 - DNA, 16 bp, R. norvegicus
ctcttagccaaactaa

SEQ ID NO: 497206 - DNA, 16 bp, R. norvegicus
ctcttatcaatggaca

SEQ ID NO: 497207 - DNA, 17 bp, R. norvegicus
ctcttatcaggttcaag

SEQ ID NO: 497208 - DNA, 16 bp, R. norvegicus
ctcttcaagaggacct

SEQ ID NO: 497209 - DNA, 16 bp, R. norvegicus
ctcttcacagcagcag

SEQ ID NO: 497210 - DNA, 16 bp, R. norvegicus
ctcttcagacacacca

SEQ ID NO: 497211 - DNA, 16 bp, R. norvegicus
ctcttcagaggacttg

SEQ ID NO: 497212 - DNA, 16 bp, R. norvegicus
ctcttcagcttcctcc

SEQ ID NO: 497213 - DNA, 16 bp, R. norvegicus
ctcttcaggaccctga

SEQ ID NO: 497214 - DNA, 16 bp, R. norvegicus
ctcttcaggcccacag

SEQ ID NO: 497215 - DNA, 16 bp, R. norvegicus
ctcttcagtctcagga

SEQ ID NO: 497216 - DNA, 16 bp, R. norvegicus
ctcttcagtgctggga

SEQ ID NO: 497217 - DNA, 16 bp, R. norvegicus
ctcttcagtttcttca

SEQ ID NO: 497218 - DNA, 16 bp, R. norvegicus
ctcttcatctgtttcc

SEQ ID NO: 497219 - DNA, 16 bp, R. norvegicus
ctcttcatgctgtggt

SEQ ID NO: 497220 - DNA, 16 bp, R. norvegicus
ctcttcattgtcagga

SEQ ID NO: 497221 - DNA, 16 bp, R. norvegicus
ctcttcatttctgatt

SEQ ID NO: 497222 - DNA, 16 bp, R. norvegicus
ctcttccacactgggt

SEQ ID NO: 497223 - DNA, 16 bp, R. norvegicus
ctcttccactacctct

SEQ ID NO: 497224 - DNA, 16 bp, R. norvegicus
ctcttccagagcctga

SEQ ID NO: 497225 - DNA, 16 bp, R. norvegicus
ctcttccagaggaccc

SEQ ID NO: 497226 - DNA, 16 bp, R. norvegicus
ctcttccagcctctgc

SEQ ID NO: 497227 - DNA, 16 bp, R. norvegicus
ctcttccaggacctct

SEQ ID NO: 497228 - DNA, 16 bp, R. norvegicus
ctcttccagggatcct

SEQ ID NO: 497229 - DNA, 16 bp, R. norvegicus
ctcttccagtcctctc

SEQ ID NO: 497230 - DNA, 16 bp, R. norvegicus
ctcttccagtttctgc

SEQ ID NO: 497231 - DNA, 16 bp, R. norvegicus
ctcttccatatcttgt

SEQ ID NO: 497232 - DNA, 16 bp, R. norvegicus
ctcttccatttctcca

SEQ ID NO: 497233 - DNA, 16 bp, R. norvegicus
ctcttcccaacctcca

SEQ ID NO: 497234 - DNA, 16 bp, R. norvegicus
ctcttcccactgttgg

SEQ ID NO: 497235 - DNA, 16 bp, R. norvegicus
ctcttcccagatccac

SEQ ID NO: 497236 - DNA, 16 bp, R. norvegicus
ctcttcccagcaatgg

SEQ ID NO: 497237 - DNA, 16 bp, R. norvegicus
ctcttcccagccaagg

SEQ ID NO: 497238 - DNA, 16 bp, R. norvegicus
ctcttccccagggaag

SEQ ID NO: 497239 - DNA, 16 bp, R. norvegicus
ctcttccctccacaga

SEQ ID NO: 497240 - DNA, 16 bp, R. norvegicus
ctcttccctcccaagg

SEQ ID NO: 497241 - DNA, 16 bp, R. norvegicus
ctcttccctgccaagg

SEQ ID NO: 497242 - DNA, 16 bp, R. norvegicus
ctcttcctaaggtcct

SEQ ID NO: 497243 - DNA, 16 bp, R. norvegicus
ctcttcctctgtctgt

SEQ ID NO: 497244 - DNA, 16 bp, R. norvegicus
ctcttcctgcaccatg

SEQ ID NO: 497245 - DNA, 16 bp, R. norvegicus
ctcttcctgcctcagc

SEQ ID NO: 497246 - DNA, 16 bp, R. norvegicus
ctcttcctgcctctgt

SEQ ID NO: 497247 - DNA, 16 bp, R. norvegicus
ctcttcctgctgccca

SEQ ID NO: 497248 - DNA, 16 bp, R. norvegicus
ctcttcctggagatgc

SEQ ID NO: 497249 - DNA, 16 bp, R. norvegicus
ctcttccttcagactt

SEQ ID NO: 497250 - DNA, 16 bp, R. norvegicus
ctcttctcacctctgc

SEQ ID NO: 497251 - DNA, 16 bp, R. norvegicus
ctcttctccaattttg

SEQ ID NO: 497252 - DNA, 16 bp, R. norvegicus
ctcttctccacacttt

SEQ ID NO: 497253 - DNA, 16 bp, R. norvegicus
ctcttctcctttgaga

SEQ ID NO: 497254 - DNA, 16 bp, R. norvegicus
ctcttctctgccaagg

SEQ ID NO: 497255 - DNA, 16 bp, R. norvegicus
ctcttctctggagaag

SEQ ID NO: 497256 - DNA, 16 bp, R. norvegicus
ctcttctctgtctgtc

SEQ ID NO: 497257 - DNA, 16 bp, R. norvegicus
ctcttctgagagtcat

SEQ ID NO: 497258 - DNA, 16 bp, R. norvegicus
ctcttctgccctgggt

SEQ ID NO: 497259 - DNA, 16 bp, R. norvegicus
ctcttctgcctctgcc

SEQ ID NO: 497260 - DNA, 16 bp, R. norvegicus
ctcttctgctgcctgt

SEQ ID NO: 497261 - DNA, 16 bp, R. norvegicus
ctcttctggactccat

SEQ ID NO: 497262 - DNA, 16 bp, R. norvegicus
ctcttctggcctcctc

SEQ ID NO: 497263 - DNA, 16 bp, R. norvegicus
ctcttctggcctctcc

SEQ ID NO: 497264 - DNA, 16 bp, R. norvegicus
ctcttctggcctctgc

SEQ ID NO: 497265 - DNA, 16 bp, R. norvegicus
ctcttctggctcaaac

SEQ ID NO: 497266 - DNA, 16 bp, R. norvegicus
ctcttctggcttctca

SEQ ID NO: 497267 - DNA, 16 bp, R. norvegicus
ctcttctgtattttat

SEQ ID NO: 497268 - DNA, 16 bp, R. norvegicus
ctcttctgtttcccag

SEQ ID NO: 497269 - DNA, 16 bp, R. norvegicus
ctcttcttccacagtg

SEQ ID NO: 497270 - DNA, 16 bp, R. norvegicus
ctcttcttccactatg

SEQ ID NO: 497271 - DNA, 16 bp, R. norvegicus
ctcttctttcaaactt

SEQ ID NO: 497272 - DNA, 16 bp, R. norvegicus
ctcttgaatgttctgt

SEQ ID NO: 497273 - DNA, 16 bp, R. norvegicus
ctcttgagctgggcct

SEQ ID NO: 497274 - DNA, 16 bp, R. norvegicus
ctcttgagcttcctgt

SEQ ID NO: 497275 - DNA, 16 bp, R. norvegicus
ctcttgatcttcctgc

SEQ ID NO: 497276 - DNA, 16 bp, R. norvegicus
ctcttgcaaaggatct

SEQ ID NO: 497277 - DNA, 16 bp, R. norvegicus
ctcttgcagagaactt

SEQ ID NO: 497278 - DNA, 16 bp, R. norvegicus
ctcttgcagaggacca

SEQ ID NO: 497279 - DNA, 16 bp, R. norvegicus
ctcttgcctctgcctc

SEQ ID NO: 497280 - DNA, 16 bp, R. norvegicus
ctcttgcctctgtctt

SEQ ID NO: 497281 - DNA, 16 bp, R. norvegicus
ctcttgccttcaggtt

SEQ ID NO: 497282 - DNA, 16 bp, R. norvegicus
ctcttgctcctgctcc

SEQ ID NO: 497283 - DNA, 16 bp, R. norvegicus
ctcttgctcttgctct

SEQ ID NO: 497284 - DNA, 16 bp, R. norvegicus
ctcttggagacagggg

SEQ ID NO: 497285 - DNA, 16 bp, R. norvegicus
ctcttggatttgattt

SEQ ID NO: 497286 - DNA, 31 bp, R. norvegicus
ctcttggcagatactgtctcacccctggaga

SEQ ID NO: 497287 - DNA, 16 bp, R. norvegicus
ctcttggctgcctttg

SEQ ID NO: 497288 - DNA, 30 bp, R. norvegicus
ctcttgggcatatacccacaagatgcccca

SEQ ID NO: 497289 - DNA, 17 bp, R. norvegicus
ctcttgggcatataccg

SEQ ID NO: 497290 - DNA, 16 bp, R. norvegicus
ctcttggttcaggaat

SEQ ID NO: 497291 - DNA, 16 bp, R. norvegicus
ctcttgtgagttcttg

SEQ ID NO: 497292 - DNA, 16 bp, R. norvegicus
ctcttgtgcactgtgt

SEQ ID NO: 497293 - DNA, 16 bp, R. norvegicus
ctctttactaggtttt

SEQ ID NO: 497294 - DNA, 16 bp, R. norvegicus
ctctttcagctccttg

SEQ ID NO: 497295 - DNA, 16 bp, R. norvegicus
ctctttccatctctat

SEQ ID NO: 497296 - DNA, 16 bp, R. norvegicus
ctctttccttgttggg

SEQ ID NO: 497297 - DNA, 16 bp, R. norvegicus
ctctttctgctgcttg

SEQ ID NO: 497298 - DNA, 16 bp, R. norvegicus
ctctttcttcctgctg

SEQ ID NO: 497299 - DNA, 16 bp, R. norvegicus
ctctttgagtgtgtgt

SEQ ID NO: 497300 - DNA, 16 bp, R. norvegicus
ctctttgatttctttc

SEQ ID NO: 497301 - DNA, 16 bp, R. norvegicus
ctctttgcaacagatg

SEQ ID NO: 497302 - DNA, 16 bp, R. norvegicus
ctctttgcagcagaca

SEQ ID NO: 497303 - DNA, 16 bp, R. norvegicus
ctctttgcttcctgct

SEQ ID NO: 497304 - DNA, 16 bp, R. norvegicus
ctctttggacacacag

SEQ ID NO: 497305 - DNA, 16 bp, R. norvegicus
ctctttgtctctgtgt

SEQ ID NO: 497306 - DNA, 16 bp, R. norvegicus
ctcttttaaaagaaag

SEQ ID NO: 497307 - DNA, 16 bp, R. norvegicus
ctcttttcagagccac

SEQ ID NO: 497308 - DNA, 16 bp, R. norvegicus
ctcttttccccagtgt

SEQ ID NO: 497309 - DNA, 16 bp, R. norvegicus
ctcttttctgaaagga

SEQ ID NO: 497310 - DNA, 16 bp, R. norvegicus
ctcttttgtgtcttac

SEQ ID NO: 497311 - DNA, 16 bp, R. norvegicus
ctctttttaaaaaaaa

SEQ ID NO: 497312 - DNA, 16 bp, R. norvegicus
ctgaaaaacaaatttc

SEQ ID NO: 497313 - DNA, 16 bp, R. norvegicus
ctgaaaacccagaagg

SEQ ID NO: 497314 - DNA, 16 bp, R. norvegicus
ctgaaaagcaaaacaa

SEQ ID NO: 497315 - DNA, 16 bp, R. norvegicus
ctgaaaagcttcttta

SEQ ID NO: 497316 - DNA, 16 bp, R. norvegicus
ctgaaaaggaagaaaa

SEQ ID NO: 497317 - DNA, 16 bp, R. norvegicus
ctgaaaaggcaaacct

SEQ ID NO: 497318 - DNA, 16 bp, R. norvegicus
ctgaaaagttcccaga

SEQ ID NO: 497319 - DNA, 16 bp, R. norvegicus
ctgaaaataaaaatga

SEQ ID NO: 497320 - DNA, 16 bp, R. norvegicus
ctgaaaataacccaga

SEQ ID NO: 497321 - DNA, 16 bp, R. norvegicus
ctgaaaatatgagaag

SEQ ID NO: 497322 - DNA, 16 bp, R. norvegicus
ctgaaaatctggagga

SEQ ID NO: 497323 - DNA, 16 bp, R. norvegicus
ctgaaaatgtattttt

SEQ ID NO: 497324 - DNA, 16 bp, R. norvegicus
ctgaaacagaaaagaa

SEQ ID NO: 497325 - DNA, 16 bp, R. norvegicus
ctgaaacagaagcaga

SEQ ID NO: 497326 - DNA, 16 bp, R. norvegicus
ctgaaacagatggagc

SEQ ID NO: 497327 - DNA, 16 bp, R. norvegicus
ctgaaaccaaagccaa

SEQ ID NO: 497328 - DNA, 16 bp, R. norvegicus
ctgaaaccaggagcca

SEQ ID NO: 497329 - DNA, 16 bp, R. norvegicus
ctgaaactccctctgt

SEQ ID NO: 497330 - DNA, 16 bp, R. norvegicus
ctgaaactgagcagat

SEQ ID NO: 497331 - DNA, 16 bp, R. norvegicus
ctgaaactgtatgcca

SEQ ID NO: 497332 - DNA, 16 bp, R. norvegicus
ctgaaacttcagagag

SEQ ID NO: 497333 - DNA, 16 bp, R. norvegicus
ctgaaagaaaaaaatc

SEQ ID NO: 497334 - DNA, 16 bp, R. norvegicus
ctgaaagaaatcagga

SEQ ID NO: 497335 - DNA, 16 bp, R. norvegicus
ctgaaagaaattcagg

SEQ ID NO: 497336 - DNA, 16 bp, R. norvegicus
ctgaaagaagacagga

SEQ ID NO: 497337 - DNA, 16 bp, R. norvegicus
ctgaaagaagcaacat

SEQ ID NO: 497338 - DNA, 16 bp, R. norvegicus
ctgaaagaattgaagg

SEQ ID NO: 497339 - DNA, 16 bp, R. norvegicus
ctgaaagactctgcca

SEQ ID NO: 497340 - DNA, 16 bp, R. norvegicus
ctgaaagagagagaga

SEQ ID NO: 497341 - DNA, 16 bp, R. norvegicus
ctgaaagagcaggcag

SEQ ID NO: 497342 - DNA, 16 bp, R. norvegicus
ctgaaagagctgcagg

SEQ ID NO: 497343 - DNA, 16 bp, R. norvegicus
ctgaaagaggaaacac

SEQ ID NO: 497344 - DNA, 16 bp, R. norvegicus
ctgaaagatgaaaacc

SEQ ID NO: 497345 - DNA, 16 bp, R. norvegicus
ctgaaagatttaaagt

SEQ ID NO: 497346 - DNA, 16 bp, R. norvegicus
ctgaaagccagcccca

SEQ ID NO: 497347 - DNA, 24 bp, R. norvegicus
ctgaaagctgtgctaagaggaaaa

SEQ ID NO: 497348 - DNA, 16 bp, R. norvegicus
ctgaaaggaaaaagaa

SEQ ID NO: 497349 - DNA, 16 bp, R. norvegicus
ctgaaaggaaacagga

SEQ ID NO: 497350 - DNA, 16 bp, R. norvegicus
ctgaaaggaacctgat

SEQ ID NO: 497351 - DNA, 16 bp, R. norvegicus
ctgaaaggagagagag

SEQ ID NO: 497352 - DNA, 16 bp, R. norvegicus
ctgaaaggcagcagag

SEQ ID NO: 497353 - DNA, 16 bp, R. norvegicus
ctgaaagtccttgaga

SEQ ID NO: 497354 - DNA, 16 bp, R. norvegicus
ctgaaagttgtcctct

SEQ ID NO: 497355 - DNA, 16 bp, R. norvegicus
ctgaaagttgtcttct

SEQ ID NO: 497356 - DNA, 16 bp, R. norvegicus
ctgaaagttgttctct

SEQ ID NO: 497357 - DNA, 16 bp, R. norvegicus
ctgaaataaactcttt

SEQ ID NO: 497358 - DNA, 16 bp, R. norvegicus
ctgaaataaataaata

SEQ ID NO: 497359 - DNA, 16 bp, R. norvegicus
ctgaaatcaaccaagc

SEQ ID NO: 497360 - DNA, 16 bp, R. norvegicus
ctgaaatcaataaaat

SEQ ID NO: 497361 - DNA, 16 bp, R. norvegicus
ctgaaatcatgagttc

SEQ ID NO: 497362 - DNA, 16 bp, R. norvegicus
ctgaaatccttgactt

SEQ ID NO: 497363 - DNA, 16 bp, R. norvegicus
ctgaaatctctaaaac

SEQ ID NO: 497364 - DNA, 16 bp, R. norvegicus
ctgaaatctctgtctt

SEQ ID NO: 497365 - DNA, 16 bp, R. norvegicus
ctgaaatgaccaacaa

SEQ ID NO: 497366 - DNA, 16 bp, R. norvegicus
ctgaaattaaccaaat

SEQ ID NO: 497367 - DNA, 16 bp, R. norvegicus
ctgaaattataagcaa

SEQ ID NO: 497368 - DNA, 16 bp, R. norvegicus
ctgaaattctttcttt

SEQ ID NO: 497369 - DNA, 16 bp, R. norvegicus
ctgaacaaaccctttc

SEQ ID NO: 497370 - DNA, 16 bp, R. norvegicus
ctgaacaacaacaaca

SEQ ID NO: 497371 - DNA, 16 bp, R. norvegicus
ctgaacaacacaccaa

SEQ ID NO: 497372 - DNA, 16 bp, R. norvegicus
ctgaacaaggagaccc

SEQ ID NO: 497373 - DNA, 16 bp, R. norvegicus
ctgaacaaggatgaca

SEQ ID NO: 497374 - DNA, 16 bp, R. norvegicus
ctgaacagatggctca

SEQ ID NO: 497375 - DNA, 16 bp, R. norvegicus
ctgaaccaaaacaaaa

SEQ ID NO: 497376 - DNA, 16 bp, R. norvegicus
ctgaaccaactctcca

SEQ ID NO: 497377 - DNA, 16 bp, R. norvegicus
ctgaaccagcaccatt

SEQ ID NO: 497378 - DNA, 16 bp, R. norvegicus
ctgaaccaggagctca

SEQ ID NO: 497379 - DNA, 16 bp, R. norvegicus
ctgaaccatctctcca

SEQ ID NO: 497380 - DNA, 16 bp, R. norvegicus
ctgaacccagacccaa

SEQ ID NO: 497381 - DNA, 16 bp, R. norvegicus
ctgaacccagagcctc

SEQ ID NO: 497382 - DNA, 16 bp, R. norvegicus
ctgaacccagatcctc

SEQ ID NO: 497383 - DNA, 16 bp, R. norvegicus
ctgaacccaggcctgg

SEQ ID NO: 497384 - DNA, 16 bp, R. norvegicus
ctgaaccccatatttt

SEQ ID NO: 497385 - DNA, 16 bp, R. norvegicus
ctgaaccccattattt

SEQ ID NO: 497386 - DNA, 16 bp, R. norvegicus
ctgaaccccatttctt

SEQ ID NO: 497387 - DNA, 16 bp, R. norvegicus
ctgaacctacaagcca

SEQ ID NO: 497388 - DNA, 16 bp, R. norvegicus
ctgaacctctgaacct

SEQ ID NO: 497389 - DNA, 16 bp, R. norvegicus
ctgaacctctggaaga

SEQ ID NO: 497390 - DNA, 16 bp, R. norvegicus
ctgaacctgaaagtca

SEQ ID NO: 497391 - DNA, 17 bp, R. norvegicus
ctgaacctggactctga

SEQ ID NO: 497392 - DNA, 16 bp, R. norvegicus
ctgaacctggaggtca

SEQ ID NO: 497393 - DNA, 16 bp, R. norvegicus
ctgaacctgtcccaca

SEQ ID NO: 497394 - DNA, 16 bp, R. norvegicus
ctgaactacctgagga

SEQ ID NO: 497395 - DNA, 16 bp, R. norvegicus
ctgaactctggtcttc

SEQ ID NO: 497396 - DNA, 16 bp, R. norvegicus
ctgaactgaactgaac

SEQ ID NO: 497397 - DNA, 16 bp, R. norvegicus
ctgaactgacaaccag

SEQ ID NO: 497398 - DNA, 16 bp, R. norvegicus
ctgaactgcactgact

SEQ ID NO: 497399 - DNA, 16 bp, R. norvegicus
ctgaagaaaagatcat

SEQ ID NO: 497400 - DNA, 16 bp, R. norvegicus
ctgaagaaaaggctat

SEQ ID NO: 497401 - DNA, 16 bp, R. norvegicus
ctgaagaaaaggttat

SEQ ID NO: 497402 - DNA, 16 bp, R. norvegicus
ctgaagaaaatgtctc

SEQ ID NO: 497403 - DNA, 16 bp, R. norvegicus
ctgaagaaaccacaag

SEQ ID NO: 497404 - DNA, 16 bp, R. norvegicus
ctgaagaaacggccat

SEQ ID NO: 497405 - DNA, 16 bp, R. norvegicus
ctgaagaaagaaaagg

SEQ ID NO: 497406 - DNA, 16 bp, R. norvegicus
ctgaagaaagaaagtg

SEQ ID NO: 497407 - DNA, 16 bp, R. norvegicus
ctgaagaaagaaattt

SEQ ID NO: 497408 - DNA, 16 bp, R. norvegicus
ctgaagaaagccagga

SEQ ID NO: 497409 - DNA, 16 bp, R. norvegicus
ctgaagaaatagaagc

SEQ ID NO: 497410 - DNA, 16 bp, R. norvegicus
ctgaagaaattaaaaa

SEQ ID NO: 497411 - DNA, 16 bp, R. norvegicus
ctgaagaaattgaaga

SEQ ID NO: 497412 - DNA, 16 bp, R. norvegicus
ctgaagaagaagaaga

SEQ ID NO: 497413 - DNA, 16 bp, R. norvegicus
ctgaagaagctgaaag

SEQ ID NO: 497414 - DNA, 16 bp, R. norvegicus
ctgaagaagctgaagg

SEQ ID NO: 497415 - DNA, 16 bp, R. norvegicus
ctgaagaagtgggctc

SEQ ID NO: 497416 - DNA, 16 bp, R. norvegicus
ctgaagaagttgaagg

SEQ ID NO: 497417 - DNA, 16 bp, R. norvegicus
ctgaagaatgctacta

SEQ ID NO: 497418 - DNA, 16 bp, R. norvegicus
ctgaagacaatgacag

SEQ ID NO: 497419 - DNA, 16 bp, R. norvegicus
ctgaagaccaagctgc

SEQ ID NO: 497420 - DNA, 16 bp, R. norvegicus
ctgaagaccaggctga

SEQ ID NO: 497421 - DNA, 16 bp, R. norvegicus
ctgaagacccaacagt

SEQ ID NO: 497422 - DNA, 16 bp, R. norvegicus
ctgaagacccagaaat

SEQ ID NO: 497423 - DNA, 16 bp, R. norvegicus
ctgaagacccagctat

SEQ ID NO: 497424 - DNA, 16 bp, R. norvegicus
ctgaagaccccttgga

SEQ ID NO: 497425 - DNA, 16 bp, R. norvegicus
ctgaagagaaaagaaa

SEQ ID NO: 497426 - DNA, 16 bp, R. norvegicus
ctgaagagaaggctca

SEQ ID NO: 497427 - DNA, 16 bp, R. norvegicus
ctgaagagaataaaca

SEQ ID NO: 497428 - DNA, 16 bp, R. norvegicus
ctgaagagagggacag

SEQ ID NO: 497429 - DNA, 16 bp, R. norvegicus
ctgaagagagtgatgg

SEQ ID NO: 497430 - DNA, 16 bp, R. norvegicus
ctgaagaggaagcaga

SEQ ID NO: 497431 - DNA, 16 bp, R. norvegicus
ctgaagaggcagaggc

SEQ ID NO: 497432 - DNA, 16 bp, R. norvegicus
ctgaagaggctttcta

SEQ ID NO: 497433 - DNA, 16 bp, R. norvegicus
ctgaagaggtttgcag

SEQ ID NO: 497434 - DNA, 16 bp, R. norvegicus
ctgaagatgccaagtg

SEQ ID NO: 497435 - DNA, 16 bp, R. norvegicus
ctgaagatggccttga

SEQ ID NO: 497436 - DNA, 16 bp, R. norvegicus
ctgaagatgttgaaca

SEQ ID NO: 497437 - DNA, 16 bp, R. norvegicus
ctgaagcaaaagaaaa

SEQ ID NO: 497438 - DNA, 16 bp, R. norvegicus
ctgaagcagaagccac

SEQ ID NO: 497439 - DNA, 16 bp, R. norvegicus
ctgaagcagaagctgt

SEQ ID NO: 497440 - DNA, 16 bp, R. norvegicus
ctgaagcagaggcagg

SEQ ID NO: 497441 - DNA, 16 bp, R. norvegicus
ctgaagcagcaagctg

SEQ ID NO: 497442 - DNA, 16 bp, R. norvegicus
ctgaagcagctgaagg

SEQ ID NO: 497443 - DNA, 16 bp, R. norvegicus
ctgaagcaggaagact

SEQ ID NO: 497444 - DNA, 16 bp, R. norvegicus
ctgaagcatccacaca

SEQ ID NO: 497445 - DNA, 16 bp, R. norvegicus
ctgaagcatctctcca

SEQ ID NO: 497446 - DNA, 16 bp, R. norvegicus
ctgaagccagacaaga

SEQ ID NO: 497447 - DNA, 16 bp, R. norvegicus
ctgaagcccaaccagg

SEQ ID NO: 497448 - DNA, 16 bp, R. norvegicus
ctgaagccctgaggac

SEQ ID NO: 497449 - DNA, 16 bp, R. norvegicus
ctgaagccctgaggga

SEQ ID NO: 497450 - DNA, 16 bp, R. norvegicus
ctgaagctcactatgt

SEQ ID NO: 497451 - DNA, 27 bp, R. norvegicus
ctgaagctcccggaaggagcggcacag

SEQ ID NO: 497452 - DNA, 16 bp, R. norvegicus
ctgaagctcctttctc

SEQ ID NO: 497453 - DNA, 16 bp, R. norvegicus
ctgaagctggaaagaa

SEQ ID NO: 497454 - DNA, 16 bp, R. norvegicus
ctgaagctggagttgt

SEQ ID NO: 497455 - DNA, 16 bp, R. norvegicus
ctgaaggaaaaaccag

SEQ ID NO: 497456 - DNA, 16 bp, R. norvegicus
ctgaaggaaatgaagg

SEQ ID NO: 497457 - DNA, 16 bp, R. norvegicus
ctgaaggaaatgcagg

SEQ ID NO: 497458 - DNA, 16 bp, R. norvegicus
ctgaaggaactgcagg

SEQ ID NO: 497459 - DNA, 16 bp, R. norvegicus
ctgaaggaagcagagg

SEQ ID NO: 497460 - DNA, 16 bp, R. norvegicus
ctgaaggaagctgagg

SEQ ID NO: 497461 - DNA, 16 bp, R. norvegicus
ctgaaggaatggccgt

SEQ ID NO: 497462 - DNA, 16 bp, R. norvegicus
ctgaaggaattccagg

SEQ ID NO: 497463 - DNA, 16 bp, R. norvegicus
ctgaaggacctgaagg

SEQ ID NO: 497464 - DNA, 16 bp, R. norvegicus
ctgaaggactgaagga

SEQ ID NO: 497465 - DNA, 16 bp, R. norvegicus
ctgaaggagataaagg

SEQ ID NO: 497466 - DNA, 16 bp, R. norvegicus
ctgaaggagataggaa

SEQ ID NO: 497467 - DNA, 16 bp, R. norvegicus
ctgaaggagatcaagg

SEQ ID NO: 497468 - DNA, 16 bp, R. norvegicus
ctgaaggagatgaaga

SEQ ID NO: 497469 - DNA, 16 bp, R. norvegicus
ctgaaggagatggcaa

SEQ ID NO: 497470 - DNA, 16 bp, R. norvegicus
ctgaaggagcagaagg

SEQ ID NO: 497471 - DNA, 16 bp, R. norvegicus
ctgaaggagctgaaca

SEQ ID NO: 497472 - DNA, 16 bp, R. norvegicus
ctgaaggagctgaacg

SEQ ID NO: 497473 - DNA, 16 bp, R. norvegicus
ctgaaggagctgaaga

SEQ ID NO: 497474 - DNA, 16 bp, R. norvegicus
ctgaaggagctgaggg

SEQ ID NO: 497475 - DNA, 16 bp, R. norvegicus
ctgaaggagctgcagg

SEQ ID NO: 497476 - DNA, 16 bp, R. norvegicus
ctgaaggagctggaag

SEQ ID NO: 497477 - DNA, 16 bp, R. norvegicus
ctgaaggagctggagg

SEQ ID NO: 497478 - DNA, 16 bp, R. norvegicus
ctgaaggaggtgaagg

SEQ ID NO: 497479 - DNA, 16 bp, R. norvegicus
ctgaaggagtttgaaa

SEQ ID NO: 497480 - DNA, 16 bp, R. norvegicus
ctgaaggagtttgcaa

SEQ ID NO: 497481 - DNA, 16 bp, R. norvegicus
ctgaaggatgctttct

SEQ ID NO: 497482 - DNA, 16 bp, R. norvegicus
ctgaaggcagagacag

SEQ ID NO: 497483 - DNA, 16 bp, R. norvegicus
ctgaaggcagcagaaa

SEQ ID NO: 497484 - DNA, 16 bp, R. norvegicus
ctgaaggctggagaga

SEQ ID NO: 497485 - DNA, 16 bp, R. norvegicus
ctgaaggcttctctct

SEQ ID NO: 497486 - DNA, 16 bp, R. norvegicus
ctgaaggggcttgcag

SEQ ID NO: 497487 - DNA, 16 bp, R. norvegicus
ctgaaggggtttgcaa

SEQ ID NO: 497488 - DNA, 16 bp, R. norvegicus
ctgaaggtgagctcag

SEQ ID NO: 497489 - DNA, 16 bp, R. norvegicus
ctgaaggtggactcta

SEQ ID NO: 497490 - DNA, 16 bp, R. norvegicus
ctgaaggtggagttgg

SEQ ID NO: 497491 - DNA, 16 bp, R. norvegicus
ctgaagtcccacagct

SEQ ID NO: 497492 - DNA, 16 bp, R. norvegicus
ctgaagtggccacctc

SEQ ID NO: 497493 - DNA, 16 bp, R. norvegicus
ctgaagtggctcctgg

SEQ ID NO: 497494 - DNA, 16 bp, R. norvegicus
ctgaagtgtctgaaga

SEQ ID NO: 497495 - DNA, 16 bp, R. norvegicus
ctgaagttctctcttt

SEQ ID NO: 497496 - DNA, 16 bp, R. norvegicus
ctgaagttgctgagag

SEQ ID NO: 497497 - DNA, 16 bp, R. norvegicus
ctgaagttggaccagt

SEQ ID NO: 497498 - DNA, 16 bp, R. norvegicus
ctgaagttttcttttt

SEQ ID NO: 497499 - DNA, 16 bp, R. norvegicus
ctgaataagttcaccc

SEQ ID NO: 497500 - DNA, 16 bp, R. norvegicus
ctgaatacaaaattaa

SEQ ID NO: 497501 - DNA, 16 bp, R. norvegicus
ctgaataccctccagt

SEQ ID NO: 497502 - DNA, 16 bp, R. norvegicus
ctgaatcagctgctgg

SEQ ID NO: 497503 - DNA, 16 bp, R. norvegicus
ctgaatccaggtcctc

SEQ ID NO: 497504 - DNA, 16 bp, R. norvegicus
ctgaatgccagaagag

SEQ ID NO: 497505 - DNA, 16 bp, R. norvegicus
ctgaatgcctgcaaaa

SEQ ID NO: 497506 - DNA, 16 bp, R. norvegicus
ctgaatggcctttctt

SEQ ID NO: 497507 - DNA, 16 bp, R. norvegicus
ctgaatgtgggtggca

SEQ ID NO: 497508 - DNA, 16 bp, R. norvegicus
ctgaattcaaggctag

SEQ ID NO: 497509 - DNA, 16 bp, R. norvegicus
ctgaattgaaccagcc

SEQ ID NO: 497510 - DNA, 16 bp, R. norvegicus
ctgaattgctttgctt

SEQ ID NO: 497511 - DNA, 16 bp, R. norvegicus
ctgaatttgatcctca

SEQ ID NO: 497512 - DNA, 16 bp, R. norvegicus
ctgaattttattgagt

SEQ ID NO: 497513 - DNA, 16 bp, R. norvegicus
ctgaatttttgatctt

SEQ ID NO: 497514 - DNA, 16 bp, R. norvegicus
ctgaatttttgctgca

SEQ ID NO: 497515 - DNA, 16 bp, R. norvegicus
ctgacaaaagcaactt

SEQ ID NO: 497516 - DNA, 16 bp, R. norvegicus
ctgacaaatggagctc

SEQ ID NO: 497517 - DNA, 16 bp, R. norvegicus
ctgacaacagatgctg

SEQ ID NO: 497518 - DNA, 16 bp, R. norvegicus
ctgacaacattctgtg

SEQ ID NO: 497519 - DNA, 16 bp, R. norvegicus
ctgacaagatggctca

SEQ ID NO: 497520 - DNA, 16 bp, R. norvegicus
ctgacacacacctcca

SEQ ID NO: 497521 - DNA, 16 bp, R. norvegicus
ctgacacacagagatg

SEQ ID NO: 497522 - DNA, 16 bp, R. norvegicus
ctgacacatacagagg

SEQ ID NO: 497523 - DNA, 16 bp, R. norvegicus
ctgacaccatcactga

SEQ ID NO: 497524 - DNA, 16 bp, R. norvegicus
ctgacagaagagaaag

SEQ ID NO: 497525 - DNA, 16 bp, R. norvegicus
ctgacagaattccagg

SEQ ID NO: 497526 - DNA, 16 bp, R. norvegicus
ctgacagagacagcaa

SEQ ID NO: 497527 - DNA, 16 bp, R. norvegicus
ctgacagagcaagaaa

SEQ ID NO: 497528 - DNA, 16 bp, R. norvegicus
ctgacaggaaccagat

SEQ ID NO: 497529 - DNA, 16 bp, R. norvegicus
ctgacaggagcctgct

SEQ ID NO: 497530 - DNA, 16 bp, R. norvegicus
ctgacaggagtctggt

SEQ ID NO: 497531 - DNA, 16 bp, R. norvegicus
ctgacaggggacaagc

SEQ ID NO: 497532 - DNA, 16 bp, R. norvegicus
ctgacagtgaagatca

SEQ ID NO: 497533 - DNA, 16 bp, R. norvegicus
ctgacagtggcttgcc

SEQ ID NO: 497534 - DNA, 16 bp, R. norvegicus
ctgacatagaacagga

SEQ ID NO: 497535 - DNA, 16 bp, R. norvegicus
ctgacatccaacaaga

SEQ ID NO: 497536 - DNA, 16 bp, R. norvegicus
ctgacatttcacctca

SEQ ID NO: 497537 - DNA, 16 bp, R. norvegicus
ctgaccaaaaacaact

SEQ ID NO: 497538 - DNA, 16 bp, R. norvegicus
ctgaccacttggtgtt

SEQ ID NO: 497539 - DNA, 16 bp, R. norvegicus
ctgaccagccaccaga

SEQ ID NO: 497540 - DNA, 16 bp, R. norvegicus
ctgaccaggctgttgg

SEQ ID NO: 497541 - DNA, 16 bp, R. norvegicus
ctgacccaagaggaaa

SEQ ID NO: 497542 - DNA, 16 bp, R. norvegicus
ctgacccagaaagaca

SEQ ID NO: 497543 - DNA, 16 bp, R. norvegicus
ctgacccagaactgtt

SEQ ID NO: 497544 - DNA, 16 bp, R. norvegicus
ctgacccagtgccaca

SEQ ID NO: 497545 - DNA, 16 bp, R. norvegicus
ctgacccctgacctct

SEQ ID NO: 497546 - DNA, 16 bp, R. norvegicus
ctgaccctcctgcctc

SEQ ID NO: 497547 - DNA, 16 bp, R. norvegicus
ctgaccctgaaggaaa

SEQ ID NO: 497548 - DNA, 18 bp, R. norvegicus
ctgaccctgaccctgacc

SEQ ID NO: 497549 - DNA, 16 bp, R. norvegicus
ctgaccctgctgtgag

SEQ ID NO: 497550 - DNA, 16 bp, R. norvegicus
ctgaccctggaccctg

SEQ ID NO: 497551 - DNA, 16 bp, R. norvegicus
ctgaccctggacgctg

SEQ ID NO: 497552 - DNA, 16 bp, R. norvegicus
ctgaccctggattcca

SEQ ID NO: 497553 - DNA, 16 bp, R. norvegicus
ctgaccgctggctctc

SEQ ID NO: 497554 - DNA, 16 bp, R. norvegicus
ctgacctcagcctctg

SEQ ID NO: 497555 - DNA, 16 bp, R. norvegicus
ctgacctcagttcaat

SEQ ID NO: 497556 - DNA, 16 bp, R. norvegicus
ctgacctccacactca

SEQ ID NO: 497557 - DNA, 16 bp, R. norvegicus
ctgacctccaggggca

SEQ ID NO: 497558 - DNA, 16 bp, R. norvegicus
ctgacctccatagaca

SEQ ID NO: 497559 - DNA, 16 bp, R. norvegicus
ctgacctccatgagca

SEQ ID NO: 497560 - DNA, 16 bp, R. norvegicus
ctgacctctacagaca

SEQ ID NO: 497561 - DNA, 16 bp, R. norvegicus
ctgacctctatgggca

SEQ ID NO: 497562 - DNA, 16 bp, R. norvegicus
ctgacctctgaggaca

SEQ ID NO: 497563 - DNA, 16 bp, R. norvegicus
ctgacctctgtgtgca

SEQ ID NO: 497564 - DNA, 16 bp, R. norvegicus
ctgacctggaacccac

SEQ ID NO: 497565 - DNA, 16 bp, R. norvegicus
ctgacctggaacttgt

SEQ ID NO: 497566 - DNA, 16 bp, R. norvegicus
ctgacctgtgaactga

SEQ ID NO: 497567 - DNA, 16 bp, R. norvegicus
ctgacgagctcagact

SEQ ID NO: 497568 - DNA, 17 bp, R. norvegicus
ctgacgctgtctggcag

SEQ ID NO: 497569 - DNA, 16 bp, R. norvegicus
ctgactaagacagtga

SEQ ID NO: 497570 - DNA, 16 bp, R. norvegicus
ctgactacctgagttc

SEQ ID NO: 497571 - DNA, 16 bp, R. norvegicus
ctgactccagagaaaa

SEQ ID NO: 497572 - DNA, 16 bp, R. norvegicus
ctgactccagagtgct

SEQ ID NO: 497573 - DNA, 16 bp, R. norvegicus
ctgactcccaggcagc

SEQ ID NO: 497574 - DNA, 16 bp, R. norvegicus
ctgactcctgatctct

SEQ ID NO: 497575 - DNA, 16 bp, R. norvegicus
ctgactcctgtgaact

SEQ ID NO: 497576 - DNA, 16 bp, R. norvegicus
ctgactctgccttcca

SEQ ID NO: 497577 - DNA, 16 bp, R. norvegicus
ctgactctggactcca

SEQ ID NO: 497578 - DNA, 16 bp, R. norvegicus
ctgactcttgcctgct

SEQ ID NO: 497579 - DNA, 16 bp, R. norvegicus
ctgactctttcagctg

SEQ ID NO: 497580 - DNA, 16 bp, R. norvegicus
ctgactctttcagttg

SEQ ID NO: 497581 - DNA, 16 bp, R. norvegicus
ctgactgacctcgcca

SEQ ID NO: 497582 - DNA, 16 bp, R. norvegicus
ctgactgcagcctgtc

SEQ ID NO: 497583 - DNA, 16 bp, R. norvegicus
ctgactgcccacagcc

SEQ ID NO: 497584 - DNA, 16 bp, R. norvegicus
ctgactgcctctgcct

SEQ ID NO: 497585 - DNA, 16 bp, R. norvegicus
ctgactgctgctcttc

SEQ ID NO: 497586 - DNA, 16 bp, R. norvegicus
ctgactggagtctgtc

SEQ ID NO: 497587 - DNA, 16 bp, R. norvegicus
ctgactggccagccag

SEQ ID NO: 497588 - DNA, 16 bp, R. norvegicus
ctgactggccagtgag

SEQ ID NO: 497589 - DNA, 16 bp, R. norvegicus
ctgactggtgtgtggt

SEQ ID NO: 497590 - DNA, 42 bp, R. norvegicus
ctgactgtattagatgatgttactgaaccaacatgtcatagt

SEQ ID NO: 497591 - DNA, 16 bp, R. norvegicus
ctgactgtcctagaac

SEQ ID NO: 497592 - DNA, 16 bp, R. norvegicus
ctgactgtggacaatt

SEQ ID NO: 497593 - DNA, 16 bp, R. norvegicus
ctgactgtggtatcca

SEQ ID NO: 497594 - DNA, 16 bp, R. norvegicus
ctgactgttctggaac

SEQ ID NO: 497595 - DNA, 16 bp, R. norvegicus
ctgacttccaggaacc

SEQ ID NO: 497596 - DNA, 16 bp, R. norvegicus
ctgacttccaggcagg

SEQ ID NO: 497597 - DNA, 16 bp, R. norvegicus
ctgacttcctttgata

SEQ ID NO: 497598 - DNA, 16 bp, R. norvegicus
ctgacttctacatgca

SEQ ID NO: 497599 - DNA, 16 bp, R. norvegicus
ctgacttctgaatctg

SEQ ID NO: 497600 - DNA, 16 bp, R. norvegicus
ctgacttctttcagtg

SEQ ID NO: 497601 - DNA, 16 bp, R. norvegicus
ctgacttgagtttcat

SEQ ID NO: 497602 - DNA, 16 bp, R. norvegicus
ctgacttgtctggcct

SEQ ID NO: 497603 - DNA, 16 bp, R. norvegicus
ctgactttaagcagta

SEQ ID NO: 497604 - DNA, 16 bp, R. norvegicus
ctgactttctaaagaa

SEQ ID NO: 497605 - DNA, 16 bp, R. norvegicus
ctgactttctttgttc

SEQ ID NO: 497606 - DNA, 16 bp, R. norvegicus
ctgactttgaactcct

SEQ ID NO: 497607 - DNA, 16 bp, R. norvegicus
ctgactttgtgagagt

SEQ ID NO: 497608 - DNA, 16 bp, R. norvegicus
ctgagaaaactccaga

SEQ ID NO: 497609 - DNA, 16 bp, R. norvegicus
ctgagaaacaaaacaa

SEQ ID NO: 497610 - DNA, 18 bp, R. norvegicus
ctgagaaacacagccaga

SEQ ID NO: 497611 - DNA, 16 bp, R. norvegicus
ctgagaaacaccgaaa

SEQ ID NO: 497612 - DNA, 23 bp, R. norvegicus
ctgagaaacacctaaagaaatgc

SEQ ID NO: 497613 - DNA, 16 bp, R. norvegicus
ctgagaaacacctaca

SEQ ID NO: 497614 - DNA, 16 bp, R. norvegicus
ctgagaaactgccaca

SEQ ID NO: 497615 - DNA, 16 bp, R. norvegicus
ctgagaaactgtcaaa

SEQ ID NO: 497616 - DNA, 16 bp, R. norvegicus
ctgagaaagaaatgag

SEQ ID NO: 497617 - DNA, 16 bp, R. norvegicus
ctgagaaagaactgga

SEQ ID NO: 497618 - DNA, 16 bp, R. norvegicus
ctgagaaaggactgga

SEQ ID NO: 497619 - DNA, 16 bp, R. norvegicus
ctgagaaaggggtccc

SEQ ID NO: 497620 - DNA, 16 bp, R. norvegicus
ctgagaaagtctacca

SEQ ID NO: 497621 - DNA, 16 bp, R. norvegicus
ctgagaaataaattaa

SEQ ID NO: 497622 - DNA, 16 bp, R. norvegicus
ctgagaaatcacacca

SEQ ID NO: 497623 - DNA, 16 bp, R. norvegicus
ctgagaaatcagaaga

SEQ ID NO: 497624 - DNA, 16 bp, R. norvegicus
ctgagaacaggaccac

SEQ ID NO: 497625 - DNA, 16 bp, R. norvegicus
ctgagaaccactgctg

SEQ ID NO: 497626 - DNA, 16 bp, R. norvegicus
ctgagaagaaagctgc

SEQ ID NO: 497627 - DNA, 16 bp, R. norvegicus
ctgagaagaaggttta

SEQ ID NO: 497628 - DNA, 16 bp, R. norvegicus
ctgagaagagaaagaa

SEQ ID NO: 497629 - DNA, 16 bp, R. norvegicus
ctgagaagagaggagg

SEQ ID NO: 497630 - DNA, 16 bp, R. norvegicus
ctgagaagccagagga

SEQ ID NO: 497631 - DNA, 16 bp, R. norvegicus
ctgagaagcttctgca

SEQ ID NO: 497632 - DNA, 16 bp, R. norvegicus
ctgagaaggaagaaag

SEQ ID NO: 497633 - DNA, 16 bp, R. norvegicus
ctgagaagtgcccaag

SEQ ID NO: 497634 - DNA, 16 bp, R. norvegicus
ctgagaataggtcccc

SEQ ID NO: 497635 - DNA, 16 bp, R. norvegicus
ctgagaatcctccaga

SEQ ID NO: 497636 - DNA, 16 bp, R. norvegicus
ctgagaatgagatccc

SEQ ID NO: 497637 - DNA, 16 bp, R. norvegicus
ctgagaatgcacatgt

SEQ ID NO: 497638 - DNA, 16 bp, R. norvegicus
ctgagaatggggtctc

SEQ ID NO: 497639 - DNA, 16 bp, R. norvegicus
ctgagaatgtgctcca

SEQ ID NO: 497640 - DNA, 16 bp, R. norvegicus
ctgagaattgaaccca

SEQ ID NO: 497641 - DNA, 16 bp, R. norvegicus
ctgagacacccagcct

SEQ ID NO: 497642 - DNA, 22 bp, R. norvegicus
ctgagacaccgccagaacctga

SEQ ID NO: 497643 - DNA, 16 bp, R. norvegicus
ctgagacacctccaga

SEQ ID NO: 497644 - DNA, 16 bp, R. norvegicus
ctgagacagacacatg

SEQ ID NO: 497645 - DNA, 16 bp, R. norvegicus
ctgagacagactcaca

SEQ ID NO: 497646 - DNA, 16 bp, R. norvegicus
ctgagacagatgaaga

SEQ ID NO: 497647 - DNA, 16 bp, R. norvegicus
ctgagacaggagaatt

SEQ ID NO: 497648 - DNA, 16 bp, R. norvegicus
ctgagacaggaggact

SEQ ID NO: 497649 - DNA, 16 bp, R. norvegicus
ctgagacctcaggaca

SEQ ID NO: 497650 - DNA, 16 bp, R. norvegicus
ctgagacctcagggga

SEQ ID NO: 497651 - DNA, 16 bp, R. norvegicus
ctgagactcaaggcag

SEQ ID NO: 497652 - DNA, 16 bp, R. norvegicus
ctgagactgaaccccc

SEQ ID NO: 497653 - DNA, 16 bp, R. norvegicus
ctgagacttgctgctg

SEQ ID NO: 497654 - DNA, 16 bp, R. norvegicus
ctgagagaaaccagat

SEQ ID NO: 497655 - DNA, 21 bp, R. norvegicus
ctgagagacacagccagaata

SEQ ID NO: 497656 - DNA, 16 bp, R. norvegicus
ctgagagacagagaca

SEQ ID NO: 497657 - DNA, 17 bp, R. norvegicus
ctgagagacatagccag

SEQ ID NO: 497658 - DNA, 16 bp, R. norvegicus
ctgagagatgcagcca

SEQ ID NO: 497659 - DNA, 16 bp, R. norvegicus
ctgagagatgctggga

SEQ ID NO: 497660 - DNA, 16 bp, R. norvegicus
ctgagagcagagctct

SEQ ID NO: 497661 - DNA, 16 bp, R. norvegicus
ctgagagcagaggaaa

SEQ ID NO: 497662 - DNA, 16 bp, R. norvegicus
ctgagagcatctgcct

SEQ ID NO: 497663 - DNA, 16 bp, R. norvegicus
ctgagagcctcagcca

SEQ ID NO: 497664 - DNA, 16 bp, R. norvegicus
ctgagagctcagaaga

SEQ ID NO: 497665 - DNA, 16 bp, R. norvegicus
ctgagagctcagagga

SEQ ID NO: 497666 - DNA, 16 bp, R. norvegicus
ctgagaggaggaaacc

SEQ ID NO: 497667 - DNA, 16 bp, R. norvegicus
ctgagaggcctgctct

SEQ ID NO: 497668 - DNA, 16 bp, R. norvegicus
ctgagaggctcttcca

SEQ ID NO: 497669 - DNA, 16 bp, R. norvegicus
ctgagaggcttcactc

SEQ ID NO: 497670 - DNA, 16 bp, R. norvegicus
ctgagagtgaggtggg

SEQ ID NO: 497671 - DNA, 16 bp, R. norvegicus
ctgagagttgggtgta

SEQ ID NO: 497672 - DNA, 16 bp, R. norvegicus
ctgagatattcctcaa

SEQ ID NO: 497673 - DNA, 16 bp, R. norvegicus
ctgagatcacaggtgt

SEQ ID NO: 497674 - DNA, 16 bp, R. norvegicus
ctgagatcctacctca

SEQ ID NO: 497675 - DNA, 16 bp, R. norvegicus
ctgagatcttcctgcc

SEQ ID NO: 497676 - DNA, 16 bp, R. norvegicus
ctgagatggagcactg

SEQ ID NO: 497677 - DNA, 16 bp, R. norvegicus
ctgagattaaaggcat

SEQ ID NO: 497678 - DNA, 16 bp, R. norvegicus
ctgagattacaaacat

SEQ ID NO: 497679 - DNA, 16 bp, R. norvegicus
ctgagattacaggttt

SEQ ID NO: 497680 - DNA, 16 bp, R. norvegicus
ctgagcaacaagaatg

SEQ ID NO: 497681 - DNA, 16 bp, R. norvegicus
ctgagcacagctttca

SEQ ID NO: 497682 - DNA, 16 bp, R. norvegicus
ctgagcacaggccctg

SEQ ID NO: 497683 - DNA, 16 bp, R. norvegicus
ctgagcacctactgtg

SEQ ID NO: 497684 - DNA, 16 bp, R. norvegicus
ctgagcactcacagaa

SEQ ID NO: 497685 - DNA, 16 bp, R. norvegicus
ctgagcagatgtcata

SEQ ID NO: 497686 - DNA, 16 bp, R. norvegicus
ctgagcagcacagtgg

SEQ ID NO: 497687 - DNA, 16 bp, R. norvegicus
ctgagcatctccccag

SEQ ID NO: 497688 - DNA, 16 bp, R. norvegicus
ctgagcatgctcagag

SEQ ID NO: 497689 - DNA, 16 bp, R. norvegicus
ctgagcatggtggtgc

SEQ ID NO: 497690 - DNA, 16 bp, R. norvegicus
ctgagcatgtctgtga

SEQ ID NO: 497691 - DNA, 16 bp, R. norvegicus
ctgagccaaaataaac

SEQ ID NO: 497692 - DNA, 16 bp, R. norvegicus
ctgagccaactttcca

SEQ ID NO: 497693 - DNA, 16 bp, R. norvegicus
ctgagccacacctcca

SEQ ID NO: 497694 - DNA, 16 bp, R. norvegicus
ctgagccacctctctg

SEQ ID NO: 497695 - DNA, 16 bp, R. norvegicus
ctgagccacgtcccca

SEQ ID NO: 497696 - DNA, 16 bp, R. norvegicus
ctgagccagcaggaga

SEQ ID NO: 497697 - DNA, 16 bp, R. norvegicus
ctgagccagcaggagg

SEQ ID NO: 497698 - DNA, 16 bp, R. norvegicus
ctgagccagcctgggc

SEQ ID NO: 497699 - DNA, 16 bp, R. norvegicus
ctgagccagctttcca

SEQ ID NO: 497700 - DNA, 16 bp, R. norvegicus
ctgagccaggaggatc

SEQ ID NO: 497701 - DNA, 16 bp, R. norvegicus
ctgagccagggcactg

SEQ ID NO: 497702 - DNA, 16 bp, R. norvegicus
ctgagccatcccactg

SEQ ID NO: 497703 - DNA, 16 bp, R. norvegicus
ctgagccatctccaca

SEQ ID NO: 497704 - DNA, 16 bp, R. norvegicus
ctgagccatctctcca

SEQ ID NO: 497705 - DNA, 16 bp, R. norvegicus
ctgagccatctctctg

SEQ ID NO: 497706 - DNA, 16 bp, R. norvegicus
ctgagccatcttgcca

SEQ ID NO: 497707 - DNA, 16 bp, R. norvegicus
ctgagccatgcctgcc

SEQ ID NO: 497708 - DNA, 16 bp, R. norvegicus
ctgagccatgtttcca

SEQ ID NO: 497709 - DNA, 16 bp, R. norvegicus
ctgagccattctccag

SEQ ID NO: 497710 - DNA, 16 bp, R. norvegicus
ctgagccattctctag

SEQ ID NO: 497711 - DNA, 16 bp, R. norvegicus
ctgagccatttctcca

SEQ ID NO: 497712 - DNA, 16 bp, R. norvegicus
ctgagccatttgtgtt

SEQ ID NO: 497713 - DNA, 16 bp, R. norvegicus
ctgagccatttttcta

SEQ ID NO: 497714 - DNA, 16 bp, R. norvegicus
ctgagcccagaactga

SEQ ID NO: 497715 - DNA, 16 bp, R. norvegicus
ctgagcccagacccag

SEQ ID NO: 497716 - DNA, 16 bp, R. norvegicus
ctgagcccagtgcctt

SEQ ID NO: 497717 - DNA, 16 bp, R. norvegicus
ctgagccctccacaga

SEQ ID NO: 497718 - DNA, 16 bp, R. norvegicus
ctgagccctctctcca

SEQ ID NO: 497719 - DNA, 16 bp, R. norvegicus
ctgagccctgaaggga

SEQ ID NO: 497720 - DNA, 16 bp, R. norvegicus
ctgagccctgtggcag

SEQ ID NO: 497721 - DNA, 16 bp, R. norvegicus
ctgagcctcagtctcc

SEQ ID NO: 497722 - DNA, 16 bp, R. norvegicus
ctgagcctccagctgc

SEQ ID NO: 497723 - DNA, 16 bp, R. norvegicus
ctgagcctgctctccc

SEQ ID NO: 497724 - DNA, 16 bp, R. norvegicus
ctgagcctggagctca

SEQ ID NO: 497725 - DNA, 16 bp, R. norvegicus
ctgagcctggcagcag

SEQ ID NO: 497726 - DNA, 16 bp, R. norvegicus
ctgagccttccctcca

SEQ ID NO: 497727 - DNA, 16 bp, R. norvegicus
ctgagccttctctcca

SEQ ID NO: 497728 - DNA, 22 bp, R. norvegicus
ctgagctaaatcctcaacccca

SEQ ID NO: 497729 - DNA, 16 bp, R. norvegicus
ctgagctacagagtga

SEQ ID NO: 497730 - DNA, 16 bp, R. norvegicus
ctgagctacatttcca

SEQ ID NO: 497731 - DNA, 16 bp, R. norvegicus
ctgagctacctctcca

SEQ ID NO: 497732 - DNA, 16 bp, R. norvegicus
ctgagctacctcttca

SEQ ID NO: 497733 - DNA, 16 bp, R. norvegicus
ctgagctacgtgagac

SEQ ID NO: 497734 - DNA, 16 bp, R. norvegicus
ctgagctagatcccca

SEQ ID NO: 497735 - DNA, 16 bp, R. norvegicus
ctgagctccacctgat

SEQ ID NO: 497736 - DNA, 16 bp, R. norvegicus
ctgagctcccaggaac

SEQ ID NO: 497737 - DNA, 16 bp, R. norvegicus
ctgagctcctcctgag

SEQ ID NO: 497738 - DNA, 16 bp, R. norvegicus
ctgagctcctgagctg

SEQ ID NO: 497739 - DNA, 16 bp, R. norvegicus
ctgagctctctctctc

SEQ ID NO: 497740 - DNA, 16 bp, R. norvegicus
ctgagctctgagggga

SEQ ID NO: 497741 - DNA, 16 bp, R. norvegicus
ctgagctctgcctgat

SEQ ID NO: 497742 - DNA, 16 bp, R. norvegicus
ctgagctctggctggc

SEQ ID NO: 497743 - DNA, 16 bp, R. norvegicus
ctgagctctggggaca

SEQ ID NO: 497744 - DNA, 16 bp, R. norvegicus
ctgagctctgttccca

SEQ ID NO: 497745 - DNA, 16 bp, R. norvegicus
ctgagctcttcttcaa

SEQ ID NO: 497746 - DNA, 16 bp, R. norvegicus
ctgagctgcctctcca

SEQ ID NO: 497747 - DNA, 16 bp, R. norvegicus
ctgagctgcctgtctg

SEQ ID NO: 497748 - DNA, 16 bp, R. norvegicus
ctgagctgtttcccca

SEQ ID NO: 497749 - DNA, 16 bp, R. norvegicus
ctgagcttccagttca

SEQ ID NO: 497750 - DNA, 16 bp, R. norvegicus
ctgagcttgaggccag

SEQ ID NO: 497751 - DNA, 16 bp, R. norvegicus
ctgaggaaaagaaggt

SEQ ID NO: 497752 - DNA, 16 bp, R. norvegicus
ctgaggaaaaggaggt

SEQ ID NO: 497753 - DNA, 16 bp, R. norvegicus
ctgaggaaacttcaga

SEQ ID NO: 497754 - DNA, 16 bp, R. norvegicus
ctgaggaaattcaaaa

SEQ ID NO: 497755 - DNA, 16 bp, R. norvegicus
ctgaggaacaaccaga

SEQ ID NO: 497756 - DNA, 16 bp, R. norvegicus
ctgaggaacatccaga

SEQ ID NO: 497757 - DNA, 16 bp, R. norvegicus
ctgaggaaccaccaga

SEQ ID NO: 497758 - DNA, 16 bp, R. norvegicus
ctgaggaacctccagg

SEQ ID NO: 497759 - DNA, 16 bp, R. norvegicus
ctgaggaaccttcaga

SEQ ID NO: 497760 - DNA, 16 bp, R. norvegicus
ctgaggaagaaaggga

SEQ ID NO: 497761 - DNA, 16 bp, R. norvegicus
ctgaggaagaacttgg

SEQ ID NO: 497762 - DNA, 16 bp, R. norvegicus
ctgaggaagacatctg

SEQ ID NO: 497763 - DNA, 16 bp, R. norvegicus
ctgaggaagagggcag

SEQ ID NO: 497764 - DNA, 16 bp, R. norvegicus
ctgaggaagagggtga

SEQ ID NO: 497765 - DNA, 16 bp, R. norvegicus
ctgaggaagatctcag

SEQ ID NO: 497766 - DNA, 16 bp, R. norvegicus
ctgaggaagcatttga

SEQ ID NO: 497767 - DNA, 16 bp, R. norvegicus
ctgaggaagctccaga

SEQ ID NO: 497768 - DNA, 16 bp, R. norvegicus
ctgaggaaggaggatt

SEQ ID NO: 497769 - DNA, 16 bp, R. norvegicus
ctgaggaagtctggcc

SEQ ID NO: 497770 - DNA, 16 bp, R. norvegicus
ctgaggaatactgaat

SEQ ID NO: 497771 - DNA, 16 bp, R. norvegicus
ctgaggacacagccat

SEQ ID NO: 497772 - DNA, 16 bp, R. norvegicus
ctgaggacacagctgt

SEQ ID NO: 497773 - DNA, 16 bp, R. norvegicus
ctgaggacagaaccca

SEQ ID NO: 497774 - DNA, 16 bp, R. norvegicus
ctgaggacagctgcag

SEQ ID NO: 497775 - DNA, 16 bp, R. norvegicus
ctgaggacagggagag

SEQ ID NO: 497776 - DNA, 16 bp, R. norvegicus
ctgaggacattaaaaa

SEQ ID NO: 497777 - DNA, 16 bp, R. norvegicus
ctgaggacattaagag

SEQ ID NO: 497778 - DNA, 16 bp, R. norvegicus
ctgaggacccagcaat

SEQ ID NO: 497779 - DNA, 21 bp, R. norvegicus
ctgaggaccgaacccagggcc

SEQ ID NO: 497780 - DNA, 17 bp, R. norvegicus
ctgaggacttcttcaat

SEQ ID NO: 497781 - DNA, 16 bp, R. norvegicus
ctgaggacttttgtga

SEQ ID NO: 497782 - DNA, 16 bp, R. norvegicus
ctgaggagaagcagag

SEQ ID NO: 497783 - DNA, 16 bp, R. norvegicus
ctgaggagatggaaaa

SEQ ID NO: 497784 - DNA, 16 bp, R. norvegicus
ctgaggagatggccca

SEQ ID NO: 497785 - DNA, 16 bp, R. norvegicus
ctgaggagatggctca

SEQ ID NO: 497786 - DNA, 16 bp, R. norvegicus
ctgaggagcagaagat

SEQ ID NO: 497787 - DNA, 16 bp, R. norvegicus
ctgaggagccaccaga

SEQ ID NO: 497788 - DNA, 16 bp, R. norvegicus
ctgaggagcctccaga

SEQ ID NO: 497789 - DNA, 16 bp, R. norvegicus
ctgaggagctgctggc

SEQ ID NO: 497790 - DNA, 16 bp, R. norvegicus
ctgaggaggaaagggt

SEQ ID NO: 497791 - DNA, 16 bp, R. norvegicus
ctgaggaggaagagaa

SEQ ID NO: 497792 - DNA, 16 bp, R. norvegicus
ctgaggaggaaggaga

SEQ ID NO: 497793 - DNA, 16 bp, R. norvegicus
ctgaggaggaaggagg

SEQ ID NO: 497794 - DNA, 16 bp, R. norvegicus
ctgaggaggaccaaat

SEQ ID NO: 497795 - DNA, 16 bp, R. norvegicus
ctgaggaggagagtga

SEQ ID NO: 497796 - DNA, 16 bp, R. norvegicus
ctgaggaggaggaggg

SEQ ID NO: 497797 - DNA, 16 bp, R. norvegicus
ctgaggaggaggatga

SEQ ID NO: 497798 - DNA, 16 bp, R. norvegicus
ctgaggaggagggagg

SEQ ID NO: 497799 - DNA, 16 bp, R. norvegicus
ctgaggaggagggtga

SEQ ID NO: 497800 - DNA, 16 bp, R. norvegicus
ctgaggaggcagaggc

SEQ ID NO: 497801 - DNA, 16 bp, R. norvegicus
ctgaggaggctgagga

SEQ ID NO: 497802 - DNA, 16 bp, R. norvegicus
ctgaggagggtggtga

SEQ ID NO: 497803 - DNA, 16 bp, R. norvegicus
ctgaggaggtggaggc

SEQ ID NO: 497804 - DNA, 16 bp, R. norvegicus
ctgaggatccaaccca

SEQ ID NO: 497805 - DNA, 16 bp, R. norvegicus
ctgaggatcctccaca

SEQ ID NO: 497806 - DNA, 16 bp, R. norvegicus
ctgaggatgaccctga

SEQ ID NO: 497807 - DNA, 16 bp, R. norvegicus
ctgaggatgctcagtc

SEQ ID NO: 497808 - DNA, 16 bp, R. norvegicus
ctgaggatgctgagga

SEQ ID NO: 497809 - DNA, 16 bp, R. norvegicus
ctgaggcagagaccac

SEQ ID NO: 497810 - DNA, 16 bp, R. norvegicus
ctgaggcagatgcaga

SEQ ID NO: 497811 - DNA, 16 bp, R. norvegicus
ctgaggcaggaagaga

SEQ ID NO: 497812 - DNA, 16 bp, R. norvegicus
ctgaggcaggaagata

SEQ ID NO: 497813 - DNA, 16 bp, R. norvegicus
ctgaggcaggaaggct

SEQ ID NO: 497814 - DNA, 16 bp, R. norvegicus
ctgaggcaggagaact

SEQ ID NO: 497815 - DNA, 16 bp, R. norvegicus
ctgaggcaggagactc

SEQ ID NO: 497816 - DNA, 16 bp, R. norvegicus
ctgaggcaggaggaca

SEQ ID NO: 497817 - DNA, 16 bp, R. norvegicus
ctgaggcaggagggtc

SEQ ID NO: 497818 - DNA, 16 bp, R. norvegicus
ctgaggcagtgggtgt

SEQ ID NO: 497819 - DNA, 16 bp, R. norvegicus
ctgaggcatcaaacct

SEQ ID NO: 497820 - DNA, 16 bp, R. norvegicus
ctgaggcatcccagga

SEQ ID NO: 497821 - DNA, 16 bp, R. norvegicus
ctgaggcatcttttgg

SEQ ID NO: 497822 - DNA, 16 bp, R. norvegicus
ctgaggcattgagcct

SEQ ID NO: 497823 - DNA, 16 bp, R. norvegicus
ctgaggccacaggaca

SEQ ID NO: 497824 - DNA, 16 bp, R. norvegicus
ctgaggccagagaagg

SEQ ID NO: 497825 - DNA, 16 bp, R. norvegicus
ctgaggccatggtgaa

SEQ ID NO: 497826 - DNA, 16 bp, R. norvegicus
ctgaggcccagccagg

SEQ ID NO: 497827 - DNA, 16 bp, R. norvegicus
ctgaggcctggctgtt

SEQ ID NO: 497828 - DNA, 16 bp, R. norvegicus
ctgaggctgagcctgg

SEQ ID NO: 497829 - DNA, 16 bp, R. norvegicus
ctgaggctgaggccag

SEQ ID NO: 497830 - DNA, 16 bp, R. norvegicus
ctgaggctgaggctgg

SEQ ID NO: 497831 - DNA, 16 bp, R. norvegicus
ctgaggctgcaggaca

SEQ ID NO: 497832 - DNA, 16 bp, R. norvegicus
ctgaggctggacaagg

SEQ ID NO: 497833 - DNA, 16 bp, R. norvegicus
ctgaggctggagtggg

SEQ ID NO: 497834 - DNA, 16 bp, R. norvegicus
ctgagggaaaggccaa

SEQ ID NO: 497835 - DNA, 16 bp, R. norvegicus
ctgagggaacagccaa

SEQ ID NO: 497836 - DNA, 16 bp, R. norvegicus
ctgagggaactcaggg

SEQ ID NO: 497837 - DNA, 16 bp, R. norvegicus
ctgagggaagtcagaa

SEQ ID NO: 497838 - DNA, 16 bp, R. norvegicus
ctgagggaagtcaggg

SEQ ID NO: 497839 - DNA, 16 bp, R. norvegicus
ctgagggaccagccac

SEQ ID NO: 497840 - DNA, 16 bp, R. norvegicus
ctgagggagaaatgaa

SEQ ID NO: 497841 - DNA, 16 bp, R. norvegicus
ctgagggagctgaagg

SEQ ID NO: 497842 - DNA, 16 bp, R. norvegicus
ctgagggagttcttca

SEQ ID NO: 497843 - DNA, 16 bp, R. norvegicus
ctgagggcagaggcag

SEQ ID NO: 497844 - DNA, 16 bp, R. norvegicus
ctgagggcctgcagaa

SEQ ID NO: 497845 - DNA, 16 bp, R. norvegicus
ctgagggctccaggag

SEQ ID NO: 497846 - DNA, 16 bp, R. norvegicus
ctgagggctccaggtg

SEQ ID NO: 497847 - DNA, 16 bp, R. norvegicus
ctgagggctgggacta

SEQ ID NO: 497848 - DNA, 16 bp, R. norvegicus
ctgaggggctgagggg

SEQ ID NO: 497849 - DNA, 16 bp, R. norvegicus
ctgagggtccagctcc

SEQ ID NO: 497850 - DNA, 16 bp, R. norvegicus
ctgagggtgactttga

SEQ ID NO: 497851 - DNA, 16 bp, R. norvegicus
ctgaggtaactgaggg

SEQ ID NO: 497852 - DNA, 16 bp, R. norvegicus
ctgaggtcctcatgct

SEQ ID NO: 497853 - DNA, 16 bp, R. norvegicus
ctgaggttccagctct

SEQ ID NO: 497854 - DNA, 18 bp, R. norvegicus
ctgagtacctgcagaaag

SEQ ID NO: 497855 - DNA, 16 bp, R. norvegicus
ctgagtcagggtctca

SEQ ID NO: 497856 - DNA, 16 bp, R. norvegicus
ctgagtcatctcacta

SEQ ID NO: 497857 - DNA, 16 bp, R. norvegicus
ctgagtccaccaggca

SEQ ID NO: 497858 - DNA, 16 bp, R. norvegicus
ctgagtctgagtctga

SEQ ID NO: 497859 - DNA, 16 bp, R. norvegicus
ctgagtctggggtctt

SEQ ID NO: 497860 - DNA, 16 bp, R. norvegicus
ctgagtctgtctcctt

SEQ ID NO: 497861 - DNA, 16 bp, R. norvegicus
ctgagtctgtggtctg

SEQ ID NO: 497862 - DNA, 16 bp, R. norvegicus
ctgagtctgtgtctga

SEQ ID NO: 497863 - DNA, 16 bp, R. norvegicus
ctgagtcttcaggtag

SEQ ID NO: 497864 - DNA, 16 bp, R. norvegicus
ctgagtgacacagcca

SEQ ID NO: 497865 - DNA, 16 bp, R. norvegicus
ctgagtgagctggggg

SEQ ID NO: 497866 - DNA, 16 bp, R. norvegicus
ctgagtgctgggattt

SEQ ID NO: 497867 - DNA, 16 bp, R. norvegicus
ctgagtgtccagctct

SEQ ID NO: 497868 - DNA, 16 bp, R. norvegicus
ctgagtgtgtatgtgt

SEQ ID NO: 497869 - DNA, 16 bp, R. norvegicus
ctgagttcaaaaccca

SEQ ID NO: 497870 - DNA, 16 bp, R. norvegicus
ctgagttcaaagtcag

SEQ ID NO: 497871 - DNA, 16 bp, R. norvegicus
ctgagttcaaatgcca

SEQ ID NO: 497872 - DNA, 16 bp, R. norvegicus
ctgagttcaacttcca

SEQ ID NO: 497873 - DNA, 16 bp, R. norvegicus
ctgagttcaagtccag

SEQ ID NO: 497874 - DNA, 16 bp, R. norvegicus
ctgagttcaatactca

SEQ ID NO: 497875 - DNA, 16 bp, R. norvegicus
ctgagttcaatcctgg

SEQ ID NO: 497876 - DNA, 16 bp, R. norvegicus
ctgagttcaatcttca

SEQ ID NO: 497877 - DNA, 16 bp, R. norvegicus
ctgagttcagatcctg

SEQ ID NO: 497878 - DNA, 16 bp, R. norvegicus
ctgagttcatatattc

SEQ ID NO: 497879 - DNA, 16 bp, R. norvegicus
ctgagttccatcccca

SEQ ID NO: 497880 - DNA, 16 bp, R. norvegicus
ctgagtttaaggccag

SEQ ID NO: 497881 - DNA, 16 bp, R. norvegicus
ctgagtttagtgggat

SEQ ID NO: 497882 - DNA, 16 bp, R. norvegicus
ctgagtttgaaccctg

SEQ ID NO: 497883 - DNA, 16 bp, R. norvegicus
ctgagtttgaagccag

SEQ ID NO: 497884 - DNA, 16 bp, R. norvegicus
ctgagtttgaagctag

SEQ ID NO: 497885 - DNA, 16 bp, R. norvegicus
ctgagtttggttcctg

SEQ ID NO: 497886 - DNA, 16 bp, R. norvegicus
ctgagttttctttctt

SEQ ID NO: 497887 - DNA, 16 bp, R. norvegicus
ctgagttttttaatct

SEQ ID NO: 497888 - DNA, 16 bp, R. norvegicus
ctgataaaagatacca

SEQ ID NO: 497889 - DNA, 16 bp, R. norvegicus
ctgataaacaagttca

SEQ ID NO: 497890 - DNA, 16 bp, R. norvegicus
ctgataattttttaat

SEQ ID NO: 497891 - DNA, 16 bp, R. norvegicus
ctgatacactcctttc

SEQ ID NO: 497892 - DNA, 16 bp, R. norvegicus
ctgatacaggtgagga

SEQ ID NO: 497893 - DNA, 38 bp, R. norvegicus
ctgatagttatgaactgcagatccctgtgctcaatagt

SEQ ID NO: 497894 - DNA, 16 bp, R. norvegicus
ctgatattctcttctg

SEQ ID NO: 497895 - DNA, 16 bp, R. norvegicus
ctgatccagggctcca

SEQ ID NO: 497896 - DNA, 16 bp, R. norvegicus
ctgatcccatcccaca

SEQ ID NO: 497897 - DNA, 16 bp, R. norvegicus
ctgatcctcctgcccc

SEQ ID NO: 497898 - DNA, 16 bp, R. norvegicus
ctgatcctcctgcctc

SEQ ID NO: 497899 - DNA, 21 bp, R. norvegicus
ctgatcgatctcaagcaccag

SEQ ID NO: 497900 - DNA, 16 bp, R. norvegicus
ctgatctcttcctagg

SEQ ID NO: 497901 - DNA, 16 bp, R. norvegicus
ctgatcttccagagaa

SEQ ID NO: 497902 - DNA, 16 bp, R. norvegicus
ctgatcttggttgtca

SEQ ID NO: 497903 - DNA, 16 bp, R. norvegicus
ctgatgaacaaaacag

SEQ ID NO: 497904 - DNA, 16 bp, R. norvegicus
ctgatgaagccaagaa

SEQ ID NO: 497905 - DNA, 16 bp, R. norvegicus
ctgatgagccatcttg

SEQ ID NO: 497906 - DNA, 16 bp, R. norvegicus
ctgatgatctttttaa

SEQ ID NO: 497907 - DNA, 16 bp, R. norvegicus
ctgatgatttttttca

SEQ ID NO: 497908 - DNA, 16 bp, R. norvegicus
ctgatgatttttttga

SEQ ID NO: 497909 - DNA, 16 bp, R. norvegicus
ctgatgcagatgagga

SEQ ID NO: 497910 - DNA, 16 bp, R. norvegicus
ctgatgcatgctggga

SEQ ID NO: 497911 - DNA, 16 bp, R. norvegicus
ctgatgccaagaagcc

SEQ ID NO: 497912 - DNA, 16 bp, R. norvegicus
ctgatgccaagaagcg

SEQ ID NO: 497913 - DNA, 16 bp, R. norvegicus
ctgatgccaagaggtg

SEQ ID NO: 497914 - DNA, 16 bp, R. norvegicus
ctgatgccagagaagg

SEQ ID NO: 497915 - DNA, 16 bp, R. norvegicus
ctgatgccctcttttg

SEQ ID NO: 497916 - DNA, 16 bp, R. norvegicus
ctgatgcccttctctg

SEQ ID NO: 497917 - DNA, 16 bp, R. norvegicus
ctgatgcctgcctgcc

SEQ ID NO: 497918 - DNA, 16 bp, R. norvegicus
ctgatgctaagaagta

SEQ ID NO: 497919 - DNA, 16 bp, R. norvegicus
ctgatgctctcttctg

SEQ ID NO: 497920 - DNA, 16 bp, R. norvegicus
ctgatgctgatgctgg

SEQ ID NO: 497921 - DNA, 16 bp, R. norvegicus
ctgatgctggtcttca

SEQ ID NO: 497922 - DNA, 16 bp, R. norvegicus
ctgatgctggtgctgg

SEQ ID NO: 497923 - DNA, 16 bp, R. norvegicus
ctgatgctgtggtgtg

SEQ ID NO: 497924 - DNA, 16 bp, R. norvegicus
ctgatggagaagcaaa

SEQ ID NO: 497925 - DNA, 16 bp, R. norvegicus
ctgatggcctttcctt

SEQ ID NO: 497926 - DNA, 16 bp, R. norvegicus
ctgatggcttcttctg

SEQ ID NO: 497927 - DNA, 16 bp, R. norvegicus
ctgatggtccagctct

SEQ ID NO: 497928 - DNA, 16 bp, R. norvegicus
ctgatggtggtggcag

SEQ ID NO: 497929 - DNA, 16 bp, R. norvegicus
ctgatgtagctgtctt

SEQ ID NO: 497930 - DNA, 16 bp, R. norvegicus
ctgatgtccctcaaca

SEQ ID NO: 497931 - DNA, 16 bp, R. norvegicus
ctgatgtctatatgca

SEQ ID NO: 497932 - DNA, 16 bp, R. norvegicus
ctgatgtggaggccat

SEQ ID NO: 497933 - DNA, 16 bp, R. norvegicus
ctgatgtggttgaaga

SEQ ID NO: 497934 - DNA, 16 bp, R. norvegicus
ctgatgtgtctgaaaa

SEQ ID NO: 497935 - DNA, 16 bp, R. norvegicus
ctgatgtgtgctctct

SEQ ID NO: 497936 - DNA, 16 bp, R. norvegicus
ctgatgttctctcctg

SEQ ID NO: 497937 - DNA, 16 bp, R. norvegicus
ctgatgttctctttct

SEQ ID NO: 497938 - DNA, 16 bp, R. norvegicus
ctgattcaatctattt

SEQ ID NO: 497939 - DNA, 16 bp, R. norvegicus
ctgattctctcttctg

SEQ ID NO: 497940 - DNA, 16 bp, R. norvegicus
ctgattctgattctga

SEQ ID NO: 497941 - DNA, 16 bp, R. norvegicus
ctgattggtctcctct

SEQ ID NO: 497942 - DNA, 16 bp, R. norvegicus
ctgattggtttgaggt

SEQ ID NO: 497943 - DNA, 16 bp, R. norvegicus
ctgatttatgtttggt

SEQ ID NO: 497944 - DNA, 16 bp, R. norvegicus
ctgatttccaggccaa

SEQ ID NO: 497945 - DNA, 16 bp, R. norvegicus
ctgatttctttggaga

SEQ ID NO: 497946 - DNA, 16 bp, R. norvegicus
ctgattttctcaaaga

SEQ ID NO: 497947 - DNA, 16 bp, R. norvegicus
ctgattttttttaaaa

SEQ ID NO: 497948 - DNA, 16 bp, R. norvegicus
ctgcaaaaggagcagc

SEQ ID NO: 497949 - DNA, 16 bp, R. norvegicus
ctgcaaacacaaacaa

SEQ ID NO: 497950 - DNA, 16 bp, R. norvegicus
ctgcaaaccaaatcca

SEQ ID NO: 497951 - DNA, 16 bp, R. norvegicus
ctgcaaaccaacagtc

SEQ ID NO: 497952 - DNA, 16 bp, R. norvegicus
ctgcaaagctctgtaa

SEQ ID NO: 497953 - DNA, 16 bp, R. norvegicus
ctgcaacaacaacaac

SEQ ID NO: 497954 - DNA, 16 bp, R. norvegicus
ctgcaaccaaggcctt

SEQ ID NO: 497955 - DNA, 16 bp, R. norvegicus
ctgcaaccccagctcc

SEQ ID NO: 497956 - DNA, 16 bp, R. norvegicus
ctgcaacttcactgcc

SEQ ID NO: 497957 - DNA, 16 bp, R. norvegicus
ctgcaagaaagctgct

SEQ ID NO: 497958 - DNA, 16 bp, R. norvegicus
ctgcaagaacaagtgc

SEQ ID NO: 497959 - DNA, 16 bp, R. norvegicus
ctgcaagaagaagctt

SEQ ID NO: 497960 - DNA, 16 bp, R. norvegicus
ctgcaagagaaacaag

SEQ ID NO: 497961 - DNA, 16 bp, R. norvegicus
ctgcaagagcaatatg

SEQ ID NO: 497962 - DNA, 16 bp, R. norvegicus
ctgcaagagcagcagc

SEQ ID NO: 497963 - DNA, 16 bp, R. norvegicus
ctgcaagcataacaca

SEQ ID NO: 497964 - DNA, 16 bp, R. norvegicus
ctgcaagctcacttgg

SEQ ID NO: 497965 - DNA, 16 bp, R. norvegicus
ctgcaaggatctgcag

SEQ ID NO: 497966 - DNA, 16 bp, R. norvegicus
ctgcaagggacctgcc

SEQ ID NO: 497967 - DNA, 16 bp, R. norvegicus
ctgcaagggcaacaag

SEQ ID NO: 497968 - DNA, 16 bp, R. norvegicus
ctgcaagttcaaagcc

SEQ ID NO: 497969 - DNA, 16 bp, R. norvegicus
ctgcaagttcaaggcc

SEQ ID NO: 497970 - DNA, 16 bp, R. norvegicus
ctgcaataaaaagaca

SEQ ID NO: 497971 - DNA, 16 bp, R. norvegicus
ctgcaatcccagtact

SEQ ID NO: 497972 - DNA, 16 bp, R. norvegicus
ctgcaatccccttcag

SEQ ID NO: 497973 - DNA, 16 bp, R. norvegicus
ctgcaatgccaccaac

SEQ ID NO: 497974 - DNA, 16 bp, R. norvegicus
ctgcaattctattcca

SEQ ID NO: 497975 - DNA, 16 bp, R. norvegicus
ctgcacaaacatcagg

SEQ ID NO: 497976 - DNA, 16 bp, R. norvegicus
ctgcacaagactgggc

SEQ ID NO: 497977 - DNA, 16 bp, R. norvegicus
ctgcacacacacatgc

SEQ ID NO: 497978 - DNA, 18 bp, R. norvegicus
ctgcacacacatctcaga

SEQ ID NO: 497979 - DNA, 16 bp, R. norvegicus
ctgcacacactgcaca

SEQ ID NO: 497980 - DNA, 16 bp, R. norvegicus
ctgcacacatgtgcac

SEQ ID NO: 497981 - DNA, 16 bp, R. norvegicus
ctgcacaccacacaca

SEQ ID NO: 497982 - DNA, 16 bp, R. norvegicus
ctgcacactgccctgc

SEQ ID NO: 497983 - DNA, 16 bp, R. norvegicus
ctgcacagaaaaaccc

SEQ ID NO: 497984 - DNA, 16 bp, R. norvegicus
ctgcacagcctacagg

SEQ ID NO: 497985 - DNA, 16 bp, R. norvegicus
ctgcacagtgcctctg

SEQ ID NO: 497986 - DNA, 16 bp, R. norvegicus
ctgcacatccttgcca

SEQ ID NO: 497987 - DNA, 16 bp, R. norvegicus
ctgcacatggaggact

SEQ ID NO: 497988 - DNA, 16 bp, R. norvegicus
ctgcaccaaacccatc

SEQ ID NO: 497989 - DNA, 16 bp, R. norvegicus
ctgcaccagctcctgc

SEQ ID NO: 497990 - DNA, 16 bp, R. norvegicus
ctgcaccatgactgcc

SEQ ID NO: 497991 - DNA, 16 bp, R. norvegicus
ctgcaccatgcctgct

SEQ ID NO: 497992 - DNA, 16 bp, R. norvegicus
ctgcacccaaacccca

SEQ ID NO: 497993 - DNA, 16 bp, R. norvegicus
ctgcacccagagctga

SEQ ID NO: 497994 - DNA, 16 bp, R. norvegicus
ctgcacccctgcaccc

SEQ ID NO: 497995 - DNA, 16 bp, R. norvegicus
ctgcaccctcaaaaaa

SEQ ID NO: 497996 - DNA, 16 bp, R. norvegicus
ctgcaccctgagctga

SEQ ID NO: 497997 - DNA, 16 bp, R. norvegicus
ctgcactcctgggtgg

SEQ ID NO: 497998 - DNA, 16 bp, R. norvegicus
ctgcactgaacccatt

SEQ ID NO: 497999 - DNA, 17 bp, R. norvegicus
ctgcactgaccccattt

SEQ ID NO: 498000 - DNA, 16 bp, R. norvegicus
ctgcactgcaccatcc

SEQ ID NO: 498001 - DNA, 16 bp, R. norvegicus
ctgcactggctgctca

SEQ ID NO: 498002 - DNA, 16 bp, R. norvegicus
ctgcacttctgagagt

SEQ ID NO: 498003 - DNA, 16 bp, R. norvegicus
ctgcacttctgggagt

SEQ ID NO: 498004 - DNA, 36 bp, R. norvegicus
ctgcacttctttgcttcatccatcttgtctaattgg

SEQ ID NO: 498005 - DNA, 16 bp, R. norvegicus
ctgcagaaagtaacag

SEQ ID NO: 498006 - DNA, 16 bp, R. norvegicus
ctgcagaacatttcac

SEQ ID NO: 498007 - DNA, 16 bp, R. norvegicus
ctgcagaaccagggca

SEQ ID NO: 498008 - DNA, 18 bp, R. norvegicus
ctgcagaacctggaaaag

SEQ ID NO: 498009 - DNA, 16 bp, R. norvegicus
ctgcagaagccaaaag

SEQ ID NO: 498010 - DNA, 16 bp, R. norvegicus
ctgcagaatgcagggt

SEQ ID NO: 498011 - DNA, 16 bp, R. norvegicus
ctgcagaatttcaagt

SEQ ID NO: 498012 - DNA, 16 bp, R. norvegicus
ctgcagaccaggctga

SEQ ID NO: 498013 - DNA, 16 bp, R. norvegicus
ctgcagagaaggctca

SEQ ID NO: 498014 - DNA, 16 bp, R. norvegicus
ctgcagagagagcaga

SEQ ID NO: 498015 - DNA, 16 bp, R. norvegicus
ctgcagagagcctggg

SEQ ID NO: 498016 - DNA, 16 bp, R. norvegicus
ctgcagagaggaaaaa

SEQ ID NO: 498017 - DNA, 16 bp, R. norvegicus
ctgcagagcagaaaag

SEQ ID NO: 498018 - DNA, 16 bp, R. norvegicus
ctgcagagcaggctgg

SEQ ID NO: 498019 - DNA, 16 bp, R. norvegicus
ctgcagagccccatat

SEQ ID NO: 498020 - DNA, 16 bp, R. norvegicus
ctgcagaggacccagg

SEQ ID NO: 498021 - DNA, 16 bp, R. norvegicus
ctgcagaggcagaggc

SEQ ID NO: 498022 - DNA, 16 bp, R. norvegicus
ctgcagaggccagaga

SEQ ID NO: 498023 - DNA, 16 bp, R. norvegicus
ctgcagaggccagagc

SEQ ID NO: 498024 - DNA, 16 bp, R. norvegicus
ctgcagaggccaggag

SEQ ID NO: 498025 - DNA, 16 bp, R. norvegicus
ctgcagagtccagaag

SEQ ID NO: 498026 - DNA, 16 bp, R. norvegicus
ctgcagagtgagtttc

SEQ ID NO: 498027 - DNA, 16 bp, R. norvegicus
ctgcagatctatgaag

SEQ ID NO: 498028 - DNA, 16 bp, R. norvegicus
ctgcagatttccagac

SEQ ID NO: 498029 - DNA, 16 bp, R. norvegicus
ctgcagcaaagcattt

SEQ ID NO: 498030 - DNA, 16 bp, R. norvegicus
ctgcagcaaagcgttt

SEQ ID NO: 498031 - DNA, 16 bp, R. norvegicus
ctgcagcaacaacagc

SEQ ID NO: 498032 - DNA, 16 bp, R. norvegicus
ctgcagcaagctcatc

SEQ ID NO: 498033 - DNA, 16 bp, R. norvegicus
ctgcagcaatgccaga

SEQ ID NO: 498034 - DNA, 16 bp, R. norvegicus
ctgcagcacacacagc

SEQ ID NO: 498035 - DNA, 16 bp, R. norvegicus
ctgcagcactctggag

SEQ ID NO: 498036 - DNA, 16 bp, R. norvegicus
ctgcagcagcagcaac

SEQ ID NO: 498037 - DNA, 16 bp, R. norvegicus
ctgcagcagcaggggt

SEQ ID NO: 498038 - DNA, 16 bp, R. norvegicus
ctgcagcagctcctcc

SEQ ID NO: 498039 - DNA, 16 bp, R. norvegicus
ctgcagcagctcctgc

SEQ ID NO: 498040 - DNA, 16 bp, R. norvegicus
ctgcagcagctggaac

SEQ ID NO: 498041 - DNA, 16 bp, R. norvegicus
ctgcagcaggtggtct

SEQ ID NO: 498042 - DNA, 16 bp, R. norvegicus
ctgcagccaggagaga

SEQ ID NO: 498043 - DNA, 16 bp, R. norvegicus
ctgcagccaggagtct

SEQ ID NO: 498044 - DNA, 16 bp, R. norvegicus
ctgcagccagtgaggg

SEQ ID NO: 498045 - DNA, 16 bp, R. norvegicus
ctgcagccattcctcc

SEQ ID NO: 498046 - DNA, 16 bp, R. norvegicus
ctgcagccctgcctgt

SEQ ID NO: 498047 - DNA, 16 bp, R. norvegicus
ctgcagccctggctgt

SEQ ID NO: 498048 - DNA, 16 bp, R. norvegicus
ctgcagcctgcagcct

SEQ ID NO: 498049 - DNA, 16 bp, R. norvegicus
ctgcagcctgtccctc

SEQ ID NO: 498050 - DNA, 16 bp, R. norvegicus
ctgcagcgacagcaac

SEQ ID NO: 498051 - DNA, 16 bp, R. norvegicus
ctgcagctccaggaga

SEQ ID NO: 498052 - DNA, 16 bp, R. norvegicus
ctgcagctccagtgcc

SEQ ID NO: 498053 - DNA, 16 bp, R. norvegicus
ctgcagctctagagat

SEQ ID NO: 498054 - DNA, 16 bp, R. norvegicus
ctgcagctgactgggg

SEQ ID NO: 498055 - DNA, 16 bp, R. norvegicus
ctgcagctgcagcaac

SEQ ID NO: 498056 - DNA, 16 bp, R. norvegicus
ctgcagctgcagctgc

SEQ ID NO: 498057 - DNA, 16 bp, R. norvegicus
ctgcagctgcctgggg

SEQ ID NO: 498058 - DNA, 16 bp, R. norvegicus
ctgcagctggcaaaga

SEQ ID NO: 498059 - DNA, 16 bp, R. norvegicus
ctgcagctggctggga

SEQ ID NO: 498060 - DNA, 17 bp, R. norvegicus
ctgcaggaaatggacag

SEQ ID NO: 498061 - DNA, 16 bp, R. norvegicus
ctgcaggaaatggaga

SEQ ID NO: 498062 - DNA, 16 bp, R. norvegicus
ctgcaggacacaatgg

SEQ ID NO: 498063 - DNA, 16 bp, R. norvegicus
ctgcaggacccctgcc

SEQ ID NO: 498064 - DNA, 16 bp, R. norvegicus
ctgcaggagatgatgg

SEQ ID NO: 498065 - DNA, 16 bp, R. norvegicus
ctgcaggagggagaga

SEQ ID NO: 498066 - DNA, 16 bp, R. norvegicus
ctgcaggagttggttc

SEQ ID NO: 498067 - DNA, 16 bp, R. norvegicus
ctgcaggatggaatgt

SEQ ID NO: 498068 - DNA, 16 bp, R. norvegicus
ctgcaggatgggagga

SEQ ID NO: 498069 - DNA, 16 bp, R. norvegicus
ctgcaggcacacagtg

SEQ ID NO: 498070 - DNA, 16 bp, R. norvegicus
ctgcaggcactcagaa

SEQ ID NO: 498071 - DNA, 17 bp, R. norvegicus
ctgcaggcactcagtgc

SEQ ID NO: 498072 - DNA, 16 bp, R. norvegicus
ctgcaggcagcagcag

SEQ ID NO: 498073 - DNA, 16 bp, R. norvegicus
ctgcaggcagccagga

SEQ ID NO: 498074 - DNA, 16 bp, R. norvegicus
ctgcaggcttcaccat

SEQ ID NO: 498075 - DNA, 16 bp, R. norvegicus
ctgcaggggacccaga

SEQ ID NO: 498076 - DNA, 16 bp, R. norvegicus
ctgcaggggcggggcc

SEQ ID NO: 498077 - DNA, 16 bp, R. norvegicus
ctgcagtcacatatgc

SEQ ID NO: 498078 - DNA, 16 bp, R. norvegicus
ctgcagtccaacttct

SEQ ID NO: 498079 - DNA, 16 bp, R. norvegicus
ctgcagtctcaggact

SEQ ID NO: 498080 - DNA, 16 bp, R. norvegicus
ctgcagtctcaggatg

SEQ ID NO: 498081 - DNA, 16 bp, R. norvegicus
ctgcagtctctggcat

SEQ ID NO: 498082 - DNA, 16 bp, R. norvegicus
ctgcagtgacttgatg

SEQ ID NO: 498083 - DNA, 16 bp, R. norvegicus
ctgcagtgaggctgtc

SEQ ID NO: 498084 - DNA, 16 bp, R. norvegicus
ctgcagtgccccaagg

SEQ ID NO: 498085 - DNA, 16 bp, R. norvegicus
ctgcagtgctgggatt

SEQ ID NO: 498086 - DNA, 16 bp, R. norvegicus
ctgcagtgctgtgtga

SEQ ID NO: 498087 - DNA, 16 bp, R. norvegicus
ctgcagtggcagcaac

SEQ ID NO: 498088 - DNA, 16 bp, R. norvegicus
ctgcagttatcacaga

SEQ ID NO: 498089 - DNA, 16 bp, R. norvegicus
ctgcagttccaggaga

SEQ ID NO: 498090 - DNA, 16 bp, R. norvegicus
ctgcagttccagggga

SEQ ID NO: 498091 - DNA, 16 bp, R. norvegicus
ctgcagttgccattct

SEQ ID NO: 498092 - DNA, 16 bp, R. norvegicus
ctgcatacaggaaaga

SEQ ID NO: 498093 - DNA, 16 bp, R. norvegicus
ctgcatagctctggct

SEQ ID NO: 498094 - DNA, 16 bp, R. norvegicus
ctgcatagtgagactc

SEQ ID NO: 498095 - DNA, 16 bp, R. norvegicus
ctgcatatctgctaca

SEQ ID NO: 498096 - DNA, 16 bp, R. norvegicus
ctgcatatctgtctgt

SEQ ID NO: 498097 - DNA, 16 bp, R. norvegicus
ctgcatatgtgcaggg

SEQ ID NO: 498098 - DNA, 16 bp, R. norvegicus
ctgcatattagatatt

SEQ ID NO: 498099 - DNA, 16 bp, R. norvegicus
ctgcatcaactcctgc

SEQ ID NO: 498100 - DNA, 16 bp, R. norvegicus
ctgcatcaattcctgc

SEQ ID NO: 498101 - DNA, 16 bp, R. norvegicus
ctgcatcagttcctgc

SEQ ID NO: 498102 - DNA, 16 bp, R. norvegicus
ctgcatcccaggcatg

SEQ ID NO: 498103 - DNA, 16 bp, R. norvegicus
ctgcatccccagtgct

SEQ ID NO: 498104 - DNA, 16 bp, R. norvegicus
ctgcatccctggatcc

SEQ ID NO: 498105 - DNA, 16 bp, R. norvegicus
ctgcatctgactctgt

SEQ ID NO: 498106 - DNA, 16 bp, R. norvegicus
ctgcatctgtctgtct

SEQ ID NO: 498107 - DNA, 16 bp, R. norvegicus
ctgcatcttcatgtct

SEQ ID NO: 498108 - DNA, 16 bp, R. norvegicus
ctgcatgacagaagag

SEQ ID NO: 498109 - DNA, 16 bp, R. norvegicus
ctgcatgctgggatca

SEQ ID NO: 498110 - DNA, 16 bp, R. norvegicus
ctgcatggccacagtt

SEQ ID NO: 498111 - DNA, 16 bp, R. norvegicus
ctgcatgtgtagcaga

SEQ ID NO: 498112 - DNA, 17 bp, R. norvegicus
ctgcattcatcttgtct

SEQ ID NO: 498113 - DNA, 16 bp, R. norvegicus
ctgcattctgctgccc

SEQ ID NO: 498114 - DNA, 16 bp, R. norvegicus
ctgcattggtcagttg

SEQ ID NO: 498115 - DNA, 16 bp, R. norvegicus
ctgcattttcttttga

SEQ ID NO: 498116 - DNA, 16 bp, R. norvegicus
ctgccaaagatgctct

SEQ ID NO: 498117 - DNA, 16 bp, R. norvegicus
ctgccaaagctggaca

SEQ ID NO: 498118 - DNA, 16 bp, R. norvegicus
ctgccaaagctggact

SEQ ID NO: 498119 - DNA, 16 bp, R. norvegicus
ctgccaacagcagaga

SEQ ID NO: 498120 - DNA, 16 bp, R. norvegicus
ctgccaagccatctca

SEQ ID NO: 498121 - DNA, 16 bp, R. norvegicus
ctgccaaggaagctgc

SEQ ID NO: 498122 - DNA, 16 bp, R. norvegicus
ctgccaaggaagggct

SEQ ID NO: 498123 - DNA, 16 bp, R. norvegicus
ctgccaaggctgcccc

SEQ ID NO: 498124 - DNA, 16 bp, R. norvegicus
ctgccaagggagaaaa

SEQ ID NO: 498125 - DNA, 16 bp, R. norvegicus
ctgccaagtatgatga

SEQ ID NO: 498126 - DNA, 16 bp, R. norvegicus
ctgccaagtctgatga

SEQ ID NO: 498127 - DNA, 16 bp, R. norvegicus
ctgccaagttctactg

SEQ ID NO: 498128 - DNA, 16 bp, R. norvegicus
ctgccaattctgtgag

SEQ ID NO: 498129 - DNA, 16 bp, R. norvegicus
ctgccacacctgggaa

SEQ ID NO: 498130 - DNA, 16 bp, R. norvegicus
ctgccacagctgagag

SEQ ID NO: 498131 - DNA, 16 bp, R. norvegicus
ctgccaccaagcctaa

SEQ ID NO: 498132 - DNA, 16 bp, R. norvegicus
ctgccaccaccacacc

SEQ ID NO: 498133 - DNA, 16 bp, R. norvegicus
ctgccaccaccaccac

SEQ ID NO: 498134 - DNA, 16 bp, R. norvegicus
ctgccaccaccatcag

SEQ ID NO: 498135 - DNA, 16 bp, R. norvegicus
ctgccacccagttcca

SEQ ID NO: 498136 - DNA, 16 bp, R. norvegicus
ctgccacctcagagag

SEQ ID NO: 498137 - DNA, 16 bp, R. norvegicus
ctgccacctgagtgct

SEQ ID NO: 498138 - DNA, 16 bp, R. norvegicus
ctgccactgccaccac

SEQ ID NO: 498139 - DNA, 16 bp, R. norvegicus
ctgccactgccactgc

SEQ ID NO: 498140 - DNA, 16 bp, R. norvegicus
ctgccactgctgccac

SEQ ID NO: 498141 - DNA, 16 bp, R. norvegicus
ctgccagcagccttca

SEQ ID NO: 498142 - DNA, 16 bp, R. norvegicus
ctgccagcattgacct

SEQ ID NO: 498143 - DNA, 16 bp, R. norvegicus
ctgccagcctctgcct

SEQ ID NO: 498144 - DNA, 16 bp, R. norvegicus
ctgccagctcccccac

SEQ ID NO: 498145 - DNA, 16 bp, R. norvegicus
ctgccagctggtcagg

SEQ ID NO: 498146 - DNA, 16 bp, R. norvegicus
ctgccagctgtgagca

SEQ ID NO: 498147 - DNA, 16 bp, R. norvegicus
ctgccaggagggccag

SEQ ID NO: 498148 - DNA, 16 bp, R. norvegicus
ctgccaggctcagaga

SEQ ID NO: 498149 - DNA, 16 bp, R. norvegicus
ctgccaggcttcccac

SEQ ID NO: 498150 - DNA, 16 bp, R. norvegicus
ctgccagtggctcctt

SEQ ID NO: 498151 - DNA, 16 bp, R. norvegicus
ctgccatacctgggga

SEQ ID NO: 498152 - DNA, 16 bp, R. norvegicus
ctgccatcaccaccac

SEQ ID NO: 498153 - DNA, 16 bp, R. norvegicus
ctgccatgctccctgt

SEQ ID NO: 498154 - DNA, 16 bp, R. norvegicus
ctgccatgcttcctgc

SEQ ID NO: 498155 - DNA, 16 bp, R. norvegicus
ctgccatgtgggtgtg

SEQ ID NO: 498156 - DNA, 16 bp, R. norvegicus
ctgccatgttcccacc

SEQ ID NO: 498157 - DNA, 16 bp, R. norvegicus
ctgccatgttttctgc

SEQ ID NO: 498158 - DNA, 16 bp, R. norvegicus
ctgccattggacaaga

SEQ ID NO: 498159 - DNA, 16 bp, R. norvegicus
ctgccattggtgccca

SEQ ID NO: 498160 - DNA, 16 bp, R. norvegicus
ctgcccaagatcttct

SEQ ID NO: 498161 - DNA, 16 bp, R. norvegicus
ctgcccaagtacctgt

SEQ ID NO: 498162 - DNA, 16 bp, R. norvegicus
ctgcccaagtcctctc

SEQ ID NO: 498163 - DNA, 16 bp, R. norvegicus
ctgcccaatgccactg

SEQ ID NO: 498164 - DNA, 16 bp, R. norvegicus
ctgcccacagccctgg

SEQ ID NO: 498165 - DNA, 16 bp, R. norvegicus
ctgcccacagggacag

SEQ ID NO: 498166 - DNA, 16 bp, R. norvegicus
ctgcccacagtggcct

SEQ ID NO: 498167 - DNA, 16 bp, R. norvegicus
ctgcccacattcctgg

SEQ ID NO: 498168 - DNA, 16 bp, R. norvegicus
ctgcccacattcttga

SEQ ID NO: 498169 - DNA, 16 bp, R. norvegicus
ctgcccacatttcaga

SEQ ID NO: 498170 - DNA, 16 bp, R. norvegicus
ctgcccaccacagccc

SEQ ID NO: 498171 - DNA, 16 bp, R. norvegicus
ctgcccaccctgccca

SEQ ID NO: 498172 - DNA, 16 bp, R. norvegicus
ctgcccacctcctgcc

SEQ ID NO: 498173 - DNA, 16 bp, R. norvegicus
ctgcccacctctgccc

SEQ ID NO: 498174 - DNA, 16 bp, R. norvegicus
ctgcccactccagctg

SEQ ID NO: 498175 - DNA, 16 bp, R. norvegicus
ctgcccactgcaaaaa

SEQ ID NO: 498176 - DNA, 16 bp, R. norvegicus
ctgcccactgtgaaga

SEQ ID NO: 498177 - DNA, 16 bp, R. norvegicus
ctgcccagaaggctgg

SEQ ID NO: 498178 - DNA, 16 bp, R. norvegicus
ctgcccagagagagct

SEQ ID NO: 498179 - DNA, 16 bp, R. norvegicus
ctgcccagatctgaag

SEQ ID NO: 498180 - DNA, 16 bp, R. norvegicus
ctgcccagccacaaag

SEQ ID NO: 498181 - DNA, 16 bp, R. norvegicus
ctgcccagccactggc

SEQ ID NO: 498182 - DNA, 16 bp, R. norvegicus
ctgcccagccatctct

SEQ ID NO: 498183 - DNA, 16 bp, R. norvegicus
ctgcccagccattgac

SEQ ID NO: 498184 - DNA, 16 bp, R. norvegicus
ctgcccagccctgccc

SEQ ID NO: 498185 - DNA, 16 bp, R. norvegicus
ctgcccagctcctgtg

SEQ ID NO: 498186 - DNA, 16 bp, R. norvegicus
ctgcccaggagaggtg

SEQ ID NO: 498187 - DNA, 16 bp, R. norvegicus
ctgcccagtgctggga

SEQ ID NO: 498188 - DNA, 16 bp, R. norvegicus
ctgcccatccttcctc

SEQ ID NO: 498189 - DNA, 16 bp, R. norvegicus
ctgcccatctctgcct

SEQ ID NO: 498190 - DNA, 16 bp, R. norvegicus
ctgcccatgatcttct

SEQ ID NO: 498191 - DNA, 16 bp, R. norvegicus
ctgccccaaagacagc

SEQ ID NO: 498192 - DNA, 16 bp, R. norvegicus
ctgccccaaattgaga

SEQ ID NO: 498193 - DNA, 16 bp, R. norvegicus
ctgccccaaggacagt

SEQ ID NO: 498194 - DNA, 16 bp, R. norvegicus
ctgccccacatggaga

SEQ ID NO: 498195 - DNA, 16 bp, R. norvegicus
ctgccccaccacctgg

SEQ ID NO: 498196 - DNA, 16 bp, R. norvegicus
ctgccccacctgcaga

SEQ ID NO: 498197 - DNA, 16 bp, R. norvegicus
ctgccccacctgggaa

SEQ ID NO: 498198 - DNA, 16 bp, R. norvegicus
ctgccccagccctgcc

SEQ ID NO: 498199 - DNA, 16 bp, R. norvegicus
ctgccccagctgggga

SEQ ID NO: 498200 - DNA, 16 bp, R. norvegicus
ctgcccccacccagtg

SEQ ID NO: 498201 - DNA, 16 bp, R. norvegicus
ctgcccccaggttcct

SEQ ID NO: 498202 - DNA, 16 bp, R. norvegicus
ctgccccccaacttca

SEQ ID NO: 498203 - DNA, 16 bp, R. norvegicus
ctgccccccacacaca

SEQ ID NO: 498204 - DNA, 16 bp, R. norvegicus
ctgccccctggtggcc

SEQ ID NO: 498205 - DNA, 16 bp, R. norvegicus
ctgcccctacccctgc

SEQ ID NO: 498206 - DNA, 16 bp, R. norvegicus
ctgcccctcctccagc

SEQ ID NO: 498207 - DNA, 16 bp, R. norvegicus
ctgcccctgaggttct

SEQ ID NO: 498208 - DNA, 16 bp, R. norvegicus
ctgcccctgccccagc

SEQ ID NO: 498209 - DNA, 16 bp, R. norvegicus
ctgcccctgcttccca

SEQ ID NO: 498210 - DNA, 16 bp, R. norvegicus
ctgcccctggcacttc

SEQ ID NO: 498211 - DNA, 16 bp, R. norvegicus
ctgcccctgggacagg

SEQ ID NO: 498212 - DNA, 16 bp, R. norvegicus
ctgcccgcctctgcct

SEQ ID NO: 498213 - DNA, 16 bp, R. norvegicus
ctgcccggatgctgcc

SEQ ID NO: 498214 - DNA, 16 bp, R. norvegicus
ctgccctcacttccct

SEQ ID NO: 498215 - DNA, 16 bp, R. norvegicus
ctgccctcagtgggag

SEQ ID NO: 498216 - DNA, 16 bp, R. norvegicus
ctgccctcctcctcag

SEQ ID NO: 498217 - DNA, 16 bp, R. norvegicus
ctgccctctagtggcc

SEQ ID NO: 498218 - DNA, 16 bp, R. norvegicus
ctgccctctccccaac

SEQ ID NO: 498219 - DNA, 16 bp, R. norvegicus
ctgccctctcttctgt

SEQ ID NO: 498220 - DNA, 16 bp, R. norvegicus
ctgccctctgcacaca

SEQ ID NO: 498221 - DNA, 16 bp, R. norvegicus
ctgccctctgctctct

SEQ ID NO: 498222 - DNA, 16 bp, R. norvegicus
ctgccctgacatttcc

SEQ ID NO: 498223 - DNA, 18 bp, R. norvegicus
ctgccctgagaggaagat

SEQ ID NO: 498224 - DNA, 16 bp, R. norvegicus
ctgccctgagcagcct

SEQ ID NO: 498225 - DNA, 16 bp, R. norvegicus
ctgccctgccacctga

SEQ ID NO: 498226 - DNA, 16 bp, R. norvegicus
ctgccctgcccagccc

SEQ ID NO: 498227 - DNA, 16 bp, R. norvegicus
ctgccctgccttttct

SEQ ID NO: 498228 - DNA, 16 bp, R. norvegicus
ctgccctgctcccacc

SEQ ID NO: 498229 - DNA, 16 bp, R. norvegicus
ctgccctgggactcac

SEQ ID NO: 498230 - DNA, 16 bp, R. norvegicus
ctgccctgtgtcccac

SEQ ID NO: 498231 - DNA, 16 bp, R. norvegicus
ctgccctgtgtgcctg

SEQ ID NO: 498232 - DNA, 16 bp, R. norvegicus
ctgccctgtttaagtt

SEQ ID NO: 498233 - DNA, 16 bp, R. norvegicus
ctgcccttcccccaac

SEQ ID NO: 498234 - DNA, 16 bp, R. norvegicus
ctgcccttcccccagc

SEQ ID NO: 498235 - DNA, 16 bp, R. norvegicus
ctgcccttctgtgggc

SEQ ID NO: 498236 - DNA, 16 bp, R. norvegicus
ctgcccttggcctgtg

SEQ ID NO: 498237 - DNA, 16 bp, R. norvegicus
ctgccctttcagagga

SEQ ID NO: 498238 - DNA, 16 bp, R. norvegicus
ctgccgccgccgccac

SEQ ID NO: 498239 - DNA, 16 bp, R. norvegicus
ctgccgctcctgggcc

SEQ ID NO: 498240 - DNA, 18 bp, R. norvegicus
ctgccgctgccgctgccg

SEQ ID NO: 498241 - DNA, 16 bp, R. norvegicus
ctgccgctgcctccca

SEQ ID NO: 498242 - DNA, 16 bp, R. norvegicus
ctgccgctgctgctgc

SEQ ID NO: 498243 - DNA, 16 bp, R. norvegicus
ctgccgtgctcctgcc

SEQ ID NO: 498244 - DNA, 16 bp, R. norvegicus
ctgcctaagttctctc

SEQ ID NO: 498245 - DNA, 16 bp, R. norvegicus
ctgcctacaagaagta

SEQ ID NO: 498246 - DNA, 16 bp, R. norvegicus
ctgcctacctctgctt

SEQ ID NO: 498247 - DNA, 16 bp, R. norvegicus
ctgcctatctgcctat

SEQ ID NO: 498248 - DNA, 16 bp, R. norvegicus
ctgcctcaaaacaaca

SEQ ID NO: 498249 - DNA, 16 bp, R. norvegicus
ctgcctcaagaagaac

SEQ ID NO: 498250 - DNA, 16 bp, R. norvegicus
ctgcctcacatgtggc

SEQ ID NO: 498251 - DNA, 16 bp, R. norvegicus
ctgcctcaccctccca

SEQ ID NO: 498252 - DNA, 16 bp, R. norvegicus
ctgcctcacctcccta

SEQ ID NO: 498253 - DNA, 16 bp, R. norvegicus
ctgcctcactgccctg

SEQ ID NO: 498254 - DNA, 16 bp, R. norvegicus
ctgcctcagccccctg

SEQ ID NO: 498255 - DNA, 16 bp, R. norvegicus
ctgcctcagcctccgg

SEQ ID NO: 498256 - DNA, 16 bp, R. norvegicus
ctgcctcagctgcctc

SEQ ID NO: 498257 - DNA, 16 bp, R. norvegicus
ctgcctcagcttccaa

SEQ ID NO: 498258 - DNA, 16 bp, R. norvegicus
ctgcctcagcttttca

SEQ ID NO: 498259 - DNA, 16 bp, R. norvegicus
ctgcctcagttcctcc

SEQ ID NO: 498260 - DNA, 16 bp, R. norvegicus
ctgcctcagtttctgc

SEQ ID NO: 498261 - DNA, 16 bp, R. norvegicus
ctgcctcatccctgcc

SEQ ID NO: 498262 - DNA, 16 bp, R. norvegicus
ctgcctcatctggcct

SEQ ID NO: 498263 - DNA, 16 bp, R. norvegicus
ctgcctccaactccca

SEQ ID NO: 498264 - DNA, 16 bp, R. norvegicus
ctgcctccaaggaggc

SEQ ID NO: 498265 - DNA, 16 bp, R. norvegicus
ctgcctccacattcct

SEQ ID NO: 498266 - DNA, 16 bp, R. norvegicus
ctgcctccacctccac

SEQ ID NO: 498267 - DNA, 16 bp, R. norvegicus
ctgcctccacctcctc

SEQ ID NO: 498268 - DNA, 16 bp, R. norvegicus
ctgcctccacctcctg

SEQ ID NO: 498269 - DNA, 16 bp, R. norvegicus
ctgcctccactgcctc

SEQ ID NO: 498270 - DNA, 16 bp, R. norvegicus
ctgcctccaggattct

SEQ ID NO: 498271 - DNA, 16 bp, R. norvegicus
ctgcctccaggttccc

SEQ ID NO: 498272 - DNA, 16 bp, R. norvegicus
ctgcctccaggttctg

SEQ ID NO: 498273 - DNA, 16 bp, R. norvegicus
ctgcctccagttcctg

SEQ ID NO: 498274 - DNA, 16 bp, R. norvegicus
ctgcctccagtttcct

SEQ ID NO: 498275 - DNA, 16 bp, R. norvegicus
ctgcctccatgccctg

SEQ ID NO: 498276 - DNA, 16 bp, R. norvegicus
ctgcctcccaagcact

SEQ ID NO: 498277 - DNA, 16 bp, R. norvegicus
ctgcctcccaagggct

SEQ ID NO: 498278 - DNA, 16 bp, R. norvegicus
ctgcctcccaagttct

SEQ ID NO: 498279 - DNA, 16 bp, R. norvegicus
ctgcctcccactgctg

SEQ ID NO: 498280 - DNA, 16 bp, R. norvegicus
ctgcctcccagagctg

SEQ ID NO: 498281 - DNA, 16 bp, R. norvegicus
ctgcctcccagcccca

SEQ ID NO: 498282 - DNA, 16 bp, R. norvegicus
ctgcctcccaggtgtt

SEQ ID NO: 498283 - DNA, 16 bp, R. norvegicus
ctgcctcccagtgctg

SEQ ID NO: 498284 - DNA, 16 bp, R. norvegicus
ctgcctccccagccct

SEQ ID NO: 498285 - DNA, 16 bp, R. norvegicus
ctgcctccccagtcct

SEQ ID NO: 498286 - DNA, 16 bp, R. norvegicus
ctgcctccctggtgct

SEQ ID NO: 498287 - DNA, 16 bp, R. norvegicus
ctgcctcctagtgctg

SEQ ID NO: 498288 - DNA, 16 bp, R. norvegicus
ctgcctcctcttctat

SEQ ID NO: 498289 - DNA, 16 bp, R. norvegicus
ctgcctcctgaccctg

SEQ ID NO: 498290 - DNA, 16 bp, R. norvegicus
ctgcctcctgactgct

SEQ ID NO: 498291 - DNA, 16 bp, R. norvegicus
ctgcctcctgctgatg

SEQ ID NO: 498292 - DNA, 16 bp, R. norvegicus
ctgcctcctgctgctg

SEQ ID NO: 498293 - DNA, 16 bp, R. norvegicus
ctgcctcctgtgtact

SEQ ID NO: 498294 - DNA, 16 bp, R. norvegicus
ctgcctcggcctcctg

SEQ ID NO: 498295 - DNA, 16 bp, R. norvegicus
ctgcctcggttactgc

SEQ ID NO: 498296 - DNA, 16 bp, R. norvegicus
ctgcctctaccaccca

SEQ ID NO: 498297 - DNA, 16 bp, R. norvegicus
ctgcctctacctccca

SEQ ID NO: 498298 - DNA, 16 bp, R. norvegicus
ctgcctctactcctcc

SEQ ID NO: 498299 - DNA, 16 bp, R. norvegicus
ctgcctctacttccag

SEQ ID NO: 498300 - DNA, 16 bp, R. norvegicus
ctgcctctacttcctg

SEQ ID NO: 498301 - DNA, 16 bp, R. norvegicus
ctgcctctagagtgct

SEQ ID NO: 498302 - DNA, 16 bp, R. norvegicus
ctgcctctatctccca

SEQ ID NO: 498303 - DNA, 16 bp, R. norvegicus
ctgcctctccagtgct

SEQ ID NO: 498304 - DNA, 16 bp, R. norvegicus
ctgcctctccctctca

SEQ ID NO: 498305 - DNA, 16 bp, R. norvegicus
ctgcctctctccacct

SEQ ID NO: 498306 - DNA, 16 bp, R. norvegicus
ctgcctctctctctgc

SEQ ID NO: 498307 - DNA, 16 bp, R. norvegicus
ctgcctctctgactct

SEQ ID NO: 498308 - DNA, 16 bp, R. norvegicus
ctgcctctgactgctc

SEQ ID NO: 498309 - DNA, 16 bp, R. norvegicus
ctgcctctgagtgctg

SEQ ID NO: 498310 - DNA, 16 bp, R. norvegicus
ctgcctctgcagtgct

SEQ ID NO: 498311 - DNA, 16 bp, R. norvegicus
ctgcctctgccaagct

SEQ ID NO: 498312 - DNA, 16 bp, R. norvegicus
ctgcctctgccaccct

SEQ ID NO: 498313 - DNA, 16 bp, R. norvegicus
ctgcctctgcccagct

SEQ ID NO: 498314 - DNA, 16 bp, R. norvegicus
ctgcctctgcccctca

SEQ ID NO: 498315 - DNA, 16 bp, R. norvegicus
ctgcctctgcccctgc

SEQ ID NO: 498316 - DNA, 16 bp, R. norvegicus
ctgcctctgccctgcc

SEQ ID NO: 498317 - DNA, 16 bp, R. norvegicus
ctgcctctgcctccag

SEQ ID NO: 498318 - DNA, 16 bp, R. norvegicus
ctgcctctgcctccca

SEQ ID NO: 498319 - DNA, 16 bp, R. norvegicus
ctgcctctgcctctga

SEQ ID NO: 498320 - DNA, 16 bp, R. norvegicus
ctgcctctgcctctgg

SEQ ID NO: 498321 - DNA, 16 bp, R. norvegicus
ctgcctctgcctgctg

SEQ ID NO: 498322 - DNA, 16 bp, R. norvegicus
ctgcctctgcctgctt

SEQ ID NO: 498323 - DNA, 16 bp, R. norvegicus
ctgcctctgctccctg

SEQ ID NO: 498324 - DNA, 16 bp, R. norvegicus
ctgcctctgctcctgg

SEQ ID NO: 498325 - DNA, 16 bp, R. norvegicus
ctgcctctgctgcctg

SEQ ID NO: 498326 - DNA, 16 bp, R. norvegicus
ctgcctctgcttctgg

SEQ ID NO: 498327 - DNA, 16 bp, R. norvegicus
ctgcctctgctttcta

SEQ ID NO: 498328 - DNA, 16 bp, R. norvegicus
ctgcctctggagagct

SEQ ID NO: 498329 - DNA, 16 bp, R. norvegicus
ctgcctctgtccccca

SEQ ID NO: 498330 - DNA, 16 bp, R. norvegicus
ctgcctctgtcccttt

SEQ ID NO: 498331 - DNA, 16 bp, R. norvegicus
ctgcctctgtctcagg

SEQ ID NO: 498332 - DNA, 16 bp, R. norvegicus
ctgcctctgtgtcctg

SEQ ID NO: 498333 - DNA, 16 bp, R. norvegicus
ctgcctctgtttctca

SEQ ID NO: 498334 - DNA, 16 bp, R. norvegicus
ctgcctcttcctccag

SEQ ID NO: 498335 - DNA, 16 bp, R. norvegicus
ctgcctcttcctccca

SEQ ID NO: 498336 - DNA, 16 bp, R. norvegicus
ctgcctgaagacccag

SEQ ID NO: 498337 - DNA, 16 bp, R. norvegicus
ctgcctgacctctttg

SEQ ID NO: 498338 - DNA, 16 bp, R. norvegicus
ctgcctgagaacccag

SEQ ID NO: 498339 - DNA, 16 bp, R. norvegicus
ctgcctgagacacccc

SEQ ID NO: 498340 - DNA, 16 bp, R. norvegicus
ctgcctgagacaccga

SEQ ID NO: 498341 - DNA, 16 bp, R. norvegicus
ctgcctgagcctctca

SEQ ID NO: 498342 - DNA, 16 bp, R. norvegicus
ctgcctgaggatcctg

SEQ ID NO: 498343 - DNA, 16 bp, R. norvegicus
ctgcctgaggatgcca

SEQ ID NO: 498344 - DNA, 16 bp, R. norvegicus
ctgcctgcaactccag

SEQ ID NO: 498345 - DNA, 16 bp, R. norvegicus
ctgcctgcacctggag

SEQ ID NO: 498346 - DNA, 16 bp, R. norvegicus
ctgcctgcagaagcca

SEQ ID NO: 498347 - DNA, 16 bp, R. norvegicus
ctgcctgccaccatgt

SEQ ID NO: 498348 - DNA, 16 bp, R. norvegicus
ctgcctgccagcctgc

SEQ ID NO: 498349 - DNA, 16 bp, R. norvegicus
ctgcctgccctgcctc

SEQ ID NO: 498350 - DNA, 16 bp, R. norvegicus
ctgcctgccctggaac

SEQ ID NO: 498351 - DNA, 17 bp, R. norvegicus
ctgcctgccgagctgct

SEQ ID NO: 498352 - DNA, 16 bp, R. norvegicus
ctgcctgcctacagga

SEQ ID NO: 498353 - DNA, 16 bp, R. norvegicus
ctgcctgcctatctgc

SEQ ID NO: 498354 - DNA, 16 bp, R. norvegicus
ctgcctgcctccacct

SEQ ID NO: 498355 - DNA, 16 bp, R. norvegicus
ctgcctgcctcctgtc

SEQ ID NO: 498356 - DNA, 16 bp, R. norvegicus
ctgcctgcctctactt

SEQ ID NO: 498357 - DNA, 16 bp, R. norvegicus
ctgcctgcctctctct

SEQ ID NO: 498358 - DNA, 16 bp, R. norvegicus
ctgcctgcctctgccc

SEQ ID NO: 498359 - DNA, 16 bp, R. norvegicus
ctgcctgcctctgcct

SEQ ID NO: 498360 - DNA, 16 bp, R. norvegicus
ctgcctgcctctgttg

SEQ ID NO: 498361 - DNA, 16 bp, R. norvegicus
ctgcctgcctcttcct

SEQ ID NO: 498362 - DNA, 16 bp, R. norvegicus
ctgcctgcctgactga

SEQ ID NO: 498363 - DNA, 16 bp, R. norvegicus
ctgcctgcctgccacc

SEQ ID NO: 498364 - DNA, 16 bp, R. norvegicus
ctgcctgcctgccagc

SEQ ID NO: 498365 - DNA, 16 bp, R. norvegicus
ctgcctgcctgccagt

SEQ ID NO: 498366 - DNA, 16 bp, R. norvegicus
ctgcctgcctgcctgt

SEQ ID NO: 498367 - DNA, 16 bp, R. norvegicus
ctgcctgcctgtgtct

SEQ ID NO: 498368 - DNA, 16 bp, R. norvegicus
ctgcctgccttcttcc

SEQ ID NO: 498369 - DNA, 16 bp, R. norvegicus
ctgcctgcctttctct

SEQ ID NO: 498370 - DNA, 16 bp, R. norvegicus
ctgcctgcctttcttc

SEQ ID NO: 498371 - DNA, 16 bp, R. norvegicus
ctgcctgctcactgcc

SEQ ID NO: 498372 - DNA, 16 bp, R. norvegicus
ctgcctgctccaagag

SEQ ID NO: 498373 - DNA, 16 bp, R. norvegicus
ctgcctgctctcttca

SEQ ID NO: 498374 - DNA, 16 bp, R. norvegicus
ctgcctgctctgtctc

SEQ ID NO: 498375 - DNA, 16 bp, R. norvegicus
ctgcctgctgccatct

SEQ ID NO: 498376 - DNA, 16 bp, R. norvegicus
ctgcctgctgcctgcc

SEQ ID NO: 498377 - DNA, 16 bp, R. norvegicus
ctgcctgctgcctgtt

SEQ ID NO: 498378 - DNA, 16 bp, R. norvegicus
ctgcctgctgccttct

SEQ ID NO: 498379 - DNA, 16 bp, R. norvegicus
ctgcctgctgctgcca

SEQ ID NO: 498380 - DNA, 16 bp, R. norvegicus
ctgcctgctgctgctg

SEQ ID NO: 498381 - DNA, 16 bp, R. norvegicus
ctgcctgctgtctgct

SEQ ID NO: 498382 - DNA, 16 bp, R. norvegicus
ctgcctgctgtctgtc

SEQ ID NO: 498383 - DNA, 16 bp, R. norvegicus
ctgcctgcttcctgct

SEQ ID NO: 498384 - DNA, 16 bp, R. norvegicus
ctgcctgcttctgcca

SEQ ID NO: 498385 - DNA, 16 bp, R. norvegicus
ctgcctgcttctgccc

SEQ ID NO: 498386 - DNA, 16 bp, R. norvegicus
ctgcctgcttgcctgc

SEQ ID NO: 498387 - DNA, 16 bp, R. norvegicus
ctgcctgctttcttat

SEQ ID NO: 498388 - DNA, 16 bp, R. norvegicus
ctgcctgctttctttc

SEQ ID NO: 498389 - DNA, 16 bp, R. norvegicus
ctgcctggaagccagc

SEQ ID NO: 498390 - DNA, 16 bp, R. norvegicus
ctgcctggaagtgaat

SEQ ID NO: 498391 - DNA, 16 bp, R. norvegicus
ctgcctggagccctct

SEQ ID NO: 498392 - DNA, 16 bp, R. norvegicus
ctgcctggatgccacc

SEQ ID NO: 498393 - DNA, 17 bp, R. norvegicus
ctgcctggatgccgcca

SEQ ID NO: 498394 - DNA, 16 bp, R. norvegicus
ctgcctggatgctgcc

SEQ ID NO: 498395 - DNA, 16 bp, R. norvegicus
ctgcctggcaggcaga

SEQ ID NO: 498396 - DNA, 16 bp, R. norvegicus
ctgcctggcctgctag

SEQ ID NO: 498397 - DNA, 16 bp, R. norvegicus
ctgcctggcctggaac

SEQ ID NO: 498398 - DNA, 16 bp, R. norvegicus
ctgcctggtgaacaca

SEQ ID NO: 498399 - DNA, 16 bp, R. norvegicus
ctgcctggttgggcct

SEQ ID NO: 498400 - DNA, 16 bp, R. norvegicus
ctgcctgtaaccccag

SEQ ID NO: 498401 - DNA, 16 bp, R. norvegicus
ctgcctgtaggctgtg

SEQ ID NO: 498402 - DNA, 16 bp, R. norvegicus
ctgcctgtctctttct

SEQ ID NO: 498403 - DNA, 16 bp, R. norvegicus
ctgcctgtctttgcct

SEQ ID NO: 498404 - DNA, 16 bp, R. norvegicus
ctgcctgtgccaagag

SEQ ID NO: 498405 - DNA, 16 bp, R. norvegicus
ctgcctgtgccctgaa

SEQ ID NO: 498406 - DNA, 16 bp, R. norvegicus
ctgcctgtgcctcctg

SEQ ID NO: 498407 - DNA, 16 bp, R. norvegicus
ctgcctgtgtgtcctc

SEQ ID NO: 498408 - DNA, 16 bp, R. norvegicus
ctgcctgtttctctct

SEQ ID NO: 498409 - DNA, 16 bp, R. norvegicus
ctgccttcacctctca

SEQ ID NO: 498410 - DNA, 16 bp, R. norvegicus
ctgccttcacctgtgt

SEQ ID NO: 498411 - DNA, 16 bp, R. norvegicus
ctgccttcatgttcct

SEQ ID NO: 498412 - DNA, 16 bp, R. norvegicus
ctgccttccaactgct

SEQ ID NO: 498413 - DNA, 16 bp, R. norvegicus
ctgccttccaagtgca

SEQ ID NO: 498414 - DNA, 16 bp, R. norvegicus
ctgccttcccagtact

SEQ ID NO: 498415 - DNA, 16 bp, R. norvegicus
ctgccttccctctgtt

SEQ ID NO: 498416 - DNA, 16 bp, R. norvegicus
ctgccttcctctgctt

SEQ ID NO: 498417 - DNA, 16 bp, R. norvegicus
ctgccttctacgcctc

SEQ ID NO: 498418 - DNA, 16 bp, R. norvegicus
ctgccttctacttctc

SEQ ID NO: 498419 - DNA, 16 bp, R. norvegicus
ctgccttctctggcct

SEQ ID NO: 498420 - DNA, 16 bp, R. norvegicus
ctgccttctcttctgc

SEQ ID NO: 498421 - DNA, 16 bp, R. norvegicus
ctgccttctgagaggc

SEQ ID NO: 498422 - DNA, 16 bp, R. norvegicus
ctgccttctgagcact

SEQ ID NO: 498423 - DNA, 16 bp, R. norvegicus
ctgccttctgagtgtt

SEQ ID NO: 498424 - DNA, 16 bp, R. norvegicus
ctgccttctgcccttg

SEQ ID NO: 498425 - DNA, 16 bp, R. norvegicus
ctgccttctgctgcct

SEQ ID NO: 498426 - DNA, 16 bp, R. norvegicus
ctgccttctgcttcct

SEQ ID NO: 498427 - DNA, 16 bp, R. norvegicus
ctgccttgcaagtgct

SEQ ID NO: 498428 - DNA, 16 bp, R. norvegicus
ctgccttggccatggt

SEQ ID NO: 498429 - DNA, 16 bp, R. norvegicus
ctgccttggcctccca

SEQ ID NO: 498430 - DNA, 16 bp, R. norvegicus
ctgccttggctttcct

SEQ ID NO: 498431 - DNA, 16 bp, R. norvegicus
ctgccttgtctgcctc

SEQ ID NO: 498432 - DNA, 16 bp, R. norvegicus
ctgcctttcttctctg

SEQ ID NO: 498433 - DNA, 16 bp, R. norvegicus
ctgcctttgatcattt

SEQ ID NO: 498434 - DNA, 16 bp, R. norvegicus
ctgcctttgcagagga

SEQ ID NO: 498435 - DNA, 16 bp, R. norvegicus
ctgcctttgcctctcc

SEQ ID NO: 498436 - DNA, 16 bp, R. norvegicus
ctgcctttgtctcctg

SEQ ID NO: 498437 - DNA, 16 bp, R. norvegicus
ctgccttttcccagag

SEQ ID NO: 498438 - DNA, 16 bp, R. norvegicus
ctgccttttcctcctg

SEQ ID NO: 498439 - DNA, 16 bp, R. norvegicus
ctgccttttgcttcct

SEQ ID NO: 498440 - DNA, 16 bp, R. norvegicus
ctgcgcctgcgcctgc

SEQ ID NO: 498441 - DNA, 16 bp, R. norvegicus
ctgcggtcttaccacc

SEQ ID NO: 498442 - DNA, 16 bp, R. norvegicus
ctgcgtctgagacact

SEQ ID NO: 498443 - DNA, 16 bp, R. norvegicus
ctgcgtgcgtgcctgc

SEQ ID NO: 498444 - DNA, 20 bp, R. norvegicus
ctgctaaaacttgtcactac

SEQ ID NO: 498445 - DNA, 16 bp, R. norvegicus
ctgctaacctaggcct

SEQ ID NO: 498446 - DNA, 16 bp, R. norvegicus
ctgctacaacctgtct

SEQ ID NO: 498447 - DNA, 16 bp, R. norvegicus
ctgctacagagggcag

SEQ ID NO: 498448 - DNA, 17 bp, R. norvegicus
ctgctactgctactgct

SEQ ID NO: 498449 - DNA, 17 bp, R. norvegicus
ctgctactggaacagtc

SEQ ID NO: 498450 - DNA, 16 bp, R. norvegicus
ctgctagagcaggagg

SEQ ID NO: 498451 - DNA, 16 bp, R. norvegicus
ctgctatatatgtggc

SEQ ID NO: 498452 - DNA, 16 bp, R. norvegicus
ctgctatgaacatgtg

SEQ ID NO: 498453 - DNA, 16 bp, R. norvegicus
ctgctatgctcccacc

SEQ ID NO: 498454 - DNA, 16 bp, R. norvegicus
ctgctatgtatgtggc

SEQ ID NO: 498455 - DNA, 20 bp, R. norvegicus
ctgctattgtagcagccatt

SEQ ID NO: 498456 - DNA, 16 bp, R. norvegicus
ctgctattgtggcagc

SEQ ID NO: 498457 - DNA, 16 bp, R. norvegicus
ctgctatttctgacag

SEQ ID NO: 498458 - DNA, 16 bp, R. norvegicus
ctgctcacagccatct

SEQ ID NO: 498459 - DNA, 16 bp, R. norvegicus
ctgctcactgcccccc

SEQ ID NO: 498460 - DNA, 16 bp, R. norvegicus
ctgctcacttttctgt

SEQ ID NO: 498461 - DNA, 16 bp, R. norvegicus
ctgctcagctattggc

SEQ ID NO: 498462 - DNA, 16 bp, R. norvegicus
ctgctcagcttgcttt

SEQ ID NO: 498463 - DNA, 16 bp, R. norvegicus
ctgctcaggatcttct

SEQ ID NO: 498464 - DNA, 16 bp, R. norvegicus
ctgctcagggaggcag

SEQ ID NO: 498465 - DNA, 16 bp, R. norvegicus
ctgctccaaatttgtc

SEQ ID NO: 498466 - DNA, 16 bp, R. norvegicus
ctgctccaacaccatg

SEQ ID NO: 498467 - DNA, 16 bp, R. norvegicus
ctgctccaattttgtc

SEQ ID NO: 498468 - DNA, 16 bp, R. norvegicus
ctgctccaccttccct

SEQ ID NO: 498469 - DNA, 16 bp, R. norvegicus
ctgctccagcacctgc

SEQ ID NO: 498470 - DNA, 16 bp, R. norvegicus
ctgctccagctcctgc

SEQ ID NO: 498471 - DNA, 16 bp, R. norvegicus
ctgctccattctttgt

SEQ ID NO: 498472 - DNA, 16 bp, R. norvegicus
ctgctcccaaacccag

SEQ ID NO: 498473 - DNA, 16 bp, R. norvegicus
ctgctcccagaactga

SEQ ID NO: 498474 - DNA, 16 bp, R. norvegicus
ctgctcccagaccagg

SEQ ID NO: 498475 - DNA, 16 bp, R. norvegicus
ctgctcccagagctgg

SEQ ID NO: 498476 - DNA, 17 bp, R. norvegicus
ctgctccccaaaatact

SEQ ID NO: 498477 - DNA, 16 bp, R. norvegicus
ctgctccccagtgctg

SEQ ID NO: 498478 - DNA, 16 bp, R. norvegicus
ctgctccctctcctca

SEQ ID NO: 498479 - DNA, 16 bp, R. norvegicus
ctgctccctgccccca

SEQ ID NO: 498480 - DNA, 16 bp, R. norvegicus
ctgctccctgtgcttc

SEQ ID NO: 498481 - DNA, 16 bp, R. norvegicus
ctgctcctccatcctg

SEQ ID NO: 498482 - DNA, 16 bp, R. norvegicus
ctgctcctgcaccatg

SEQ ID NO: 498483 - DNA, 16 bp, R. norvegicus
ctgctcctgctcctgc

SEQ ID NO: 498484 - DNA, 16 bp, R. norvegicus
ctgctcctgctcctgt

SEQ ID NO: 498485 - DNA, 16 bp, R. norvegicus
ctgctcctgctgctgc

SEQ ID NO: 498486 - DNA, 16 bp, R. norvegicus
ctgctcctgggattct

SEQ ID NO: 498487 - DNA, 16 bp, R. norvegicus
ctgctccttagattct

SEQ ID NO: 498488 - DNA, 16 bp, R. norvegicus
ctgctccttctccagc

SEQ ID NO: 498489 - DNA, 16 bp, R. norvegicus
ctgctcgctctctctc

SEQ ID NO: 498490 - DNA, 16 bp, R. norvegicus
ctgctctacatagaga

SEQ ID NO: 498491 - DNA, 16 bp, R. norvegicus
ctgctctcacctgcat

SEQ ID NO: 498492 - DNA, 16 bp, R. norvegicus
ctgctctcagcattct

SEQ ID NO: 498493 - DNA, 16 bp, R. norvegicus
ctgctctcagggacct

SEQ ID NO: 498494 - DNA, 16 bp, R. norvegicus
ctgctctccacctctg

SEQ ID NO: 498495 - DNA, 16 bp, R. norvegicus
ctgctctcctagagga

SEQ ID NO: 498496 - DNA, 16 bp, R. norvegicus
ctgctctctctgcagc

SEQ ID NO: 498497 - DNA, 16 bp, R. norvegicus
ctgctctctgctctct

SEQ ID NO: 498498 - DNA, 16 bp, R. norvegicus
ctgctctcttccccat

SEQ ID NO: 498499 - DNA, 16 bp, R. norvegicus
ctgctctgagctgtgc

SEQ ID NO: 498500 - DNA, 16 bp, R. norvegicus
ctgctctgagttcctg

SEQ ID NO: 498501 - DNA, 16 bp, R. norvegicus
ctgctctgcactcact

SEQ ID NO: 498502 - DNA, 17 bp, R. norvegicus
ctgctctgcagcctcag

SEQ ID NO: 498503 - DNA, 16 bp, R. norvegicus
ctgctctgctctgcct

SEQ ID NO: 498504 - DNA, 16 bp, R. norvegicus
ctgctctgctcttctc

SEQ ID NO: 498505 - DNA, 16 bp, R. norvegicus
ctgctctggaacatgt

SEQ ID NO: 498506 - DNA, 16 bp, R. norvegicus
ctgctctggctagaac

SEQ ID NO: 498507 - DNA, 16 bp, R. norvegicus
ctgctctgtcctctct

SEQ ID NO: 498508 - DNA, 16 bp, R. norvegicus
ctgctctgtcttctct

SEQ ID NO: 498509 - DNA, 16 bp, R. norvegicus
ctgctcttcagcctgg

SEQ ID NO: 498510 - DNA, 16 bp, R. norvegicus
ctgctcttcagtcaga

SEQ ID NO: 498511 - DNA, 16 bp, R. norvegicus
ctgctcttccacaaga

SEQ ID NO: 498512 - DNA, 16 bp, R. norvegicus
ctgctcttccagggat

SEQ ID NO: 498513 - DNA, 16 bp, R. norvegicus
ctgctcttccaggggt

SEQ ID NO: 498514 - DNA, 16 bp, R. norvegicus
ctgctcttcctaaagg

SEQ ID NO: 498515 - DNA, 16 bp, R. norvegicus
ctgctcttcctgaaga

SEQ ID NO: 498516 - DNA, 16 bp, R. norvegicus
ctgctcttgaaaagga

SEQ ID NO: 498517 - DNA, 16 bp, R. norvegicus
ctgctcttgaagagga

SEQ ID NO: 498518 - DNA, 16 bp, R. norvegicus
ctgctcttgggattct

SEQ ID NO: 498519 - DNA, 16 bp, R. norvegicus
ctgctctttctgctct

SEQ ID NO: 498520 - DNA, 16 bp, R. norvegicus
ctgctcttttagaaga

SEQ ID NO: 498521 - DNA, 16 bp, R. norvegicus
ctgctcttttctgaaa

SEQ ID NO: 498522 - DNA, 16 bp, R. norvegicus
ctgctgaaccatttct

SEQ ID NO: 498523 - DNA, 16 bp, R. norvegicus
ctgctgaagccatggg

SEQ ID NO: 498524 - DNA, 16 bp, R. norvegicus
ctgctgaagccctgct

SEQ ID NO: 498525 - DNA, 16 bp, R. norvegicus
ctgctgacaatatctg

SEQ ID NO: 498526 - DNA, 16 bp, R. norvegicus
ctgctgacaggagcct

SEQ ID NO: 498527 - DNA, 16 bp, R. norvegicus
ctgctgacatcacaga

SEQ ID NO: 498528 - DNA, 16 bp, R. norvegicus
ctgctgacatttgcct

SEQ ID NO: 498529 - DNA, 16 bp, R. norvegicus
ctgctgaccactgtgg

SEQ ID NO: 498530 - DNA, 16 bp, R. norvegicus
ctgctgacccctctgt

SEQ ID NO: 498531 - DNA, 16 bp, R. norvegicus
ctgctgacctgtgaac

SEQ ID NO: 498532 - DNA, 16 bp, R. norvegicus
ctgctgactcctgtga

SEQ ID NO: 498533 - DNA, 16 bp, R. norvegicus
ctgctgagaaagggag

SEQ ID NO: 498534 - DNA, 16 bp, R. norvegicus
ctgctgagaagtctgg

SEQ ID NO: 498535 - DNA, 16 bp, R. norvegicus
ctgctgagagaggaag

SEQ ID NO: 498536 - DNA, 16 bp, R. norvegicus
ctgctgagattaaaga

SEQ ID NO: 498537 - DNA, 16 bp, R. norvegicus
ctgctgagccagctct

SEQ ID NO: 498538 - DNA, 16 bp, R. norvegicus
ctgctgagccatctct

SEQ ID NO: 498539 - DNA, 20 bp, R. norvegicus
ctgctgagcccggctgatgc

SEQ ID NO: 498540 - DNA, 16 bp, R. norvegicus
ctgctgagccctgtgg

SEQ ID NO: 498541 - DNA, 16 bp, R. norvegicus
ctgctgagccttgctg

SEQ ID NO: 498542 - DNA, 16 bp, R. norvegicus
ctgctgaggagagctg

SEQ ID NO: 498543 - DNA, 16 bp, R. norvegicus
ctgctgagggacatct

SEQ ID NO: 498544 - DNA, 16 bp, R. norvegicus
ctgctgagtagagcct

SEQ ID NO: 498545 - DNA, 16 bp, R. norvegicus
ctgctgagtcatctca

SEQ ID NO: 498546 - DNA, 16 bp, R. norvegicus
ctgctgagtcctggga

SEQ ID NO: 498547 - DNA, 16 bp, R. norvegicus
ctgctgatatcctgac

SEQ ID NO: 498548 - DNA, 16 bp, R. norvegicus
ctgctgcagaaggaag

SEQ ID NO: 498549 - DNA, 16 bp, R. norvegicus
ctgctgcagagagctc

SEQ ID NO: 498550 - DNA, 16 bp, R. norvegicus
ctgctgcagccagggc

SEQ ID NO: 498551 - DNA, 16 bp, R. norvegicus
ctgctgcagctggact

SEQ ID NO: 498552 - DNA, 16 bp, R. norvegicus
ctgctgcaggaggaaa

SEQ ID NO: 498553 - DNA, 16 bp, R. norvegicus
ctgctgcagggccaca

SEQ ID NO: 498554 - DNA, 16 bp, R. norvegicus
ctgctgccaagtctga

SEQ ID NO: 498555 - DNA, 16 bp, R. norvegicus
ctgctgccactgccac

SEQ ID NO: 498556 - DNA, 16 bp, R. norvegicus
ctgctgccagaggaag

SEQ ID NO: 498557 - DNA, 16 bp, R. norvegicus
ctgctgccatccgtgt

SEQ ID NO: 498558 - DNA, 16 bp, R. norvegicus
ctgctgcccaagaaga

SEQ ID NO: 498559 - DNA, 16 bp, R. norvegicus
ctgctgcccacaggaa

SEQ ID NO: 498560 - DNA, 16 bp, R. norvegicus
ctgctgccccctggtg

SEQ ID NO: 498561 - DNA, 16 bp, R. norvegicus
ctgctgcccctgctgc

SEQ ID NO: 498562 - DNA, 16 bp, R. norvegicus
ctgctgccctctgcag

SEQ ID NO: 498563 - DNA, 16 bp, R. norvegicus
ctgctgccctgctgcc

SEQ ID NO: 498564 - DNA, 17 bp, R. norvegicus
ctgctgccgcagagagc

SEQ ID NO: 498565 - DNA, 16 bp, R. norvegicus
ctgctgcctcagtctc

SEQ ID NO: 498566 - DNA, 16 bp, R. norvegicus
ctgctgcctcctgcct

SEQ ID NO: 498567 - DNA, 16 bp, R. norvegicus
ctgctgcctctgctgc

SEQ ID NO: 498568 - DNA, 16 bp, R. norvegicus
ctgctgcctgaagatc

SEQ ID NO: 498569 - DNA, 16 bp, R. norvegicus
ctgctgcctgctgacc

SEQ ID NO: 498570 - DNA, 16 bp, R. norvegicus
ctgctgcctgtctgtg

SEQ ID NO: 498571 - DNA, 16 bp, R. norvegicus
ctgctgcctgtggatc

SEQ ID NO: 498572 - DNA, 16 bp, R. norvegicus
ctgctgctcctcctgc

SEQ ID NO: 498573 - DNA, 16 bp, R. norvegicus
ctgctgctcctgcccc

SEQ ID NO: 498574 - DNA, 16 bp, R. norvegicus
ctgctgctcctggccc

SEQ ID NO: 498575 - DNA, 16 bp, R. norvegicus
ctgctgctctctgcag

SEQ ID NO: 498576 - DNA, 16 bp, R. norvegicus
ctgctgctctgcctct

SEQ ID NO: 498577 - DNA, 16 bp, R. norvegicus
ctgctgctcttggtga

SEQ ID NO: 498578 - DNA, 16 bp, R. norvegicus
ctgctgctgacctgtg

SEQ ID NO: 498579 - DNA, 16 bp, R. norvegicus
ctgctgctgagtgcca

SEQ ID NO: 498580 - DNA, 16 bp, R. norvegicus
ctgctgctgatgatga

SEQ ID NO: 498581 - DNA, 16 bp, R. norvegicus
ctgctgctgcagggcc

SEQ ID NO: 498582 - DNA, 16 bp, R. norvegicus
ctgctgctgccactgc

SEQ ID NO: 498583 - DNA, 16 bp, R. norvegicus
ctgctgctgcctcctg

SEQ ID NO: 498584 - DNA, 16 bp, R. norvegicus
ctgctgctgcctgtgg

SEQ ID NO: 498585 - DNA, 16 bp, R. norvegicus
ctgctgctgcggagag

SEQ ID NO: 498586 - DNA, 16 bp, R. norvegicus
ctgctgctgcggctgc

SEQ ID NO: 498587 - DNA, 16 bp, R. norvegicus
ctgctgctgctaccac

SEQ ID NO: 498588 - DNA, 16 bp, R. norvegicus
ctgctgctgctattgc

SEQ ID NO: 498589 - DNA, 16 bp, R. norvegicus
ctgctgctgctctgct

SEQ ID NO: 498590 - DNA, 16 bp, R. norvegicus
ctgctgctgctcttcc

SEQ ID NO: 498591 - DNA, 16 bp, R. norvegicus
ctgctgctgctcttgg

SEQ ID NO: 498592 - DNA, 16 bp, R. norvegicus
ctgctgctgctgacca

SEQ ID NO: 498593 - DNA, 16 bp, R. norvegicus
ctgctgctgctgcact

SEQ ID NO: 498594 - DNA, 16 bp, R. norvegicus
ctgctgctgctgcagt

SEQ ID NO: 498595 - DNA, 16 bp, R. norvegicus
ctgctgctgctgccac

SEQ ID NO: 498596 - DNA, 16 bp, R. norvegicus
ctgctgctgctgcccc

SEQ ID NO: 498597 - DNA, 16 bp, R. norvegicus
ctgctgctgctgccct

SEQ ID NO: 498598 - DNA, 16 bp, R. norvegicus
ctgctgctgctgctcc

SEQ ID NO: 498599 - DNA, 21 bp, R. norvegicus
ctgctgctgctgctcctgctg

SEQ ID NO: 498600 - DNA, 18 bp, R. norvegicus
ctgctgctgctgctggtt

SEQ ID NO: 498601 - DNA, 16 bp, R. norvegicus
ctgctgctgctggtga

SEQ ID NO: 498602 - DNA, 16 bp, R. norvegicus
ctgctgctgctggtgt

SEQ ID NO: 498603 - DNA, 16 bp, R. norvegicus
ctgctgctgctgtggt

SEQ ID NO: 498604 - DNA, 16 bp, R. norvegicus
ctgctgctgctgtgtg

SEQ ID NO: 498605 - DNA, 16 bp, R. norvegicus
ctgctgctgctgttgg

SEQ ID NO: 498606 - DNA, 16 bp, R. norvegicus
ctgctgctgctgtttc

SEQ ID NO: 498607 - DNA, 16 bp, R. norvegicus
ctgctgctgcttcctc

SEQ ID NO: 498608 - DNA, 16 bp, R. norvegicus
ctgctgctgcttctcc

SEQ ID NO: 498609 - DNA, 16 bp, R. norvegicus
ctgctgctgcttctgc

SEQ ID NO: 498610 - DNA, 16 bp, R. norvegicus
ctgctgctgcttgctg

SEQ ID NO: 498611 - DNA, 20 bp, R. norvegicus
ctgctgctgcttttagatta

SEQ ID NO: 498612 - DNA, 16 bp, R. norvegicus
ctgctgctggaggaag

SEQ ID NO: 498613 - DNA, 16 bp, R. norvegicus
ctgctgctggggccag

SEQ ID NO: 498614 - DNA, 16 bp, R. norvegicus
ctgctgctggtgctgc

SEQ ID NO: 498615 - DNA, 16 bp, R. norvegicus
ctgctgctggttcctg

SEQ ID NO: 498616 - DNA, 16 bp, R. norvegicus
ctgctgctgtgctgtg

SEQ ID NO: 498617 - DNA, 16 bp, R. norvegicus
ctgctgctgtgtcttc

SEQ ID NO: 498618 - DNA, 16 bp, R. norvegicus
ctgctgctgttcttgt

SEQ ID NO: 498619 - DNA, 16 bp, R. norvegicus
ctgctgctgttgctgg

SEQ ID NO: 498620 - DNA, 16 bp, R. norvegicus
ctgctgctgttgctgt

SEQ ID NO: 498621 - DNA, 16 bp, R. norvegicus
ctgctgctgttgttgt

SEQ ID NO: 498622 - DNA, 16 bp, R. norvegicus
ctgctgctgtttctgc

SEQ ID NO: 498623 - DNA, 16 bp, R. norvegicus
ctgctgcttcctgggg

SEQ ID NO: 498624 - DNA, 16 bp, R. norvegicus
ctgctgcttctctctc

SEQ ID NO: 498625 - DNA, 16 bp, R. norvegicus
ctgctgcttctgctgt

SEQ ID NO: 498626 - DNA, 16 bp, R. norvegicus
ctgctgcttctgcttc

SEQ ID NO: 498627 - DNA, 16 bp, R. norvegicus
ctgctgcttcttcctc

SEQ ID NO: 498628 - DNA, 16 bp, R. norvegicus
ctgctgcttgctggag

SEQ ID NO: 498629 - DNA, 16 bp, R. norvegicus
ctgctgcttttgcaga

SEQ ID NO: 498630 - DNA, 16 bp, R. norvegicus
ctgctggaactggagt

SEQ ID NO: 498631 - DNA, 16 bp, R. norvegicus
ctgctggaattcacct

SEQ ID NO: 498632 - DNA, 16 bp, R. norvegicus
ctgctggagaaggagc

SEQ ID NO: 498633 - DNA, 16 bp, R. norvegicus
ctgctggagcacatga

SEQ ID NO: 498634 - DNA, 16 bp, R. norvegicus
ctgctggagccatgag

SEQ ID NO: 498635 - DNA, 16 bp, R. norvegicus
ctgctggagccctggg

SEQ ID NO: 498636 - DNA, 16 bp, R. norvegicus
ctgctggaggcctaca

SEQ ID NO: 498637 - DNA, 16 bp, R. norvegicus
ctgctggaggctggag

SEQ ID NO: 498638 - DNA, 16 bp, R. norvegicus
ctgctggaggtgggct

SEQ ID NO: 498639 - DNA, 16 bp, R. norvegicus
ctgctggaggtgggtt

SEQ ID NO: 498640 - DNA, 16 bp, R. norvegicus
ctgctggaggtggtct

SEQ ID NO: 498641 - DNA, 16 bp, R. norvegicus
ctgctggagtgctctc

SEQ ID NO: 498642 - DNA, 16 bp, R. norvegicus
ctgctggcactcagag

SEQ ID NO: 498643 - DNA, 16 bp, R. norvegicus
ctgctggcagcctata

SEQ ID NO: 498644 - DNA, 16 bp, R. norvegicus
ctgctggccagccagc

SEQ ID NO: 498645 - DNA, 16 bp, R. norvegicus
ctgctggccctcaagg

SEQ ID NO: 498646 - DNA, 16 bp, R. norvegicus
ctgctggccctcatgg

SEQ ID NO: 498647 - DNA, 16 bp, R. norvegicus
ctgctggcctagaagt

SEQ ID NO: 498648 - DNA, 16 bp, R. norvegicus
ctgctggctcagccca

SEQ ID NO: 498649 - DNA, 16 bp, R. norvegicus
ctgctggctcagcctg

SEQ ID NO: 498650 - DNA, 16 bp, R. norvegicus
ctgctggctcctttaa

SEQ ID NO: 498651 - DNA, 16 bp, R. norvegicus
ctgctggctgctggtt

SEQ ID NO: 498652 - DNA, 16 bp, R. norvegicus
ctgctgggaacagaca

SEQ ID NO: 498653 - DNA, 16 bp, R. norvegicus
ctgctgggcagtggtg

SEQ ID NO: 498654 - DNA, 16 bp, R. norvegicus
ctgctgggctcagaga

SEQ ID NO: 498655 - DNA, 16 bp, R. norvegicus
ctgctggggctggaga

SEQ ID NO: 498656 - DNA, 16 bp, R. norvegicus
ctgctgggtagagcct

SEQ ID NO: 498657 - DNA, 16 bp, R. norvegicus
ctgctgggtgatgggc

SEQ ID NO: 498658 - DNA, 16 bp, R. norvegicus
ctgctgggtggggcct

SEQ ID NO: 498659 - DNA, 16 bp, R. norvegicus
ctgctggtcttcctac

SEQ ID NO: 498660 - DNA, 16 bp, R. norvegicus
ctgctggtctttctat

SEQ ID NO: 498661 - DNA, 16 bp, R. norvegicus
ctgctggtgatggtgg

SEQ ID NO: 498662 - DNA, 16 bp, R. norvegicus
ctgctggtgctgctcc

SEQ ID NO: 498663 - DNA, 16 bp, R. norvegicus
ctgctggtgctgctct

SEQ ID NO: 498664 - DNA, 16 bp, R. norvegicus
ctgctggtgtatctgt

SEQ ID NO: 498665 - DNA, 19 bp, R. norvegicus
ctgctggttgttccagaga

SEQ ID NO: 498666 - DNA, 16 bp, R. norvegicus
ctgctgtatatgtatt

SEQ ID NO: 498667 - DNA, 16 bp, R. norvegicus
ctgctgtcacctgagg

SEQ ID NO: 498668 - DNA, 16 bp, R. norvegicus
ctgctgtccgagggca

SEQ ID NO: 498669 - DNA, 16 bp, R. norvegicus
ctgctgtcctggaact

SEQ ID NO: 498670 - DNA, 16 bp, R. norvegicus
ctgctgtctatataag

SEQ ID NO: 498671 - DNA, 16 bp, R. norvegicus
ctgctgtctctgctgc

SEQ ID NO: 498672 - DNA, 16 bp, R. norvegicus
ctgctgtcttctgctg

SEQ ID NO: 498673 - DNA, 16 bp, R. norvegicus
ctgctgtgaaaccacc

SEQ ID NO: 498674 - DNA, 16 bp, R. norvegicus
ctgctgtgagattgtg

SEQ ID NO: 498675 - DNA, 16 bp, R. norvegicus
ctgctgtgagttcaag

SEQ ID NO: 498676 - DNA, 16 bp, R. norvegicus
ctgctgtgctcctgtc

SEQ ID NO: 498677 - DNA, 16 bp, R. norvegicus
ctgctgtgctgctgtg

SEQ ID NO: 498678 - DNA, 16 bp, R. norvegicus
ctgctgtggcagcaac

SEQ ID NO: 498679 - DNA, 17 bp, R. norvegicus
ctgctgtggctcctgtc

SEQ ID NO: 498680 - DNA, 16 bp, R. norvegicus
ctgctgtggctgctgc

SEQ ID NO: 498681 - DNA, 16 bp, R. norvegicus
ctgctgtggtggtggt

SEQ ID NO: 498682 - DNA, 16 bp, R. norvegicus
ctgctgtgtctgtgtg

SEQ ID NO: 498683 - DNA, 16 bp, R. norvegicus
ctgctgtgtgagaagt

SEQ ID NO: 498684 - DNA, 16 bp, R. norvegicus
ctgctgttacatcaag

SEQ ID NO: 498685 - DNA, 16 bp, R. norvegicus
ctgctgttcctgtggg

SEQ ID NO: 498686 - DNA, 16 bp, R. norvegicus
ctgctgtttctgttgt

SEQ ID NO: 498687 - DNA, 16 bp, R. norvegicus
ctgcttaagcttggct

SEQ ID NO: 498688 - DNA, 16 bp, R. norvegicus
ctgcttacaggaaaca

SEQ ID NO: 498689 - DNA, 16 bp, R. norvegicus
ctgcttcaaaataaaa

SEQ ID NO: 498690 - DNA, 16 bp, R. norvegicus
ctgcttcaagctcctg

SEQ ID NO: 498691 - DNA, 16 bp, R. norvegicus
ctgcttcagaaaaaca

SEQ ID NO: 498692 - DNA, 16 bp, R. norvegicus
ctgcttcagcctccta

SEQ ID NO: 498693 - DNA, 16 bp, R. norvegicus
ctgcttcagcctcttg

SEQ ID NO: 498694 - DNA, 16 bp, R. norvegicus
ctgcttcagccttcca

SEQ ID NO: 498695 - DNA, 16 bp, R. norvegicus
ctgcttcagctaaatg

SEQ ID NO: 498696 - DNA, 16 bp, R. norvegicus
ctgcttcagctcctgc

SEQ ID NO: 498697 - DNA, 16 bp, R. norvegicus
ctgcttcagcttctgc

SEQ ID NO: 498698 - DNA, 16 bp, R. norvegicus
ctgcttcagtgagggt

SEQ ID NO: 498699 - DNA, 16 bp, R. norvegicus
ctgcttcagttccttc

SEQ ID NO: 498700 - DNA, 16 bp, R. norvegicus
ctgcttcatgcttgtg

SEQ ID NO: 498701 - DNA, 16 bp, R. norvegicus
ctgcttccaagttcct

SEQ ID NO: 498702 - DNA, 16 bp, R. norvegicus
ctgcttccacttcctg

SEQ ID NO: 498703 - DNA, 16 bp, R. norvegicus
ctgcttcccaagggct

SEQ ID NO: 498704 - DNA, 16 bp, R. norvegicus
ctgcttcccaagtact

SEQ ID NO: 498705 - DNA, 16 bp, R. norvegicus
ctgcttcctgagtgtg

SEQ ID NO: 498706 - DNA, 16 bp, R. norvegicus
ctgcttcctgcagatc

SEQ ID NO: 498707 - DNA, 16 bp, R. norvegicus
ctgcttcctgctgact

SEQ ID NO: 498708 - DNA, 16 bp, R. norvegicus
ctgcttcctggagaag

SEQ ID NO: 498709 - DNA, 16 bp, R. norvegicus
ctgcttcctggcagcc

SEQ ID NO: 498710 - DNA, 16 bp, R. norvegicus
ctgcttcctggctgtg

SEQ ID NO: 498711 - DNA, 16 bp, R. norvegicus
ctgcttcctgtcctgc

SEQ ID NO: 498712 - DNA, 16 bp, R. norvegicus
ctgcttcctgtcttcc

SEQ ID NO: 498713 - DNA, 16 bp, R. norvegicus
ctgcttctatgagtgt

SEQ ID NO: 498714 - DNA, 16 bp, R. norvegicus
ctgcttctatggggat

SEQ ID NO: 498715 - DNA, 16 bp, R. norvegicus
ctgcttctcagtgctg

SEQ ID NO: 498716 - DNA, 16 bp, R. norvegicus
ctgcttctcctgcctc

SEQ ID NO: 498717 - DNA, 16 bp, R. norvegicus
ctgcttctgcagtgct

SEQ ID NO: 498718 - DNA, 16 bp, R. norvegicus
ctgcttctgcatcctg

SEQ ID NO: 498719 - DNA, 16 bp, R. norvegicus
ctgcttctgccctctg

SEQ ID NO: 498720 - DNA, 16 bp, R. norvegicus
ctgcttctgccttccc

SEQ ID NO: 498721 - DNA, 16 bp, R. norvegicus
ctgcttctgcttctgc

SEQ ID NO: 498722 - DNA, 16 bp, R. norvegicus
ctgcttctgggatgag

SEQ ID NO: 498723 - DNA, 16 bp, R. norvegicus
ctgcttctgtttccca

SEQ ID NO: 498724 - DNA, 16 bp, R. norvegicus
ctgcttcttcctcctg

SEQ ID NO: 498725 - DNA, 16 bp, R. norvegicus
ctgcttcttctgcctc

SEQ ID NO: 498726 - DNA, 16 bp, R. norvegicus
ctgcttcttctgcttc

SEQ ID NO: 498727 - DNA, 16 bp, R. norvegicus
ctgcttgagctcaggg

SEQ ID NO: 498728 - DNA, 16 bp, R. norvegicus
ctgcttgcaaggcaag

SEQ ID NO: 498729 - DNA, 16 bp, R. norvegicus
ctgcttgctgaaagga

SEQ ID NO: 498730 - DNA, 16 bp, R. norvegicus
ctgcttgcttgtttgc

SEQ ID NO: 498731 - DNA, 16 bp, R. norvegicus
ctgcttggcagctgct

SEQ ID NO: 498732 - DNA, 16 bp, R. norvegicus
ctgcttgtcttcctat

SEQ ID NO: 498733 - DNA, 16 bp, R. norvegicus
ctgcttgtggtttaca

SEQ ID NO: 498734 - DNA, 16 bp, R. norvegicus
ctgctttcagtcgtgt

SEQ ID NO: 498735 - DNA, 16 bp, R. norvegicus
ctgctttccaaatcca

SEQ ID NO: 498736 - DNA, 16 bp, R. norvegicus
ctgctttccctctgtt

SEQ ID NO: 498737 - DNA, 16 bp, R. norvegicus
ctgctttgacatcaga

SEQ ID NO: 498738 - DNA, 16 bp, R. norvegicus
ctgcttttatttcact

SEQ ID NO: 498739 - DNA, 16 bp, R. norvegicus
ctgcttttccagggga

SEQ ID NO: 498740 - DNA, 16 bp, R. norvegicus
ctgcttttgcctccca

SEQ ID NO: 498741 - DNA, 16 bp, R. norvegicus
ctgcttttgttaattt

SEQ ID NO: 498742 - DNA, 16 bp, R. norvegicus
ctgcttttgtttcctg

SEQ ID NO: 498743 - DNA, 16 bp, R. norvegicus
ctggaaaaagaaaaga

SEQ ID NO: 498744 - DNA, 16 bp, R. norvegicus
ctggaaaagaaaaaga

SEQ ID NO: 498745 - DNA, 16 bp, R. norvegicus
ctggaaaagaagaagt

SEQ ID NO: 498746 - DNA, 16 bp, R. norvegicus
ctggaaaagccactgc

SEQ ID NO: 498747 - DNA, 17 bp, R. norvegicus
ctggaaaagctgttgct

SEQ ID NO: 498748 - DNA, 16 bp, R. norvegicus
ctggaaaatctggaaa

SEQ ID NO: 498749 - DNA, 16 bp, R. norvegicus
ctggaaacaactttcc

SEQ ID NO: 498750 - DNA, 16 bp, R. norvegicus
ctggaaacatcctcat

SEQ ID NO: 498751 - DNA, 16 bp, R. norvegicus
ctggaaaccaaactca

SEQ ID NO: 498752 - DNA, 16 bp, R. norvegicus
ctggaaactgaactta

SEQ ID NO: 498753 - DNA, 16 bp, R. norvegicus
ctggaaactgaggcag

SEQ ID NO: 498754 - DNA, 16 bp, R. norvegicus
ctggaaagaacaggaa

SEQ ID NO: 498755 - DNA, 84 bp, R. norvegicus
ctggaaagaaccgagatgcccttcaacagaggaatggatacagaaaatgtggtacatctacacaatggaatattactcagctat

SEQ ID NO: 498756 - DNA, 16 bp, R. norvegicus
ctggaaagaagaaaga

SEQ ID NO: 498757 - DNA, 16 bp, R. norvegicus
ctggaaagacaaaaaa

SEQ ID NO: 498758 - DNA, 16 bp, R. norvegicus
ctggaaagatggctga

SEQ ID NO: 498759 - DNA, 16 bp, R. norvegicus
ctggaaagccagagga

SEQ ID NO: 498760 - DNA, 16 bp, R. norvegicus
ctggaaagctgaggca

SEQ ID NO: 498761 - DNA, 16 bp, R. norvegicus
ctggaaaggaaggagg

SEQ ID NO: 498762 - DNA, 16 bp, R. norvegicus
ctggaaaggcaaaaat

SEQ ID NO: 498763 - DNA, 16 bp, R. norvegicus
ctggaaagtgtttcct

SEQ ID NO: 498764 - DNA, 16 bp, R. norvegicus
ctggaacaaagtggct

SEQ ID NO: 498765 - DNA, 16 bp, R. norvegicus
ctggaacacagattct

SEQ ID NO: 498766 - DNA, 16 bp, R. norvegicus
ctggaacagcagtcag

SEQ ID NO: 498767 - DNA, 16 bp, R. norvegicus
ctggaacatatcatcc

SEQ ID NO: 498768 - DNA, 16 bp, R. norvegicus
ctggaaccaaaacttc

SEQ ID NO: 498769 - DNA, 16 bp, R. norvegicus
ctggaacccacagaaa

SEQ ID NO: 498770 - DNA, 16 bp, R. norvegicus
ctggaaccctgatgca

SEQ ID NO: 498771 - DNA, 16 bp, R. norvegicus
ctggaactaccattgt

SEQ ID NO: 498772 - DNA, 16 bp, R. norvegicus
ctggaactcacagaga

SEQ ID NO: 498773 - DNA, 16 bp, R. norvegicus
ctggaactcactcttt

SEQ ID NO: 498774 - DNA, 16 bp, R. norvegicus
ctggaactcactgtgc

SEQ ID NO: 498775 - DNA, 16 bp, R. norvegicus
ctggaactcactgtgt

SEQ ID NO: 498776 - DNA, 16 bp, R. norvegicus
ctggaactcagagaaa

SEQ ID NO: 498777 - DNA, 16 bp, R. norvegicus
ctggaactcagagatt

SEQ ID NO: 498778 - DNA, 16 bp, R. norvegicus
ctggaactgaagtcac

SEQ ID NO: 498779 - DNA, 16 bp, R. norvegicus
ctggaactggagagat

SEQ ID NO: 498780 - DNA, 16 bp, R. norvegicus
ctggaacttgctctga

SEQ ID NO: 498781 - DNA, 16 bp, R. norvegicus
ctggaagaaaagccag

SEQ ID NO: 498782 - DNA, 16 bp, R. norvegicus
ctggaagaaacagaaa

SEQ ID NO: 498783 - DNA, 16 bp, R. norvegicus
ctggaagaaatctttc

SEQ ID NO: 498784 - DNA, 16 bp, R. norvegicus
ctggaagaaatggaaa

SEQ ID NO: 498785 - DNA, 16 bp, R. norvegicus
ctggaagaaatggaca

SEQ ID NO: 498786 - DNA, 16 bp, R. norvegicus
ctggaagaacaaacag

SEQ ID NO: 498787 - DNA, 16 bp, R. norvegicus
ctggaagaacagagag

SEQ ID NO: 498788 - DNA, 16 bp, R. norvegicus
ctggaagaagcagagg

SEQ ID NO: 498789 - DNA, 16 bp, R. norvegicus
ctggaagaagttgaag

SEQ ID NO: 498790 - DNA, 16 bp, R. norvegicus
ctggaagacagtcttc

SEQ ID NO: 498791 - DNA, 16 bp, R. norvegicus
ctggaagacagtgtct

SEQ ID NO: 498792 - DNA, 16 bp, R. norvegicus
ctggaagaccagcaag

SEQ ID NO: 498793 - DNA, 16 bp, R. norvegicus
ctggaagaccttgaag

SEQ ID NO: 498794 - DNA, 16 bp, R. norvegicus
ctggaagactgttgcc

SEQ ID NO: 498795 - DNA, 16 bp, R. norvegicus
ctggaagagaaaccag

SEQ ID NO: 498796 - DNA, 16 bp, R. norvegicus
ctggaagagaatgagg

SEQ ID NO: 498797 - DNA, 16 bp, R. norvegicus
ctggaagagcaacaaa

SEQ ID NO: 498798 - DNA, 16 bp, R. norvegicus
ctggaagagcaactag

SEQ ID NO: 498799 - DNA, 16 bp, R. norvegicus
ctggaagagcagcaaa

SEQ ID NO: 498800 - DNA, 16 bp, R. norvegicus
ctggaagagcagccac

SEQ ID NO: 498801 - DNA, 16 bp, R. norvegicus
ctggaagagcagctct

SEQ ID NO: 498802 - DNA, 16 bp, R. norvegicus
ctggaagagcagctga

SEQ ID NO: 498803 - DNA, 16 bp, R. norvegicus
ctggaagagcagctgg

SEQ ID NO: 498804 - DNA, 16 bp, R. norvegicus
ctggaagagcaggcaa

SEQ ID NO: 498805 - DNA, 16 bp, R. norvegicus
ctggaagagcagtctg

SEQ ID NO: 498806 - DNA, 16 bp, R. norvegicus
ctggaagagcagtgct

SEQ ID NO: 498807 - DNA, 16 bp, R. norvegicus
ctggaagagcatcaag

SEQ ID NO: 498808 - DNA, 16 bp, R. norvegicus
ctggaagagcatgaag

SEQ ID NO: 498809 - DNA, 16 bp, R. norvegicus
ctggaagagccaagag

SEQ ID NO: 498810 - DNA, 16 bp, R. norvegicus
ctggaagagcggtcag

SEQ ID NO: 498811 - DNA, 16 bp, R. norvegicus
ctggaagagctgagag

SEQ ID NO: 498812 - DNA, 16 bp, R. norvegicus
ctggaagagctgccag

SEQ ID NO: 498813 - DNA, 16 bp, R. norvegicus
ctggaagagcttgagg

SEQ ID NO: 498814 - DNA, 16 bp, R. norvegicus
ctggaagagcttgcag

SEQ ID NO: 498815 - DNA, 16 bp, R. norvegicus
ctggaagaggagacag

SEQ ID NO: 498816 - DNA, 16 bp, R. norvegicus
ctggaagaggagccag

SEQ ID NO: 498817 - DNA, 16 bp, R. norvegicus
ctggaagaggaggcag

SEQ ID NO: 498818 - DNA, 16 bp, R. norvegicus
ctggaagagggcatca

SEQ ID NO: 498819 - DNA, 16 bp, R. norvegicus
ctggaagatcagcaag

SEQ ID NO: 498820 - DNA, 16 bp, R. norvegicus
ctggaagccaggaagc

SEQ ID NO: 498821 - DNA, 16 bp, R. norvegicus
ctggaagccagtcttt

SEQ ID NO: 498822 - DNA, 16 bp, R. norvegicus
ctggaagctctagaac

SEQ ID NO: 498823 - DNA, 16 bp, R. norvegicus
ctggaagctctgattg

SEQ ID NO: 498824 - DNA, 16 bp, R. norvegicus
ctggaagctctgtttg

SEQ ID NO: 498825 - DNA, 16 bp, R. norvegicus
ctggaagctggggaag

SEQ ID NO: 498826 - DNA, 16 bp, R. norvegicus
ctggaagctttgcaga

SEQ ID NO: 498827 - DNA, 16 bp, R. norvegicus
ctggaaggaacccaga

SEQ ID NO: 498828 - DNA, 16 bp, R. norvegicus
ctggaaggacagcaag

SEQ ID NO: 498829 - DNA, 16 bp, R. norvegicus
ctggaaggagaggaga

SEQ ID NO: 498830 - DNA, 16 bp, R. norvegicus
ctggaaggagttgagg

SEQ ID NO: 498831 - DNA, 16 bp, R. norvegicus
ctggaaggatggctca

SEQ ID NO: 498832 - DNA, 16 bp, R. norvegicus
ctggaaggcactgtcc

SEQ ID NO: 498833 - DNA, 16 bp, R. norvegicus
ctggaagtcccacctt

SEQ ID NO: 498834 - DNA, 16 bp, R. norvegicus
ctggaagtctctcctg

SEQ ID NO: 498835 - DNA, 16 bp, R. norvegicus
ctggaagtgggctttg

SEQ ID NO: 498836 - DNA, 16 bp, R. norvegicus
ctggaagttgtcctct

SEQ ID NO: 498837 - DNA, 16 bp, R. norvegicus
ctggaatacagacagg

SEQ ID NO: 498838 - DNA, 16 bp, R. norvegicus
ctggaatcccagcact

SEQ ID NO: 498839 - DNA, 16 bp, R. norvegicus
ctggaatcccagctct

SEQ ID NO: 498840 - DNA, 16 bp, R. norvegicus
ctggaatgaattgttc

SEQ ID NO: 498841 - DNA, 16 bp, R. norvegicus
ctggaattaaaggagt

SEQ ID NO: 498842 - DNA, 16 bp, R. norvegicus
ctggaattaaaggcat

SEQ ID NO: 498843 - DNA, 16 bp, R. norvegicus
ctggaattacaggtat

SEQ ID NO: 498844 - DNA, 16 bp, R. norvegicus
ctggaattcacagaga

SEQ ID NO: 498845 - DNA, 16 bp, R. norvegicus
ctggaattcagaggca

SEQ ID NO: 498846 - DNA, 16 bp, R. norvegicus
ctggaattcattatat

SEQ ID NO: 498847 - DNA, 16 bp, R. norvegicus
ctggaattctctctgt

SEQ ID NO: 498848 - DNA, 16 bp, R. norvegicus
ctggacaaccaattgg

SEQ ID NO: 498849 - DNA, 16 bp, R. norvegicus
ctggacacctgagatc

SEQ ID NO: 498850 - DNA, 16 bp, R. norvegicus
ctggacactgctgtgc

SEQ ID NO: 498851 - DNA, 16 bp, R. norvegicus
ctggacagatggctta

SEQ ID NO: 498852 - DNA, 16 bp, R. norvegicus
ctggacagtgtgcaga

SEQ ID NO: 498853 - DNA, 16 bp, R. norvegicus
ctggacatttctaatc

SEQ ID NO: 498854 - DNA, 16 bp, R. norvegicus
ctggaccaaaacaaga

SEQ ID NO: 498855 - DNA, 16 bp, R. norvegicus
ctggaccaaagcaaga

SEQ ID NO: 498856 - DNA, 16 bp, R. norvegicus
ctggaccacccagccc

SEQ ID NO: 498857 - DNA, 16 bp, R. norvegicus
ctggaccagaaaagaa

SEQ ID NO: 498858 - DNA, 16 bp, R. norvegicus
ctggaccatctctcca

SEQ ID NO: 498859 - DNA, 16 bp, R. norvegicus
ctggacctcagggctc

SEQ ID NO: 498860 - DNA, 16 bp, R. norvegicus
ctggacctcccagtgt

SEQ ID NO: 498861 - DNA, 16 bp, R. norvegicus
ctggacctgaagggaa

SEQ ID NO: 498862 - DNA, 16 bp, R. norvegicus
ctggacctgagctctt

SEQ ID NO: 498863 - DNA, 16 bp, R. norvegicus
ctggactacatagtga

SEQ ID NO: 498864 - DNA, 16 bp, R. norvegicus
ctggactacatggtga

SEQ ID NO: 498865 - DNA, 16 bp, R. norvegicus
ctggactcctccaaag

SEQ ID NO: 498866 - DNA, 16 bp, R. norvegicus
ctggactctgacctta

SEQ ID NO: 498867 - DNA, 16 bp, R. norvegicus
ctggactgaggaggca

SEQ ID NO: 498868 - DNA, 16 bp, R. norvegicus
ctggactggtggttct

SEQ ID NO: 498869 - DNA, 16 bp, R. norvegicus
ctggactgtagctgct

SEQ ID NO: 498870 - DNA, 16 bp, R. norvegicus
ctggacttccctgctt

SEQ ID NO: 498871 - DNA, 16 bp, R. norvegicus
ctggacttgaactcag

SEQ ID NO: 498872 - DNA, 16 bp, R. norvegicus
ctggacttgggtcctc

SEQ ID NO: 498873 - DNA, 16 bp, R. norvegicus
ctggagaaaagttcct

SEQ ID NO: 498874 - DNA, 16 bp, R. norvegicus
ctggagaaaatggaca

SEQ ID NO: 498875 - DNA, 16 bp, R. norvegicus
ctggagaaagaaaacc

SEQ ID NO: 498876 - DNA, 16 bp, R. norvegicus
ctggagaaagcatata

SEQ ID NO: 498877 - DNA, 16 bp, R. norvegicus
ctggagaaagtaccat

SEQ ID NO: 498878 - DNA, 16 bp, R. norvegicus
ctggagaaattttcct

SEQ ID NO: 498879 - DNA, 16 bp, R. norvegicus
ctggagaagaagctga

SEQ ID NO: 498880 - DNA, 16 bp, R. norvegicus
ctggagaagcagctca

SEQ ID NO: 498881 - DNA, 16 bp, R. norvegicus
ctggagaagcagctga

SEQ ID NO: 498882 - DNA, 16 bp, R. norvegicus
ctggagaagctgccca

SEQ ID NO: 498883 - DNA, 16 bp, R. norvegicus
ctggagaaggagatga

SEQ ID NO: 498884 - DNA, 16 bp, R. norvegicus
ctggagaaggagcaga

SEQ ID NO: 498885 - DNA, 16 bp, R. norvegicus
ctggagaaggagctca

SEQ ID NO: 498886 - DNA, 16 bp, R. norvegicus
ctggagaaggagttga

SEQ ID NO: 498887 - DNA, 16 bp, R. norvegicus
ctggagaagtggctca

SEQ ID NO: 498888 - DNA, 16 bp, R. norvegicus
ctggagaagtggctga

SEQ ID NO: 498889 - DNA, 16 bp, R. norvegicus
ctggagaagttgctga

SEQ ID NO: 498890 - DNA, 16 bp, R. norvegicus
ctggagaagtttaggg

SEQ ID NO: 498891 - DNA, 16 bp, R. norvegicus
ctggagacagagacag

SEQ ID NO: 498892 - DNA, 16 bp, R. norvegicus
ctggagacagtgacag

SEQ ID NO: 498893 - DNA, 16 bp, R. norvegicus
ctggagactgaactca

SEQ ID NO: 498894 - DNA, 16 bp, R. norvegicus
ctggagactgagccca

SEQ ID NO: 498895 - DNA, 16 bp, R. norvegicus
ctggagactggagaga

SEQ ID NO: 498896 - DNA, 16 bp, R. norvegicus
ctggagagaagattct

SEQ ID NO: 498897 - DNA, 16 bp, R. norvegicus
ctggagagaaggctta

SEQ ID NO: 498898 - DNA, 16 bp, R. norvegicus
ctggagagacagacag

SEQ ID NO: 498899 - DNA, 16 bp, R. norvegicus
ctggagagacagagac

SEQ ID NO: 498900 - DNA, 16 bp, R. norvegicus
ctggagagacagaggc

SEQ ID NO: 498901 - DNA, 16 bp, R. norvegicus
ctggagagacggccca

SEQ ID NO: 498902 - DNA, 16 bp, R. norvegicus
ctggagagagaggaga

SEQ ID NO: 498903 - DNA, 16 bp, R. norvegicus
ctggagagagctcagc

SEQ ID NO: 498904 - DNA, 16 bp, R. norvegicus
ctggagagatacctca

SEQ ID NO: 498905 - DNA, 16 bp, R. norvegicus
ctggagagatagatgg

SEQ ID NO: 498906 - DNA, 16 bp, R. norvegicus
ctggagagatcgctca

SEQ ID NO: 498907 - DNA, 16 bp, R. norvegicus
ctggagagatgcctta

SEQ ID NO: 498908 - DNA, 16 bp, R. norvegicus
ctggagagatggcttg

SEQ ID NO: 498909 - DNA, 16 bp, R. norvegicus
ctggagagatggtcca

SEQ ID NO: 498910 - DNA, 16 bp, R. norvegicus
ctggagagatggttca

SEQ ID NO: 498911 - DNA, 16 bp, R. norvegicus
ctggagagcctcctgg

SEQ ID NO: 498912 - DNA, 16 bp, R. norvegicus
ctggagagctgactca

SEQ ID NO: 498913 - DNA, 16 bp, R. norvegicus
ctggagagctggagag

SEQ ID NO: 498914 - DNA, 16 bp, R. norvegicus
ctggagagctggttca

SEQ ID NO: 498915 - DNA, 16 bp, R. norvegicus
ctggagaggaaactgg

SEQ ID NO: 498916 - DNA, 16 bp, R. norvegicus
ctggagaggcagagcc

SEQ ID NO: 498917 - DNA, 16 bp, R. norvegicus
ctggagaggcagctga

SEQ ID NO: 498918 - DNA, 16 bp, R. norvegicus
ctggagagggactgag

SEQ ID NO: 498919 - DNA, 16 bp, R. norvegicus
ctggagagggagctga

SEQ ID NO: 498920 - DNA, 16 bp, R. norvegicus
ctggagaggggagact

SEQ ID NO: 498921 - DNA, 16 bp, R. norvegicus
ctggagaggtggaggc

SEQ ID NO: 498922 - DNA, 16 bp, R. norvegicus
ctggagaggtggctgg

SEQ ID NO: 498923 - DNA, 16 bp, R. norvegicus
ctggagagttcagggt

SEQ ID NO: 498924 - DNA, 16 bp, R. norvegicus
ctggagatcaaattca

SEQ ID NO: 498925 - DNA, 16 bp, R. norvegicus
ctggagatccagccca

SEQ ID NO: 498926 - DNA, 16 bp, R. norvegicus
ctggagatctctcaga

SEQ ID NO: 498927 - DNA, 16 bp, R. norvegicus
ctggagatctctggag

SEQ ID NO: 498928 - DNA, 16 bp, R. norvegicus
ctggagatggagctca

SEQ ID NO: 498929 - DNA, 16 bp, R. norvegicus
ctggagatggagctga

SEQ ID NO: 498930 - DNA, 16 bp, R. norvegicus
ctggagatggcccact

SEQ ID NO: 498931 - DNA, 16 bp, R. norvegicus
ctggagatgtgactca

SEQ ID NO: 498932 - DNA, 16 bp, R. norvegicus
ctggagcaagagtgag

SEQ ID NO: 498933 - DNA, 16 bp, R. norvegicus
ctggagcaagctggct

SEQ ID NO: 498934 - DNA, 16 bp, R. norvegicus
ctggagcagaagattc

SEQ ID NO: 498935 - DNA, 16 bp, R. norvegicus
ctggagcagagccagc

SEQ ID NO: 498936 - DNA, 16 bp, R. norvegicus
ctggagcagaggctct

SEQ ID NO: 498937 - DNA, 16 bp, R. norvegicus
ctggagcagcagctac

SEQ ID NO: 498938 - DNA, 16 bp, R. norvegicus
ctggagcagcagctga

SEQ ID NO: 498939 - DNA, 16 bp, R. norvegicus
ctggagcagcaggtcc

SEQ ID NO: 498940 - DNA, 16 bp, R. norvegicus
ctggagcaggagctga

SEQ ID NO: 498941 - DNA, 16 bp, R. norvegicus
ctggagcagtgctgga

SEQ ID NO: 498942 - DNA, 16 bp, R. norvegicus
ctggagcagtgtgtgt

SEQ ID NO: 498943 - DNA, 17 bp, R. norvegicus
ctggagccactgcaaca

SEQ ID NO: 498944 - DNA, 16 bp, R. norvegicus
ctggagccaggggtct

SEQ ID NO: 498945 - DNA, 16 bp, R. norvegicus
ctggagccatctctcc

SEQ ID NO: 498946 - DNA, 16 bp, R. norvegicus
ctggagccatgggtgt

SEQ ID NO: 498947 - DNA, 16 bp, R. norvegicus
ctggagcccaggctgg

SEQ ID NO: 498948 - DNA, 16 bp, R. norvegicus
ctggagccctcaggac

SEQ ID NO: 498949 - DNA, 16 bp, R. norvegicus
ctggagcctcgggacc

SEQ ID NO: 498950 - DNA, 16 bp, R. norvegicus
ctggagctcaccattt

SEQ ID NO: 498951 - DNA, 16 bp, R. norvegicus
ctggagctccaggcag

SEQ ID NO: 498952 - DNA, 16 bp, R. norvegicus
ctggagctgaagaatc

SEQ ID NO: 498953 - DNA, 16 bp, R. norvegicus
ctggagctgaagtcac

SEQ ID NO: 498954 - DNA, 16 bp, R. norvegicus
ctggagctgaagttaa

SEQ ID NO: 498955 - DNA, 16 bp, R. norvegicus
ctggagctgcagacag

SEQ ID NO: 498956 - DNA, 16 bp, R. norvegicus
ctggagctgcagaccc

SEQ ID NO: 498957 - DNA, 16 bp, R. norvegicus
ctggagctgcagatgg

SEQ ID NO: 498958 - DNA, 16 bp, R. norvegicus
ctggagctgcaggcag

SEQ ID NO: 498959 - DNA, 16 bp, R. norvegicus
ctggagctggagctgg

SEQ ID NO: 498960 - DNA, 17 bp, R. norvegicus
ctggagctggggaccaa

SEQ ID NO: 498961 - DNA, 16 bp, R. norvegicus
ctggagctggggaccg

SEQ ID NO: 498962 - DNA, 16 bp, R. norvegicus
ctggaggaacagaggg

SEQ ID NO: 498963 - DNA, 16 bp, R. norvegicus
ctggaggaagccgagg

SEQ ID NO: 498964 - DNA, 16 bp, R. norvegicus
ctggaggaagctgaga

SEQ ID NO: 498965 - DNA, 18 bp, R. norvegicus
ctggaggaattcaagaaa

SEQ ID NO: 498966 - DNA, 16 bp, R. norvegicus
ctggaggacctcaaga

SEQ ID NO: 498967 - DNA, 16 bp, R. norvegicus
ctggaggactttaaga

SEQ ID NO: 498968 - DNA, 16 bp, R. norvegicus
ctggaggagaaaccag

SEQ ID NO: 498969 - DNA, 16 bp, R. norvegicus
ctggaggagaaggaag

SEQ ID NO: 498970 - DNA, 16 bp, R. norvegicus
ctggaggagatgtgag

SEQ ID NO: 498971 - DNA, 16 bp, R. norvegicus
ctggaggagcagccag

SEQ ID NO: 498972 - DNA, 16 bp, R. norvegicus
ctggaggagccgagag

SEQ ID NO: 498973 - DNA, 16 bp, R. norvegicus
ctggaggagctcagag

SEQ ID NO: 498974 - DNA, 16 bp, R. norvegicus
ctggaggagctgaaag

SEQ ID NO: 498975 - DNA, 16 bp, R. norvegicus
ctggaggagctgaagg

SEQ ID NO: 498976 - DNA, 16 bp, R. norvegicus
ctggaggagctgagag

SEQ ID NO: 498977 - DNA, 16 bp, R. norvegicus
ctggaggagctgggag

SEQ ID NO: 498978 - DNA, 16 bp, R. norvegicus
ctggaggaggaagctg

SEQ ID NO: 498979 - DNA, 16 bp, R. norvegicus
ctggaggaggagctga

SEQ ID NO: 498980 - DNA, 16 bp, R. norvegicus
ctggaggaggaggagg

SEQ ID NO: 498981 - DNA, 16 bp, R. norvegicus
ctggaggagttcaaga

SEQ ID NO: 498982 - DNA, 16 bp, R. norvegicus
ctggaggatatggaca

SEQ ID NO: 498983 - DNA, 16 bp, R. norvegicus
ctggaggatggggagg

SEQ ID NO: 498984 - DNA, 16 bp, R. norvegicus
ctggaggcagaaactg

SEQ ID NO: 498985 - DNA, 16 bp, R. norvegicus
ctggaggcagaggctg

SEQ ID NO: 498986 - DNA, 16 bp, R. norvegicus
ctggaggcagagggag

SEQ ID NO: 498987 - DNA, 16 bp, R. norvegicus
ctggaggcaggaactg

SEQ ID NO: 498988 - DNA, 16 bp, R. norvegicus
ctggaggcaggaattg

SEQ ID NO: 498989 - DNA, 16 bp, R. norvegicus
ctggaggcaggagatg

SEQ ID NO: 498990 - DNA, 16 bp, R. norvegicus
ctggaggcaggagctg

SEQ ID NO: 498991 - DNA, 16 bp, R. norvegicus
ctggaggcccagggag

SEQ ID NO: 498992 - DNA, 16 bp, R. norvegicus
ctggaggccgaggcag

SEQ ID NO: 498993 - DNA, 16 bp, R. norvegicus
ctggaggcctcaggga

SEQ ID NO: 498994 - DNA, 16 bp, R. norvegicus
ctggaggctagcctgg

SEQ ID NO: 498995 - DNA, 16 bp, R. norvegicus
ctggaggctgaggctg

SEQ ID NO: 498996 - DNA, 16 bp, R. norvegicus
ctggaggctggagaga

SEQ ID NO: 498997 - DNA, 16 bp, R. norvegicus
ctggagggatccatgg

SEQ ID NO: 498998 - DNA, 16 bp, R. norvegicus
ctggaggggaagccag

SEQ ID NO: 498999 - DNA, 16 bp, R. norvegicus
ctggaggggaagctgg

SEQ ID NO: 499000 - DNA, 16 bp, R. norvegicus
ctggaggtacacttcc

SEQ ID NO: 499001 - DNA, 16 bp, R. norvegicus
ctggaggtagaggcag

SEQ ID NO: 499002 - DNA, 18 bp, R. norvegicus
ctggaggtcaacatgcag

SEQ ID NO: 499003 - DNA, 16 bp, R. norvegicus
ctggaggtcagtatgt

SEQ ID NO: 499004 - DNA, 16 bp, R. norvegicus
ctggaggtctcagtgg

SEQ ID NO: 499005 - DNA, 16 bp, R. norvegicus
ctggaggtgagcagag

SEQ ID NO: 499006 - DNA, 16 bp, R. norvegicus
ctggaggtttcatttg

SEQ ID NO: 499007 - DNA, 16 bp, R. norvegicus
ctggagtcagaaatgt

SEQ ID NO: 499008 - DNA, 16 bp, R. norvegicus
ctggagtcagaggcag

SEQ ID NO: 499009 - DNA, 16 bp, R. norvegicus
ctggagtgggcagctg

SEQ ID NO: 499010 - DNA, 16 bp, R. norvegicus
ctggagttaacagatg

SEQ ID NO: 499011 - DNA, 16 bp, R. norvegicus
ctggagttacagactg

SEQ ID NO: 499012 - DNA, 16 bp, R. norvegicus
ctggagttacaggggg

SEQ ID NO: 499013 - DNA, 16 bp, R. norvegicus
ctggagttgcaggagg

SEQ ID NO: 499014 - DNA, 16 bp, R. norvegicus
ctggagttgcaggtgg

SEQ ID NO: 499015 - DNA, 16 bp, R. norvegicus
ctggagttgtgagctg

SEQ ID NO: 499016 - DNA, 16 bp, R. norvegicus
ctggatactggggctg

SEQ ID NO: 499017 - DNA, 16 bp, R. norvegicus
ctggatagagaggaga

SEQ ID NO: 499018 - DNA, 16 bp, R. norvegicus
ctggatagctcagaga

SEQ ID NO: 499019 - DNA, 16 bp, R. norvegicus
ctggatataaacttaa

SEQ ID NO: 499020 - DNA, 19 bp, R. norvegicus
ctggatatagaaaaccgaa

SEQ ID NO: 499021 - DNA, 16 bp, R. norvegicus
ctggatatcagtctgg

SEQ ID NO: 499022 - DNA, 16 bp, R. norvegicus
ctggatatcccaacac

SEQ ID NO: 499023 - DNA, 16 bp, R. norvegicus
ctggatatgtagcaga

SEQ ID NO: 499024 - DNA, 16 bp, R. norvegicus
ctggatcagcatgagg

SEQ ID NO: 499025 - DNA, 16 bp, R. norvegicus
ctggatcatcctgctc

SEQ ID NO: 499026 - DNA, 16 bp, R. norvegicus
ctggatccacagacag

SEQ ID NO: 499027 - DNA, 16 bp, R. norvegicus
ctggatccccaggtgt

SEQ ID NO: 499028 - DNA, 16 bp, R. norvegicus
ctggatccccagtgaa

SEQ ID NO: 499029 - DNA, 16 bp, R. norvegicus
ctggatctacaggcag

SEQ ID NO: 499030 - DNA, 16 bp, R. norvegicus
ctggatctcatggaga

SEQ ID NO: 499031 - DNA, 16 bp, R. norvegicus
ctggatctcctggaac

SEQ ID NO: 499032 - DNA, 16 bp, R. norvegicus
ctggatgaaatgaaca

SEQ ID NO: 499033 - DNA, 16 bp, R. norvegicus
ctggatgaaatgtaca

SEQ ID NO: 499034 - DNA, 16 bp, R. norvegicus
ctggatgacaagaact

SEQ ID NO: 499035 - DNA, 16 bp, R. norvegicus
ctggatgaggccatgt

SEQ ID NO: 499036 - DNA, 16 bp, R. norvegicus
ctggatgattttgttc

SEQ ID NO: 499037 - DNA, 16 bp, R. norvegicus
ctggatgcctgctgtg

SEQ ID NO: 499038 - DNA, 16 bp, R. norvegicus
ctggatgctgccatga

SEQ ID NO: 499039 - DNA, 16 bp, R. norvegicus
ctggatggctttgttc

SEQ ID NO: 499040 - DNA, 16 bp, R. norvegicus
ctggatgtcctaaaac

SEQ ID NO: 499041 - DNA, 16 bp, R. norvegicus
ctggatgtgcagggcc

SEQ ID NO: 499042 - DNA, 16 bp, R. norvegicus
ctggattcaatctcca

SEQ ID NO: 499043 - DNA, 16 bp, R. norvegicus
ctggattctgtaagaa

SEQ ID NO: 499044 - DNA, 16 bp, R. norvegicus
ctggattctgttccca

SEQ ID NO: 499045 - DNA, 16 bp, R. norvegicus
ctggattcttagactt

SEQ ID NO: 499046 - DNA, 16 bp, R. norvegicus
ctggatttccaggatg

SEQ ID NO: 499047 - DNA, 16 bp, R. norvegicus
ctggatttcctagata

SEQ ID NO: 499048 - DNA, 16 bp, R. norvegicus
ctggatttcctggaac

SEQ ID NO: 499049 - DNA, 16 bp, R. norvegicus
ctggatttcctggatg

SEQ ID NO: 499050 - DNA, 16 bp, R. norvegicus
ctggatttcctggatt

SEQ ID NO: 499051 - DNA, 16 bp, R. norvegicus
ctggatttgacctcct

SEQ ID NO: 499052 - DNA, 16 bp, R. norvegicus
ctggatttggtcctca

SEQ ID NO: 499053 - DNA, 64 bp, R. norvegicus
ctggatttgtagaaagatattgtgtaaatttggttttgtcatggaatatcttggtttctccatc

SEQ ID NO: 499054 - DNA, 16 bp, R. norvegicus
ctggatttgtggaaaa

SEQ ID NO: 499055 - DNA, 16 bp, R. norvegicus
ctggcaatcctcctgc

SEQ ID NO: 499056 - DNA, 16 bp, R. norvegicus
ctggcacagacctgcc

SEQ ID NO: 499057 - DNA, 17 bp, R. norvegicus
ctggcaccatttttttt

SEQ ID NO: 499058 - DNA, 16 bp, R. norvegicus
ctggcacctcagtgcc

SEQ ID NO: 499059 - DNA, 16 bp, R. norvegicus
ctggcactgggatttt

SEQ ID NO: 499060 - DNA, 16 bp, R. norvegicus
ctggcagaacatctca

SEQ ID NO: 499061 - DNA, 16 bp, R. norvegicus
ctggcagaaggactgg

SEQ ID NO: 499062 - DNA, 16 bp, R. norvegicus
ctggcagagcttctca

SEQ ID NO: 499063 - DNA, 16 bp, R. norvegicus
ctggcagcagaacttg

SEQ ID NO: 499064 - DNA, 16 bp, R. norvegicus
ctggcagcagtggagg

SEQ ID NO: 499065 - DNA, 16 bp, R. norvegicus
ctggcagctagcacac

SEQ ID NO: 499066 - DNA, 16 bp, R. norvegicus
ctggcagctggctttc

SEQ ID NO: 499067 - DNA, 16 bp, R. norvegicus
ctggcaggctgtaggt

SEQ ID NO: 499068 - DNA, 16 bp, R. norvegicus
ctggcaggggtcctgc

SEQ ID NO: 499069 - DNA, 16 bp, R. norvegicus
ctggcagtcagtatgt

SEQ ID NO: 499070 - DNA, 16 bp, R. norvegicus
ctggcatatgcctctg

SEQ ID NO: 499071 - DNA, 16 bp, R. norvegicus
ctggcatcgatgggag

SEQ ID NO: 499072 - DNA, 16 bp, R. norvegicus
ctggcatctgtgggca

SEQ ID NO: 499073 - DNA, 16 bp, R. norvegicus
ctggcatctttttttt

SEQ ID NO: 499074 - DNA, 16 bp, R. norvegicus
ctggcattcctctaca

SEQ ID NO: 499075 - DNA, 16 bp, R. norvegicus
ctggcattcctggagc

SEQ ID NO: 499076 - DNA, 16 bp, R. norvegicus
ctggcattgctgcagt

SEQ ID NO: 499077 - DNA, 16 bp, R. norvegicus
ctggccaacaagcccc

SEQ ID NO: 499078 - DNA, 16 bp, R. norvegicus
ctggccaaggacaagc

SEQ ID NO: 499079 - DNA, 16 bp, R. norvegicus
ctggccaaggtcatcc

SEQ ID NO: 499080 - DNA, 16 bp, R. norvegicus
ctggccactgtcagaa

SEQ ID NO: 499081 - DNA, 16 bp, R. norvegicus
ctggccagagagcccc

SEQ ID NO: 499082 - DNA, 16 bp, R. norvegicus
ctggccagccagtgag

SEQ ID NO: 499083 - DNA, 16 bp, R. norvegicus
ctggccaggtacttct

SEQ ID NO: 499084 - DNA, 16 bp, R. norvegicus
ctggccatgggaccag

SEQ ID NO: 499085 - DNA, 16 bp, R. norvegicus
ctggcccagaatatct

SEQ ID NO: 499086 - DNA, 16 bp, R. norvegicus
ctggcccagctgctcc

SEQ ID NO: 499087 - DNA, 16 bp, R. norvegicus
ctggcccagtgtcctc

SEQ ID NO: 499088 - DNA, 16 bp, R. norvegicus
ctggccccacccctca

SEQ ID NO: 499089 - DNA, 16 bp, R. norvegicus
ctggccccagtggtct

SEQ ID NO: 499090 - DNA, 16 bp, R. norvegicus
ctggccccataggctt

SEQ ID NO: 499091 - DNA, 16 bp, R. norvegicus
ctggccccatccctca

SEQ ID NO: 499092 - DNA, 16 bp, R. norvegicus
ctggccctcctggcag

SEQ ID NO: 499093 - DNA, 16 bp, R. norvegicus
ctggccctctggccct

SEQ ID NO: 499094 - DNA, 16 bp, R. norvegicus
ctggccctgaactcag

SEQ ID NO: 499095 - DNA, 16 bp, R. norvegicus
ctggccctgcacatcc

SEQ ID NO: 499096 - DNA, 16 bp, R. norvegicus
ctggccctgcctcttg

SEQ ID NO: 499097 - DNA, 16 bp, R. norvegicus
ctggccctggccctgc

SEQ ID NO: 499098 - DNA, 16 bp, R. norvegicus
ctggccctggccctgg

SEQ ID NO: 499099 - DNA, 16 bp, R. norvegicus
ctggcctacacagtga

SEQ ID NO: 499100 - DNA, 16 bp, R. norvegicus
ctggcctcaaagtcag

SEQ ID NO: 499101 - DNA, 16 bp, R. norvegicus
ctggcctcaaagtcat

SEQ ID NO: 499102 - DNA, 16 bp, R. norvegicus
ctggcctcacactcag

SEQ ID NO: 499103 - DNA, 16 bp, R. norvegicus
ctggcctcagtctccc

SEQ ID NO: 499104 - DNA, 16 bp, R. norvegicus
ctggcctcagtggaga

SEQ ID NO: 499105 - DNA, 16 bp, R. norvegicus
ctggcctcagtttccc

SEQ ID NO: 499106 - DNA, 16 bp, R. norvegicus
ctggcctccaagttct

SEQ ID NO: 499107 - DNA, 16 bp, R. norvegicus
ctggcctccacacaca

SEQ ID NO: 499108 - DNA, 16 bp, R. norvegicus
ctggcctccacaggca

SEQ ID NO: 499109 - DNA, 16 bp, R. norvegicus
ctggcctccagctcag

SEQ ID NO: 499110 - DNA, 16 bp, R. norvegicus
ctggcctcccaggcat

SEQ ID NO: 499111 - DNA, 16 bp, R. norvegicus
ctggcctcccagggca

SEQ ID NO: 499112 - DNA, 16 bp, R. norvegicus
ctggcctccctgggca

SEQ ID NO: 499113 - DNA, 16 bp, R. norvegicus
ctggcctcctcaagca

SEQ ID NO: 499114 - DNA, 16 bp, R. norvegicus
ctggcctcctccagca

SEQ ID NO: 499115 - DNA, 16 bp, R. norvegicus
ctggcctcctggggca

SEQ ID NO: 499116 - DNA, 16 bp, R. norvegicus
ctggcctccttccttg

SEQ ID NO: 499117 - DNA, 16 bp, R. norvegicus
ctggcctcgaactcat

SEQ ID NO: 499118 - DNA, 16 bp, R. norvegicus
ctggcctcggtgggag

SEQ ID NO: 499119 - DNA, 16 bp, R. norvegicus
ctggcctctacataca

SEQ ID NO: 499120 - DNA, 16 bp, R. norvegicus
ctggcctctacctcct

SEQ ID NO: 499121 - DNA, 16 bp, R. norvegicus
ctggcctctgacctca

SEQ ID NO: 499122 - DNA, 16 bp, R. norvegicus
ctggcctctgcagata

SEQ ID NO: 499123 - DNA, 16 bp, R. norvegicus
ctggcctctgcctccc

SEQ ID NO: 499124 - DNA, 16 bp, R. norvegicus
ctggcctctgcttcct

SEQ ID NO: 499125 - DNA, 16 bp, R. norvegicus
ctggcctctgtctccc

SEQ ID NO: 499126 - DNA, 16 bp, R. norvegicus
ctggcctctgtggaag

SEQ ID NO: 499127 - DNA, 16 bp, R. norvegicus
ctggcctctgtgggaa

SEQ ID NO: 499128 - DNA, 16 bp, R. norvegicus
ctggcctctgtgggct

SEQ ID NO: 499129 - DNA, 16 bp, R. norvegicus
ctggcctctgtgggta

SEQ ID NO: 499130 - DNA, 16 bp, R. norvegicus
ctggcctctttgggca

SEQ ID NO: 499131 - DNA, 16 bp, R. norvegicus
ctggcctgcagaaggc

SEQ ID NO: 499132 - DNA, 16 bp, R. norvegicus
ctggcctgcaggcaga

SEQ ID NO: 499133 - DNA, 16 bp, R. norvegicus
ctggcctgcaggtata

SEQ ID NO: 499134 - DNA, 16 bp, R. norvegicus
ctggcctggaacccat

SEQ ID NO: 499135 - DNA, 16 bp, R. norvegicus
ctggcctggaactcaa

SEQ ID NO: 499136 - DNA, 16 bp, R. norvegicus
ctggcctggaattcac

SEQ ID NO: 499137 - DNA, 16 bp, R. norvegicus
ctggcctggaattcct

SEQ ID NO: 499138 - DNA, 16 bp, R. norvegicus
ctggcctggagctcac

SEQ ID NO: 499139 - DNA, 16 bp, R. norvegicus
ctggcctggagtttgc

SEQ ID NO: 499140 - DNA, 16 bp, R. norvegicus
ctggcctggctacctc

SEQ ID NO: 499141 - DNA, 16 bp, R. norvegicus
ctggcctgggactcac

SEQ ID NO: 499142 - DNA, 16 bp, R. norvegicus
ctggccttcaagggca

SEQ ID NO: 499143 - DNA, 16 bp, R. norvegicus
ctggccttcacagaca

SEQ ID NO: 499144 - DNA, 16 bp, R. norvegicus
ctggccttcacaggca

SEQ ID NO: 499145 - DNA, 16 bp, R. norvegicus
ctggccttcatacttt

SEQ ID NO: 499146 - DNA, 16 bp, R. norvegicus
ctggccttcctgggca

SEQ ID NO: 499147 - DNA, 16 bp, R. norvegicus
ctggccttgaactcac

SEQ ID NO: 499148 - DNA, 16 bp, R. norvegicus
ctggccttgaactcat

SEQ ID NO: 499149 - DNA, 16 bp, R. norvegicus
ctggccttgaactcct

SEQ ID NO: 499150 - DNA, 16 bp, R. norvegicus
ctggccttgaactctc

SEQ ID NO: 499151 - DNA, 16 bp, R. norvegicus
ctggccttgaagtcaa

SEQ ID NO: 499152 - DNA, 16 bp, R. norvegicus
ctggccttgagctcaa

SEQ ID NO: 499153 - DNA, 16 bp, R. norvegicus
ctggcgaaagccctta

SEQ ID NO: 499154 - DNA, 16 bp, R. norvegicus
ctggcgaggaggtgga

SEQ ID NO: 499155 - DNA, 16 bp, R. norvegicus
ctggcgaggatgtgaa

SEQ ID NO: 499156 - DNA, 16 bp, R. norvegicus
ctggctaactgttctt

SEQ ID NO: 499157 - DNA, 16 bp, R. norvegicus
ctggctacagctgctg

SEQ ID NO: 499158 - DNA, 16 bp, R. norvegicus
ctggctatccaaacac

SEQ ID NO: 499159 - DNA, 16 bp, R. norvegicus
ctggctattatgacta

SEQ ID NO: 499160 - DNA, 16 bp, R. norvegicus
ctggctcagcctggcc

SEQ ID NO: 499161 - DNA, 16 bp, R. norvegicus
ctggctcagtgagtaa

SEQ ID NO: 499162 - DNA, 16 bp, R. norvegicus
ctggctcatagtgcag

SEQ ID NO: 499163 - DNA, 16 bp, R. norvegicus
ctggctccaggctgct

SEQ ID NO: 499164 - DNA, 16 bp, R. norvegicus
ctggctccagtgggcc

SEQ ID NO: 499165 - DNA, 17 bp, R. norvegicus
ctggctccccctcctgg

SEQ ID NO: 499166 - DNA, 16 bp, R. norvegicus
ctggctcctgccagca

SEQ ID NO: 499167 - DNA, 16 bp, R. norvegicus
ctggctctgcctccct

SEQ ID NO: 499168 - DNA, 16 bp, R. norvegicus
ctggctctgcctggaa

SEQ ID NO: 499169 - DNA, 16 bp, R. norvegicus
ctggctctggctctgt

SEQ ID NO: 499170 - DNA, 16 bp, R. norvegicus
ctggctgactggctgg

SEQ ID NO: 499171 - DNA, 16 bp, R. norvegicus
ctggctgagaaagaaa

SEQ ID NO: 499172 - DNA, 16 bp, R. norvegicus
ctggctgaggaggaag

SEQ ID NO: 499173 - DNA, 16 bp, R. norvegicus
ctggctgcactggctg

SEQ ID NO: 499174 - DNA, 16 bp, R. norvegicus
ctggctgcagcagatc

SEQ ID NO: 499175 - DNA, 16 bp, R. norvegicus
ctggctgcccttctag

SEQ ID NO: 499176 - DNA, 16 bp, R. norvegicus
ctggctgcctgcagaa

SEQ ID NO: 499177 - DNA, 16 bp, R. norvegicus
ctggctgctcctccaa

SEQ ID NO: 499178 - DNA, 16 bp, R. norvegicus
ctggctgctctggcag

SEQ ID NO: 499179 - DNA, 16 bp, R. norvegicus
ctggctgctcttgcag

SEQ ID NO: 499180 - DNA, 16 bp, R. norvegicus
ctggctgctgagggga

SEQ ID NO: 499181 - DNA, 16 bp, R. norvegicus
ctggctgctgcaggaa

SEQ ID NO: 499182 - DNA, 16 bp, R. norvegicus
ctggctgctgccgctg

SEQ ID NO: 499183 - DNA, 17 bp, R. norvegicus
ctggctgctgctgctgc

SEQ ID NO: 499184 - DNA, 16 bp, R. norvegicus
ctggctgctggctggc

SEQ ID NO: 499185 - DNA, 16 bp, R. norvegicus
ctggctgctttccaga

SEQ ID NO: 499186 - DNA, 16 bp, R. norvegicus
ctggctgctttgtgac

SEQ ID NO: 499187 - DNA, 16 bp, R. norvegicus
ctggctggacagtgag

SEQ ID NO: 499188 - DNA, 16 bp, R. norvegicus
ctggctggagaggtgg

SEQ ID NO: 499189 - DNA, 16 bp, R. norvegicus
ctggctggagattttc

SEQ ID NO: 499190 - DNA, 16 bp, R. norvegicus
ctggctggccaccaag

SEQ ID NO: 499191 - DNA, 16 bp, R. norvegicus
ctggctggccagagag

SEQ ID NO: 499192 - DNA, 16 bp, R. norvegicus
ctggctggccagggag

SEQ ID NO: 499193 - DNA, 16 bp, R. norvegicus
ctggctggcctggaac

SEQ ID NO: 499194 - DNA, 16 bp, R. norvegicus
ctggctggctggcctg

SEQ ID NO: 499195 - DNA, 16 bp, R. norvegicus
ctggctggctgtcctg

SEQ ID NO: 499196 - DNA, 21 bp, R. norvegicus
ctggctggggcggtactatgc

SEQ ID NO: 499197 - DNA, 16 bp, R. norvegicus
ctggctggtttcgtgt

SEQ ID NO: 499198 - DNA, 16 bp, R. norvegicus
ctggctgtaggtctct

SEQ ID NO: 499199 - DNA, 16 bp, R. norvegicus
ctggctgtcctgaaac

SEQ ID NO: 499200 - DNA, 16 bp, R. norvegicus
ctggctgtcctggaga

SEQ ID NO: 499201 - DNA, 16 bp, R. norvegicus
ctggctgtctggaact

SEQ ID NO: 499202 - DNA, 16 bp, R. norvegicus
ctggctgtgaatggaa

SEQ ID NO: 499203 - DNA, 16 bp, R. norvegicus
ctggctgtggctctca

SEQ ID NO: 499204 - DNA, 16 bp, R. norvegicus
ctggctgtggtggtgc

SEQ ID NO: 499205 - DNA, 16 bp, R. norvegicus
ctggctgtgtctcagg

SEQ ID NO: 499206 - DNA, 16 bp, R. norvegicus
ctggctgtgtctctga

SEQ ID NO: 499207 - DNA, 16 bp, R. norvegicus
ctggctgttccagaac

SEQ ID NO: 499208 - DNA, 16 bp, R. norvegicus
ctggctgttgccaagt

SEQ ID NO: 499209 - DNA, 16 bp, R. norvegicus
ctggcttagtttcaga

SEQ ID NO: 499210 - DNA, 16 bp, R. norvegicus
ctggcttcaactgcct

SEQ ID NO: 499211 - DNA, 16 bp, R. norvegicus
ctggcttccaaaggca

SEQ ID NO: 499212 - DNA, 16 bp, R. norvegicus
ctggcttccaaggaca

SEQ ID NO: 499213 - DNA, 16 bp, R. norvegicus
ctggcttccagcctag

SEQ ID NO: 499214 - DNA, 16 bp, R. norvegicus
ctggcttccagtcagc

SEQ ID NO: 499215 - DNA, 16 bp, R. norvegicus
ctggcttcccaggcct

SEQ ID NO: 499216 - DNA, 16 bp, R. norvegicus
ctggcttccctcagtg

SEQ ID NO: 499217 - DNA, 16 bp, R. norvegicus
ctggcttccctgggca

SEQ ID NO: 499218 - DNA, 16 bp, R. norvegicus
ctggcttccgagatgt

SEQ ID NO: 499219 - DNA, 16 bp, R. norvegicus
ctggcttccttccagt

SEQ ID NO: 499220 - DNA, 16 bp, R. norvegicus
ctggcttccttccttc

SEQ ID NO: 499221 - DNA, 16 bp, R. norvegicus
ctggcttctctctcag

SEQ ID NO: 499222 - DNA, 16 bp, R. norvegicus
ctggcttctgagaatt

SEQ ID NO: 499223 - DNA, 16 bp, R. norvegicus
ctggcttctgcagaca

SEQ ID NO: 499224 - DNA, 16 bp, R. norvegicus
ctggcttcttcctctg

SEQ ID NO: 499225 - DNA, 16 bp, R. norvegicus
ctggcttgctcatcat

SEQ ID NO: 499226 - DNA, 16 bp, R. norvegicus
ctggcttgctctctgt

SEQ ID NO: 499227 - DNA, 16 bp, R. norvegicus
ctggcttggtggcaag

SEQ ID NO: 499228 - DNA, 16 bp, R. norvegicus
ctggcttgttcctcat

SEQ ID NO: 499229 - DNA, 16 bp, R. norvegicus
ctggctttcaaagttt

SEQ ID NO: 499230 - DNA, 16 bp, R. norvegicus
ctggctttgaactcac

SEQ ID NO: 499231 - DNA, 16 bp, R. norvegicus
ctggcttttgttgatt

SEQ ID NO: 499232 - DNA, 16 bp, R. norvegicus
ctgggaaaacaagcct

SEQ ID NO: 499233 - DNA, 16 bp, R. norvegicus
ctgggaaaaggaagat

SEQ ID NO: 499234 - DNA, 16 bp, R. norvegicus
ctgggaaacaagagga

SEQ ID NO: 499235 - DNA, 16 bp, R. norvegicus
ctgggaaacagaaact

SEQ ID NO: 499236 - DNA, 16 bp, R. norvegicus
ctgggaaagaaattag

SEQ ID NO: 499237 - DNA, 16 bp, R. norvegicus
ctgggaaagagaataa

SEQ ID NO: 499238 - DNA, 16 bp, R. norvegicus
ctgggaaagagagaga

SEQ ID NO: 499239 - DNA, 16 bp, R. norvegicus
ctgggaaagggaagaa

SEQ ID NO: 499240 - DNA, 16 bp, R. norvegicus
ctgggaaatgttttct

SEQ ID NO: 499241 - DNA, 16 bp, R. norvegicus
ctgggaacctggagca

SEQ ID NO: 499242 - DNA, 16 bp, R. norvegicus
ctgggaactgaatgca

SEQ ID NO: 499243 - DNA, 16 bp, R. norvegicus
ctgggaactgacctgg

SEQ ID NO: 499244 - DNA, 16 bp, R. norvegicus
ctgggaactggacttg

SEQ ID NO: 499245 - DNA, 16 bp, R. norvegicus
ctgggaagaaaaaaaa

SEQ ID NO: 499246 - DNA, 16 bp, R. norvegicus
ctgggaagacaaaaga

SEQ ID NO: 499247 - DNA, 16 bp, R. norvegicus
ctgggaagagacacca

SEQ ID NO: 499248 - DNA, 16 bp, R. norvegicus
ctgggaagaggaacct

SEQ ID NO: 499249 - DNA, 16 bp, R. norvegicus
ctgggaagaggaagat

SEQ ID NO: 499250 - DNA, 16 bp, R. norvegicus
ctgggaagagggaagc

SEQ ID NO: 499251 - DNA, 16 bp, R. norvegicus
ctgggaagagggaccc

SEQ ID NO: 499252 - DNA, 16 bp, R. norvegicus
ctgggaagatggagac

SEQ ID NO: 499253 - DNA, 16 bp, R. norvegicus
ctgggaagccagagga

SEQ ID NO: 499254 - DNA, 16 bp, R. norvegicus
ctgggaaggagaaaga

SEQ ID NO: 499255 - DNA, 16 bp, R. norvegicus
ctgggaaggagaaagg

SEQ ID NO: 499256 - DNA, 16 bp, R. norvegicus
ctgggaaggcagagga

SEQ ID NO: 499257 - DNA, 16 bp, R. norvegicus
ctgggaagggagagag

SEQ ID NO: 499258 - DNA, 16 bp, R. norvegicus
ctgggaataaagatgt

SEQ ID NO: 499259 - DNA, 16 bp, R. norvegicus
ctgggaatctagccca

SEQ ID NO: 499260 - DNA, 16 bp, R. norvegicus
ctgggaatctgagaga

SEQ ID NO: 499261 - DNA, 16 bp, R. norvegicus
ctgggaatggaacctg

SEQ ID NO: 499262 - DNA, 16 bp, R. norvegicus
ctgggaatggtaatac

SEQ ID NO: 499263 - DNA, 16 bp, R. norvegicus
ctgggaattgaaccca

SEQ ID NO: 499264 - DNA, 16 bp, R. norvegicus
ctgggacaagatcctt

SEQ ID NO: 499265 - DNA, 16 bp, R. norvegicus
ctgggacaagccagag

SEQ ID NO: 499266 - DNA, 16 bp, R. norvegicus
ctgggacacctagcca

SEQ ID NO: 499267 - DNA, 16 bp, R. norvegicus
ctgggacaggatactt

SEQ ID NO: 499268 - DNA, 16 bp, R. norvegicus
ctgggacagtggaagt

SEQ ID NO: 499269 - DNA, 16 bp, R. norvegicus
ctgggaccaagtgttc

SEQ ID NO: 499270 - DNA, 16 bp, R. norvegicus
ctgggaccccagccca

SEQ ID NO: 499271 - DNA, 16 bp, R. norvegicus
ctgggactcacagaga

SEQ ID NO: 499272 - DNA, 16 bp, R. norvegicus
ctgggactcctctcag

SEQ ID NO: 499273 - DNA, 16 bp, R. norvegicus
ctgggactggggctgg

SEQ ID NO: 499274 - DNA, 16 bp, R. norvegicus
ctgggacttcaccatg

SEQ ID NO: 499275 - DNA, 16 bp, R. norvegicus
ctgggacttgaactca

SEQ ID NO: 499276 - DNA, 16 bp, R. norvegicus
ctgggagaaaaaaaaa

SEQ ID NO: 499277 - DNA, 16 bp, R. norvegicus
ctgggagaaagcctgt

SEQ ID NO: 499278 - DNA, 16 bp, R. norvegicus
ctgggagaacatggca

SEQ ID NO: 499279 - DNA, 16 bp, R. norvegicus
ctgggagaacatggtg

SEQ ID NO: 499280 - DNA, 16 bp, R. norvegicus
ctgggagaactgaaga

SEQ ID NO: 499281 - DNA, 16 bp, R. norvegicus
ctgggagaagactggc

SEQ ID NO: 499282 - DNA, 16 bp, R. norvegicus
ctgggagaagctggag

SEQ ID NO: 499283 - DNA, 16 bp, R. norvegicus
ctgggagaccctgtct

SEQ ID NO: 499284 - DNA, 16 bp, R. norvegicus
ctgggagacttcactc

SEQ ID NO: 499285 - DNA, 16 bp, R. norvegicus
ctgggagagcagcaag

SEQ ID NO: 499286 - DNA, 16 bp, R. norvegicus
ctgggagagcagccaa

SEQ ID NO: 499287 - DNA, 16 bp, R. norvegicus
ctgggagagcagccag

SEQ ID NO: 499288 - DNA, 16 bp, R. norvegicus
ctgggagagctgggag

SEQ ID NO: 499289 - DNA, 16 bp, R. norvegicus
ctgggagccagtcttc

SEQ ID NO: 499290 - DNA, 16 bp, R. norvegicus
ctgggagcctctccca

SEQ ID NO: 499291 - DNA, 16 bp, R. norvegicus
ctgggagcctgggagc

SEQ ID NO: 499292 - DNA, 16 bp, R. norvegicus
ctgggagctcagagag

SEQ ID NO: 499293 - DNA, 16 bp, R. norvegicus
ctgggagctccctgag

SEQ ID NO: 499294 - DNA, 16 bp, R. norvegicus
ctgggagctctgaggg

SEQ ID NO: 499295 - DNA, 16 bp, R. norvegicus
ctgggagctctgagtg

SEQ ID NO: 499296 - DNA, 16 bp, R. norvegicus
ctgggagctgaggcag

SEQ ID NO: 499297 - DNA, 16 bp, R. norvegicus
ctgggaggaagagagg

SEQ ID NO: 499298 - DNA, 16 bp, R. norvegicus
ctgggaggagaggagg

SEQ ID NO: 499299 - DNA, 16 bp, R. norvegicus
ctgggaggagatgagg

SEQ ID NO: 499300 - DNA, 16 bp, R. norvegicus
ctgggaggaggaggag

SEQ ID NO: 499301 - DNA, 16 bp, R. norvegicus
ctgggaggagggcagt

SEQ ID NO: 499302 - DNA, 16 bp, R. norvegicus
ctgggaggagggtctc

SEQ ID NO: 499303 - DNA, 16 bp, R. norvegicus
ctgggaggcagagatg

SEQ ID NO: 499304 - DNA, 16 bp, R. norvegicus
ctgggagtcaagcttc

SEQ ID NO: 499305 - DNA, 16 bp, R. norvegicus
ctgggagtcaggcttc

SEQ ID NO: 499306 - DNA, 16 bp, R. norvegicus
ctgggagtcctacctg

SEQ ID NO: 499307 - DNA, 16 bp, R. norvegicus
ctgggagttccaggcc

SEQ ID NO: 499308 - DNA, 16 bp, R. norvegicus
ctgggagttctgcctg

SEQ ID NO: 499309 - DNA, 16 bp, R. norvegicus
ctgggataacaggcat

SEQ ID NO: 499310 - DNA, 16 bp, R. norvegicus
ctgggatgaaagatgt

SEQ ID NO: 499311 - DNA, 16 bp, R. norvegicus
ctgggatgagctagaa

SEQ ID NO: 499312 - DNA, 16 bp, R. norvegicus
ctgggatgtttccagc

SEQ ID NO: 499313 - DNA, 16 bp, R. norvegicus
ctgggattaaacacat

SEQ ID NO: 499314 - DNA, 16 bp, R. norvegicus
ctgggattaaaggcgt

SEQ ID NO: 499315 - DNA, 16 bp, R. norvegicus
ctgggattacaaatgc

SEQ ID NO: 499316 - DNA, 16 bp, R. norvegicus
ctgggattatagatat

SEQ ID NO: 499317 - DNA, 16 bp, R. norvegicus
ctgggattccaggcct

SEQ ID NO: 499318 - DNA, 16 bp, R. norvegicus
ctgggattcttttttt

SEQ ID NO: 499319 - DNA, 16 bp, R. norvegicus
ctgggattgaagatgt

SEQ ID NO: 499320 - DNA, 16 bp, R. norvegicus
ctgggattgaaggcct

SEQ ID NO: 499321 - DNA, 16 bp, R. norvegicus
ctgggcacacagtagg

SEQ ID NO: 499322 - DNA, 16 bp, R. norvegicus
ctgggcacagaaatca

SEQ ID NO: 499323 - DNA, 16 bp, R. norvegicus
ctgggcacaggaagat

SEQ ID NO: 499324 - DNA, 16 bp, R. norvegicus
ctgggcacagtctgga

SEQ ID NO: 499325 - DNA, 16 bp, R. norvegicus
ctgggcacttcctgtg

SEQ ID NO: 499326 - DNA, 16 bp, R. norvegicus
ctgggcagagagacag

SEQ ID NO: 499327 - DNA, 16 bp, R. norvegicus
ctgggcagagccagaa

SEQ ID NO: 499328 - DNA, 16 bp, R. norvegicus
ctgggcagctgcctac

SEQ ID NO: 499329 - DNA, 16 bp, R. norvegicus
ctgggcagtagtggca

SEQ ID NO: 499330 - DNA, 16 bp, R. norvegicus
ctgggcagtggtagtg

SEQ ID NO: 499331 - DNA, 16 bp, R. norvegicus
ctgggcagtggtggtg

SEQ ID NO: 499332 - DNA, 16 bp, R. norvegicus
ctgggcagtgtgtgtg

SEQ ID NO: 499333 - DNA, 17 bp, R. norvegicus
ctgggcatatacccaaa

SEQ ID NO: 499334 - DNA, 16 bp, R. norvegicus
ctgggcatccagccca

SEQ ID NO: 499335 - DNA, 16 bp, R. norvegicus
ctgggcatgttctcca

SEQ ID NO: 499336 - DNA, 17 bp, R. norvegicus
ctgggccagaggacagg

SEQ ID NO: 499337 - DNA, 16 bp, R. norvegicus
ctgggccagctctcca

SEQ ID NO: 499338 - DNA, 16 bp, R. norvegicus
ctgggcccctgtgcac

SEQ ID NO: 499339 - DNA, 16 bp, R. norvegicus
ctgggccctcccctac

SEQ ID NO: 499340 - DNA, 16 bp, R. norvegicus
ctgggcctggacctaa

SEQ ID NO: 499341 - DNA, 16 bp, R. norvegicus
ctgggcctggcctgag

SEQ ID NO: 499342 - DNA, 16 bp, R. norvegicus
ctgggcctggcttggg

SEQ ID NO: 499343 - DNA, 16 bp, R. norvegicus
ctgggcctgggcctgc

SEQ ID NO: 499344 - DNA, 16 bp, R. norvegicus
ctgggcctgggcctgg

SEQ ID NO: 499345 - DNA, 16 bp, R. norvegicus
ctgggcctggggcctg

SEQ ID NO: 499346 - DNA, 16 bp, R. norvegicus
ctgggcctggggctgg

SEQ ID NO: 499347 - DNA, 16 bp, R. norvegicus
ctgggccttcagagag

SEQ ID NO: 499348 - DNA, 16 bp, R. norvegicus
ctgggctacatcctca

SEQ ID NO: 499349 - DNA, 16 bp, R. norvegicus
ctgggctacatgaaat

SEQ ID NO: 499350 - DNA, 16 bp, R. norvegicus
ctgggctcagtccaag

SEQ ID NO: 499351 - DNA, 16 bp, R. norvegicus
ctgggctcagtttcca

SEQ ID NO: 499352 - DNA, 16 bp, R. norvegicus
ctgggctccaaccaca

SEQ ID NO: 499353 - DNA, 16 bp, R. norvegicus
ctgggctccaccctca

SEQ ID NO: 499354 - DNA, 17 bp, R. norvegicus
ctgggctctgacctcat

SEQ ID NO: 499355 - DNA, 16 bp, R. norvegicus
ctgggctctgatgatg

SEQ ID NO: 499356 - DNA, 16 bp, R. norvegicus
ctgggctgagccagca

SEQ ID NO: 499357 - DNA, 16 bp, R. norvegicus
ctgggctgcagagtaa

SEQ ID NO: 499358 - DNA, 16 bp, R. norvegicus
ctgggctgcctcatct

SEQ ID NO: 499359 - DNA, 16 bp, R. norvegicus
ctgggctgccttctct

SEQ ID NO: 499360 - DNA, 16 bp, R. norvegicus
ctgggctgccttgtct

SEQ ID NO: 499361 - DNA, 16 bp, R. norvegicus
ctgggctgctgcctga

SEQ ID NO: 499362 - DNA, 16 bp, R. norvegicus
ctgggctggtgctcct

SEQ ID NO: 499363 - DNA, 16 bp, R. norvegicus
ctgggctggtgggcct

SEQ ID NO: 499364 - DNA, 16 bp, R. norvegicus
ctgggctgtcctggaa

SEQ ID NO: 499365 - DNA, 16 bp, R. norvegicus
ctgggctgttggtcct

SEQ ID NO: 499366 - DNA, 16 bp, R. norvegicus
ctgggcttcaacctca

SEQ ID NO: 499367 - DNA, 16 bp, R. norvegicus
ctgggcttggggtctg

SEQ ID NO: 499368 - DNA, 16 bp, R. norvegicus
ctgggcttttctcctg

SEQ ID NO: 499369 - DNA, 16 bp, R. norvegicus
ctggggaaagaggctg

SEQ ID NO: 499370 - DNA, 16 bp, R. norvegicus
ctggggaaatggctta

SEQ ID NO: 499371 - DNA, 16 bp, R. norvegicus
ctggggaagcctggag

SEQ ID NO: 499372 - DNA, 16 bp, R. norvegicus
ctggggaaggagggag

SEQ ID NO: 499373 - DNA, 16 bp, R. norvegicus
ctggggacagagagct

SEQ ID NO: 499374 - DNA, 16 bp, R. norvegicus
ctggggacagagctca

SEQ ID NO: 499375 - DNA, 16 bp, R. norvegicus
ctggggaccccatgct

SEQ ID NO: 499376 - DNA, 16 bp, R. norvegicus
ctggggacccctgagc

SEQ ID NO: 499377 - DNA, 19 bp, R. norvegicus
ctggggaccgaacccagga

SEQ ID NO: 499378 - DNA, 16 bp, R. norvegicus
ctggggactaagtatt

SEQ ID NO: 499379 - DNA, 16 bp, R. norvegicus
ctggggactcttcaga

SEQ ID NO: 499380 - DNA, 16 bp, R. norvegicus
ctggggactgagccca

SEQ ID NO: 499381 - DNA, 16 bp, R. norvegicus
ctggggagatggagac

SEQ ID NO: 499382 - DNA, 16 bp, R. norvegicus
ctggggagatggttta

SEQ ID NO: 499383 - DNA, 18 bp, R. norvegicus
ctggggagcgaacccagg

SEQ ID NO: 499384 - DNA, 16 bp, R. norvegicus
ctggggaggacagaca

SEQ ID NO: 499385 - DNA, 16 bp, R. norvegicus
ctggggaggcagaaac

SEQ ID NO: 499386 - DNA, 16 bp, R. norvegicus
ctggggaggctgaggt

SEQ ID NO: 499387 - DNA, 16 bp, R. norvegicus
ctggggatccagcata

SEQ ID NO: 499388 - DNA, 16 bp, R. norvegicus
ctggggatcctcctgt

SEQ ID NO: 499389 - DNA, 16 bp, R. norvegicus
ctggggattgaactca

SEQ ID NO: 499390 - DNA, 16 bp, R. norvegicus
ctggggattgattgga

SEQ ID NO: 499391 - DNA, 16 bp, R. norvegicus
ctggggattttccatg

SEQ ID NO: 499392 - DNA, 16 bp, R. norvegicus
ctggggcaagagaaag

SEQ ID NO: 499393 - DNA, 16 bp, R. norvegicus
ctggggcaagcatgtg

SEQ ID NO: 499394 - DNA, 16 bp, R. norvegicus
ctggggcaggggcagg

SEQ ID NO: 499395 - DNA, 16 bp, R. norvegicus
ctggggcaggggctgg

SEQ ID NO: 499396 - DNA, 16 bp, R. norvegicus
ctggggccagaccagg

SEQ ID NO: 499397 - DNA, 16 bp, R. norvegicus
ctggggccagtgagat

SEQ ID NO: 499398 - DNA, 16 bp, R. norvegicus
ctggggcctccagcct

SEQ ID NO: 499399 - DNA, 16 bp, R. norvegicus
ctggggcctggagaga

SEQ ID NO: 499400 - DNA, 16 bp, R. norvegicus
ctggggctggagctgg

SEQ ID NO: 499401 - DNA, 16 bp, R. norvegicus
ctggggctgggctttg

SEQ ID NO: 499402 - DNA, 16 bp, R. norvegicus
ctgggggaaaaaaaaa

SEQ ID NO: 499403 - DNA, 16 bp, R. norvegicus
ctgggggaggggaagc

SEQ ID NO: 499404 - DNA, 16 bp, R. norvegicus
ctgggggcaggaactg

SEQ ID NO: 499405 - DNA, 16 bp, R. norvegicus
ctgggggccagtggac

SEQ ID NO: 499406 - DNA, 16 bp, R. norvegicus
ctggggtagttcagga

SEQ ID NO: 499407 - DNA, 16 bp, R. norvegicus
ctggggtcagagaaag

SEQ ID NO: 499408 - DNA, 16 bp, R. norvegicus
ctggggtctccccatt

SEQ ID NO: 499409 - DNA, 16 bp, R. norvegicus
ctggggtctctgtccc

SEQ ID NO: 499410 - DNA, 16 bp, R. norvegicus
ctggggttaaaacaaa

SEQ ID NO: 499411 - DNA, 16 bp, R. norvegicus
ctggggttaaaggagt

SEQ ID NO: 499412 - DNA, 16 bp, R. norvegicus
ctgggtacaaggagcc

SEQ ID NO: 499413 - DNA, 18 bp, R. norvegicus
ctgggtcctaagtctgtg

SEQ ID NO: 499414 - DNA, 16 bp, R. norvegicus
ctgggtcctatttatg

SEQ ID NO: 499415 - DNA, 16 bp, R. norvegicus
ctgggtcctgccaagg

SEQ ID NO: 499416 - DNA, 16 bp, R. norvegicus
ctgggtcctgggagcc

SEQ ID NO: 499417 - DNA, 16 bp, R. norvegicus
ctgggtcctgggtgac

SEQ ID NO: 499418 - DNA, 16 bp, R. norvegicus
ctgggtctctctctct

SEQ ID NO: 499419 - DNA, 16 bp, R. norvegicus
ctgggtctctgtctct

SEQ ID NO: 499420 - DNA, 16 bp, R. norvegicus
ctgggtctttgtgtgg

SEQ ID NO: 499421 - DNA, 16 bp, R. norvegicus
ctgggtgggatcttgt

SEQ ID NO: 499422 - DNA, 16 bp, R. norvegicus
ctgggtggtgagctct

SEQ ID NO: 499423 - DNA, 16 bp, R. norvegicus
ctgggtggttggcatt

SEQ ID NO: 499424 - DNA, 16 bp, R. norvegicus
ctgggtgtcctgtttg

SEQ ID NO: 499425 - DNA, 16 bp, R. norvegicus
ctgggtgtggtagcac

SEQ ID NO: 499426 - DNA, 16 bp, R. norvegicus
ctgggtgtggtggcgc

SEQ ID NO: 499427 - DNA, 16 bp, R. norvegicus
ctgggtgtttgggatc

SEQ ID NO: 499428 - DNA, 16 bp, R. norvegicus
ctgggttcaaatccag

SEQ ID NO: 499429 - DNA, 31 bp, R. norvegicus
ctgggttcagtccccagctccgaaaaaaaga

SEQ ID NO: 499430 - DNA, 16 bp, R. norvegicus
ctgggttcattttcca

SEQ ID NO: 499431 - DNA, 16 bp, R. norvegicus
ctgggttctacaggaa

SEQ ID NO: 499432 - DNA, 16 bp, R. norvegicus
ctgggttctctggaag

SEQ ID NO: 499433 - DNA, 16 bp, R. norvegicus
ctgggttctgatgata

SEQ ID NO: 499434 - DNA, 16 bp, R. norvegicus
ctgggttcttccagct

SEQ ID NO: 499435 - DNA, 16 bp, R. norvegicus
ctgggttctttctagt

SEQ ID NO: 499436 - DNA, 16 bp, R. norvegicus
ctgggttgtatgagaa

SEQ ID NO: 499437 - DNA, 16 bp, R. norvegicus
ctgggtttgactgaga

SEQ ID NO: 499438 - DNA, 16 bp, R. norvegicus
ctgggtttgatccaca

SEQ ID NO: 499439 - DNA, 16 bp, R. norvegicus
ctgggtttgatcttca

SEQ ID NO: 499440 - DNA, 16 bp, R. norvegicus
ctgggtttgatggctg

SEQ ID NO: 499441 - DNA, 16 bp, R. norvegicus
ctgggtttggtagcta

SEQ ID NO: 499442 - DNA, 16 bp, R. norvegicus
ctgggtttggtcttca

SEQ ID NO: 499443 - DNA, 16 bp, R. norvegicus
ctgggttttttgtcat

SEQ ID NO: 499444 - DNA, 16 bp, R. norvegicus
ctggtaaggatgtgaa

SEQ ID NO: 499445 - DNA, 16 bp, R. norvegicus
ctggtacccagggagg

SEQ ID NO: 499446 - DNA, 16 bp, R. norvegicus
ctggtatgatgtggaa

SEQ ID NO: 499447 - DNA, 16 bp, R. norvegicus
ctggtattaaaggtgt

SEQ ID NO: 499448 - DNA, 16 bp, R. norvegicus
ctggtcaaggaaaaaa

SEQ ID NO: 499449 - DNA, 16 bp, R. norvegicus
ctggtcagccagccca

SEQ ID NO: 499450 - DNA, 16 bp, R. norvegicus
ctggtcagctggagct

SEQ ID NO: 499451 - DNA, 25 bp, R. norvegicus
ctggtcagtgttaagagggcagatg

SEQ ID NO: 499452 - DNA, 16 bp, R. norvegicus
ctggtcatcaccaaag

SEQ ID NO: 499453 - DNA, 16 bp, R. norvegicus
ctggtcatgatgtttg

SEQ ID NO: 499454 - DNA, 16 bp, R. norvegicus
ctggtccaaatcatac

SEQ ID NO: 499455 - DNA, 16 bp, R. norvegicus
ctggtccaacttcaga

SEQ ID NO: 499456 - DNA, 16 bp, R. norvegicus
ctggtccaaggagaaa

SEQ ID NO: 499457 - DNA, 16 bp, R. norvegicus
ctggtcccagaggaat

SEQ ID NO: 499458 - DNA, 16 bp, R. norvegicus
ctggtcccccacattc

SEQ ID NO: 499459 - DNA, 16 bp, R. norvegicus
ctggtccctggtccct

SEQ ID NO: 499460 - DNA, 16 bp, R. norvegicus
ctggtcctcctgtctc

SEQ ID NO: 499461 - DNA, 16 bp, R. norvegicus
ctggtcctgggatttt

SEQ ID NO: 499462 - DNA, 16 bp, R. norvegicus
ctggtcctgtgctctt

SEQ ID NO: 499463 - DNA, 16 bp, R. norvegicus
ctggtccttggagctg

SEQ ID NO: 499464 - DNA, 16 bp, R. norvegicus
ctggtctacagagtga

SEQ ID NO: 499465 - DNA, 16 bp, R. norvegicus
ctggtctagaacttgc

SEQ ID NO: 499466 - DNA, 16 bp, R. norvegicus
ctggtctccaactcag

SEQ ID NO: 499467 - DNA, 16 bp, R. norvegicus
ctggtctccaggagtg

SEQ ID NO: 499468 - DNA, 16 bp, R. norvegicus
ctggtctcccaggtgt

SEQ ID NO: 499469 - DNA, 16 bp, R. norvegicus
ctggtctctgcagaca

SEQ ID NO: 499470 - DNA, 16 bp, R. norvegicus
ctggtctctggagtct

SEQ ID NO: 499471 - DNA, 16 bp, R. norvegicus
ctggtctctgtgggta

SEQ ID NO: 499472 - DNA, 16 bp, R. norvegicus
ctggtctgcaaagtga

SEQ ID NO: 499473 - DNA, 16 bp, R. norvegicus
ctggtctggcctcagt

SEQ ID NO: 499474 - DNA, 16 bp, R. norvegicus
ctggtctgtttccttc

SEQ ID NO: 499475 - DNA, 16 bp, R. norvegicus
ctggtcttcactgatg

SEQ ID NO: 499476 - DNA, 16 bp, R. norvegicus
ctggtcttctacaaga

SEQ ID NO: 499477 - DNA, 16 bp, R. norvegicus
ctggtcttgaactcag

SEQ ID NO: 499478 - DNA, 16 bp, R. norvegicus
ctggtgaaggtgcagc

SEQ ID NO: 499479 - DNA, 16 bp, R. norvegicus
ctggtgaatgctgcct

SEQ ID NO: 499480 - DNA, 16 bp, R. norvegicus
ctggtgacatcacaga

SEQ ID NO: 499481 - DNA, 16 bp, R. norvegicus
ctggtgagaaatctgg

SEQ ID NO: 499482 - DNA, 16 bp, R. norvegicus
ctggtgagaagactgg

SEQ ID NO: 499483 - DNA, 16 bp, R. norvegicus
ctggtgagaagtccag

SEQ ID NO: 499484 - DNA, 16 bp, R. norvegicus
ctggtgagaggggcac

SEQ ID NO: 499485 - DNA, 16 bp, R. norvegicus
ctggtgaggttgtgga

SEQ ID NO: 499486 - DNA, 16 bp, R. norvegicus
ctggtgatcctcctgc

SEQ ID NO: 499487 - DNA, 16 bp, R. norvegicus
ctggtgcactggggct

SEQ ID NO: 499488 - DNA, 16 bp, R. norvegicus
ctggtgcagaagccat

SEQ ID NO: 499489 - DNA, 16 bp, R. norvegicus
ctggtgcagacctgtg

SEQ ID NO: 499490 - DNA, 16 bp, R. norvegicus
ctggtgcagaggccat

SEQ ID NO: 499491 - DNA, 16 bp, R. norvegicus
ctggtgcccacagagg

SEQ ID NO: 499492 - DNA, 16 bp, R. norvegicus
ctggtgcccagagagg

SEQ ID NO: 499493 - DNA, 16 bp, R. norvegicus
ctggtgcccccaacaa

SEQ ID NO: 499494 - DNA, 16 bp, R. norvegicus
ctggtgcctcaacaag

SEQ ID NO: 499495 - DNA, 16 bp, R. norvegicus
ctggtgcctgaggagg

SEQ ID NO: 499496 - DNA, 16 bp, R. norvegicus
ctggtgcctgctgagg

SEQ ID NO: 499497 - DNA, 16 bp, R. norvegicus
ctggtgctcatggagg

SEQ ID NO: 499498 - DNA, 16 bp, R. norvegicus
ctggtgctcttaacta

SEQ ID NO: 499499 - DNA, 16 bp, R. norvegicus
ctggtgctgagtatgt

SEQ ID NO: 499500 - DNA, 16 bp, R. norvegicus
ctggtgctggagcagt

SEQ ID NO: 499501 - DNA, 16 bp, R. norvegicus
ctggtgctgggaactg

SEQ ID NO: 499502 - DNA, 17 bp, R. norvegicus
ctggtggactcaagaca

SEQ ID NO: 499503 - DNA, 16 bp, R. norvegicus
ctggtggactcagtac

SEQ ID NO: 499504 - DNA, 17 bp, R. norvegicus
ctggtggcaaggagcac

SEQ ID NO: 499505 - DNA, 16 bp, R. norvegicus
ctggtggctcttccag

SEQ ID NO: 499506 - DNA, 16 bp, R. norvegicus
ctggtggcttccctgg

SEQ ID NO: 499507 - DNA, 16 bp, R. norvegicus
ctggtgggggagctgg

SEQ ID NO: 499508 - DNA, 16 bp, R. norvegicus
ctggtggggtggatgg

SEQ ID NO: 499509 - DNA, 16 bp, R. norvegicus
ctggtggtcctggctt

SEQ ID NO: 499510 - DNA, 16 bp, R. norvegicus
ctggtggtgatttcag

SEQ ID NO: 499511 - DNA, 16 bp, R. norvegicus
ctggtggtgtcttagg

SEQ ID NO: 499512 - DNA, 16 bp, R. norvegicus
ctggtggttcagtctt

SEQ ID NO: 499513 - DNA, 16 bp, R. norvegicus
ctggtgtctaaagaca

SEQ ID NO: 499514 - DNA, 16 bp, R. norvegicus
ctggtgtctgaggaca

SEQ ID NO: 499515 - DNA, 16 bp, R. norvegicus
ctggtgtctgtggagg

SEQ ID NO: 499516 - DNA, 16 bp, R. norvegicus
ctggtgtgcagatgta

SEQ ID NO: 499517 - DNA, 16 bp, R. norvegicus
ctggtgtgcctcacct

SEQ ID NO: 499518 - DNA, 16 bp, R. norvegicus
ctggtgtgctggtgtg

SEQ ID NO: 499519 - DNA, 16 bp, R. norvegicus
ctggtgtggctgctcc

SEQ ID NO: 499520 - DNA, 16 bp, R. norvegicus
ctggtgtgtctgaaga

SEQ ID NO: 499521 - DNA, 16 bp, R. norvegicus
ctggtgtgtgtgagga

SEQ ID NO: 499522 - DNA, 16 bp, R. norvegicus
ctggtgtgtttctgat

SEQ ID NO: 499523 - DNA, 16 bp, R. norvegicus
ctggtgttcctcctgg

SEQ ID NO: 499524 - DNA, 16 bp, R. norvegicus
ctggtgttcctgctgg

SEQ ID NO: 499525 - DNA, 16 bp, R. norvegicus
ctggtgttggaggctg

SEQ ID NO: 499526 - DNA, 16 bp, R. norvegicus
ctggttcaatctattt

SEQ ID NO: 499527 - DNA, 16 bp, R. norvegicus
ctggttcccagaggcc

SEQ ID NO: 499528 - DNA, 16 bp, R. norvegicus
ctggttcctgctgctg

SEQ ID NO: 499529 - DNA, 16 bp, R. norvegicus
ctggttcctgtcagca

SEQ ID NO: 499530 - DNA, 16 bp, R. norvegicus
ctggttccttctcatt

SEQ ID NO: 499531 - DNA, 16 bp, R. norvegicus
ctggttctcctggaac

SEQ ID NO: 499532 - DNA, 16 bp, R. norvegicus
ctggttctctcctccc

SEQ ID NO: 499533 - DNA, 16 bp, R. norvegicus
ctggttctggttctgg

SEQ ID NO: 499534 - DNA, 16 bp, R. norvegicus
ctggttctgttgcctg

SEQ ID NO: 499535 - DNA, 16 bp, R. norvegicus
ctggttctttccagct

SEQ ID NO: 499536 - DNA, 16 bp, R. norvegicus
ctggttgctcttctag

SEQ ID NO: 499537 - DNA, 16 bp, R. norvegicus
ctggttgctgcagctg

SEQ ID NO: 499538 - DNA, 16 bp, R. norvegicus
ctggttgctgccctca

SEQ ID NO: 499539 - DNA, 16 bp, R. norvegicus
ctggttggtgacccag

SEQ ID NO: 499540 - DNA, 16 bp, R. norvegicus
ctggttggtgatccag

SEQ ID NO: 499541 - DNA, 16 bp, R. norvegicus
ctggttggttggcctt

SEQ ID NO: 499542 - DNA, 16 bp, R. norvegicus
ctggttgtcctggaaa

SEQ ID NO: 499543 - DNA, 16 bp, R. norvegicus
ctggtttcatgtccat

SEQ ID NO: 499544 - DNA, 16 bp, R. norvegicus
ctggtttccacctgtg

SEQ ID NO: 499545 - DNA, 16 bp, R. norvegicus
ctggtttccaggcagc

SEQ ID NO: 499546 - DNA, 16 bp, R. norvegicus
ctggtttccagtccat

SEQ ID NO: 499547 - DNA, 16 bp, R. norvegicus
ctggtttcccttccac

SEQ ID NO: 499548 - DNA, 16 bp, R. norvegicus
ctggtttctcctccac

SEQ ID NO: 499549 - DNA, 16 bp, R. norvegicus
ctggtttctctggaga

SEQ ID NO: 499550 - DNA, 16 bp, R. norvegicus
ctggtttggaactcac

SEQ ID NO: 499551 - DNA, 16 bp, R. norvegicus
ctggttttaatatttt

SEQ ID NO: 499552 - DNA, 16 bp, R. norvegicus
ctggttttgaaacatg

SEQ ID NO: 499553 - DNA, 16 bp, R. norvegicus
ctgtaacaaaatgcca

SEQ ID NO: 499554 - DNA, 16 bp, R. norvegicus
ctgtaacacagttcct

SEQ ID NO: 499555 - DNA, 16 bp, R. norvegicus
ctgtaacaccaggcag

SEQ ID NO: 499556 - DNA, 16 bp, R. norvegicus
ctgtaacccaagcact

SEQ ID NO: 499557 - DNA, 16 bp, R. norvegicus
ctgtaaccccagaact

SEQ ID NO: 499558 - DNA, 16 bp, R. norvegicus
ctgtaacctgtaagcc

SEQ ID NO: 499559 - DNA, 17 bp, R. norvegicus
ctgtaactacacaggat

SEQ ID NO: 499560 - DNA, 16 bp, R. norvegicus
ctgtaactcactgtgt

SEQ ID NO: 499561 - DNA, 16 bp, R. norvegicus
ctgtaactccaacccc

SEQ ID NO: 499562 - DNA, 16 bp, R. norvegicus
ctgtaactccagatcc

SEQ ID NO: 499563 - DNA, 16 bp, R. norvegicus
ctgtaactccagctcc

SEQ ID NO: 499564 - DNA, 16 bp, R. norvegicus
ctgtaactgccttcag

SEQ ID NO: 499565 - DNA, 16 bp, R. norvegicus
ctgtaacttcagttcc

SEQ ID NO: 499566 - DNA, 16 bp, R. norvegicus
ctgtaagaaagcagac

SEQ ID NO: 499567 - DNA, 16 bp, R. norvegicus
ctgtaagccaattaaa

SEQ ID NO: 499568 - DNA, 16 bp, R. norvegicus
ctgtaagccagactca

SEQ ID NO: 499569 - DNA, 16 bp, R. norvegicus
ctgtaagccagcccca

SEQ ID NO: 499570 - DNA, 16 bp, R. norvegicus
ctgtaagccagcttca

SEQ ID NO: 499571 - DNA, 16 bp, R. norvegicus
ctgtaagccattttct

SEQ ID NO: 499572 - DNA, 16 bp, R. norvegicus
ctgtaagcctagcact

SEQ ID NO: 499573 - DNA, 16 bp, R. norvegicus
ctgtaagctgaataaa

SEQ ID NO: 499574 - DNA, 16 bp, R. norvegicus
ctgtaaggaagcccaa

SEQ ID NO: 499575 - DNA, 16 bp, R. norvegicus
ctgtaagttctgtgac

SEQ ID NO: 499576 - DNA, 16 bp, R. norvegicus
ctgtaataaaatactc

SEQ ID NO: 499577 - DNA, 16 bp, R. norvegicus
ctgtaatcccagcact

SEQ ID NO: 499578 - DNA, 16 bp, R. norvegicus
ctgtaatcccaggact

SEQ ID NO: 499579 - DNA, 16 bp, R. norvegicus
ctgtaatgggatccaa

SEQ ID NO: 499580 - DNA, 16 bp, R. norvegicus
ctgtaattttctttct

SEQ ID NO: 499581 - DNA, 16 bp, R. norvegicus
ctgtacaccaggctga

SEQ ID NO: 499582 - DNA, 16 bp, R. norvegicus
ctgtacagtttttatc

SEQ ID NO: 499583 - DNA, 16 bp, R. norvegicus
ctgtaccagcaagcca

SEQ ID NO: 499584 - DNA, 16 bp, R. norvegicus
ctgtaccaggctcctg

SEQ ID NO: 499585 - DNA, 16 bp, R. norvegicus
ctgtacctcagtttcc

SEQ ID NO: 499586 - DNA, 16 bp, R. norvegicus
ctgtacctcattttta

SEQ ID NO: 499587 - DNA, 16 bp, R. norvegicus
ctgtacctccagtttc

SEQ ID NO: 499588 - DNA, 16 bp, R. norvegicus
ctgtacctgctgagcc

SEQ ID NO: 499589 - DNA, 16 bp, R. norvegicus
ctgtacctggagctga

SEQ ID NO: 499590 - DNA, 16 bp, R. norvegicus
ctgtacctgtccctca

SEQ ID NO: 499591 - DNA, 16 bp, R. norvegicus
ctgtacctgttgagga

SEQ ID NO: 499592 - DNA, 16 bp, R. norvegicus
ctgtacttctgagggt

SEQ ID NO: 499593 - DNA, 19 bp, R. norvegicus
ctgtagaagaagatgcaga

SEQ ID NO: 499594 - DNA, 16 bp, R. norvegicus
ctgtagaagctggaat

SEQ ID NO: 499595 - DNA, 16 bp, R. norvegicus
ctgtagaaggcctctg

SEQ ID NO: 499596 - DNA, 17 bp, R. norvegicus
ctgtagaagggcatctg

SEQ ID NO: 499597 - DNA, 16 bp, R. norvegicus
ctgtagaccagactgg

SEQ ID NO: 499598 - DNA, 16 bp, R. norvegicus
ctgtagagaaccctga

SEQ ID NO: 499599 - DNA, 16 bp, R. norvegicus
ctgtagatcaagatgt

SEQ ID NO: 499600 - DNA, 17 bp, R. norvegicus
ctgtagccactgttttt

SEQ ID NO: 499601 - DNA, 16 bp, R. norvegicus
ctgtagccaggcagaa

SEQ ID NO: 499602 - DNA, 16 bp, R. norvegicus
ctgtagcccagggtgg

SEQ ID NO: 499603 - DNA, 16 bp, R. norvegicus
ctgtagccctttattt

SEQ ID NO: 499604 - DNA, 16 bp, R. norvegicus
ctgtagctaaggatga

SEQ ID NO: 499605 - DNA, 17 bp, R. norvegicus
ctgtagcttcacagaaa

SEQ ID NO: 499606 - DNA, 16 bp, R. norvegicus
ctgtagcttcagttcc

SEQ ID NO: 499607 - DNA, 26 bp, R. norvegicus
ctgtagctttacaggaatgctacctg

SEQ ID NO: 499608 - DNA, 16 bp, R. norvegicus
ctgtaggcatctttat

SEQ ID NO: 499609 - DNA, 16 bp, R. norvegicus
ctgtaggcattttctt

SEQ ID NO: 499610 - DNA, 16 bp, R. norvegicus
ctgtaggccaggctgg

SEQ ID NO: 499611 - DNA, 16 bp, R. norvegicus
ctgtagggaattttct

SEQ ID NO: 499612 - DNA, 16 bp, R. norvegicus
ctgtagtcccagaact

SEQ ID NO: 499613 - DNA, 16 bp, R. norvegicus
ctgtagtcccagcact

SEQ ID NO: 499614 - DNA, 16 bp, R. norvegicus
ctgtagttctgtctcc

SEQ ID NO: 499615 - DNA, 16 bp, R. norvegicus
ctgtagttctgtttct

SEQ ID NO: 499616 - DNA, 16 bp, R. norvegicus
ctgtataactcaatct

SEQ ID NO: 499617 - DNA, 16 bp, R. norvegicus
ctgtataagacctctg

SEQ ID NO: 499618 - DNA, 16 bp, R. norvegicus
ctgtataagcagaaaa

SEQ ID NO: 499619 - DNA, 16 bp, R. norvegicus
ctgtataaggtctctg

SEQ ID NO: 499620 - DNA, 16 bp, R. norvegicus
ctgtataccaggctgg

SEQ ID NO: 499621 - DNA, 16 bp, R. norvegicus
ctgtatataaatgggc

SEQ ID NO: 499622 - DNA, 16 bp, R. norvegicus
ctgtatcagctcctgc

SEQ ID NO: 499623 - DNA, 16 bp, R. norvegicus
ctgtatcatgcaaaac

SEQ ID NO: 499624 - DNA, 16 bp, R. norvegicus
ctgtatccagaggcca

SEQ ID NO: 499625 - DNA, 16 bp, R. norvegicus
ctgtatcccaggctgg

SEQ ID NO: 499626 - DNA, 16 bp, R. norvegicus
ctgtatctctgtgtct

SEQ ID NO: 499627 - DNA, 16 bp, R. norvegicus
ctgtatgacaagaaat

SEQ ID NO: 499628 - DNA, 16 bp, R. norvegicus
ctgtatggcaagaact

SEQ ID NO: 499629 - DNA, 16 bp, R. norvegicus
ctgtatggcatctgcc

SEQ ID NO: 499630 - DNA, 16 bp, R. norvegicus
ctgtatgtctctctct

SEQ ID NO: 499631 - DNA, 16 bp, R. norvegicus
ctgtatgtgttggggg

SEQ ID NO: 499632 - DNA, 16 bp, R. norvegicus
ctgtattaaagagttg

SEQ ID NO: 499633 - DNA, 16 bp, R. norvegicus
ctgtattctcagcact

SEQ ID NO: 499634 - DNA, 17 bp, R. norvegicus
ctgtattgacccctgct

SEQ ID NO: 499635 - DNA, 16 bp, R. norvegicus
ctgtatttctttatgg

SEQ ID NO: 499636 - DNA, 16 bp, R. norvegicus
ctgtatttggctttta

SEQ ID NO: 499637 - DNA, 16 bp, R. norvegicus
ctgtatttttggcttt

SEQ ID NO: 499638 - DNA, 16 bp, R. norvegicus
ctgtcaaagatactgt

SEQ ID NO: 499639 - DNA, 16 bp, R. norvegicus
ctgtcaagctgctcat

SEQ ID NO: 499640 - DNA, 16 bp, R. norvegicus
ctgtcaagctgctgct

SEQ ID NO: 499641 - DNA, 16 bp, R. norvegicus
ctgtcaaggtgctgac

SEQ ID NO: 499642 - DNA, 16 bp, R. norvegicus
ctgtcacacaaagcta

SEQ ID NO: 499643 - DNA, 16 bp, R. norvegicus
ctgtcacacagcactg

SEQ ID NO: 499644 - DNA, 16 bp, R. norvegicus
ctgtcacagactctgc

SEQ ID NO: 499645 - DNA, 16 bp, R. norvegicus
ctgtcacagcacttca

SEQ ID NO: 499646 - DNA, 16 bp, R. norvegicus
ctgtcacagtaatgag

SEQ ID NO: 499647 - DNA, 16 bp, R. norvegicus
ctgtcaccaaacccag

SEQ ID NO: 499648 - DNA, 16 bp, R. norvegicus
ctgtcaccaccaccac

SEQ ID NO: 499649 - DNA, 16 bp, R. norvegicus
ctgtcacccaccctcc

SEQ ID NO: 499650 - DNA, 16 bp, R. norvegicus
ctgtcactgcagtgcc

SEQ ID NO: 499651 - DNA, 16 bp, R. norvegicus
ctgtcactgccttcag

SEQ ID NO: 499652 - DNA, 16 bp, R. norvegicus
ctgtcactgtctttag

SEQ ID NO: 499653 - DNA, 18 bp, R. norvegicus
ctgtcagaaacagcagaa

SEQ ID NO: 499654 - DNA, 16 bp, R. norvegicus
ctgtcagacactgacc

SEQ ID NO: 499655 - DNA, 16 bp, R. norvegicus
ctgtcagaccaccacg

SEQ ID NO: 499656 - DNA, 16 bp, R. norvegicus
ctgtcagagacaggaa

SEQ ID NO: 499657 - DNA, 16 bp, R. norvegicus
ctgtcagcaagaaaga

SEQ ID NO: 499658 - DNA, 16 bp, R. norvegicus
ctgtcagcatgcaact

SEQ ID NO: 499659 - DNA, 16 bp, R. norvegicus
ctgtcagcctctgcct

SEQ ID NO: 499660 - DNA, 17 bp, R. norvegicus
ctgtcagtccagctgct

SEQ ID NO: 499661 - DNA, 16 bp, R. norvegicus
ctgtcatcccagccct

SEQ ID NO: 499662 - DNA, 17 bp, R. norvegicus
ctgtcatgctgctgaca

SEQ ID NO: 499663 - DNA, 16 bp, R. norvegicus
ctgtcatgtgaagtca

SEQ ID NO: 499664 - DNA, 22 bp, R. norvegicus
ctgtcattataattggtcctaa

SEQ ID NO: 499665 - DNA, 16 bp, R. norvegicus
ctgtcattttcctttt

SEQ ID NO: 499666 - DNA, 16 bp, R. norvegicus
ctgtccacagtgactg

SEQ ID NO: 499667 - DNA, 19 bp, R. norvegicus
ctgtccaccaggagcactg

SEQ ID NO: 499668 - DNA, 16 bp, R. norvegicus
ctgtccactggtgaga

SEQ ID NO: 499669 - DNA, 16 bp, R. norvegicus
ctgtccaggaaaggac

SEQ ID NO: 499670 - DNA, 16 bp, R. norvegicus
ctgtccaggaaatttt

SEQ ID NO: 499671 - DNA, 16 bp, R. norvegicus
ctgtccaggcccttct

SEQ ID NO: 499672 - DNA, 16 bp, R. norvegicus
ctgtccagggcctggg

SEQ ID NO: 499673 - DNA, 16 bp, R. norvegicus
ctgtccatctgtgtgt

SEQ ID NO: 499674 - DNA, 16 bp, R. norvegicus
ctgtccatggtgctga

SEQ ID NO: 499675 - DNA, 16 bp, R. norvegicus
ctgtccatgtctctgt

SEQ ID NO: 499676 - DNA, 17 bp, R. norvegicus
ctgtccattggttggat

SEQ ID NO: 499677 - DNA, 16 bp, R. norvegicus
ctgtcccagaacttgc

SEQ ID NO: 499678 - DNA, 16 bp, R. norvegicus
ctgtccccagctccaa

SEQ ID NO: 499679 - DNA, 16 bp, R. norvegicus
ctgtcccccaacctgg

SEQ ID NO: 499680 - DNA, 16 bp, R. norvegicus
ctgtcccctgacctcc

SEQ ID NO: 499681 - DNA, 16 bp, R. norvegicus
ctgtcccctgagagtc

SEQ ID NO: 499682 - DNA, 16 bp, R. norvegicus
ctgtccctaggagagc

SEQ ID NO: 499683 - DNA, 16 bp, R. norvegicus
ctgtccctcacctcac

SEQ ID NO: 499684 - DNA, 16 bp, R. norvegicus
ctgtccctccactgga

SEQ ID NO: 499685 - DNA, 16 bp, R. norvegicus
ctgtccctgccaccat

SEQ ID NO: 499686 - DNA, 16 bp, R. norvegicus
ctgtccctgcccctca

SEQ ID NO: 499687 - DNA, 17 bp, R. norvegicus
ctgtccctgctgctgct

SEQ ID NO: 499688 - DNA, 16 bp, R. norvegicus
ctgtccctgctgtccc

SEQ ID NO: 499689 - DNA, 16 bp, R. norvegicus
ctgtccctgtccctgt

SEQ ID NO: 499690 - DNA, 16 bp, R. norvegicus
ctgtccctgtctctct

SEQ ID NO: 499691 - DNA, 16 bp, R. norvegicus
ctgtccctgtgggcgg

SEQ ID NO: 499692 - DNA, 16 bp, R. norvegicus
ctgtccgcggtgctga

SEQ ID NO: 499693 - DNA, 16 bp, R. norvegicus
ctgtccgtggtgctga

SEQ ID NO: 499694 - DNA, 16 bp, R. norvegicus
ctgtcctagaactcag

SEQ ID NO: 499695 - DNA, 16 bp, R. norvegicus
ctgtcctcctgtcctc

SEQ ID NO: 499696 - DNA, 16 bp, R. norvegicus
ctgtcctctaagaggc

SEQ ID NO: 499697 - DNA, 16 bp, R. norvegicus
ctgtcctctgacatcc

SEQ ID NO: 499698 - DNA, 16 bp, R. norvegicus
ctgtcctctgaggggc

SEQ ID NO: 499699 - DNA, 16 bp, R. norvegicus
ctgtcctctgcctcct

SEQ ID NO: 499700 - DNA, 16 bp, R. norvegicus
ctgtcctctggcttcc

SEQ ID NO: 499701 - DNA, 16 bp, R. norvegicus
ctgtcctctgtctctg

SEQ ID NO: 499702 - DNA, 16 bp, R. norvegicus
ctgtcctcttgctcct

SEQ ID NO: 499703 - DNA, 16 bp, R. norvegicus
ctgtcctctttagccc

SEQ ID NO: 499704 - DNA, 16 bp, R. norvegicus
ctgtcctgcagtctca

SEQ ID NO: 499705 - DNA, 16 bp, R. norvegicus
ctgtcctggaacccac

SEQ ID NO: 499706 - DNA, 16 bp, R. norvegicus
ctgtcctggaacctac

SEQ ID NO: 499707 - DNA, 16 bp, R. norvegicus
ctgtcctggaactcta

SEQ ID NO: 499708 - DNA, 16 bp, R. norvegicus
ctgtcctggagctcac

SEQ ID NO: 499709 - DNA, 16 bp, R. norvegicus
ctgtcctggagcttgt

SEQ ID NO: 499710 - DNA, 16 bp, R. norvegicus
ctgtcctgggtgctga

SEQ ID NO: 499711 - DNA, 16 bp, R. norvegicus
ctgtcctgtaactcct

SEQ ID NO: 499712 - DNA, 16 bp, R. norvegicus
ctgtcctgtcttcctt

SEQ ID NO: 499713 - DNA, 16 bp, R. norvegicus
ctgtcctgtgtgactt

SEQ ID NO: 499714 - DNA, 16 bp, R. norvegicus
ctgtccttaacagcac

SEQ ID NO: 499715 - DNA, 16 bp, R. norvegicus
ctgtccttccagagga

SEQ ID NO: 499716 - DNA, 16 bp, R. norvegicus
ctgtccttcctcacac

SEQ ID NO: 499717 - DNA, 16 bp, R. norvegicus
ctgtccttctctgccc

SEQ ID NO: 499718 - DNA, 16 bp, R. norvegicus
ctgtccttctgtctgt

SEQ ID NO: 499719 - DNA, 16 bp, R. norvegicus
ctgtcctttaaaaaaa

SEQ ID NO: 499720 - DNA, 16 bp, R. norvegicus
ctgtctattgtctgtc

SEQ ID NO: 499721 - DNA, 16 bp, R. norvegicus
ctgtctcaaaaaaaaa

SEQ ID NO: 499722 - DNA, 16 bp, R. norvegicus
ctgtctcaaaaataaa

SEQ ID NO: 499723 - DNA, 16 bp, R. norvegicus
ctgtctcaagaacaaa

SEQ ID NO: 499724 - DNA, 16 bp, R. norvegicus
ctgtctcaagaagaaa

SEQ ID NO: 499725 - DNA, 16 bp, R. norvegicus
ctgtctcaagagaata

SEQ ID NO: 499726 - DNA, 16 bp, R. norvegicus
ctgtctcagaagagaa

SEQ ID NO: 499727 - DNA, 16 bp, R. norvegicus
ctgtctcaggctgacc

SEQ ID NO: 499728 - DNA, 16 bp, R. norvegicus
ctgtctcagtctctgt

SEQ ID NO: 499729 - DNA, 16 bp, R. norvegicus
ctgtctcagttcccca

SEQ ID NO: 499730 - DNA, 16 bp, R. norvegicus
ctgtctcatacacaca

SEQ ID NO: 499731 - DNA, 16 bp, R. norvegicus
ctgtctcattctctct

SEQ ID NO: 499732 - DNA, 16 bp, R. norvegicus
ctgtctccaaaacaaa

SEQ ID NO: 499733 - DNA, 16 bp, R. norvegicus
ctgtctccaagatgat

SEQ ID NO: 499734 - DNA, 16 bp, R. norvegicus
ctgtctccagagaggc

SEQ ID NO: 499735 - DNA, 16 bp, R. norvegicus
ctgtctccagagttgt

SEQ ID NO: 499736 - DNA, 16 bp, R. norvegicus
ctgtctcccagcccat

SEQ ID NO: 499737 - DNA, 16 bp, R. norvegicus
ctgtctccccaccctg

SEQ ID NO: 499738 - DNA, 16 bp, R. norvegicus
ctgtctccccagctcc

SEQ ID NO: 499739 - DNA, 16 bp, R. norvegicus
ctgtctccccagtgct

SEQ ID NO: 499740 - DNA, 16 bp, R. norvegicus
ctgtctccctgcccaa

SEQ ID NO: 499741 - DNA, 16 bp, R. norvegicus
ctgtctccggagaggc

SEQ ID NO: 499742 - DNA, 16 bp, R. norvegicus
ctgtctcctgcacagg

SEQ ID NO: 499743 - DNA, 16 bp, R. norvegicus
ctgtctccttctgtct

SEQ ID NO: 499744 - DNA, 16 bp, R. norvegicus
ctgtctccttgtctcc

SEQ ID NO: 499745 - DNA, 16 bp, R. norvegicus
ctgtctctatctcctg

SEQ ID NO: 499746 - DNA, 16 bp, R. norvegicus
ctgtctctcacacaca

SEQ ID NO: 499747 - DNA, 16 bp, R. norvegicus
ctgtctctcctgccct

SEQ ID NO: 499748 - DNA, 16 bp, R. norvegicus
ctgtctctctcaggag

SEQ ID NO: 499749 - DNA, 16 bp, R. norvegicus
ctgtctctctcctctg

SEQ ID NO: 499750 - DNA, 16 bp, R. norvegicus
ctgtctctctctctga

SEQ ID NO: 499751 - DNA, 16 bp, R. norvegicus
ctgtctctctcttcag

SEQ ID NO: 499752 - DNA, 16 bp, R. norvegicus
ctgtctctctgtcctc

SEQ ID NO: 499753 - DNA, 16 bp, R. norvegicus
ctgtctctctgtctcc

SEQ ID NO: 499754 - DNA, 16 bp, R. norvegicus
ctgtctctcttgctct

SEQ ID NO: 499755 - DNA, 16 bp, R. norvegicus
ctgtctctgcccctct

SEQ ID NO: 499756 - DNA, 16 bp, R. norvegicus
ctgtctctgcccctgt

SEQ ID NO: 499757 - DNA, 16 bp, R. norvegicus
ctgtctctgcctccca

SEQ ID NO: 499758 - DNA, 16 bp, R. norvegicus
ctgtctctgcctcctc

SEQ ID NO: 499759 - DNA, 16 bp, R. norvegicus
ctgtctctgcctctga

SEQ ID NO: 499760 - DNA, 16 bp, R. norvegicus
ctgtctctgcctgctg

SEQ ID NO: 499761 - DNA, 16 bp, R. norvegicus
ctgtctctgcttcccc

SEQ ID NO: 499762 - DNA, 16 bp, R. norvegicus
ctgtctctggaccaat

SEQ ID NO: 499763 - DNA, 16 bp, R. norvegicus
ctgtctctggcagtgg

SEQ ID NO: 499764 - DNA, 16 bp, R. norvegicus
ctgtctctgggttcct

SEQ ID NO: 499765 - DNA, 16 bp, R. norvegicus
ctgtctctgtccctca

SEQ ID NO: 499766 - DNA, 16 bp, R. norvegicus
ctgtctctgtccttct

SEQ ID NO: 499767 - DNA, 16 bp, R. norvegicus
ctgtctctgtctccta

SEQ ID NO: 499768 - DNA, 16 bp, R. norvegicus
ctgtctctgtgtctgt

SEQ ID NO: 499769 - DNA, 16 bp, R. norvegicus
ctgtctctgtttctca

SEQ ID NO: 499770 - DNA, 16 bp, R. norvegicus
ctgtctcttcatctct

SEQ ID NO: 499771 - DNA, 16 bp, R. norvegicus
ctgtctcttctctctg

SEQ ID NO: 499772 - DNA, 16 bp, R. norvegicus
ctgtctcttcttcctg

SEQ ID NO: 499773 - DNA, 16 bp, R. norvegicus
ctgtctgaaaaaaaaa

SEQ ID NO: 499774 - DNA, 16 bp, R. norvegicus
ctgtctgaaaaaccaa

SEQ ID NO: 499775 - DNA, 16 bp, R. norvegicus
ctgtctgactgctctg

SEQ ID NO: 499776 - DNA, 16 bp, R. norvegicus
ctgtctgcatctctgt

SEQ ID NO: 499777 - DNA, 16 bp, R. norvegicus
ctgtctgcctgcctgc

SEQ ID NO: 499778 - DNA, 16 bp, R. norvegicus
ctgtctgcctgccttt

SEQ ID NO: 499779 - DNA, 16 bp, R. norvegicus
ctgtctgccttccttt

SEQ ID NO: 499780 - DNA, 16 bp, R. norvegicus
ctgtctgcctttgcct

SEQ ID NO: 499781 - DNA, 16 bp, R. norvegicus
ctgtctgctgctgcag

SEQ ID NO: 499782 - DNA, 16 bp, R. norvegicus
ctgtctgggaatctgg

SEQ ID NO: 499783 - DNA, 16 bp, R. norvegicus
ctgtctggggcagcag

SEQ ID NO: 499784 - DNA, 16 bp, R. norvegicus
ctgtctggggctggag

SEQ ID NO: 499785 - DNA, 16 bp, R. norvegicus
ctgtctggtcctgggc

SEQ ID NO: 499786 - DNA, 16 bp, R. norvegicus
ctgtctgtaactccag

SEQ ID NO: 499787 - DNA, 16 bp, R. norvegicus
ctgtctgtccttccat

SEQ ID NO: 499788 - DNA, 16 bp, R. norvegicus
ctgtctgtctctctca

SEQ ID NO: 499789 - DNA, 16 bp, R. norvegicus
ctgtctgtctctctgt

SEQ ID NO: 499790 - DNA, 16 bp, R. norvegicus
ctgtctgtctctgact

SEQ ID NO: 499791 - DNA, 16 bp, R. norvegicus
ctgtctgtctgcattt

SEQ ID NO: 499792 - DNA, 16 bp, R. norvegicus
ctgtctgtctgtcagg

SEQ ID NO: 499793 - DNA, 16 bp, R. norvegicus
ctgtctgtctgtccat

SEQ ID NO: 499794 - DNA, 16 bp, R. norvegicus
ctgtctgtctgtctag

SEQ ID NO: 499795 - DNA, 16 bp, R. norvegicus
ctgtctgtctgtgttt

SEQ ID NO: 499796 - DNA, 16 bp, R. norvegicus
ctgtctgtctgttttg

SEQ ID NO: 499797 - DNA, 16 bp, R. norvegicus
ctgtctgtcttcctct

SEQ ID NO: 499798 - DNA, 16 bp, R. norvegicus
ctgtctgtgactccag

SEQ ID NO: 499799 - DNA, 16 bp, R. norvegicus
ctgtctgtgctgtctg

SEQ ID NO: 499800 - DNA, 16 bp, R. norvegicus
ctgtctgtggaatatg

SEQ ID NO: 499801 - DNA, 16 bp, R. norvegicus
ctgtctgtggatccag

SEQ ID NO: 499802 - DNA, 16 bp, R. norvegicus
ctgtcttaaagaaaaa

SEQ ID NO: 499803 - DNA, 16 bp, R. norvegicus
ctgtcttcacctcccc

SEQ ID NO: 499804 - DNA, 16 bp, R. norvegicus
ctgtcttcacttgtgt

SEQ ID NO: 499805 - DNA, 16 bp, R. norvegicus
ctgtcttcctctgcct

SEQ ID NO: 499806 - DNA, 16 bp, R. norvegicus
ctgtcttcgtctctga

SEQ ID NO: 499807 - DNA, 16 bp, R. norvegicus
ctgtcttgaagaaaaa

SEQ ID NO: 499808 - DNA, 16 bp, R. norvegicus
ctgtctttcagtcagt

SEQ ID NO: 499809 - DNA, 16 bp, R. norvegicus
ctgtctttctctgcct

SEQ ID NO: 499810 - DNA, 16 bp, R. norvegicus
ctgtctttctgctggt

SEQ ID NO: 499811 - DNA, 16 bp, R. norvegicus
ctgtctttgcctccca

SEQ ID NO: 499812 - DNA, 16 bp, R. norvegicus
ctgtctttgtctttga

SEQ ID NO: 499813 - DNA, 16 bp, R. norvegicus
ctgtctttgttattga

SEQ ID NO: 499814 - DNA, 16 bp, R. norvegicus
ctgtctttttctctga

SEQ ID NO: 499815 - DNA, 16 bp, R. norvegicus
ctgtgaaacagaaagg

SEQ ID NO: 499816 - DNA, 16 bp, R. norvegicus
ctgtgaaagggttgtt

SEQ ID NO: 499817 - DNA, 16 bp, R. norvegicus
ctgtgaaagtgaagcc

SEQ ID NO: 499818 - DNA, 16 bp, R. norvegicus
ctgtgaaccctgagat

SEQ ID NO: 499819 - DNA, 16 bp, R. norvegicus
ctgtgaactacaataa

SEQ ID NO: 499820 - DNA, 16 bp, R. norvegicus
ctgtgaactctttgtt

SEQ ID NO: 499821 - DNA, 16 bp, R. norvegicus
ctgtgaactgaaataa

SEQ ID NO: 499822 - DNA, 16 bp, R. norvegicus
ctgtgaactgagctgc

SEQ ID NO: 499823 - DNA, 16 bp, R. norvegicus
ctgtgaacttctggcc

SEQ ID NO: 499824 - DNA, 16 bp, R. norvegicus
ctgtgaagaaatacca

SEQ ID NO: 499825 - DNA, 16 bp, R. norvegicus
ctgtgaagagctggag

SEQ ID NO: 499826 - DNA, 16 bp, R. norvegicus
ctgtgaagctccttgt

SEQ ID NO: 499827 - DNA, 16 bp, R. norvegicus
ctgtgaagggtgtcat

SEQ ID NO: 499828 - DNA, 16 bp, R. norvegicus
ctgtgaaggtctggga

SEQ ID NO: 499829 - DNA, 16 bp, R. norvegicus
ctgtgaagtcctggct

SEQ ID NO: 499830 - DNA, 16 bp, R. norvegicus
ctgtgaagtggaaact

SEQ ID NO: 499831 - DNA, 16 bp, R. norvegicus
ctgtgaatattttgtt

SEQ ID NO: 499832 - DNA, 16 bp, R. norvegicus
ctgtgaatgggaagtc

SEQ ID NO: 499833 - DNA, 16 bp, R. norvegicus
ctgtgaatgggttacc

SEQ ID NO: 499834 - DNA, 16 bp, R. norvegicus
ctgtgacaaagaagcc

SEQ ID NO: 499835 - DNA, 16 bp, R. norvegicus
ctgtgacaggaagcca

SEQ ID NO: 499836 - DNA, 16 bp, R. norvegicus
ctgtgaccacagcagg

SEQ ID NO: 499837 - DNA, 16 bp, R. norvegicus
ctgtgaccacatccca

SEQ ID NO: 499838 - DNA, 16 bp, R. norvegicus
ctgtgaccccagcatt

SEQ ID NO: 499839 - DNA, 16 bp, R. norvegicus
ctgtgaccctgtgatc

SEQ ID NO: 499840 - DNA, 16 bp, R. norvegicus
ctgtgaccctttaaga

SEQ ID NO: 499841 - DNA, 16 bp, R. norvegicus
ctgtgacctctgacct

SEQ ID NO: 499842 - DNA, 16 bp, R. norvegicus
ctgtgactccagcact

SEQ ID NO: 499843 - DNA, 16 bp, R. norvegicus
ctgtgactccagctgc

SEQ ID NO: 499844 - DNA, 16 bp, R. norvegicus
ctgtgactgctttctt

SEQ ID NO: 499845 - DNA, 16 bp, R. norvegicus
ctgtgactgtgctcct

SEQ ID NO: 499846 - DNA, 16 bp, R. norvegicus
ctgtgactgtgtgaca

SEQ ID NO: 499847 - DNA, 16 bp, R. norvegicus
ctgtgactgttgatga

SEQ ID NO: 499848 - DNA, 16 bp, R. norvegicus
ctgtgagaaagcaggc

SEQ ID NO: 499849 - DNA, 16 bp, R. norvegicus
ctgtgagaatcaccat

SEQ ID NO: 499850 - DNA, 16 bp, R. norvegicus
ctgtgagaatgcagag

SEQ ID NO: 499851 - DNA, 16 bp, R. norvegicus
ctgtgagacctgcttt

SEQ ID NO: 499852 - DNA, 16 bp, R. norvegicus
ctgtgagagcagcaag

SEQ ID NO: 499853 - DNA, 16 bp, R. norvegicus
ctgtgagatcctgtct

SEQ ID NO: 499854 - DNA, 16 bp, R. norvegicus
ctgtgagatggctcag

SEQ ID NO: 499855 - DNA, 16 bp, R. norvegicus
ctgtgagcacccgtgt

SEQ ID NO: 499856 - DNA, 16 bp, R. norvegicus
ctgtgagcctatgagc

SEQ ID NO: 499857 - DNA, 16 bp, R. norvegicus
ctgtgagcctggttat

SEQ ID NO: 499858 - DNA, 16 bp, R. norvegicus
ctgtgagcctgtgatt

SEQ ID NO: 499859 - DNA, 16 bp, R. norvegicus
ctgtgaggaaaacaaa

SEQ ID NO: 499860 - DNA, 16 bp, R. norvegicus
ctgtgaggacagcatt

SEQ ID NO: 499861 - DNA, 16 bp, R. norvegicus
ctgtgaggtgtgtgtg

SEQ ID NO: 499862 - DNA, 16 bp, R. norvegicus
ctgtgagtacctgcat

SEQ ID NO: 499863 - DNA, 16 bp, R. norvegicus
ctgtgagtattttgct

SEQ ID NO: 499864 - DNA, 16 bp, R. norvegicus
ctgtgagtcagatcca

SEQ ID NO: 499865 - DNA, 16 bp, R. norvegicus
ctgtgagtgctgggaa

SEQ ID NO: 499866 - DNA, 16 bp, R. norvegicus
ctgtgagtgtgaggcc

SEQ ID NO: 499867 - DNA, 16 bp, R. norvegicus
ctgtgagtgtgtatat

SEQ ID NO: 499868 - DNA, 16 bp, R. norvegicus
ctgtgagttcaagatc

SEQ ID NO: 499869 - DNA, 16 bp, R. norvegicus
ctgtgagttcatggcc

SEQ ID NO: 499870 - DNA, 16 bp, R. norvegicus
ctgtgagttcatgtat

SEQ ID NO: 499871 - DNA, 16 bp, R. norvegicus
ctgtgagttccaggac

SEQ ID NO: 499872 - DNA, 16 bp, R. norvegicus
ctgtgagttcctgtcc

SEQ ID NO: 499873 - DNA, 16 bp, R. norvegicus
ctgtgagttggaggac

SEQ ID NO: 499874 - DNA, 16 bp, R. norvegicus
ctgtgataaaactcca

SEQ ID NO: 499875 - DNA, 16 bp, R. norvegicus
ctgtgataaaatattc

SEQ ID NO: 499876 - DNA, 16 bp, R. norvegicus
ctgtgataactccaga

SEQ ID NO: 499877 - DNA, 16 bp, R. norvegicus
ctgtgatcaggatata

SEQ ID NO: 499878 - DNA, 16 bp, R. norvegicus
ctgtgatccatgagaa

SEQ ID NO: 499879 - DNA, 16 bp, R. norvegicus
ctgtgatcccaggact

SEQ ID NO: 499880 - DNA, 16 bp, R. norvegicus
ctgtgatcccagtgct

SEQ ID NO: 499881 - DNA, 16 bp, R. norvegicus
ctgtgatgagatacca

SEQ ID NO: 499882 - DNA, 21 bp, R. norvegicus
ctgtgatgtcaccagtgttgt

SEQ ID NO: 499883 - DNA, 16 bp, R. norvegicus
ctgtgcaaccctggct

SEQ ID NO: 499884 - DNA, 16 bp, R. norvegicus
ctgtgcaagagcagca

SEQ ID NO: 499885 - DNA, 16 bp, R. norvegicus
ctgtgcaatgcttgtg

SEQ ID NO: 499886 - DNA, 16 bp, R. norvegicus
ctgtgcacagacacca

SEQ ID NO: 499887 - DNA, 16 bp, R. norvegicus
ctgtgcacagggaccc

SEQ ID NO: 499888 - DNA, 16 bp, R. norvegicus
ctgtgcacatgagtgc

SEQ ID NO: 499889 - DNA, 16 bp, R. norvegicus
ctgtgcagcctcagga

SEQ ID NO: 499890 - DNA, 16 bp, R. norvegicus
ctgtgcagctcaggct

SEQ ID NO: 499891 - DNA, 16 bp, R. norvegicus
ctgtgcatgtgtatgt

SEQ ID NO: 499892 - DNA, 16 bp, R. norvegicus
ctgtgccacagccctc

SEQ ID NO: 499893 - DNA, 16 bp, R. norvegicus
ctgtgccaggagctga

SEQ ID NO: 499894 - DNA, 16 bp, R. norvegicus
ctgtgccatctcccca

SEQ ID NO: 499895 - DNA, 16 bp, R. norvegicus
ctgtgcccagagatga

SEQ ID NO: 499896 - DNA, 16 bp, R. norvegicus
ctgtgcccagagctgg

SEQ ID NO: 499897 - DNA, 16 bp, R. norvegicus
ctgtgcccagaggaca

SEQ ID NO: 499898 - DNA, 16 bp, R. norvegicus
ctgtgccctcttctgg

SEQ ID NO: 499899 - DNA, 16 bp, R. norvegicus
ctgtgccctgagttca

SEQ ID NO: 499900 - DNA, 16 bp, R. norvegicus
ctgtgccctggactac

SEQ ID NO: 499901 - DNA, 16 bp, R. norvegicus
ctgtgcccttggaaac

SEQ ID NO: 499902 - DNA, 16 bp, R. norvegicus
ctgtgccgccatttcc

SEQ ID NO: 499903 - DNA, 16 bp, R. norvegicus
ctgtgcctctgggatc

SEQ ID NO: 499904 - DNA, 16 bp, R. norvegicus
ctgtgcctctgtgtct

SEQ ID NO: 499905 - DNA, 16 bp, R. norvegicus
ctgtgcctgcctgcct

SEQ ID NO: 499906 - DNA, 16 bp, R. norvegicus
ctgtgcctggagccag

SEQ ID NO: 499907 - DNA, 16 bp, R. norvegicus
ctgtgcctgggatgga

SEQ ID NO: 499908 - DNA, 16 bp, R. norvegicus
ctgtgcctgtgtgtct

SEQ ID NO: 499909 - DNA, 16 bp, R. norvegicus
ctgtgctaaggggaaa

SEQ ID NO: 499910 - DNA, 16 bp, R. norvegicus
ctgtgctacagagtga

SEQ ID NO: 499911 - DNA, 16 bp, R. norvegicus
ctgtgctcaatctgat

SEQ ID NO: 499912 - DNA, 16 bp, R. norvegicus
ctgtgctccaacctca

SEQ ID NO: 499913 - DNA, 16 bp, R. norvegicus
ctgtgctccagacacc

SEQ ID NO: 499914 - DNA, 16 bp, R. norvegicus
ctgtgctcccttccct

SEQ ID NO: 499915 - DNA, 16 bp, R. norvegicus
ctgtgctcctgtgtgc

SEQ ID NO: 499916 - DNA, 16 bp, R. norvegicus
ctgtgctctcagatgt

SEQ ID NO: 499917 - DNA, 16 bp, R. norvegicus
ctgtgctctgtgctct

SEQ ID NO: 499918 - DNA, 16 bp, R. norvegicus
ctgtgctctttttggt

SEQ ID NO: 499919 - DNA, 16 bp, R. norvegicus
ctgtgctgcccaggtg

SEQ ID NO: 499920 - DNA, 16 bp, R. norvegicus
ctgtgctgccttgtct

SEQ ID NO: 499921 - DNA, 16 bp, R. norvegicus
ctgtgctggccaaggt

SEQ ID NO: 499922 - DNA, 16 bp, R. norvegicus
ctgtgctggtagggaa

SEQ ID NO: 499923 - DNA, 16 bp, R. norvegicus
ctgtgctgtagtgatg

SEQ ID NO: 499924 - DNA, 16 bp, R. norvegicus
ctgtgctgtcacctca

SEQ ID NO: 499925 - DNA, 16 bp, R. norvegicus
ctgtgctgtctgtctg

SEQ ID NO: 499926 - DNA, 16 bp, R. norvegicus
ctgtgctgtgctgctg

SEQ ID NO: 499927 - DNA, 16 bp, R. norvegicus
ctgtgctgtgctgtgg

SEQ ID NO: 499928 - DNA, 16 bp, R. norvegicus
ctgtgctgtgtctgtg

SEQ ID NO: 499929 - DNA, 16 bp, R. norvegicus
ctgtgcttctaaatgt

SEQ ID NO: 499930 - DNA, 16 bp, R. norvegicus
ctgtgcttgcctctca

SEQ ID NO: 499931 - DNA, 16 bp, R. norvegicus
ctgtggaaagcctcca

SEQ ID NO: 499932 - DNA, 16 bp, R. norvegicus
ctgtggaaaggagtgt

SEQ ID NO: 499933 - DNA, 16 bp, R. norvegicus
ctgtggaacagcccca

SEQ ID NO: 499934 - DNA, 16 bp, R. norvegicus
ctgtggaagccagagg

SEQ ID NO: 499935 - DNA, 16 bp, R. norvegicus
ctgtggactctgacct

SEQ ID NO: 499936 - DNA, 16 bp, R. norvegicus
ctgtggagaacagaag

SEQ ID NO: 499937 - DNA, 16 bp, R. norvegicus
ctgtggagaaggggct

SEQ ID NO: 499938 - DNA, 16 bp, R. norvegicus
ctgtggagatagaaaa

SEQ ID NO: 499939 - DNA, 16 bp, R. norvegicus
ctgtggagcagagact

SEQ ID NO: 499940 - DNA, 16 bp, R. norvegicus
ctgtggagcccacatt

SEQ ID NO: 499941 - DNA, 16 bp, R. norvegicus
ctgtggaggcaggctt

SEQ ID NO: 499942 - DNA, 16 bp, R. norvegicus
ctgtggaggccagaag

SEQ ID NO: 499943 - DNA, 16 bp, R. norvegicus
ctgtggaggtctgagg

SEQ ID NO: 499944 - DNA, 16 bp, R. norvegicus
ctgtggagtatagcat

SEQ ID NO: 499945 - DNA, 16 bp, R. norvegicus
ctgtggatcatgaccc

SEQ ID NO: 499946 - DNA, 16 bp, R. norvegicus
ctgtggattacatctt

SEQ ID NO: 499947 - DNA, 16 bp, R. norvegicus
ctgtggattgtgtcct

SEQ ID NO: 499948 - DNA, 16 bp, R. norvegicus
ctgtggcagcccagtg

SEQ ID NO: 499949 - DNA, 16 bp, R. norvegicus
ctgtggcagctgctgc

SEQ ID NO: 499950 - DNA, 16 bp, R. norvegicus
ctgtggcaggggactt

SEQ ID NO: 499951 - DNA, 16 bp, R. norvegicus
ctgtggccatacagcc

SEQ ID NO: 499952 - DNA, 16 bp, R. norvegicus
ctgtggccctggctgt

SEQ ID NO: 499953 - DNA, 16 bp, R. norvegicus
ctgtggccctgtgtct

SEQ ID NO: 499954 - DNA, 16 bp, R. norvegicus
ctgtggctccagctgc

SEQ ID NO: 499955 - DNA, 16 bp, R. norvegicus
ctgtggctctcaggag

SEQ ID NO: 499956 - DNA, 16 bp, R. norvegicus
ctgtggctctgtgctg

SEQ ID NO: 499957 - DNA, 16 bp, R. norvegicus
ctgtggctgcctgcac

SEQ ID NO: 499958 - DNA, 16 bp, R. norvegicus
ctgtggctgctggaga

SEQ ID NO: 499959 - DNA, 16 bp, R. norvegicus
ctgtggctgtggctgg

SEQ ID NO: 499960 - DNA, 16 bp, R. norvegicus
ctgtggctgtggtgag

SEQ ID NO: 499961 - DNA, 16 bp, R. norvegicus
ctgtgggaaagaactc

SEQ ID NO: 499962 - DNA, 16 bp, R. norvegicus
ctgtgggaacctggac

SEQ ID NO: 499963 - DNA, 16 bp, R. norvegicus
ctgtgggaaggctggt

SEQ ID NO: 499964 - DNA, 16 bp, R. norvegicus
ctgtgggacagcaacc

SEQ ID NO: 499965 - DNA, 16 bp, R. norvegicus
ctgtgggacagcttta

SEQ ID NO: 499966 - DNA, 16 bp, R. norvegicus
ctgtgggacttttaaa

SEQ ID NO: 499967 - DNA, 16 bp, R. norvegicus
ctgtgggagaaagagc

SEQ ID NO: 499968 - DNA, 16 bp, R. norvegicus
ctgtgggagggggtga

SEQ ID NO: 499969 - DNA, 16 bp, R. norvegicus
ctgtgggagtggagct

SEQ ID NO: 499970 - DNA, 16 bp, R. norvegicus
ctgtgggcaagtctgt

SEQ ID NO: 499971 - DNA, 16 bp, R. norvegicus
ctgtgggcacctgtgt

SEQ ID NO: 499972 - DNA, 16 bp, R. norvegicus
ctgtgggcagtcagga

SEQ ID NO: 499973 - DNA, 16 bp, R. norvegicus
ctgtgggcctgtgcct

SEQ ID NO: 499974 - DNA, 16 bp, R. norvegicus
ctgtgggcctgtttct

SEQ ID NO: 499975 - DNA, 16 bp, R. norvegicus
ctgtgggcctttgtct

SEQ ID NO: 499976 - DNA, 16 bp, R. norvegicus
ctgtgggcttcctctt

SEQ ID NO: 499977 - DNA, 16 bp, R. norvegicus
ctgtggggaagctggg

SEQ ID NO: 499978 - DNA, 16 bp, R. norvegicus
ctgtggggcctgcccc

SEQ ID NO: 499979 - DNA, 16 bp, R. norvegicus
ctgtgggggtcccagt

SEQ ID NO: 499980 - DNA, 16 bp, R. norvegicus
ctgtgggtctcaaccc

SEQ ID NO: 499981 - DNA, 16 bp, R. norvegicus
ctgtgggtctctgtgt

SEQ ID NO: 499982 - DNA, 16 bp, R. norvegicus
ctgtgggtggagcctg

SEQ ID NO: 499983 - DNA, 16 bp, R. norvegicus
ctgtgggtgggaacca

SEQ ID NO: 499984 - DNA, 16 bp, R. norvegicus
ctgtgggtgtgatgtg

SEQ ID NO: 499985 - DNA, 16 bp, R. norvegicus
ctgtgggttctgggga

SEQ ID NO: 499986 - DNA, 16 bp, R. norvegicus
ctgtggtcacctgcac

SEQ ID NO: 499987 - DNA, 16 bp, R. norvegicus
ctgtggtcatgtctgt

SEQ ID NO: 499988 - DNA, 16 bp, R. norvegicus
ctgtggtccccagcag

SEQ ID NO: 499989 - DNA, 16 bp, R. norvegicus
ctgtggtcctctgcaa

SEQ ID NO: 499990 - DNA, 16 bp, R. norvegicus
ctgtggtcctgtggct

SEQ ID NO: 499991 - DNA, 16 bp, R. norvegicus
ctgtggtgatgctcac

SEQ ID NO: 499992 - DNA, 18 bp, R. norvegicus
ctgtggtgatggctctga

SEQ ID NO: 499993 - DNA, 16 bp, R. norvegicus
ctgtggtgtcctgggt

SEQ ID NO: 499994 - DNA, 16 bp, R. norvegicus
ctgtggttatgacaaa

SEQ ID NO: 499995 - DNA, 16 bp, R. norvegicus
ctgtggttattttatt

SEQ ID NO: 499996 - DNA, 16 bp, R. norvegicus
ctgtggttcctgtgcc

SEQ ID NO: 499997 - DNA, 16 bp, R. norvegicus
ctgtggttgaattggg

SEQ ID NO: 499998 - DNA, 16 bp, R. norvegicus
ctgtggtttctgtttc

SEQ ID NO: 499999 - DNA, 16 bp, R. norvegicus
ctgtgtacctctggct

SEQ ID NO: 500000 - DNA, 16 bp, R. norvegicus
ctgtgtacctgtgtgt

SEQ ID NO: 500001 - DNA, 16 bp, R. norvegicus
ctgtgtacttctgtgc

SEQ ID NO: 500002 - DNA, 16 bp, R. norvegicus
ctgtgtagaccaggct

SEQ ID NO: 500003 - DNA, 16 bp, R. norvegicus
ctgtgtagcactggct

SEQ ID NO: 500004 - DNA, 16 bp, R. norvegicus
ctgtgtagccaaggat

SEQ ID NO: 500005 - DNA, 16 bp, R. norvegicus
ctgtgtagcctaggct

SEQ ID NO: 500006 - DNA, 16 bp, R. norvegicus
ctgtgtatccctggct

SEQ ID NO: 500007 - DNA, 16 bp, R. norvegicus
ctgtgtatgtctctct

SEQ ID NO: 500008 - DNA, 16 bp, R. norvegicus
ctgtgtatgtgtgtgt

SEQ ID NO: 500009 - DNA, 16 bp, R. norvegicus
ctgtgtattgctttta

SEQ ID NO: 500010 - DNA, 16 bp, R. norvegicus
ctgtgtatttctggct

SEQ ID NO: 500011 - DNA, 16 bp, R. norvegicus
ctgtgtcatggagacc

SEQ ID NO: 500012 - DNA, 16 bp, R. norvegicus
ctgtgtccctgtgtgt

SEQ ID NO: 500013 - DNA, 16 bp, R. norvegicus
ctgtgtcctctgtcct

SEQ ID NO: 500014 - DNA, 16 bp, R. norvegicus
ctgtgtcctgtgtcca

SEQ ID NO: 500015 - DNA, 16 bp, R. norvegicus
ctgtgtctctctggag

SEQ ID NO: 500016 - DNA, 16 bp, R. norvegicus
ctgtgtctctgttcag

SEQ ID NO: 500017 - DNA, 16 bp, R. norvegicus
ctgtgtctgaagacag

SEQ ID NO: 500018 - DNA, 16 bp, R. norvegicus
ctgtgtctgagacacc

SEQ ID NO: 500019 - DNA, 16 bp, R. norvegicus
ctgtgtctgctgtgtc

SEQ ID NO: 500020 - DNA, 16 bp, R. norvegicus
ctgtgtctgcttcaga

SEQ ID NO: 500021 - DNA, 16 bp, R. norvegicus
ctgtgtctgtctctgt

SEQ ID NO: 500022 - DNA, 16 bp, R. norvegicus
ctgtgtctgtgcctgt

SEQ ID NO: 500023 - DNA, 16 bp, R. norvegicus
ctgtgtctgtgtctct

SEQ ID NO: 500024 - DNA, 16 bp, R. norvegicus
ctgtgtctgttttcat

SEQ ID NO: 500025 - DNA, 16 bp, R. norvegicus
ctgtgtgaaatccatg

SEQ ID NO: 500026 - DNA, 16 bp, R. norvegicus
ctgtgtgaatacatgg

SEQ ID NO: 500027 - DNA, 16 bp, R. norvegicus
ctgtgtgaccagctgc

SEQ ID NO: 500028 - DNA, 16 bp, R. norvegicus
ctgtgtgaccctgggc

SEQ ID NO: 500029 - DNA, 16 bp, R. norvegicus
ctgtgtgaccttgggc

SEQ ID NO: 500030 - DNA, 16 bp, R. norvegicus
ctgtgtgactctgggc

SEQ ID NO: 500031 - DNA, 16 bp, R. norvegicus
ctgtgtgactttaacc

SEQ ID NO: 500032 - DNA, 16 bp, R. norvegicus
ctgtgtgcacctgcac

SEQ ID NO: 500033 - DNA, 16 bp, R. norvegicus
ctgtgtgcagacacca

SEQ ID NO: 500034 - DNA, 16 bp, R. norvegicus
ctgtgtgcagggggca

SEQ ID NO: 500035 - DNA, 16 bp, R. norvegicus
ctgtgtgcatgtgtgc

SEQ ID NO: 500036 - DNA, 16 bp, R. norvegicus
ctgtgtgccacactgg

SEQ ID NO: 500037 - DNA, 16 bp, R. norvegicus
ctgtgtgcctgtctgt

SEQ ID NO: 500038 - DNA, 16 bp, R. norvegicus
ctgtgtgctcaggtga

SEQ ID NO: 500039 - DNA, 38 bp, R. norvegicus
ctgtgtgctgcgggaatcccggcgcaggaagacggttt

SEQ ID NO: 500040 - DNA, 16 bp, R. norvegicus
ctgtgtggaagaggag

SEQ ID NO: 500041 - DNA, 16 bp, R. norvegicus
ctgtgtggaggccaga

SEQ ID NO: 500042 - DNA, 16 bp, R. norvegicus
ctgtgtggccctgact

SEQ ID NO: 500043 - DNA, 16 bp, R. norvegicus
ctgtgtggccctggct

SEQ ID NO: 500044 - DNA, 16 bp, R. norvegicus
ctgtgtggctgctggg

SEQ ID NO: 500045 - DNA, 16 bp, R. norvegicus
ctgtgtggctgtgtgg

SEQ ID NO: 500046 - DNA, 16 bp, R. norvegicus
ctgtgtggctgtgtgt

SEQ ID NO: 500047 - DNA, 16 bp, R. norvegicus
ctgtgtggtgctggga

SEQ ID NO: 500048 - DNA, 16 bp, R. norvegicus
ctgtgtggttattggg

SEQ ID NO: 500049 - DNA, 16 bp, R. norvegicus
ctgtgtggttcctggg

SEQ ID NO: 500050 - DNA, 16 bp, R. norvegicus
ctgtgtgtatgtgtgt

SEQ ID NO: 500051 - DNA, 16 bp, R. norvegicus
ctgtgtgtatttgctt

SEQ ID NO: 500052 - DNA, 16 bp, R. norvegicus
ctgtgtgtcaacactc

SEQ ID NO: 500053 - DNA, 16 bp, R. norvegicus
ctgtgtgtctctgcct

SEQ ID NO: 500054 - DNA, 16 bp, R. norvegicus
ctgtgtgtctgagtgt

SEQ ID NO: 500055 - DNA, 16 bp, R. norvegicus
ctgtgtgtctgtcctt

SEQ ID NO: 500056 - DNA, 16 bp, R. norvegicus
ctgtgtgtctgtgact

SEQ ID NO: 500057 - DNA, 16 bp, R. norvegicus
ctgtgtgtgagagtgt

SEQ ID NO: 500058 - DNA, 16 bp, R. norvegicus
ctgtgtgtgaggcctg

SEQ ID NO: 500059 - DNA, 16 bp, R. norvegicus
ctgtgtgtgctgcaga

SEQ ID NO: 500060 - DNA, 16 bp, R. norvegicus
ctgtgtgtggatgtgt

SEQ ID NO: 500061 - DNA, 16 bp, R. norvegicus
ctgtgtgtgtatatat

SEQ ID NO: 500062 - DNA, 16 bp, R. norvegicus
ctgtgtgtgtatctgt

SEQ ID NO: 500063 - DNA, 16 bp, R. norvegicus
ctgtgtgtgtatgtgt

SEQ ID NO: 500064 - DNA, 16 bp, R. norvegicus
ctgtgtgtgtgcactg

SEQ ID NO: 500065 - DNA, 16 bp, R. norvegicus
ctgtgtgtgtgtatgt

SEQ ID NO: 500066 - DNA, 16 bp, R. norvegicus
ctgtgtgtgtgtctgt

SEQ ID NO: 500067 - DNA, 16 bp, R. norvegicus
ctgtgtgtgtgtgtct

SEQ ID NO: 500068 - DNA, 16 bp, R. norvegicus
ctgtgtgtgtgtgtgc

SEQ ID NO: 500069 - DNA, 16 bp, R. norvegicus
ctgtgtgtgttcatgt

SEQ ID NO: 500070 - DNA, 16 bp, R. norvegicus
ctgtgtgttgggatta

SEQ ID NO: 500071 - DNA, 16 bp, R. norvegicus
ctgtgttaagaggaaa

SEQ ID NO: 500072 - DNA, 16 bp, R. norvegicus
ctgtgttcactgtctg

SEQ ID NO: 500073 - DNA, 16 bp, R. norvegicus
ctgtgttccagagatg

SEQ ID NO: 500074 - DNA, 16 bp, R. norvegicus
ctgtgttccataagtt

SEQ ID NO: 500075 - DNA, 16 bp, R. norvegicus
ctgtgttcctgtgtcc

SEQ ID NO: 500076 - DNA, 16 bp, R. norvegicus
ctgtgttcctgtgttc

SEQ ID NO: 500077 - DNA, 16 bp, R. norvegicus
ctgtgttctcctgtgt

SEQ ID NO: 500078 - DNA, 16 bp, R. norvegicus
ctgtgttgaagcaggg

SEQ ID NO: 500079 - DNA, 16 bp, R. norvegicus
ctgtgttggacatgct

SEQ ID NO: 500080 - DNA, 16 bp, R. norvegicus
ctgtgttgtctggaaa

SEQ ID NO: 500081 - DNA, 16 bp, R. norvegicus
ctgtgttgtgtgacag

SEQ ID NO: 500082 - DNA, 16 bp, R. norvegicus
ctgtgtttaaatgtgt

SEQ ID NO: 500083 - DNA, 16 bp, R. norvegicus
ctgtgtttgagtgtgt

SEQ ID NO: 500084 - DNA, 16 bp, R. norvegicus
ctgtgtttggtggctg

SEQ ID NO: 500085 - DNA, 16 bp, R. norvegicus
ctgtgtttgtgtctct

SEQ ID NO: 500086 - DNA, 16 bp, R. norvegicus
ctgtgttttaaaagaa

SEQ ID NO: 500087 - DNA, 16 bp, R. norvegicus
ctgtgttttgatgcta

SEQ ID NO: 500088 - DNA, 16 bp, R. norvegicus
ctgttaccaccaagga

SEQ ID NO: 500089 - DNA, 17 bp, R. norvegicus
ctgttaccaccaagggc

SEQ ID NO: 500090 - DNA, 16 bp, R. norvegicus
ctgttactatgacaaa

SEQ ID NO: 500091 - DNA, 16 bp, R. norvegicus
ctgttactatgataaa

SEQ ID NO: 500092 - DNA, 16 bp, R. norvegicus
ctgttaggaggtgtgg

SEQ ID NO: 500093 - DNA, 16 bp, R. norvegicus
ctgttagtgtgtgtgt

SEQ ID NO: 500094 - DNA, 16 bp, R. norvegicus
ctgttagtttctatat

SEQ ID NO: 500095 - DNA, 16 bp, R. norvegicus
ctgttagtttttctgt

SEQ ID NO: 500096 - DNA, 16 bp, R. norvegicus
ctgttataaaggaaaa

SEQ ID NO: 500097 - DNA, 16 bp, R. norvegicus
ctgttattattaaata

SEQ ID NO: 500098 - DNA, 16 bp, R. norvegicus
ctgttcacagtcccag

SEQ ID NO: 500099 - DNA, 16 bp, R. norvegicus
ctgttcagctccttca

SEQ ID NO: 500100 - DNA, 16 bp, R. norvegicus
ctgttcaggaaattat

SEQ ID NO: 500101 - DNA, 16 bp, R. norvegicus
ctgttcatctccaaag

SEQ ID NO: 500102 - DNA, 16 bp, R. norvegicus
ctgttcatttgtttgt

SEQ ID NO: 500103 - DNA, 16 bp, R. norvegicus
ctgttccagctccctg

SEQ ID NO: 500104 - DNA, 16 bp, R. norvegicus
ctgttcctcatcccat

SEQ ID NO: 500105 - DNA, 16 bp, R. norvegicus
ctgttcctccagagaa

SEQ ID NO: 500106 - DNA, 16 bp, R. norvegicus
ctgttcctctgtctct

SEQ ID NO: 500107 - DNA, 16 bp, R. norvegicus
ctgttcctgcccctca

SEQ ID NO: 500108 - DNA, 16 bp, R. norvegicus
ctgttcctgcgggcct

SEQ ID NO: 500109 - DNA, 16 bp, R. norvegicus
ctgttcctgctcctgc

SEQ ID NO: 500110 - DNA, 16 bp, R. norvegicus
ctgttcctgggctggt

SEQ ID NO: 500111 - DNA, 16 bp, R. norvegicus
ctgttcctgtgggtgt

SEQ ID NO: 500112 - DNA, 16 bp, R. norvegicus
ctgttccttctggtcc

SEQ ID NO: 500113 - DNA, 16 bp, R. norvegicus
ctgttctatctgcctg

SEQ ID NO: 500114 - DNA, 16 bp, R. norvegicus
ctgttctcatttcagt

SEQ ID NO: 500115 - DNA, 16 bp, R. norvegicus
ctgttctccattgtca

SEQ ID NO: 500116 - DNA, 16 bp, R. norvegicus
ctgttctcttcttcca

SEQ ID NO: 500117 - DNA, 16 bp, R. norvegicus
ctgttctgacttccct

SEQ ID NO: 500118 - DNA, 16 bp, R. norvegicus
ctgttctggctccaac

SEQ ID NO: 500119 - DNA, 16 bp, R. norvegicus
ctgttctggcttcctt

SEQ ID NO: 500120 - DNA, 16 bp, R. norvegicus
ctgttctgtggctgtg

SEQ ID NO: 500121 - DNA, 16 bp, R. norvegicus
ctgttcttcatgatgc

SEQ ID NO: 500122 - DNA, 16 bp, R. norvegicus
ctgttcttggctcaat

SEQ ID NO: 500123 - DNA, 16 bp, R. norvegicus
ctgttcttggctcagt

SEQ ID NO: 500124 - DNA, 16 bp, R. norvegicus
ctgttcttttctaaag

SEQ ID NO: 500125 - DNA, 16 bp, R. norvegicus
ctgttgaccaggctgg

SEQ ID NO: 500126 - DNA, 16 bp, R. norvegicus
ctgttgacttcaatac

SEQ ID NO: 500127 - DNA, 16 bp, R. norvegicus
ctgttgagaagaatct

SEQ ID NO: 500128 - DNA, 16 bp, R. norvegicus
ctgttgagaattttct

SEQ ID NO: 500129 - DNA, 16 bp, R. norvegicus
ctgttgagccctgttt

SEQ ID NO: 500130 - DNA, 16 bp, R. norvegicus
ctgttgaggaaagctg

SEQ ID NO: 500131 - DNA, 16 bp, R. norvegicus
ctgttgagtcatctct

SEQ ID NO: 500132 - DNA, 16 bp, R. norvegicus
ctgttgccatggcaac

SEQ ID NO: 500133 - DNA, 16 bp, R. norvegicus
ctgttgccccaccaaa

SEQ ID NO: 500134 - DNA, 16 bp, R. norvegicus
ctgttgctaacctgac

SEQ ID NO: 500135 - DNA, 16 bp, R. norvegicus
ctgttgctatgatgaa

SEQ ID NO: 500136 - DNA, 16 bp, R. norvegicus
ctgttgctgaagacac

SEQ ID NO: 500137 - DNA, 16 bp, R. norvegicus
ctgttgctgccctgtg

SEQ ID NO: 500138 - DNA, 16 bp, R. norvegicus
ctgttgctgctgctgt

SEQ ID NO: 500139 - DNA, 16 bp, R. norvegicus
ctgttgctgctgcttt

SEQ ID NO: 500140 - DNA, 16 bp, R. norvegicus
ctgttggagttcctgt

SEQ ID NO: 500141 - DNA, 16 bp, R. norvegicus
ctgttggctaccccca

SEQ ID NO: 500142 - DNA, 16 bp, R. norvegicus
ctgttggtcctcctgt

SEQ ID NO: 500143 - DNA, 16 bp, R. norvegicus
ctgttggtcttcctgt

SEQ ID NO: 500144 - DNA, 16 bp, R. norvegicus
ctgttgtaggatttgt

SEQ ID NO: 500145 - DNA, 16 bp, R. norvegicus
ctgttgtctccatatc

SEQ ID NO: 500146 - DNA, 16 bp, R. norvegicus
ctgttgtctgtctgtc

SEQ ID NO: 500147 - DNA, 16 bp, R. norvegicus
ctgttgtctgtcttga

SEQ ID NO: 500148 - DNA, 16 bp, R. norvegicus
ctgttgtgaagggtgt

SEQ ID NO: 500149 - DNA, 16 bp, R. norvegicus
ctgtttaaaagaaaaa

SEQ ID NO: 500150 - DNA, 16 bp, R. norvegicus
ctgtttaaaagaactg

SEQ ID NO: 500151 - DNA, 16 bp, R. norvegicus
ctgtttaaggagcttc

SEQ ID NO: 500152 - DNA, 16 bp, R. norvegicus
ctgtttagaaatattt

SEQ ID NO: 500153 - DNA, 16 bp, R. norvegicus
ctgtttattggttgtt

SEQ ID NO: 500154 - DNA, 16 bp, R. norvegicus
ctgtttcagtttctgc

SEQ ID NO: 500155 - DNA, 16 bp, R. norvegicus
ctgtttccaagatctg

SEQ ID NO: 500156 - DNA, 16 bp, R. norvegicus
ctgtttcccaggcctg

SEQ ID NO: 500157 - DNA, 16 bp, R. norvegicus
ctgtttctatttcctg

SEQ ID NO: 500158 - DNA, 16 bp, R. norvegicus
ctgtttctcatgattg

SEQ ID NO: 500159 - DNA, 16 bp, R. norvegicus
ctgtttctccagccct

SEQ ID NO: 500160 - DNA, 16 bp, R. norvegicus
ctgtttctcccactct

SEQ ID NO: 500161 - DNA, 16 bp, R. norvegicus
ctgtttctctgtctca

SEQ ID NO: 500162 - DNA, 16 bp, R. norvegicus
ctgtttctggcttcct

SEQ ID NO: 500163 - DNA, 16 bp, R. norvegicus
ctgtttctgtaataaa

SEQ ID NO: 500164 - DNA, 16 bp, R. norvegicus
ctgtttcttcctgcag

SEQ ID NO: 500165 - DNA, 16 bp, R. norvegicus
ctgtttgatttctgtt

SEQ ID NO: 500166 - DNA, 16 bp, R. norvegicus
ctgtttgctgttgctg

SEQ ID NO: 500167 - DNA, 16 bp, R. norvegicus
ctgtttgttttggacc

SEQ ID NO: 500168 - DNA, 16 bp, R. norvegicus
ctgttttaaaagaaaa

SEQ ID NO: 500169 - DNA, 16 bp, R. norvegicus
ctgttttccttcagcc

SEQ ID NO: 500170 - DNA, 16 bp, R. norvegicus
ctgttttgaatgttta

SEQ ID NO: 500171 - DNA, 16 bp, R. norvegicus
ctgttttgcctacatg

SEQ ID NO: 500172 - DNA, 16 bp, R. norvegicus
ctgttttgggaggttg

SEQ ID NO: 500173 - DNA, 16 bp, R. norvegicus
ctgttttggtccatat

SEQ ID NO: 500174 - DNA, 16 bp, R. norvegicus
cttaaaagtacacata

SEQ ID NO: 500175 - DNA, 16 bp, R. norvegicus
cttaaaatccatgtta

SEQ ID NO: 500176 - DNA, 16 bp, R. norvegicus
cttaaactcacagaga

SEQ ID NO: 500177 - DNA, 16 bp, R. norvegicus
cttaaagaaagagggc

SEQ ID NO: 500178 - DNA, 16 bp, R. norvegicus
cttaaagaaatagaag

SEQ ID NO: 500179 - DNA, 16 bp, R. norvegicus
cttaaagaagaaagag

SEQ ID NO: 500180 - DNA, 16 bp, R. norvegicus
cttaaagatatgttca

SEQ ID NO: 500181 - DNA, 16 bp, R. norvegicus
cttaaagcctctgaag

SEQ ID NO: 500182 - DNA, 16 bp, R. norvegicus
cttaaagtcctctatc

SEQ ID NO: 500183 - DNA, 16 bp, R. norvegicus
cttaaattctgttcca

SEQ ID NO: 500184 - DNA, 16 bp, R. norvegicus
cttaaattgtgtgtgt

SEQ ID NO: 500185 - DNA, 16 bp, R. norvegicus
cttaaatttccacttc

SEQ ID NO: 500186 - DNA, 16 bp, R. norvegicus
cttaacaaaactgaaa

SEQ ID NO: 500187 - DNA, 16 bp, R. norvegicus
cttaactacaaatggt

SEQ ID NO: 500188 - DNA, 16 bp, R. norvegicus
cttaactgctgagctg

SEQ ID NO: 500189 - DNA, 16 bp, R. norvegicus
cttaactgctggacca

SEQ ID NO: 500190 - DNA, 16 bp, R. norvegicus
cttaacttctgttttc

SEQ ID NO: 500191 - DNA, 16 bp, R. norvegicus
cttaagaaagaaggaa

SEQ ID NO: 500192 - DNA, 16 bp, R. norvegicus
cttaagctggaatgaa

SEQ ID NO: 500193 - DNA, 16 bp, R. norvegicus
cttaagtttgaggcca

SEQ ID NO: 500194 - DNA, 16 bp, R. norvegicus
cttaataaatattcat

SEQ ID NO: 500195 - DNA, 16 bp, R. norvegicus
cttaatctgtgtcttt

SEQ ID NO: 500196 - DNA, 16 bp, R. norvegicus
cttacaaacaggagcc

SEQ ID NO: 500197 - DNA, 16 bp, R. norvegicus
cttacaaaccaaatcc

SEQ ID NO: 500198 - DNA, 16 bp, R. norvegicus
cttacacctgtcagaa

SEQ ID NO: 500199 - DNA, 16 bp, R. norvegicus
cttacagaaactttgt

SEQ ID NO: 500200 - DNA, 16 bp, R. norvegicus
cttacagaagacccag

SEQ ID NO: 500201 - DNA, 16 bp, R. norvegicus
cttacagagaacccag

SEQ ID NO: 500202 - DNA, 16 bp, R. norvegicus
cttacaggagtgtcaa

SEQ ID NO: 500203 - DNA, 16 bp, R. norvegicus
cttacagtttcagagt

SEQ ID NO: 500204 - DNA, 16 bp, R. norvegicus
cttacatatttcaaaa

SEQ ID NO: 500205 - DNA, 16 bp, R. norvegicus
cttacatttttcaaaa

SEQ ID NO: 500206 - DNA, 16 bp, R. norvegicus
cttaccaaaactctgt

SEQ ID NO: 500207 - DNA, 28 bp, R. norvegicus
cttactaggctattcattgctacctatg

SEQ ID NO: 500208 - DNA, 16 bp, R. norvegicus
cttactgatacagatt

SEQ ID NO: 500209 - DNA, 16 bp, R. norvegicus
cttactgctaaataaa

SEQ ID NO: 500210 - DNA, 16 bp, R. norvegicus
cttactgctttcaata

SEQ ID NO: 500211 - DNA, 16 bp, R. norvegicus
cttactggcttccttc

SEQ ID NO: 500212 - DNA, 16 bp, R. norvegicus
cttactgtgtgccagg

SEQ ID NO: 500213 - DNA, 16 bp, R. norvegicus
cttacttttaaaaaaa

SEQ ID NO: 500214 - DNA, 16 bp, R. norvegicus
cttagaactcacagag

SEQ ID NO: 500215 - DNA, 16 bp, R. norvegicus
cttagaagcctgctct

SEQ ID NO: 500216 - DNA, 16 bp, R. norvegicus
cttagaaggcagaggc

SEQ ID NO: 500217 - DNA, 16 bp, R. norvegicus
cttagaagggcaaaca

SEQ ID NO: 500218 - DNA, 25 bp, R. norvegicus
cttagaatctgctcatctcaataaa

SEQ ID NO: 500219 - DNA, 16 bp, R. norvegicus
cttagagaagtcatga

SEQ ID NO: 500220 - DNA, 16 bp, R. norvegicus
cttagaggacagtcat

SEQ ID NO: 500221 - DNA, 16 bp, R. norvegicus
cttagccagacaaatg

SEQ ID NO: 500222 - DNA, 16 bp, R. norvegicus
cttagcccttctcact

SEQ ID NO: 500223 - DNA, 16 bp, R. norvegicus
cttagctccttctcta

SEQ ID NO: 500224 - DNA, 16 bp, R. norvegicus
cttaggatgaaaagaa

SEQ ID NO: 500225 - DNA, 16 bp, R. norvegicus
cttaggatgatgtttt

SEQ ID NO: 500226 - DNA, 16 bp, R. norvegicus
cttaggggacacaatg

SEQ ID NO: 500227 - DNA, 16 bp, R. norvegicus
cttagggttttcctgc

SEQ ID NO: 500228 - DNA, 16 bp, R. norvegicus
cttagtcattaaggaa

SEQ ID NO: 500229 - DNA, 16 bp, R. norvegicus
cttagtgattgatgtg

SEQ ID NO: 500230 - DNA, 18 bp, R. norvegicus
cttagtgcgtagctgcct

SEQ ID NO: 500231 - DNA, 16 bp, R. norvegicus
cttagttatggtttta

SEQ ID NO: 500232 - DNA, 16 bp, R. norvegicus
cttagtttgggttttc

SEQ ID NO: 500233 - DNA, 16 bp, R. norvegicus
cttataaagacaaaca

SEQ ID NO: 500234 - DNA, 16 bp, R. norvegicus
cttatacacaggtgca

SEQ ID NO: 500235 - DNA, 16 bp, R. norvegicus
cttatacttctcaaaa

SEQ ID NO: 500236 - DNA, 16 bp, R. norvegicus
cttatagacaggatca

SEQ ID NO: 500237 - DNA, 16 bp, R. norvegicus
cttatatttccttagg

SEQ ID NO: 500238 - DNA, 16 bp, R. norvegicus
cttatattttcagagg

SEQ ID NO: 500239 - DNA, 16 bp, R. norvegicus
cttatcaccctgaaca

SEQ ID NO: 500240 - DNA, 60 bp, R. norvegicus
cttatcaccctgtacaaagcttaagtccaagtggatcaaggacctccacatcaaacctga

SEQ ID NO: 500241 - DNA, 16 bp, R. norvegicus
cttatcagtgggtaca

SEQ ID NO: 500242 - DNA, 16 bp, R. norvegicus
cttatccaaggtcaca

SEQ ID NO: 500243 - DNA, 16 bp, R. norvegicus
cttatccgctgagcca

SEQ ID NO: 500244 - DNA, 20 bp, R. norvegicus
cttatctacgtcggccttat

SEQ ID NO: 500245 - DNA, 16 bp, R. norvegicus
cttatgaaactggaaa

SEQ ID NO: 500246 - DNA, 16 bp, R. norvegicus
cttatgaacagcaatg

SEQ ID NO: 500247 - DNA, 16 bp, R. norvegicus
cttatggacaggaaac

SEQ ID NO: 500248 - DNA, 16 bp, R. norvegicus
cttatggctattataa

SEQ ID NO: 500249 - DNA, 16 bp, R. norvegicus
cttatggggttgccat

SEQ ID NO: 500250 - DNA, 16 bp, R. norvegicus
cttattattttatgtg

SEQ ID NO: 500251 - DNA, 16 bp, R. norvegicus
cttattcccttgagac

SEQ ID NO: 500252 - DNA, 16 bp, R. norvegicus
cttattggaggagatg

SEQ ID NO: 500253 - DNA, 16 bp, R. norvegicus
cttattgttctaatta

SEQ ID NO: 500254 - DNA, 19 bp, R. norvegicus
cttatttacgatcgattta

SEQ ID NO: 500255 - DNA, 16 bp, R. norvegicus
cttatttattttgaaa

SEQ ID NO: 500256 - DNA, 16 bp, R. norvegicus
cttattttcaagacag

SEQ ID NO: 500257 - DNA, 16 bp, R. norvegicus
cttattttgagacaag

SEQ ID NO: 500258 - DNA, 16 bp, R. norvegicus
cttcaaaaagaaactg

SEQ ID NO: 500259 - DNA, 16 bp, R. norvegicus
cttcaaaacaaagcaa

SEQ ID NO: 500260 - DNA, 16 bp, R. norvegicus
cttcaaaagaagaatg

SEQ ID NO: 500261 - DNA, 16 bp, R. norvegicus
cttcaaaagcatcaga

SEQ ID NO: 500262 - DNA, 16 bp, R. norvegicus
cttcaaaagcctgtac

SEQ ID NO: 500263 - DNA, 16 bp, R. norvegicus
cttcaaaaggaaaaaa

SEQ ID NO: 500264 - DNA, 16 bp, R. norvegicus
cttcaaactcactatg

SEQ ID NO: 500265 - DNA, 16 bp, R. norvegicus
cttcaaactcagagac

SEQ ID NO: 500266 - DNA, 16 bp, R. norvegicus
cttcaaacttttttcc

SEQ ID NO: 500267 - DNA, 16 bp, R. norvegicus
cttcaaagaaatggaa

SEQ ID NO: 500268 - DNA, 16 bp, R. norvegicus
cttcaaagacatagaa

SEQ ID NO: 500269 - DNA, 16 bp, R. norvegicus
cttcaaaggaaatatt

SEQ ID NO: 500270 - DNA, 16 bp, R. norvegicus
cttcaaattcatcaaa

SEQ ID NO: 500271 - DNA, 16 bp, R. norvegicus
cttcaaattcatggtc

SEQ ID NO: 500272 - DNA, 16 bp, R. norvegicus
cttcaaatttggctca

SEQ ID NO: 500273 - DNA, 16 bp, R. norvegicus
cttcaacaaaactgga

SEQ ID NO: 500274 - DNA, 16 bp, R. norvegicus
cttcaacaaaatcaca

SEQ ID NO: 500275 - DNA, 16 bp, R. norvegicus
cttcaacaaaattaaa

SEQ ID NO: 500276 - DNA, 16 bp, R. norvegicus
cttcaacaaggacaca

SEQ ID NO: 500277 - DNA, 16 bp, R. norvegicus
cttcaacagcaactcc

SEQ ID NO: 500278 - DNA, 16 bp, R. norvegicus
cttcaacatttttcag

SEQ ID NO: 500279 - DNA, 16 bp, R. norvegicus
cttcaaccccagcact

SEQ ID NO: 500280 - DNA, 16 bp, R. norvegicus
cttcaactccttcaat

SEQ ID NO: 500281 - DNA, 16 bp, R. norvegicus
cttcaactgcctctgc

SEQ ID NO: 500282 - DNA, 16 bp, R. norvegicus
cttcaacttcttcagt

SEQ ID NO: 500283 - DNA, 16 bp, R. norvegicus
cttcaagaactaaatt

SEQ ID NO: 500284 - DNA, 16 bp, R. norvegicus
cttcaagaactatatt

SEQ ID NO: 500285 - DNA, 16 bp, R. norvegicus
cttcaagaaggccaca

SEQ ID NO: 500286 - DNA, 16 bp, R. norvegicus
cttcaagacaccgagg

SEQ ID NO: 500287 - DNA, 16 bp, R. norvegicus
cttcaagccccaaccc

SEQ ID NO: 500288 - DNA, 16 bp, R. norvegicus
cttcaagcctctggag

SEQ ID NO: 500289 - DNA, 16 bp, R. norvegicus
cttcaagctcctgcct

SEQ ID NO: 500290 - DNA, 16 bp, R. norvegicus
cttcaagctcttccac

SEQ ID NO: 500291 - DNA, 16 bp, R. norvegicus
cttcaagctcttccgg

SEQ ID NO: 500292 - DNA, 16 bp, R. norvegicus
cttcaagctgttccag

SEQ ID NO: 500293 - DNA, 16 bp, R. norvegicus
cttcaaggcctgacac

SEQ ID NO: 500294 - DNA, 16 bp, R. norvegicus
cttcaaggggagatga

SEQ ID NO: 500295 - DNA, 16 bp, R. norvegicus
cttcaagtctctgaaa

SEQ ID NO: 500296 - DNA, 16 bp, R. norvegicus
cttcaagtctctgcag

SEQ ID NO: 500297 - DNA, 16 bp, R. norvegicus
cttcaagttccctctc

SEQ ID NO: 500298 - DNA, 16 bp, R. norvegicus
cttcaagttcctgccc

SEQ ID NO: 500299 - DNA, 16 bp, R. norvegicus
cttcaagttcctgctg

SEQ ID NO: 500300 - DNA, 16 bp, R. norvegicus
cttcaagttcttccag

SEQ ID NO: 500301 - DNA, 16 bp, R. norvegicus
cttcaagttcttgtca

SEQ ID NO: 500302 - DNA, 16 bp, R. norvegicus
cttcaagttgtcctct

SEQ ID NO: 500303 - DNA, 16 bp, R. norvegicus
cttcaatatcaacaaa

SEQ ID NO: 500304 - DNA, 16 bp, R. norvegicus
cttcaatattttgata

SEQ ID NO: 500305 - DNA, 16 bp, R. norvegicus
cttcaatccttttcct

SEQ ID NO: 500306 - DNA, 16 bp, R. norvegicus
cttcaatctcttgtat

SEQ ID NO: 500307 - DNA, 16 bp, R. norvegicus
cttcaatgactgcttc

SEQ ID NO: 500308 - DNA, 16 bp, R. norvegicus
cttcaatggaggagtt

SEQ ID NO: 500309 - DNA, 16 bp, R. norvegicus
cttcaatggcttcttc

SEQ ID NO: 500310 - DNA, 16 bp, R. norvegicus
cttcaattcagttcca

SEQ ID NO: 500311 - DNA, 16 bp, R. norvegicus
cttcacacacatgtac

SEQ ID NO: 500312 - DNA, 16 bp, R. norvegicus
cttcacacagatggca

SEQ ID NO: 500313 - DNA, 16 bp, R. norvegicus
cttcacagatgaggaa

SEQ ID NO: 500314 - DNA, 16 bp, R. norvegicus
cttcacaggaccaagt

SEQ ID NO: 500315 - DNA, 16 bp, R. norvegicus
cttcacagtaacagaa

SEQ ID NO: 500316 - DNA, 16 bp, R. norvegicus
cttcaccaacagcctc

SEQ ID NO: 500317 - DNA, 16 bp, R. norvegicus
cttcaccagggcatcc

SEQ ID NO: 500318 - DNA, 16 bp, R. norvegicus
cttcacccaaaggaag

SEQ ID NO: 500319 - DNA, 16 bp, R. norvegicus
cttcaccccagggatg

SEQ ID NO: 500320 - DNA, 16 bp, R. norvegicus
cttcacctgcatgatg

SEQ ID NO: 500321 - DNA, 16 bp, R. norvegicus
cttcacctgggagcag

SEQ ID NO: 500322 - DNA, 16 bp, R. norvegicus
cttcacctgtgtctgc

SEQ ID NO: 500323 - DNA, 16 bp, R. norvegicus
cttcactttttaaaaa

SEQ ID NO: 500324 - DNA, 16 bp, R. norvegicus
cttcagaaaaaggcag

SEQ ID NO: 500325 - DNA, 16 bp, R. norvegicus
cttcagaaaaggacag

SEQ ID NO: 500326 - DNA, 16 bp, R. norvegicus
cttcagaaaatcaaag

SEQ ID NO: 500327 - DNA, 16 bp, R. norvegicus
cttcagaaaggagcag

SEQ ID NO: 500328 - DNA, 16 bp, R. norvegicus
cttcagaaggcagtat

SEQ ID NO: 500329 - DNA, 16 bp, R. norvegicus
cttcagacacagaaga

SEQ ID NO: 500330 - DNA, 16 bp, R. norvegicus
cttcagacacaggaga

SEQ ID NO: 500331 - DNA, 16 bp, R. norvegicus
cttcagacacatcaga

SEQ ID NO: 500332 - DNA, 16 bp, R. norvegicus
cttcagaccagaagag

SEQ ID NO: 500333 - DNA, 16 bp, R. norvegicus
cttcagacccatttcc

SEQ ID NO: 500334 - DNA, 16 bp, R. norvegicus
cttcagacctccaact

SEQ ID NO: 500335 - DNA, 16 bp, R. norvegicus
cttcagaccttcccct

SEQ ID NO: 500336 - DNA, 16 bp, R. norvegicus
cttcagactctgttct

SEQ ID NO: 500337 - DNA, 16 bp, R. norvegicus
cttcagactgtccaca

SEQ ID NO: 500338 - DNA, 16 bp, R. norvegicus
cttcagagaactggtt

SEQ ID NO: 500339 - DNA, 16 bp, R. norvegicus
cttcagagaagagcag

SEQ ID NO: 500340 - DNA, 16 bp, R. norvegicus
cttcagagactggaag

SEQ ID NO: 500341 - DNA, 16 bp, R. norvegicus
cttcagagagccagac

SEQ ID NO: 500342 - DNA, 16 bp, R. norvegicus
cttcagagaggaatcg

SEQ ID NO: 500343 - DNA, 16 bp, R. norvegicus
cttcagagaggctgac

SEQ ID NO: 500344 - DNA, 16 bp, R. norvegicus
cttcagagcaagttcc

SEQ ID NO: 500345 - DNA, 16 bp, R. norvegicus
cttcagagccttgaag

SEQ ID NO: 500346 - DNA, 16 bp, R. norvegicus
cttcagaggacccaag

SEQ ID NO: 500347 - DNA, 16 bp, R. norvegicus
cttcagagtcctgaag

SEQ ID NO: 500348 - DNA, 16 bp, R. norvegicus
cttcagatcaagatat

SEQ ID NO: 500349 - DNA, 16 bp, R. norvegicus
cttcagatctcctgga

SEQ ID NO: 500350 - DNA, 16 bp, R. norvegicus
cttcagcaaaatgact

SEQ ID NO: 500351 - DNA, 16 bp, R. norvegicus
cttcagcacagtggct

SEQ ID NO: 500352 - DNA, 16 bp, R. norvegicus
cttcagcctcagcctc

SEQ ID NO: 500353 - DNA, 16 bp, R. norvegicus
cttcagcctcctcagt

SEQ ID NO: 500354 - DNA, 16 bp, R. norvegicus
cttcagcctcctgaat

SEQ ID NO: 500355 - DNA, 16 bp, R. norvegicus
cttcagcctctgtgag

SEQ ID NO: 500356 - DNA, 16 bp, R. norvegicus
cttcagccttttctct

SEQ ID NO: 500357 - DNA, 16 bp, R. norvegicus
cttcagctccagagga

SEQ ID NO: 500358 - DNA, 16 bp, R. norvegicus
cttcagctcctgcagt

SEQ ID NO: 500359 - DNA, 16 bp, R. norvegicus
cttcagctcctgccct

SEQ ID NO: 500360 - DNA, 16 bp, R. norvegicus
cttcagctcctgtctc

SEQ ID NO: 500361 - DNA, 16 bp, R. norvegicus
cttcagctctttccat

SEQ ID NO: 500362 - DNA, 16 bp, R. norvegicus
cttcaggattccaaca

SEQ ID NO: 500363 - DNA, 16 bp, R. norvegicus
cttcaggccaaatcca

SEQ ID NO: 500364 - DNA, 16 bp, R. norvegicus
cttcaggccactccag

SEQ ID NO: 500365 - DNA, 17 bp, R. norvegicus
cttcaggctcttccagt

SEQ ID NO: 500366 - DNA, 16 bp, R. norvegicus
cttcagggattggcag

SEQ ID NO: 500367 - DNA, 16 bp, R. norvegicus
cttcaggtagaaatat

SEQ ID NO: 500368 - DNA, 16 bp, R. norvegicus
cttcaggttcagtgaa

SEQ ID NO: 500369 - DNA, 16 bp, R. norvegicus
cttcaggtttcccagg

SEQ ID NO: 500370 - DNA, 16 bp, R. norvegicus
cttcagtcactgctct

SEQ ID NO: 500371 - DNA, 16 bp, R. norvegicus
cttcagtcaggctcac

SEQ ID NO: 500372 - DNA, 16 bp, R. norvegicus
cttcagtctttgtttt

SEQ ID NO: 500373 - DNA, 16 bp, R. norvegicus
cttcagtgtctgctcc

SEQ ID NO: 500374 - DNA, 16 bp, R. norvegicus
cttcagtgtggctgga

SEQ ID NO: 500375 - DNA, 16 bp, R. norvegicus
cttcagtgttttctct

SEQ ID NO: 500376 - DNA, 16 bp, R. norvegicus
cttcagttcccagcac

SEQ ID NO: 500377 - DNA, 24 bp, R. norvegicus
cttcagttccctttgggttcacaa

SEQ ID NO: 500378 - DNA, 16 bp, R. norvegicus
cttcagttcctgtctt

SEQ ID NO: 500379 - DNA, 16 bp, R. norvegicus
cttcagttcttccctt

SEQ ID NO: 500380 - DNA, 16 bp, R. norvegicus
cttcagttctttcaga

SEQ ID NO: 500381 - DNA, 16 bp, R. norvegicus
cttcagttgcagttga

SEQ ID NO: 500382 - DNA, 16 bp, R. norvegicus
cttcagtttaaaaaaa

SEQ ID NO: 500383 - DNA, 16 bp, R. norvegicus
cttcagtttcttcagt

SEQ ID NO: 500384 - DNA, 16 bp, R. norvegicus
cttcagtttcttgaag

SEQ ID NO: 500385 - DNA, 16 bp, R. norvegicus
cttcataaagaaattg

SEQ ID NO: 500386 - DNA, 17 bp, R. norvegicus
cttcatagaagacctct

SEQ ID NO: 500387 - DNA, 16 bp, R. norvegicus
cttcatagaaggcatt

SEQ ID NO: 500388 - DNA, 16 bp, R. norvegicus
cttcatattaaggctg

SEQ ID NO: 500389 - DNA, 16 bp, R. norvegicus
cttcatcaaaattcca

SEQ ID NO: 500390 - DNA, 16 bp, R. norvegicus
cttcatcaaggccaca

SEQ ID NO: 500391 - DNA, 16 bp, R. norvegicus
cttcatcatcaccatc

SEQ ID NO: 500392 - DNA, 16 bp, R. norvegicus
cttcatcatcagttca

SEQ ID NO: 500393 - DNA, 16 bp, R. norvegicus
cttcatccaaaggaaa

SEQ ID NO: 500394 - DNA, 16 bp, R. norvegicus
cttcatccagcagcag

SEQ ID NO: 500395 - DNA, 16 bp, R. norvegicus
cttcatccgaaggctg

SEQ ID NO: 500396 - DNA, 16 bp, R. norvegicus
cttcatcctcctgcct

SEQ ID NO: 500397 - DNA, 16 bp, R. norvegicus
cttcatctacagcctg

SEQ ID NO: 500398 - DNA, 16 bp, R. norvegicus
cttcatctgaaggaag

SEQ ID NO: 500399 - DNA, 16 bp, R. norvegicus
cttcatcttcctgcct

SEQ ID NO: 500400 - DNA, 16 bp, R. norvegicus
cttcatcttcttcatc

SEQ ID NO: 500401 - DNA, 16 bp, R. norvegicus
cttcatgaagaaattg

SEQ ID NO: 500402 - DNA, 16 bp, R. norvegicus
cttcatgataaaagta

SEQ ID NO: 500403 - DNA, 16 bp, R. norvegicus
cttcatgataaaagtc

SEQ ID NO: 500404 - DNA, 16 bp, R. norvegicus
cttcatgcatgctaga

SEQ ID NO: 500405 - DNA, 16 bp, R. norvegicus
cttcatgctcttccag

SEQ ID NO: 500406 - DNA, 16 bp, R. norvegicus
cttcatggtgggaagc

SEQ ID NO: 500407 - DNA, 16 bp, R. norvegicus
cttcatgtatgtgagt

SEQ ID NO: 500408 - DNA, 16 bp, R. norvegicus
cttcatgtatgttcat

SEQ ID NO: 500409 - DNA, 16 bp, R. norvegicus
cttcatgtgtattctt

SEQ ID NO: 500410 - DNA, 16 bp, R. norvegicus
cttcatgttgaaagtc

SEQ ID NO: 500411 - DNA, 16 bp, R. norvegicus
cttcatgtttctgcct

SEQ ID NO: 500412 - DNA, 16 bp, R. norvegicus
cttcattgtcaacctg

SEQ ID NO: 500413 - DNA, 16 bp, R. norvegicus
cttcattgtgcacaca

SEQ ID NO: 500414 - DNA, 16 bp, R. norvegicus
cttcattgtttctatt

SEQ ID NO: 500415 - DNA, 16 bp, R. norvegicus
cttcatttccatctct

SEQ ID NO: 500416 - DNA, 16 bp, R. norvegicus
cttcatttctatttca

SEQ ID NO: 500417 - DNA, 16 bp, R. norvegicus
cttcattttcttctgt

SEQ ID NO: 500418 - DNA, 16 bp, R. norvegicus
cttccaaaagacccaa

SEQ ID NO: 500419 - DNA, 16 bp, R. norvegicus
cttccaaaggaggaaa

SEQ ID NO: 500420 - DNA, 16 bp, R. norvegicus
cttccaaaggagggaa

SEQ ID NO: 500421 - DNA, 16 bp, R. norvegicus
cttccaaatgctgtga

SEQ ID NO: 500422 - DNA, 16 bp, R. norvegicus
cttccaaccatttgcc

SEQ ID NO: 500423 - DNA, 16 bp, R. norvegicus
cttccaatgtcctcat

SEQ ID NO: 500424 - DNA, 16 bp, R. norvegicus
cttccacaagactcca

SEQ ID NO: 500425 - DNA, 16 bp, R. norvegicus
cttccacactgggcag

SEQ ID NO: 500426 - DNA, 16 bp, R. norvegicus
cttccacagactcagg

SEQ ID NO: 500427 - DNA, 16 bp, R. norvegicus
cttccacagggttccc

SEQ ID NO: 500428 - DNA, 16 bp, R. norvegicus
cttccaccagcagcct

SEQ ID NO: 500429 - DNA, 16 bp, R. norvegicus
cttccacctcacacca

SEQ ID NO: 500430 - DNA, 16 bp, R. norvegicus
cttccacctccctgcc

SEQ ID NO: 500431 - DNA, 16 bp, R. norvegicus
cttccacctgcctctc

SEQ ID NO: 500432 - DNA, 16 bp, R. norvegicus
cttccacgatgccaaa

SEQ ID NO: 500433 - DNA, 16 bp, R. norvegicus
cttccactccctgccc

SEQ ID NO: 500434 - DNA, 16 bp, R. norvegicus
cttccactcctcttga

SEQ ID NO: 500435 - DNA, 16 bp, R. norvegicus
cttccactctgcagtc

SEQ ID NO: 500436 - DNA, 16 bp, R. norvegicus
cttccactgagccaaa

SEQ ID NO: 500437 - DNA, 16 bp, R. norvegicus
cttccactgcctctgc

SEQ ID NO: 500438 - DNA, 16 bp, R. norvegicus
cttccactggtgccac

SEQ ID NO: 500439 - DNA, 16 bp, R. norvegicus
cttccactggtgccca

SEQ ID NO: 500440 - DNA, 16 bp, R. norvegicus
cttccacttgtgcccc

SEQ ID NO: 500441 - DNA, 16 bp, R. norvegicus
cttccagaaccttcca

SEQ ID NO: 500442 - DNA, 16 bp, R. norvegicus
cttccagaagacatgg

SEQ ID NO: 500443 - DNA, 16 bp, R. norvegicus
cttccagaagacccag

SEQ ID NO: 500444 - DNA, 16 bp, R. norvegicus
cttccagaagacctgg

SEQ ID NO: 500445 - DNA, 16 bp, R. norvegicus
cttccagaagcttttc

SEQ ID NO: 500446 - DNA, 16 bp, R. norvegicus
cttccagaatgttctt

SEQ ID NO: 500447 - DNA, 16 bp, R. norvegicus
cttccagacacagcag

SEQ ID NO: 500448 - DNA, 16 bp, R. norvegicus
cttccagacaggagcc

SEQ ID NO: 500449 - DNA, 16 bp, R. norvegicus
cttccagactttccct

SEQ ID NO: 500450 - DNA, 16 bp, R. norvegicus
cttccagagaacccag

SEQ ID NO: 500451 - DNA, 16 bp, R. norvegicus
cttccagagaacctga

SEQ ID NO: 500452 - DNA, 16 bp, R. norvegicus
cttccagagagcctga

SEQ ID NO: 500453 - DNA, 16 bp, R. norvegicus
cttccagaggagccag

SEQ ID NO: 500454 - DNA, 16 bp, R. norvegicus
cttccagaggagggag

SEQ ID NO: 500455 - DNA, 16 bp, R. norvegicus
cttccagaggccctgg

SEQ ID NO: 500456 - DNA, 16 bp, R. norvegicus
cttccagagttcctga

SEQ ID NO: 500457 - DNA, 16 bp, R. norvegicus
cttccagatcacagtc

SEQ ID NO: 500458 - DNA, 16 bp, R. norvegicus
cttccagcaccatgcc

SEQ ID NO: 500459 - DNA, 16 bp, R. norvegicus
cttccagcaggatctg

SEQ ID NO: 500460 - DNA, 16 bp, R. norvegicus
cttccagccaggctgt

SEQ ID NO: 500461 - DNA, 16 bp, R. norvegicus
cttccagccttttcct

SEQ ID NO: 500462 - DNA, 16 bp, R. norvegicus
cttccagctcttccag

SEQ ID NO: 500463 - DNA, 16 bp, R. norvegicus
cttccaggtcctgagt

SEQ ID NO: 500464 - DNA, 16 bp, R. norvegicus
cttccagtactttctc

SEQ ID NO: 500465 - DNA, 16 bp, R. norvegicus
cttccagtcccttctc

SEQ ID NO: 500466 - DNA, 16 bp, R. norvegicus
cttccagttcctgccc

SEQ ID NO: 500467 - DNA, 16 bp, R. norvegicus
cttccagttcttcctc

SEQ ID NO: 500468 - DNA, 16 bp, R. norvegicus
cttccagttcttcttg

SEQ ID NO: 500469 - DNA, 16 bp, R. norvegicus
cttccataacaacaaa

SEQ ID NO: 500470 - DNA, 16 bp, R. norvegicus
cttccataagattccc

SEQ ID NO: 500471 - DNA, 16 bp, R. norvegicus
cttccatctctgtgag

SEQ ID NO: 500472 - DNA, 16 bp, R. norvegicus
cttccatgagtatttt

SEQ ID NO: 500473 - DNA, 16 bp, R. norvegicus
cttccatgtgtatatg

SEQ ID NO: 500474 - DNA, 16 bp, R. norvegicus
cttccatgttcctact

SEQ ID NO: 500475 - DNA, 16 bp, R. norvegicus
cttccatttgtatgtg

SEQ ID NO: 500476 - DNA, 16 bp, R. norvegicus
cttcccaagggctggg

SEQ ID NO: 500477 - DNA, 16 bp, R. norvegicus
cttcccaagtctctgg

SEQ ID NO: 500478 - DNA, 16 bp, R. norvegicus
cttcccacatgctggg

SEQ ID NO: 500479 - DNA, 16 bp, R. norvegicus
cttcccagaaccaagg

SEQ ID NO: 500480 - DNA, 16 bp, R. norvegicus
cttcccagacattctt

SEQ ID NO: 500481 - DNA, 16 bp, R. norvegicus
cttcccagcaacagaa

SEQ ID NO: 500482 - DNA, 16 bp, R. norvegicus
cttcccagcatcctct

SEQ ID NO: 500483 - DNA, 16 bp, R. norvegicus
cttcccagccattcaa

SEQ ID NO: 500484 - DNA, 16 bp, R. norvegicus
cttcccagcctcccct

SEQ ID NO: 500485 - DNA, 17 bp, R. norvegicus
cttcccagtcagactga

SEQ ID NO: 500486 - DNA, 16 bp, R. norvegicus
cttcccagtcttccca

SEQ ID NO: 500487 - DNA, 16 bp, R. norvegicus
cttcccagtgtccttt

SEQ ID NO: 500488 - DNA, 16 bp, R. norvegicus
cttcccatcctgacat

SEQ ID NO: 500489 - DNA, 16 bp, R. norvegicus
cttccccaacttgctt

SEQ ID NO: 500490 - DNA, 16 bp, R. norvegicus
cttccccaccatggtg

SEQ ID NO: 500491 - DNA, 16 bp, R. norvegicus
cttccccacgggattt

SEQ ID NO: 500492 - DNA, 16 bp, R. norvegicus
cttccccacttgttct

SEQ ID NO: 500493 - DNA, 16 bp, R. norvegicus
cttccccagagggacc

SEQ ID NO: 500494 - DNA, 16 bp, R. norvegicus
cttccccagcaagcag

SEQ ID NO: 500495 - DNA, 16 bp, R. norvegicus
cttccccagcttccag

SEQ ID NO: 500496 - DNA, 16 bp, R. norvegicus
cttccccagtgctgag

SEQ ID NO: 500497 - DNA, 16 bp, R. norvegicus
cttcccccattaccac

SEQ ID NO: 500498 - DNA, 16 bp, R. norvegicus
cttccccctccactgg

SEQ ID NO: 500499 - DNA, 17 bp, R. norvegicus
cttcccctgccactggt

SEQ ID NO: 500500 - DNA, 17 bp, R. norvegicus
cttccccttccactgat

SEQ ID NO: 500501 - DNA, 16 bp, R. norvegicus
cttccccttggccttc

SEQ ID NO: 500502 - DNA, 16 bp, R. norvegicus
cttccccttttaaaga

SEQ ID NO: 500503 - DNA, 16 bp, R. norvegicus
cttcccgaatgctggg

SEQ ID NO: 500504 - DNA, 16 bp, R. norvegicus
cttccctcagctcttc

SEQ ID NO: 500505 - DNA, 16 bp, R. norvegicus
cttccctcagtggact

SEQ ID NO: 500506 - DNA, 16 bp, R. norvegicus
cttccctcggtgatgg

SEQ ID NO: 500507 - DNA, 16 bp, R. norvegicus
cttccctctctgttgg

SEQ ID NO: 500508 - DNA, 16 bp, R. norvegicus
cttccctgagagaggc

SEQ ID NO: 500509 - DNA, 16 bp, R. norvegicus
cttccctgcctgcctg

SEQ ID NO: 500510 - DNA, 16 bp, R. norvegicus
cttccctggagaagac

SEQ ID NO: 500511 - DNA, 16 bp, R. norvegicus
cttccctggcatctgg

SEQ ID NO: 500512 - DNA, 16 bp, R. norvegicus
cttccctggccttggt

SEQ ID NO: 500513 - DNA, 16 bp, R. norvegicus
cttccctgggaaagac

SEQ ID NO: 500514 - DNA, 16 bp, R. norvegicus
cttccctgggcaccag

SEQ ID NO: 500515 - DNA, 16 bp, R. norvegicus
cttccctggggtatca

SEQ ID NO: 500516 - DNA, 16 bp, R. norvegicus
cttccctgtctccatc

SEQ ID NO: 500517 - DNA, 16 bp, R. norvegicus
cttccctgtgctggga

SEQ ID NO: 500518 - DNA, 16 bp, R. norvegicus
cttccctgtgtgtgtg

SEQ ID NO: 500519 - DNA, 16 bp, R. norvegicus
cttcccttctaccatg

SEQ ID NO: 500520 - DNA, 16 bp, R. norvegicus
cttcctaatgctatga

SEQ ID NO: 500521 - DNA, 16 bp, R. norvegicus
cttcctacaagctttg

SEQ ID NO: 500522 - DNA, 16 bp, R. norvegicus
cttcctagtgctgtga

SEQ ID NO: 500523 - DNA, 16 bp, R. norvegicus
cttcctatgggggtgc

SEQ ID NO: 500524 - DNA, 16 bp, R. norvegicus
cttcctatggggtctc

SEQ ID NO: 500525 - DNA, 16 bp, R. norvegicus
cttcctatgggttgaa

SEQ ID NO: 500526 - DNA, 16 bp, R. norvegicus
cttcctcagaggagct

SEQ ID NO: 500527 - DNA, 16 bp, R. norvegicus
cttcctcagaggggct

SEQ ID NO: 500528 - DNA, 16 bp, R. norvegicus
cttcctcagcactggg

SEQ ID NO: 500529 - DNA, 16 bp, R. norvegicus
cttcctcagctgctct

SEQ ID NO: 500530 - DNA, 16 bp, R. norvegicus
cttcctcagcttcctg

SEQ ID NO: 500531 - DNA, 16 bp, R. norvegicus
cttcctcagtgtcttg

SEQ ID NO: 500532 - DNA, 16 bp, R. norvegicus
cttcctcagtttccca

SEQ ID NO: 500533 - DNA, 16 bp, R. norvegicus
cttcctcatgggtgtt

SEQ ID NO: 500534 - DNA, 16 bp, R. norvegicus
cttcctccaagaaggc

SEQ ID NO: 500535 - DNA, 16 bp, R. norvegicus
cttcctccaagttcct

SEQ ID NO: 500536 - DNA, 16 bp, R. norvegicus
cttcctccagcagggc

SEQ ID NO: 500537 - DNA, 16 bp, R. norvegicus
cttcctccagctcccc

SEQ ID NO: 500538 - DNA, 16 bp, R. norvegicus
cttcctccagctcttc

SEQ ID NO: 500539 - DNA, 16 bp, R. norvegicus
cttcctccaggaagcc

SEQ ID NO: 500540 - DNA, 16 bp, R. norvegicus
cttcctccatctgcct

SEQ ID NO: 500541 - DNA, 16 bp, R. norvegicus
cttcctccctcagcct

SEQ ID NO: 500542 - DNA, 16 bp, R. norvegicus
cttcctcctacagcag

SEQ ID NO: 500543 - DNA, 16 bp, R. norvegicus
cttcctcctagctgcc

SEQ ID NO: 500544 - DNA, 16 bp, R. norvegicus
cttcctcctcagccag

SEQ ID NO: 500545 - DNA, 16 bp, R. norvegicus
cttcctcctcctgtgc

SEQ ID NO: 500546 - DNA, 16 bp, R. norvegicus
cttcctcctctggcct

SEQ ID NO: 500547 - DNA, 16 bp, R. norvegicus
cttcctcctgcaacag

SEQ ID NO: 500548 - DNA, 16 bp, R. norvegicus
cttcctctacaaaaag

SEQ ID NO: 500549 - DNA, 16 bp, R. norvegicus
cttcctctatagaaaa

SEQ ID NO: 500550 - DNA, 16 bp, R. norvegicus
cttcctctcccagcag

SEQ ID NO: 500551 - DNA, 16 bp, R. norvegicus
cttcctctctgcagcc

SEQ ID NO: 500552 - DNA, 16 bp, R. norvegicus
cttcctctgattcccc

SEQ ID NO: 500553 - DNA, 16 bp, R. norvegicus
cttcctctgcctccca

SEQ ID NO: 500554 - DNA, 16 bp, R. norvegicus
cttcctctgctcaaag

SEQ ID NO: 500555 - DNA, 16 bp, R. norvegicus
cttcctctgggtattg

SEQ ID NO: 500556 - DNA, 16 bp, R. norvegicus
cttcctcttcctgagg

SEQ ID NO: 500557 - DNA, 16 bp, R. norvegicus
cttcctgaagctcttc

SEQ ID NO: 500558 - DNA, 16 bp, R. norvegicus
cttcctgaagctcttt

SEQ ID NO: 500559 - DNA, 16 bp, R. norvegicus
cttcctgacctgtgtg

SEQ ID NO: 500560 - DNA, 16 bp, R. norvegicus
cttcctgactgcagac

SEQ ID NO: 500561 - DNA, 16 bp, R. norvegicus
cttcctgagcctcagt

SEQ ID NO: 500562 - DNA, 16 bp, R. norvegicus
cttcctgaggaaccac

SEQ ID NO: 500563 - DNA, 16 bp, R. norvegicus
cttcctgaggaccagg

SEQ ID NO: 500564 - DNA, 16 bp, R. norvegicus
cttcctgattggctgc

SEQ ID NO: 500565 - DNA, 16 bp, R. norvegicus
cttcctgcagcagcca

SEQ ID NO: 500566 - DNA, 16 bp, R. norvegicus
cttcctgcctacagga

SEQ ID NO: 500567 - DNA, 16 bp, R. norvegicus
cttcctgcctcagccc

SEQ ID NO: 500568 - DNA, 16 bp, R. norvegicus
cttcctgcctccaggt

SEQ ID NO: 500569 - DNA, 16 bp, R. norvegicus
cttcctgcctccatcc

SEQ ID NO: 500570 - DNA, 16 bp, R. norvegicus
cttcctgcctctaccc

SEQ ID NO: 500571 - DNA, 16 bp, R. norvegicus
cttcctgcctctgctg

SEQ ID NO: 500572 - DNA, 16 bp, R. norvegicus
cttcctgcctctggct

SEQ ID NO: 500573 - DNA, 16 bp, R. norvegicus
cttcctgccttcacct

SEQ ID NO: 500574 - DNA, 16 bp, R. norvegicus
cttcctgccttgacat

SEQ ID NO: 500575 - DNA, 16 bp, R. norvegicus
cttcctgctctgtgtg

SEQ ID NO: 500576 - DNA, 16 bp, R. norvegicus
cttcctgctgcctttg

SEQ ID NO: 500577 - DNA, 16 bp, R. norvegicus
cttcctgctgtctgcc

SEQ ID NO: 500578 - DNA, 16 bp, R. norvegicus
cttcctgctgtctggg

SEQ ID NO: 500579 - DNA, 16 bp, R. norvegicus
cttcctgctgtctgtg

SEQ ID NO: 500580 - DNA, 16 bp, R. norvegicus
cttcctgcttctcaag

SEQ ID NO: 500581 - DNA, 16 bp, R. norvegicus
cttcctgcttctgctc

SEQ ID NO: 500582 - DNA, 16 bp, R. norvegicus
cttcctgcttctgctg

SEQ ID NO: 500583 - DNA, 16 bp, R. norvegicus
cttcctgcttctgctt

SEQ ID NO: 500584 - DNA, 16 bp, R. norvegicus
cttcctggaactggag

SEQ ID NO: 500585 - DNA, 16 bp, R. norvegicus
cttcctggagaaagca

SEQ ID NO: 500586 - DNA, 16 bp, R. norvegicus
cttcctggagaagact

SEQ ID NO: 500587 - DNA, 16 bp, R. norvegicus
cttcctggagcttcag

SEQ ID NO: 500588 - DNA, 16 bp, R. norvegicus
cttcctggaggaagtg

SEQ ID NO: 500589 - DNA, 16 bp, R. norvegicus
cttcctggaggaggaa

SEQ ID NO: 500590 - DNA, 16 bp, R. norvegicus
cttcctggctgccatg

SEQ ID NO: 500591 - DNA, 16 bp, R. norvegicus
cttcctggctgccttc

SEQ ID NO: 500592 - DNA, 16 bp, R. norvegicus
cttcctggcttgcttc

SEQ ID NO: 500593 - DNA, 16 bp, R. norvegicus
cttcctggggctggag

SEQ ID NO: 500594 - DNA, 16 bp, R. norvegicus
cttcctggtgcccttt

SEQ ID NO: 500595 - DNA, 16 bp, R. norvegicus
cttcctggtgctccct

SEQ ID NO: 500596 - DNA, 16 bp, R. norvegicus
cttcctggtggctgcc

SEQ ID NO: 500597 - DNA, 16 bp, R. norvegicus
cttcctggtttccagg

SEQ ID NO: 500598 - DNA, 16 bp, R. norvegicus
cttcctgtattttctt

SEQ ID NO: 500599 - DNA, 16 bp, R. norvegicus
cttcctgtcctccatt

SEQ ID NO: 500600 - DNA, 16 bp, R. norvegicus
cttcctgtcctgtgtg

SEQ ID NO: 500601 - DNA, 16 bp, R. norvegicus
cttcctgtctcagctt

SEQ ID NO: 500602 - DNA, 16 bp, R. norvegicus
cttcctgtctctcatt

SEQ ID NO: 500603 - DNA, 16 bp, R. norvegicus
cttcctgtctctgctc

SEQ ID NO: 500604 - DNA, 16 bp, R. norvegicus
cttcctgtctctgtct

SEQ ID NO: 500605 - DNA, 16 bp, R. norvegicus
cttcctgtctgtcttc

SEQ ID NO: 500606 - DNA, 16 bp, R. norvegicus
cttcctgtcttcatct

SEQ ID NO: 500607 - DNA, 16 bp, R. norvegicus
cttcctgtggagtctc

SEQ ID NO: 500608 - DNA, 16 bp, R. norvegicus
cttcctgtggtgttcc

SEQ ID NO: 500609 - DNA, 16 bp, R. norvegicus
cttcctgtgtgtctga

SEQ ID NO: 500610 - DNA, 16 bp, R. norvegicus
cttcctgtgttcctct

SEQ ID NO: 500611 - DNA, 16 bp, R. norvegicus
cttcctgtttgctgcc

SEQ ID NO: 500612 - DNA, 16 bp, R. norvegicus
cttccttcagcaaggc

SEQ ID NO: 500613 - DNA, 16 bp, R. norvegicus
cttccttcagtccttt

SEQ ID NO: 500614 - DNA, 16 bp, R. norvegicus
cttccttcctcctgag

SEQ ID NO: 500615 - DNA, 16 bp, R. norvegicus
cttccttcctgaagtt

SEQ ID NO: 500616 - DNA, 16 bp, R. norvegicus
cttccttcctgcctgc

SEQ ID NO: 500617 - DNA, 16 bp, R. norvegicus
cttccttctagctgcc

SEQ ID NO: 500618 - DNA, 16 bp, R. norvegicus
cttccttctcacccaa

SEQ ID NO: 500619 - DNA, 16 bp, R. norvegicus
cttccttctccttcag

SEQ ID NO: 500620 - DNA, 16 bp, R. norvegicus
cttccttcttttctga

SEQ ID NO: 500621 - DNA, 16 bp, R. norvegicus
cttccttgagttcctg

SEQ ID NO: 500622 - DNA, 16 bp, R. norvegicus
cttccttgatttcttt

SEQ ID NO: 500623 - DNA, 24 bp, R. norvegicus
cttccttggacttctgtatgacgg

SEQ ID NO: 500624 - DNA, 16 bp, R. norvegicus
cttccttgtgtgtgtg

SEQ ID NO: 500625 - DNA, 16 bp, R. norvegicus
cttcctttccaaactg

SEQ ID NO: 500626 - DNA, 16 bp, R. norvegicus
cttcctttccagtctc

SEQ ID NO: 500627 - DNA, 17 bp, R. norvegicus
cttcctttcttggccct

SEQ ID NO: 500628 - DNA, 16 bp, R. norvegicus
cttcctttgatgatga

SEQ ID NO: 500629 - DNA, 16 bp, R. norvegicus
cttccttttgggtgtt

SEQ ID NO: 500630 - DNA, 16 bp, R. norvegicus
cttcgccttacagaag

SEQ ID NO: 500631 - DNA, 16 bp, R. norvegicus
cttcggcctctgtctc

SEQ ID NO: 500632 - DNA, 16 bp, R. norvegicus
cttctaactgggctgc

SEQ ID NO: 500633 - DNA, 16 bp, R. norvegicus
cttctaagaagaaatg

SEQ ID NO: 500634 - DNA, 16 bp, R. norvegicus
cttctacagtgttccc

SEQ ID NO: 500635 - DNA, 16 bp, R. norvegicus
cttctacccacccact

SEQ ID NO: 500636 - DNA, 16 bp, R. norvegicus
cttctactcctgggtg

SEQ ID NO: 500637 - DNA, 16 bp, R. norvegicus
cttctacttgcttatt

SEQ ID NO: 500638 - DNA, 16 bp, R. norvegicus
cttctagaagaacagc

SEQ ID NO: 500639 - DNA, 16 bp, R. norvegicus
cttctagaggccctga

SEQ ID NO: 500640 - DNA, 16 bp, R. norvegicus
cttctagccagaaact

SEQ ID NO: 500641 - DNA, 16 bp, R. norvegicus
cttctaggaaggtctg

SEQ ID NO: 500642 - DNA, 16 bp, R. norvegicus
cttctagtcctttctc

SEQ ID NO: 500643 - DNA, 16 bp, R. norvegicus
cttctatgaaggtcag

SEQ ID NO: 500644 - DNA, 16 bp, R. norvegicus
cttctatgtgggtgct

SEQ ID NO: 500645 - DNA, 16 bp, R. norvegicus
cttctcacctctgtgg

SEQ ID NO: 500646 - DNA, 16 bp, R. norvegicus
cttctcactgaacctg

SEQ ID NO: 500647 - DNA, 16 bp, R. norvegicus
cttctcagagaagaag

SEQ ID NO: 500648 - DNA, 16 bp, R. norvegicus
cttctcagaggagaag

SEQ ID NO: 500649 - DNA, 16 bp, R. norvegicus
cttctcagcaccttct

SEQ ID NO: 500650 - DNA, 16 bp, R. norvegicus
cttctcagcagagact

SEQ ID NO: 500651 - DNA, 16 bp, R. norvegicus
cttctcagccatttgc

SEQ ID NO: 500652 - DNA, 16 bp, R. norvegicus
cttctcagccttccta

SEQ ID NO: 500653 - DNA, 16 bp, R. norvegicus
cttctcaggcatttga

SEQ ID NO: 500654 - DNA, 16 bp, R. norvegicus
cttctcagtgagattc

SEQ ID NO: 500655 - DNA, 16 bp, R. norvegicus
cttctcagtgaggctg

SEQ ID NO: 500656 - DNA, 16 bp, R. norvegicus
cttctcagtgctggga

SEQ ID NO: 500657 - DNA, 16 bp, R. norvegicus
cttctcattatgtcct

SEQ ID NO: 500658 - DNA, 16 bp, R. norvegicus
cttctccaaaattgac

SEQ ID NO: 500659 - DNA, 16 bp, R. norvegicus
cttctccagaactgac

SEQ ID NO: 500660 - DNA, 16 bp, R. norvegicus
cttctccagctctgtc

SEQ ID NO: 500661 - DNA, 16 bp, R. norvegicus
cttctccagcttctcc

SEQ ID NO: 500662 - DNA, 16 bp, R. norvegicus
cttctccagggaagag

SEQ ID NO: 500663 - DNA, 16 bp, R. norvegicus
cttctccatcttgctg

SEQ ID NO: 500664 - DNA, 16 bp, R. norvegicus
cttctccatgctgtct

SEQ ID NO: 500665 - DNA, 28 bp, R. norvegicus
cttctcccaacatatggctggcctcttt

SEQ ID NO: 500666 - DNA, 16 bp, R. norvegicus
cttctcccagatcctc

SEQ ID NO: 500667 - DNA, 16 bp, R. norvegicus
cttctcccagcagcct

SEQ ID NO: 500668 - DNA, 16 bp, R. norvegicus
cttctcccagctactc

SEQ ID NO: 500669 - DNA, 16 bp, R. norvegicus
cttctcccattgatgt

SEQ ID NO: 500670 - DNA, 16 bp, R. norvegicus
cttctccctcccaaga

SEQ ID NO: 500671 - DNA, 16 bp, R. norvegicus
cttctccgtctccatc

SEQ ID NO: 500672 - DNA, 16 bp, R. norvegicus
cttctcctcagcacct

SEQ ID NO: 500673 - DNA, 16 bp, R. norvegicus
cttctcctcagcttcc

SEQ ID NO: 500674 - DNA, 16 bp, R. norvegicus
cttctcctccaatggc

SEQ ID NO: 500675 - DNA, 17 bp, R. norvegicus
cttctcctcctgagatt

SEQ ID NO: 500676 - DNA, 16 bp, R. norvegicus
cttctcctctgagcag

SEQ ID NO: 500677 - DNA, 16 bp, R. norvegicus
cttctcctgccattgg

SEQ ID NO: 500678 - DNA, 16 bp, R. norvegicus
cttctcctggcttcct

SEQ ID NO: 500679 - DNA, 16 bp, R. norvegicus
cttctcctgtttgcct

SEQ ID NO: 500680 - DNA, 16 bp, R. norvegicus
cttctccttgtgtcct

SEQ ID NO: 500681 - DNA, 16 bp, R. norvegicus
cttctccttttccaat

SEQ ID NO: 500682 - DNA, 16 bp, R. norvegicus
cttctctcagcagcca

SEQ ID NO: 500683 - DNA, 16 bp, R. norvegicus
cttctctcagggtgag

SEQ ID NO: 500684 - DNA, 16 bp, R. norvegicus
cttctctcgcccccca

SEQ ID NO: 500685 - DNA, 16 bp, R. norvegicus
cttctctcttggcctc

SEQ ID NO: 500686 - DNA, 16 bp, R. norvegicus
cttctctgaccaaggc

SEQ ID NO: 500687 - DNA, 16 bp, R. norvegicus
cttctctgacctcagt

SEQ ID NO: 500688 - DNA, 16 bp, R. norvegicus
cttctctgagaagaaa

SEQ ID NO: 500689 - DNA, 16 bp, R. norvegicus
cttctctgagaagaag

SEQ ID NO: 500690 - DNA, 16 bp, R. norvegicus
cttctctgagcctcag

SEQ ID NO: 500691 - DNA, 16 bp, R. norvegicus
cttctctgaggaaaag

SEQ ID NO: 500692 - DNA, 16 bp, R. norvegicus
cttctctgatgatggt

SEQ ID NO: 500693 - DNA, 16 bp, R. norvegicus
cttctctgctgctgtg

SEQ ID NO: 500694 - DNA, 16 bp, R. norvegicus
cttctctggcttcctc

SEQ ID NO: 500695 - DNA, 16 bp, R. norvegicus
cttctctgggtctgtg

SEQ ID NO: 500696 - DNA, 16 bp, R. norvegicus
cttctctgtctgtctc

SEQ ID NO: 500697 - DNA, 16 bp, R. norvegicus
cttctctgtgtctgtg

SEQ ID NO: 500698 - DNA, 16 bp, R. norvegicus
cttctctgtgtgtgca

SEQ ID NO: 500699 - DNA, 16 bp, R. norvegicus
cttctctgttcttgcc

SEQ ID NO: 500700 - DNA, 16 bp, R. norvegicus
cttctctgttgctatg

SEQ ID NO: 500701 - DNA, 16 bp, R. norvegicus
cttctcttcccactga

SEQ ID NO: 500702 - DNA, 16 bp, R. norvegicus
cttctcttggcttctc

SEQ ID NO: 500703 - DNA, 16 bp, R. norvegicus
cttctcttgggtccct

SEQ ID NO: 500704 - DNA, 16 bp, R. norvegicus
cttctgacttctgtgg

SEQ ID NO: 500705 - DNA, 16 bp, R. norvegicus
cttctgagaaggggga

SEQ ID NO: 500706 - DNA, 16 bp, R. norvegicus
cttctgagagagagag

SEQ ID NO: 500707 - DNA, 16 bp, R. norvegicus
cttctgagaggctcta

SEQ ID NO: 500708 - DNA, 16 bp, R. norvegicus
cttctgagagttcagc

SEQ ID NO: 500709 - DNA, 16 bp, R. norvegicus
cttctgaggaaaaaaa

SEQ ID NO: 500710 - DNA, 16 bp, R. norvegicus
cttctgagtgctgggg

SEQ ID NO: 500711 - DNA, 16 bp, R. norvegicus
cttctgatccttctgt

SEQ ID NO: 500712 - DNA, 16 bp, R. norvegicus
cttctgatcttcctac

SEQ ID NO: 500713 - DNA, 16 bp, R. norvegicus
cttctgatttctgcct

SEQ ID NO: 500714 - DNA, 16 bp, R. norvegicus
cttctgatttctgtgg

SEQ ID NO: 500715 - DNA, 16 bp, R. norvegicus
cttctgcaacacctgc

SEQ ID NO: 500716 - DNA, 16 bp, R. norvegicus
cttctgcacagcaaag

SEQ ID NO: 500717 - DNA, 16 bp, R. norvegicus
cttctgcactgggcag

SEQ ID NO: 500718 - DNA, 16 bp, R. norvegicus
cttctgcaggagcagc

SEQ ID NO: 500719 - DNA, 16 bp, R. norvegicus
cttctgcagtgttcct

SEQ ID NO: 500720 - DNA, 16 bp, R. norvegicus
cttctgcatcagcttc

SEQ ID NO: 500721 - DNA, 16 bp, R. norvegicus
cttctgcccaactttg

SEQ ID NO: 500722 - DNA, 16 bp, R. norvegicus
cttctgccctctgtgg

SEQ ID NO: 500723 - DNA, 16 bp, R. norvegicus
cttctgcctcagcctc

SEQ ID NO: 500724 - DNA, 16 bp, R. norvegicus
cttctgcctcagctcc

SEQ ID NO: 500725 - DNA, 16 bp, R. norvegicus
cttctgcctccacttc

SEQ ID NO: 500726 - DNA, 16 bp, R. norvegicus
cttctgcctcccaggt

SEQ ID NO: 500727 - DNA, 16 bp, R. norvegicus
cttctgcctctatttt

SEQ ID NO: 500728 - DNA, 16 bp, R. norvegicus
cttctgcctctgagat

SEQ ID NO: 500729 - DNA, 16 bp, R. norvegicus
cttctgcctctgagtg

SEQ ID NO: 500730 - DNA, 16 bp, R. norvegicus
cttctgcctctggagt

SEQ ID NO: 500731 - DNA, 16 bp, R. norvegicus
cttctgcctctgttct

SEQ ID NO: 500732 - DNA, 16 bp, R. norvegicus
cttctgccttacagaa

SEQ ID NO: 500733 - DNA, 16 bp, R. norvegicus
cttctgcctttatgtg

SEQ ID NO: 500734 - DNA, 16 bp, R. norvegicus
cttctgctccacaaaa

SEQ ID NO: 500735 - DNA, 16 bp, R. norvegicus
cttctgctccagagat

SEQ ID NO: 500736 - DNA, 16 bp, R. norvegicus
cttctgctccccagaa

SEQ ID NO: 500737 - DNA, 16 bp, R. norvegicus
cttctgctcctgcctc

SEQ ID NO: 500738 - DNA, 16 bp, R. norvegicus
cttctgctctgcagct

SEQ ID NO: 500739 - DNA, 16 bp, R. norvegicus
cttctgctgctgcttc

SEQ ID NO: 500740 - DNA, 16 bp, R. norvegicus
cttctgctgtccgagg

SEQ ID NO: 500741 - DNA, 16 bp, R. norvegicus
cttctgctgtgtgtgt

SEQ ID NO: 500742 - DNA, 16 bp, R. norvegicus
cttctgcttcagcttc

SEQ ID NO: 500743 - DNA, 16 bp, R. norvegicus
cttctgcttcagtccc

SEQ ID NO: 500744 - DNA, 16 bp, R. norvegicus
cttctgcttccacctc

SEQ ID NO: 500745 - DNA, 16 bp, R. norvegicus
cttctgcttcctgagt

SEQ ID NO: 500746 - DNA, 17 bp, R. norvegicus
cttctggaacaccagca

SEQ ID NO: 500747 - DNA, 16 bp, R. norvegicus
cttctggaagagcaaa

SEQ ID NO: 500748 - DNA, 16 bp, R. norvegicus
cttctggaagagcatt

SEQ ID NO: 500749 - DNA, 16 bp, R. norvegicus
cttctggaatgctggg

SEQ ID NO: 500750 - DNA, 16 bp, R. norvegicus
cttctggaatgttgct

SEQ ID NO: 500751 - DNA, 16 bp, R. norvegicus
cttctggacctgggct

SEQ ID NO: 500752 - DNA, 16 bp, R. norvegicus
cttctggaggacccaa

SEQ ID NO: 500753 - DNA, 16 bp, R. norvegicus
cttctggagtttcatg

SEQ ID NO: 500754 - DNA, 16 bp, R. norvegicus
cttctggattcccagg

SEQ ID NO: 500755 - DNA, 16 bp, R. norvegicus
cttctggcatccatgg

SEQ ID NO: 500756 - DNA, 16 bp, R. norvegicus
cttctggcctccacat

SEQ ID NO: 500757 - DNA, 16 bp, R. norvegicus
cttctggcctcctggg

SEQ ID NO: 500758 - DNA, 16 bp, R. norvegicus
cttctggcctctatgg

SEQ ID NO: 500759 - DNA, 16 bp, R. norvegicus
cttctggcctttatgg

SEQ ID NO: 500760 - DNA, 16 bp, R. norvegicus
cttctggcctttgcag

SEQ ID NO: 500761 - DNA, 16 bp, R. norvegicus
cttctggctgttacaa

SEQ ID NO: 500762 - DNA, 16 bp, R. norvegicus
cttctggcttccatgg

SEQ ID NO: 500763 - DNA, 16 bp, R. norvegicus
cttctggcttctggct

SEQ ID NO: 500764 - DNA, 16 bp, R. norvegicus
cttctggcttctgtgg

SEQ ID NO: 500765 - DNA, 16 bp, R. norvegicus
cttctggcttttagag

SEQ ID NO: 500766 - DNA, 16 bp, R. norvegicus
cttctgggacacaatg

SEQ ID NO: 500767 - DNA, 33 bp, R. norvegicus
cttctgggacaggcaggaactggccaggcaaat

SEQ ID NO: 500768 - DNA, 16 bp, R. norvegicus
cttctgggccatctct

SEQ ID NO: 500769 - DNA, 16 bp, R. norvegicus
cttctgggccctcccc

SEQ ID NO: 500770 - DNA, 16 bp, R. norvegicus
cttctgggctcttcca

SEQ ID NO: 500771 - DNA, 16 bp, R. norvegicus
cttctggggctggaga

SEQ ID NO: 500772 - DNA, 16 bp, R. norvegicus
cttctgggggctggag

SEQ ID NO: 500773 - DNA, 16 bp, R. norvegicus
cttctgggtgctggga

SEQ ID NO: 500774 - DNA, 16 bp, R. norvegicus
cttctggtccaccctc

SEQ ID NO: 500775 - DNA, 16 bp, R. norvegicus
cttctggtctccatct

SEQ ID NO: 500776 - DNA, 16 bp, R. norvegicus
cttctggtgtcccagg

SEQ ID NO: 500777 - DNA, 16 bp, R. norvegicus
cttctggtgtgtcaga

SEQ ID NO: 500778 - DNA, 16 bp, R. norvegicus
cttctggtgttcctgt

SEQ ID NO: 500779 - DNA, 16 bp, R. norvegicus
cttctggttcagtgag

SEQ ID NO: 500780 - DNA, 16 bp, R. norvegicus
cttctgtacctgttga

SEQ ID NO: 500781 - DNA, 16 bp, R. norvegicus
cttctgtctctacttc

SEQ ID NO: 500782 - DNA, 16 bp, R. norvegicus
cttctgtctctctgtc

SEQ ID NO: 500783 - DNA, 16 bp, R. norvegicus
cttctgtctgcaagca

SEQ ID NO: 500784 - DNA, 16 bp, R. norvegicus
cttctgtctgtgtgca

SEQ ID NO: 500785 - DNA, 16 bp, R. norvegicus
cttctgtgaggcaaag

SEQ ID NO: 500786 - DNA, 16 bp, R. norvegicus
cttctgtgatcttctt

SEQ ID NO: 500787 - DNA, 16 bp, R. norvegicus
cttctgtgatgtttcc

SEQ ID NO: 500788 - DNA, 16 bp, R. norvegicus
cttctgtgccaagcaa

SEQ ID NO: 500789 - DNA, 16 bp, R. norvegicus
cttctgtggttgaatt

SEQ ID NO: 500790 - DNA, 16 bp, R. norvegicus
cttctgtgtctggttt

SEQ ID NO: 500791 - DNA, 16 bp, R. norvegicus
cttctgtgtgctgact

SEQ ID NO: 500792 - DNA, 16 bp, R. norvegicus
cttctgtgtgggtgtt

SEQ ID NO: 500793 - DNA, 16 bp, R. norvegicus
cttctgttcctttaga

SEQ ID NO: 500794 - DNA, 16 bp, R. norvegicus
cttctgttgaaaatga

SEQ ID NO: 500795 - DNA, 16 bp, R. norvegicus
cttcttaaaatttaat

SEQ ID NO: 500796 - DNA, 16 bp, R. norvegicus
cttcttaaagtactct

SEQ ID NO: 500797 - DNA, 16 bp, R. norvegicus
cttcttcagcttcaga

SEQ ID NO: 500798 - DNA, 16 bp, R. norvegicus
cttcttcatcatcttc

SEQ ID NO: 500799 - DNA, 16 bp, R. norvegicus
cttcttcattctcctg

SEQ ID NO: 500800 - DNA, 16 bp, R. norvegicus
cttcttccaactcttc

SEQ ID NO: 500801 - DNA, 16 bp, R. norvegicus
cttcttcccagggatg

SEQ ID NO: 500802 - DNA, 16 bp, R. norvegicus
cttcttcccttccaat

SEQ ID NO: 500803 - DNA, 16 bp, R. norvegicus
cttcttcctcagcctc

SEQ ID NO: 500804 - DNA, 16 bp, R. norvegicus
cttcttcctctccaat

SEQ ID NO: 500805 - DNA, 16 bp, R. norvegicus
cttcttccttgccaat

SEQ ID NO: 500806 - DNA, 16 bp, R. norvegicus
cttcttctcagcagct

SEQ ID NO: 500807 - DNA, 16 bp, R. norvegicus
cttcttctctgagaag

SEQ ID NO: 500808 - DNA, 16 bp, R. norvegicus
cttcttctgcctcctg

SEQ ID NO: 500809 - DNA, 16 bp, R. norvegicus
cttcttctgtctattc

SEQ ID NO: 500810 - DNA, 16 bp, R. norvegicus
cttcttctgtgatgtc

SEQ ID NO: 500811 - DNA, 16 bp, R. norvegicus
cttcttcttcattgtc

SEQ ID NO: 500812 - DNA, 16 bp, R. norvegicus
cttcttcttctgctgc

SEQ ID NO: 500813 - DNA, 16 bp, R. norvegicus
cttcttcttcttcaaa

SEQ ID NO: 500814 - DNA, 16 bp, R. norvegicus
cttcttcttgatcttc

SEQ ID NO: 500815 - DNA, 16 bp, R. norvegicus
cttcttgagcttcagg

SEQ ID NO: 500816 - DNA, 16 bp, R. norvegicus
cttcttgcctcagtct

SEQ ID NO: 500817 - DNA, 16 bp, R. norvegicus
cttcttgctatagcag

SEQ ID NO: 500818 - DNA, 16 bp, R. norvegicus
cttcttggagaactct

SEQ ID NO: 500819 - DNA, 16 bp, R. norvegicus
cttcttggcaacagca

SEQ ID NO: 500820 - DNA, 16 bp, R. norvegicus
cttcttggcatctgaa

SEQ ID NO: 500821 - DNA, 16 bp, R. norvegicus
cttcttggctgcattt

SEQ ID NO: 500822 - DNA, 16 bp, R. norvegicus
cttcttgggcacacga

SEQ ID NO: 500823 - DNA, 16 bp, R. norvegicus
cttcttggggcctcca

SEQ ID NO: 500824 - DNA, 16 bp, R. norvegicus
cttcttgggtgtattt

SEQ ID NO: 500825 - DNA, 16 bp, R. norvegicus
cttcttggtcctctgt

SEQ ID NO: 500826 - DNA, 16 bp, R. norvegicus
cttcttggtgtgtgtg

SEQ ID NO: 500827 - DNA, 16 bp, R. norvegicus
cttcttgtccaatgat

SEQ ID NO: 500828 - DNA, 16 bp, R. norvegicus
cttcttgtgctcctcc

SEQ ID NO: 500829 - DNA, 16 bp, R. norvegicus
cttctttaaatgggga

SEQ ID NO: 500830 - DNA, 16 bp, R. norvegicus
cttctttcaatgatgg

SEQ ID NO: 500831 - DNA, 16 bp, R. norvegicus
cttctttccactggat

SEQ ID NO: 500832 - DNA, 16 bp, R. norvegicus
cttctttctcttgggc

SEQ ID NO: 500833 - DNA, 16 bp, R. norvegicus
cttctttgactgaacc

SEQ ID NO: 500834 - DNA, 16 bp, R. norvegicus
cttctttgaggagaag

SEQ ID NO: 500835 - DNA, 16 bp, R. norvegicus
cttctttgaggatgct

SEQ ID NO: 500836 - DNA, 16 bp, R. norvegicus
cttctttgcctgcctg

SEQ ID NO: 500837 - DNA, 16 bp, R. norvegicus
cttctttgggtctgtt

SEQ ID NO: 500838 - DNA, 16 bp, R. norvegicus
cttctttgtgtctgtg

SEQ ID NO: 500839 - DNA, 16 bp, R. norvegicus
cttcttttcctgggct

SEQ ID NO: 500840 - DNA, 16 bp, R. norvegicus
cttcttttggttatat

SEQ ID NO: 500841 - DNA, 16 bp, R. norvegicus
cttctttttgttctaa

SEQ ID NO: 500842 - DNA, 16 bp, R. norvegicus
cttgaaaaaaaattaa

SEQ ID NO: 500843 - DNA, 16 bp, R. norvegicus
cttgaaaaacaacaaa

SEQ ID NO: 500844 - DNA, 16 bp, R. norvegicus
cttgaaaatatcatct

SEQ ID NO: 500845 - DNA, 16 bp, R. norvegicus
cttgaaaccccagtga

SEQ ID NO: 500846 - DNA, 16 bp, R. norvegicus
cttgaaactcctctta

SEQ ID NO: 500847 - DNA, 16 bp, R. norvegicus
cttgaaagaaaaagaa

SEQ ID NO: 500848 - DNA, 16 bp, R. norvegicus
cttgaaatcacatcaa

SEQ ID NO: 500849 - DNA, 16 bp, R. norvegicus
cttgaacagaacacca

SEQ ID NO: 500850 - DNA, 16 bp, R. norvegicus
cttgaactaacagaga

SEQ ID NO: 500851 - DNA, 16 bp, R. norvegicus
cttgaactcacagagg

SEQ ID NO: 500852 - DNA, 16 bp, R. norvegicus
cttgaactcagagaac

SEQ ID NO: 500853 - DNA, 16 bp, R. norvegicus
cttgaactcagagatc

SEQ ID NO: 500854 - DNA, 16 bp, R. norvegicus
cttgaactcatagaga

SEQ ID NO: 500855 - DNA, 16 bp, R. norvegicus
cttgaactcctgacct

SEQ ID NO: 500856 - DNA, 16 bp, R. norvegicus
cttgaactgtgagctg

SEQ ID NO: 500857 - DNA, 16 bp, R. norvegicus
cttgaacttcatgtgg

SEQ ID NO: 500858 - DNA, 16 bp, R. norvegicus
cttgaacttgaacttg

SEQ ID NO: 500859 - DNA, 16 bp, R. norvegicus
cttgaagacccagcta

SEQ ID NO: 500860 - DNA, 16 bp, R. norvegicus
cttgaaggagctcaag

SEQ ID NO: 500861 - DNA, 18 bp, R. norvegicus
cttgaaggggctctagac

SEQ ID NO: 500862 - DNA, 16 bp, R. norvegicus
cttgaagttcttatca

SEQ ID NO: 500863 - DNA, 16 bp, R. norvegicus
cttgaatattgtaaac

SEQ ID NO: 500864 - DNA, 16 bp, R. norvegicus
cttgaattcagtttgc

SEQ ID NO: 500865 - DNA, 16 bp, R. norvegicus
cttgaattgcccaaga

SEQ ID NO: 500866 - DNA, 16 bp, R. norvegicus
cttgaatttagttttt

SEQ ID NO: 500867 - DNA, 16 bp, R. norvegicus
cttgacaacatcagaa

SEQ ID NO: 500868 - DNA, 16 bp, R. norvegicus
cttgacacaagctgga

SEQ ID NO: 500869 - DNA, 16 bp, R. norvegicus
cttgacattcttgtca

SEQ ID NO: 500870 - DNA, 16 bp, R. norvegicus
cttgacctcaagctgt

SEQ ID NO: 500871 - DNA, 16 bp, R. norvegicus
cttgaccttttcccct

SEQ ID NO: 500872 - DNA, 16 bp, R. norvegicus
cttgagaaacaggaag

SEQ ID NO: 500873 - DNA, 16 bp, R. norvegicus
cttgagaaacagggag

SEQ ID NO: 500874 - DNA, 16 bp, R. norvegicus
cttgagactgtgcctc

SEQ ID NO: 500875 - DNA, 16 bp, R. norvegicus
cttgagaggacacatg

SEQ ID NO: 500876 - DNA, 16 bp, R. norvegicus
cttgagatggaaccca

SEQ ID NO: 500877 - DNA, 16 bp, R. norvegicus
cttgagatggatccca

SEQ ID NO: 500878 - DNA, 16 bp, R. norvegicus
cttgagatggctcagt

SEQ ID NO: 500879 - DNA, 16 bp, R. norvegicus
cttgagcctctggacc

SEQ ID NO: 500880 - DNA, 16 bp, R. norvegicus
cttgagctcacagaga

SEQ ID NO: 500881 - DNA, 16 bp, R. norvegicus
cttgagctggatctca

SEQ ID NO: 500882 - DNA, 16 bp, R. norvegicus
cttgagctttgaacaa

SEQ ID NO: 500883 - DNA, 16 bp, R. norvegicus
cttgaggaagaaaggg

SEQ ID NO: 500884 - DNA, 16 bp, R. norvegicus
cttgaggagcaagcca

SEQ ID NO: 500885 - DNA, 19 bp, R. norvegicus
cttgaggaggaggtagctc

SEQ ID NO: 500886 - DNA, 16 bp, R. norvegicus
cttgaggcaggagctg

SEQ ID NO: 500887 - DNA, 16 bp, R. norvegicus
cttgaggctgaaagac

SEQ ID NO: 500888 - DNA, 16 bp, R. norvegicus
cttgaggtcaaagatg

SEQ ID NO: 500889 - DNA, 16 bp, R. norvegicus
cttgagtaattcttat

SEQ ID NO: 500890 - DNA, 16 bp, R. norvegicus
cttgagttcagtctcc

SEQ ID NO: 500891 - DNA, 16 bp, R. norvegicus
cttgatcaagttatca

SEQ ID NO: 500892 - DNA, 16 bp, R. norvegicus
cttgatccaaaggcaa

SEQ ID NO: 500893 - DNA, 16 bp, R. norvegicus
cttgatctttgaaaaa

SEQ ID NO: 500894 - DNA, 16 bp, R. norvegicus
cttgatgaaaagagac

SEQ ID NO: 500895 - DNA, 16 bp, R. norvegicus
cttgatgatcatggac

SEQ ID NO: 500896 - DNA, 16 bp, R. norvegicus
cttgatgttcttgtgg

SEQ ID NO: 500897 - DNA, 16 bp, R. norvegicus
cttgatgtttgtgcag

SEQ ID NO: 500898 - DNA, 16 bp, R. norvegicus
cttgattttgtgcagg

SEQ ID NO: 500899 - DNA, 16 bp, R. norvegicus
cttgatttttgacaga

SEQ ID NO: 500900 - DNA, 16 bp, R. norvegicus
cttgcaagacaagcac

SEQ ID NO: 500901 - DNA, 16 bp, R. norvegicus
cttgcacacaagcaga

SEQ ID NO: 500902 - DNA, 16 bp, R. norvegicus
cttgcacagacacaca

SEQ ID NO: 500903 - DNA, 16 bp, R. norvegicus
cttgcacatgcacaca

SEQ ID NO: 500904 - DNA, 16 bp, R. norvegicus
cttgcacttccacatt

SEQ ID NO: 500905 - DNA, 16 bp, R. norvegicus
cttgcagaagaccaga

SEQ ID NO: 500906 - DNA, 16 bp, R. norvegicus
cttgcagagaacccag

SEQ ID NO: 500907 - DNA, 16 bp, R. norvegicus
cttgcagaggatccag

SEQ ID NO: 500908 - DNA, 16 bp, R. norvegicus
cttgcagaggccctgg

SEQ ID NO: 500909 - DNA, 16 bp, R. norvegicus
cttgcagccaagcctg

SEQ ID NO: 500910 - DNA, 16 bp, R. norvegicus
cttgcaggagctggtt

SEQ ID NO: 500911 - DNA, 16 bp, R. norvegicus
cttgcaggcaaatgga

SEQ ID NO: 500912 - DNA, 16 bp, R. norvegicus
cttgcatacatacata

SEQ ID NO: 500913 - DNA, 16 bp, R. norvegicus
cttgcatttggaacat

SEQ ID NO: 500914 - DNA, 16 bp, R. norvegicus
cttgccaccaagcccg

SEQ ID NO: 500915 - DNA, 16 bp, R. norvegicus
cttgccagagaagcca

SEQ ID NO: 500916 - DNA, 16 bp, R. norvegicus
cttgccagagacctgg

SEQ ID NO: 500917 - DNA, 16 bp, R. norvegicus
cttgccagccagccag

SEQ ID NO: 500918 - DNA, 16 bp, R. norvegicus
cttgccagtcctgcct

SEQ ID NO: 500919 - DNA, 16 bp, R. norvegicus
cttgcccaaggtcaca

SEQ ID NO: 500920 - DNA, 16 bp, R. norvegicus
cttgcccacctctgtg

SEQ ID NO: 500921 - DNA, 16 bp, R. norvegicus
cttgcccccaagcctg

SEQ ID NO: 500922 - DNA, 16 bp, R. norvegicus
cttgccctctgtggct

SEQ ID NO: 500923 - DNA, 16 bp, R. norvegicus
cttgcctacagcctga

SEQ ID NO: 500924 - DNA, 29 bp, R. norvegicus
cttgcctagcaagtgcaaggccctgggtt

SEQ ID NO: 500925 - DNA, 16 bp, R. norvegicus
cttgcctcaaaaataa

SEQ ID NO: 500926 - DNA, 16 bp, R. norvegicus
cttgcctcagcacgtg

SEQ ID NO: 500927 - DNA, 16 bp, R. norvegicus
cttgcctcagcctcca

SEQ ID NO: 500928 - DNA, 16 bp, R. norvegicus
cttgcctcagcctcct

SEQ ID NO: 500929 - DNA, 16 bp, R. norvegicus
cttgcctccaagcctg

SEQ ID NO: 500930 - DNA, 16 bp, R. norvegicus
cttgcctcccaccatc

SEQ ID NO: 500931 - DNA, 16 bp, R. norvegicus
cttgcctcggaagcgc

SEQ ID NO: 500932 - DNA, 16 bp, R. norvegicus
cttgcctctcaccttc

SEQ ID NO: 500933 - DNA, 16 bp, R. norvegicus
cttgcctctgcctcct

SEQ ID NO: 500934 - DNA, 16 bp, R. norvegicus
cttgcctgcctgcttg

SEQ ID NO: 500935 - DNA, 16 bp, R. norvegicus
cttgcctgctcttggg

SEQ ID NO: 500936 - DNA, 16 bp, R. norvegicus
cttgcctgtaatccca

SEQ ID NO: 500937 - DNA, 16 bp, R. norvegicus
cttgcctttaacaaca

SEQ ID NO: 500938 - DNA, 16 bp, R. norvegicus
cttgcctttgcttcct

SEQ ID NO: 500939 - DNA, 16 bp, R. norvegicus
cttgcgcacacacaca

SEQ ID NO: 500940 - DNA, 16 bp, R. norvegicus
cttgctactctttcag

SEQ ID NO: 500941 - DNA, 16 bp, R. norvegicus
cttgctagccaataga

SEQ ID NO: 500942 - DNA, 22 bp, R. norvegicus
cttgctaggcaagcgctctacc

SEQ ID NO: 500943 - DNA, 16 bp, R. norvegicus
cttgctcagagtcact

SEQ ID NO: 500944 - DNA, 16 bp, R. norvegicus
cttgctcagccatcat

SEQ ID NO: 500945 - DNA, 16 bp, R. norvegicus
cttgctctccctggct

SEQ ID NO: 500946 - DNA, 16 bp, R. norvegicus
cttgctctggggatcc

SEQ ID NO: 500947 - DNA, 16 bp, R. norvegicus
cttgctcttcctgctg

SEQ ID NO: 500948 - DNA, 16 bp, R. norvegicus
cttgctgacaggggcc

SEQ ID NO: 500949 - DNA, 16 bp, R. norvegicus
cttgctgctcttgcaa

SEQ ID NO: 500950 - DNA, 16 bp, R. norvegicus
cttgctgcttactata

SEQ ID NO: 500951 - DNA, 16 bp, R. norvegicus
cttgctgcttctgctg

SEQ ID NO: 500952 - DNA, 16 bp, R. norvegicus
cttgctgctttagtct

SEQ ID NO: 500953 - DNA, 16 bp, R. norvegicus
cttgctggagaagact

SEQ ID NO: 500954 - DNA, 16 bp, R. norvegicus
cttgctggaggaactg

SEQ ID NO: 500955 - DNA, 16 bp, R. norvegicus
cttgctggccaaccag

SEQ ID NO: 500956 - DNA, 16 bp, R. norvegicus
cttgctggccagccag

SEQ ID NO: 500957 - DNA, 16 bp, R. norvegicus
cttgctgggtaccaat

SEQ ID NO: 500958 - DNA, 16 bp, R. norvegicus
cttgctgtctctgact

SEQ ID NO: 500959 - DNA, 16 bp, R. norvegicus
cttgctgtctctgtct

SEQ ID NO: 500960 - DNA, 16 bp, R. norvegicus
cttgctgtgcaagtgt

SEQ ID NO: 500961 - DNA, 16 bp, R. norvegicus
cttgctgtgtctgaca

SEQ ID NO: 500962 - DNA, 16 bp, R. norvegicus
cttgctgtgtgacctt

SEQ ID NO: 500963 - DNA, 16 bp, R. norvegicus
cttgctgtttctcctg

SEQ ID NO: 500964 - DNA, 16 bp, R. norvegicus
cttgctgtttctctgt

SEQ ID NO: 500965 - DNA, 16 bp, R. norvegicus
cttgctgtttcttctg

SEQ ID NO: 500966 - DNA, 16 bp, R. norvegicus
cttgcttacccatcag

SEQ ID NO: 500967 - DNA, 16 bp, R. norvegicus
cttgcttacttactta

SEQ ID NO: 500968 - DNA, 16 bp, R. norvegicus
cttgcttccctggcat

SEQ ID NO: 500969 - DNA, 16 bp, R. norvegicus
cttgcttctctggtgt

SEQ ID NO: 500970 - DNA, 16 bp, R. norvegicus
cttgcttctgcctccc

SEQ ID NO: 500971 - DNA, 16 bp, R. norvegicus
cttgcttcttctgtgg

SEQ ID NO: 500972 - DNA, 16 bp, R. norvegicus
cttgcttggcctgctt

SEQ ID NO: 500973 - DNA, 16 bp, R. norvegicus
cttgcttgtgccttcc

SEQ ID NO: 500974 - DNA, 16 bp, R. norvegicus
cttgcttgtttgttta

SEQ ID NO: 500975 - DNA, 16 bp, R. norvegicus
cttgctttctccatct

SEQ ID NO: 500976 - DNA, 16 bp, R. norvegicus
cttgcttttaaactat

SEQ ID NO: 500977 - DNA, 16 bp, R. norvegicus
cttgcttttccttggg

SEQ ID NO: 500978 - DNA, 16 bp, R. norvegicus
cttgctttttggtcct

SEQ ID NO: 500979 - DNA, 16 bp, R. norvegicus
cttggaaaaccaaaaa

SEQ ID NO: 500980 - DNA, 16 bp, R. norvegicus
cttggaaaactgtttt

SEQ ID NO: 500981 - DNA, 16 bp, R. norvegicus
cttggaaaatagtttt

SEQ ID NO: 500982 - DNA, 16 bp, R. norvegicus
cttggaaagactgcct

SEQ ID NO: 500983 - DNA, 16 bp, R. norvegicus
cttggaaagcagaggc

SEQ ID NO: 500984 - DNA, 16 bp, R. norvegicus
cttggaactaaagtta

SEQ ID NO: 500985 - DNA, 16 bp, R. norvegicus
cttggaaggctgaggc

SEQ ID NO: 500986 - DNA, 16 bp, R. norvegicus
cttggaaggtggaggc

SEQ ID NO: 500987 - DNA, 16 bp, R. norvegicus
cttggaatccacaata

SEQ ID NO: 500988 - DNA, 16 bp, R. norvegicus
cttggacattttatgt

SEQ ID NO: 500989 - DNA, 16 bp, R. norvegicus
cttggacttgagattt

SEQ ID NO: 500990 - DNA, 16 bp, R. norvegicus
cttggacttgagcatt

SEQ ID NO: 500991 - DNA, 16 bp, R. norvegicus
cttggagaaaaaaaaa

SEQ ID NO: 500992 - DNA, 16 bp, R. norvegicus
cttggagaaaagaaca

SEQ ID NO: 500993 - DNA, 16 bp, R. norvegicus
cttggagacccttctc

SEQ ID NO: 500994 - DNA, 16 bp, R. norvegicus
cttggagaggacctgg

SEQ ID NO: 500995 - DNA, 16 bp, R. norvegicus
cttggagatctacctg

SEQ ID NO: 500996 - DNA, 16 bp, R. norvegicus
cttggagctatgagtt

SEQ ID NO: 500997 - DNA, 16 bp, R. norvegicus
cttggagctgaggacc

SEQ ID NO: 500998 - DNA, 16 bp, R. norvegicus
cttggaggacagaaga

SEQ ID NO: 500999 - DNA, 16 bp, R. norvegicus
cttggaggaggtgtgg

SEQ ID NO: 501000 - DNA, 16 bp, R. norvegicus
cttggaggcaagagct

SEQ ID NO: 501001 - DNA, 16 bp, R. norvegicus
cttggaggcctgctct

SEQ ID NO: 501002 - DNA, 16 bp, R. norvegicus
cttggaggctggagag

SEQ ID NO: 501003 - DNA, 16 bp, R. norvegicus
cttggagtgtttccct

SEQ ID NO: 501004 - DNA, 16 bp, R. norvegicus
cttggagttcttgtca

SEQ ID NO: 501005 - DNA, 16 bp, R. norvegicus
cttggatcctgaagaa

SEQ ID NO: 501006 - DNA, 16 bp, R. norvegicus
cttggcaagctccagg

SEQ ID NO: 501007 - DNA, 16 bp, R. norvegicus
cttggcaggacaaagg

SEQ ID NO: 501008 - DNA, 16 bp, R. norvegicus
cttggcaggaccaggg

SEQ ID NO: 501009 - DNA, 16 bp, R. norvegicus
cttggcattcctcagc

SEQ ID NO: 501010 - DNA, 16 bp, R. norvegicus
cttggcattcttgtac

SEQ ID NO: 501011 - DNA, 16 bp, R. norvegicus
cttggccagcagcacc

SEQ ID NO: 501012 - DNA, 16 bp, R. norvegicus
cttggccattcgagat

SEQ ID NO: 501013 - DNA, 16 bp, R. norvegicus
cttggcccagagagta

SEQ ID NO: 501014 - DNA, 16 bp, R. norvegicus
cttggcccagggggtg

SEQ ID NO: 501015 - DNA, 16 bp, R. norvegicus
cttggcccagggtgtg

SEQ ID NO: 501016 - DNA, 16 bp, R. norvegicus
cttggcccggggagtg

SEQ ID NO: 501017 - DNA, 16 bp, R. norvegicus
cttggctacatagcaa

SEQ ID NO: 501018 - DNA, 16 bp, R. norvegicus
cttggctacctcaaag

SEQ ID NO: 501019 - DNA, 16 bp, R. norvegicus
cttggctatcctagaa

SEQ ID NO: 501020 - DNA, 16 bp, R. norvegicus
cttggctccaactgca

SEQ ID NO: 501021 - DNA, 16 bp, R. norvegicus
cttggctctgtgaagg

SEQ ID NO: 501022 - DNA, 16 bp, R. norvegicus
cttggctcttccagca

SEQ ID NO: 501023 - DNA, 16 bp, R. norvegicus
cttggctgctgtcttg

SEQ ID NO: 501024 - DNA, 16 bp, R. norvegicus
cttggcttgtttctgc

SEQ ID NO: 501025 - DNA, 16 bp, R. norvegicus
cttggctttcttcatg

SEQ ID NO: 501026 - DNA, 16 bp, R. norvegicus
cttgggaagaaagggt

SEQ ID NO: 501027 - DNA, 16 bp, R. norvegicus
cttgggaatttaccac

SEQ ID NO: 501028 - DNA, 16 bp, R. norvegicus
cttgggacacagaggc

SEQ ID NO: 501029 - DNA, 16 bp, R. norvegicus
cttgggagacaggcag

SEQ ID NO: 501030 - DNA, 16 bp, R. norvegicus
cttgggagagagaact

SEQ ID NO: 501031 - DNA, 16 bp, R. norvegicus
cttgggagagatctac

SEQ ID NO: 501032 - DNA, 16 bp, R. norvegicus
cttgggagcctgaggc

SEQ ID NO: 501033 - DNA, 16 bp, R. norvegicus
cttgggaggaagagaa

SEQ ID NO: 501034 - DNA, 16 bp, R. norvegicus
cttgggatacccaaga

SEQ ID NO: 501035 - DNA, 16 bp, R. norvegicus
cttgggatggtgattt

SEQ ID NO: 501036 - DNA, 16 bp, R. norvegicus
cttgggcactggggaa

SEQ ID NO: 501037 - DNA, 16 bp, R. norvegicus
cttgggcagcagaggc

SEQ ID NO: 501038 - DNA, 16 bp, R. norvegicus
cttgggccctccttgt

SEQ ID NO: 501039 - DNA, 16 bp, R. norvegicus
cttgggcctggagaga

SEQ ID NO: 501040 - DNA, 16 bp, R. norvegicus
cttggggaagcagaat

SEQ ID NO: 501041 - DNA, 16 bp, R. norvegicus
cttggggagcagaggc

SEQ ID NO: 501042 - DNA, 16 bp, R. norvegicus
cttggggcagcagaat

SEQ ID NO: 501043 - DNA, 16 bp, R. norvegicus
cttggggtctccaaag

SEQ ID NO: 501044 - DNA, 16 bp, R. norvegicus
cttggggttggagaga

SEQ ID NO: 501045 - DNA, 16 bp, R. norvegicus
cttgggtaccactcca

SEQ ID NO: 501046 - DNA, 16 bp, R. norvegicus
cttgggtattctgagc

SEQ ID NO: 501047 - DNA, 16 bp, R. norvegicus
cttgggtatttcttct

SEQ ID NO: 501048 - DNA, 16 bp, R. norvegicus
cttgggtctgtttgct

SEQ ID NO: 501049 - DNA, 16 bp, R. norvegicus
cttgggtttatttatt

SEQ ID NO: 501050 - DNA, 16 bp, R. norvegicus
cttggtactgtgaagg

SEQ ID NO: 501051 - DNA, 16 bp, R. norvegicus
cttggtcagagtcaca

SEQ ID NO: 501052 - DNA, 16 bp, R. norvegicus
cttggtccaggaagtg

SEQ ID NO: 501053 - DNA, 16 bp, R. norvegicus
cttggtccccaggtgg

SEQ ID NO: 501054 - DNA, 16 bp, R. norvegicus
cttggtccctcctgct

SEQ ID NO: 501055 - DNA, 16 bp, R. norvegicus
cttggtccctctgctg

SEQ ID NO: 501056 - DNA, 16 bp, R. norvegicus
cttggtcttcagttct

SEQ ID NO: 501057 - DNA, 16 bp, R. norvegicus
cttggtcttcctgtgg

SEQ ID NO: 501058 - DNA, 16 bp, R. norvegicus
cttggtggaggaggtg

SEQ ID NO: 501059 - DNA, 16 bp, R. norvegicus
cttggtggcaaatgcc

SEQ ID NO: 501060 - DNA, 17 bp, R. norvegicus
cttggtggtagcagctg

SEQ ID NO: 501061 - DNA, 16 bp, R. norvegicus
cttggtgtgactccaa

SEQ ID NO: 501062 - DNA, 16 bp, R. norvegicus
cttggttctgttgctt

SEQ ID NO: 501063 - DNA, 16 bp, R. norvegicus
cttggttgacttcagc

SEQ ID NO: 501064 - DNA, 16 bp, R. norvegicus
cttggttggagtcaca

SEQ ID NO: 501065 - DNA, 16 bp, R. norvegicus
cttgtaatccttctgc

SEQ ID NO: 501066 - DNA, 16 bp, R. norvegicus
cttgtacttcctgctg

SEQ ID NO: 501067 - DNA, 16 bp, R. norvegicus
cttgtagcccaggctg

SEQ ID NO: 501068 - DNA, 16 bp, R. norvegicus
cttgtataatcccttt

SEQ ID NO: 501069 - DNA, 16 bp, R. norvegicus
cttgtatattatctga

SEQ ID NO: 501070 - DNA, 16 bp, R. norvegicus
cttgtatgtctgtggg

SEQ ID NO: 501071 - DNA, 16 bp, R. norvegicus
cttgtatttggaacat

SEQ ID NO: 501072 - DNA, 16 bp, R. norvegicus
cttgtcaccctcagcc

SEQ ID NO: 501073 - DNA, 16 bp, R. norvegicus
cttgtcagaaccaagg

SEQ ID NO: 501074 - DNA, 16 bp, R. norvegicus
cttgtcattgttgtac

SEQ ID NO: 501075 - DNA, 16 bp, R. norvegicus
cttgtcccaaggaact

SEQ ID NO: 501076 - DNA, 17 bp, R. norvegicus
cttgtcccccattctct

SEQ ID NO: 501077 - DNA, 16 bp, R. norvegicus
cttgtcctgggcttcc

SEQ ID NO: 501078 - DNA, 16 bp, R. norvegicus
cttgtccttcctgtgg

SEQ ID NO: 501079 - DNA, 16 bp, R. norvegicus
cttgtctacaaagcaa

SEQ ID NO: 501080 - DNA, 16 bp, R. norvegicus
cttgtctacacacaca

SEQ ID NO: 501081 - DNA, 16 bp, R. norvegicus
cttgtctacctctctg

SEQ ID NO: 501082 - DNA, 16 bp, R. norvegicus
cttgtctattccctga

SEQ ID NO: 501083 - DNA, 16 bp, R. norvegicus
cttgtctcccactgtc

SEQ ID NO: 501084 - DNA, 16 bp, R. norvegicus
cttgtctccctgcagt

SEQ ID NO: 501085 - DNA, 16 bp, R. norvegicus
cttgtctgacctcagt

SEQ ID NO: 501086 - DNA, 16 bp, R. norvegicus
cttgtctgcctttctg

SEQ ID NO: 501087 - DNA, 16 bp, R. norvegicus
cttgtctggtccctga

SEQ ID NO: 501088 - DNA, 16 bp, R. norvegicus
cttgtcttcagctgtt

SEQ ID NO: 501089 - DNA, 16 bp, R. norvegicus
cttgtcttcctgtctc

SEQ ID NO: 501090 - DNA, 16 bp, R. norvegicus
cttgtgactttgtttc

SEQ ID NO: 501091 - DNA, 16 bp, R. norvegicus
cttgtgagccaccgtg

SEQ ID NO: 501092 - DNA, 16 bp, R. norvegicus
cttgtgatttggtctg

SEQ ID NO: 501093 - DNA, 16 bp, R. norvegicus
cttgtgcatgcatgtg

SEQ ID NO: 501094 - DNA, 16 bp, R. norvegicus
cttgtgccaccactgc

SEQ ID NO: 501095 - DNA, 16 bp, R. norvegicus
cttgtggaagccagaa

SEQ ID NO: 501096 - DNA, 16 bp, R. norvegicus
cttgtggagacaggag

SEQ ID NO: 501097 - DNA, 16 bp, R. norvegicus
cttgtggagactgggg

SEQ ID NO: 501098 - DNA, 16 bp, R. norvegicus
cttgtggatcaagata

SEQ ID NO: 501099 - DNA, 16 bp, R. norvegicus
cttgtggccagggtcc

SEQ ID NO: 501100 - DNA, 16 bp, R. norvegicus
cttgtggctgtgttct

SEQ ID NO: 501101 - DNA, 16 bp, R. norvegicus
cttgtgggagctggtt

SEQ ID NO: 501102 - DNA, 16 bp, R. norvegicus
cttgtgggtctcacat

SEQ ID NO: 501103 - DNA, 16 bp, R. norvegicus
cttgtgtatatgtgtg

SEQ ID NO: 501104 - DNA, 16 bp, R. norvegicus
cttgtgtctgcctccc

SEQ ID NO: 501105 - DNA, 16 bp, R. norvegicus
cttgtgtgaggtgaaa

SEQ ID NO: 501106 - DNA, 16 bp, R. norvegicus
cttgtgtgtgcacaca

SEQ ID NO: 501107 - DNA, 16 bp, R. norvegicus
cttgtgttcctgtgct

SEQ ID NO: 501108 - DNA, 16 bp, R. norvegicus
cttgtgttgtggtgac

SEQ ID NO: 501109 - DNA, 16 bp, R. norvegicus
cttgttagaaaacaaa

SEQ ID NO: 501110 - DNA, 16 bp, R. norvegicus
cttgttagggcaccag

SEQ ID NO: 501111 - DNA, 16 bp, R. norvegicus
cttgttcatttatgat

SEQ ID NO: 501112 - DNA, 16 bp, R. norvegicus
cttgttccaatgtctg

SEQ ID NO: 501113 - DNA, 16 bp, R. norvegicus
cttgttccacatcctt

SEQ ID NO: 501114 - DNA, 16 bp, R. norvegicus
cttgttcctcaacagt

SEQ ID NO: 501115 - DNA, 16 bp, R. norvegicus
cttgttctcctggtgt

SEQ ID NO: 501116 - DNA, 16 bp, R. norvegicus
cttgttcttgtaagga

SEQ ID NO: 501117 - DNA, 16 bp, R. norvegicus
cttgttgattttgtca

SEQ ID NO: 501118 - DNA, 16 bp, R. norvegicus
cttgttgctgctgctg

SEQ ID NO: 501119 - DNA, 16 bp, R. norvegicus
cttgttgctgttgctg

SEQ ID NO: 501120 - DNA, 16 bp, R. norvegicus
cttgttggaagaagtt

SEQ ID NO: 501121 - DNA, 16 bp, R. norvegicus
cttgttggagaaaatg

SEQ ID NO: 501122 - DNA, 16 bp, R. norvegicus
cttgttggagaaagta

SEQ ID NO: 501123 - DNA, 16 bp, R. norvegicus
cttgttgttgctgctg

SEQ ID NO: 501124 - DNA, 16 bp, R. norvegicus
cttgtttgcttctatt

SEQ ID NO: 501125 - DNA, 20 bp, R. norvegicus
cttgttttctcaccatccca

SEQ ID NO: 501126 - DNA, 19 bp, R. norvegicus
cttgttttgatttgcattt

SEQ ID NO: 501127 - DNA, 16 bp, R. norvegicus
cttgttttgttgccaa

SEQ ID NO: 501128 - DNA, 16 bp, R. norvegicus
cttgtttttccattgt

SEQ ID NO: 501129 - DNA, 16 bp, R. norvegicus
ctttaaaaaaaaaagt

SEQ ID NO: 501130 - DNA, 16 bp, R. norvegicus
ctttaaaaaaaatgaa

SEQ ID NO: 501131 - DNA, 16 bp, R. norvegicus
ctttaaaaaatgttta

SEQ ID NO: 501132 - DNA, 16 bp, R. norvegicus
ctttaaaaacagaaat

SEQ ID NO: 501133 - DNA, 16 bp, R. norvegicus
ctttaaaaacattttt

SEQ ID NO: 501134 - DNA, 16 bp, R. norvegicus
ctttaaaaaggaaaca

SEQ ID NO: 501135 - DNA, 16 bp, R. norvegicus
ctttaaaaatgttatt

SEQ ID NO: 501136 - DNA, 16 bp, R. norvegicus
ctttaaaagtttattt

SEQ ID NO: 501137 - DNA, 16 bp, R. norvegicus
ctttaaaatattttca

SEQ ID NO: 501138 - DNA, 16 bp, R. norvegicus
ctttaaagaaaactga

SEQ ID NO: 501139 - DNA, 16 bp, R. norvegicus
ctttaaagaagaaaca

SEQ ID NO: 501140 - DNA, 17 bp, R. norvegicus
ctttaaattccccttct

SEQ ID NO: 501141 - DNA, 16 bp, R. norvegicus
ctttaaatttttcaaa

SEQ ID NO: 501142 - DNA, 16 bp, R. norvegicus
ctttaaccccagcgct

SEQ ID NO: 501143 - DNA, 16 bp, R. norvegicus
ctttaactccagttcc

SEQ ID NO: 501144 - DNA, 16 bp, R. norvegicus
ctttaacttcccttct

SEQ ID NO: 501145 - DNA, 16 bp, R. norvegicus
ctttaagaaaatcaac

SEQ ID NO: 501146 - DNA, 16 bp, R. norvegicus
ctttaagaaataaaaa

SEQ ID NO: 501147 - DNA, 16 bp, R. norvegicus
ctttaagacagacata

SEQ ID NO: 501148 - DNA, 16 bp, R. norvegicus
ctttaagatcaagaat

SEQ ID NO: 501149 - DNA, 16 bp, R. norvegicus
ctttaaggaaatgatg

SEQ ID NO: 501150 - DNA, 16 bp, R. norvegicus
ctttaaggggctggag

SEQ ID NO: 501151 - DNA, 16 bp, R. norvegicus
ctttaagttcttctca

SEQ ID NO: 501152 - DNA, 16 bp, R. norvegicus
ctttaataagggttct

SEQ ID NO: 501153 - DNA, 16 bp, R. norvegicus
ctttaatacagttcct

SEQ ID NO: 501154 - DNA, 16 bp, R. norvegicus
ctttaatacagttctt

SEQ ID NO: 501155 - DNA, 16 bp, R. norvegicus
ctttaatcccaacagt

SEQ ID NO: 501156 - DNA, 16 bp, R. norvegicus
ctttaatcccagcact

SEQ ID NO: 501157 - DNA, 16 bp, R. norvegicus
ctttaatcccagtact

SEQ ID NO: 501158 - DNA, 16 bp, R. norvegicus
ctttaatcctaacact

SEQ ID NO: 501159 - DNA, 16 bp, R. norvegicus
ctttaatcctagcact

SEQ ID NO: 501160 - DNA, 16 bp, R. norvegicus
ctttaatctcagcact

SEQ ID NO: 501161 - DNA, 16 bp, R. norvegicus
ctttaatctcagtgct

SEQ ID NO: 501162 - DNA, 16 bp, R. norvegicus
ctttacaatagcacag

SEQ ID NO: 501163 - DNA, 16 bp, R. norvegicus
ctttacacaggagcaa

SEQ ID NO: 501164 - DNA, 17 bp, R. norvegicus
ctttacagatggttgtg

SEQ ID NO: 501165 - DNA, 16 bp, R. norvegicus
ctttacaggttgttac

SEQ ID NO: 501166 - DNA, 16 bp, R. norvegicus
ctttacattatttttg

SEQ ID NO: 501167 - DNA, 16 bp, R. norvegicus
ctttaccaaaagcaat

SEQ ID NO: 501168 - DNA, 16 bp, R. norvegicus
ctttaccaattgtaca

SEQ ID NO: 501169 - DNA, 16 bp, R. norvegicus
ctttaccagtttcctg

SEQ ID NO: 501170 - DNA, 16 bp, R. norvegicus
ctttacccgctgagcc

SEQ ID NO: 501171 - DNA, 16 bp, R. norvegicus
ctttacctgctcagcc

SEQ ID NO: 501172 - DNA, 16 bp, R. norvegicus
ctttacctgctgatcc

SEQ ID NO: 501173 - DNA, 16 bp, R. norvegicus
ctttactgactgagcc

SEQ ID NO: 501174 - DNA, 16 bp, R. norvegicus
ctttactgactgagtc

SEQ ID NO: 501175 - DNA, 16 bp, R. norvegicus
ctttactgtttttaat

SEQ ID NO: 501176 - DNA, 16 bp, R. norvegicus
ctttagaaaagaacag

SEQ ID NO: 501177 - DNA, 16 bp, R. norvegicus
ctttagacaggagaaa

SEQ ID NO: 501178 - DNA, 16 bp, R. norvegicus
ctttagcctctgttct

SEQ ID NO: 501179 - DNA, 16 bp, R. norvegicus
ctttagcttcttcagt

SEQ ID NO: 501180 - DNA, 16 bp, R. norvegicus
ctttaggtgcttctca

SEQ ID NO: 501181 - DNA, 16 bp, R. norvegicus
ctttaggtgtttctaa

SEQ ID NO: 501182 - DNA, 17 bp, R. norvegicus
ctttaggtgtttctctg

SEQ ID NO: 501183 - DNA, 16 bp, R. norvegicus
ctttagtcccagcgct

SEQ ID NO: 501184 - DNA, 16 bp, R. norvegicus
ctttagtgcttctcag

SEQ ID NO: 501185 - DNA, 16 bp, R. norvegicus
ctttatagtatttggg

SEQ ID NO: 501186 - DNA, 16 bp, R. norvegicus
ctttatatattttgca

SEQ ID NO: 501187 - DNA, 16 bp, R. norvegicus
ctttatccacatcctc

SEQ ID NO: 501188 - DNA, 22 bp, R. norvegicus
ctttatcccgatccctgttgat

SEQ ID NO: 501189 - DNA, 16 bp, R. norvegicus
ctttatgaaattcata

SEQ ID NO: 501190 - DNA, 16 bp, R. norvegicus
ctttatgatattcata

SEQ ID NO: 501191 - DNA, 16 bp, R. norvegicus
ctttatgtagctctgg

SEQ ID NO: 501192 - DNA, 17 bp, R. norvegicus
ctttatgtcagcctcca

SEQ ID NO: 501193 - DNA, 16 bp, R. norvegicus
ctttattaatccttat

SEQ ID NO: 501194 - DNA, 16 bp, R. norvegicus
ctttattcccagcact

SEQ ID NO: 501195 - DNA, 16 bp, R. norvegicus
ctttattttttaagat

SEQ ID NO: 501196 - DNA, 16 bp, R. norvegicus
ctttcaaaaaagaaaa

SEQ ID NO: 501197 - DNA, 16 bp, R. norvegicus
ctttcaaaatatttta

SEQ ID NO: 501198 - DNA, 16 bp, R. norvegicus
ctttcaacagaagaat

SEQ ID NO: 501199 - DNA, 16 bp, R. norvegicus
ctttcaatgcttcctc

SEQ ID NO: 501200 - DNA, 16 bp, R. norvegicus
ctttcacaggggtctc

SEQ ID NO: 501201 - DNA, 16 bp, R. norvegicus
ctttcacttgcttcgt

SEQ ID NO: 501202 - DNA, 16 bp, R. norvegicus
ctttcagaaaagaaaa

SEQ ID NO: 501203 - DNA, 16 bp, R. norvegicus
ctttcagaaagaaaaa

SEQ ID NO: 501204 - DNA, 16 bp, R. norvegicus
ctttcagaaaggaaga

SEQ ID NO: 501205 - DNA, 16 bp, R. norvegicus
ctttcagaggactgga

SEQ ID NO: 501206 - DNA, 16 bp, R. norvegicus
ctttcagatgattcta

SEQ ID NO: 501207 - DNA, 16 bp, R. norvegicus
ctttcagccaaaagtc

SEQ ID NO: 501208 - DNA, 16 bp, R. norvegicus
ctttcagccagatatg

SEQ ID NO: 501209 - DNA, 16 bp, R. norvegicus
ctttcagccatgatgg

SEQ ID NO: 501210 - DNA, 16 bp, R. norvegicus
ctttcagctcctcctg

SEQ ID NO: 501211 - DNA, 16 bp, R. norvegicus
ctttcagctctcagca

SEQ ID NO: 501212 - DNA, 16 bp, R. norvegicus
ctttcaggagacagct

SEQ ID NO: 501213 - DNA, 16 bp, R. norvegicus
ctttcaggttcaggcg

SEQ ID NO: 501214 - DNA, 16 bp, R. norvegicus
ctttcagtcagttatt

SEQ ID NO: 501215 - DNA, 16 bp, R. norvegicus
ctttcagtcctttcac

SEQ ID NO: 501216 - DNA, 16 bp, R. norvegicus
ctttcagtgatgaaca

SEQ ID NO: 501217 - DNA, 16 bp, R. norvegicus
ctttcagtgctgggat

SEQ ID NO: 501218 - DNA, 16 bp, R. norvegicus
ctttcagtgtctgctc

SEQ ID NO: 501219 - DNA, 16 bp, R. norvegicus
ctttcagttccttcag

SEQ ID NO: 501220 - DNA, 16 bp, R. norvegicus
ctttcattgtgcccca

SEQ ID NO: 501221 - DNA, 16 bp, R. norvegicus
ctttcattttgtctca

SEQ ID NO: 501222 - DNA, 16 bp, R. norvegicus
ctttccaacttgggcc

SEQ ID NO: 501223 - DNA, 16 bp, R. norvegicus
ctttccagatgactct

SEQ ID NO: 501224 - DNA, 16 bp, R. norvegicus
ctttcccactggcctt

SEQ ID NO: 501225 - DNA, 16 bp, R. norvegicus
ctttcccagtatccag

SEQ ID NO: 501226 - DNA, 16 bp, R. norvegicus
ctttcccagtttccat

SEQ ID NO: 501227 - DNA, 16 bp, R. norvegicus
ctttcccctgcttcta

SEQ ID NO: 501228 - DNA, 16 bp, R. norvegicus
ctttccctcaatttct

SEQ ID NO: 501229 - DNA, 16 bp, R. norvegicus
ctttcctagttgtggt

SEQ ID NO: 501230 - DNA, 16 bp, R. norvegicus
ctttcctcaccaaaca

SEQ ID NO: 501231 - DNA, 16 bp, R. norvegicus
ctttcctctgctctca

SEQ ID NO: 501232 - DNA, 16 bp, R. norvegicus
ctttcctctttgcaag

SEQ ID NO: 501233 - DNA, 16 bp, R. norvegicus
ctttcctgctgtctct

SEQ ID NO: 501234 - DNA, 16 bp, R. norvegicus
ctttcctgcttctggc

SEQ ID NO: 501235 - DNA, 16 bp, R. norvegicus
ctttcctggagcttcc

SEQ ID NO: 501236 - DNA, 16 bp, R. norvegicus
ctttcctggttttctg

SEQ ID NO: 501237 - DNA, 16 bp, R. norvegicus
ctttcctgtgctgttc

SEQ ID NO: 501238 - DNA, 16 bp, R. norvegicus
ctttccttcagtctct

SEQ ID NO: 501239 - DNA, 16 bp, R. norvegicus
ctttccttcatccatc

SEQ ID NO: 501240 - DNA, 16 bp, R. norvegicus
ctttccttggcaggta

SEQ ID NO: 501241 - DNA, 17 bp, R. norvegicus
ctttctacctgtgggtc

SEQ ID NO: 501242 - DNA, 16 bp, R. norvegicus
ctttctactgggaaat

SEQ ID NO: 501243 - DNA, 16 bp, R. norvegicus
ctttctactttcatgt

SEQ ID NO: 501244 - DNA, 16 bp, R. norvegicus
ctttctcagaggagaa

SEQ ID NO: 501245 - DNA, 16 bp, R. norvegicus
ctttctcattctctga

SEQ ID NO: 501246 - DNA, 16 bp, R. norvegicus
ctttctccaaaatgga

SEQ ID NO: 501247 - DNA, 16 bp, R. norvegicus
ctttctccaaaattga

SEQ ID NO: 501248 - DNA, 16 bp, R. norvegicus
ctttctccaaaattta

SEQ ID NO: 501249 - DNA, 16 bp, R. norvegicus
ctttctccagcaaagc

SEQ ID NO: 501250 - DNA, 16 bp, R. norvegicus
ctttctccagcaaggc

SEQ ID NO: 501251 - DNA, 16 bp, R. norvegicus
ctttctccctcccaga

SEQ ID NO: 501252 - DNA, 16 bp, R. norvegicus
ctttctcctactcaga

SEQ ID NO: 501253 - DNA, 16 bp, R. norvegicus
ctttctcctcagcttc

SEQ ID NO: 501254 - DNA, 16 bp, R. norvegicus
ctttctcctgcccatc

SEQ ID NO: 501255 - DNA, 16 bp, R. norvegicus
ctttctcctggaagaa

SEQ ID NO: 501256 - DNA, 16 bp, R. norvegicus
ctttctctaagtttac

SEQ ID NO: 501257 - DNA, 16 bp, R. norvegicus
ctttctctacatcctg

SEQ ID NO: 501258 - DNA, 16 bp, R. norvegicus
ctttctctacatcttc

SEQ ID NO: 501259 - DNA, 19 bp, R. norvegicus
ctttctctgattctttcaa

SEQ ID NO: 501260 - DNA, 16 bp, R. norvegicus
ctttctctgtaactta

SEQ ID NO: 501261 - DNA, 16 bp, R. norvegicus
ctttctctgtttcaca

SEQ ID NO: 501262 - DNA, 16 bp, R. norvegicus
ctttctcttcctgctg

SEQ ID NO: 501263 - DNA, 16 bp, R. norvegicus
ctttctcttctattgg

SEQ ID NO: 501264 - DNA, 16 bp, R. norvegicus
ctttctgagcctggct

SEQ ID NO: 501265 - DNA, 16 bp, R. norvegicus
ctttctgcaggcactg

SEQ ID NO: 501266 - DNA, 16 bp, R. norvegicus
ctttctgcccttgtcc

SEQ ID NO: 501267 - DNA, 16 bp, R. norvegicus
ctttctgcctcagctt

SEQ ID NO: 501268 - DNA, 16 bp, R. norvegicus
ctttctgcctcccaga

SEQ ID NO: 501269 - DNA, 16 bp, R. norvegicus
ctttctgcctcctgga

SEQ ID NO: 501270 - DNA, 16 bp, R. norvegicus
ctttctgcctctctgc

SEQ ID NO: 501271 - DNA, 16 bp, R. norvegicus
ctttctgctgggacag

SEQ ID NO: 501272 - DNA, 16 bp, R. norvegicus
ctttctggcttgcttc

SEQ ID NO: 501273 - DNA, 16 bp, R. norvegicus
ctttctgggctggaga

SEQ ID NO: 501274 - DNA, 16 bp, R. norvegicus
ctttctggggctggag

SEQ ID NO: 501275 - DNA, 16 bp, R. norvegicus
ctttctggttgctacc

SEQ ID NO: 501276 - DNA, 16 bp, R. norvegicus
ctttctgtatctgttt

SEQ ID NO: 501277 - DNA, 16 bp, R. norvegicus
ctttctgtgacctctg

SEQ ID NO: 501278 - DNA, 16 bp, R. norvegicus
ctttctgtgattcatc

SEQ ID NO: 501279 - DNA, 16 bp, R. norvegicus
ctttctgtgtctgttg

SEQ ID NO: 501280 - DNA, 16 bp, R. norvegicus
ctttcttaaaaataaa

SEQ ID NO: 501281 - DNA, 16 bp, R. norvegicus
ctttcttcatatcctc

SEQ ID NO: 501282 - DNA, 16 bp, R. norvegicus
ctttcttctatccttg

SEQ ID NO: 501283 - DNA, 16 bp, R. norvegicus
ctttcttctgactctc

SEQ ID NO: 501284 - DNA, 16 bp, R. norvegicus
ctttcttctggcctct

SEQ ID NO: 501285 - DNA, 16 bp, R. norvegicus
ctttcttctgtaccta

SEQ ID NO: 501286 - DNA, 18 bp, R. norvegicus
ctttcttgcagcagaaaa

SEQ ID NO: 501287 - DNA, 16 bp, R. norvegicus
ctttcttgggatgaaa

SEQ ID NO: 501288 - DNA, 16 bp, R. norvegicus
ctttctttcctttgta

SEQ ID NO: 501289 - DNA, 16 bp, R. norvegicus
ctttctttcttaaaat

SEQ ID NO: 501290 - DNA, 16 bp, R. norvegicus
ctttctttggtgggtc

SEQ ID NO: 501291 - DNA, 16 bp, R. norvegicus
ctttcttttacaagtt

SEQ ID NO: 501292 - DNA, 16 bp, R. norvegicus
ctttcttttccaccac

SEQ ID NO: 501293 - DNA, 16 bp, R. norvegicus
ctttgaaaagtgatta

SEQ ID NO: 501294 - DNA, 16 bp, R. norvegicus
ctttgaacttacagag

SEQ ID NO: 501295 - DNA, 18 bp, R. norvegicus
ctttgaagaaatggattg

SEQ ID NO: 501296 - DNA, 16 bp, R. norvegicus
ctttgaagacacagtt

SEQ ID NO: 501297 - DNA, 16 bp, R. norvegicus
ctttgaagccacagtt

SEQ ID NO: 501298 - DNA, 16 bp, R. norvegicus
ctttgaaggattggat

SEQ ID NO: 501299 - DNA, 16 bp, R. norvegicus
ctttgaagtttcaaaa

SEQ ID NO: 501300 - DNA, 16 bp, R. norvegicus
ctttgaattgttttct

SEQ ID NO: 501301 - DNA, 16 bp, R. norvegicus
ctttgaatttgaggcc

SEQ ID NO: 501302 - DNA, 16 bp, R. norvegicus
ctttgacaacaaggaa

SEQ ID NO: 501303 - DNA, 16 bp, R. norvegicus
ctttgacatcttcctt

SEQ ID NO: 501304 - DNA, 16 bp, R. norvegicus
ctttgaccccagcact

SEQ ID NO: 501305 - DNA, 16 bp, R. norvegicus
ctttgactgtcctgga

SEQ ID NO: 501306 - DNA, 16 bp, R. norvegicus
ctttgagaagaacgtt

SEQ ID NO: 501307 - DNA, 16 bp, R. norvegicus
ctttgagactctcttc

SEQ ID NO: 501308 - DNA, 16 bp, R. norvegicus
ctttgagataaggtct

SEQ ID NO: 501309 - DNA, 26 bp, R. norvegicus
ctttgagatcttatatggggcctcag

SEQ ID NO: 501310 - DNA, 16 bp, R. norvegicus
ctttgagatttttatc

SEQ ID NO: 501311 - DNA, 16 bp, R. norvegicus
ctttgagctagaagag

SEQ ID NO: 501312 - DNA, 16 bp, R. norvegicus
ctttgagctggatccc

SEQ ID NO: 501313 - DNA, 16 bp, R. norvegicus
ctttgagctgggagac

SEQ ID NO: 501314 - DNA, 16 bp, R. norvegicus
ctttgagctgggagcc

SEQ ID NO: 501315 - DNA, 16 bp, R. norvegicus
ctttgagctgggagtt

SEQ ID NO: 501316 - DNA, 16 bp, R. norvegicus
ctttgaggatttcata

SEQ ID NO: 501317 - DNA, 16 bp, R. norvegicus
ctttgagggaaaaaaa

SEQ ID NO: 501318 - DNA, 16 bp, R. norvegicus
ctttgaggtgtgctgt

SEQ ID NO: 501319 - DNA, 16 bp, R. norvegicus
ctttgaggtttcataa

SEQ ID NO: 501320 - DNA, 16 bp, R. norvegicus
ctttgagttcctgatc

SEQ ID NO: 501321 - DNA, 16 bp, R. norvegicus
ctttgatccacttggg

SEQ ID NO: 501322 - DNA, 16 bp, R. norvegicus
ctttgatcccagcact

SEQ ID NO: 501323 - DNA, 16 bp, R. norvegicus
ctttgatcccagtact

SEQ ID NO: 501324 - DNA, 16 bp, R. norvegicus
ctttgatgaaaatgaa

SEQ ID NO: 501325 - DNA, 16 bp, R. norvegicus
ctttgatgaaagtgtt

SEQ ID NO: 501326 - DNA, 16 bp, R. norvegicus
ctttgatgagtatgag

SEQ ID NO: 501327 - DNA, 16 bp, R. norvegicus
ctttgatgatgatgga

SEQ ID NO: 501328 - DNA, 22 bp, R. norvegicus
ctttgatgatggccaagctcac

SEQ ID NO: 501329 - DNA, 16 bp, R. norvegicus
ctttgatgccagcact

SEQ ID NO: 501330 - DNA, 16 bp, R. norvegicus
ctttgattctattcca

SEQ ID NO: 501331 - DNA, 16 bp, R. norvegicus
ctttgatttttaaaaa

SEQ ID NO: 501332 - DNA, 16 bp, R. norvegicus
ctttgcagttttatca

SEQ ID NO: 501333 - DNA, 16 bp, R. norvegicus
ctttgccaatgctcag

SEQ ID NO: 501334 - DNA, 16 bp, R. norvegicus
ctttgccagagcccta

SEQ ID NO: 501335 - DNA, 16 bp, R. norvegicus
ctttgcctccacctcc

SEQ ID NO: 501336 - DNA, 16 bp, R. norvegicus
ctttgcctctgaggtg

SEQ ID NO: 501337 - DNA, 16 bp, R. norvegicus
ctttgcctctgtctct

SEQ ID NO: 501338 - DNA, 16 bp, R. norvegicus
ctttgcctgcttgatt

SEQ ID NO: 501339 - DNA, 16 bp, R. norvegicus
ctttgccttaaagaaa

SEQ ID NO: 501340 - DNA, 16 bp, R. norvegicus
ctttgccttggatcct

SEQ ID NO: 501341 - DNA, 16 bp, R. norvegicus
ctttgctccaaaatcc

SEQ ID NO: 501342 - DNA, 16 bp, R. norvegicus
ctttgctccacacttt

SEQ ID NO: 501343 - DNA, 16 bp, R. norvegicus
ctttgctgaaggtctt

SEQ ID NO: 501344 - DNA, 16 bp, R. norvegicus
ctttgctgaatgtgtt

SEQ ID NO: 501345 - DNA, 16 bp, R. norvegicus
ctttgctgatgaacag

SEQ ID NO: 501346 - DNA, 16 bp, R. norvegicus
ctttgcttcatacatc

SEQ ID NO: 501347 - DNA, 16 bp, R. norvegicus
ctttggaaaaatcact

SEQ ID NO: 501348 - DNA, 16 bp, R. norvegicus
ctttggaaaacacaga

SEQ ID NO: 501349 - DNA, 16 bp, R. norvegicus
ctttggaaaagcagcc

SEQ ID NO: 501350 - DNA, 16 bp, R. norvegicus
ctttggaagagcaacc

SEQ ID NO: 501351 - DNA, 16 bp, R. norvegicus
ctttggaagctgaggc

SEQ ID NO: 501352 - DNA, 16 bp, R. norvegicus
ctttggagaaagaaaa

SEQ ID NO: 501353 - DNA, 16 bp, R. norvegicus
ctttggaggaagagag

SEQ ID NO: 501354 - DNA, 16 bp, R. norvegicus
ctttggaggcagaggc

SEQ ID NO: 501355 - DNA, 16 bp, R. norvegicus
ctttggaggctgaggc

SEQ ID NO: 501356 - DNA, 16 bp, R. norvegicus
ctttggagtccagaag

SEQ ID NO: 501357 - DNA, 16 bp, R. norvegicus
ctttggatgaagatat

SEQ ID NO: 501358 - DNA, 16 bp, R. norvegicus
ctttggattcctttcc

SEQ ID NO: 501359 - DNA, 16 bp, R. norvegicus
ctttggatttgaaaag

SEQ ID NO: 501360 - DNA, 16 bp, R. norvegicus
ctttggcaaatggtcc

SEQ ID NO: 501361 - DNA, 16 bp, R. norvegicus
ctttggcaagatggcc

SEQ ID NO: 501362 - DNA, 16 bp, R. norvegicus
ctttggccatgtggtt

SEQ ID NO: 501363 - DNA, 16 bp, R. norvegicus
ctttggctgtgtctct

SEQ ID NO: 501364 - DNA, 16 bp, R. norvegicus
ctttgggaaaaaaaat

SEQ ID NO: 501365 - DNA, 16 bp, R. norvegicus
ctttgggagagacttt

SEQ ID NO: 501366 - DNA, 16 bp, R. norvegicus
ctttgggatttcaaaa

SEQ ID NO: 501367 - DNA, 16 bp, R. norvegicus
ctttgggcagggggaa

SEQ ID NO: 501368 - DNA, 22 bp, R. norvegicus
ctttgggcatgaagtcactcag

SEQ ID NO: 501369 - DNA, 16 bp, R. norvegicus
ctttgggcctgtggtg

SEQ ID NO: 501370 - DNA, 16 bp, R. norvegicus
ctttggtacctggtat

SEQ ID NO: 501371 - DNA, 16 bp, R. norvegicus
ctttggtccctggtat

SEQ ID NO: 501372 - DNA, 18 bp, R. norvegicus
ctttggtccttgggcctt

SEQ ID NO: 501373 - DNA, 16 bp, R. norvegicus
ctttggtgatgaaaag

SEQ ID NO: 501374 - DNA, 16 bp, R. norvegicus
ctttggtgatgaccag

SEQ ID NO: 501375 - DNA, 16 bp, R. norvegicus
ctttggtgatgagcag

SEQ ID NO: 501376 - DNA, 16 bp, R. norvegicus
ctttggtgatgcagct

SEQ ID NO: 501377 - DNA, 16 bp, R. norvegicus
ctttggttcacctaat

SEQ ID NO: 501378 - DNA, 16 bp, R. norvegicus
ctttggttggtggctt

SEQ ID NO: 501379 - DNA, 16 bp, R. norvegicus
ctttggttttctaaat

SEQ ID NO: 501380 - DNA, 16 bp, R. norvegicus
ctttgtaaaaagaaaa

SEQ ID NO: 501381 - DNA, 16 bp, R. norvegicus
ctttgtacaaggatat

SEQ ID NO: 501382 - DNA, 16 bp, R. norvegicus
ctttgtacacagtgat

SEQ ID NO: 501383 - DNA, 16 bp, R. norvegicus
ctttgtacaccaggct

SEQ ID NO: 501384 - DNA, 16 bp, R. norvegicus
ctttgtagtgctggat

SEQ ID NO: 501385 - DNA, 16 bp, R. norvegicus
ctttgtagttttctga

SEQ ID NO: 501386 - DNA, 16 bp, R. norvegicus
ctttgtatattttgaa

SEQ ID NO: 501387 - DNA, 16 bp, R. norvegicus
ctttgtatattttgta

SEQ ID NO: 501388 - DNA, 16 bp, R. norvegicus
ctttgtcactgagctg

SEQ ID NO: 501389 - DNA, 16 bp, R. norvegicus
ctttgtccccagttgg

SEQ ID NO: 501390 - DNA, 16 bp, R. norvegicus
ctttgtctcaaaagaa

SEQ ID NO: 501391 - DNA, 26 bp, R. norvegicus
ctttgtctctggcctgtacttgtggg

SEQ ID NO: 501392 - DNA, 16 bp, R. norvegicus
ctttgtctgtctgtct

SEQ ID NO: 501393 - DNA, 16 bp, R. norvegicus
ctttgtgaaacatcag

SEQ ID NO: 501394 - DNA, 16 bp, R. norvegicus
ctttgtgcatgtgtgt

SEQ ID NO: 501395 - DNA, 16 bp, R. norvegicus
ctttgtgctttattgt

SEQ ID NO: 501396 - DNA, 16 bp, R. norvegicus
ctttgtggagttggtt

SEQ ID NO: 501397 - DNA, 16 bp, R. norvegicus
ctttgtggggctggag

SEQ ID NO: 501398 - DNA, 16 bp, R. norvegicus
ctttgtggtgctggat

SEQ ID NO: 501399 - DNA, 16 bp, R. norvegicus
ctttgtgtgcgtgtgt

SEQ ID NO: 501400 - DNA, 16 bp, R. norvegicus
ctttgtgtgggaagcc

SEQ ID NO: 501401 - DNA, 16 bp, R. norvegicus
ctttgtgtggtctgtg

SEQ ID NO: 501402 - DNA, 16 bp, R. norvegicus
ctttgtgtgtgcatgt

SEQ ID NO: 501403 - DNA, 16 bp, R. norvegicus
ctttgttctgtgaaac

SEQ ID NO: 501404 - DNA, 16 bp, R. norvegicus
ctttgttgtcaggata

SEQ ID NO: 501405 - DNA, 16 bp, R. norvegicus
ctttgttttttaaaat

SEQ ID NO: 501406 - DNA, 16 bp, R. norvegicus
cttttaaaaacaaaac

SEQ ID NO: 501407 - DNA, 16 bp, R. norvegicus
cttttaaaaacaagga

SEQ ID NO: 501408 - DNA, 16 bp, R. norvegicus
cttttaaaaacaatga

SEQ ID NO: 501409 - DNA, 16 bp, R. norvegicus
cttttaaaaagaaaag

SEQ ID NO: 501410 - DNA, 16 bp, R. norvegicus
cttttaaaaataactt

SEQ ID NO: 501411 - DNA, 16 bp, R. norvegicus
cttttaaaaataatga

SEQ ID NO: 501412 - DNA, 16 bp, R. norvegicus
cttttaaaaatgttat

SEQ ID NO: 501413 - DNA, 16 bp, R. norvegicus
cttttaaaaattggtt

SEQ ID NO: 501414 - DNA, 16 bp, R. norvegicus
cttttaaaatatactt

SEQ ID NO: 501415 - DNA, 16 bp, R. norvegicus
cttttaaaatgcaaat

SEQ ID NO: 501416 - DNA, 16 bp, R. norvegicus
cttttaaaattagaaa

SEQ ID NO: 501417 - DNA, 16 bp, R. norvegicus
cttttaaagaatatat

SEQ ID NO: 501418 - DNA, 16 bp, R. norvegicus
cttttaaataaagttt

SEQ ID NO: 501419 - DNA, 16 bp, R. norvegicus
cttttaaatgtattta

SEQ ID NO: 501420 - DNA, 16 bp, R. norvegicus
cttttaaccaaaagtc

SEQ ID NO: 501421 - DNA, 16 bp, R. norvegicus
cttttaaccaaaagtt

SEQ ID NO: 501422 - DNA, 16 bp, R. norvegicus
cttttaaggatttatt

SEQ ID NO: 501423 - DNA, 16 bp, R. norvegicus
cttttaatggatattt

SEQ ID NO: 501424 - DNA, 16 bp, R. norvegicus
cttttacataaaccat

SEQ ID NO: 501425 - DNA, 16 bp, R. norvegicus
cttttaccatgtgggt

SEQ ID NO: 501426 - DNA, 16 bp, R. norvegicus
cttttagaaagatcat

SEQ ID NO: 501427 - DNA, 16 bp, R. norvegicus
cttttagagtctccac

SEQ ID NO: 501428 - DNA, 16 bp, R. norvegicus
cttttatgtatgtaag

SEQ ID NO: 501429 - DNA, 16 bp, R. norvegicus
cttttatttcctcaaa

SEQ ID NO: 501430 - DNA, 16 bp, R. norvegicus
cttttattttgaggta

SEQ ID NO: 501431 - DNA, 16 bp, R. norvegicus
cttttcaaagaaagaa

SEQ ID NO: 501432 - DNA, 16 bp, R. norvegicus
cttttcaaatatttct

SEQ ID NO: 501433 - DNA, 16 bp, R. norvegicus
cttttcaattaaaaaa

SEQ ID NO: 501434 - DNA, 16 bp, R. norvegicus
cttttcacctgtgtct

SEQ ID NO: 501435 - DNA, 18 bp, R. norvegicus
cttttcagagctggggac

SEQ ID NO: 501436 - DNA, 16 bp, R. norvegicus
cttttcagcttctgga

SEQ ID NO: 501437 - DNA, 16 bp, R. norvegicus
cttttcatcaacaaaa

SEQ ID NO: 501438 - DNA, 16 bp, R. norvegicus
cttttcattgctacct

SEQ ID NO: 501439 - DNA, 16 bp, R. norvegicus
cttttcattttgaaaa

SEQ ID NO: 501440 - DNA, 22 bp, R. norvegicus
cttttccacccctaggtctgaa

SEQ ID NO: 501441 - DNA, 16 bp, R. norvegicus
cttttccactgaggcc

SEQ ID NO: 501442 - DNA, 16 bp, R. norvegicus
cttttccagaggactt

SEQ ID NO: 501443 - DNA, 16 bp, R. norvegicus
cttttccagtgtattt

SEQ ID NO: 501444 - DNA, 16 bp, R. norvegicus
cttttccagtgtgatg

SEQ ID NO: 501445 - DNA, 16 bp, R. norvegicus
cttttccagtgtgttt

SEQ ID NO: 501446 - DNA, 16 bp, R. norvegicus
cttttccagttctttc

SEQ ID NO: 501447 - DNA, 16 bp, R. norvegicus
cttttccattgctgtg

SEQ ID NO: 501448 - DNA, 16 bp, R. norvegicus
cttttcccagtctgtt

SEQ ID NO: 501449 - DNA, 16 bp, R. norvegicus
cttttcctagtttccc

SEQ ID NO: 501450 - DNA, 16 bp, R. norvegicus
cttttcctctgagaag

SEQ ID NO: 501451 - DNA, 16 bp, R. norvegicus
cttttcctggcttcct

SEQ ID NO: 501452 - DNA, 16 bp, R. norvegicus
cttttcctggggagat

SEQ ID NO: 501453 - DNA, 16 bp, R. norvegicus
cttttccttctatgta

SEQ ID NO: 501454 - DNA, 16 bp, R. norvegicus
cttttccttgatttct

SEQ ID NO: 501455 - DNA, 16 bp, R. norvegicus
cttttctaatccaaag

SEQ ID NO: 501456 - DNA, 16 bp, R. norvegicus
cttttctacactcaaa

SEQ ID NO: 501457 - DNA, 16 bp, R. norvegicus
cttttctagttccatt

SEQ ID NO: 501458 - DNA, 16 bp, R. norvegicus
cttttctcaagaagaa

SEQ ID NO: 501459 - DNA, 16 bp, R. norvegicus
cttttctcctgctcat

SEQ ID NO: 501460 - DNA, 16 bp, R. norvegicus
cttttctctcttaaaa

SEQ ID NO: 501461 - DNA, 16 bp, R. norvegicus
cttttctgaaaggaaa

SEQ ID NO: 501462 - DNA, 16 bp, R. norvegicus
cttttctgaagagaaa

SEQ ID NO: 501463 - DNA, 16 bp, R. norvegicus
cttttctgagacaagg

SEQ ID NO: 501464 - DNA, 16 bp, R. norvegicus
cttttctgaggagaag

SEQ ID NO: 501465 - DNA, 16 bp, R. norvegicus
cttttctggacagtgt

SEQ ID NO: 501466 - DNA, 16 bp, R. norvegicus
cttttctgtggctgtg

SEQ ID NO: 501467 - DNA, 16 bp, R. norvegicus
cttttcttcagtctgt

SEQ ID NO: 501468 - DNA, 16 bp, R. norvegicus
cttttcttcggagctg

SEQ ID NO: 501469 - DNA, 16 bp, R. norvegicus
cttttcttgctgctgt

SEQ ID NO: 501470 - DNA, 16 bp, R. norvegicus
cttttgaaaaaaataa

SEQ ID NO: 501471 - DNA, 16 bp, R. norvegicus
cttttgaaaattcaaa

SEQ ID NO: 501472 - DNA, 16 bp, R. norvegicus
cttttgacctcctttt

SEQ ID NO: 501473 - DNA, 16 bp, R. norvegicus
cttttgagatcttctt

SEQ ID NO: 501474 - DNA, 16 bp, R. norvegicus
cttttgagctctcggt

SEQ ID NO: 501475 - DNA, 16 bp, R. norvegicus
cttttgatgaaattct

SEQ ID NO: 501476 - DNA, 16 bp, R. norvegicus
cttttgatgatgaact

SEQ ID NO: 501477 - DNA, 16 bp, R. norvegicus
cttttgattcctgccc

SEQ ID NO: 501478 - DNA, 16 bp, R. norvegicus
cttttgccaaagcatc

SEQ ID NO: 501479 - DNA, 16 bp, R. norvegicus
cttttgctctgaggta

SEQ ID NO: 501480 - DNA, 16 bp, R. norvegicus
cttttgctgtctgatt

SEQ ID NO: 501481 - DNA, 16 bp, R. norvegicus
cttttggaactggagt

SEQ ID NO: 501482 - DNA, 16 bp, R. norvegicus
cttttggagtttgggg

SEQ ID NO: 501483 - DNA, 16 bp, R. norvegicus
cttttggatatgtgcc

SEQ ID NO: 501484 - DNA, 16 bp, R. norvegicus
cttttgggatagaccc

SEQ ID NO: 501485 - DNA, 16 bp, R. norvegicus
cttttggggctggaga

SEQ ID NO: 501486 - DNA, 16 bp, R. norvegicus
cttttggtgaagcttg

SEQ ID NO: 501487 - DNA, 16 bp, R. norvegicus
cttttggttctgctga

SEQ ID NO: 501488 - DNA, 16 bp, R. norvegicus
cttttgtacagaggaa

SEQ ID NO: 501489 - DNA, 16 bp, R. norvegicus
cttttgtatagagaaa

SEQ ID NO: 501490 - DNA, 16 bp, R. norvegicus
cttttgtccctgggtt

SEQ ID NO: 501491 - DNA, 16 bp, R. norvegicus
cttttgtgattgggct

SEQ ID NO: 501492 - DNA, 16 bp, R. norvegicus
cttttgtttttgaaaa

SEQ ID NO: 501493 - DNA, 16 bp, R. norvegicus
ctttttaaaaagaaaa

SEQ ID NO: 501494 - DNA, 16 bp, R. norvegicus
ctttttaaaacaaaac

SEQ ID NO: 501495 - DNA, 16 bp, R. norvegicus
ctttttaaaagtaatt

SEQ ID NO: 501496 - DNA, 16 bp, R. norvegicus
ctttttaaaattgttt

SEQ ID NO: 501497 - DNA, 16 bp, R. norvegicus
ctttttaaacagccaa

SEQ ID NO: 501498 - DNA, 16 bp, R. norvegicus
ctttttaaagaaaaaa

SEQ ID NO: 501499 - DNA, 16 bp, R. norvegicus
ctttttaaagaaatat

SEQ ID NO: 501500 - DNA, 16 bp, R. norvegicus
ctttttaaatgtattt

SEQ ID NO: 501501 - DNA, 16 bp, R. norvegicus
ctttttaaatgttatt

SEQ ID NO: 501502 - DNA, 16 bp, R. norvegicus
ctttttcaaaaaacaa

SEQ ID NO: 501503 - DNA, 16 bp, R. norvegicus
ctttttcaacaaatgg

SEQ ID NO: 501504 - DNA, 16 bp, R. norvegicus
ctttttcagatatttt

SEQ ID NO: 501505 - DNA, 16 bp, R. norvegicus
ctttttctctcccagg

SEQ ID NO: 501506 - DNA, 16 bp, R. norvegicus
ctttttctggtccaat

SEQ ID NO: 501507 - DNA, 16 bp, R. norvegicus
ctttttcttacaataa

SEQ ID NO: 501508 - DNA, 16 bp, R. norvegicus
ctttttctttaaaaaa

SEQ ID NO: 501509 - DNA, 16 bp, R. norvegicus
ctttttctttaaagat

SEQ ID NO: 501510 - DNA, 16 bp, R. norvegicus
ctttttgcactttgca

SEQ ID NO: 501511 - DNA, 16 bp, R. norvegicus
ctttttgcattttgta

SEQ ID NO: 501512 - DNA, 16 bp, R. norvegicus
ctttttgctgtctcac

SEQ ID NO: 501513 - DNA, 16 bp, R. norvegicus
ctttttggagaaagtg

SEQ ID NO: 501514 - DNA, 16 bp, R. norvegicus
ctttttggtaaaatgg

SEQ ID NO: 501515 - DNA, 16 bp, R. norvegicus
ctttttgttcaagagc

SEQ ID NO: 501516 - DNA, 16 bp, R. norvegicus
cttttttaaaaaattg

SEQ ID NO: 501517 - DNA, 16 bp, R. norvegicus
cttttttaaaaagaag

SEQ ID NO: 501518 - DNA, 16 bp, R. norvegicus
cttttttaaaatacaa

SEQ ID NO: 501519 - DNA, 16 bp, R. norvegicus
cttttttaaaatgtat

SEQ ID NO: 501520 - DNA, 16 bp, R. norvegicus
cttttttgacaacttt

SEQ ID NO: 501521 - DNA, 16 bp, R. norvegicus
cttttttgagacagaa

SEQ ID NO: 501522 - DNA, 16 bp, R. norvegicus
ctttttttaaaaaaag

SEQ ID NO: 501523 - DNA, 16 bp, R. norvegicus
ctttttttaaaataag

SEQ ID NO: 501524 - DNA, 16 bp, R. norvegicus
ctttttttctactgga

SEQ ID NO: 501525 - DNA, 16 bp, R. norvegicus
ctttttttgaaaaaaa

SEQ ID NO: 501526 - DNA, 16 bp, R. norvegicus
cttttttttcttaaag

SEQ ID NO: 501527 - DNA, 16 bp, R. norvegicus
gaaaaaaaggtttatt

SEQ ID NO: 501528 - DNA, 16 bp, R. norvegicus
gaaaaaaataaatctt

SEQ ID NO: 501529 - DNA, 16 bp, R. norvegicus
gaaaaaaatcacagat

SEQ ID NO: 501530 - DNA, 16 bp, R. norvegicus
gaaaaaaatgtcaagt

SEQ ID NO: 501531 - DNA, 16 bp, R. norvegicus
gaaaaaaatgttttct

SEQ ID NO: 501532 - DNA, 16 bp, R. norvegicus
gaaaaaaatgtttttt

SEQ ID NO: 501533 - DNA, 16 bp, R. norvegicus
gaaaaaacaagatatt

SEQ ID NO: 501534 - DNA, 16 bp, R. norvegicus
gaaaaaagacaacatt

SEQ ID NO: 501535 - DNA, 16 bp, R. norvegicus
gaaaaaagacaatatt

SEQ ID NO: 501536 - DNA, 16 bp, R. norvegicus
gaaaaaagcatcttca

SEQ ID NO: 501537 - DNA, 16 bp, R. norvegicus
gaaaaaagtcaatgaa

SEQ ID NO: 501538 - DNA, 16 bp, R. norvegicus
gaaaaaatggaaacag

SEQ ID NO: 501539 - DNA, 16 bp, R. norvegicus
gaaaaaatgttccaga

SEQ ID NO: 501540 - DNA, 16 bp, R. norvegicus
gaaaaaattcctgaac

SEQ ID NO: 501541 - DNA, 16 bp, R. norvegicus
gaaaaacaacagtatc

SEQ ID NO: 501542 - DNA, 16 bp, R. norvegicus
gaaaaacacacacagt

SEQ ID NO: 501543 - DNA, 16 bp, R. norvegicus
gaaaaacacacatggg

SEQ ID NO: 501544 - DNA, 16 bp, R. norvegicus
gaaaaagaaaatgtgt

SEQ ID NO: 501545 - DNA, 16 bp, R. norvegicus
gaaaaagacacatggt

SEQ ID NO: 501546 - DNA, 16 bp, R. norvegicus
gaaaaagacttaatag

SEQ ID NO: 501547 - DNA, 16 bp, R. norvegicus
gaaaaagatcaggagt

SEQ ID NO: 501548 - DNA, 16 bp, R. norvegicus
gaaaaaggaacacttc

SEQ ID NO: 501549 - DNA, 16 bp, R. norvegicus
gaaaaaggacattggg

SEQ ID NO: 501550 - DNA, 16 bp, R. norvegicus
gaaaaaggtcaaggaa

SEQ ID NO: 501551 - DNA, 16 bp, R. norvegicus
gaaaaaggttttccaa

SEQ ID NO: 501552 - DNA, 16 bp, R. norvegicus
gaaaaagtaaggcagg

SEQ ID NO: 501553 - DNA, 16 bp, R. norvegicus
gaaaaagtccaccaag

SEQ ID NO: 501554 - DNA, 16 bp, R. norvegicus
gaaaaatattatttct

SEQ ID NO: 501555 - DNA, 16 bp, R. norvegicus
gaaaaatcatcctgag

SEQ ID NO: 501556 - DNA, 16 bp, R. norvegicus
gaaaaatccaccgaga

SEQ ID NO: 501557 - DNA, 16 bp, R. norvegicus
gaaaaatccactaaga

SEQ ID NO: 501558 - DNA, 16 bp, R. norvegicus
gaaaaatctcccatgc

SEQ ID NO: 501559 - DNA, 16 bp, R. norvegicus
gaaaaatgaaactttt

SEQ ID NO: 501560 - DNA, 16 bp, R. norvegicus
gaaaaatggagacaaa

SEQ ID NO: 501561 - DNA, 16 bp, R. norvegicus
gaaaaatggaggagtg

SEQ ID NO: 501562 - DNA, 16 bp, R. norvegicus
gaaaaatgtggctgct

SEQ ID NO: 501563 - DNA, 16 bp, R. norvegicus
gaaaaatgtttatttc

SEQ ID NO: 501564 - DNA, 16 bp, R. norvegicus
gaaaaattcaacaaga

SEQ ID NO: 501565 - DNA, 16 bp, R. norvegicus
gaaaaatttttccaag

SEQ ID NO: 501566 - DNA, 16 bp, R. norvegicus
gaaaacaacaatcatt

SEQ ID NO: 501567 - DNA, 16 bp, R. norvegicus
gaaaacaacattccaa

SEQ ID NO: 501568 - DNA, 16 bp, R. norvegicus
gaaaacaagagtccag

SEQ ID NO: 501569 - DNA, 16 bp, R. norvegicus
gaaaacaatctggcag

SEQ ID NO: 501570 - DNA, 16 bp, R. norvegicus
gaaaacaattttcaaa

SEQ ID NO: 501571 - DNA, 16 bp, R. norvegicus
gaaaacaccaaggcca

SEQ ID NO: 501572 - DNA, 16 bp, R. norvegicus
gaaaacactccaaaaa

SEQ ID NO: 501573 - DNA, 16 bp, R. norvegicus
gaaaacactgtttctt

SEQ ID NO: 501574 - DNA, 16 bp, R. norvegicus
gaaaacagaaagttgg

SEQ ID NO: 501575 - DNA, 16 bp, R. norvegicus
gaaaacagaagagact

SEQ ID NO: 501576 - DNA, 16 bp, R. norvegicus
gaaaacagttctacag

SEQ ID NO: 501577 - DNA, 16 bp, R. norvegicus
gaaaacataaagaatt

SEQ ID NO: 501578 - DNA, 16 bp, R. norvegicus
gaaaacatcagaagga

SEQ ID NO: 501579 - DNA, 16 bp, R. norvegicus
gaaaacatggccctga

SEQ ID NO: 501580 - DNA, 16 bp, R. norvegicus
gaaaacatttaaaaat

SEQ ID NO: 501581 - DNA, 16 bp, R. norvegicus
gaaaacatttagctgg

SEQ ID NO: 501582 - DNA, 16 bp, R. norvegicus
gaaaacatttggagaa

SEQ ID NO: 501583 - DNA, 16 bp, R. norvegicus
gaaaacattttattgg

SEQ ID NO: 501584 - DNA, 16 bp, R. norvegicus
gaaaaccaggagctgg

SEQ ID NO: 501585 - DNA, 20 bp, R. norvegicus
gaaaaccatcaacgtgatca

SEQ ID NO: 501586 - DNA, 16 bp, R. norvegicus
gaaaaccatctatgta

SEQ ID NO: 501587 - DNA, 16 bp, R. norvegicus
gaaaacccagaaataa

SEQ ID NO: 501588 - DNA, 16 bp, R. norvegicus
gaaaacccaggaaaga

SEQ ID NO: 501589 - DNA, 16 bp, R. norvegicus
gaaaacctagagaaga

SEQ ID NO: 501590 - DNA, 16 bp, R. norvegicus
gaaaacctggaggaaa

SEQ ID NO: 501591 - DNA, 16 bp, R. norvegicus
gaaaactaatttttcc

SEQ ID NO: 501592 - DNA, 16 bp, R. norvegicus
gaaaactcaaagccca

SEQ ID NO: 501593 - DNA, 16 bp, R. norvegicus
gaaaactccaacacaa

SEQ ID NO: 501594 - DNA, 16 bp, R. norvegicus
gaaaactgaagagaaa

SEQ ID NO: 501595 - DNA, 16 bp, R. norvegicus
gaaaactgctaacagg

SEQ ID NO: 501596 - DNA, 16 bp, R. norvegicus
gaaaactggaaagggg

SEQ ID NO: 501597 - DNA, 16 bp, R. norvegicus
gaaaacttcccttacc

SEQ ID NO: 501598 - DNA, 16 bp, R. norvegicus
gaaaagaaaactattt

SEQ ID NO: 501599 - DNA, 16 bp, R. norvegicus
gaaaagaaactcctgc

SEQ ID NO: 501600 - DNA, 16 bp, R. norvegicus
gaaaagaaagcaggct

SEQ ID NO: 501601 - DNA, 16 bp, R. norvegicus
gaaaagaaattcaaat

SEQ ID NO: 501602 - DNA, 16 bp, R. norvegicus
gaaaagaagttcctcc

SEQ ID NO: 501603 - DNA, 16 bp, R. norvegicus
gaaaagaatacatttt

SEQ ID NO: 501604 - DNA, 16 bp, R. norvegicus
gaaaagacaccatgac

SEQ ID NO: 501605 - DNA, 16 bp, R. norvegicus
gaaaagactaaaggaa

SEQ ID NO: 501606 - DNA, 17 bp, R. norvegicus
gaaaagagagattgctg

SEQ ID NO: 501607 - DNA, 16 bp, R. norvegicus
gaaaagagattttttt

SEQ ID NO: 501608 - DNA, 16 bp, R. norvegicus
gaaaagagcaggcctc

SEQ ID NO: 501609 - DNA, 16 bp, R. norvegicus
gaaaagagcaggtctc

SEQ ID NO: 501610 - DNA, 16 bp, R. norvegicus
gaaaagagcccaagag

SEQ ID NO: 501611 - DNA, 16 bp, R. norvegicus
gaaaagaggaagtcaa

SEQ ID NO: 501612 - DNA, 16 bp, R. norvegicus
gaaaagaggtcaaagg

SEQ ID NO: 501613 - DNA, 16 bp, R. norvegicus
gaaaagagttccaaga

SEQ ID NO: 501614 - DNA, 16 bp, R. norvegicus
gaaaagatcatccaga

SEQ ID NO: 501615 - DNA, 16 bp, R. norvegicus
gaaaagatcatcctga

SEQ ID NO: 501616 - DNA, 16 bp, R. norvegicus
gaaaagattgttacca

SEQ ID NO: 501617 - DNA, 16 bp, R. norvegicus
gaaaagatttttacta

SEQ ID NO: 501618 - DNA, 16 bp, R. norvegicus
gaaaagcaagaaagta

SEQ ID NO: 501619 - DNA, 16 bp, R. norvegicus
gaaaagcaagatcaag

SEQ ID NO: 501620 - DNA, 16 bp, R. norvegicus
gaaaagcaagatttag

SEQ ID NO: 501621 - DNA, 16 bp, R. norvegicus
gaaaagccattcagag

SEQ ID NO: 501622 - DNA, 16 bp, R. norvegicus
gaaaagctgaagacct

SEQ ID NO: 501623 - DNA, 16 bp, R. norvegicus
gaaaagctgaaggaag

SEQ ID NO: 501624 - DNA, 16 bp, R. norvegicus
gaaaagctgctaacag

SEQ ID NO: 501625 - DNA, 16 bp, R. norvegicus
gaaaagctggaaaaca

SEQ ID NO: 501626 - DNA, 16 bp, R. norvegicus
gaaaagctggagaaag

SEQ ID NO: 501627 - DNA, 16 bp, R. norvegicus
gaaaaggaacaaactg

SEQ ID NO: 501628 - DNA, 16 bp, R. norvegicus
gaaaaggaagatttgg

SEQ ID NO: 501629 - DNA, 16 bp, R. norvegicus
gaaaaggacatccaga

SEQ ID NO: 501630 - DNA, 16 bp, R. norvegicus
gaaaaggatttaaatt

SEQ ID NO: 501631 - DNA, 16 bp, R. norvegicus
gaaaaggcaaaatgca

SEQ ID NO: 501632 - DNA, 16 bp, R. norvegicus
gaaaaggcagcccagc

SEQ ID NO: 501633 - DNA, 16 bp, R. norvegicus
gaaaaggcagtgcagg

SEQ ID NO: 501634 - DNA, 16 bp, R. norvegicus
gaaaaggctatctttt

SEQ ID NO: 501635 - DNA, 16 bp, R. norvegicus
gaaaagggagatgtaa

SEQ ID NO: 501636 - DNA, 16 bp, R. norvegicus
gaaaagggggttgtgg

SEQ ID NO: 501637 - DNA, 16 bp, R. norvegicus
gaaaaggtggtgcagg

SEQ ID NO: 501638 - DNA, 16 bp, R. norvegicus
gaaaagtagattctaa

SEQ ID NO: 501639 - DNA, 16 bp, R. norvegicus
gaaaagtccttaacat

SEQ ID NO: 501640 - DNA, 16 bp, R. norvegicus
gaaaagtctaccaaga

SEQ ID NO: 501641 - DNA, 16 bp, R. norvegicus
gaaaagttggaagaag

SEQ ID NO: 501642 - DNA, 16 bp, R. norvegicus
gaaaataaagacattt

SEQ ID NO: 501643 - DNA, 16 bp, R. norvegicus
gaaaataaataaatct

SEQ ID NO: 501644 - DNA, 16 bp, R. norvegicus
gaaaataaatccatat

SEQ ID NO: 501645 - DNA, 16 bp, R. norvegicus
gaaaataatattttca

SEQ ID NO: 501646 - DNA, 16 bp, R. norvegicus
gaaaataatcaaactt

SEQ ID NO: 501647 - DNA, 16 bp, R. norvegicus
gaaaatacagaagaga

SEQ ID NO: 501648 - DNA, 16 bp, R. norvegicus
gaaaatagaagcagtc

SEQ ID NO: 501649 - DNA, 16 bp, R. norvegicus
gaaaatatatttcatt

SEQ ID NO: 501650 - DNA, 16 bp, R. norvegicus
gaaaatatcatccgga

SEQ ID NO: 501651 - DNA, 16 bp, R. norvegicus
gaaaatatcatcctaa

SEQ ID NO: 501652 - DNA, 17 bp, R. norvegicus
gaaaatatcatcctgac

SEQ ID NO: 501653 - DNA, 16 bp, R. norvegicus
gaaaatatcttttttt

SEQ ID NO: 501654 - DNA, 16 bp, R. norvegicus
gaaaatattatcctga

SEQ ID NO: 501655 - DNA, 16 bp, R. norvegicus
gaaaatatttcagaat

SEQ ID NO: 501656 - DNA, 16 bp, R. norvegicus
gaaaatattttcagaa

SEQ ID NO: 501657 - DNA, 16 bp, R. norvegicus
gaaaatattttctgag

SEQ ID NO: 501658 - DNA, 16 bp, R. norvegicus
gaaaatcaatgcaaaa

SEQ ID NO: 501659 - DNA, 16 bp, R. norvegicus
gaaaatcaggaggaaa

SEQ ID NO: 501660 - DNA, 16 bp, R. norvegicus
gaaaatccagatgaaa

SEQ ID NO: 501661 - DNA, 16 bp, R. norvegicus
gaaaatctcagaaaat

SEQ ID NO: 501662 - DNA, 16 bp, R. norvegicus
gaaaatctggaagaag

SEQ ID NO: 501663 - DNA, 16 bp, R. norvegicus
gaaaatctggagggaa

SEQ ID NO: 501664 - DNA, 16 bp, R. norvegicus
gaaaatctgtaggaaa

SEQ ID NO: 501665 - DNA, 16 bp, R. norvegicus
gaaaatcttcatgaaa

SEQ ID NO: 501666 - DNA, 16 bp, R. norvegicus
gaaaatgaaaacacag

SEQ ID NO: 501667 - DNA, 16 bp, R. norvegicus
gaaaatgaagaagatc

SEQ ID NO: 501668 - DNA, 16 bp, R. norvegicus
gaaaatgatgtctttt

SEQ ID NO: 501669 - DNA, 16 bp, R. norvegicus
gaaaatgcaaaaggca

SEQ ID NO: 501670 - DNA, 16 bp, R. norvegicus
gaaaatgcagtacatt

SEQ ID NO: 501671 - DNA, 16 bp, R. norvegicus
gaaaatgcatttaaaa

SEQ ID NO: 501672 - DNA, 16 bp, R. norvegicus
gaaaatgccatctttt

SEQ ID NO: 501673 - DNA, 16 bp, R. norvegicus
gaaaatgccccacaga

SEQ ID NO: 501674 - DNA, 16 bp, R. norvegicus
gaaaatgccctacaga

SEQ ID NO: 501675 - DNA, 16 bp, R. norvegicus
gaaaatggaaacattt

SEQ ID NO: 501676 - DNA, 16 bp, R. norvegicus
gaaaatggaatttaaa

SEQ ID NO: 501677 - DNA, 16 bp, R. norvegicus
gaaaatgggacattga

SEQ ID NO: 501678 - DNA, 16 bp, R. norvegicus
gaaaatgtaaaactca

SEQ ID NO: 501679 - DNA, 16 bp, R. norvegicus
gaaaatgtcccctgtg

SEQ ID NO: 501680 - DNA, 16 bp, R. norvegicus
gaaaatgtcttcataa

SEQ ID NO: 501681 - DNA, 16 bp, R. norvegicus
gaaaatgtgattcatt

SEQ ID NO: 501682 - DNA, 16 bp, R. norvegicus
gaaaatgttccttttt

SEQ ID NO: 501683 - DNA, 16 bp, R. norvegicus
gaaaattcatagtact

SEQ ID NO: 501684 - DNA, 16 bp, R. norvegicus
gaaaattgaaataatg

SEQ ID NO: 501685 - DNA, 16 bp, R. norvegicus
gaaaatttctctttct

SEQ ID NO: 501686 - DNA, 16 bp, R. norvegicus
gaaaatttgaagagag

SEQ ID NO: 501687 - DNA, 16 bp, R. norvegicus
gaaaatttgctgaaca

SEQ ID NO: 501688 - DNA, 16 bp, R. norvegicus
gaaaatttggagaaaa

SEQ ID NO: 501689 - DNA, 16 bp, R. norvegicus
gaaaatttggagatga

SEQ ID NO: 501690 - DNA, 16 bp, R. norvegicus
gaaaattttgataaat

SEQ ID NO: 501691 - DNA, 16 bp, R. norvegicus
gaaaattttgttttgt

SEQ ID NO: 501692 - DNA, 16 bp, R. norvegicus
gaaacaaaatgaagga

SEQ ID NO: 501693 - DNA, 16 bp, R. norvegicus
gaaacaaagaaatgtt

SEQ ID NO: 501694 - DNA, 16 bp, R. norvegicus
gaaacaaagaagtcaa

SEQ ID NO: 501695 - DNA, 16 bp, R. norvegicus
gaaacaaatcagtagc

SEQ ID NO: 501696 - DNA, 16 bp, R. norvegicus
gaaacaaccagatgtc

SEQ ID NO: 501697 - DNA, 16 bp, R. norvegicus
gaaacaactggaagag

SEQ ID NO: 501698 - DNA, 16 bp, R. norvegicus
gaaacaagaagagact

SEQ ID NO: 501699 - DNA, 16 bp, R. norvegicus
gaaacaagccgagaca

SEQ ID NO: 501700 - DNA, 16 bp, R. norvegicus
gaaacaagtcttcaca

SEQ ID NO: 501701 - DNA, 16 bp, R. norvegicus
gaaacaagttgagaaa

SEQ ID NO: 501702 - DNA, 16 bp, R. norvegicus
gaaacaatgagaagat

SEQ ID NO: 501703 - DNA, 58 bp, R. norvegicus
gaaacacacctcagagacaaagacagacattacctcagagtgaaaggctggaaaacaa

SEQ ID NO: 501704 - DNA, 16 bp, R. norvegicus
gaaacacatcccaact

SEQ ID NO: 501705 - DNA, 16 bp, R. norvegicus
gaaacacctctcgtca

SEQ ID NO: 501706 - DNA, 16 bp, R. norvegicus
gaaacacctgaagaaa

SEQ ID NO: 501707 - DNA, 16 bp, R. norvegicus
gaaacactaaagaaag

SEQ ID NO: 501708 - DNA, 16 bp, R. norvegicus
gaaacactggaaaact

SEQ ID NO: 501709 - DNA, 16 bp, R. norvegicus
gaaacactgtccaggc

SEQ ID NO: 501710 - DNA, 16 bp, R. norvegicus
gaaacagaaagctggt

SEQ ID NO: 501711 - DNA, 16 bp, R. norvegicus
gaaacagaaaggcgag

SEQ ID NO: 501712 - DNA, 16 bp, R. norvegicus
gaaacagaagaaatac

SEQ ID NO: 501713 - DNA, 16 bp, R. norvegicus
gaaacagacacagaga

SEQ ID NO: 501714 - DNA, 16 bp, R. norvegicus
gaaacagacgaaacag

SEQ ID NO: 501715 - DNA, 16 bp, R. norvegicus
gaaacagactcagaga

SEQ ID NO: 501716 - DNA, 16 bp, R. norvegicus
gaaacagagacaggca

SEQ ID NO: 501717 - DNA, 16 bp, R. norvegicus
gaaacagaggcagaga

SEQ ID NO: 501718 - DNA, 16 bp, R. norvegicus
gaaacagaggcagggg

SEQ ID NO: 501719 - DNA, 16 bp, R. norvegicus
gaaacagatacagaga

SEQ ID NO: 501720 - DNA, 16 bp, R. norvegicus
gaaacagatgaagaga

SEQ ID NO: 501721 - DNA, 16 bp, R. norvegicus
gaaacagatgaggatg

SEQ ID NO: 501722 - DNA, 16 bp, R. norvegicus
gaaacagctgaagggg

SEQ ID NO: 501723 - DNA, 16 bp, R. norvegicus
gaaacaggaaacctca

SEQ ID NO: 501724 - DNA, 16 bp, R. norvegicus
gaaacaggactgaagc

SEQ ID NO: 501725 - DNA, 16 bp, R. norvegicus
gaaacagggtctcact

SEQ ID NO: 501726 - DNA, 22 bp, R. norvegicus
gaaacagtctctaaggaataga

SEQ ID NO: 501727 - DNA, 16 bp, R. norvegicus
gaaacagtgagcagag

SEQ ID NO: 501728 - DNA, 16 bp, R. norvegicus
gaaacatggatggaca

SEQ ID NO: 501729 - DNA, 16 bp, R. norvegicus
gaaacatggtttctct

SEQ ID NO: 501730 - DNA, 16 bp, R. norvegicus
gaaacattatacagca

SEQ ID NO: 501731 - DNA, 16 bp, R. norvegicus
gaaacattttctttta

SEQ ID NO: 501732 - DNA, 16 bp, R. norvegicus
gaaaccaaaagaacta

SEQ ID NO: 501733 - DNA, 16 bp, R. norvegicus
gaaaccaaaattctca

SEQ ID NO: 501734 - DNA, 16 bp, R. norvegicus
gaaaccagaagaatcc

SEQ ID NO: 501735 - DNA, 16 bp, R. norvegicus
gaaaccagaggcctca

SEQ ID NO: 501736 - DNA, 16 bp, R. norvegicus
gaaaccagcatttgaa

SEQ ID NO: 501737 - DNA, 16 bp, R. norvegicus
gaaaccaggacaggga

SEQ ID NO: 501738 - DNA, 16 bp, R. norvegicus
gaaaccagtgctaaga

SEQ ID NO: 501739 - DNA, 16 bp, R. norvegicus
gaaaccagttctccca

SEQ ID NO: 501740 - DNA, 16 bp, R. norvegicus
gaaacccaacctcagc

SEQ ID NO: 501741 - DNA, 16 bp, R. norvegicus
gaaacccagctctgag

SEQ ID NO: 501742 - DNA, 16 bp, R. norvegicus
gaaacccagctgtaag

SEQ ID NO: 501743 - DNA, 16 bp, R. norvegicus
gaaaccctgccttaaa

SEQ ID NO: 501744 - DNA, 16 bp, R. norvegicus
gaaaccctgtctccag

SEQ ID NO: 501745 - DNA, 16 bp, R. norvegicus
gaaaccctgtctctga

SEQ ID NO: 501746 - DNA, 16 bp, R. norvegicus
gaaacctcaaagccca

SEQ ID NO: 501747 - DNA, 16 bp, R. norvegicus
gaaacctggaagcagg

SEQ ID NO: 501748 - DNA, 16 bp, R. norvegicus
gaaactaaaagaagag

SEQ ID NO: 501749 - DNA, 16 bp, R. norvegicus
gaaactaacagaagct

SEQ ID NO: 501750 - DNA, 16 bp, R. norvegicus
gaaactatacccaaga

SEQ ID NO: 501751 - DNA, 16 bp, R. norvegicus
gaaactatgaaaacca

SEQ ID NO: 501752 - DNA, 16 bp, R. norvegicus
gaaactcaaaaagaag

SEQ ID NO: 501753 - DNA, 16 bp, R. norvegicus
gaaactcaagaagaag

SEQ ID NO: 501754 - DNA, 16 bp, R. norvegicus
gaaactcaagaagaat

SEQ ID NO: 501755 - DNA, 16 bp, R. norvegicus
gaaactcaagcagggc

SEQ ID NO: 501756 - DNA, 16 bp, R. norvegicus
gaaactcagttatgtc

SEQ ID NO: 501757 - DNA, 16 bp, R. norvegicus
gaaactctcaaagaat

SEQ ID NO: 501758 - DNA, 16 bp, R. norvegicus
gaaactgaaactgaaa

SEQ ID NO: 501759 - DNA, 16 bp, R. norvegicus
gaaactgaaagaatgg

SEQ ID NO: 501760 - DNA, 16 bp, R. norvegicus
gaaactgaagaaaagg

SEQ ID NO: 501761 - DNA, 16 bp, R. norvegicus
gaaactgaagaaattc

SEQ ID NO: 501762 - DNA, 16 bp, R. norvegicus
gaaactgaagaactct

SEQ ID NO: 501763 - DNA, 16 bp, R. norvegicus
gaaactgaagaagata

SEQ ID NO: 501764 - DNA, 16 bp, R. norvegicus
gaaactgaagaaggat

SEQ ID NO: 501765 - DNA, 16 bp, R. norvegicus
gaaactgaagcagagg

SEQ ID NO: 501766 - DNA, 16 bp, R. norvegicus
gaaactgagctcaggt

SEQ ID NO: 501767 - DNA, 16 bp, R. norvegicus
gaaactgaggaggagg

SEQ ID NO: 501768 - DNA, 16 bp, R. norvegicus
gaaactgaggcacaga

SEQ ID NO: 501769 - DNA, 16 bp, R. norvegicus
gaaactgaggcaggag

SEQ ID NO: 501770 - DNA, 16 bp, R. norvegicus
gaaactgaggcctgag

SEQ ID NO: 501771 - DNA, 16 bp, R. norvegicus
gaaactgaggctggaa

SEQ ID NO: 501772 - DNA, 16 bp, R. norvegicus
gaaactgagtcacaga

SEQ ID NO: 501773 - DNA, 25 bp, R. norvegicus
gaaactgagttctacttaggcaaga

SEQ ID NO: 501774 - DNA, 16 bp, R. norvegicus
gaaactgcaaacaacc

SEQ ID NO: 501775 - DNA, 16 bp, R. norvegicus
gaaactgcagggcagg

SEQ ID NO: 501776 - DNA, 16 bp, R. norvegicus
gaaactgcccaggcca

SEQ ID NO: 501777 - DNA, 16 bp, R. norvegicus
gaaactggaaaaggag

SEQ ID NO: 501778 - DNA, 16 bp, R. norvegicus
gaaactggaaagaaca

SEQ ID NO: 501779 - DNA, 16 bp, R. norvegicus
gaaactgggaaagaga

SEQ ID NO: 501780 - DNA, 16 bp, R. norvegicus
gaaactgggaagaagg

SEQ ID NO: 501781 - DNA, 16 bp, R. norvegicus
gaaactgtgggagggg

SEQ ID NO: 501782 - DNA, 16 bp, R. norvegicus
gaaactgtggtcagaa

SEQ ID NO: 501783 - DNA, 16 bp, R. norvegicus
gaaactgtggtcagga

SEQ ID NO: 501784 - DNA, 16 bp, R. norvegicus
gaaacttcagactgat

SEQ ID NO: 501785 - DNA, 16 bp, R. norvegicus
gaaacttctggtttct

SEQ ID NO: 501786 - DNA, 16 bp, R. norvegicus
gaaactttgaaagcca

SEQ ID NO: 501787 - DNA, 16 bp, R. norvegicus
gaaagaaaaaaatgtc

SEQ ID NO: 501788 - DNA, 16 bp, R. norvegicus
gaaagaaaaactttta

SEQ ID NO: 501789 - DNA, 16 bp, R. norvegicus
gaaagaaaacaccaat

SEQ ID NO: 501790 - DNA, 16 bp, R. norvegicus
gaaagaaagaaagcat

SEQ ID NO: 501791 - DNA, 16 bp, R. norvegicus
gaaagaaagtctttta

SEQ ID NO: 501792 - DNA, 16 bp, R. norvegicus
gaaagaaatcaaagac

SEQ ID NO: 501793 - DNA, 16 bp, R. norvegicus
gaaagaaatgcaggaa

SEQ ID NO: 501794 - DNA, 16 bp, R. norvegicus
gaaagaacaagaattc

SEQ ID NO: 501795 - DNA, 16 bp, R. norvegicus
gaaagaacatacaaca

SEQ ID NO: 501796 - DNA, 18 bp, R. norvegicus
gaaagaaccgcagtggca

SEQ ID NO: 501797 - DNA, 16 bp, R. norvegicus
gaaagaactagaaaag

SEQ ID NO: 501798 - DNA, 16 bp, R. norvegicus
gaaagaactgaaagag

SEQ ID NO: 501799 - DNA, 16 bp, R. norvegicus
gaaagaactggaaaag

SEQ ID NO: 501800 - DNA, 16 bp, R. norvegicus
gaaagaactggaagag

SEQ ID NO: 501801 - DNA, 16 bp, R. norvegicus
gaaagaactggagaaa

SEQ ID NO: 501802 - DNA, 16 bp, R. norvegicus
gaaagaactggagaag

SEQ ID NO: 501803 - DNA, 16 bp, R. norvegicus
gaaagaactgggagag

SEQ ID NO: 501804 - DNA, 16 bp, R. norvegicus
gaaagaactgtatgac

SEQ ID NO: 501805 - DNA, 16 bp, R. norvegicus
gaaagaagacatggaa

SEQ ID NO: 501806 - DNA, 16 bp, R. norvegicus
gaaagaagtcagggaa

SEQ ID NO: 501807 - DNA, 16 bp, R. norvegicus
gaaagaagtgaagaac

SEQ ID NO: 501808 - DNA, 16 bp, R. norvegicus
gaaagaataattctca

SEQ ID NO: 501809 - DNA, 16 bp, R. norvegicus
gaaagaatatgatcaa

SEQ ID NO: 501810 - DNA, 16 bp, R. norvegicus
gaaagaatccagatat

SEQ ID NO: 501811 - DNA, 16 bp, R. norvegicus
gaaagaatgttttgct

SEQ ID NO: 501812 - DNA, 16 bp, R. norvegicus
gaaagaattccagaaa

SEQ ID NO: 501813 - DNA, 16 bp, R. norvegicus
gaaagaattcgaggaa

SEQ ID NO: 501814 - DNA, 16 bp, R. norvegicus
gaaagacaaacactcc

SEQ ID NO: 501815 - DNA, 16 bp, R. norvegicus
gaaagacaaatatcat

SEQ ID NO: 501816 - DNA, 16 bp, R. norvegicus
gaaagacagaaataat

SEQ ID NO: 501817 - DNA, 16 bp, R. norvegicus
gaaagacatacatgga

SEQ ID NO: 501818 - DNA, 16 bp, R. norvegicus
gaaagacatggcatca

SEQ ID NO: 501819 - DNA, 16 bp, R. norvegicus
gaaagacattttagaa

SEQ ID NO: 501820 - DNA, 16 bp, R. norvegicus
gaaagacattttcttc

SEQ ID NO: 501821 - DNA, 16 bp, R. norvegicus
gaaagacccaacaaag

SEQ ID NO: 501822 - DNA, 18 bp, R. norvegicus
gaaagaccttggcatttt

SEQ ID NO: 501823 - DNA, 16 bp, R. norvegicus
gaaagactggaagaag

SEQ ID NO: 501824 - DNA, 16 bp, R. norvegicus
gaaagacttgaagaac

SEQ ID NO: 501825 - DNA, 16 bp, R. norvegicus
gaaagagaaaatatca

SEQ ID NO: 501826 - DNA, 16 bp, R. norvegicus
gaaagagaactgactc

SEQ ID NO: 501827 - DNA, 16 bp, R. norvegicus
gaaagagagatacaga

SEQ ID NO: 501828 - DNA, 16 bp, R. norvegicus
gaaagagatcaggaac

SEQ ID NO: 501829 - DNA, 16 bp, R. norvegicus
gaaagagatcaggagc

SEQ ID NO: 501830 - DNA, 16 bp, R. norvegicus
gaaagagatcaggagg

SEQ ID NO: 501831 - DNA, 16 bp, R. norvegicus
gaaagagatgcccaga

SEQ ID NO: 501832 - DNA, 16 bp, R. norvegicus
gaaagagcagcaaatg

SEQ ID NO: 501833 - DNA, 31 bp, R. norvegicus
gaaagagcggcgcagatcttcccggttgctg

SEQ ID NO: 501834 - DNA, 16 bp, R. norvegicus
gaaagagctgaaggaa

SEQ ID NO: 501835 - DNA, 16 bp, R. norvegicus
gaaagagctgaaggag

SEQ ID NO: 501836 - DNA, 16 bp, R. norvegicus
gaaagaggaaactcct

SEQ ID NO: 501837 - DNA, 16 bp, R. norvegicus
gaaagaggctcccagg

SEQ ID NO: 501838 - DNA, 16 bp, R. norvegicus
gaaagaggtgaagaac

SEQ ID NO: 501839 - DNA, 16 bp, R. norvegicus
gaaagagtggagcaga

SEQ ID NO: 501840 - DNA, 16 bp, R. norvegicus
gaaagatctctatgat

SEQ ID NO: 501841 - DNA, 16 bp, R. norvegicus
gaaagatctgaaggag

SEQ ID NO: 501842 - DNA, 16 bp, R. norvegicus
gaaagatggctcagcg

SEQ ID NO: 501843 - DNA, 16 bp, R. norvegicus
gaaagcaaaaggctcc

SEQ ID NO: 501844 - DNA, 16 bp, R. norvegicus
gaaagcaaagcaaagc

SEQ ID NO: 501845 - DNA, 16 bp, R. norvegicus
gaaagcaaaggtgaca

SEQ ID NO: 501846 - DNA, 16 bp, R. norvegicus
gaaagcaagaggctcc

SEQ ID NO: 501847 - DNA, 16 bp, R. norvegicus
gaaagcacacagggag

SEQ ID NO: 501848 - DNA, 16 bp, R. norvegicus
gaaagcacagcagcag

SEQ ID NO: 501849 - DNA, 16 bp, R. norvegicus
gaaagcagaagcagga

SEQ ID NO: 501850 - DNA, 16 bp, R. norvegicus
gaaagcagagctaaga

SEQ ID NO: 501851 - DNA, 16 bp, R. norvegicus
gaaagcagaggcagga

SEQ ID NO: 501852 - DNA, 16 bp, R. norvegicus
gaaagcaggctgaaga

SEQ ID NO: 501853 - DNA, 16 bp, R. norvegicus
gaaagcatttcactgg

SEQ ID NO: 501854 - DNA, 16 bp, R. norvegicus
gaaagcatttgaaatg

SEQ ID NO: 501855 - DNA, 16 bp, R. norvegicus
gaaagcatttgtcaaa

SEQ ID NO: 501856 - DNA, 16 bp, R. norvegicus
gaaagccaggaacaga

SEQ ID NO: 501857 - DNA, 16 bp, R. norvegicus
gaaagccagggtgggg

SEQ ID NO: 501858 - DNA, 16 bp, R. norvegicus
gaaagccagtatccag

SEQ ID NO: 501859 - DNA, 16 bp, R. norvegicus
gaaagccatgctaaga

SEQ ID NO: 501860 - DNA, 16 bp, R. norvegicus
gaaagcccacatacaa

SEQ ID NO: 501861 - DNA, 16 bp, R. norvegicus
gaaagcctgacagcct

SEQ ID NO: 501862 - DNA, 16 bp, R. norvegicus
gaaagctgaatcttca

SEQ ID NO: 501863 - DNA, 16 bp, R. norvegicus
gaaagctgctagtgga

SEQ ID NO: 501864 - DNA, 16 bp, R. norvegicus
gaaagctgtgcaaaga

SEQ ID NO: 501865 - DNA, 16 bp, R. norvegicus
gaaaggaaaagtcaaa

SEQ ID NO: 501866 - DNA, 16 bp, R. norvegicus
gaaaggaaactgggaa

SEQ ID NO: 501867 - DNA, 16 bp, R. norvegicus
gaaaggaaaggtagca

SEQ ID NO: 501868 - DNA, 16 bp, R. norvegicus
gaaaggaaataatcag

SEQ ID NO: 501869 - DNA, 16 bp, R. norvegicus
gaaaggaaatttaatt

SEQ ID NO: 501870 - DNA, 16 bp, R. norvegicus
gaaaggaactggatat

SEQ ID NO: 501871 - DNA, 16 bp, R. norvegicus
gaaaggaagttgggct

SEQ ID NO: 501872 - DNA, 16 bp, R. norvegicus
gaaaggaattaaaaac

SEQ ID NO: 501873 - DNA, 16 bp, R. norvegicus
gaaaggacagaccaga

SEQ ID NO: 501874 - DNA, 16 bp, R. norvegicus
gaaaggactgaagccc

SEQ ID NO: 501875 - DNA, 16 bp, R. norvegicus
gaaaggagtgtgtgtg

SEQ ID NO: 501876 - DNA, 16 bp, R. norvegicus
gaaaggatacagggaa

SEQ ID NO: 501877 - DNA, 16 bp, R. norvegicus
gaaaggatggatggat

SEQ ID NO: 501878 - DNA, 16 bp, R. norvegicus
gaaaggatgttttgat

SEQ ID NO: 501879 - DNA, 16 bp, R. norvegicus
gaaaggattcaaggag

SEQ ID NO: 501880 - DNA, 16 bp, R. norvegicus
gaaaggcagatgccca

SEQ ID NO: 501881 - DNA, 16 bp, R. norvegicus
gaaaggccctgtctca

SEQ ID NO: 501882 - DNA, 16 bp, R. norvegicus
gaaaggcctgaagaag

SEQ ID NO: 501883 - DNA, 16 bp, R. norvegicus
gaaaggcgctgcttat

SEQ ID NO: 501884 - DNA, 16 bp, R. norvegicus
gaaaggctggaaaaaa

SEQ ID NO: 501885 - DNA, 16 bp, R. norvegicus
gaaaggctggaaaaag

SEQ ID NO: 501886 - DNA, 16 bp, R. norvegicus
gaaaggctggaagaag

SEQ ID NO: 501887 - DNA, 16 bp, R. norvegicus
gaaaggcttattttgg

SEQ ID NO: 501888 - DNA, 16 bp, R. norvegicus
gaaaggctttgccaga

SEQ ID NO: 501889 - DNA, 16 bp, R. norvegicus
gaaagggagatgtttg

SEQ ID NO: 501890 - DNA, 16 bp, R. norvegicus
gaaaggggaacactct

SEQ ID NO: 501891 - DNA, 16 bp, R. norvegicus
gaaaggggagaacatt

SEQ ID NO: 501892 - DNA, 16 bp, R. norvegicus
gaaagggggcttatgg

SEQ ID NO: 501893 - DNA, 16 bp, R. norvegicus
gaaagggtctctgttt

SEQ ID NO: 501894 - DNA, 16 bp, R. norvegicus
gaaagggtttatttgc

SEQ ID NO: 501895 - DNA, 16 bp, R. norvegicus
gaaaggtatagctgga

SEQ ID NO: 501896 - DNA, 16 bp, R. norvegicus
gaaaggtttaatgaaa

SEQ ID NO: 501897 - DNA, 16 bp, R. norvegicus
gaaagtaccatgaaga

SEQ ID NO: 501898 - DNA, 16 bp, R. norvegicus
gaaagtatcatcctga

SEQ ID NO: 501899 - DNA, 16 bp, R. norvegicus
gaaagtatttttttaa

SEQ ID NO: 501900 - DNA, 16 bp, R. norvegicus
gaaagtcagagacaga

SEQ ID NO: 501901 - DNA, 16 bp, R. norvegicus
gaaagtccctgaaact

SEQ ID NO: 501902 - DNA, 16 bp, R. norvegicus
gaaagtctcagtgtct

SEQ ID NO: 501903 - DNA, 16 bp, R. norvegicus
gaaagtctggaaaaca

SEQ ID NO: 501904 - DNA, 16 bp, R. norvegicus
gaaagtctggaagaag

SEQ ID NO: 501905 - DNA, 16 bp, R. norvegicus
gaaagtcttggaaaga

SEQ ID NO: 501906 - DNA, 16 bp, R. norvegicus
gaaagtgtggagaata

SEQ ID NO: 501907 - DNA, 17 bp, R. norvegicus
gaaagttatggatcctt

SEQ ID NO: 501908 - DNA, 16 bp, R. norvegicus
gaaagttcaaggccaa

SEQ ID NO: 501909 - DNA, 16 bp, R. norvegicus
gaaagttccaggacag

SEQ ID NO: 501910 - DNA, 16 bp, R. norvegicus
gaaagttcttttattg

SEQ ID NO: 501911 - DNA, 16 bp, R. norvegicus
gaaagtttagctctcc

SEQ ID NO: 501912 - DNA, 16 bp, R. norvegicus
gaaagttttactggat

SEQ ID NO: 501913 - DNA, 16 bp, R. norvegicus
gaaagttttcttctgt

SEQ ID NO: 501914 - DNA, 16 bp, R. norvegicus
gaaataaacctttccc

SEQ ID NO: 501915 - DNA, 16 bp, R. norvegicus
gaaataaacctttcct

SEQ ID NO: 501916 - DNA, 16 bp, R. norvegicus
gaaataacatttgaaa

SEQ ID NO: 501917 - DNA, 16 bp, R. norvegicus
gaaataagccttcaca

SEQ ID NO: 501918 - DNA, 16 bp, R. norvegicus
gaaataatcaaactga

SEQ ID NO: 501919 - DNA, 16 bp, R. norvegicus
gaaataattctttttt

SEQ ID NO: 501920 - DNA, 16 bp, R. norvegicus
gaaataatttgaagag

SEQ ID NO: 501921 - DNA, 16 bp, R. norvegicus
gaaatacagaagaaca

SEQ ID NO: 501922 - DNA, 16 bp, R. norvegicus
gaaatacaggaaaatg

SEQ ID NO: 501923 - DNA, 16 bp, R. norvegicus
gaaatacaggaagaaa

SEQ ID NO: 501924 - DNA, 16 bp, R. norvegicus
gaaatactgggccaaa

SEQ ID NO: 501925 - DNA, 16 bp, R. norvegicus
gaaatagaaaccctaa

SEQ ID NO: 501926 - DNA, 19 bp, R. norvegicus
gaaatagaagcaatgaaga

SEQ ID NO: 501927 - DNA, 16 bp, R. norvegicus
gaaatagaagctatca

SEQ ID NO: 501928 - DNA, 16 bp, R. norvegicus
gaaatagacaatttcc

SEQ ID NO: 501929 - DNA, 16 bp, R. norvegicus
gaaatagcagaataaa

SEQ ID NO: 501930 - DNA, 16 bp, R. norvegicus
gaaatagtctttaaaa

SEQ ID NO: 501931 - DNA, 16 bp, R. norvegicus
gaaatatcttcaacaa

SEQ ID NO: 501932 - DNA, 16 bp, R. norvegicus
gaaatatggaaacaaa

SEQ ID NO: 501933 - DNA, 16 bp, R. norvegicus
gaaatatggaagcaaa

SEQ ID NO: 501934 - DNA, 16 bp, R. norvegicus
gaaatatggagacaat

SEQ ID NO: 501935 - DNA, 16 bp, R. norvegicus
gaaatatggtacattt

SEQ ID NO: 501936 - DNA, 16 bp, R. norvegicus
gaaatatttctttttt

SEQ ID NO: 501937 - DNA, 16 bp, R. norvegicus
gaaatatttttaaaga

SEQ ID NO: 501938 - DNA, 16 bp, R. norvegicus
gaaatcaagaggctcc

SEQ ID NO: 501939 - DNA, 17 bp, R. norvegicus
gaaatcaagcctatccc

SEQ ID NO: 501940 - DNA, 16 bp, R. norvegicus
gaaatcaatctgaagg

SEQ ID NO: 501941 - DNA, 16 bp, R. norvegicus
gaaatcaatttggaga

SEQ ID NO: 501942 - DNA, 16 bp, R. norvegicus
gaaatcacagaagaag

SEQ ID NO: 501943 - DNA, 16 bp, R. norvegicus
gaaatcacagatattt

SEQ ID NO: 501944 - DNA, 16 bp, R. norvegicus
gaaatcagaaatttcc

SEQ ID NO: 501945 - DNA, 16 bp, R. norvegicus
gaaatccaggaaaata

SEQ ID NO: 501946 - DNA, 16 bp, R. norvegicus
gaaatcctaattaaga

SEQ ID NO: 501947 - DNA, 16 bp, R. norvegicus
gaaatcctatctcaaa

SEQ ID NO: 501948 - DNA, 16 bp, R. norvegicus
gaaatctgtgaaaaca

SEQ ID NO: 501949 - DNA, 16 bp, R. norvegicus
gaaatgaaaaggaaca

SEQ ID NO: 501950 - DNA, 16 bp, R. norvegicus
gaaatgaaaatacata

SEQ ID NO: 501951 - DNA, 16 bp, R. norvegicus
gaaatgaaaatatcac

SEQ ID NO: 501952 - DNA, 16 bp, R. norvegicus
gaaatgaacaaaacca

SEQ ID NO: 501953 - DNA, 16 bp, R. norvegicus
gaaatgaaccacattt

SEQ ID NO: 501954 - DNA, 16 bp, R. norvegicus
gaaatgaacctgggtc

SEQ ID NO: 501955 - DNA, 16 bp, R. norvegicus
gaaatgacacctttta

SEQ ID NO: 501956 - DNA, 16 bp, R. norvegicus
gaaatgaccatgtgat

SEQ ID NO: 501957 - DNA, 26 bp, R. norvegicus
gaaatgagccacagggagagtccaga

SEQ ID NO: 501958 - DNA, 16 bp, R. norvegicus
gaaatgatcatatgtt

SEQ ID NO: 501959 - DNA, 16 bp, R. norvegicus
gaaatgatgatgatga

SEQ ID NO: 501960 - DNA, 16 bp, R. norvegicus
gaaatgcaaagcaaaa

SEQ ID NO: 501961 - DNA, 16 bp, R. norvegicus
gaaatgcaaattaaaa

SEQ ID NO: 501962 - DNA, 16 bp, R. norvegicus
gaaatgcaccaaaaat

SEQ ID NO: 501963 - DNA, 16 bp, R. norvegicus
gaaatgcagggatgga

SEQ ID NO: 501964 - DNA, 16 bp, R. norvegicus
gaaatgccctacaatg

SEQ ID NO: 501965 - DNA, 16 bp, R. norvegicus
gaaatgccctacaggc

SEQ ID NO: 501966 - DNA, 16 bp, R. norvegicus
gaaatgctgatgataa

SEQ ID NO: 501967 - DNA, 16 bp, R. norvegicus
gaaatgcttccccatg

SEQ ID NO: 501968 - DNA, 16 bp, R. norvegicus
gaaatggacatttttt

SEQ ID NO: 501969 - DNA, 16 bp, R. norvegicus
gaaatggagaatttcc

SEQ ID NO: 501970 - DNA, 16 bp, R. norvegicus
gaaatggcagattctt

SEQ ID NO: 501971 - DNA, 16 bp, R. norvegicus
gaaatggcatcaagaa

SEQ ID NO: 501972 - DNA, 16 bp, R. norvegicus
gaaatggctcagctgg

SEQ ID NO: 501973 - DNA, 16 bp, R. norvegicus
gaaatgtaaatacgta

SEQ ID NO: 501974 - DNA, 16 bp, R. norvegicus
gaaatgtccctcacag

SEQ ID NO: 501975 - DNA, 16 bp, R. norvegicus
gaaatgtctttttaaa

SEQ ID NO: 501976 - DNA, 16 bp, R. norvegicus
gaaatgtgttttattt

SEQ ID NO: 501977 - DNA, 16 bp, R. norvegicus
gaaatgttcaacatca

SEQ ID NO: 501978 - DNA, 16 bp, R. norvegicus
gaaatgtttttaaaaa

SEQ ID NO: 501979 - DNA, 16 bp, R. norvegicus
gaaattaaaaactttt

SEQ ID NO: 501980 - DNA, 16 bp, R. norvegicus
gaaattaaacagaaac

SEQ ID NO: 501981 - DNA, 16 bp, R. norvegicus
gaaattaaagacttcc

SEQ ID NO: 501982 - DNA, 16 bp, R. norvegicus
gaaattaaagactttc

SEQ ID NO: 501983 - DNA, 16 bp, R. norvegicus
gaaattaccaaagaat

SEQ ID NO: 501984 - DNA, 16 bp, R. norvegicus
gaaattatggaaataa

SEQ ID NO: 501985 - DNA, 16 bp, R. norvegicus
gaaattattgacacaa

SEQ ID NO: 501986 - DNA, 16 bp, R. norvegicus
gaaattcaaatggctg

SEQ ID NO: 501987 - DNA, 16 bp, R. norvegicus
gaaattcacagacaaa

SEQ ID NO: 501988 - DNA, 23 bp, R. norvegicus
gaaattcactgatgaagttgtgt

SEQ ID NO: 501989 - DNA, 16 bp, R. norvegicus
gaaattcagaaaaata

SEQ ID NO: 501990 - DNA, 16 bp, R. norvegicus
gaaattcctcctttca

SEQ ID NO: 501991 - DNA, 16 bp, R. norvegicus
gaaattctcaaaaatt

SEQ ID NO: 501992 - DNA, 16 bp, R. norvegicus
gaaattctcaaagagt

SEQ ID NO: 501993 - DNA, 16 bp, R. norvegicus
gaaattctccaagaat

SEQ ID NO: 501994 - DNA, 16 bp, R. norvegicus
gaaattctccccagtg

SEQ ID NO: 501995 - DNA, 16 bp, R. norvegicus
gaaattctgcttccct

SEQ ID NO: 501996 - DNA, 16 bp, R. norvegicus
gaaattcttaggcaag

SEQ ID NO: 501997 - DNA, 16 bp, R. norvegicus
gaaattcttcttcact

SEQ ID NO: 501998 - DNA, 16 bp, R. norvegicus
gaaattctttcttctt

SEQ ID NO: 501999 - DNA, 16 bp, R. norvegicus
gaaattgaaagcatgt

SEQ ID NO: 502000 - DNA, 16 bp, R. norvegicus
gaaattgaagaaaaca

SEQ ID NO: 502001 - DNA, 16 bp, R. norvegicus
gaaattgaagatgtca

SEQ ID NO: 502002 - DNA, 16 bp, R. norvegicus
gaaattgagtccatta

SEQ ID NO: 502003 - DNA, 16 bp, R. norvegicus
gaaattggagagatca

SEQ ID NO: 502004 - DNA, 16 bp, R. norvegicus
gaaattgtgaaccaaa

SEQ ID NO: 502005 - DNA, 16 bp, R. norvegicus
gaaatttgaaatattt

SEQ ID NO: 502006 - DNA, 16 bp, R. norvegicus
gaaattttcccctttg

SEQ ID NO: 502007 - DNA, 16 bp, R. norvegicus
gaaattttcctgaact

SEQ ID NO: 502008 - DNA, 16 bp, R. norvegicus
gaaattttcctgtaca

SEQ ID NO: 502009 - DNA, 16 bp, R. norvegicus
gaaattttcttcagtg

SEQ ID NO: 502010 - DNA, 16 bp, R. norvegicus
gaaatttttcccagtg

SEQ ID NO: 502011 - DNA, 16 bp, R. norvegicus
gaacaaaaccatccag

SEQ ID NO: 502012 - DNA, 16 bp, R. norvegicus
gaacaaaaccgtataa

SEQ ID NO: 502013 - DNA, 16 bp, R. norvegicus
gaacaaaatattcaag

SEQ ID NO: 502014 - DNA, 16 bp, R. norvegicus
gaacaaaatcatccaa

SEQ ID NO: 502015 - DNA, 16 bp, R. norvegicus
gaacaaaatgacaacc

SEQ ID NO: 502016 - DNA, 16 bp, R. norvegicus
gaacaaagtgtgtgtg

SEQ ID NO: 502017 - DNA, 16 bp, R. norvegicus
gaacaaatgaaactca

SEQ ID NO: 502018 - DNA, 16 bp, R. norvegicus
gaacaacaacatcaac

SEQ ID NO: 502019 - DNA, 16 bp, R. norvegicus
gaacaacaatgccgac

SEQ ID NO: 502020 - DNA, 16 bp, R. norvegicus
gaacaaccagcaggca

SEQ ID NO: 502021 - DNA, 16 bp, R. norvegicus
gaacaaccttgagaag

SEQ ID NO: 502022 - DNA, 16 bp, R. norvegicus
gaacaactggagcaga

SEQ ID NO: 502023 - DNA, 16 bp, R. norvegicus
gaacaagaacaccctt

SEQ ID NO: 502024 - DNA, 16 bp, R. norvegicus
gaacaagaagctgtaa

SEQ ID NO: 502025 - DNA, 16 bp, R. norvegicus
gaacaagatcataaaa

SEQ ID NO: 502026 - DNA, 16 bp, R. norvegicus
gaacaatagaagaact

SEQ ID NO: 502027 - DNA, 16 bp, R. norvegicus
gaacaatttccctcat

SEQ ID NO: 502028 - DNA, 16 bp, R. norvegicus
gaacacacactcacac

SEQ ID NO: 502029 - DNA, 16 bp, R. norvegicus
gaacacagaaggcacc

SEQ ID NO: 502030 - DNA, 16 bp, R. norvegicus
gaacacagagcctgct

SEQ ID NO: 502031 - DNA, 16 bp, R. norvegicus
gaacacatggaaagaa

SEQ ID NO: 502032 - DNA, 16 bp, R. norvegicus
gaacacatggacactg

SEQ ID NO: 502033 - DNA, 16 bp, R. norvegicus
gaacacatgggcaatg

SEQ ID NO: 502034 - DNA, 16 bp, R. norvegicus
gaacacatgggcacca

SEQ ID NO: 502035 - DNA, 16 bp, R. norvegicus
gaacacatgggcattg

SEQ ID NO: 502036 - DNA, 16 bp, R. norvegicus
gaacaccaatgccagc

SEQ ID NO: 502037 - DNA, 16 bp, R. norvegicus
gaacaccacaagaaga

SEQ ID NO: 502038 - DNA, 16 bp, R. norvegicus
gaacactcctacattg

SEQ ID NO: 502039 - DNA, 16 bp, R. norvegicus
gaacactccttcatta

SEQ ID NO: 502040 - DNA, 16 bp, R. norvegicus
gaacactgattgttct

SEQ ID NO: 502041 - DNA, 16 bp, R. norvegicus
gaacactggctgcttt

SEQ ID NO: 502042 - DNA, 16 bp, R. norvegicus
gaacagaaggcagaag

SEQ ID NO: 502043 - DNA, 16 bp, R. norvegicus
gaacagactctgccag

SEQ ID NO: 502044 - DNA, 16 bp, R. norvegicus
gaacagagatgtagac

SEQ ID NO: 502045 - DNA, 16 bp, R. norvegicus
gaacagagattgaagg

SEQ ID NO: 502046 - DNA, 16 bp, R. norvegicus
gaacagagcagaggag

SEQ ID NO: 502047 - DNA, 60 bp, R. norvegicus
gaacagataaaccagttaaacaaccgcataactcctaaggaaatagaagcagtcattaaa

SEQ ID NO: 502048 - DNA, 16 bp, R. norvegicus
gaacagcaatatcaac

SEQ ID NO: 502049 - DNA, 16 bp, R. norvegicus
gaacagcagcagcagc

SEQ ID NO: 502050 - DNA, 16 bp, R. norvegicus
gaacagcagcagcagg

SEQ ID NO: 502051 - DNA, 16 bp, R. norvegicus
gaacagctaaagacca

SEQ ID NO: 502052 - DNA, 16 bp, R. norvegicus
gaacaggaagaaactg

SEQ ID NO: 502053 - DNA, 16 bp, R. norvegicus
gaacaggacaggacag

SEQ ID NO: 502054 - DNA, 16 bp, R. norvegicus
gaacaggagctacaga

SEQ ID NO: 502055 - DNA, 16 bp, R. norvegicus
gaacaggggcagaagg

SEQ ID NO: 502056 - DNA, 16 bp, R. norvegicus
gaacaggtgggcactc

SEQ ID NO: 502057 - DNA, 16 bp, R. norvegicus
gaacatatcaaaaaga

SEQ ID NO: 502058 - DNA, 16 bp, R. norvegicus
gaacatatcatcctga

SEQ ID NO: 502059 - DNA, 16 bp, R. norvegicus
gaacatcacagaagag

SEQ ID NO: 502060 - DNA, 16 bp, R. norvegicus
gaacatcatcatcatc

SEQ ID NO: 502061 - DNA, 16 bp, R. norvegicus
gaacatcatcctggaa

SEQ ID NO: 502062 - DNA, 16 bp, R. norvegicus
gaacatccagtgattt

SEQ ID NO: 502063 - DNA, 16 bp, R. norvegicus
gaacatcctcatagaa

SEQ ID NO: 502064 - DNA, 16 bp, R. norvegicus
gaacatgaagaaatca

SEQ ID NO: 502065 - DNA, 16 bp, R. norvegicus
gaacatggccagcaga

SEQ ID NO: 502066 - DNA, 16 bp, R. norvegicus
gaacatggcccacaga

SEQ ID NO: 502067 - DNA, 16 bp, R. norvegicus
gaacatggtggagcac

SEQ ID NO: 502068 - DNA, 16 bp, R. norvegicus
gaacattctagaaaag

SEQ ID NO: 502069 - DNA, 16 bp, R. norvegicus
gaacattggacattga

SEQ ID NO: 502070 - DNA, 16 bp, R. norvegicus
gaacattgtggaagag

SEQ ID NO: 502071 - DNA, 16 bp, R. norvegicus
gaacatttatgcccca

SEQ ID NO: 502072 - DNA, 16 bp, R. norvegicus
gaacatttctttggtg

SEQ ID NO: 502073 - DNA, 16 bp, R. norvegicus
gaacattttcctgaaa

SEQ ID NO: 502074 - DNA, 16 bp, R. norvegicus
gaacattttggaagag

SEQ ID NO: 502075 - DNA, 16 bp, R. norvegicus
gaacattttgttaaag

SEQ ID NO: 502076 - DNA, 30 bp, R. norvegicus
gaaccaaaagagattttggaattacggcag

SEQ ID NO: 502077 - DNA, 16 bp, R. norvegicus
gaaccaaaagctgatt

SEQ ID NO: 502078 - DNA, 16 bp, R. norvegicus
gaaccaaatggaatta

SEQ ID NO: 502079 - DNA, 16 bp, R. norvegicus
gaaccaacttctgcaa

SEQ ID NO: 502080 - DNA, 16 bp, R. norvegicus
gaaccaagctcaggtc

SEQ ID NO: 502081 - DNA, 16 bp, R. norvegicus
gaaccaagggcttccc

SEQ ID NO: 502082 - DNA, 16 bp, R. norvegicus
gaaccacatggtggaa

SEQ ID NO: 502083 - DNA, 16 bp, R. norvegicus
gaaccaccacccaaag

SEQ ID NO: 502084 - DNA, 16 bp, R. norvegicus
gaaccaccagcccagg

SEQ ID NO: 502085 - DNA, 16 bp, R. norvegicus
gaaccacccacagtgg

SEQ ID NO: 502086 - DNA, 16 bp, R. norvegicus
gaaccactgagctaga

SEQ ID NO: 502087 - DNA, 16 bp, R. norvegicus
gaaccactgtctacag

SEQ ID NO: 502088 - DNA, 16 bp, R. norvegicus
gaaccagagaatgaga

SEQ ID NO: 502089 - DNA, 16 bp, R. norvegicus
gaaccagagctctggg

SEQ ID NO: 502090 - DNA, 16 bp, R. norvegicus
gaaccagaggcaggag

SEQ ID NO: 502091 - DNA, 16 bp, R. norvegicus
gaaccagaggctggat

SEQ ID NO: 502092 - DNA, 16 bp, R. norvegicus
gaaccagagtttggat

SEQ ID NO: 502093 - DNA, 16 bp, R. norvegicus
gaaccagcagctgtag

SEQ ID NO: 502094 - DNA, 16 bp, R. norvegicus
gaaccagccaaccaga

SEQ ID NO: 502095 - DNA, 16 bp, R. norvegicus
gaaccagccagccaga

SEQ ID NO: 502096 - DNA, 16 bp, R. norvegicus
gaaccagcccaagaga

SEQ ID NO: 502097 - DNA, 16 bp, R. norvegicus
gaaccagctcctggat

SEQ ID NO: 502098 - DNA, 16 bp, R. norvegicus
gaaccaggaaccagga

SEQ ID NO: 502099 - DNA, 16 bp, R. norvegicus
gaaccaggagaagaga

SEQ ID NO: 502100 - DNA, 16 bp, R. norvegicus
gaaccaggctgccttt

SEQ ID NO: 502101 - DNA, 16 bp, R. norvegicus
gaaccagggaaaccca

SEQ ID NO: 502102 - DNA, 17 bp, R. norvegicus
gaaccagggcaatgctg

SEQ ID NO: 502103 - DNA, 16 bp, R. norvegicus
gaaccatctctccaac

SEQ ID NO: 502104 - DNA, 16 bp, R. norvegicus
gaacccaaaagttcca

SEQ ID NO: 502105 - DNA, 16 bp, R. norvegicus
gaacccaattctccca

SEQ ID NO: 502106 - DNA, 16 bp, R. norvegicus
gaacccacctggagcc

SEQ ID NO: 502107 - DNA, 16 bp, R. norvegicus
gaacccagagccttgt

SEQ ID NO: 502108 - DNA, 16 bp, R. norvegicus
gaacccagaggcagga

SEQ ID NO: 502109 - DNA, 16 bp, R. norvegicus
gaacccagaggcctca

SEQ ID NO: 502110 - DNA, 16 bp, R. norvegicus
gaacccaggaccttgc

SEQ ID NO: 502111 - DNA, 16 bp, R. norvegicus
gaacccagggccacca

SEQ ID NO: 502112 - DNA, 16 bp, R. norvegicus
gaacccagggcctctt

SEQ ID NO: 502113 - DNA, 16 bp, R. norvegicus
gaacccagggccttct

SEQ ID NO: 502114 - DNA, 16 bp, R. norvegicus
gaacccagggctgtgt

SEQ ID NO: 502115 - DNA, 16 bp, R. norvegicus
gaacccagggcttcac

SEQ ID NO: 502116 - DNA, 16 bp, R. norvegicus
gaacccagggtctcac

SEQ ID NO: 502117 - DNA, 16 bp, R. norvegicus
gaacccagggtcttgc

SEQ ID NO: 502118 - DNA, 16 bp, R. norvegicus
gaacccaggtcctctg

SEQ ID NO: 502119 - DNA, 16 bp, R. norvegicus
gaacccattacagatg

SEQ ID NO: 502120 - DNA, 16 bp, R. norvegicus
gaaccccacttttaat

SEQ ID NO: 502121 - DNA, 16 bp, R. norvegicus
gaaccccattgaagga

SEQ ID NO: 502122 - DNA, 16 bp, R. norvegicus
gaacccccagggaact

SEQ ID NO: 502123 - DNA, 16 bp, R. norvegicus
gaaccctgcagaagag

SEQ ID NO: 502124 - DNA, 16 bp, R. norvegicus
gaaccctggctgtcct

SEQ ID NO: 502125 - DNA, 16 bp, R. norvegicus
gaaccctggggcactg

SEQ ID NO: 502126 - DNA, 16 bp, R. norvegicus
gaaccctggtcctctg

SEQ ID NO: 502127 - DNA, 16 bp, R. norvegicus
gaaccggaaccggaac

SEQ ID NO: 502128 - DNA, 16 bp, R. norvegicus
gaaccgtttccctgtg

SEQ ID NO: 502129 - DNA, 16 bp, R. norvegicus
gaacctaaacaacaga

SEQ ID NO: 502130 - DNA, 16 bp, R. norvegicus
gaacctaagcaaaaga

SEQ ID NO: 502131 - DNA, 16 bp, R. norvegicus
gaacctacagaattca

SEQ ID NO: 502132 - DNA, 16 bp, R. norvegicus
gaacctcaaacacatt

SEQ ID NO: 502133 - DNA, 16 bp, R. norvegicus
gaacctcaacataaaa

SEQ ID NO: 502134 - DNA, 16 bp, R. norvegicus
gaacctgaagagacct

SEQ ID NO: 502135 - DNA, 16 bp, R. norvegicus
gaacctgaagggatct

SEQ ID NO: 502136 - DNA, 16 bp, R. norvegicus
gaacctgagcttcctg

SEQ ID NO: 502137 - DNA, 16 bp, R. norvegicus
gaacctgaggaggagg

SEQ ID NO: 502138 - DNA, 16 bp, R. norvegicus
gaacctgatagaaaca

SEQ ID NO: 502139 - DNA, 16 bp, R. norvegicus
gaacctgatagaagag

SEQ ID NO: 502140 - DNA, 16 bp, R. norvegicus
gaacctgatagagctg

SEQ ID NO: 502141 - DNA, 16 bp, R. norvegicus
gaacctgcaggcagga

SEQ ID NO: 502142 - DNA, 16 bp, R. norvegicus
gaacctggagacagaa

SEQ ID NO: 502143 - DNA, 16 bp, R. norvegicus
gaacctggagctcact

SEQ ID NO: 502144 - DNA, 16 bp, R. norvegicus
gaacctggattctctg

SEQ ID NO: 502145 - DNA, 16 bp, R. norvegicus
gaacctgggaagggga

SEQ ID NO: 502146 - DNA, 16 bp, R. norvegicus
gaacctgggtccactg

SEQ ID NO: 502147 - DNA, 16 bp, R. norvegicus
gaacctgggtcctctg

SEQ ID NO: 502148 - DNA, 16 bp, R. norvegicus
gaacctgggttctttg

SEQ ID NO: 502149 - DNA, 16 bp, R. norvegicus
gaacctgtgacagtga

SEQ ID NO: 502150 - DNA, 16 bp, R. norvegicus
gaacctgtgtcttctg

SEQ ID NO: 502151 - DNA, 17 bp, R. norvegicus
gaaccttaaagggacag

SEQ ID NO: 502152 - DNA, 16 bp, R. norvegicus
gaaccttactaaagct

SEQ ID NO: 502153 - DNA, 16 bp, R. norvegicus
gaaccttcttcccatt

SEQ ID NO: 502154 - DNA, 16 bp, R. norvegicus
gaaccttgaagaaatg

SEQ ID NO: 502155 - DNA, 16 bp, R. norvegicus
gaaccttggagagtgg

SEQ ID NO: 502156 - DNA, 22 bp, R. norvegicus
gaacctttcattcccaatataa

SEQ ID NO: 502157 - DNA, 16 bp, R. norvegicus
gaacgcagggccttgc

SEQ ID NO: 502158 - DNA, 16 bp, R. norvegicus
gaactaaaccatcaac

SEQ ID NO: 502159 - DNA, 16 bp, R. norvegicus
gaactaaatgaattta

SEQ ID NO: 502160 - DNA, 16 bp, R. norvegicus
gaactaacagaccata

SEQ ID NO: 502161 - DNA, 16 bp, R. norvegicus
gaactaagaatgggac

SEQ ID NO: 502162 - DNA, 16 bp, R. norvegicus
gaactacaactcccag

SEQ ID NO: 502163 - DNA, 16 bp, R. norvegicus
gaactacatctccagc

SEQ ID NO: 502164 - DNA, 16 bp, R. norvegicus
gaactacatttcccag

SEQ ID NO: 502165 - DNA, 16 bp, R. norvegicus
gaactacctgaggagc

SEQ ID NO: 502166 - DNA, 16 bp, R. norvegicus
gaactagaaaacatca

SEQ ID NO: 502167 - DNA, 16 bp, R. norvegicus
gaactagggaggcaga

SEQ ID NO: 502168 - DNA, 16 bp, R. norvegicus
gaactatgacctggaa

SEQ ID NO: 502169 - DNA, 16 bp, R. norvegicus
gaactcaagaagaact

SEQ ID NO: 502170 - DNA, 16 bp, R. norvegicus
gaactcaagaagttaa

SEQ ID NO: 502171 - DNA, 16 bp, R. norvegicus
gaactcaagacagaaa

SEQ ID NO: 502172 - DNA, 16 bp, R. norvegicus
gaactcaaggcacagg

SEQ ID NO: 502173 - DNA, 16 bp, R. norvegicus
gaactcaaggcccata

SEQ ID NO: 502174 - DNA, 16 bp, R. norvegicus
gaactcacacaggaca

SEQ ID NO: 502175 - DNA, 16 bp, R. norvegicus
gaactcacagaaatcc

SEQ ID NO: 502176 - DNA, 16 bp, R. norvegicus
gaactcacagagattc

SEQ ID NO: 502177 - DNA, 16 bp, R. norvegicus
gaactcacagcagctg

SEQ ID NO: 502178 - DNA, 16 bp, R. norvegicus
gaactcactcactctg

SEQ ID NO: 502179 - DNA, 16 bp, R. norvegicus
gaactcagaaatctgc

SEQ ID NO: 502180 - DNA, 16 bp, R. norvegicus
gaactcagagactgag

SEQ ID NO: 502181 - DNA, 16 bp, R. norvegicus
gaactcagagagatcc

SEQ ID NO: 502182 - DNA, 16 bp, R. norvegicus
gaactcagagatcaac

SEQ ID NO: 502183 - DNA, 16 bp, R. norvegicus
gaactcagagcagctg

SEQ ID NO: 502184 - DNA, 16 bp, R. norvegicus
gaactcaggccccttc

SEQ ID NO: 502185 - DNA, 16 bp, R. norvegicus
gaactcaggctgtcag

SEQ ID NO: 502186 - DNA, 16 bp, R. norvegicus
gaactcagggccttgc

SEQ ID NO: 502187 - DNA, 16 bp, R. norvegicus
gaactcaggtcatctg

SEQ ID NO: 502188 - DNA, 16 bp, R. norvegicus
gaactcatagagatcc

SEQ ID NO: 502189 - DNA, 16 bp, R. norvegicus
gaactcatctggacct

SEQ ID NO: 502190 - DNA, 28 bp, R. norvegicus
gaactccacatgtgcagatgctagactg

SEQ ID NO: 502191 - DNA, 16 bp, R. norvegicus
gaactccagacctctg

SEQ ID NO: 502192 - DNA, 16 bp, R. norvegicus
gaactcgggaggcaga

SEQ ID NO: 502193 - DNA, 16 bp, R. norvegicus
gaactctcagctactt

SEQ ID NO: 502194 - DNA, 17 bp, R. norvegicus
gaactctgccctggttt

SEQ ID NO: 502195 - DNA, 16 bp, R. norvegicus
gaactctgtgtgtgtg

SEQ ID NO: 502196 - DNA, 16 bp, R. norvegicus
gaactgaagcaggtca

SEQ ID NO: 502197 - DNA, 16 bp, R. norvegicus
gaactgaaggagttga

SEQ ID NO: 502198 - DNA, 16 bp, R. norvegicus
gaactgaaggcccaga

SEQ ID NO: 502199 - DNA, 16 bp, R. norvegicus
gaactgactcttgaaa

SEQ ID NO: 502200 - DNA, 16 bp, R. norvegicus
gaactgagaactggac

SEQ ID NO: 502201 - DNA, 16 bp, R. norvegicus
gaactgagaatgggaa

SEQ ID NO: 502202 - DNA, 16 bp, R. norvegicus
gaactgagaatggggg

SEQ ID NO: 502203 - DNA, 16 bp, R. norvegicus
gaactgcatgaactca

SEQ ID NO: 502204 - DNA, 16 bp, R. norvegicus
gaactgcctgagaatc

SEQ ID NO: 502205 - DNA, 16 bp, R. norvegicus
gaactgctgagaaaga

SEQ ID NO: 502206 - DNA, 16 bp, R. norvegicus
gaactgctggagtgca

SEQ ID NO: 502207 - DNA, 16 bp, R. norvegicus
gaactggaaagatggc

SEQ ID NO: 502208 - DNA, 16 bp, R. norvegicus
gaactggaactacaga

SEQ ID NO: 502209 - DNA, 16 bp, R. norvegicus
gaactggaagctcaga

SEQ ID NO: 502210 - DNA, 16 bp, R. norvegicus
gaactggaattgcaga

SEQ ID NO: 502211 - DNA, 16 bp, R. norvegicus
gaactggagaagtgac

SEQ ID NO: 502212 - DNA, 16 bp, R. norvegicus
gaactggagtgacaga

SEQ ID NO: 502213 - DNA, 16 bp, R. norvegicus
gaactggagttgtaga

SEQ ID NO: 502214 - DNA, 21 bp, R. norvegicus
gaactggcagcatggtgctta

SEQ ID NO: 502215 - DNA, 16 bp, R. norvegicus
gaactggcctctgatg

SEQ ID NO: 502216 - DNA, 17 bp, R. norvegicus
gaactggctgctgtggg

SEQ ID NO: 502217 - DNA, 16 bp, R. norvegicus
gaactggctttgtaga

SEQ ID NO: 502218 - DNA, 16 bp, R. norvegicus
gaactgggaggagagg

SEQ ID NO: 502219 - DNA, 16 bp, R. norvegicus
gaactgggtgagagag

SEQ ID NO: 502220 - DNA, 16 bp, R. norvegicus
gaactgggttcagttc

SEQ ID NO: 502221 - DNA, 16 bp, R. norvegicus
gaactgggttctgatg

SEQ ID NO: 502222 - DNA, 16 bp, R. norvegicus
gaactgggtttggttc

SEQ ID NO: 502223 - DNA, 16 bp, R. norvegicus
gaactggtaaatatca

SEQ ID NO: 502224 - DNA, 16 bp, R. norvegicus
gaactggtggtagcca

SEQ ID NO: 502225 - DNA, 16 bp, R. norvegicus
gaactggttctttgag

SEQ ID NO: 502226 - DNA, 16 bp, R. norvegicus
gaactgtatttttaaa

SEQ ID NO: 502227 - DNA, 16 bp, R. norvegicus
gaactgtgacctggaa

SEQ ID NO: 502228 - DNA, 16 bp, R. norvegicus
gaactgtggtcctctg

SEQ ID NO: 502229 - DNA, 16 bp, R. norvegicus
gaactgtttggaaagg

SEQ ID NO: 502230 - DNA, 16 bp, R. norvegicus
gaacttcaaagaagac

SEQ ID NO: 502231 - DNA, 16 bp, R. norvegicus
gaacttcaagaacttt

SEQ ID NO: 502232 - DNA, 16 bp, R. norvegicus
gaacttcaagcctgtg

SEQ ID NO: 502233 - DNA, 16 bp, R. norvegicus
gaacttcaagtgtctg

SEQ ID NO: 502234 - DNA, 16 bp, R. norvegicus
gaacttcagaaaaatt

SEQ ID NO: 502235 - DNA, 16 bp, R. norvegicus
gaacttcaggtctctg

SEQ ID NO: 502236 - DNA, 16 bp, R. norvegicus
gaacttccaagatggc

SEQ ID NO: 502237 - DNA, 16 bp, R. norvegicus
gaacttctgatcttcc

SEQ ID NO: 502238 - DNA, 16 bp, R. norvegicus
gaacttctggaggaaa

SEQ ID NO: 502239 - DNA, 16 bp, R. norvegicus
gaacttgaagacactg

SEQ ID NO: 502240 - DNA, 16 bp, R. norvegicus
gaacttgaagcagaaa

SEQ ID NO: 502241 - DNA, 16 bp, R. norvegicus
gaacttgagctttgta

SEQ ID NO: 502242 - DNA, 16 bp, R. norvegicus
gaactttgctcacatc

SEQ ID NO: 502243 - DNA, 16 bp, R. norvegicus
gaagaaaaagtttatt

SEQ ID NO: 502244 - DNA, 16 bp, R. norvegicus
gaagaaaactgatttt

SEQ ID NO: 502245 - DNA, 16 bp, R. norvegicus
gaagaaaagaactgac

SEQ ID NO: 502246 - DNA, 16 bp, R. norvegicus
gaagaaaaggacatcc

SEQ ID NO: 502247 - DNA, 16 bp, R. norvegicus
gaagaaaagggtccca

SEQ ID NO: 502248 - DNA, 16 bp, R. norvegicus
gaagaaaccctttcct

SEQ ID NO: 502249 - DNA, 16 bp, R. norvegicus
gaagaaactgaaagaa

SEQ ID NO: 502250 - DNA, 16 bp, R. norvegicus
gaagaaactgaagggg

SEQ ID NO: 502251 - DNA, 16 bp, R. norvegicus
gaagaaagaaatcgag

SEQ ID NO: 502252 - DNA, 16 bp, R. norvegicus
gaagaaagaaattcaa

SEQ ID NO: 502253 - DNA, 16 bp, R. norvegicus
gaagaaagaagtgcag

SEQ ID NO: 502254 - DNA, 16 bp, R. norvegicus
gaagaaagaatttgaa

SEQ ID NO: 502255 - DNA, 16 bp, R. norvegicus
gaagaaagaccaaaat

SEQ ID NO: 502256 - DNA, 16 bp, R. norvegicus
gaagaaagagatgccc

SEQ ID NO: 502257 - DNA, 42 bp, R. norvegicus
gaagaaagatatgggcctaggtggagagccactgtgaagaaa

SEQ ID NO: 502258 - DNA, 16 bp, R. norvegicus
gaagaaagcaaagatt

SEQ ID NO: 502259 - DNA, 16 bp, R. norvegicus
gaagaaagcattttca

SEQ ID NO: 502260 - DNA, 16 bp, R. norvegicus
gaagaaagctggtctc

SEQ ID NO: 502261 - DNA, 16 bp, R. norvegicus
gaagaaaggaaatgtg

SEQ ID NO: 502262 - DNA, 16 bp, R. norvegicus
gaagaaaggcagaact

SEQ ID NO: 502263 - DNA, 16 bp, R. norvegicus
gaagaaagtaaagact

SEQ ID NO: 502264 - DNA, 16 bp, R. norvegicus
gaagaaagtgacagtg

SEQ ID NO: 502265 - DNA, 16 bp, R. norvegicus
gaagaaatacagagac

SEQ ID NO: 502266 - DNA, 16 bp, R. norvegicus
gaagaaatccaggaag

SEQ ID NO: 502267 - DNA, 16 bp, R. norvegicus
gaagaaatgcccattc

SEQ ID NO: 502268 - DNA, 16 bp, R. norvegicus
gaagaaatggacaatt

SEQ ID NO: 502269 - DNA, 16 bp, R. norvegicus
gaagaaattaaagact

SEQ ID NO: 502270 - DNA, 16 bp, R. norvegicus
gaagaaattcaaagaa

SEQ ID NO: 502271 - DNA, 16 bp, R. norvegicus
gaagaaattgaaaatg

SEQ ID NO: 502272 - DNA, 16 bp, R. norvegicus
gaagaaattgaggaag

SEQ ID NO: 502273 - DNA, 16 bp, R. norvegicus
gaagaaattgaggaca

SEQ ID NO: 502274 - DNA, 16 bp, R. norvegicus
gaagaaatttgtttat

SEQ ID NO: 502275 - DNA, 16 bp, R. norvegicus
gaagaacaaagtaaca

SEQ ID NO: 502276 - DNA, 16 bp, R. norvegicus
gaagaacaatataaac

SEQ ID NO: 502277 - DNA, 16 bp, R. norvegicus
gaagaacatcgtggtg

SEQ ID NO: 502278 - DNA, 16 bp, R. norvegicus
gaagaacatgcaggag

SEQ ID NO: 502279 - DNA, 16 bp, R. norvegicus
gaagaacattccagaa

SEQ ID NO: 502280 - DNA, 16 bp, R. norvegicus
gaagaacctaaagaaa

SEQ ID NO: 502281 - DNA, 16 bp, R. norvegicus
gaagaacggtcagtgc

SEQ ID NO: 502282 - DNA, 16 bp, R. norvegicus
gaagaactctcagctc

SEQ ID NO: 502283 - DNA, 16 bp, R. norvegicus
gaagaactgaaggagt

SEQ ID NO: 502284 - DNA, 16 bp, R. norvegicus
gaagaacttgaaggag

SEQ ID NO: 502285 - DNA, 16 bp, R. norvegicus
gaagaagaaaactgac

SEQ ID NO: 502286 - DNA, 16 bp, R. norvegicus
gaagaagaaatcttaa

SEQ ID NO: 502287 - DNA, 16 bp, R. norvegicus
gaagaagaagaaatca

SEQ ID NO: 502288 - DNA, 16 bp, R. norvegicus
gaagaagaagaagact

SEQ ID NO: 502289 - DNA, 16 bp, R. norvegicus
gaagaagaagcccttg

SEQ ID NO: 502290 - DNA, 16 bp, R. norvegicus
gaagaagaagctgcca

SEQ ID NO: 502291 - DNA, 16 bp, R. norvegicus
gaagaagaagctggag

SEQ ID NO: 502292 - DNA, 16 bp, R. norvegicus
gaagaagacctccgaa

SEQ ID NO: 502293 - DNA, 16 bp, R. norvegicus
gaagaagagaactgac

SEQ ID NO: 502294 - DNA, 16 bp, R. norvegicus
gaagaagagccagtgc

SEQ ID NO: 502295 - DNA, 16 bp, R. norvegicus
gaagaagagctcagaa

SEQ ID NO: 502296 - DNA, 16 bp, R. norvegicus
gaagaagatattagaa

SEQ ID NO: 502297 - DNA, 16 bp, R. norvegicus
gaagaagatttcagaa

SEQ ID NO: 502298 - DNA, 16 bp, R. norvegicus
gaagaagcaagaaaat

SEQ ID NO: 502299 - DNA, 17 bp, R. norvegicus
gaagaagcagaagcagc

SEQ ID NO: 502300 - DNA, 16 bp, R. norvegicus
gaagaagcagagacag

SEQ ID NO: 502301 - DNA, 16 bp, R. norvegicus
gaagaagcagcagaag

SEQ ID NO: 502302 - DNA, 16 bp, R. norvegicus
gaagaagccaaagtat

SEQ ID NO: 502303 - DNA, 16 bp, R. norvegicus
gaagaagccagaagat

SEQ ID NO: 502304 - DNA, 16 bp, R. norvegicus
gaagaagctctcagaa

SEQ ID NO: 502305 - DNA, 16 bp, R. norvegicus
gaagaagctgaaaagg

SEQ ID NO: 502306 - DNA, 16 bp, R. norvegicus
gaagaagctgaaaggg

SEQ ID NO: 502307 - DNA, 16 bp, R. norvegicus
gaagaagctgcagaga

SEQ ID NO: 502308 - DNA, 16 bp, R. norvegicus
gaagaaggaagattct

SEQ ID NO: 502309 - DNA, 16 bp, R. norvegicus
gaagaaggaaggctca

SEQ ID NO: 502310 - DNA, 16 bp, R. norvegicus
gaagaaggacgccaag

SEQ ID NO: 502311 - DNA, 16 bp, R. norvegicus
gaagaaggataaccaa

SEQ ID NO: 502312 - DNA, 16 bp, R. norvegicus
gaagaaggatcaccaa

SEQ ID NO: 502313 - DNA, 16 bp, R. norvegicus
gaagaaggtgtcagat

SEQ ID NO: 502314 - DNA, 16 bp, R. norvegicus
gaagaagtagggtctg

SEQ ID NO: 502315 - DNA, 16 bp, R. norvegicus
gaagaagtcaaagaat

SEQ ID NO: 502316 - DNA, 16 bp, R. norvegicus
gaagaagtcagtgctc

SEQ ID NO: 502317 - DNA, 16 bp, R. norvegicus
gaagaagttagactcc

SEQ ID NO: 502318 - DNA, 16 bp, R. norvegicus
gaagaagttatggaga

SEQ ID NO: 502319 - DNA, 16 bp, R. norvegicus
gaagaagttggaaaac

SEQ ID NO: 502320 - DNA, 17 bp, R. norvegicus
gaagaatgatatgtgga

SEQ ID NO: 502321 - DNA, 16 bp, R. norvegicus
gaagaatgcaaaatga

SEQ ID NO: 502322 - DNA, 16 bp, R. norvegicus
gaagaatgcaaagaga

SEQ ID NO: 502323 - DNA, 16 bp, R. norvegicus
gaagaatgcagaccaa

SEQ ID NO: 502324 - DNA, 16 bp, R. norvegicus
gaagaatgctgtttct

SEQ ID NO: 502325 - DNA, 16 bp, R. norvegicus
gaagaatgtagatcaa

SEQ ID NO: 502326 - DNA, 16 bp, R. norvegicus
gaagaatgtggatttt

SEQ ID NO: 502327 - DNA, 16 bp, R. norvegicus
gaagaattacaggaaa

SEQ ID NO: 502328 - DNA, 16 bp, R. norvegicus
gaagaattcaagaagt

SEQ ID NO: 502329 - DNA, 16 bp, R. norvegicus
gaagaattcagagaaa

SEQ ID NO: 502330 - DNA, 16 bp, R. norvegicus
gaagaatttgagcatc

SEQ ID NO: 502331 - DNA, 16 bp, R. norvegicus
gaagaattttttaaaa

SEQ ID NO: 502332 - DNA, 16 bp, R. norvegicus
gaagacaaagtttaga

SEQ ID NO: 502333 - DNA, 16 bp, R. norvegicus
gaagacacagaaataa

SEQ ID NO: 502334 - DNA, 16 bp, R. norvegicus
gaagacacagaaatga

SEQ ID NO: 502335 - DNA, 16 bp, R. norvegicus
gaagacacctgatgtc

SEQ ID NO: 502336 - DNA, 16 bp, R. norvegicus
gaagacactgtttcct

SEQ ID NO: 502337 - DNA, 16 bp, R. norvegicus
gaagacagaagaccaa

SEQ ID NO: 502338 - DNA, 16 bp, R. norvegicus
gaagacagacagacag

SEQ ID NO: 502339 - DNA, 16 bp, R. norvegicus
gaagacagaggcagaa

SEQ ID NO: 502340 - DNA, 16 bp, R. norvegicus
gaagacagcagcagtg

SEQ ID NO: 502341 - DNA, 16 bp, R. norvegicus
gaagacagcagcattt

SEQ ID NO: 502342 - DNA, 16 bp, R. norvegicus
gaagacagccacagtg

SEQ ID NO: 502343 - DNA, 17 bp, R. norvegicus
gaagacagctacagtgt

SEQ ID NO: 502344 - DNA, 16 bp, R. norvegicus
gaagacagctgcagta

SEQ ID NO: 502345 - DNA, 16 bp, R. norvegicus
gaagacagtgaagact

SEQ ID NO: 502346 - DNA, 16 bp, R. norvegicus
gaagacagtgacttat

SEQ ID NO: 502347 - DNA, 16 bp, R. norvegicus
gaagacagtgatagtg

SEQ ID NO: 502348 - DNA, 17 bp, R. norvegicus
gaagacagtgatggtgt

SEQ ID NO: 502349 - DNA, 16 bp, R. norvegicus
gaagacagtgctgagg

SEQ ID NO: 502350 - DNA, 16 bp, R. norvegicus
gaagacatcagaaaat

SEQ ID NO: 502351 - DNA, 16 bp, R. norvegicus
gaagacatcataccaa

SEQ ID NO: 502352 - DNA, 16 bp, R. norvegicus
gaagacatctaccaga

SEQ ID NO: 502353 - DNA, 16 bp, R. norvegicus
gaagaccaaaatttgg

SEQ ID NO: 502354 - DNA, 16 bp, R. norvegicus
gaagaccaaagtgtgc

SEQ ID NO: 502355 - DNA, 16 bp, R. norvegicus
gaagaccagcttttgc

SEQ ID NO: 502356 - DNA, 16 bp, R. norvegicus
gaagaccaggctgacc

SEQ ID NO: 502357 - DNA, 16 bp, R. norvegicus
gaagaccatcagtctc

SEQ ID NO: 502358 - DNA, 16 bp, R. norvegicus
gaagacccagaagtga

SEQ ID NO: 502359 - DNA, 16 bp, R. norvegicus
gaagacccagagatga

SEQ ID NO: 502360 - DNA, 17 bp, R. norvegicus
gaagacccagatatgaa

SEQ ID NO: 502361 - DNA, 16 bp, R. norvegicus
gaagaccccaagatgt

SEQ ID NO: 502362 - DNA, 16 bp, R. norvegicus
gaagacctgaagagag

SEQ ID NO: 502363 - DNA, 16 bp, R. norvegicus
gaagacctgcagagag

SEQ ID NO: 502364 - DNA, 16 bp, R. norvegicus
gaagacggtgacagtg

SEQ ID NO: 502365 - DNA, 16 bp, R. norvegicus
gaagactatagagagg

SEQ ID NO: 502366 - DNA, 16 bp, R. norvegicus
gaagactgccttatct

SEQ ID NO: 502367 - DNA, 16 bp, R. norvegicus
gaagactgctacagtg

SEQ ID NO: 502368 - DNA, 17 bp, R. norvegicus
gaagactggactccagc

SEQ ID NO: 502369 - DNA, 16 bp, R. norvegicus
gaagactggctttcag

SEQ ID NO: 502370 - DNA, 16 bp, R. norvegicus
gaagacttcttccttg

SEQ ID NO: 502371 - DNA, 16 bp, R. norvegicus
gaagacttgagctcac

SEQ ID NO: 502372 - DNA, 16 bp, R. norvegicus
gaagactttaagaaag

SEQ ID NO: 502373 - DNA, 16 bp, R. norvegicus
gaagactttcaagttt

SEQ ID NO: 502374 - DNA, 16 bp, R. norvegicus
gaagactttgttgctg

SEQ ID NO: 502375 - DNA, 16 bp, R. norvegicus
gaagagaaactgagga

SEQ ID NO: 502376 - DNA, 16 bp, R. norvegicus
gaagagaaactgggaa

SEQ ID NO: 502377 - DNA, 16 bp, R. norvegicus
gaagagaaattcttcc

SEQ ID NO: 502378 - DNA, 16 bp, R. norvegicus
gaagagaacaaagact

SEQ ID NO: 502379 - DNA, 16 bp, R. norvegicus
gaagagaacaccaatg

SEQ ID NO: 502380 - DNA, 31 bp, R. norvegicus
gaagagaactgttcccgtctgtggacaaggt

SEQ ID NO: 502381 - DNA, 16 bp, R. norvegicus
gaagagaagcagaagc

SEQ ID NO: 502382 - DNA, 16 bp, R. norvegicus
gaagagacaccatgac

SEQ ID NO: 502383 - DNA, 16 bp, R. norvegicus
gaagagaccaccagca

SEQ ID NO: 502384 - DNA, 16 bp, R. norvegicus
gaagagaccatcaaca

SEQ ID NO: 502385 - DNA, 16 bp, R. norvegicus
gaagagactagcatca

SEQ ID NO: 502386 - DNA, 16 bp, R. norvegicus
gaagagagaatctcaa

SEQ ID NO: 502387 - DNA, 16 bp, R. norvegicus
gaagagagcaaagact

SEQ ID NO: 502388 - DNA, 16 bp, R. norvegicus
gaagagagcaacagtg

SEQ ID NO: 502389 - DNA, 16 bp, R. norvegicus
gaagagagcaccagat

SEQ ID NO: 502390 - DNA, 16 bp, R. norvegicus
gaagagagccacagtg

SEQ ID NO: 502391 - DNA, 16 bp, R. norvegicus
gaagagaggaaaaact

SEQ ID NO: 502392 - DNA, 16 bp, R. norvegicus
gaagagagtgaagaat

SEQ ID NO: 502393 - DNA, 16 bp, R. norvegicus
gaagagagtgaaggct

SEQ ID NO: 502394 - DNA, 20 bp, R. norvegicus
gaagagagtgaggactccca

SEQ ID NO: 502395 - DNA, 16 bp, R. norvegicus
gaagagatagctcagc

SEQ ID NO: 502396 - DNA, 16 bp, R. norvegicus
gaagagatcaccaaca

SEQ ID NO: 502397 - DNA, 16 bp, R. norvegicus
gaagagatggctcagt

SEQ ID NO: 502398 - DNA, 16 bp, R. norvegicus
gaagagatggctcggt

SEQ ID NO: 502399 - DNA, 16 bp, R. norvegicus
gaagagatgtgtcact

SEQ ID NO: 502400 - DNA, 16 bp, R. norvegicus
gaagagattgaaggaa

SEQ ID NO: 502401 - DNA, 16 bp, R. norvegicus
gaagagcaaccagtac

SEQ ID NO: 502402 - DNA, 16 bp, R. norvegicus
gaagagcaagtcagtg

SEQ ID NO: 502403 - DNA, 16 bp, R. norvegicus
gaagagcagaaggcag

SEQ ID NO: 502404 - DNA, 16 bp, R. norvegicus
gaagagcagacagtgc

SEQ ID NO: 502405 - DNA, 16 bp, R. norvegicus
gaagagcagagagtgc

SEQ ID NO: 502406 - DNA, 16 bp, R. norvegicus
gaagagcagagcagag

SEQ ID NO: 502407 - DNA, 16 bp, R. norvegicus
gaagagcagcaagcca

SEQ ID NO: 502408 - DNA, 16 bp, R. norvegicus
gaagagcagcaagtgc

SEQ ID NO: 502409 - DNA, 16 bp, R. norvegicus
gaagagcagccagtga

SEQ ID NO: 502410 - DNA, 16 bp, R. norvegicus
gaagagcagccatgct

SEQ ID NO: 502411 - DNA, 16 bp, R. norvegicus
gaagagcagcctgtgc

SEQ ID NO: 502412 - DNA, 16 bp, R. norvegicus
gaagagcccagcccac

SEQ ID NO: 502413 - DNA, 16 bp, R. norvegicus
gaagagcctgaagggg

SEQ ID NO: 502414 - DNA, 16 bp, R. norvegicus
gaagagctagggaaag

SEQ ID NO: 502415 - DNA, 16 bp, R. norvegicus
gaagagctgaagacca

SEQ ID NO: 502416 - DNA, 16 bp, R. norvegicus
gaagagctgaagacct

SEQ ID NO: 502417 - DNA, 16 bp, R. norvegicus
gaagagctggaagaag

SEQ ID NO: 502418 - DNA, 16 bp, R. norvegicus
gaagagctggaggaag

SEQ ID NO: 502419 - DNA, 16 bp, R. norvegicus
gaagagctggaggggc

SEQ ID NO: 502420 - DNA, 16 bp, R. norvegicus
gaagagctggccctgg

SEQ ID NO: 502421 - DNA, 16 bp, R. norvegicus
gaagaggaaactgaga

SEQ ID NO: 502422 - DNA, 16 bp, R. norvegicus
gaagaggaaacttcaa

SEQ ID NO: 502423 - DNA, 16 bp, R. norvegicus
gaagaggaaagggttt

SEQ ID NO: 502424 - DNA, 16 bp, R. norvegicus
gaagaggaagcctttg

SEQ ID NO: 502425 - DNA, 16 bp, R. norvegicus
gaagaggaagtggaca

SEQ ID NO: 502426 - DNA, 16 bp, R. norvegicus
gaagaggaagtggcca

SEQ ID NO: 502427 - DNA, 17 bp, R. norvegicus
gaagaggaagtgtacag

SEQ ID NO: 502428 - DNA, 16 bp, R. norvegicus
gaagaggaattccagg

SEQ ID NO: 502429 - DNA, 16 bp, R. norvegicus
gaagaggacctgagtt

SEQ ID NO: 502430 - DNA, 16 bp, R. norvegicus
gaagaggagagactgg

SEQ ID NO: 502431 - DNA, 16 bp, R. norvegicus
gaagaggaggagacta

SEQ ID NO: 502432 - DNA, 16 bp, R. norvegicus
gaagaggaggagactg

SEQ ID NO: 502433 - DNA, 16 bp, R. norvegicus
gaagaggaggaggctg

SEQ ID NO: 502434 - DNA, 16 bp, R. norvegicus
gaagaggaggcagaca

SEQ ID NO: 502435 - DNA, 23 bp, R. norvegicus
gaagaggatctgcgcctagggac

SEQ ID NO: 502436 - DNA, 16 bp, R. norvegicus
gaagaggatgctggat

SEQ ID NO: 502437 - DNA, 16 bp, R. norvegicus
gaagaggcagcacagg

SEQ ID NO: 502438 - DNA, 16 bp, R. norvegicus
gaagaggctgaggagg

SEQ ID NO: 502439 - DNA, 16 bp, R. norvegicus
gaagaggctgaggcag

SEQ ID NO: 502440 - DNA, 16 bp, R. norvegicus
gaagagggcatcaaac

SEQ ID NO: 502441 - DNA, 16 bp, R. norvegicus
gaagagggcttcagat

SEQ ID NO: 502442 - DNA, 16 bp, R. norvegicus
gaagagtagacagcag

SEQ ID NO: 502443 - DNA, 16 bp, R. norvegicus
gaagagtcaaagtgtc

SEQ ID NO: 502444 - DNA, 16 bp, R. norvegicus
gaagagtcccagctca

SEQ ID NO: 502445 - DNA, 16 bp, R. norvegicus
gaagagtgtgtgtgtg

SEQ ID NO: 502446 - DNA, 16 bp, R. norvegicus
gaagagttaaatttca

SEQ ID NO: 502447 - DNA, 16 bp, R. norvegicus
gaagagttagaagaag

SEQ ID NO: 502448 - DNA, 16 bp, R. norvegicus
gaagagttctacatct

SEQ ID NO: 502449 - DNA, 16 bp, R. norvegicus
gaagagttgaaggagc

SEQ ID NO: 502450 - DNA, 16 bp, R. norvegicus
gaagagttggagaaag

SEQ ID NO: 502451 - DNA, 16 bp, R. norvegicus
gaagagttggggaaag

SEQ ID NO: 502452 - DNA, 16 bp, R. norvegicus
gaagagtttgttttgg

SEQ ID NO: 502453 - DNA, 16 bp, R. norvegicus
gaagataaaaataatc

SEQ ID NO: 502454 - DNA, 18 bp, R. norvegicus
gaagataaacgatgtgaa

SEQ ID NO: 502455 - DNA, 16 bp, R. norvegicus
gaagataacaggaaac

SEQ ID NO: 502456 - DNA, 16 bp, R. norvegicus
gaagataatgttgaga

SEQ ID NO: 502457 - DNA, 16 bp, R. norvegicus
gaagatactggactga

SEQ ID NO: 502458 - DNA, 16 bp, R. norvegicus
gaagatatgagagaga

SEQ ID NO: 502459 - DNA, 16 bp, R. norvegicus
gaagatcaaagtgtgg

SEQ ID NO: 502460 - DNA, 16 bp, R. norvegicus
gaagatcagaagttca

SEQ ID NO: 502461 - DNA, 16 bp, R. norvegicus
gaagatcatgtgtgaa

SEQ ID NO: 502462 - DNA, 16 bp, R. norvegicus
gaagatcccagaagat

SEQ ID NO: 502463 - DNA, 16 bp, R. norvegicus
gaagatcctcaaacac

SEQ ID NO: 502464 - DNA, 16 bp, R. norvegicus
gaagatcctgaggaaa

SEQ ID NO: 502465 - DNA, 16 bp, R. norvegicus
gaagatctcagaaggt

SEQ ID NO: 502466 - DNA, 16 bp, R. norvegicus
gaagatcttagaaaat

SEQ ID NO: 502467 - DNA, 16 bp, R. norvegicus
gaagatgaagatgaag

SEQ ID NO: 502468 - DNA, 16 bp, R. norvegicus
gaagatgatgatggtg

SEQ ID NO: 502469 - DNA, 16 bp, R. norvegicus
gaagatgatggagatg

SEQ ID NO: 502470 - DNA, 16 bp, R. norvegicus
gaagatgatggtgatg

SEQ ID NO: 502471 - DNA, 16 bp, R. norvegicus
gaagatgcacccaacc

SEQ ID NO: 502472 - DNA, 16 bp, R. norvegicus
gaagatgcagaaatga

SEQ ID NO: 502473 - DNA, 16 bp, R. norvegicus
gaagatgctttctttt

SEQ ID NO: 502474 - DNA, 16 bp, R. norvegicus
gaagatggaaagagct

SEQ ID NO: 502475 - DNA, 16 bp, R. norvegicus
gaagatggaggcagag

SEQ ID NO: 502476 - DNA, 16 bp, R. norvegicus
gaagatggccttgctg

SEQ ID NO: 502477 - DNA, 16 bp, R. norvegicus
gaagatggctcagagg

SEQ ID NO: 502478 - DNA, 16 bp, R. norvegicus
gaagatgggaagatct

SEQ ID NO: 502479 - DNA, 16 bp, R. norvegicus
gaagatggtgacagtg

SEQ ID NO: 502480 - DNA, 16 bp, R. norvegicus
gaagatgtaaaactct

SEQ ID NO: 502481 - DNA, 16 bp, R. norvegicus
gaagatgtattctttt

SEQ ID NO: 502482 - DNA, 16 bp, R. norvegicus
gaagatgtcaaagtat

SEQ ID NO: 502483 - DNA, 16 bp, R. norvegicus
gaagatgtccccaccc

SEQ ID NO: 502484 - DNA, 16 bp, R. norvegicus
gaagatgtgtgtgtgt

SEQ ID NO: 502485 - DNA, 16 bp, R. norvegicus
gaagatgttttcaggt

SEQ ID NO: 502486 - DNA, 16 bp, R. norvegicus
gaagatgttttctttt

SEQ ID NO: 502487 - DNA, 16 bp, R. norvegicus
gaagattaaaacagat

SEQ ID NO: 502488 - DNA, 16 bp, R. norvegicus
gaagattaaaataatc

SEQ ID NO: 502489 - DNA, 16 bp, R. norvegicus
gaagattaggaattca

SEQ ID NO: 502490 - DNA, 16 bp, R. norvegicus
gaagattattttcttg

SEQ ID NO: 502491 - DNA, 16 bp, R. norvegicus
gaagattccagagaaa

SEQ ID NO: 502492 - DNA, 16 bp, R. norvegicus
gaagattcccaaatca

SEQ ID NO: 502493 - DNA, 17 bp, R. norvegicus
gaagattccccctcatc

SEQ ID NO: 502494 - DNA, 16 bp, R. norvegicus
gaagattcctggagag

SEQ ID NO: 502495 - DNA, 16 bp, R. norvegicus
gaagattctcccactc

SEQ ID NO: 502496 - DNA, 16 bp, R. norvegicus
gaagatttcctgaaca

SEQ ID NO: 502497 - DNA, 16 bp, R. norvegicus
gaagatttcttctagt

SEQ ID NO: 502498 - DNA, 16 bp, R. norvegicus
gaagatttggatttaa

SEQ ID NO: 502499 - DNA, 17 bp, R. norvegicus
gaagattttcaagtttt

SEQ ID NO: 502500 - DNA, 16 bp, R. norvegicus
gaagattttttttttc

SEQ ID NO: 502501 - DNA, 16 bp, R. norvegicus
gaagcaaaggcaggaa

SEQ ID NO: 502502 - DNA, 16 bp, R. norvegicus
gaagcaaaggcaggag

SEQ ID NO: 502503 - DNA, 16 bp, R. norvegicus
gaagcaaatatatcca

SEQ ID NO: 502504 - DNA, 16 bp, R. norvegicus
gaagcaacagaaacca

SEQ ID NO: 502505 - DNA, 16 bp, R. norvegicus
gaagcaacagaaccaa

SEQ ID NO: 502506 - DNA, 16 bp, R. norvegicus
gaagcaagaggatcag

SEQ ID NO: 502507 - DNA, 16 bp, R. norvegicus
gaagcaagatttggat

SEQ ID NO: 502508 - DNA, 16 bp, R. norvegicus
gaagcaagccagcaag

SEQ ID NO: 502509 - DNA, 16 bp, R. norvegicus
gaagcaagccaggaag

SEQ ID NO: 502510 - DNA, 16 bp, R. norvegicus
gaagcaaggcagcatg

SEQ ID NO: 502511 - DNA, 16 bp, R. norvegicus
gaagcaatcaagaaac

SEQ ID NO: 502512 - DNA, 18 bp, R. norvegicus
gaagcaatcccactaaag

SEQ ID NO: 502513 - DNA, 16 bp, R. norvegicus
gaagcacacctcagag

SEQ ID NO: 502514 - DNA, 16 bp, R. norvegicus
gaagcacaggagtgag

SEQ ID NO: 502515 - DNA, 16 bp, R. norvegicus
gaagcacgtaaagaaa

SEQ ID NO: 502516 - DNA, 16 bp, R. norvegicus
gaagcactaaaagaaa

SEQ ID NO: 502517 - DNA, 16 bp, R. norvegicus
gaagcactgagggcca

SEQ ID NO: 502518 - DNA, 16 bp, R. norvegicus
gaagcagaaaccacag

SEQ ID NO: 502519 - DNA, 16 bp, R. norvegicus
gaagcagaaagagatg

SEQ ID NO: 502520 - DNA, 16 bp, R. norvegicus
gaagcagaactacaga

SEQ ID NO: 502521 - DNA, 16 bp, R. norvegicus
gaagcagaagcagaca

SEQ ID NO: 502522 - DNA, 16 bp, R. norvegicus
gaagcagaagcagaga

SEQ ID NO: 502523 - DNA, 16 bp, R. norvegicus
gaagcagaagcagagg

SEQ ID NO: 502524 - DNA, 16 bp, R. norvegicus
gaagcagaagcaggct

SEQ ID NO: 502525 - DNA, 16 bp, R. norvegicus
gaagcagaagcaggtg

SEQ ID NO: 502526 - DNA, 16 bp, R. norvegicus
gaagcagaagccagag

SEQ ID NO: 502527 - DNA, 16 bp, R. norvegicus
gaagcagaagccatga

SEQ ID NO: 502528 - DNA, 16 bp, R. norvegicus
gaagcagaagctgatg

SEQ ID NO: 502529 - DNA, 17 bp, R. norvegicus
gaagcagaattcctgta

SEQ ID NO: 502530 - DNA, 16 bp, R. norvegicus
gaagcagacacgggtg

SEQ ID NO: 502531 - DNA, 16 bp, R. norvegicus
gaagcagagaaagcac

SEQ ID NO: 502532 - DNA, 16 bp, R. norvegicus
gaagcagagaagtgca

SEQ ID NO: 502533 - DNA, 16 bp, R. norvegicus
gaagcagagacagaag

SEQ ID NO: 502534 - DNA, 16 bp, R. norvegicus
gaagcagagacagaca

SEQ ID NO: 502535 - DNA, 16 bp, R. norvegicus
gaagcagagagaagcc

SEQ ID NO: 502536 - DNA, 16 bp, R. norvegicus
gaagcagagagagcag

SEQ ID NO: 502537 - DNA, 16 bp, R. norvegicus
gaagcagagaggaagc

SEQ ID NO: 502538 - DNA, 16 bp, R. norvegicus
gaagcagagatcacag

SEQ ID NO: 502539 - DNA, 16 bp, R. norvegicus
gaagcagaggcaagta

SEQ ID NO: 502540 - DNA, 16 bp, R. norvegicus
gaagcagaggcagaga

SEQ ID NO: 502541 - DNA, 16 bp, R. norvegicus
gaagcagaggcaggag

SEQ ID NO: 502542 - DNA, 16 bp, R. norvegicus
gaagcagaggcaggcg

SEQ ID NO: 502543 - DNA, 16 bp, R. norvegicus
gaagcagaggccgaag

SEQ ID NO: 502544 - DNA, 16 bp, R. norvegicus
gaagcagaggctatgg

SEQ ID NO: 502545 - DNA, 16 bp, R. norvegicus
gaagcagaggctgctg

SEQ ID NO: 502546 - DNA, 16 bp, R. norvegicus
gaagcagaggctggtg

SEQ ID NO: 502547 - DNA, 16 bp, R. norvegicus
gaagcagaggtaggca

SEQ ID NO: 502548 - DNA, 16 bp, R. norvegicus
gaagcagcaagcacag

SEQ ID NO: 502549 - DNA, 16 bp, R. norvegicus
gaagcagcaatcatgg

SEQ ID NO: 502550 - DNA, 16 bp, R. norvegicus
gaagcagccatgtttg

SEQ ID NO: 502551 - DNA, 16 bp, R. norvegicus
gaagcagcggagagaa

SEQ ID NO: 502552 - DNA, 16 bp, R. norvegicus
gaagcagctgaaagag

SEQ ID NO: 502553 - DNA, 16 bp, R. norvegicus
gaagcagctgagagaa

SEQ ID NO: 502554 - DNA, 16 bp, R. norvegicus
gaagcagctggaacac

SEQ ID NO: 502555 - DNA, 16 bp, R. norvegicus
gaagcaggaaaatcag

SEQ ID NO: 502556 - DNA, 16 bp, R. norvegicus
gaagcaggagcagaag

SEQ ID NO: 502557 - DNA, 16 bp, R. norvegicus
gaagcaggagctgctg

SEQ ID NO: 502558 - DNA, 16 bp, R. norvegicus
gaagcaggaggaacag

SEQ ID NO: 502559 - DNA, 16 bp, R. norvegicus
gaagcaggaggattgc

SEQ ID NO: 502560 - DNA, 16 bp, R. norvegicus
gaagcaggaggcagga

SEQ ID NO: 502561 - DNA, 16 bp, R. norvegicus
gaagcaggcagatttc

SEQ ID NO: 502562 - DNA, 16 bp, R. norvegicus
gaagcaggcatctgag

SEQ ID NO: 502563 - DNA, 16 bp, R. norvegicus
gaagcaggggaagtgg

SEQ ID NO: 502564 - DNA, 16 bp, R. norvegicus
gaagcaggtggttctc

SEQ ID NO: 502565 - DNA, 16 bp, R. norvegicus
gaagcagtggagagaa

SEQ ID NO: 502566 - DNA, 16 bp, R. norvegicus
gaagcatctggacttt

SEQ ID NO: 502567 - DNA, 16 bp, R. norvegicus
gaagcatgtgctgtca

SEQ ID NO: 502568 - DNA, 16 bp, R. norvegicus
gaagcatttaaagaaa

SEQ ID NO: 502569 - DNA, 16 bp, R. norvegicus
gaagcatttattaaaa

SEQ ID NO: 502570 - DNA, 16 bp, R. norvegicus
gaagcatttccatttt

SEQ ID NO: 502571 - DNA, 16 bp, R. norvegicus
gaagcatttcctcaat

SEQ ID NO: 502572 - DNA, 16 bp, R. norvegicus
gaagcatttgagaacc

SEQ ID NO: 502573 - DNA, 16 bp, R. norvegicus
gaagccaaaaccatcc

SEQ ID NO: 502574 - DNA, 16 bp, R. norvegicus
gaagccaagagaagac

SEQ ID NO: 502575 - DNA, 16 bp, R. norvegicus
gaagccaaggcaagaa

SEQ ID NO: 502576 - DNA, 16 bp, R. norvegicus
gaagccaagtaacaag

SEQ ID NO: 502577 - DNA, 16 bp, R. norvegicus
gaagccacacccatga

SEQ ID NO: 502578 - DNA, 16 bp, R. norvegicus
gaagccagaagccaga

SEQ ID NO: 502579 - DNA, 16 bp, R. norvegicus
gaagccagagatcaac

SEQ ID NO: 502580 - DNA, 16 bp, R. norvegicus
gaagccagagccttga

SEQ ID NO: 502581 - DNA, 16 bp, R. norvegicus
gaagccagaggccttg

SEQ ID NO: 502582 - DNA, 16 bp, R. norvegicus
gaagccagcaactgtg

SEQ ID NO: 502583 - DNA, 16 bp, R. norvegicus
gaagccagccagccag

SEQ ID NO: 502584 - DNA, 16 bp, R. norvegicus
gaagccagccccagtt

SEQ ID NO: 502585 - DNA, 16 bp, R. norvegicus
gaagccagccctttgg

SEQ ID NO: 502586 - DNA, 16 bp, R. norvegicus
gaagccagctacagtg

SEQ ID NO: 502587 - DNA, 16 bp, R. norvegicus
gaagccaggaacagac

SEQ ID NO: 502588 - DNA, 16 bp, R. norvegicus
gaagccaggctgggct

SEQ ID NO: 502589 - DNA, 16 bp, R. norvegicus
gaagccagtactctgc

SEQ ID NO: 502590 - DNA, 16 bp, R. norvegicus
gaagccatagataagg

SEQ ID NO: 502591 - DNA, 16 bp, R. norvegicus
gaagccatcctgggct

SEQ ID NO: 502592 - DNA, 16 bp, R. norvegicus
gaagccatggagaagg

SEQ ID NO: 502593 - DNA, 16 bp, R. norvegicus
gaagccatggcaggaa

SEQ ID NO: 502594 - DNA, 16 bp, R. norvegicus
gaagcccaagaagaag

SEQ ID NO: 502595 - DNA, 16 bp, R. norvegicus
gaagcccaagaaggaa

SEQ ID NO: 502596 - DNA, 16 bp, R. norvegicus
gaagcccagagaagcc

SEQ ID NO: 502597 - DNA, 16 bp, R. norvegicus
gaagcccagagagagg

SEQ ID NO: 502598 - DNA, 16 bp, R. norvegicus
gaagccccagtgaaca

SEQ ID NO: 502599 - DNA, 16 bp, R. norvegicus
gaagccctgaaggcca

SEQ ID NO: 502600 - DNA, 16 bp, R. norvegicus
gaagccctgagggaca

SEQ ID NO: 502601 - DNA, 16 bp, R. norvegicus
gaagccctgagtcctg

SEQ ID NO: 502602 - DNA, 16 bp, R. norvegicus
gaagccctgagtgcca

SEQ ID NO: 502603 - DNA, 16 bp, R. norvegicus
gaagccctggagaccc

SEQ ID NO: 502604 - DNA, 16 bp, R. norvegicus
gaagccctgggtttca

SEQ ID NO: 502605 - DNA, 16 bp, R. norvegicus
gaagcccttcatcctg

SEQ ID NO: 502606 - DNA, 16 bp, R. norvegicus
gaagcccttggtcctg

SEQ ID NO: 502607 - DNA, 16 bp, R. norvegicus
gaagcccttgttcctg

SEQ ID NO: 502608 - DNA, 16 bp, R. norvegicus
gaagccgttggtcctg

SEQ ID NO: 502609 - DNA, 16 bp, R. norvegicus
gaagcctcaggagtgc

SEQ ID NO: 502610 - DNA, 16 bp, R. norvegicus
gaagccttcttgatca

SEQ ID NO: 502611 - DNA, 16 bp, R. norvegicus
gaagccttggtcctgc

SEQ ID NO: 502612 - DNA, 16 bp, R. norvegicus
gaagcctttagagagg

SEQ ID NO: 502613 - DNA, 16 bp, R. norvegicus
gaagcctttgatcctg

SEQ ID NO: 502614 - DNA, 16 bp, R. norvegicus
gaagcgcaaggccatg

SEQ ID NO: 502615 - DNA, 16 bp, R. norvegicus
gaagcgcaaggccctc

SEQ ID NO: 502616 - DNA, 16 bp, R. norvegicus
gaagcggaagcggaag

SEQ ID NO: 502617 - DNA, 16 bp, R. norvegicus
gaagcgtgtgtgtgtg

SEQ ID NO: 502618 - DNA, 16 bp, R. norvegicus
gaagctaaagaagaag

SEQ ID NO: 502619 - DNA, 16 bp, R. norvegicus
gaagctaccccagaag

SEQ ID NO: 502620 - DNA, 16 bp, R. norvegicus
gaagctagagttacag

SEQ ID NO: 502621 - DNA, 16 bp, R. norvegicus
gaagctcaagaaaaag

SEQ ID NO: 502622 - DNA, 16 bp, R. norvegicus
gaagctcaagaagaaa

SEQ ID NO: 502623 - DNA, 16 bp, R. norvegicus
gaagctcaagaagacg

SEQ ID NO: 502624 - DNA, 16 bp, R. norvegicus
gaagctcaagaagcag

SEQ ID NO: 502625 - DNA, 16 bp, R. norvegicus
gaagctcaagaaggaa

SEQ ID NO: 502626 - DNA, 16 bp, R. norvegicus
gaagctcaagaaggac

SEQ ID NO: 502627 - DNA, 16 bp, R. norvegicus
gaagctcacccaagaa

SEQ ID NO: 502628 - DNA, 16 bp, R. norvegicus
gaagctcattggccag

SEQ ID NO: 502629 - DNA, 17 bp, R. norvegicus
gaagctcccggaaaggg

SEQ ID NO: 502630 - DNA, 16 bp, R. norvegicus
gaagctctaccagcag

SEQ ID NO: 502631 - DNA, 16 bp, R. norvegicus
gaagctctggggggtc

SEQ ID NO: 502632 - DNA, 16 bp, R. norvegicus
gaagctctgggtggtc

SEQ ID NO: 502633 - DNA, 16 bp, R. norvegicus
gaagctcttcagtttc

SEQ ID NO: 502634 - DNA, 16 bp, R. norvegicus
gaagctgaagaagaaa

SEQ ID NO: 502635 - DNA, 16 bp, R. norvegicus
gaagctgaagaagaag

SEQ ID NO: 502636 - DNA, 16 bp, R. norvegicus
gaagctgaagaaggat

SEQ ID NO: 502637 - DNA, 16 bp, R. norvegicus
gaagctgaagaggaag

SEQ ID NO: 502638 - DNA, 16 bp, R. norvegicus
gaagctgaagcagaag

SEQ ID NO: 502639 - DNA, 16 bp, R. norvegicus
gaagctgaaggagagg

SEQ ID NO: 502640 - DNA, 16 bp, R. norvegicus
gaagctgaagggaagg

SEQ ID NO: 502641 - DNA, 16 bp, R. norvegicus
gaagctgaaggggaga

SEQ ID NO: 502642 - DNA, 16 bp, R. norvegicus
gaagctgagagaagcc

SEQ ID NO: 502643 - DNA, 16 bp, R. norvegicus
gaagctgaggaagaga

SEQ ID NO: 502644 - DNA, 16 bp, R. norvegicus
gaagctgaggagaagg

SEQ ID NO: 502645 - DNA, 16 bp, R. norvegicus
gaagctgaggaggagg

SEQ ID NO: 502646 - DNA, 16 bp, R. norvegicus
gaagctgaggaggggg

SEQ ID NO: 502647 - DNA, 16 bp, R. norvegicus
gaagctgaggcaggag

SEQ ID NO: 502648 - DNA, 16 bp, R. norvegicus
gaagctgaggctcaga

SEQ ID NO: 502649 - DNA, 16 bp, R. norvegicus
gaagctgaggctggag

SEQ ID NO: 502650 - DNA, 16 bp, R. norvegicus
gaagctgagttctaca

SEQ ID NO: 502651 - DNA, 16 bp, R. norvegicus
gaagctgatggtgaaa

SEQ ID NO: 502652 - DNA, 16 bp, R. norvegicus
gaagctgcagttacag

SEQ ID NO: 502653 - DNA, 16 bp, R. norvegicus
gaagctgccacccagt

SEQ ID NO: 502654 - DNA, 16 bp, R. norvegicus
gaagctgctgctactg

SEQ ID NO: 502655 - DNA, 16 bp, R. norvegicus
gaagctggaaacagcc

SEQ ID NO: 502656 - DNA, 16 bp, R. norvegicus
gaagctggaaatgacc

SEQ ID NO: 502657 - DNA, 16 bp, R. norvegicus
gaagctggaagaaacc

SEQ ID NO: 502658 - DNA, 16 bp, R. norvegicus
gaagctggagacctgg

SEQ ID NO: 502659 - DNA, 16 bp, R. norvegicus
gaagctggagagagca

SEQ ID NO: 502660 - DNA, 16 bp, R. norvegicus
gaagctggagcaggag

SEQ ID NO: 502661 - DNA, 16 bp, R. norvegicus
gaagctggaggacttc

SEQ ID NO: 502662 - DNA, 16 bp, R. norvegicus
gaagctggagttccag

SEQ ID NO: 502663 - DNA, 16 bp, R. norvegicus
gaagctggcaagaacc

SEQ ID NO: 502664 - DNA, 16 bp, R. norvegicus
gaagctgggaagaacc

SEQ ID NO: 502665 - DNA, 16 bp, R. norvegicus
gaagctgggcaaacag

SEQ ID NO: 502666 - DNA, 16 bp, R. norvegicus
gaagctggtcacattg

SEQ ID NO: 502667 - DNA, 16 bp, R. norvegicus
gaagctgtaacattga

SEQ ID NO: 502668 - DNA, 16 bp, R. norvegicus
gaagctgtaagccagc

SEQ ID NO: 502669 - DNA, 16 bp, R. norvegicus
gaagctgtctctgctc

SEQ ID NO: 502670 - DNA, 16 bp, R. norvegicus
gaagctgtgctccaga

SEQ ID NO: 502671 - DNA, 16 bp, R. norvegicus
gaagctgtggagagaa

SEQ ID NO: 502672 - DNA, 16 bp, R. norvegicus
gaagctgtttccagag

SEQ ID NO: 502673 - DNA, 16 bp, R. norvegicus
gaagcttccagctcag

SEQ ID NO: 502674 - DNA, 16 bp, R. norvegicus
gaagcttctcagagga

SEQ ID NO: 502675 - DNA, 16 bp, R. norvegicus
gaagcttctggaacac

SEQ ID NO: 502676 - DNA, 16 bp, R. norvegicus
gaagctttcttctatg

SEQ ID NO: 502677 - DNA, 16 bp, R. norvegicus
gaagctttgcaaattt

SEQ ID NO: 502678 - DNA, 16 bp, R. norvegicus
gaaggaaaagagtcca

SEQ ID NO: 502679 - DNA, 16 bp, R. norvegicus
gaaggaaaccattgaa

SEQ ID NO: 502680 - DNA, 16 bp, R. norvegicus
gaaggaaagaagccag

SEQ ID NO: 502681 - DNA, 16 bp, R. norvegicus
gaaggaaaggccaagg

SEQ ID NO: 502682 - DNA, 16 bp, R. norvegicus
gaaggaaaggccagcc

SEQ ID NO: 502683 - DNA, 16 bp, R. norvegicus
gaaggaaagggtttgt

SEQ ID NO: 502684 - DNA, 16 bp, R. norvegicus
gaaggaaagtgtttat

SEQ ID NO: 502685 - DNA, 16 bp, R. norvegicus
gaaggaaattgaggaa

SEQ ID NO: 502686 - DNA, 16 bp, R. norvegicus
gaaggaacacacaaca

SEQ ID NO: 502687 - DNA, 31 bp, R. norvegicus
gaaggaacacccattcagagcctgccccaca

SEQ ID NO: 502688 - DNA, 16 bp, R. norvegicus
gaaggaacagactgga

SEQ ID NO: 502689 - DNA, 16 bp, R. norvegicus
gaaggaactgaacaaa

SEQ ID NO: 502690 - DNA, 16 bp, R. norvegicus
gaaggaactgaaggag

SEQ ID NO: 502691 - DNA, 16 bp, R. norvegicus
gaaggaactgggaggg

SEQ ID NO: 502692 - DNA, 16 bp, R. norvegicus
gaaggaagaaatgatg

SEQ ID NO: 502693 - DNA, 16 bp, R. norvegicus
gaaggaagaagagact

SEQ ID NO: 502694 - DNA, 16 bp, R. norvegicus
gaaggaagacaaaagt

SEQ ID NO: 502695 - DNA, 16 bp, R. norvegicus
gaaggaagacaggcag

SEQ ID NO: 502696 - DNA, 16 bp, R. norvegicus
gaaggaagagcaaaat

SEQ ID NO: 502697 - DNA, 16 bp, R. norvegicus
gaaggaagagtctctt

SEQ ID NO: 502698 - DNA, 16 bp, R. norvegicus
gaaggaagcagaggca

SEQ ID NO: 502699 - DNA, 16 bp, R. norvegicus
gaaggaagccaggaac

SEQ ID NO: 502700 - DNA, 16 bp, R. norvegicus
gaaggaagccagggaa

SEQ ID NO: 502701 - DNA, 16 bp, R. norvegicus
gaaggaagccagggca

SEQ ID NO: 502702 - DNA, 16 bp, R. norvegicus
gaaggaagctgaggag

SEQ ID NO: 502703 - DNA, 16 bp, R. norvegicus
gaaggaagggtttact

SEQ ID NO: 502704 - DNA, 16 bp, R. norvegicus
gaaggaagtcaaggca

SEQ ID NO: 502705 - DNA, 16 bp, R. norvegicus
gaaggaatcaagaaag

SEQ ID NO: 502706 - DNA, 16 bp, R. norvegicus
gaaggaatcaagaaga

SEQ ID NO: 502707 - DNA, 16 bp, R. norvegicus
gaaggaatcagaaaga

SEQ ID NO: 502708 - DNA, 16 bp, R. norvegicus
gaaggaatccagaact

SEQ ID NO: 502709 - DNA, 16 bp, R. norvegicus
gaaggaatggacttgc

SEQ ID NO: 502710 - DNA, 16 bp, R. norvegicus
gaaggaattccaggaa

SEQ ID NO: 502711 - DNA, 16 bp, R. norvegicus
gaaggacacagagaga

SEQ ID NO: 502712 - DNA, 16 bp, R. norvegicus
gaaggaccagctcaag

SEQ ID NO: 502713 - DNA, 16 bp, R. norvegicus
gaaggacgtgaagaac

SEQ ID NO: 502714 - DNA, 16 bp, R. norvegicus
gaaggacttcaagaaa

SEQ ID NO: 502715 - DNA, 16 bp, R. norvegicus
gaaggacttgggggag

SEQ ID NO: 502716 - DNA, 16 bp, R. norvegicus
gaaggactttaagaag

SEQ ID NO: 502717 - DNA, 16 bp, R. norvegicus
gaaggagaaactgaag

SEQ ID NO: 502718 - DNA, 16 bp, R. norvegicus
gaaggagaaactgact

SEQ ID NO: 502719 - DNA, 16 bp, R. norvegicus
gaaggagaaatgttgc

SEQ ID NO: 502720 - DNA, 16 bp, R. norvegicus
gaaggagaagcagcag

SEQ ID NO: 502721 - DNA, 16 bp, R. norvegicus
gaaggagaagcctttg

SEQ ID NO: 502722 - DNA, 16 bp, R. norvegicus
gaaggagaaggccttg

SEQ ID NO: 502723 - DNA, 16 bp, R. norvegicus
gaaggagaatgcagag

SEQ ID NO: 502724 - DNA, 16 bp, R. norvegicus
gaaggagagaactaac

SEQ ID NO: 502725 - DNA, 16 bp, R. norvegicus
gaaggagagaagcaac

SEQ ID NO: 502726 - DNA, 16 bp, R. norvegicus
gaaggagaggaaactg

SEQ ID NO: 502727 - DNA, 16 bp, R. norvegicus
gaaggagaggaccaac

SEQ ID NO: 502728 - DNA, 16 bp, R. norvegicus
gaaggagatacagaga

SEQ ID NO: 502729 - DNA, 16 bp, R. norvegicus
gaaggagatgccaagt

SEQ ID NO: 502730 - DNA, 16 bp, R. norvegicus
gaaggagcagagactg

SEQ ID NO: 502731 - DNA, 16 bp, R. norvegicus
gaaggagcagcagaag

SEQ ID NO: 502732 - DNA, 16 bp, R. norvegicus
gaaggagcagccagtg

SEQ ID NO: 502733 - DNA, 16 bp, R. norvegicus
gaaggagcaggggcaa

SEQ ID NO: 502734 - DNA, 16 bp, R. norvegicus
gaaggagcagtggagg

SEQ ID NO: 502735 - DNA, 16 bp, R. norvegicus
gaaggagcctcagctg

SEQ ID NO: 502736 - DNA, 16 bp, R. norvegicus
gaaggagctaaatggg

SEQ ID NO: 502737 - DNA, 16 bp, R. norvegicus
gaaggagctagaagat

SEQ ID NO: 502738 - DNA, 16 bp, R. norvegicus
gaaggagctgaagcag

SEQ ID NO: 502739 - DNA, 16 bp, R. norvegicus
gaaggagctgaagcgg

SEQ ID NO: 502740 - DNA, 16 bp, R. norvegicus
gaaggagctgaaggac

SEQ ID NO: 502741 - DNA, 16 bp, R. norvegicus
gaaggagctggagaga

SEQ ID NO: 502742 - DNA, 16 bp, R. norvegicus
gaaggagctggaggag

SEQ ID NO: 502743 - DNA, 16 bp, R. norvegicus
gaaggaggaaatgatg

SEQ ID NO: 502744 - DNA, 16 bp, R. norvegicus
gaaggaggagctgatg

SEQ ID NO: 502745 - DNA, 16 bp, R. norvegicus
gaaggaggcagaagca

SEQ ID NO: 502746 - DNA, 16 bp, R. norvegicus
gaaggaggggaaactg

SEQ ID NO: 502747 - DNA, 16 bp, R. norvegicus
gaaggaggggctggag

SEQ ID NO: 502748 - DNA, 16 bp, R. norvegicus
gaaggagtcagagaaa

SEQ ID NO: 502749 - DNA, 16 bp, R. norvegicus
gaaggagttgaaggag

SEQ ID NO: 502750 - DNA, 16 bp, R. norvegicus
gaaggagttggaaaac

SEQ ID NO: 502751 - DNA, 16 bp, R. norvegicus
gaaggatcatgagttc

SEQ ID NO: 502752 - DNA, 16 bp, R. norvegicus
gaaggatcctctcatt

SEQ ID NO: 502753 - DNA, 16 bp, R. norvegicus
gaaggatctggaagga

SEQ ID NO: 502754 - DNA, 16 bp, R. norvegicus
gaaggatggaaggatg

SEQ ID NO: 502755 - DNA, 16 bp, R. norvegicus
gaaggatggggccacc

SEQ ID NO: 502756 - DNA, 16 bp, R. norvegicus
gaaggatgttttgcta

SEQ ID NO: 502757 - DNA, 16 bp, R. norvegicus
gaaggattgtgggaga

SEQ ID NO: 502758 - DNA, 16 bp, R. norvegicus
gaaggatttattttgg

SEQ ID NO: 502759 - DNA, 16 bp, R. norvegicus
gaaggatttgatggag

SEQ ID NO: 502760 - DNA, 16 bp, R. norvegicus
gaaggcaaccaggaga

SEQ ID NO: 502761 - DNA, 16 bp, R. norvegicus
gaaggcaagctgagca

SEQ ID NO: 502762 - DNA, 16 bp, R. norvegicus
gaaggcagaggaaggc

SEQ ID NO: 502763 - DNA, 16 bp, R. norvegicus
gaaggcagaggcagga

SEQ ID NO: 502764 - DNA, 16 bp, R. norvegicus
gaaggcagagtggagt

SEQ ID NO: 502765 - DNA, 16 bp, R. norvegicus
gaaggcagcaagcaga

SEQ ID NO: 502766 - DNA, 16 bp, R. norvegicus
gaaggcagcagaatgc

SEQ ID NO: 502767 - DNA, 16 bp, R. norvegicus
gaaggcagcccagcta

SEQ ID NO: 502768 - DNA, 16 bp, R. norvegicus
gaaggcagctacaatg

SEQ ID NO: 502769 - DNA, 16 bp, R. norvegicus
gaaggcagggcaggaa

SEQ ID NO: 502770 - DNA, 16 bp, R. norvegicus
gaaggcatcatcccaa

SEQ ID NO: 502771 - DNA, 16 bp, R. norvegicus
gaaggcatctgggttc

SEQ ID NO: 502772 - DNA, 16 bp, R. norvegicus
gaaggcatctttcagg

SEQ ID NO: 502773 - DNA, 16 bp, R. norvegicus
gaaggcatgaaggtgt

SEQ ID NO: 502774 - DNA, 16 bp, R. norvegicus
gaaggcattttctcaa

SEQ ID NO: 502775 - DNA, 16 bp, R. norvegicus
gaaggccagaagaggg

SEQ ID NO: 502776 - DNA, 16 bp, R. norvegicus
gaaggccagaagatca

SEQ ID NO: 502777 - DNA, 16 bp, R. norvegicus
gaaggccagaagatct

SEQ ID NO: 502778 - DNA, 17 bp, R. norvegicus
gaaggccagaatatcct

SEQ ID NO: 502779 - DNA, 16 bp, R. norvegicus
gaaggccagaggttga

SEQ ID NO: 502780 - DNA, 16 bp, R. norvegicus
gaaggccagcagcaaa

SEQ ID NO: 502781 - DNA, 16 bp, R. norvegicus
gaaggccattggtgaa

SEQ ID NO: 502782 - DNA, 21 bp, R. norvegicus
gaaggccctcacttctgcctg

SEQ ID NO: 502783 - DNA, 16 bp, R. norvegicus
gaaggcctcacaggag

SEQ ID NO: 502784 - DNA, 16 bp, R. norvegicus
gaaggcctctcaggag

SEQ ID NO: 502785 - DNA, 16 bp, R. norvegicus
gaaggcctctctctga

SEQ ID NO: 502786 - DNA, 16 bp, R. norvegicus
gaaggcctgtgtgcct

SEQ ID NO: 502787 - DNA, 17 bp, R. norvegicus
gaaggctactgctttat

SEQ ID NO: 502788 - DNA, 16 bp, R. norvegicus
gaaggctcaatgcccc

SEQ ID NO: 502789 - DNA, 16 bp, R. norvegicus
gaaggctcagtgggga

SEQ ID NO: 502790 - DNA, 16 bp, R. norvegicus
gaaggctggcgccatc

SEQ ID NO: 502791 - DNA, 16 bp, R. norvegicus
gaaggctgtggaacct

SEQ ID NO: 502792 - DNA, 16 bp, R. norvegicus
gaagggaaaaaaatca

SEQ ID NO: 502793 - DNA, 16 bp, R. norvegicus
gaagggacacacacac

SEQ ID NO: 502794 - DNA, 16 bp, R. norvegicus
gaagggacctgggtgg

SEQ ID NO: 502795 - DNA, 16 bp, R. norvegicus
gaagggacggcacagg

SEQ ID NO: 502796 - DNA, 16 bp, R. norvegicus
gaagggactctagcca

SEQ ID NO: 502797 - DNA, 16 bp, R. norvegicus
gaagggactgggagga

SEQ ID NO: 502798 - DNA, 16 bp, R. norvegicus
gaagggagaccaggaa

SEQ ID NO: 502799 - DNA, 16 bp, R. norvegicus
gaagggagacgcaaag

SEQ ID NO: 502800 - DNA, 16 bp, R. norvegicus
gaagggcacctgggtt

SEQ ID NO: 502801 - DNA, 16 bp, R. norvegicus
gaagggcagctgggtt

SEQ ID NO: 502802 - DNA, 18 bp, R. norvegicus
gaagggcatctgggttca

SEQ ID NO: 502803 - DNA, 16 bp, R. norvegicus
gaagggcctgccccta

SEQ ID NO: 502804 - DNA, 16 bp, R. norvegicus
gaagggctcatgacca

SEQ ID NO: 502805 - DNA, 16 bp, R. norvegicus
gaaggggaaactggaa

SEQ ID NO: 502806 - DNA, 16 bp, R. norvegicus
gaaggggaaggcctgg

SEQ ID NO: 502807 - DNA, 16 bp, R. norvegicus
gaaggggaataacatt

SEQ ID NO: 502808 - DNA, 16 bp, R. norvegicus
gaaggggacgccctgg

SEQ ID NO: 502809 - DNA, 16 bp, R. norvegicus
gaaggggagactggga

SEQ ID NO: 502810 - DNA, 16 bp, R. norvegicus
gaaggggagagtgacc

SEQ ID NO: 502811 - DNA, 16 bp, R. norvegicus
gaaggggagcaccctc

SEQ ID NO: 502812 - DNA, 16 bp, R. norvegicus
gaaggggcctgagttc

SEQ ID NO: 502813 - DNA, 16 bp, R. norvegicus
gaagggtgagagccac

SEQ ID NO: 502814 - DNA, 16 bp, R. norvegicus
gaagggtgccatggaa

SEQ ID NO: 502815 - DNA, 16 bp, R. norvegicus
gaaggtcaagaagaag

SEQ ID NO: 502816 - DNA, 16 bp, R. norvegicus
gaaggtcacagcattc

SEQ ID NO: 502817 - DNA, 16 bp, R. norvegicus
gaaggtcagaagacag

SEQ ID NO: 502818 - DNA, 16 bp, R. norvegicus
gaaggtcagaggacaa

SEQ ID NO: 502819 - DNA, 16 bp, R. norvegicus
gaaggtcagaggtcag

SEQ ID NO: 502820 - DNA, 16 bp, R. norvegicus
gaaggtcaggaagcag

SEQ ID NO: 502821 - DNA, 16 bp, R. norvegicus
gaaggtcctggacaga

SEQ ID NO: 502822 - DNA, 16 bp, R. norvegicus
gaaggtctcatagaat

SEQ ID NO: 502823 - DNA, 16 bp, R. norvegicus
gaaggtgaagaggtca

SEQ ID NO: 502824 - DNA, 16 bp, R. norvegicus
gaaggtgcagtctcag

SEQ ID NO: 502825 - DNA, 16 bp, R. norvegicus
gaaggtgctgcagtcc

SEQ ID NO: 502826 - DNA, 16 bp, R. norvegicus
gaaggtggaggcagaa

SEQ ID NO: 502827 - DNA, 16 bp, R. norvegicus
gaaggtgtttatcagt

SEQ ID NO: 502828 - DNA, 16 bp, R. norvegicus
gaaggttactgatttg

SEQ ID NO: 502829 - DNA, 16 bp, R. norvegicus
gaagtaagaccaaaat

SEQ ID NO: 502830 - DNA, 16 bp, R. norvegicus
gaagtaattattttta

SEQ ID NO: 502831 - DNA, 16 bp, R. norvegicus
gaagtaattgtttttg

SEQ ID NO: 502832 - DNA, 16 bp, R. norvegicus
gaagtagaagtagaag

SEQ ID NO: 502833 - DNA, 16 bp, R. norvegicus
gaagtagagacaggag

SEQ ID NO: 502834 - DNA, 16 bp, R. norvegicus
gaagtagctgaagagg

SEQ ID NO: 502835 - DNA, 16 bp, R. norvegicus
gaagtatcaaaagaaa

SEQ ID NO: 502836 - DNA, 16 bp, R. norvegicus
gaagtatccatacttt

SEQ ID NO: 502837 - DNA, 17 bp, R. norvegicus
gaagtatggaaagagtt

SEQ ID NO: 502838 - DNA, 16 bp, R. norvegicus
gaagtcaaggaaggaa

SEQ ID NO: 502839 - DNA, 16 bp, R. norvegicus
gaagtcagaagagggc

SEQ ID NO: 502840 - DNA, 16 bp, R. norvegicus
gaagtcagagaaggaa

SEQ ID NO: 502841 - DNA, 16 bp, R. norvegicus
gaagtcaggaccggaa

SEQ ID NO: 502842 - DNA, 16 bp, R. norvegicus
gaagtcagggaagaaa

SEQ ID NO: 502843 - DNA, 16 bp, R. norvegicus
gaagtcagggacccct

SEQ ID NO: 502844 - DNA, 16 bp, R. norvegicus
gaagtcagtgacagtg

SEQ ID NO: 502845 - DNA, 16 bp, R. norvegicus
gaagtcatggaggagt

SEQ ID NO: 502846 - DNA, 16 bp, R. norvegicus
gaagtcattttattgt

SEQ ID NO: 502847 - DNA, 16 bp, R. norvegicus
gaagtccaagaagaag

SEQ ID NO: 502848 - DNA, 16 bp, R. norvegicus
gaagtcccacagctgc

SEQ ID NO: 502849 - DNA, 16 bp, R. norvegicus
gaagtccctaaagaaa

SEQ ID NO: 502850 - DNA, 16 bp, R. norvegicus
gaagtcctcaggacac

SEQ ID NO: 502851 - DNA, 16 bp, R. norvegicus
gaagtcctttgtcctg

SEQ ID NO: 502852 - DNA, 16 bp, R. norvegicus
gaagtctcagaaatgc

SEQ ID NO: 502853 - DNA, 16 bp, R. norvegicus
gaagtctccttcctta

SEQ ID NO: 502854 - DNA, 16 bp, R. norvegicus
gaagtctgccttttat

SEQ ID NO: 502855 - DNA, 16 bp, R. norvegicus
gaagtctggtgtaatc

SEQ ID NO: 502856 - DNA, 16 bp, R. norvegicus
gaagtgaatgctgaca

SEQ ID NO: 502857 - DNA, 16 bp, R. norvegicus
gaagtgagaagaccca

SEQ ID NO: 502858 - DNA, 16 bp, R. norvegicus
gaagtgcagatcgaca

SEQ ID NO: 502859 - DNA, 16 bp, R. norvegicus
gaagtgcaggctgtca

SEQ ID NO: 502860 - DNA, 16 bp, R. norvegicus
gaagtgcttgctgact

SEQ ID NO: 502861 - DNA, 16 bp, R. norvegicus
gaagtgcttgttgata

SEQ ID NO: 502862 - DNA, 16 bp, R. norvegicus
gaagtggagaagagcc

SEQ ID NO: 502863 - DNA, 16 bp, R. norvegicus
gaagtggcactgttag

SEQ ID NO: 502864 - DNA, 16 bp, R. norvegicus
gaagtggcccagccat

SEQ ID NO: 502865 - DNA, 16 bp, R. norvegicus
gaagtgtccttcctca

SEQ ID NO: 502866 - DNA, 16 bp, R. norvegicus
gaagtgtgagtgtgtg

SEQ ID NO: 502867 - DNA, 16 bp, R. norvegicus
gaagtgtggtggtttg

SEQ ID NO: 502868 - DNA, 16 bp, R. norvegicus
gaagtgtgtccctggg

SEQ ID NO: 502869 - DNA, 16 bp, R. norvegicus
gaagtgttcctgtcta

SEQ ID NO: 502870 - DNA, 16 bp, R. norvegicus
gaagtgttctttctta

SEQ ID NO: 502871 - DNA, 16 bp, R. norvegicus
gaagtgtttgccagtg

SEQ ID NO: 502872 - DNA, 16 bp, R. norvegicus
gaagtgtttgttgaca

SEQ ID NO: 502873 - DNA, 16 bp, R. norvegicus
gaagttatttactggc

SEQ ID NO: 502874 - DNA, 16 bp, R. norvegicus
gaagttcaaaaagaag

SEQ ID NO: 502875 - DNA, 16 bp, R. norvegicus
gaagttcaaggacagc

SEQ ID NO: 502876 - DNA, 16 bp, R. norvegicus
gaagttcaaggtcact

SEQ ID NO: 502877 - DNA, 16 bp, R. norvegicus
gaagttcaaggtcatc

SEQ ID NO: 502878 - DNA, 16 bp, R. norvegicus
gaagttccagagacct

SEQ ID NO: 502879 - DNA, 16 bp, R. norvegicus
gaagttctctgctgtg

SEQ ID NO: 502880 - DNA, 16 bp, R. norvegicus
gaagttctctttgttt

SEQ ID NO: 502881 - DNA, 16 bp, R. norvegicus
gaagttcttttactgt

SEQ ID NO: 502882 - DNA, 16 bp, R. norvegicus
gaagttgaacgatgct

SEQ ID NO: 502883 - DNA, 16 bp, R. norvegicus
gaagttgaagaagaag

SEQ ID NO: 502884 - DNA, 16 bp, R. norvegicus
gaagttgaggaggaag

SEQ ID NO: 502885 - DNA, 16 bp, R. norvegicus
gaagttgaggcagaag

SEQ ID NO: 502886 - DNA, 16 bp, R. norvegicus
gaagttgccatgggga

SEQ ID NO: 502887 - DNA, 16 bp, R. norvegicus
gaagttgctcctcagg

SEQ ID NO: 502888 - DNA, 21 bp, R. norvegicus
gaagttggagactggctggga

SEQ ID NO: 502889 - DNA, 16 bp, R. norvegicus
gaagttggagcccagg

SEQ ID NO: 502890 - DNA, 16 bp, R. norvegicus
gaagtttctgtaaggc

SEQ ID NO: 502891 - DNA, 16 bp, R. norvegicus
gaagtttggaggaaga

SEQ ID NO: 502892 - DNA, 16 bp, R. norvegicus
gaagttttctggtaga

SEQ ID NO: 502893 - DNA, 16 bp, R. norvegicus
gaagtttttcaatttt

SEQ ID NO: 502894 - DNA, 16 bp, R. norvegicus
gaataaaactgacttt

SEQ ID NO: 502895 - DNA, 16 bp, R. norvegicus
gaataaacctttaaaa

SEQ ID NO: 502896 - DNA, 16 bp, R. norvegicus
gaataaattctattct

SEQ ID NO: 502897 - DNA, 16 bp, R. norvegicus
gaataagagacaaaga

SEQ ID NO: 502898 - DNA, 16 bp, R. norvegicus
gaataagattaaggtg

SEQ ID NO: 502899 - DNA, 16 bp, R. norvegicus
gaataatttagacagt

SEQ ID NO: 502900 - DNA, 16 bp, R. norvegicus
gaatacagcaagtaca

SEQ ID NO: 502901 - DNA, 16 bp, R. norvegicus
gaatacaggaaacaca

SEQ ID NO: 502902 - DNA, 16 bp, R. norvegicus
gaatacatttttgttt

SEQ ID NO: 502903 - DNA, 16 bp, R. norvegicus
gaatactggcttctag

SEQ ID NO: 502904 - DNA, 16 bp, R. norvegicus
gaatagacttgaagac

SEQ ID NO: 502905 - DNA, 16 bp, R. norvegicus
gaatagtttggaaagt

SEQ ID NO: 502906 - DNA, 16 bp, R. norvegicus
gaatataccttcttag

SEQ ID NO: 502907 - DNA, 16 bp, R. norvegicus
gaatatccaaacagac

SEQ ID NO: 502908 - DNA, 16 bp, R. norvegicus
gaatatcttggttcct

SEQ ID NO: 502909 - DNA, 16 bp, R. norvegicus
gaatatgaagtggcct

SEQ ID NO: 502910 - DNA, 16 bp, R. norvegicus
gaatatgcccaagaga

SEQ ID NO: 502911 - DNA, 16 bp, R. norvegicus
gaatatgtatgtgtgt

SEQ ID NO: 502912 - DNA, 16 bp, R. norvegicus
gaatatgtttgaccca

SEQ ID NO: 502913 - DNA, 16 bp, R. norvegicus
gaatattttggataat

SEQ ID NO: 502914 - DNA, 16 bp, R. norvegicus
gaatcaaagacctcaa

SEQ ID NO: 502915 - DNA, 16 bp, R. norvegicus
gaatcaacaaaaccaa

SEQ ID NO: 502916 - DNA, 16 bp, R. norvegicus
gaatcaagaaatggga

SEQ ID NO: 502917 - DNA, 16 bp, R. norvegicus
gaatcaccatttctga

SEQ ID NO: 502918 - DNA, 16 bp, R. norvegicus
gaatcagaaaagaaat

SEQ ID NO: 502919 - DNA, 17 bp, R. norvegicus
gaatcagagaaaggcct

SEQ ID NO: 502920 - DNA, 16 bp, R. norvegicus
gaatcagagacagaac

SEQ ID NO: 502921 - DNA, 16 bp, R. norvegicus
gaatcagcattttatg

SEQ ID NO: 502922 - DNA, 16 bp, R. norvegicus
gaatcataacatcaag

SEQ ID NO: 502923 - DNA, 16 bp, R. norvegicus
gaatcatcagaaccca

SEQ ID NO: 502924 - DNA, 16 bp, R. norvegicus
gaatcatctggaacac

SEQ ID NO: 502925 - DNA, 16 bp, R. norvegicus
gaatcattgcagaaga

SEQ ID NO: 502926 - DNA, 16 bp, R. norvegicus
gaatcatttgggaaga

SEQ ID NO: 502927 - DNA, 16 bp, R. norvegicus
gaatccaagtcctctg

SEQ ID NO: 502928 - DNA, 16 bp, R. norvegicus
gaatccacaaatggga

SEQ ID NO: 502929 - DNA, 16 bp, R. norvegicus
gaatccatgacacaac

SEQ ID NO: 502930 - DNA, 16 bp, R. norvegicus
gaatcccaacttaaag

SEQ ID NO: 502931 - DNA, 16 bp, R. norvegicus
gaatccctcagtgagg

SEQ ID NO: 502932 - DNA, 16 bp, R. norvegicus
gaatccctgagggcca

SEQ ID NO: 502933 - DNA, 16 bp, R. norvegicus
gaatcctctggaagaa

SEQ ID NO: 502934 - DNA, 16 bp, R. norvegicus
gaatcctgtggaagag

SEQ ID NO: 502935 - DNA, 16 bp, R. norvegicus
gaatcgacacccttca

SEQ ID NO: 502936 - DNA, 16 bp, R. norvegicus
gaatctcaagaagaag

SEQ ID NO: 502937 - DNA, 16 bp, R. norvegicus
gaatctccctgggaag

SEQ ID NO: 502938 - DNA, 16 bp, R. norvegicus
gaatctctgagttcta

SEQ ID NO: 502939 - DNA, 16 bp, R. norvegicus
gaatctctttctttag

SEQ ID NO: 502940 - DNA, 19 bp, R. norvegicus
gaatctgaaggaaacagac

SEQ ID NO: 502941 - DNA, 16 bp, R. norvegicus
gaatctgtgtgtgtgt

SEQ ID NO: 502942 - DNA, 16 bp, R. norvegicus
gaatcttctcctcctg

SEQ ID NO: 502943 - DNA, 16 bp, R. norvegicus
gaatgaagattcccaa

SEQ ID NO: 502944 - DNA, 16 bp, R. norvegicus
gaatgaatgaatggag

SEQ ID NO: 502945 - DNA, 16 bp, R. norvegicus
gaatgacaactccagc

SEQ ID NO: 502946 - DNA, 16 bp, R. norvegicus
gaatgacatgtgttgt

SEQ ID NO: 502947 - DNA, 16 bp, R. norvegicus
gaatgaccaccaagaa

SEQ ID NO: 502948 - DNA, 16 bp, R. norvegicus
gaatgaccattccttg

SEQ ID NO: 502949 - DNA, 16 bp, R. norvegicus
gaatgagaaggagcca

SEQ ID NO: 502950 - DNA, 16 bp, R. norvegicus
gaatgagaatgagcca

SEQ ID NO: 502951 - DNA, 16 bp, R. norvegicus
gaatgagaatggaccc

SEQ ID NO: 502952 - DNA, 16 bp, R. norvegicus
gaatgagcagagatga

SEQ ID NO: 502953 - DNA, 16 bp, R. norvegicus
gaatgaggagggggca

SEQ ID NO: 502954 - DNA, 16 bp, R. norvegicus
gaatgaggtgttcctg

SEQ ID NO: 502955 - DNA, 16 bp, R. norvegicus
gaatgataattttgat

SEQ ID NO: 502956 - DNA, 16 bp, R. norvegicus
gaatgatcattctgat

SEQ ID NO: 502957 - DNA, 16 bp, R. norvegicus
gaatgatcattttaat

SEQ ID NO: 502958 - DNA, 16 bp, R. norvegicus
gaatgatcattttgat

SEQ ID NO: 502959 - DNA, 16 bp, R. norvegicus
gaatgatcgttttgat

SEQ ID NO: 502960 - DNA, 16 bp, R. norvegicus
gaatgattattttgat

SEQ ID NO: 502961 - DNA, 16 bp, R. norvegicus
gaatgattgttttgat

SEQ ID NO: 502962 - DNA, 16 bp, R. norvegicus
gaatgcacctgccatc

SEQ ID NO: 502963 - DNA, 16 bp, R. norvegicus
gaatgcagagatccat

SEQ ID NO: 502964 - DNA, 16 bp, R. norvegicus
gaatgcatgtggtgca

SEQ ID NO: 502965 - DNA, 16 bp, R. norvegicus
gaatgcccaagataca

SEQ ID NO: 502966 - DNA, 16 bp, R. norvegicus
gaatgctagcatcaaa

SEQ ID NO: 502967 - DNA, 16 bp, R. norvegicus
gaatgctgctgtgcat

SEQ ID NO: 502968 - DNA, 16 bp, R. norvegicus
gaatgctgggatggca

SEQ ID NO: 502969 - DNA, 16 bp, R. norvegicus
gaatggaaacagtcaa

SEQ ID NO: 502970 - DNA, 16 bp, R. norvegicus
gaatggaaatatgcaa

SEQ ID NO: 502971 - DNA, 16 bp, R. norvegicus
gaatggaagttcaagg

SEQ ID NO: 502972 - DNA, 16 bp, R. norvegicus
gaatggacagccttgt

SEQ ID NO: 502973 - DNA, 16 bp, R. norvegicus
gaatggagcagaaact

SEQ ID NO: 502974 - DNA, 18 bp, R. norvegicus
gaatggatacagaaaatc

SEQ ID NO: 502975 - DNA, 16 bp, R. norvegicus
gaatggctcagaagca

SEQ ID NO: 502976 - DNA, 16 bp, R. norvegicus
gaatggctcccacagg

SEQ ID NO: 502977 - DNA, 16 bp, R. norvegicus
gaatggctgaaaagca

SEQ ID NO: 502978 - DNA, 16 bp, R. norvegicus
gaatggctgagaagca

SEQ ID NO: 502979 - DNA, 16 bp, R. norvegicus
gaatgggatccacagg

SEQ ID NO: 502980 - DNA, 16 bp, R. norvegicus
gaatggggccacccac

SEQ ID NO: 502981 - DNA, 16 bp, R. norvegicus
gaatggggtccccagt

SEQ ID NO: 502982 - DNA, 16 bp, R. norvegicus
gaatgggtgttccctc

SEQ ID NO: 502983 - DNA, 16 bp, R. norvegicus
gaatggtagttccttc

SEQ ID NO: 502984 - DNA, 16 bp, R. norvegicus
gaatggtgccacccac

SEQ ID NO: 502985 - DNA, 16 bp, R. norvegicus
gaatggtgccatccct

SEQ ID NO: 502986 - DNA, 16 bp, R. norvegicus
gaatggttacaaaagt

SEQ ID NO: 502987 - DNA, 16 bp, R. norvegicus
gaatgtaagcagaagt

SEQ ID NO: 502988 - DNA, 19 bp, R. norvegicus
gaatgtcagtcgtgctgct

SEQ ID NO: 502989 - DNA, 16 bp, R. norvegicus
gaatgtccaagaagca

SEQ ID NO: 502990 - DNA, 21 bp, R. norvegicus
gaatgtccaattttctgagga

SEQ ID NO: 502991 - DNA, 16 bp, R. norvegicus
gaatgtgatgtgtgtg

SEQ ID NO: 502992 - DNA, 16 bp, R. norvegicus
gaatgtggaacaaaag

SEQ ID NO: 502993 - DNA, 16 bp, R. norvegicus
gaatgtggagaaagaa

SEQ ID NO: 502994 - DNA, 16 bp, R. norvegicus
gaatgtggtgtgtgtg

SEQ ID NO: 502995 - DNA, 16 bp, R. norvegicus
gaatgtggttgctttt

SEQ ID NO: 502996 - DNA, 16 bp, R. norvegicus
gaatgtgtatgtgtga

SEQ ID NO: 502997 - DNA, 16 bp, R. norvegicus
gaatgttttgctgaga

SEQ ID NO: 502998 - DNA, 16 bp, R. norvegicus
gaattacaagctggta

SEQ ID NO: 502999 - DNA, 16 bp, R. norvegicus
gaattacagaaaaata

SEQ ID NO: 503000 - DNA, 16 bp, R. norvegicus
gaattacaggaaacca

SEQ ID NO: 503001 - DNA, 16 bp, R. norvegicus
gaattacaggaaagca

SEQ ID NO: 503002 - DNA, 16 bp, R. norvegicus
gaattagaaatggaaa

SEQ ID NO: 503003 - DNA, 16 bp, R. norvegicus
gaattagaaggtgtgg

SEQ ID NO: 503004 - DNA, 16 bp, R. norvegicus
gaattatctgaaagga

SEQ ID NO: 503005 - DNA, 16 bp, R. norvegicus
gaattatgctggtcta

SEQ ID NO: 503006 - DNA, 16 bp, R. norvegicus
gaattcaagatcctcc

SEQ ID NO: 503007 - DNA, 16 bp, R. norvegicus
gaattcaatgaaagtg

SEQ ID NO: 503008 - DNA, 16 bp, R. norvegicus
gaattcacagaggtcc

SEQ ID NO: 503009 - DNA, 16 bp, R. norvegicus
gaattcaccaatttac

SEQ ID NO: 503010 - DNA, 16 bp, R. norvegicus
gaattcagatcccagc

SEQ ID NO: 503011 - DNA, 16 bp, R. norvegicus
gaattcatagctgagg

SEQ ID NO: 503012 - DNA, 16 bp, R. norvegicus
gaattcattgaaaatg

SEQ ID NO: 503013 - DNA, 16 bp, R. norvegicus
gaattccaggaaacca

SEQ ID NO: 503014 - DNA, 16 bp, R. norvegicus
gaattccaggccagtg

SEQ ID NO: 503015 - DNA, 16 bp, R. norvegicus
gaattcctattcttta

SEQ ID NO: 503016 - DNA, 16 bp, R. norvegicus
gaattcctggacagcc

SEQ ID NO: 503017 - DNA, 16 bp, R. norvegicus
gaattccttctacaaa

SEQ ID NO: 503018 - DNA, 16 bp, R. norvegicus
gaattctcaaaagaga

SEQ ID NO: 503019 - DNA, 16 bp, R. norvegicus
gaattctcagctgatg

SEQ ID NO: 503020 - DNA, 16 bp, R. norvegicus
gaattctgcaataaac

SEQ ID NO: 503021 - DNA, 16 bp, R. norvegicus
gaattctgcaggcaaa

SEQ ID NO: 503022 - DNA, 16 bp, R. norvegicus
gaattctgcagtaaaa

SEQ ID NO: 503023 - DNA, 16 bp, R. norvegicus
gaattctgcattaaaa

SEQ ID NO: 503024 - DNA, 16 bp, R. norvegicus
gaattctgggaaagaa

SEQ ID NO: 503025 - DNA, 16 bp, R. norvegicus
gaattctttcaaggat

SEQ ID NO: 503026 - DNA, 16 bp, R. norvegicus
gaattcttttttttaa

SEQ ID NO: 503027 - DNA, 16 bp, R. norvegicus
gaattgaaaatggaaa

SEQ ID NO: 503028 - DNA, 16 bp, R. norvegicus
gaattgagatgtgtat

SEQ ID NO: 503029 - DNA, 16 bp, R. norvegicus
gaattgataaatgtga

SEQ ID NO: 503030 - DNA, 16 bp, R. norvegicus
gaattgccttatctgg

SEQ ID NO: 503031 - DNA, 16 bp, R. norvegicus
gaattgctttggtcat

SEQ ID NO: 503032 - DNA, 16 bp, R. norvegicus
gaattggctccttggt

SEQ ID NO: 503033 - DNA, 16 bp, R. norvegicus
gaatttacagagatcc

SEQ ID NO: 503034 - DNA, 16 bp, R. norvegicus
gaatttcatgaagaca

SEQ ID NO: 503035 - DNA, 16 bp, R. norvegicus
gaatttccatgaagat

SEQ ID NO: 503036 - DNA, 16 bp, R. norvegicus
gaatttcctccaaatc

SEQ ID NO: 503037 - DNA, 16 bp, R. norvegicus
gaatttcctgaagtca

SEQ ID NO: 503038 - DNA, 16 bp, R. norvegicus
gaatttcttttttggt

SEQ ID NO: 503039 - DNA, 16 bp, R. norvegicus
gaatttgaaaattact

SEQ ID NO: 503040 - DNA, 16 bp, R. norvegicus
gaatttgaatcccaga

SEQ ID NO: 503041 - DNA, 16 bp, R. norvegicus
gaatttggaaaacaaa

SEQ ID NO: 503042 - DNA, 16 bp, R. norvegicus
gaatttgtggatagat

SEQ ID NO: 503043 - DNA, 16 bp, R. norvegicus
gaatttgtttttaaaa

SEQ ID NO: 503044 - DNA, 16 bp, R. norvegicus
gaattttgaaggcaaa

SEQ ID NO: 503045 - DNA, 16 bp, R. norvegicus
gacaaaacagaaagta

SEQ ID NO: 503046 - DNA, 16 bp, R. norvegicus
gacaaaaccaagttta

SEQ ID NO: 503047 - DNA, 16 bp, R. norvegicus
gacaaaagacactgtc

SEQ ID NO: 503048 - DNA, 16 bp, R. norvegicus
gacaaaatagatttca

SEQ ID NO: 503049 - DNA, 16 bp, R. norvegicus
gacaaaatgtggagca

SEQ ID NO: 503050 - DNA, 16 bp, R. norvegicus
gacaaacagttctctg

SEQ ID NO: 503051 - DNA, 16 bp, R. norvegicus
gacaaacctgtcctct

SEQ ID NO: 503052 - DNA, 16 bp, R. norvegicus
gacaaagaaaatgtgg

SEQ ID NO: 503053 - DNA, 16 bp, R. norvegicus
gacaaagaagctgaaa

SEQ ID NO: 503054 - DNA, 16 bp, R. norvegicus
gacaaagacagagact

SEQ ID NO: 503055 - DNA, 16 bp, R. norvegicus
gacaaagacagtcact

SEQ ID NO: 503056 - DNA, 16 bp, R. norvegicus
gacaaagaggaacact

SEQ ID NO: 503057 - DNA, 16 bp, R. norvegicus
gacaaagatagaacag

SEQ ID NO: 503058 - DNA, 16 bp, R. norvegicus
gacaaaggcagagaga

SEQ ID NO: 503059 - DNA, 16 bp, R. norvegicus
gacaaaggcccacagg

SEQ ID NO: 503060 - DNA, 16 bp, R. norvegicus
gacaaagtgacaacca

SEQ ID NO: 503061 - DNA, 16 bp, R. norvegicus
gacaaagtgtagagca

SEQ ID NO: 503062 - DNA, 16 bp, R. norvegicus
gacaaagttatcattg

SEQ ID NO: 503063 - DNA, 16 bp, R. norvegicus
gacaaataaccctatc

SEQ ID NO: 503064 - DNA, 16 bp, R. norvegicus
gacaaatacagaggag

SEQ ID NO: 503065 - DNA, 16 bp, R. norvegicus
gacaaatggatggagc

SEQ ID NO: 503066 - DNA, 16 bp, R. norvegicus
gacaaatgggaccaca

SEQ ID NO: 503067 - DNA, 16 bp, R. norvegicus
gacaacaaaagtagat

SEQ ID NO: 503068 - DNA, 16 bp, R. norvegicus
gacaacacaaatgtca

SEQ ID NO: 503069 - DNA, 16 bp, R. norvegicus
gacaacacaggcaaac

SEQ ID NO: 503070 - DNA, 16 bp, R. norvegicus
gacaaccaagactaca

SEQ ID NO: 503071 - DNA, 16 bp, R. norvegicus
gacaaccagggataca

SEQ ID NO: 503072 - DNA, 16 bp, R. norvegicus
gacaacgtgtggagca

SEQ ID NO: 503073 - DNA, 16 bp, R. norvegicus
gacaactgagtccaag

SEQ ID NO: 503074 - DNA, 16 bp, R. norvegicus
gacaactgtgagctgc

SEQ ID NO: 503075 - DNA, 16 bp, R. norvegicus
gacaacttcagcaaag

SEQ ID NO: 503076 - DNA, 16 bp, R. norvegicus
gacaacttgagagagt

SEQ ID NO: 503077 - DNA, 22 bp, R. norvegicus
gacaactttgtaaagctcattt

SEQ ID NO: 503078 - DNA, 16 bp, R. norvegicus
gacaagaaaaggctgc

SEQ ID NO: 503079 - DNA, 16 bp, R. norvegicus
gacaagaacttccagt

SEQ ID NO: 503080 - DNA, 16 bp, R. norvegicus
gacaagaagaattatg

SEQ ID NO: 503081 - DNA, 16 bp, R. norvegicus
gacaagaaggaaagat

SEQ ID NO: 503082 - DNA, 16 bp, R. norvegicus
gacaagactggccttg

SEQ ID NO: 503083 - DNA, 16 bp, R. norvegicus
gacaagagaaggaaat

SEQ ID NO: 503084 - DNA, 16 bp, R. norvegicus
gacaagagcaagagag

SEQ ID NO: 503085 - DNA, 16 bp, R. norvegicus
gacaagcactgagcat

SEQ ID NO: 503086 - DNA, 16 bp, R. norvegicus
gacaagcctcattcta

SEQ ID NO: 503087 - DNA, 16 bp, R. norvegicus
gacaagcctgagaaac

SEQ ID NO: 503088 - DNA, 16 bp, R. norvegicus
gacaaggatgtgaaga

SEQ ID NO: 503089 - DNA, 16 bp, R. norvegicus
gacaaggcaaggctgc

SEQ ID NO: 503090 - DNA, 16 bp, R. norvegicus
gacaaggccatcctct

SEQ ID NO: 503091 - DNA, 16 bp, R. norvegicus
gacaaggctggcctgg

SEQ ID NO: 503092 - DNA, 16 bp, R. norvegicus
gacaatatggcaggtg

SEQ ID NO: 503093 - DNA, 16 bp, R. norvegicus
gacaatctgatggtga

SEQ ID NO: 503094 - DNA, 16 bp, R. norvegicus
gacaatgatgacgatg

SEQ ID NO: 503095 - DNA, 16 bp, R. norvegicus
gacaatgatgatgatg

SEQ ID NO: 503096 - DNA, 16 bp, R. norvegicus
gacaatgccatcctgt

SEQ ID NO: 503097 - DNA, 16 bp, R. norvegicus
gacaatggtgatgatg

SEQ ID NO: 503098 - DNA, 16 bp, R. norvegicus
gacaatgtgcagagag

SEQ ID NO: 503099 - DNA, 16 bp, R. norvegicus
gacaattgatgctggt

SEQ ID NO: 503100 - DNA, 16 bp, R. norvegicus
gacaattttcagcttc

SEQ ID NO: 503101 - DNA, 16 bp, R. norvegicus
gacacaaataacctgt

SEQ ID NO: 503102 - DNA, 16 bp, R. norvegicus
gacacaacaaaagcag

SEQ ID NO: 503103 - DNA, 16 bp, R. norvegicus
gacacaaccttcaaag

SEQ ID NO: 503104 - DNA, 17 bp, R. norvegicus
gacacaactgtcaaaga

SEQ ID NO: 503105 - DNA, 16 bp, R. norvegicus
gacacaagaacccagg

SEQ ID NO: 503106 - DNA, 16 bp, R. norvegicus
gacacaatgaaaacaa

SEQ ID NO: 503107 - DNA, 16 bp, R. norvegicus
gacacaatttcacagc

SEQ ID NO: 503108 - DNA, 16 bp, R. norvegicus
gacacacacacattca

SEQ ID NO: 503109 - DNA, 16 bp, R. norvegicus
gacacacacagactca

SEQ ID NO: 503110 - DNA, 16 bp, R. norvegicus
gacacacagagagact

SEQ ID NO: 503111 - DNA, 16 bp, R. norvegicus
gacacacccatggctc

SEQ ID NO: 503112 - DNA, 16 bp, R. norvegicus
gacacacctgggaaac

SEQ ID NO: 503113 - DNA, 16 bp, R. norvegicus
gacacacttattccaa

SEQ ID NO: 503114 - DNA, 16 bp, R. norvegicus
gacacagaaaatgtga

SEQ ID NO: 503115 - DNA, 16 bp, R. norvegicus
gacacagacacagaaa

SEQ ID NO: 503116 - DNA, 16 bp, R. norvegicus
gacacagacacagtca

SEQ ID NO: 503117 - DNA, 16 bp, R. norvegicus
gacacagacatgcatg

SEQ ID NO: 503118 - DNA, 16 bp, R. norvegicus
gacacagagaaacaga

SEQ ID NO: 503119 - DNA, 16 bp, R. norvegicus
gacacagagaaagaca

SEQ ID NO: 503120 - DNA, 16 bp, R. norvegicus
gacacagagaggagag

SEQ ID NO: 503121 - DNA, 16 bp, R. norvegicus
gacacagagaggcaga

SEQ ID NO: 503122 - DNA, 16 bp, R. norvegicus
gacacagagagtgagt

SEQ ID NO: 503123 - DNA, 16 bp, R. norvegicus
gacacagagatggaga

SEQ ID NO: 503124 - DNA, 16 bp, R. norvegicus
gacacagaggcacaga

SEQ ID NO: 503125 - DNA, 16 bp, R. norvegicus
gacacagaggcagagg

SEQ ID NO: 503126 - DNA, 16 bp, R. norvegicus
gacacagattggaaag

SEQ ID NO: 503127 - DNA, 16 bp, R. norvegicus
gacacagcaggacagg

SEQ ID NO: 503128 - DNA, 16 bp, R. norvegicus
gacacagcagggcagc

SEQ ID NO: 503129 - DNA, 16 bp, R. norvegicus
gacacagccagaaaac

SEQ ID NO: 503130 - DNA, 16 bp, R. norvegicus
gacacagccagaacat

SEQ ID NO: 503131 - DNA, 16 bp, R. norvegicus
gacacaggaacagctg

SEQ ID NO: 503132 - DNA, 16 bp, R. norvegicus
gacacaggacttggag

SEQ ID NO: 503133 - DNA, 16 bp, R. norvegicus
gacacaggagccaaaa

SEQ ID NO: 503134 - DNA, 16 bp, R. norvegicus
gacacaggcaggcagg

SEQ ID NO: 503135 - DNA, 16 bp, R. norvegicus
gacacaggggaaaatt

SEQ ID NO: 503136 - DNA, 16 bp, R. norvegicus
gacacagtactcgtgt

SEQ ID NO: 503137 - DNA, 16 bp, R. norvegicus
gacacagtagtcaaag

SEQ ID NO: 503138 - DNA, 16 bp, R. norvegicus
gacacagtgagaagac

SEQ ID NO: 503139 - DNA, 16 bp, R. norvegicus
gacacatcttcacaca

SEQ ID NO: 503140 - DNA, 16 bp, R. norvegicus
gacacatgcctttgat

SEQ ID NO: 503141 - DNA, 16 bp, R. norvegicus
gacaccacagagctcc

SEQ ID NO: 503142 - DNA, 16 bp, R. norvegicus
gacaccacagtgatgg

SEQ ID NO: 503143 - DNA, 16 bp, R. norvegicus
gacaccacccagatct

SEQ ID NO: 503144 - DNA, 16 bp, R. norvegicus
gacaccagagagccaa

SEQ ID NO: 503145 - DNA, 16 bp, R. norvegicus
gacaccagaggaaaaa

SEQ ID NO: 503146 - DNA, 16 bp, R. norvegicus
gacaccatcacacaga

SEQ ID NO: 503147 - DNA, 16 bp, R. norvegicus
gacaccatgaaagctg

SEQ ID NO: 503148 - DNA, 16 bp, R. norvegicus
gacaccatgaattttg

SEQ ID NO: 503149 - DNA, 16 bp, R. norvegicus
gacaccatgacaaagg

SEQ ID NO: 503150 - DNA, 16 bp, R. norvegicus
gacaccatgatcaaga

SEQ ID NO: 503151 - DNA, 16 bp, R. norvegicus
gacaccatggccaaga

SEQ ID NO: 503152 - DNA, 16 bp, R. norvegicus
gacaccatggccatgg

SEQ ID NO: 503153 - DNA, 16 bp, R. norvegicus
gacacccacccatctc

SEQ ID NO: 503154 - DNA, 16 bp, R. norvegicus
gacacccagatctaga

SEQ ID NO: 503155 - DNA, 16 bp, R. norvegicus
gacaccctcacccaga

SEQ ID NO: 503156 - DNA, 16 bp, R. norvegicus
gacaccctctcctggc

SEQ ID NO: 503157 - DNA, 16 bp, R. norvegicus
gacacccttcctaata

SEQ ID NO: 503158 - DNA, 16 bp, R. norvegicus
gacacccttggtcctg

SEQ ID NO: 503159 - DNA, 16 bp, R. norvegicus
gacacggacacagaca

SEQ ID NO: 503160 - DNA, 24 bp, R. norvegicus
gacacggtggttaggacaaaatgg

SEQ ID NO: 503161 - DNA, 16 bp, R. norvegicus
gacactatgaatgata

SEQ ID NO: 503162 - DNA, 16 bp, R. norvegicus
gacactgaaaaagaaa

SEQ ID NO: 503163 - DNA, 16 bp, R. norvegicus
gacactgaggcaggag

SEQ ID NO: 503164 - DNA, 16 bp, R. norvegicus
gacactgccatgcttc

SEQ ID NO: 503165 - DNA, 16 bp, R. norvegicus
gacactgggcctggtg

SEQ ID NO: 503166 - DNA, 16 bp, R. norvegicus
gacactgtcaaaagga

SEQ ID NO: 503167 - DNA, 16 bp, R. norvegicus
gacactgtctcaaaaa

SEQ ID NO: 503168 - DNA, 16 bp, R. norvegicus
gacactgtctctgtgc

SEQ ID NO: 503169 - DNA, 16 bp, R. norvegicus
gacactgtgaccaaag

SEQ ID NO: 503170 - DNA, 16 bp, R. norvegicus
gacactgtgaccaaga

SEQ ID NO: 503171 - DNA, 16 bp, R. norvegicus
gacacttgacatcaac

SEQ ID NO: 503172 - DNA, 16 bp, R. norvegicus
gacacttgtggtcctg

SEQ ID NO: 503173 - DNA, 16 bp, R. norvegicus
gacagaaacacagaca

SEQ ID NO: 503174 - DNA, 16 bp, R. norvegicus
gacagaaagggagtgg

SEQ ID NO: 503175 - DNA, 16 bp, R. norvegicus
gacagaaataaggaaa

SEQ ID NO: 503176 - DNA, 16 bp, R. norvegicus
gacagaaccatttgca

SEQ ID NO: 503177 - DNA, 16 bp, R. norvegicus
gacagaagacaaaata

SEQ ID NO: 503178 - DNA, 16 bp, R. norvegicus
gacagaagataaaatt

SEQ ID NO: 503179 - DNA, 16 bp, R. norvegicus
gacagaagctactgac

SEQ ID NO: 503180 - DNA, 16 bp, R. norvegicus
gacagaagctggggac

SEQ ID NO: 503181 - DNA, 16 bp, R. norvegicus
gacagaagctgtttga

SEQ ID NO: 503182 - DNA, 16 bp, R. norvegicus
gacagaaggagccaga

SEQ ID NO: 503183 - DNA, 16 bp, R. norvegicus
gacagaagttctcaga

SEQ ID NO: 503184 - DNA, 16 bp, R. norvegicus
gacagaatgagccaga

SEQ ID NO: 503185 - DNA, 16 bp, R. norvegicus
gacagacaaataaata

SEQ ID NO: 503186 - DNA, 16 bp, R. norvegicus
gacagacacagaaaca

SEQ ID NO: 503187 - DNA, 16 bp, R. norvegicus
gacagacacagagact

SEQ ID NO: 503188 - DNA, 16 bp, R. norvegicus
gacagacagaaggatg

SEQ ID NO: 503189 - DNA, 16 bp, R. norvegicus
gacagacagacacaga

SEQ ID NO: 503190 - DNA, 16 bp, R. norvegicus
gacagacagacagaaa

SEQ ID NO: 503191 - DNA, 16 bp, R. norvegicus
gacagacagacagaag

SEQ ID NO: 503192 - DNA, 16 bp, R. norvegicus
gacagacagacagata

SEQ ID NO: 503193 - DNA, 16 bp, R. norvegicus
gacagacagacagcag

SEQ ID NO: 503194 - DNA, 16 bp, R. norvegicus
gacagacagactgact

SEQ ID NO: 503195 - DNA, 16 bp, R. norvegicus
gacagacagagagaca

SEQ ID NO: 503196 - DNA, 16 bp, R. norvegicus
gacagacagaggcaca

SEQ ID NO: 503197 - DNA, 16 bp, R. norvegicus
gacagacagatggaca

SEQ ID NO: 503198 - DNA, 16 bp, R. norvegicus
gacagacagggaggag

SEQ ID NO: 503199 - DNA, 16 bp, R. norvegicus
gacagacccatgactc

SEQ ID NO: 503200 - DNA, 16 bp, R. norvegicus
gacagacggacggacg

SEQ ID NO: 503201 - DNA, 16 bp, R. norvegicus
gacagactaaaagaag

SEQ ID NO: 503202 - DNA, 22 bp, R. norvegicus
gacagactaagagaagccatga

SEQ ID NO: 503203 - DNA, 37 bp, R. norvegicus
gacagactaagagaagtcatgagccaaatggacttaa

SEQ ID NO: 503204 - DNA, 16 bp, R. norvegicus
gacagacttagagaag

SEQ ID NO: 503205 - DNA, 16 bp, R. norvegicus
gacagagaaacagaca

SEQ ID NO: 503206 - DNA, 16 bp, R. norvegicus
gacagagaaggagaca

SEQ ID NO: 503207 - DNA, 16 bp, R. norvegicus
gacagagaaggcagag

SEQ ID NO: 503208 - DNA, 16 bp, R. norvegicus
gacagagacaaaggga

SEQ ID NO: 503209 - DNA, 16 bp, R. norvegicus
gacagagacacacata

SEQ ID NO: 503210 - DNA, 16 bp, R. norvegicus
gacagagacacagagg

SEQ ID NO: 503211 - DNA, 16 bp, R. norvegicus
gacagagacagagaag

SEQ ID NO: 503212 - DNA, 16 bp, R. norvegicus
gacagagacagagata

SEQ ID NO: 503213 - DNA, 16 bp, R. norvegicus
gacagagacaggagag

SEQ ID NO: 503214 - DNA, 16 bp, R. norvegicus
gacagagacaggagga

SEQ ID NO: 503215 - DNA, 16 bp, R. norvegicus
gacagagacagggaga

SEQ ID NO: 503216 - DNA, 16 bp, R. norvegicus
gacagagaccattaca

SEQ ID NO: 503217 - DNA, 16 bp, R. norvegicus
gacagagacctgcaga

SEQ ID NO: 503218 - DNA, 16 bp, R. norvegicus
gacagagagaacagag

SEQ ID NO: 503219 - DNA, 16 bp, R. norvegicus
gacagagagactgaaa

SEQ ID NO: 503220 - DNA, 16 bp, R. norvegicus
gacagagagagacagg

SEQ ID NO: 503221 - DNA, 16 bp, R. norvegicus
gacagagagagcagag

SEQ ID NO: 503222 - DNA, 16 bp, R. norvegicus
gacagagagatacagg

SEQ ID NO: 503223 - DNA, 16 bp, R. norvegicus
gacagagagatgcaga

SEQ ID NO: 503224 - DNA, 16 bp, R. norvegicus
gacagagaggacagag

SEQ ID NO: 503225 - DNA, 16 bp, R. norvegicus
gacagagaggcaaaga

SEQ ID NO: 503226 - DNA, 16 bp, R. norvegicus
gacagagaggcagatg

SEQ ID NO: 503227 - DNA, 16 bp, R. norvegicus
gacagagataaagaaa

SEQ ID NO: 503228 - DNA, 16 bp, R. norvegicus
gacagagatagacaga

SEQ ID NO: 503229 - DNA, 16 bp, R. norvegicus
gacagagatagagatg

SEQ ID NO: 503230 - DNA, 16 bp, R. norvegicus
gacagagcagagactg

SEQ ID NO: 503231 - DNA, 16 bp, R. norvegicus
gacagagctggagaag

SEQ ID NO: 503232 - DNA, 16 bp, R. norvegicus
gacagaggaagacaga

SEQ ID NO: 503233 - DNA, 16 bp, R. norvegicus
gacagagggacagaag

SEQ ID NO: 503234 - DNA, 16 bp, R. norvegicus
gacagagggacagaga

SEQ ID NO: 503235 - DNA, 16 bp, R. norvegicus
gacagagtctctcagg

SEQ ID NO: 503236 - DNA, 16 bp, R. norvegicus
gacagatacagagaaa

SEQ ID NO: 503237 - DNA, 16 bp, R. norvegicus
gacagatagacagaca

SEQ ID NO: 503238 - DNA, 16 bp, R. norvegicus
gacagatggaaggatg

SEQ ID NO: 503239 - DNA, 16 bp, R. norvegicus
gacagatgtcatccag

SEQ ID NO: 503240 - DNA, 34 bp, R. norvegicus
gacagattgggaaaagatctttaccaatcctaca

SEQ ID NO: 503241 - DNA, 16 bp, R. norvegicus
gacagatttctctgtg

SEQ ID NO: 503242 - DNA, 16 bp, R. norvegicus
gacagcaaatcctggc

SEQ ID NO: 503243 - DNA, 16 bp, R. norvegicus
gacagcaaatgctgtt

SEQ ID NO: 503244 - DNA, 16 bp, R. norvegicus
gacagcaacagtgtac

SEQ ID NO: 503245 - DNA, 16 bp, R. norvegicus
gacagcaagagcagct

SEQ ID NO: 503246 - DNA, 16 bp, R. norvegicus
gacagcaagcacaagc

SEQ ID NO: 503247 - DNA, 16 bp, R. norvegicus
gacagcaagctgagca

SEQ ID NO: 503248 - DNA, 16 bp, R. norvegicus
gacagcaccacctgcc

SEQ ID NO: 503249 - DNA, 28 bp, R. norvegicus
gacagcagaaggcctcgcactcgactca

SEQ ID NO: 503250 - DNA, 16 bp, R. norvegicus
gacagcagcagcaaca

SEQ ID NO: 503251 - DNA, 16 bp, R. norvegicus
gacagcagcctagtca

SEQ ID NO: 503252 - DNA, 16 bp, R. norvegicus
gacagcagctggaggc

SEQ ID NO: 503253 - DNA, 16 bp, R. norvegicus
gacagcaggcaggcag

SEQ ID NO: 503254 - DNA, 16 bp, R. norvegicus
gacagcatcattttta

SEQ ID NO: 503255 - DNA, 16 bp, R. norvegicus
gacagccaagactaca

SEQ ID NO: 503256 - DNA, 16 bp, R. norvegicus
gacagccaatgctggc

SEQ ID NO: 503257 - DNA, 16 bp, R. norvegicus
gacagccactacctca

SEQ ID NO: 503258 - DNA, 16 bp, R. norvegicus
gacagccagagataca

SEQ ID NO: 503259 - DNA, 16 bp, R. norvegicus
gacagccagagccaca

SEQ ID NO: 503260 - DNA, 16 bp, R. norvegicus
gacagccagagctaca

SEQ ID NO: 503261 - DNA, 16 bp, R. norvegicus
gacagccagcgctaca

SEQ ID NO: 503262 - DNA, 16 bp, R. norvegicus
gacagccaggaggagg

SEQ ID NO: 503263 - DNA, 16 bp, R. norvegicus
gacagccagggcaaca

SEQ ID NO: 503264 - DNA, 16 bp, R. norvegicus
gacagccagggctaca

SEQ ID NO: 503265 - DNA, 16 bp, R. norvegicus
gacagccagggctctg

SEQ ID NO: 503266 - DNA, 16 bp, R. norvegicus
gacagccatagctaca

SEQ ID NO: 503267 - DNA, 16 bp, R. norvegicus
gacagccccagctcca

SEQ ID NO: 503268 - DNA, 16 bp, R. norvegicus
gacagcctgggccaca

SEQ ID NO: 503269 - DNA, 16 bp, R. norvegicus
gacagcctggtctaca

SEQ ID NO: 503270 - DNA, 16 bp, R. norvegicus
gacagctatatcaagt

SEQ ID NO: 503271 - DNA, 16 bp, R. norvegicus
gacagctgaaagccag

SEQ ID NO: 503272 - DNA, 16 bp, R. norvegicus
gacagctgatgtcatg

SEQ ID NO: 503273 - DNA, 16 bp, R. norvegicus
gacagctgtgctaaga

SEQ ID NO: 503274 - DNA, 16 bp, R. norvegicus
gacaggaaaaattatg

SEQ ID NO: 503275 - DNA, 16 bp, R. norvegicus
gacaggacaggacagg

SEQ ID NO: 503276 - DNA, 17 bp, R. norvegicus
gacaggactcagggagt

SEQ ID NO: 503277 - DNA, 16 bp, R. norvegicus
gacaggagagaaaccc

SEQ ID NO: 503278 - DNA, 16 bp, R. norvegicus
gacaggagcaattcta

SEQ ID NO: 503279 - DNA, 16 bp, R. norvegicus
gacaggagcctggaat

SEQ ID NO: 503280 - DNA, 16 bp, R. norvegicus
gacaggagcctggtac

SEQ ID NO: 503281 - DNA, 16 bp, R. norvegicus
gacaggaggaattctg

SEQ ID NO: 503282 - DNA, 16 bp, R. norvegicus
gacaggaggctccctg

SEQ ID NO: 503283 - DNA, 16 bp, R. norvegicus
gacaggagggtcagga

SEQ ID NO: 503284 - DNA, 16 bp, R. norvegicus
gacaggatctctcttt

SEQ ID NO: 503285 - DNA, 16 bp, R. norvegicus
gacaggatgaggagtg

SEQ ID NO: 503286 - DNA, 16 bp, R. norvegicus
gacaggatgtcagaaa

SEQ ID NO: 503287 - DNA, 16 bp, R. norvegicus
gacaggcacagagaga

SEQ ID NO: 503288 - DNA, 16 bp, R. norvegicus
gacaggcagacagatg

SEQ ID NO: 503289 - DNA, 16 bp, R. norvegicus
gacaggcagctgccca

SEQ ID NO: 503290 - DNA, 16 bp, R. norvegicus
gacaggcaggtcaaga

SEQ ID NO: 503291 - DNA, 16 bp, R. norvegicus
gacaggcccttctggt

SEQ ID NO: 503292 - DNA, 16 bp, R. norvegicus
gacaggctcctgtcag

SEQ ID NO: 503293 - DNA, 16 bp, R. norvegicus
gacaggctggtctgtg

SEQ ID NO: 503294 - DNA, 16 bp, R. norvegicus
gacagggaggcagaga

SEQ ID NO: 503295 - DNA, 16 bp, R. norvegicus
gacagggaggtgggag

SEQ ID NO: 503296 - DNA, 16 bp, R. norvegicus
gacagggctggagaga

SEQ ID NO: 503297 - DNA, 16 bp, R. norvegicus
gacagggtctctctgt

SEQ ID NO: 503298 - DNA, 16 bp, R. norvegicus
gacagggtgtgtgtgt

SEQ ID NO: 503299 - DNA, 16 bp, R. norvegicus
gacagggtttcactac

SEQ ID NO: 503300 - DNA, 16 bp, R. norvegicus
gacaggtggatcaatg

SEQ ID NO: 503301 - DNA, 16 bp, R. norvegicus
gacagtatgacagcat

SEQ ID NO: 503302 - DNA, 16 bp, R. norvegicus
gacagtcacagagcag

SEQ ID NO: 503303 - DNA, 20 bp, R. norvegicus
gacagtcccatgaggagtgg

SEQ ID NO: 503304 - DNA, 16 bp, R. norvegicus
gacagtcccctccaat

SEQ ID NO: 503305 - DNA, 16 bp, R. norvegicus
gacagtctctcacaga

SEQ ID NO: 503306 - DNA, 16 bp, R. norvegicus
gacagtctgctcctgg

SEQ ID NO: 503307 - DNA, 16 bp, R. norvegicus
gacagtgacaaaaatg

SEQ ID NO: 503308 - DNA, 16 bp, R. norvegicus
gacagtgacagagaga

SEQ ID NO: 503309 - DNA, 16 bp, R. norvegicus
gacagtgacagaggct

SEQ ID NO: 503310 - DNA, 16 bp, R. norvegicus
gacagtgacagtgatg

SEQ ID NO: 503311 - DNA, 16 bp, R. norvegicus
gacagtgagacagaga

SEQ ID NO: 503312 - DNA, 16 bp, R. norvegicus
gacagtgagagagaca

SEQ ID NO: 503313 - DNA, 16 bp, R. norvegicus
gacagtgctcccccac

SEQ ID NO: 503314 - DNA, 16 bp, R. norvegicus
gacagtgtttcctgtg

SEQ ID NO: 503315 - DNA, 16 bp, R. norvegicus
gacataaggaatgaac

SEQ ID NO: 503316 - DNA, 16 bp, R. norvegicus
gacatacacagagata

SEQ ID NO: 503317 - DNA, 16 bp, R. norvegicus
gacatactgcagcttc

SEQ ID NO: 503318 - DNA, 16 bp, R. norvegicus
gacatagacaaacaga

SEQ ID NO: 503319 - DNA, 16 bp, R. norvegicus
gacatagatgcaggca

SEQ ID NO: 503320 - DNA, 16 bp, R. norvegicus
gacatcaacctacagg

SEQ ID NO: 503321 - DNA, 16 bp, R. norvegicus
gacatcaagaaaacaa

SEQ ID NO: 503322 - DNA, 16 bp, R. norvegicus
gacatcaatgggaagg

SEQ ID NO: 503323 - DNA, 16 bp, R. norvegicus
gacatcagaagggaag

SEQ ID NO: 503324 - DNA, 16 bp, R. norvegicus
gacatcagatcccctg

SEQ ID NO: 503325 - DNA, 16 bp, R. norvegicus
gacatcaggtgtcttc

SEQ ID NO: 503326 - DNA, 16 bp, R. norvegicus
gacatcagtgagcttc

SEQ ID NO: 503327 - DNA, 16 bp, R. norvegicus
gacatcatctgaatat

SEQ ID NO: 503328 - DNA, 16 bp, R. norvegicus
gacatcctcatggaga

SEQ ID NO: 503329 - DNA, 16 bp, R. norvegicus
gacatcctcctgcctc

SEQ ID NO: 503330 - DNA, 16 bp, R. norvegicus
gacatctacctgcctc

SEQ ID NO: 503331 - DNA, 16 bp, R. norvegicus
gacatctgagtttttt

SEQ ID NO: 503332 - DNA, 16 bp, R. norvegicus
gacatctgatgccctc

SEQ ID NO: 503333 - DNA, 16 bp, R. norvegicus
gacatctgcccaggat

SEQ ID NO: 503334 - DNA, 16 bp, R. norvegicus
gacatctgcccaggtt

SEQ ID NO: 503335 - DNA, 16 bp, R. norvegicus
gacatctggggaagaa

SEQ ID NO: 503336 - DNA, 16 bp, R. norvegicus
gacatctgtccaggct

SEQ ID NO: 503337 - DNA, 18 bp, R. norvegicus
gacatcttcatctcagtc

SEQ ID NO: 503338 - DNA, 16 bp, R. norvegicus
gacatgatgctagaga

SEQ ID NO: 503339 - DNA, 16 bp, R. norvegicus
gacatggagacagaga

SEQ ID NO: 503340 - DNA, 16 bp, R. norvegicus
gacatggagactccag

SEQ ID NO: 503341 - DNA, 16 bp, R. norvegicus
gacatggagatggcag

SEQ ID NO: 503342 - DNA, 16 bp, R. norvegicus
gacatggatggaagac

SEQ ID NO: 503343 - DNA, 16 bp, R. norvegicus
gacatggtgctggaag

SEQ ID NO: 503344 - DNA, 16 bp, R. norvegicus
gacatgtgctgaagag

SEQ ID NO: 503345 - DNA, 16 bp, R. norvegicus
gacattcccaaggtca

SEQ ID NO: 503346 - DNA, 16 bp, R. norvegicus
gacattcttctcaaag

SEQ ID NO: 503347 - DNA, 16 bp, R. norvegicus
gacattgaagaaggaa

SEQ ID NO: 503348 - DNA, 16 bp, R. norvegicus
gacatttggaattctg

SEQ ID NO: 503349 - DNA, 16 bp, R. norvegicus
gacattttatattcaa

SEQ ID NO: 503350 - DNA, 16 bp, R. norvegicus
gacattttcaaagaaa

SEQ ID NO: 503351 - DNA, 16 bp, R. norvegicus
gacatttttatacatg

SEQ ID NO: 503352 - DNA, 16 bp, R. norvegicus
gacatttttctagaca

SEQ ID NO: 503353 - DNA, 16 bp, R. norvegicus
gaccaaaagcaacctg

SEQ ID NO: 503354 - DNA, 16 bp, R. norvegicus
gaccaaaagcagtttg

SEQ ID NO: 503355 - DNA, 16 bp, R. norvegicus
gaccaaaatgtggaag

SEQ ID NO: 503356 - DNA, 16 bp, R. norvegicus
gaccaaaggctttccc

SEQ ID NO: 503357 - DNA, 16 bp, R. norvegicus
gaccaaataagggaat

SEQ ID NO: 503358 - DNA, 16 bp, R. norvegicus
gaccaacagaatcaat

SEQ ID NO: 503359 - DNA, 16 bp, R. norvegicus
gaccaagaagcaaatt

SEQ ID NO: 503360 - DNA, 16 bp, R. norvegicus
gaccaagaagcagaga

SEQ ID NO: 503361 - DNA, 16 bp, R. norvegicus
gaccaagaagccaaaa

SEQ ID NO: 503362 - DNA, 16 bp, R. norvegicus
gaccaagacaatttat

SEQ ID NO: 503363 - DNA, 16 bp, R. norvegicus
gaccaagagatggact

SEQ ID NO: 503364 - DNA, 16 bp, R. norvegicus
gaccaagccttcaaca

SEQ ID NO: 503365 - DNA, 16 bp, R. norvegicus
gaccaagctcctgaga

SEQ ID NO: 503366 - DNA, 16 bp, R. norvegicus
gaccaagctgcccatc

SEQ ID NO: 503367 - DNA, 16 bp, R. norvegicus
gaccaagctggcctag

SEQ ID NO: 503368 - DNA, 16 bp, R. norvegicus
gaccaaggctggcctc

SEQ ID NO: 503369 - DNA, 16 bp, R. norvegicus
gaccaagggctgctcc

SEQ ID NO: 503370 - DNA, 16 bp, R. norvegicus
gaccaagggcttccac

SEQ ID NO: 503371 - DNA, 17 bp, R. norvegicus
gaccaagtagaaacaaa

SEQ ID NO: 503372 - DNA, 16 bp, R. norvegicus
gaccaatcagacaaca

SEQ ID NO: 503373 - DNA, 16 bp, R. norvegicus
gaccaatttccctttt

SEQ ID NO: 503374 - DNA, 16 bp, R. norvegicus
gaccacaagaagctca

SEQ ID NO: 503375 - DNA, 16 bp, R. norvegicus
gaccacacctcctcca

SEQ ID NO: 503376 - DNA, 16 bp, R. norvegicus
gaccaccaacactgca

SEQ ID NO: 503377 - DNA, 16 bp, R. norvegicus
gaccaccagtccaggg

SEQ ID NO: 503378 - DNA, 16 bp, R. norvegicus
gaccaccagtggaagg

SEQ ID NO: 503379 - DNA, 16 bp, R. norvegicus
gaccacccagagcttc

SEQ ID NO: 503380 - DNA, 16 bp, R. norvegicus
gaccacccagtgctcc

SEQ ID NO: 503381 - DNA, 16 bp, R. norvegicus
gaccacctgtccaggg

SEQ ID NO: 503382 - DNA, 16 bp, R. norvegicus
gaccactaaggacttt

SEQ ID NO: 503383 - DNA, 16 bp, R. norvegicus
gaccactcctgagatg

SEQ ID NO: 503384 - DNA, 16 bp, R. norvegicus
gaccactggctgctct

SEQ ID NO: 503385 - DNA, 16 bp, R. norvegicus
gaccactgggcagcac

SEQ ID NO: 503386 - DNA, 16 bp, R. norvegicus
gaccacttcctgctga

SEQ ID NO: 503387 - DNA, 16 bp, R. norvegicus
gaccagaaaaaaattc

SEQ ID NO: 503388 - DNA, 16 bp, R. norvegicus
gaccagaaagcaagtt

SEQ ID NO: 503389 - DNA, 16 bp, R. norvegicus
gaccagagaagaaaca

SEQ ID NO: 503390 - DNA, 16 bp, R. norvegicus
gaccagagagagagag

SEQ ID NO: 503391 - DNA, 16 bp, R. norvegicus
gaccagagcttccagg

SEQ ID NO: 503392 - DNA, 16 bp, R. norvegicus
gaccagattataaaaa

SEQ ID NO: 503393 - DNA, 16 bp, R. norvegicus
gaccagcaagctccag

SEQ ID NO: 503394 - DNA, 16 bp, R. norvegicus
gaccagcaggaaagga

SEQ ID NO: 503395 - DNA, 16 bp, R. norvegicus
gaccagccacagtgga

SEQ ID NO: 503396 - DNA, 16 bp, R. norvegicus
gaccagccagcttcct

SEQ ID NO: 503397 - DNA, 16 bp, R. norvegicus
gaccagcctggactat

SEQ ID NO: 503398 - DNA, 16 bp, R. norvegicus
gaccagcctggtccac

SEQ ID NO: 503399 - DNA, 16 bp, R. norvegicus
gaccagcctggtctcc

SEQ ID NO: 503400 - DNA, 16 bp, R. norvegicus
gaccagctctctgctg

SEQ ID NO: 503401 - DNA, 16 bp, R. norvegicus
gaccagctgaaacaac

SEQ ID NO: 503402 - DNA, 16 bp, R. norvegicus
gaccagctgcctcaca

SEQ ID NO: 503403 - DNA, 16 bp, R. norvegicus
gaccaggaccagatgg

SEQ ID NO: 503404 - DNA, 16 bp, R. norvegicus
gaccaggatggcctgg

SEQ ID NO: 503405 - DNA, 16 bp, R. norvegicus
gaccaggatggcttca

SEQ ID NO: 503406 - DNA, 16 bp, R. norvegicus
gaccaggctgacccca

SEQ ID NO: 503407 - DNA, 16 bp, R. norvegicus
gaccaggctggctcca

SEQ ID NO: 503408 - DNA, 16 bp, R. norvegicus
gaccaggggctggaga

SEQ ID NO: 503409 - DNA, 16 bp, R. norvegicus
gaccagggtggcttca

SEQ ID NO: 503410 - DNA, 16 bp, R. norvegicus
gaccagtcagatgagt

SEQ ID NO: 503411 - DNA, 16 bp, R. norvegicus
gaccagttcagctctg

SEQ ID NO: 503412 - DNA, 16 bp, R. norvegicus
gaccagttgctttttc

SEQ ID NO: 503413 - DNA, 16 bp, R. norvegicus
gaccatcatggtggga

SEQ ID NO: 503414 - DNA, 16 bp, R. norvegicus
gaccatcctgagactg

SEQ ID NO: 503415 - DNA, 16 bp, R. norvegicus
gaccatcctgggctac

SEQ ID NO: 503416 - DNA, 47 bp, R. norvegicus
gaccatgatcaagtaggcttcatcccaggcatgcagggatggtttaa

SEQ ID NO: 503417 - DNA, 16 bp, R. norvegicus
gaccatgcagcagctg

SEQ ID NO: 503418 - DNA, 16 bp, R. norvegicus
gaccatttcatcctaa

SEQ ID NO: 503419 - DNA, 16 bp, R. norvegicus
gacccaacaaagaaat

SEQ ID NO: 503420 - DNA, 16 bp, R. norvegicus
gacccaagacctgaca

SEQ ID NO: 503421 - DNA, 16 bp, R. norvegicus
gacccaagtgaggaca

SEQ ID NO: 503422 - DNA, 16 bp, R. norvegicus
gacccaagtgtggatg

SEQ ID NO: 503423 - DNA, 16 bp, R. norvegicus
gacccacagctccagc

SEQ ID NO: 503424 - DNA, 16 bp, R. norvegicus
gacccacatccttctc

SEQ ID NO: 503425 - DNA, 16 bp, R. norvegicus
gacccacatggagact

SEQ ID NO: 503426 - DNA, 16 bp, R. norvegicus
gacccacctctccagc

SEQ ID NO: 503427 - DNA, 16 bp, R. norvegicus
gacccacgtggtagaa

SEQ ID NO: 503428 - DNA, 16 bp, R. norvegicus
gacccacttccttcag

SEQ ID NO: 503429 - DNA, 16 bp, R. norvegicus
gacccagagagtggca

SEQ ID NO: 503430 - DNA, 16 bp, R. norvegicus
gacccagctctttgaa

SEQ ID NO: 503431 - DNA, 16 bp, R. norvegicus
gacccagctggcctca

SEQ ID NO: 503432 - DNA, 16 bp, R. norvegicus
gacccaggaagacaaa

SEQ ID NO: 503433 - DNA, 16 bp, R. norvegicus
gacccaggccctctgc

SEQ ID NO: 503434 - DNA, 16 bp, R. norvegicus
gacccagggagtggca

SEQ ID NO: 503435 - DNA, 16 bp, R. norvegicus
gacccagggctccaaa

SEQ ID NO: 503436 - DNA, 16 bp, R. norvegicus
gacccagggcttaccc

SEQ ID NO: 503437 - DNA, 16 bp, R. norvegicus
gacccagggcttctcc

SEQ ID NO: 503438 - DNA, 16 bp, R. norvegicus
gacccaggtcctctgc

SEQ ID NO: 503439 - DNA, 16 bp, R. norvegicus
gacccatggctccagc

SEQ ID NO: 503440 - DNA, 56 bp, R. norvegicus
gaccccagacacagagagaccattttggatgtaataagcaaaggcgaggtttatta

SEQ ID NO: 503441 - DNA, 16 bp, R. norvegicus
gaccccagaccccaga

SEQ ID NO: 503442 - DNA, 16 bp, R. norvegicus
gaccccagagaaggag

SEQ ID NO: 503443 - DNA, 16 bp, R. norvegicus
gaccccagcatgctgg

SEQ ID NO: 503444 - DNA, 20 bp, R. norvegicus
gacccctgcacctgagacac

SEQ ID NO: 503445 - DNA, 16 bp, R. norvegicus
gaccctaaaaagaaag

SEQ ID NO: 503446 - DNA, 16 bp, R. norvegicus
gaccctacccttctcc

SEQ ID NO: 503447 - DNA, 16 bp, R. norvegicus
gaccctattgctgaag

SEQ ID NO: 503448 - DNA, 16 bp, R. norvegicus
gaccctcagtgatgga

SEQ ID NO: 503449 - DNA, 16 bp, R. norvegicus
gaccctctggaactgg

SEQ ID NO: 503450 - DNA, 16 bp, R. norvegicus
gaccctgaagggacag

SEQ ID NO: 503451 - DNA, 16 bp, R. norvegicus
gaccctgactcaaaac

SEQ ID NO: 503452 - DNA, 16 bp, R. norvegicus
gaccctgcactctgac

SEQ ID NO: 503453 - DNA, 16 bp, R. norvegicus
gaccctgcctcaagaa

SEQ ID NO: 503454 - DNA, 17 bp, R. norvegicus
gaccctggactctgact

SEQ ID NO: 503455 - DNA, 16 bp, R. norvegicus
gaccctgggaccctgg

SEQ ID NO: 503456 - DNA, 16 bp, R. norvegicus
gacccttccagtctcc

SEQ ID NO: 503457 - DNA, 16 bp, R. norvegicus
gaccctttaatatagt

SEQ ID NO: 503458 - DNA, 16 bp, R. norvegicus
gaccctttcttcagtc

SEQ ID NO: 503459 - DNA, 16 bp, R. norvegicus
gaccgacaggagcctg

SEQ ID NO: 503460 - DNA, 16 bp, R. norvegicus
gacctaaaagctctag

SEQ ID NO: 503461 - DNA, 16 bp, R. norvegicus
gacctaaagctgtatt

SEQ ID NO: 503462 - DNA, 16 bp, R. norvegicus
gacctagaactcacca

SEQ ID NO: 503463 - DNA, 16 bp, R. norvegicus
gacctcaaacttgctg

SEQ ID NO: 503464 - DNA, 16 bp, R. norvegicus
gacctcaagcagcatt

SEQ ID NO: 503465 - DNA, 16 bp, R. norvegicus
gacctcaagctatact

SEQ ID NO: 503466 - DNA, 16 bp, R. norvegicus
gacctcacaccagtca

SEQ ID NO: 503467 - DNA, 16 bp, R. norvegicus
gacctcagaaagagca

SEQ ID NO: 503468 - DNA, 16 bp, R. norvegicus
gacctcagtttcctag

SEQ ID NO: 503469 - DNA, 16 bp, R. norvegicus
gacctccacaggcaca

SEQ ID NO: 503470 - DNA, 16 bp, R. norvegicus
gacctccacataaaac

SEQ ID NO: 503471 - DNA, 16 bp, R. norvegicus
gacctccacctaaaac

SEQ ID NO: 503472 - DNA, 16 bp, R. norvegicus
gacctccagtgcaggg

SEQ ID NO: 503473 - DNA, 16 bp, R. norvegicus
gacctcctctgccggg

SEQ ID NO: 503474 - DNA, 16 bp, R. norvegicus
gacctcctggaactgg

SEQ ID NO: 503475 - DNA, 16 bp, R. norvegicus
gacctctcagacccca

SEQ ID NO: 503476 - DNA, 16 bp, R. norvegicus
gacctctgacctccag

SEQ ID NO: 503477 - DNA, 16 bp, R. norvegicus
gacctctgagggcact

SEQ ID NO: 503478 - DNA, 17 bp, R. norvegicus
gacctctggaagagcag

SEQ ID NO: 503479 - DNA, 16 bp, R. norvegicus
gacctctggaagaggt

SEQ ID NO: 503480 - DNA, 16 bp, R. norvegicus
gacctctggaagggca

SEQ ID NO: 503481 - DNA, 16 bp, R. norvegicus
gacctcttccatccca

SEQ ID NO: 503482 - DNA, 16 bp, R. norvegicus
gacctgaaggaaacag

SEQ ID NO: 503483 - DNA, 16 bp, R. norvegicus
gacctgaccactgcca

SEQ ID NO: 503484 - DNA, 16 bp, R. norvegicus
gacctgagttcagttc

SEQ ID NO: 503485 - DNA, 16 bp, R. norvegicus
gacctgagttggatcc

SEQ ID NO: 503486 - DNA, 16 bp, R. norvegicus
gacctgagtttgatcc

SEQ ID NO: 503487 - DNA, 16 bp, R. norvegicus
gacctgatgcagaggc

SEQ ID NO: 503488 - DNA, 16 bp, R. norvegicus
gacctgcatgaagacc

SEQ ID NO: 503489 - DNA, 16 bp, R. norvegicus
gacctgcctgcaagat

SEQ ID NO: 503490 - DNA, 16 bp, R. norvegicus
gacctgcctgcttctg

SEQ ID NO: 503491 - DNA, 16 bp, R. norvegicus
gacctgcctggggaac

SEQ ID NO: 503492 - DNA, 16 bp, R. norvegicus
gacctgctcagcagta

SEQ ID NO: 503493 - DNA, 16 bp, R. norvegicus
gacctgctctgtgact

SEQ ID NO: 503494 - DNA, 16 bp, R. norvegicus
gacctgctgctccagt

SEQ ID NO: 503495 - DNA, 16 bp, R. norvegicus
gacctgctgctcctgt

SEQ ID NO: 503496 - DNA, 16 bp, R. norvegicus
gacctgctgctgctgt

SEQ ID NO: 503497 - DNA, 16 bp, R. norvegicus
gacctgcttggtggac

SEQ ID NO: 503498 - DNA, 16 bp, R. norvegicus
gacctggaaacctgga

SEQ ID NO: 503499 - DNA, 16 bp, R. norvegicus
gacctggaactcacca

SEQ ID NO: 503500 - DNA, 16 bp, R. norvegicus
gacctggaagagcttg

SEQ ID NO: 503501 - DNA, 16 bp, R. norvegicus
gacctggagcactccc

SEQ ID NO: 503502 - DNA, 16 bp, R. norvegicus
gacctggagtctgcac

SEQ ID NO: 503503 - DNA, 16 bp, R. norvegicus
gacctggccaccaggt

SEQ ID NO: 503504 - DNA, 16 bp, R. norvegicus
gacctggcccaagatg

SEQ ID NO: 503505 - DNA, 16 bp, R. norvegicus
gacctggctggcctca

SEQ ID NO: 503506 - DNA, 16 bp, R. norvegicus
gacctggcttcagttc

SEQ ID NO: 503507 - DNA, 16 bp, R. norvegicus
gacctgggagatgaga

SEQ ID NO: 503508 - DNA, 16 bp, R. norvegicus
gacctgggttctattc

SEQ ID NO: 503509 - DNA, 16 bp, R. norvegicus
gacctggtgcagaccc

SEQ ID NO: 503510 - DNA, 16 bp, R. norvegicus
gacctggtgctggaga

SEQ ID NO: 503511 - DNA, 17 bp, R. norvegicus
gacctgtacaataagaa

SEQ ID NO: 503512 - DNA, 16 bp, R. norvegicus
gacctgtctgtctctg

SEQ ID NO: 503513 - DNA, 16 bp, R. norvegicus
gacctgttttcctctc

SEQ ID NO: 503514 - DNA, 16 bp, R. norvegicus
gaccttaaatgaaatg

SEQ ID NO: 503515 - DNA, 16 bp, R. norvegicus
gaccttcacatgcaca

SEQ ID NO: 503516 - DNA, 16 bp, R. norvegicus
gaccttcagaagggca

SEQ ID NO: 503517 - DNA, 16 bp, R. norvegicus
gaccttctcaaagctg

SEQ ID NO: 503518 - DNA, 16 bp, R. norvegicus
gaccttgaacttgaga

SEQ ID NO: 503519 - DNA, 16 bp, R. norvegicus
gaccttggccagcaca

SEQ ID NO: 503520 - DNA, 16 bp, R. norvegicus
gacctttctgggaaga

SEQ ID NO: 503521 - DNA, 16 bp, R. norvegicus
gacctttctgtttgcc

SEQ ID NO: 503522 - DNA, 16 bp, R. norvegicus
gacctttgcccatcct

SEQ ID NO: 503523 - DNA, 16 bp, R. norvegicus
gacctttggaagagca

SEQ ID NO: 503524 - DNA, 45 bp, R. norvegicus
gacgaatggaaaggtccttgaggaggtcaagtgagtactgggcag

SEQ ID NO: 503525 - DNA, 16 bp, R. norvegicus
gacgacaacgacgacg

SEQ ID NO: 503526 - DNA, 16 bp, R. norvegicus
gacgacgacgacgaca

SEQ ID NO: 503527 - DNA, 16 bp, R. norvegicus
gacgacgacgacgacg

SEQ ID NO: 503528 - DNA, 16 bp, R. norvegicus
gacgacgacgacgact

SEQ ID NO: 503529 - DNA, 16 bp, R. norvegicus
gacgacgacgatgatg

SEQ ID NO: 503530 - DNA, 16 bp, R. norvegicus
gacgacgatgacgacg

SEQ ID NO: 503531 - DNA, 16 bp, R. norvegicus
gacgacgatgatgaca

SEQ ID NO: 503532 - DNA, 16 bp, R. norvegicus
gacgatgacaatgatg

SEQ ID NO: 503533 - DNA, 16 bp, R. norvegicus
gacgatgacgacaaca

SEQ ID NO: 503534 - DNA, 17 bp, R. norvegicus
gacgatgatgatgatga

SEQ ID NO: 503535 - DNA, 16 bp, R. norvegicus
gacgatgatggtgatg

SEQ ID NO: 503536 - DNA, 16 bp, R. norvegicus
gacgatggtgatgatg

SEQ ID NO: 503537 - DNA, 16 bp, R. norvegicus
gacggatttccagaat

SEQ ID NO: 503538 - DNA, 16 bp, R. norvegicus
gacgtgcaggctgaca

SEQ ID NO: 503539 - DNA, 16 bp, R. norvegicus
gacgttctctttcttt

SEQ ID NO: 503540 - DNA, 16 bp, R. norvegicus
gactaaagcatctgca

SEQ ID NO: 503541 - DNA, 16 bp, R. norvegicus
gactaacaagaagaca

SEQ ID NO: 503542 - DNA, 16 bp, R. norvegicus
gactaagaaagaaatt

SEQ ID NO: 503543 - DNA, 16 bp, R. norvegicus
gactaaggatattgaa

SEQ ID NO: 503544 - DNA, 16 bp, R. norvegicus
gactaaggatattgag

SEQ ID NO: 503545 - DNA, 16 bp, R. norvegicus
gactaaggatgttgac

SEQ ID NO: 503546 - DNA, 16 bp, R. norvegicus
gactaatttttgaaga

SEQ ID NO: 503547 - DNA, 16 bp, R. norvegicus
gactacataccatgtg

SEQ ID NO: 503548 - DNA, 16 bp, R. norvegicus
gactactactcagcta

SEQ ID NO: 503549 - DNA, 16 bp, R. norvegicus
gactagcctgggctac

SEQ ID NO: 503550 - DNA, 16 bp, R. norvegicus
gactaggagagaaagg

SEQ ID NO: 503551 - DNA, 16 bp, R. norvegicus
gactaggtgaaataga

SEQ ID NO: 503552 - DNA, 16 bp, R. norvegicus
gactatgaaagtcaga

SEQ ID NO: 503553 - DNA, 16 bp, R. norvegicus
gactattgacactttt

SEQ ID NO: 503554 - DNA, 16 bp, R. norvegicus
gactcaaagggaagga

SEQ ID NO: 503555 - DNA, 16 bp, R. norvegicus
gactcaagaagttaga

SEQ ID NO: 503556 - DNA, 16 bp, R. norvegicus
gactcagaaagacaaa

SEQ ID NO: 503557 - DNA, 16 bp, R. norvegicus
gactcagaaggcagag

SEQ ID NO: 503558 - DNA, 16 bp, R. norvegicus
gactcagggatttcta

SEQ ID NO: 503559 - DNA, 16 bp, R. norvegicus
gactcaggtcaccagg

SEQ ID NO: 503560 - DNA, 16 bp, R. norvegicus
gactcagtgtcccaca

SEQ ID NO: 503561 - DNA, 16 bp, R. norvegicus
gactcagtttcctcat

SEQ ID NO: 503562 - DNA, 16 bp, R. norvegicus
gactcatttgtagcag

SEQ ID NO: 503563 - DNA, 16 bp, R. norvegicus
gactccaaagaaccaa

SEQ ID NO: 503564 - DNA, 16 bp, R. norvegicus
gactccaaggaaacag

SEQ ID NO: 503565 - DNA, 16 bp, R. norvegicus
gactccagagacccaa

SEQ ID NO: 503566 - DNA, 23 bp, R. norvegicus
gactccatccctggactggaagc

SEQ ID NO: 503567 - DNA, 16 bp, R. norvegicus
gactcccaactcaaaa

SEQ ID NO: 503568 - DNA, 16 bp, R. norvegicus
gactcccagaagttgt

SEQ ID NO: 503569 - DNA, 16 bp, R. norvegicus
gactccccagaggaca

SEQ ID NO: 503570 - DNA, 16 bp, R. norvegicus
gactcccgctaaatac

SEQ ID NO: 503571 - DNA, 16 bp, R. norvegicus
gactccctggagctgg

SEQ ID NO: 503572 - DNA, 16 bp, R. norvegicus
gactcctaaaagttgt

SEQ ID NO: 503573 - DNA, 16 bp, R. norvegicus
gactcctcccactcca

SEQ ID NO: 503574 - DNA, 16 bp, R. norvegicus
gactcctcttccagag

SEQ ID NO: 503575 - DNA, 16 bp, R. norvegicus
gactcctgagagcctc

SEQ ID NO: 503576 - DNA, 16 bp, R. norvegicus
gactcctggtctcttt

SEQ ID NO: 503577 - DNA, 16 bp, R. norvegicus
gactctaaaggaaaac

SEQ ID NO: 503578 - DNA, 16 bp, R. norvegicus
gactctagagaatcct

SEQ ID NO: 503579 - DNA, 16 bp, R. norvegicus
gactctctctttctct

SEQ ID NO: 503580 - DNA, 16 bp, R. norvegicus
gactctcttgcagcta

SEQ ID NO: 503581 - DNA, 16 bp, R. norvegicus
gactctgaagagagga

SEQ ID NO: 503582 - DNA, 16 bp, R. norvegicus
gactctgcctctgcct

SEQ ID NO: 503583 - DNA, 16 bp, R. norvegicus
gactctgtcttaaaaa

SEQ ID NO: 503584 - DNA, 16 bp, R. norvegicus
gactcttcatattcat

SEQ ID NO: 503585 - DNA, 16 bp, R. norvegicus
gactcttcctcacttt

SEQ ID NO: 503586 - DNA, 16 bp, R. norvegicus
gactctttttggttgg

SEQ ID NO: 503587 - DNA, 16 bp, R. norvegicus
gactgaaaccagaccc

SEQ ID NO: 503588 - DNA, 16 bp, R. norvegicus
gactgaagaagctgaa

SEQ ID NO: 503589 - DNA, 16 bp, R. norvegicus
gactgaagagatggct

SEQ ID NO: 503590 - DNA, 16 bp, R. norvegicus
gactgaagatccttct

SEQ ID NO: 503591 - DNA, 16 bp, R. norvegicus
gactgaagcacccaca

SEQ ID NO: 503592 - DNA, 16 bp, R. norvegicus
gactgaaggagaggaa

SEQ ID NO: 503593 - DNA, 16 bp, R. norvegicus
gactgaagtctgggac

SEQ ID NO: 503594 - DNA, 16 bp, R. norvegicus
gactgaatacaaaatg

SEQ ID NO: 503595 - DNA, 16 bp, R. norvegicus
gactgacccacctggg

SEQ ID NO: 503596 - DNA, 17 bp, R. norvegicus
gactgactggttacatt

SEQ ID NO: 503597 - DNA, 16 bp, R. norvegicus
gactgagaaagaaatc

SEQ ID NO: 503598 - DNA, 16 bp, R. norvegicus
gactgagacagaaaca

SEQ ID NO: 503599 - DNA, 16 bp, R. norvegicus
gactgagcagctactg

SEQ ID NO: 503600 - DNA, 16 bp, R. norvegicus
gactgagcctggggac

SEQ ID NO: 503601 - DNA, 16 bp, R. norvegicus
gactgagttcaaggcc

SEQ ID NO: 503602 - DNA, 16 bp, R. norvegicus
gactgatggacaggaa

SEQ ID NO: 503603 - DNA, 16 bp, R. norvegicus
gactgatttccagatt

SEQ ID NO: 503604 - DNA, 16 bp, R. norvegicus
gactgcaatagaacca

SEQ ID NO: 503605 - DNA, 16 bp, R. norvegicus
gactgcaatcccacca

SEQ ID NO: 503606 - DNA, 16 bp, R. norvegicus
gactgcaccacccaca

SEQ ID NO: 503607 - DNA, 16 bp, R. norvegicus
gactgcagagaggaag

SEQ ID NO: 503608 - DNA, 16 bp, R. norvegicus
gactgcagcaccttcc

SEQ ID NO: 503609 - DNA, 16 bp, R. norvegicus
gactgccatttctgcc

SEQ ID NO: 503610 - DNA, 16 bp, R. norvegicus
gactgccccacccagg

SEQ ID NO: 503611 - DNA, 16 bp, R. norvegicus
gactgccccgcctggg

SEQ ID NO: 503612 - DNA, 16 bp, R. norvegicus
gactgcctctgaactc

SEQ ID NO: 503613 - DNA, 16 bp, R. norvegicus
gactgcctggtctgcc

SEQ ID NO: 503614 - DNA, 16 bp, R. norvegicus
gactgcctttccctca

SEQ ID NO: 503615 - DNA, 16 bp, R. norvegicus
gactgctcagcagtta

SEQ ID NO: 503616 - DNA, 16 bp, R. norvegicus
gactgctccctgaaca

SEQ ID NO: 503617 - DNA, 16 bp, R. norvegicus
gactgctcctcggttc

SEQ ID NO: 503618 - DNA, 16 bp, R. norvegicus
gactgctctacctggg

SEQ ID NO: 503619 - DNA, 16 bp, R. norvegicus
gactgctctcccagag

SEQ ID NO: 503620 - DNA, 16 bp, R. norvegicus
gactgctcttccgaag

SEQ ID NO: 503621 - DNA, 16 bp, R. norvegicus
gactgctggtctacct

SEQ ID NO: 503622 - DNA, 16 bp, R. norvegicus
gactgctgtgacacac

SEQ ID NO: 503623 - DNA, 16 bp, R. norvegicus
gactgcttccttctac

SEQ ID NO: 503624 - DNA, 16 bp, R. norvegicus
gactgctttccagaat

SEQ ID NO: 503625 - DNA, 16 bp, R. norvegicus
gactggaaaggtggct

SEQ ID NO: 503626 - DNA, 16 bp, R. norvegicus
gactggacattgtgaa

SEQ ID NO: 503627 - DNA, 16 bp, R. norvegicus
gactggaccaccaacc

SEQ ID NO: 503628 - DNA, 16 bp, R. norvegicus
gactggactgctgaca

SEQ ID NO: 503629 - DNA, 16 bp, R. norvegicus
gactggagaaatgact

SEQ ID NO: 503630 - DNA, 16 bp, R. norvegicus
gactggagagaaggct

SEQ ID NO: 503631 - DNA, 16 bp, R. norvegicus
gactggaggagaggag

SEQ ID NO: 503632 - DNA, 16 bp, R. norvegicus
gactggagtgatggct

SEQ ID NO: 503633 - DNA, 16 bp, R. norvegicus
gactggattttggaga

SEQ ID NO: 503634 - DNA, 16 bp, R. norvegicus
gactggcgcagactgg

SEQ ID NO: 503635 - DNA, 16 bp, R. norvegicus
gactggctttgaactc

SEQ ID NO: 503636 - DNA, 16 bp, R. norvegicus
gactgggaaaaaatct

SEQ ID NO: 503637 - DNA, 16 bp, R. norvegicus
gactgggaagaaagga

SEQ ID NO: 503638 - DNA, 16 bp, R. norvegicus
gactgggaagagtgga

SEQ ID NO: 503639 - DNA, 16 bp, R. norvegicus
gactgggaggaaagaa

SEQ ID NO: 503640 - DNA, 16 bp, R. norvegicus
gactgggccctcctac

SEQ ID NO: 503641 - DNA, 16 bp, R. norvegicus
gactgggctgcccttc

SEQ ID NO: 503642 - DNA, 16 bp, R. norvegicus
gactgggctgggctgg

SEQ ID NO: 503643 - DNA, 16 bp, R. norvegicus
gactgggcttggtggc

SEQ ID NO: 503644 - DNA, 16 bp, R. norvegicus
gactgggtgttccttc

SEQ ID NO: 503645 - DNA, 16 bp, R. norvegicus
gactgggttttgtggc

SEQ ID NO: 503646 - DNA, 16 bp, R. norvegicus
gactgtaaaaaaagat

SEQ ID NO: 503647 - DNA, 16 bp, R. norvegicus
gactgtacaattcaat

SEQ ID NO: 503648 - DNA, 16 bp, R. norvegicus
gactgtatagctcaaa

SEQ ID NO: 503649 - DNA, 16 bp, R. norvegicus
gactgtcctcaggcag

SEQ ID NO: 503650 - DNA, 16 bp, R. norvegicus
gactgtgaaagactat

SEQ ID NO: 503651 - DNA, 16 bp, R. norvegicus
gactgtgaggaggagg

SEQ ID NO: 503652 - DNA, 16 bp, R. norvegicus
gactgtgctggtggag

SEQ ID NO: 503653 - DNA, 16 bp, R. norvegicus
gactgtggaaggactt

SEQ ID NO: 503654 - DNA, 16 bp, R. norvegicus
gactgtggagatggct

SEQ ID NO: 503655 - DNA, 16 bp, R. norvegicus
gactgtggctgtggct

SEQ ID NO: 503656 - DNA, 16 bp, R. norvegicus
gactgtggtatctgtt

SEQ ID NO: 503657 - DNA, 16 bp, R. norvegicus
gactgtggtgatggct

SEQ ID NO: 503658 - DNA, 16 bp, R. norvegicus
gactgtgtgtgtgact

SEQ ID NO: 503659 - DNA, 23 bp, R. norvegicus
gactgtgtttccaaggaatcctc

SEQ ID NO: 503660 - DNA, 16 bp, R. norvegicus
gactgttcctccagag

SEQ ID NO: 503661 - DNA, 16 bp, R. norvegicus
gactgttgcctcagtg

SEQ ID NO: 503662 - DNA, 16 bp, R. norvegicus
gacttcaacaacaaca

SEQ ID NO: 503663 - DNA, 16 bp, R. norvegicus
gacttcaagaaattct

SEQ ID NO: 503664 - DNA, 16 bp, R. norvegicus
gacttcaagaaggaca

SEQ ID NO: 503665 - DNA, 16 bp, R. norvegicus
gacttcaagacactga

SEQ ID NO: 503666 - DNA, 16 bp, R. norvegicus
gacttcaataacaaca

SEQ ID NO: 503667 - DNA, 16 bp, R. norvegicus
gacttcatcttggtgg

SEQ ID NO: 503668 - DNA, 16 bp, R. norvegicus
gacttccaggacagtc

SEQ ID NO: 503669 - DNA, 16 bp, R. norvegicus
gacttccagggaaatc

SEQ ID NO: 503670 - DNA, 16 bp, R. norvegicus
gacttccctttccact

SEQ ID NO: 503671 - DNA, 16 bp, R. norvegicus
gacttcctagaattca

SEQ ID NO: 503672 - DNA, 16 bp, R. norvegicus
gacttcctcagcaaca

SEQ ID NO: 503673 - DNA, 16 bp, R. norvegicus
gacttcctctgatgat

SEQ ID NO: 503674 - DNA, 16 bp, R. norvegicus
gacttcctctggtgat

SEQ ID NO: 503675 - DNA, 16 bp, R. norvegicus
gacttcctgcagcagc

SEQ ID NO: 503676 - DNA, 16 bp, R. norvegicus
gacttcctggaggagg

SEQ ID NO: 503677 - DNA, 16 bp, R. norvegicus
gacttctacatgcatg

SEQ ID NO: 503678 - DNA, 16 bp, R. norvegicus
gacttctcaccagaca

SEQ ID NO: 503679 - DNA, 16 bp, R. norvegicus
gacttctctctgagcc

SEQ ID NO: 503680 - DNA, 16 bp, R. norvegicus
gacttctcttccagag

SEQ ID NO: 503681 - DNA, 16 bp, R. norvegicus
gacttctgcaagagca

SEQ ID NO: 503682 - DNA, 16 bp, R. norvegicus
gacttcttccttttct

SEQ ID NO: 503683 - DNA, 16 bp, R. norvegicus
gacttgaactcagaac

SEQ ID NO: 503684 - DNA, 16 bp, R. norvegicus
gacttgaagaactccc

SEQ ID NO: 503685 - DNA, 16 bp, R. norvegicus
gacttgatgctccagg

SEQ ID NO: 503686 - DNA, 16 bp, R. norvegicus
gacttggccagagctg

SEQ ID NO: 503687 - DNA, 16 bp, R. norvegicus
gacttgggaggaagag

SEQ ID NO: 503688 - DNA, 16 bp, R. norvegicus
gacttgtccatcaaca

SEQ ID NO: 503689 - DNA, 16 bp, R. norvegicus
gactttaagaagcaca

SEQ ID NO: 503690 - DNA, 16 bp, R. norvegicus
gactttacaactttta

SEQ ID NO: 503691 - DNA, 16 bp, R. norvegicus
gactttgaagaaagaa

SEQ ID NO: 503692 - DNA, 16 bp, R. norvegicus
gactttgggtttggaa

SEQ ID NO: 503693 - DNA, 16 bp, R. norvegicus
gactttgtctcaaaga

SEQ ID NO: 503694 - DNA, 16 bp, R. norvegicus
gacttttaacctgaag

SEQ ID NO: 503695 - DNA, 16 bp, R. norvegicus
gacttttatttgaaaa

SEQ ID NO: 503696 - DNA, 16 bp, R. norvegicus
gacttttctccagaaa

SEQ ID NO: 503697 - DNA, 16 bp, R. norvegicus
gacttttctccagaga

SEQ ID NO: 503698 - DNA, 16 bp, R. norvegicus
gagaaaaaccctacaa

SEQ ID NO: 503699 - DNA, 16 bp, R. norvegicus
gagaaaaaccttttca

SEQ ID NO: 503700 - DNA, 16 bp, R. norvegicus
gagaaaaactgcatgg

SEQ ID NO: 503701 - DNA, 16 bp, R. norvegicus
gagaaaaagacactgg

SEQ ID NO: 503702 - DNA, 16 bp, R. norvegicus
gagaaaaatcatcctg

SEQ ID NO: 503703 - DNA, 16 bp, R. norvegicus
gagaaaaccaaaccta

SEQ ID NO: 503704 - DNA, 16 bp, R. norvegicus
gagaaaacgcctccat

SEQ ID NO: 503705 - DNA, 16 bp, R. norvegicus
gagaaaagaaacacct

SEQ ID NO: 503706 - DNA, 16 bp, R. norvegicus
gagaaaaggatcctga

SEQ ID NO: 503707 - DNA, 16 bp, R. norvegicus
gagaaaaggctgaagg

SEQ ID NO: 503708 - DNA, 16 bp, R. norvegicus
gagaaaaggctgagag

SEQ ID NO: 503709 - DNA, 16 bp, R. norvegicus
gagaaaagttttagag

SEQ ID NO: 503710 - DNA, 16 bp, R. norvegicus
gagaaaatcaagaaga

SEQ ID NO: 503711 - DNA, 16 bp, R. norvegicus
gagaaaatcaatgaga

SEQ ID NO: 503712 - DNA, 16 bp, R. norvegicus
gagaaaatcagtaaga

SEQ ID NO: 503713 - DNA, 16 bp, R. norvegicus
gagaaaatgaacaaga

SEQ ID NO: 503714 - DNA, 16 bp, R. norvegicus
gagaaaatgagcaaga

SEQ ID NO: 503715 - DNA, 16 bp, R. norvegicus
gagaaaatgtctctat

SEQ ID NO: 503716 - DNA, 16 bp, R. norvegicus
gagaaaattacctgaa

SEQ ID NO: 503717 - DNA, 16 bp, R. norvegicus
gagaaaatttcatgaa

SEQ ID NO: 503718 - DNA, 16 bp, R. norvegicus
gagaaacaactaaaga

SEQ ID NO: 503719 - DNA, 16 bp, R. norvegicus
gagaaacaagcggaga

SEQ ID NO: 503720 - DNA, 16 bp, R. norvegicus
gagaaacacaccaaag

SEQ ID NO: 503721 - DNA, 16 bp, R. norvegicus
gagaaacacaggaaat

SEQ ID NO: 503722 - DNA, 16 bp, R. norvegicus
gagaaacacatgaaaa

SEQ ID NO: 503723 - DNA, 16 bp, R. norvegicus
gagaaacagatgcaga

SEQ ID NO: 503724 - DNA, 16 bp, R. norvegicus
gagaaacagctagagc

SEQ ID NO: 503725 - DNA, 16 bp, R. norvegicus
gagaaacatctgccaa

SEQ ID NO: 503726 - DNA, 16 bp, R. norvegicus
gagaaaccacaacctg

SEQ ID NO: 503727 - DNA, 16 bp, R. norvegicus
gagaaaccaggaaagg

SEQ ID NO: 503728 - DNA, 16 bp, R. norvegicus
gagaaaccctgcctta

SEQ ID NO: 503729 - DNA, 16 bp, R. norvegicus
gagaaaccctgtcttg

SEQ ID NO: 503730 - DNA, 16 bp, R. norvegicus
gagaaacctgccaagt

SEQ ID NO: 503731 - DNA, 16 bp, R. norvegicus
gagaaactcacagaag

SEQ ID NO: 503732 - DNA, 16 bp, R. norvegicus
gagaaactcttggtcc

SEQ ID NO: 503733 - DNA, 16 bp, R. norvegicus
gagaaactgaaggaaa

SEQ ID NO: 503734 - DNA, 16 bp, R. norvegicus
gagaaactgagacaga

SEQ ID NO: 503735 - DNA, 16 bp, R. norvegicus
gagaaactggaagcaa

SEQ ID NO: 503736 - DNA, 16 bp, R. norvegicus
gagaaagaaaaacatt

SEQ ID NO: 503737 - DNA, 16 bp, R. norvegicus
gagaaagaaatttggg

SEQ ID NO: 503738 - DNA, 16 bp, R. norvegicus
gagaaagaagagcact

SEQ ID NO: 503739 - DNA, 16 bp, R. norvegicus
gagaaagaatttaagg

SEQ ID NO: 503740 - DNA, 16 bp, R. norvegicus
gagaaagagagtcaga

SEQ ID NO: 503741 - DNA, 36 bp, R. norvegicus
gagaaagaggaacactcctccattgttggtgggatg

SEQ ID NO: 503742 - DNA, 39 bp, R. norvegicus
gagaaagaggaacactcctccattgttggtgggattgca

SEQ ID NO: 503743 - DNA, 16 bp, R. norvegicus
gagaaaggcacagaga

SEQ ID NO: 503744 - DNA, 16 bp, R. norvegicus
gagaaaggcaggtaga

SEQ ID NO: 503745 - DNA, 16 bp, R. norvegicus
gagaaaggcctgaagg

SEQ ID NO: 503746 - DNA, 16 bp, R. norvegicus
gagaaagggtctcatg

SEQ ID NO: 503747 - DNA, 16 bp, R. norvegicus
gagaaagtaccatgaa

SEQ ID NO: 503748 - DNA, 16 bp, R. norvegicus
gagaaagtactgaaag

SEQ ID NO: 503749 - DNA, 16 bp, R. norvegicus
gagaaagttacagaaa

SEQ ID NO: 503750 - DNA, 16 bp, R. norvegicus
gagaaagttcaagaag

SEQ ID NO: 503751 - DNA, 16 bp, R. norvegicus
gagaaatacagagaga

SEQ ID NO: 503752 - DNA, 16 bp, R. norvegicus
gagaaatacagagtca

SEQ ID NO: 503753 - DNA, 16 bp, R. norvegicus
gagaaatcacaaaggg

SEQ ID NO: 503754 - DNA, 16 bp, R. norvegicus
gagaaatcagaaaaca

SEQ ID NO: 503755 - DNA, 16 bp, R. norvegicus
gagaaatctggtgtga

SEQ ID NO: 503756 - DNA, 16 bp, R. norvegicus
gagaaatgaatgaatg

SEQ ID NO: 503757 - DNA, 16 bp, R. norvegicus
gagaaatggctcagga

SEQ ID NO: 503758 - DNA, 16 bp, R. norvegicus
gagaaattacaggcag

SEQ ID NO: 503759 - DNA, 16 bp, R. norvegicus
gagaaattatatatat

SEQ ID NO: 503760 - DNA, 16 bp, R. norvegicus
gagaaattctgtcttg

SEQ ID NO: 503761 - DNA, 16 bp, R. norvegicus
gagaacaaaaggagat

SEQ ID NO: 503762 - DNA, 16 bp, R. norvegicus
gagaacaagagagctg

SEQ ID NO: 503763 - DNA, 16 bp, R. norvegicus
gagaacaagctgagca

SEQ ID NO: 503764 - DNA, 16 bp, R. norvegicus
gagaacaaggccctct

SEQ ID NO: 503765 - DNA, 16 bp, R. norvegicus
gagaacacatggaggg

SEQ ID NO: 503766 - DNA, 16 bp, R. norvegicus
gagaacatgctagaca

SEQ ID NO: 503767 - DNA, 16 bp, R. norvegicus
gagaacatggaggtgg

SEQ ID NO: 503768 - DNA, 16 bp, R. norvegicus
gagaacattaaagtat

SEQ ID NO: 503769 - DNA, 16 bp, R. norvegicus
gagaaccaaatccagg

SEQ ID NO: 503770 - DNA, 16 bp, R. norvegicus
gagaacccagaggaga

SEQ ID NO: 503771 - DNA, 16 bp, R. norvegicus
gagaacccaggagtga

SEQ ID NO: 503772 - DNA, 16 bp, R. norvegicus
gagaacctgagtttaa

SEQ ID NO: 503773 - DNA, 16 bp, R. norvegicus
gagaacctgcagagac

SEQ ID NO: 503774 - DNA, 16 bp, R. norvegicus
gagaacctggaggtca

SEQ ID NO: 503775 - DNA, 16 bp, R. norvegicus
gagaacctgtcaagac

SEQ ID NO: 503776 - DNA, 16 bp, R. norvegicus
gagaactgactccaga

SEQ ID NO: 503777 - DNA, 16 bp, R. norvegicus
gagaactgggatctga

SEQ ID NO: 503778 - DNA, 16 bp, R. norvegicus
gagaactgtttatccg

SEQ ID NO: 503779 - DNA, 16 bp, R. norvegicus
gagaacttcttcagct

SEQ ID NO: 503780 - DNA, 16 bp, R. norvegicus
gagaagaaactgaagg

SEQ ID NO: 503781 - DNA, 16 bp, R. norvegicus
gagaagaaactgagaa

SEQ ID NO: 503782 - DNA, 16 bp, R. norvegicus
gagaagaagctgagag

SEQ ID NO: 503783 - DNA, 16 bp, R. norvegicus
gagaagaatgcccaca

SEQ ID NO: 503784 - DNA, 16 bp, R. norvegicus
gagaagaatttcaata

SEQ ID NO: 503785 - DNA, 16 bp, R. norvegicus
gagaagacacacctaa

SEQ ID NO: 503786 - DNA, 16 bp, R. norvegicus
gagaagacaccatggg

SEQ ID NO: 503787 - DNA, 16 bp, R. norvegicus
gagaagacagacagag

SEQ ID NO: 503788 - DNA, 16 bp, R. norvegicus
gagaagacagggacag

SEQ ID NO: 503789 - DNA, 16 bp, R. norvegicus
gagaagagccttgttg

SEQ ID NO: 503790 - DNA, 16 bp, R. norvegicus
gagaagaggcccttgg

SEQ ID NO: 503791 - DNA, 16 bp, R. norvegicus
gagaagagggtttatt

SEQ ID NO: 503792 - DNA, 16 bp, R. norvegicus
gagaagatatcatgag

SEQ ID NO: 503793 - DNA, 16 bp, R. norvegicus
gagaagatcaaaacta

SEQ ID NO: 503794 - DNA, 16 bp, R. norvegicus
gagaagatgcacctaa

SEQ ID NO: 503795 - DNA, 16 bp, R. norvegicus
gagaagatggatgaag

SEQ ID NO: 503796 - DNA, 16 bp, R. norvegicus
gagaagatggctcagc

SEQ ID NO: 503797 - DNA, 16 bp, R. norvegicus
gagaagattgatgaag

SEQ ID NO: 503798 - DNA, 16 bp, R. norvegicus
gagaagcaactccagg

SEQ ID NO: 503799 - DNA, 16 bp, R. norvegicus
gagaagcaagatgatg

SEQ ID NO: 503800 - DNA, 16 bp, R. norvegicus
gagaagcacctgaaga

SEQ ID NO: 503801 - DNA, 16 bp, R. norvegicus
gagaagcagaaagcag

SEQ ID NO: 503802 - DNA, 16 bp, R. norvegicus
gagaagcagaagcagg

SEQ ID NO: 503803 - DNA, 16 bp, R. norvegicus
gagaagcagagcagag

SEQ ID NO: 503804 - DNA, 16 bp, R. norvegicus
gagaagcagagccagg

SEQ ID NO: 503805 - DNA, 16 bp, R. norvegicus
gagaagcagaggctgg

SEQ ID NO: 503806 - DNA, 16 bp, R. norvegicus
gagaagcagcagcagg

SEQ ID NO: 503807 - DNA, 16 bp, R. norvegicus
gagaagcaggaagcag

SEQ ID NO: 503808 - DNA, 16 bp, R. norvegicus
gagaagccagggcagg

SEQ ID NO: 503809 - DNA, 16 bp, R. norvegicus
gagaagccatcagcag

SEQ ID NO: 503810 - DNA, 16 bp, R. norvegicus
gagaagccatgacagg

SEQ ID NO: 503811 - DNA, 16 bp, R. norvegicus
gagaagctgagaagaa

SEQ ID NO: 503812 - DNA, 16 bp, R. norvegicus
gagaagctgagggaag

SEQ ID NO: 503813 - DNA, 16 bp, R. norvegicus
gagaagctggagaagc

SEQ ID NO: 503814 - DNA, 16 bp, R. norvegicus
gagaagctggaggaag

SEQ ID NO: 503815 - DNA, 16 bp, R. norvegicus
gagaagctgggagaag

SEQ ID NO: 503816 - DNA, 16 bp, R. norvegicus
gagaagctgggggagg

SEQ ID NO: 503817 - DNA, 16 bp, R. norvegicus
gagaagcttcctcctg

SEQ ID NO: 503818 - DNA, 16 bp, R. norvegicus
gagaagcttgaagcaa

SEQ ID NO: 503819 - DNA, 16 bp, R. norvegicus
gagaaggaacctgaag

SEQ ID NO: 503820 - DNA, 16 bp, R. norvegicus
gagaaggaactggaag

SEQ ID NO: 503821 - DNA, 16 bp, R. norvegicus
gagaaggaagcatggg

SEQ ID NO: 503822 - DNA, 16 bp, R. norvegicus
gagaaggactgaaaga

SEQ ID NO: 503823 - DNA, 16 bp, R. norvegicus
gagaaggactgaagca

SEQ ID NO: 503824 - DNA, 16 bp, R. norvegicus
gagaaggagcagcaga

SEQ ID NO: 503825 - DNA, 16 bp, R. norvegicus
gagaaggagcaggagc

SEQ ID NO: 503826 - DNA, 16 bp, R. norvegicus
gagaaggagctggaag

SEQ ID NO: 503827 - DNA, 16 bp, R. norvegicus
gagaaggagttgagag

SEQ ID NO: 503828 - DNA, 16 bp, R. norvegicus
gagaaggcaccattgc

SEQ ID NO: 503829 - DNA, 16 bp, R. norvegicus
gagaaggcagagccag

SEQ ID NO: 503830 - DNA, 16 bp, R. norvegicus
gagaaggcagcatatg

SEQ ID NO: 503831 - DNA, 16 bp, R. norvegicus
gagaaggcagccctgg

SEQ ID NO: 503832 - DNA, 16 bp, R. norvegicus
gagaaggctcagcaga

SEQ ID NO: 503833 - DNA, 16 bp, R. norvegicus
gagaaggctcttcaac

SEQ ID NO: 503834 - DNA, 16 bp, R. norvegicus
gagaagggagcctcag

SEQ ID NO: 503835 - DNA, 16 bp, R. norvegicus
gagaagggcagcccag

SEQ ID NO: 503836 - DNA, 16 bp, R. norvegicus
gagaaggggaagctcc

SEQ ID NO: 503837 - DNA, 16 bp, R. norvegicus
gagaaggggctgagag

SEQ ID NO: 503838 - DNA, 16 bp, R. norvegicus
gagaaggtggagacag

SEQ ID NO: 503839 - DNA, 16 bp, R. norvegicus
gagaaggttctggtga

SEQ ID NO: 503840 - DNA, 16 bp, R. norvegicus
gagaagtaccatgagg

SEQ ID NO: 503841 - DNA, 16 bp, R. norvegicus
gagaagtaccttaaga

SEQ ID NO: 503842 - DNA, 16 bp, R. norvegicus
gagaagtcagaggaaa

SEQ ID NO: 503843 - DNA, 16 bp, R. norvegicus
gagaagtctctggatg

SEQ ID NO: 503844 - DNA, 17 bp, R. norvegicus
gagaagtctggggtaat

SEQ ID NO: 503845 - DNA, 16 bp, R. norvegicus
gagaagtgatgccagc

SEQ ID NO: 503846 - DNA, 16 bp, R. norvegicus
gagaagtgttcctctt

SEQ ID NO: 503847 - DNA, 16 bp, R. norvegicus
gagaagtttgaaggaa

SEQ ID NO: 503848 - DNA, 16 bp, R. norvegicus
gagaagtttgaaggag

SEQ ID NO: 503849 - DNA, 16 bp, R. norvegicus
gagaataagattaagt

SEQ ID NO: 503850 - DNA, 16 bp, R. norvegicus
gagaatagcacatgca

SEQ ID NO: 503851 - DNA, 16 bp, R. norvegicus
gagaatagccttgttc

SEQ ID NO: 503852 - DNA, 16 bp, R. norvegicus
gagaatcaaacttggg

SEQ ID NO: 503853 - DNA, 16 bp, R. norvegicus
gagaatcaagagttca

SEQ ID NO: 503854 - DNA, 16 bp, R. norvegicus
gagaatcacaagttca

SEQ ID NO: 503855 - DNA, 16 bp, R. norvegicus
gagaatcagagttcaa

SEQ ID NO: 503856 - DNA, 16 bp, R. norvegicus
gagaatcattaatagt

SEQ ID NO: 503857 - DNA, 63 bp, R. norvegicus
gagaatctcaggagcagaagattccatagaaatcattgactcgactgtcaaagataatgtaaa

SEQ ID NO: 503858 - DNA, 16 bp, R. norvegicus
gagaatctgaggggca

SEQ ID NO: 503859 - DNA, 16 bp, R. norvegicus
gagaatgaaattaagg

SEQ ID NO: 503860 - DNA, 16 bp, R. norvegicus
gagaatgaacagaaac

SEQ ID NO: 503861 - DNA, 16 bp, R. norvegicus
gagaatgaacagaaat

SEQ ID NO: 503862 - DNA, 16 bp, R. norvegicus
gagaatgaagaagctg

SEQ ID NO: 503863 - DNA, 16 bp, R. norvegicus
gagaatgaagatttcc

SEQ ID NO: 503864 - DNA, 16 bp, R. norvegicus
gagaatgagaagaagc

SEQ ID NO: 503865 - DNA, 16 bp, R. norvegicus
gagaatgagaatatga

SEQ ID NO: 503866 - DNA, 16 bp, R. norvegicus
gagaatgagagcacac

SEQ ID NO: 503867 - DNA, 16 bp, R. norvegicus
gagaatgcagagaaag

SEQ ID NO: 503868 - DNA, 16 bp, R. norvegicus
gagaatggaacctggc

SEQ ID NO: 503869 - DNA, 16 bp, R. norvegicus
gagaatggagctggag

SEQ ID NO: 503870 - DNA, 16 bp, R. norvegicus
gagaatggccttgtct

SEQ ID NO: 503871 - DNA, 16 bp, R. norvegicus
gagaatgggaccccag

SEQ ID NO: 503872 - DNA, 16 bp, R. norvegicus
gagaatgggaccctca

SEQ ID NO: 503873 - DNA, 16 bp, R. norvegicus
gagaatgtggggaaga

SEQ ID NO: 503874 - DNA, 16 bp, R. norvegicus
gagaatgtgtccttgt

SEQ ID NO: 503875 - DNA, 16 bp, R. norvegicus
gagaattcacaataga

SEQ ID NO: 503876 - DNA, 16 bp, R. norvegicus
gagaattccctgttta

SEQ ID NO: 503877 - DNA, 16 bp, R. norvegicus
gagaattctcagaaga

SEQ ID NO: 503878 - DNA, 16 bp, R. norvegicus
gagaattgctaagatc

SEQ ID NO: 503879 - DNA, 16 bp, R. norvegicus
gagaattgctctttct

SEQ ID NO: 503880 - DNA, 16 bp, R. norvegicus
gagaatttcagaccta

SEQ ID NO: 503881 - DNA, 16 bp, R. norvegicus
gagaatttcaggagca

SEQ ID NO: 503882 - DNA, 16 bp, R. norvegicus
gagaatttttctgctt

SEQ ID NO: 503883 - DNA, 16 bp, R. norvegicus
gagacaaaaggaacac

SEQ ID NO: 503884 - DNA, 16 bp, R. norvegicus
gagacaaagattggag

SEQ ID NO: 503885 - DNA, 16 bp, R. norvegicus
gagacaaagctgcagg

SEQ ID NO: 503886 - DNA, 16 bp, R. norvegicus
gagacaaccatggata

SEQ ID NO: 503887 - DNA, 16 bp, R. norvegicus
gagacaagcagatctc

SEQ ID NO: 503888 - DNA, 16 bp, R. norvegicus
gagacaagcgcaggaa

SEQ ID NO: 503889 - DNA, 16 bp, R. norvegicus
gagacaagctggagta

SEQ ID NO: 503890 - DNA, 16 bp, R. norvegicus
gagacaaggtctcacg

SEQ ID NO: 503891 - DNA, 16 bp, R. norvegicus
gagacaaggtctcact

SEQ ID NO: 503892 - DNA, 16 bp, R. norvegicus
gagacaaggtttctct

SEQ ID NO: 503893 - DNA, 16 bp, R. norvegicus
gagacaagtgcaggaa

SEQ ID NO: 503894 - DNA, 16 bp, R. norvegicus
gagacaattacagaaa

SEQ ID NO: 503895 - DNA, 16 bp, R. norvegicus
gagacacacacagaca

SEQ ID NO: 503896 - DNA, 16 bp, R. norvegicus
gagacacacactgaga

SEQ ID NO: 503897 - DNA, 16 bp, R. norvegicus
gagacacacccagagc

SEQ ID NO: 503898 - DNA, 16 bp, R. norvegicus
gagacacagagaaaat

SEQ ID NO: 503899 - DNA, 16 bp, R. norvegicus
gagacacagagacagt

SEQ ID NO: 503900 - DNA, 16 bp, R. norvegicus
gagacacagagacgga

SEQ ID NO: 503901 - DNA, 16 bp, R. norvegicus
gagacacagagtcaga

SEQ ID NO: 503902 - DNA, 16 bp, R. norvegicus
gagacacagccagaac

SEQ ID NO: 503903 - DNA, 16 bp, R. norvegicus
gagacacggagacaga

SEQ ID NO: 503904 - DNA, 16 bp, R. norvegicus
gagacagaaacagata

SEQ ID NO: 503905 - DNA, 16 bp, R. norvegicus
gagacagaactggaag

SEQ ID NO: 503906 - DNA, 16 bp, R. norvegicus
gagacagaagcagatg

SEQ ID NO: 503907 - DNA, 16 bp, R. norvegicus
gagacagaagcagcaa

SEQ ID NO: 503908 - DNA, 16 bp, R. norvegicus
gagacagacaggagga

SEQ ID NO: 503909 - DNA, 16 bp, R. norvegicus
gagacagacagggaga

SEQ ID NO: 503910 - DNA, 41 bp, R. norvegicus
gagacagactcagaaaagacagatacagaggaggaaacaga

SEQ ID NO: 503911 - DNA, 16 bp, R. norvegicus
gagacagagaaagtca

SEQ ID NO: 503912 - DNA, 16 bp, R. norvegicus
gagacagagaaagtga

SEQ ID NO: 503913 - DNA, 16 bp, R. norvegicus
gagacagagacaaagg

SEQ ID NO: 503914 - DNA, 16 bp, R. norvegicus
gagacagagacaagag

SEQ ID NO: 503915 - DNA, 16 bp, R. norvegicus
gagacagagacagact

SEQ ID NO: 503916 - DNA, 16 bp, R. norvegicus
gagacagagacctgga

SEQ ID NO: 503917 - DNA, 16 bp, R. norvegicus
gagacagagactgaga

SEQ ID NO: 503918 - DNA, 16 bp, R. norvegicus
gagacagagactgggg

SEQ ID NO: 503919 - DNA, 16 bp, R. norvegicus
gagacagagagaaatg

SEQ ID NO: 503920 - DNA, 16 bp, R. norvegicus
gagacagagagaagca

SEQ ID NO: 503921 - DNA, 16 bp, R. norvegicus
gagacagagagaataa

SEQ ID NO: 503922 - DNA, 16 bp, R. norvegicus
gagacagagagagatc

SEQ ID NO: 503923 - DNA, 16 bp, R. norvegicus
gagacagagagagcca

SEQ ID NO: 503924 - DNA, 16 bp, R. norvegicus
gagacagagagggagt

SEQ ID NO: 503925 - DNA, 16 bp, R. norvegicus
gagacagagaggtgga

SEQ ID NO: 503926 - DNA, 16 bp, R. norvegicus
gagacagagatgcaga

SEQ ID NO: 503927 - DNA, 16 bp, R. norvegicus
gagacagagcaagaga

SEQ ID NO: 503928 - DNA, 16 bp, R. norvegicus
gagacagaggcagatg

SEQ ID NO: 503929 - DNA, 16 bp, R. norvegicus
gagacagaggcaggac

SEQ ID NO: 503930 - DNA, 16 bp, R. norvegicus
gagacagaggcaggag

SEQ ID NO: 503931 - DNA, 16 bp, R. norvegicus
gagacagaggtttgcc

SEQ ID NO: 503932 - DNA, 16 bp, R. norvegicus
gagacagagtctctca

SEQ ID NO: 503933 - DNA, 16 bp, R. norvegicus
gagacagatgaagata

SEQ ID NO: 503934 - DNA, 16 bp, R. norvegicus
gagacagatggatctc

SEQ ID NO: 503935 - DNA, 16 bp, R. norvegicus
gagacagatggctcag

SEQ ID NO: 503936 - DNA, 16 bp, R. norvegicus
gagacagcaaaacaag

SEQ ID NO: 503937 - DNA, 16 bp, R. norvegicus
gagacagcagatgctg

SEQ ID NO: 503938 - DNA, 16 bp, R. norvegicus
gagacagccaaggttg

SEQ ID NO: 503939 - DNA, 16 bp, R. norvegicus
gagacagccaggcctc

SEQ ID NO: 503940 - DNA, 16 bp, R. norvegicus
gagacagctgagaaag

SEQ ID NO: 503941 - DNA, 16 bp, R. norvegicus
gagacaggaagattac

SEQ ID NO: 503942 - DNA, 16 bp, R. norvegicus
gagacaggaagcttct

SEQ ID NO: 503943 - DNA, 16 bp, R. norvegicus
gagacaggaaggtctc

SEQ ID NO: 503944 - DNA, 16 bp, R. norvegicus
gagacaggagctggaa

SEQ ID NO: 503945 - DNA, 16 bp, R. norvegicus
gagacaggaggaccag

SEQ ID NO: 503946 - DNA, 16 bp, R. norvegicus
gagacaggaggatccc

SEQ ID NO: 503947 - DNA, 16 bp, R. norvegicus
gagacaggagtgggtg

SEQ ID NO: 503948 - DNA, 16 bp, R. norvegicus
gagacaggcaggcaga

SEQ ID NO: 503949 - DNA, 16 bp, R. norvegicus
gagacaggcttcctgg

SEQ ID NO: 503950 - DNA, 16 bp, R. norvegicus
gagacagggacaggga

SEQ ID NO: 503951 - DNA, 16 bp, R. norvegicus
gagacagggactctca

SEQ ID NO: 503952 - DNA, 16 bp, R. norvegicus
gagacagggtctgact

SEQ ID NO: 503953 - DNA, 16 bp, R. norvegicus
gagacagtgacagaca

SEQ ID NO: 503954 - DNA, 16 bp, R. norvegicus
gagacagtgacagaga

SEQ ID NO: 503955 - DNA, 16 bp, R. norvegicus
gagacagtgagacaga

SEQ ID NO: 503956 - DNA, 16 bp, R. norvegicus
gagacagtgagtgaga

SEQ ID NO: 503957 - DNA, 16 bp, R. norvegicus
gagacagtgggcagcc

SEQ ID NO: 503958 - DNA, 16 bp, R. norvegicus
gagacagtttggtaaa

SEQ ID NO: 503959 - DNA, 16 bp, R. norvegicus
gagacataaagacaga

SEQ ID NO: 503960 - DNA, 16 bp, R. norvegicus
gagacatagagacata

SEQ ID NO: 503961 - DNA, 16 bp, R. norvegicus
gagacatagagagaga

SEQ ID NO: 503962 - DNA, 16 bp, R. norvegicus
gagacatggagagaca

SEQ ID NO: 503963 - DNA, 17 bp, R. norvegicus
gagaccaagcaagattc

SEQ ID NO: 503964 - DNA, 16 bp, R. norvegicus
gagaccacagatgcca

SEQ ID NO: 503965 - DNA, 16 bp, R. norvegicus
gagaccacagatgtca

SEQ ID NO: 503966 - DNA, 17 bp, R. norvegicus
gagaccaccaacactgc

SEQ ID NO: 503967 - DNA, 16 bp, R. norvegicus
gagaccacctccagca

SEQ ID NO: 503968 - DNA, 16 bp, R. norvegicus
gagaccagaagacagc

SEQ ID NO: 503969 - DNA, 16 bp, R. norvegicus
gagaccagaagagagt

SEQ ID NO: 503970 - DNA, 16 bp, R. norvegicus
gagaccagacaagaca

SEQ ID NO: 503971 - DNA, 16 bp, R. norvegicus
gagaccagctctcttc

SEQ ID NO: 503972 - DNA, 16 bp, R. norvegicus
gagaccatcacagaaa

SEQ ID NO: 503973 - DNA, 16 bp, R. norvegicus
gagaccatggaggagc

SEQ ID NO: 503974 - DNA, 16 bp, R. norvegicus
gagaccatgtctcaaa

SEQ ID NO: 503975 - DNA, 16 bp, R. norvegicus
gagaccatttctcaaa

SEQ ID NO: 503976 - DNA, 16 bp, R. norvegicus
gagacccaactgcctg

SEQ ID NO: 503977 - DNA, 16 bp, R. norvegicus
gagacccacagcaaaa

SEQ ID NO: 503978 - DNA, 16 bp, R. norvegicus
gagacccagctgtagg

SEQ ID NO: 503979 - DNA, 16 bp, R. norvegicus
gagaccccaaagccca

SEQ ID NO: 503980 - DNA, 16 bp, R. norvegicus
gagaccctcactcaag

SEQ ID NO: 503981 - DNA, 16 bp, R. norvegicus
gagaccctgaggacag

SEQ ID NO: 503982 - DNA, 16 bp, R. norvegicus
gagaccctgcctcaaa

SEQ ID NO: 503983 - DNA, 16 bp, R. norvegicus
gagaccctgcttcaaa

SEQ ID NO: 503984 - DNA, 16 bp, R. norvegicus
gagaccctggagagag

SEQ ID NO: 503985 - DNA, 16 bp, R. norvegicus
gagaccctgggttcca

SEQ ID NO: 503986 - DNA, 16 bp, R. norvegicus
gagaccctgtcccaga

SEQ ID NO: 503987 - DNA, 16 bp, R. norvegicus
gagaccctgtctcaaa

SEQ ID NO: 503988 - DNA, 16 bp, R. norvegicus
gagaccctgtctcaag

SEQ ID NO: 503989 - DNA, 16 bp, R. norvegicus
gagaccctttatgaac

SEQ ID NO: 503990 - DNA, 31 bp, R. norvegicus
gagacctattacagagatctccgggccgaca

SEQ ID NO: 503991 - DNA, 16 bp, R. norvegicus
gagacctcaggagaga

SEQ ID NO: 503992 - DNA, 16 bp, R. norvegicus
gagacctggggcccag

SEQ ID NO: 503993 - DNA, 16 bp, R. norvegicus
gagaccttcaaagaag

SEQ ID NO: 503994 - DNA, 16 bp, R. norvegicus
gagaccttgcctcagt

SEQ ID NO: 503995 - DNA, 16 bp, R. norvegicus
gagaccttgccttaaa

SEQ ID NO: 503996 - DNA, 16 bp, R. norvegicus
gagaccttgtctccag

SEQ ID NO: 503997 - DNA, 16 bp, R. norvegicus
gagacgcaaagaagga

SEQ ID NO: 503998 - DNA, 16 bp, R. norvegicus
gagacggttcagtggt

SEQ ID NO: 503999 - DNA, 16 bp, R. norvegicus
gagactatctcaaaac

SEQ ID NO: 504000 - DNA, 16 bp, R. norvegicus
gagactattttttttt

SEQ ID NO: 504001 - DNA, 16 bp, R. norvegicus
gagactcacagccaga

SEQ ID NO: 504002 - DNA, 16 bp, R. norvegicus
gagactcaggaagtaa

SEQ ID NO: 504003 - DNA, 35 bp, R. norvegicus
gagactccaggctcagcctcagcccatgaagaaga

SEQ ID NO: 504004 - DNA, 16 bp, R. norvegicus
gagactcccagctcaa

SEQ ID NO: 504005 - DNA, 16 bp, R. norvegicus
gagactcccttgagga

SEQ ID NO: 504006 - DNA, 16 bp, R. norvegicus
gagactctcaggagac

SEQ ID NO: 504007 - DNA, 16 bp, R. norvegicus
gagactctctcttcca

SEQ ID NO: 504008 - DNA, 16 bp, R. norvegicus
gagactctgcctcaaa

SEQ ID NO: 504009 - DNA, 16 bp, R. norvegicus
gagactctgtcacaaa

SEQ ID NO: 504010 - DNA, 16 bp, R. norvegicus
gagactctgtgtgtgt

SEQ ID NO: 504011 - DNA, 16 bp, R. norvegicus
gagactcttgagctcc

SEQ ID NO: 504012 - DNA, 16 bp, R. norvegicus
gagactgaaacaggag

SEQ ID NO: 504013 - DNA, 16 bp, R. norvegicus
gagactgaactgccaa

SEQ ID NO: 504014 - DNA, 16 bp, R. norvegicus
gagactgaagaaacag

SEQ ID NO: 504015 - DNA, 16 bp, R. norvegicus
gagactgaagaaagaa

SEQ ID NO: 504016 - DNA, 16 bp, R. norvegicus
gagactgaagcaaagg

SEQ ID NO: 504017 - DNA, 16 bp, R. norvegicus
gagactgaaggaaggg

SEQ ID NO: 504018 - DNA, 16 bp, R. norvegicus
gagactgaagggatgg

SEQ ID NO: 504019 - DNA, 16 bp, R. norvegicus
gagactgagaaaatgg

SEQ ID NO: 504020 - DNA, 16 bp, R. norvegicus
gagactgagctaccaa

SEQ ID NO: 504021 - DNA, 16 bp, R. norvegicus
gagactgagctcaggt

SEQ ID NO: 504022 - DNA, 16 bp, R. norvegicus
gagactgaggaagaca

SEQ ID NO: 504023 - DNA, 16 bp, R. norvegicus
gagactgagggagaga

SEQ ID NO: 504024 - DNA, 16 bp, R. norvegicus
gagactgcagagcaga

SEQ ID NO: 504025 - DNA, 16 bp, R. norvegicus
gagactgcagagctgg

SEQ ID NO: 504026 - DNA, 16 bp, R. norvegicus
gagactgcagggcagg

SEQ ID NO: 504027 - DNA, 16 bp, R. norvegicus
gagactgcagtttctg

SEQ ID NO: 504028 - DNA, 16 bp, R. norvegicus
gagactgccagtactg

SEQ ID NO: 504029 - DNA, 16 bp, R. norvegicus
gagactgccccagcaa

SEQ ID NO: 504030 - DNA, 16 bp, R. norvegicus
gagactgctgatcctc

SEQ ID NO: 504031 - DNA, 16 bp, R. norvegicus
gagactgctgctcctc

SEQ ID NO: 504032 - DNA, 16 bp, R. norvegicus
gagactggaagagaaa

SEQ ID NO: 504033 - DNA, 16 bp, R. norvegicus
gagactggaaggatcc

SEQ ID NO: 504034 - DNA, 16 bp, R. norvegicus
gagactggagcaggag

SEQ ID NO: 504035 - DNA, 16 bp, R. norvegicus
gagactggaggaaagg

SEQ ID NO: 504036 - DNA, 16 bp, R. norvegicus
gagactggaggcccca

SEQ ID NO: 504037 - DNA, 16 bp, R. norvegicus
gagactggcagagttc

SEQ ID NO: 504038 - DNA, 16 bp, R. norvegicus
gagactgggtctcatt

SEQ ID NO: 504039 - DNA, 16 bp, R. norvegicus
gagactgtgtgcctgc

SEQ ID NO: 504040 - DNA, 16 bp, R. norvegicus
gagacttcaacatccc

SEQ ID NO: 504041 - DNA, 16 bp, R. norvegicus
gagacttgaggcccca

SEQ ID NO: 504042 - DNA, 16 bp, R. norvegicus
gagacttgctgctgaa

SEQ ID NO: 504043 - DNA, 16 bp, R. norvegicus
gagactttgaaagcca

SEQ ID NO: 504044 - DNA, 16 bp, R. norvegicus
gagactttgtctttaa

SEQ ID NO: 504045 - DNA, 16 bp, R. norvegicus
gagactttgtttcaaa

SEQ ID NO: 504046 - DNA, 16 bp, R. norvegicus
gagacttttcttaaat

SEQ ID NO: 504047 - DNA, 16 bp, R. norvegicus
gagagaaacatctgcc

SEQ ID NO: 504048 - DNA, 16 bp, R. norvegicus
gagagaaacatgaagc

SEQ ID NO: 504049 - DNA, 16 bp, R. norvegicus
gagagaaaccttacaa

SEQ ID NO: 504050 - DNA, 16 bp, R. norvegicus
gagagaaactcaggag

SEQ ID NO: 504051 - DNA, 16 bp, R. norvegicus
gagagaaactgaagca

SEQ ID NO: 504052 - DNA, 16 bp, R. norvegicus
gagagaaatacagagg

SEQ ID NO: 504053 - DNA, 16 bp, R. norvegicus
gagagaaatcctgtct

SEQ ID NO: 504054 - DNA, 16 bp, R. norvegicus
gagagaaatttgaagc

SEQ ID NO: 504055 - DNA, 16 bp, R. norvegicus
gagagaactgactcta

SEQ ID NO: 504056 - DNA, 16 bp, R. norvegicus
gagagaagaatctatt

SEQ ID NO: 504057 - DNA, 16 bp, R. norvegicus
gagagaagacacagag

SEQ ID NO: 504058 - DNA, 16 bp, R. norvegicus
gagagaagcaaagatt

SEQ ID NO: 504059 - DNA, 16 bp, R. norvegicus
gagagaagcagaggca

SEQ ID NO: 504060 - DNA, 16 bp, R. norvegicus
gagagaagcagcagag

SEQ ID NO: 504061 - DNA, 16 bp, R. norvegicus
gagagaagcaggcaga

SEQ ID NO: 504062 - DNA, 16 bp, R. norvegicus
gagagaagccctgtct

SEQ ID NO: 504063 - DNA, 16 bp, R. norvegicus
gagagaaggcaggcag

SEQ ID NO: 504064 - DNA, 16 bp, R. norvegicus
gagagaaggcagggca

SEQ ID NO: 504065 - DNA, 16 bp, R. norvegicus
gagagaatcagagaga

SEQ ID NO: 504066 - DNA, 16 bp, R. norvegicus
gagagaatcccaggag

SEQ ID NO: 504067 - DNA, 16 bp, R. norvegicus
gagagacacacagaga

SEQ ID NO: 504068 - DNA, 16 bp, R. norvegicus
gagagacacagagagg

SEQ ID NO: 504069 - DNA, 17 bp, R. norvegicus
gagagacacagcaagaa

SEQ ID NO: 504070 - DNA, 16 bp, R. norvegicus
gagagacacagccaaa

SEQ ID NO: 504071 - DNA, 16 bp, R. norvegicus
gagagacagagaaaat

SEQ ID NO: 504072 - DNA, 16 bp, R. norvegicus
gagagacagctcaggg

SEQ ID NO: 504073 - DNA, 16 bp, R. norvegicus
gagagacagctctgtg

SEQ ID NO: 504074 - DNA, 16 bp, R. norvegicus
gagagacaggacagag

SEQ ID NO: 504075 - DNA, 16 bp, R. norvegicus
gagagacaggcagagg

SEQ ID NO: 504076 - DNA, 16 bp, R. norvegicus
gagagacagttcagtg

SEQ ID NO: 504077 - DNA, 16 bp, R. norvegicus
gagagacatccagagc

SEQ ID NO: 504078 - DNA, 16 bp, R. norvegicus
gagagaccaaggattg

SEQ ID NO: 504079 - DNA, 16 bp, R. norvegicus
gagagactctaaggac

SEQ ID NO: 504080 - DNA, 16 bp, R. norvegicus
gagagactctgcctca

SEQ ID NO: 504081 - DNA, 16 bp, R. norvegicus
gagagactctgcttca

SEQ ID NO: 504082 - DNA, 16 bp, R. norvegicus
gagagactgaggaaga

SEQ ID NO: 504083 - DNA, 16 bp, R. norvegicus
gagagactgaggaagg

SEQ ID NO: 504084 - DNA, 16 bp, R. norvegicus
gagagactgggaggag

SEQ ID NO: 504085 - DNA, 16 bp, R. norvegicus
gagagagaaaatgcag

SEQ ID NO: 504086 - DNA, 16 bp, R. norvegicus
gagagagaacatgcag

SEQ ID NO: 504087 - DNA, 16 bp, R. norvegicus
gagagagaactgaaaa

SEQ ID NO: 504088 - DNA, 16 bp, R. norvegicus
gagagagaagaaattt

SEQ ID NO: 504089 - DNA, 16 bp, R. norvegicus
gagagagaagcagaca

SEQ ID NO: 504090 - DNA, 16 bp, R. norvegicus
gagagagaagccatgg

SEQ ID NO: 504091 - DNA, 16 bp, R. norvegicus
gagagagaagccgtgg

SEQ ID NO: 504092 - DNA, 16 bp, R. norvegicus
gagagagaatctcagg

SEQ ID NO: 504093 - DNA, 16 bp, R. norvegicus
gagagagaatgtgaga

SEQ ID NO: 504094 - DNA, 16 bp, R. norvegicus
gagagagacagaggtg

SEQ ID NO: 504095 - DNA, 16 bp, R. norvegicus
gagagagactcagaga

SEQ ID NO: 504096 - DNA, 16 bp, R. norvegicus
gagagagagaaaatgt

SEQ ID NO: 504097 - DNA, 16 bp, R. norvegicus
gagagagagaaagcct

SEQ ID NO: 504098 - DNA, 16 bp, R. norvegicus
gagagagagaaatcaa

SEQ ID NO: 504099 - DNA, 16 bp, R. norvegicus
gagagagagaaattgg

SEQ ID NO: 504100 - DNA, 16 bp, R. norvegicus
gagagagagaacatct

SEQ ID NO: 504101 - DNA, 16 bp, R. norvegicus
gagagagagaacctgg

SEQ ID NO: 504102 - DNA, 16 bp, R. norvegicus
gagagagagaagctgc

SEQ ID NO: 504103 - DNA, 16 bp, R. norvegicus
gagagagagaatatcc

SEQ ID NO: 504104 - DNA, 16 bp, R. norvegicus
gagagagagaatgaac

SEQ ID NO: 504105 - DNA, 16 bp, R. norvegicus
gagagagagaatgcag

SEQ ID NO: 504106 - DNA, 16 bp, R. norvegicus
gagagagagaatgcca

SEQ ID NO: 504107 - DNA, 16 bp, R. norvegicus
gagagagagaatgtta

SEQ ID NO: 504108 - DNA, 16 bp, R. norvegicus
gagagagagaattcca

SEQ ID NO: 504109 - DNA, 16 bp, R. norvegicus
gagagagagaatttca

SEQ ID NO: 504110 - DNA, 16 bp, R. norvegicus
gagagagagaccgaga

SEQ ID NO: 504111 - DNA, 16 bp, R. norvegicus
gagagagagagactga

SEQ ID NO: 504112 - DNA, 16 bp, R. norvegicus
gagagagagagacttg

SEQ ID NO: 504113 - DNA, 16 bp, R. norvegicus
gagagagagagagcac

SEQ ID NO: 504114 - DNA, 16 bp, R. norvegicus
gagagagagagagcca

SEQ ID NO: 504115 - DNA, 16 bp, R. norvegicus
gagagagagagaggct

SEQ ID NO: 504116 - DNA, 16 bp, R. norvegicus
gagagagagagcaaat

SEQ ID NO: 504117 - DNA, 16 bp, R. norvegicus
gagagagagagcactt

SEQ ID NO: 504118 - DNA, 16 bp, R. norvegicus
gagagagagagcagca

SEQ ID NO: 504119 - DNA, 16 bp, R. norvegicus
gagagagagagccttt

SEQ ID NO: 504120 - DNA, 16 bp, R. norvegicus
gagagagagagcgagc

SEQ ID NO: 504121 - DNA, 16 bp, R. norvegicus
gagagagagaggaact

SEQ ID NO: 504122 - DNA, 16 bp, R. norvegicus
gagagagagaggcatg

SEQ ID NO: 504123 - DNA, 16 bp, R. norvegicus
gagagagagaggctgt

SEQ ID NO: 504124 - DNA, 16 bp, R. norvegicus
gagagagagagtcctc

SEQ ID NO: 504125 - DNA, 16 bp, R. norvegicus
gagagagagagtgttt

SEQ ID NO: 504126 - DNA, 16 bp, R. norvegicus
gagagagagagttttg

SEQ ID NO: 504127 - DNA, 16 bp, R. norvegicus
gagagagagatctaaa

SEQ ID NO: 504128 - DNA, 16 bp, R. norvegicus
gagagagagatctgag

SEQ ID NO: 504129 - DNA, 16 bp, R. norvegicus
gagagagagatgagat

SEQ ID NO: 504130 - DNA, 16 bp, R. norvegicus
gagagagagatggcag

SEQ ID NO: 504131 - DNA, 16 bp, R. norvegicus
gagagagagatgtttg

SEQ ID NO: 504132 - DNA, 16 bp, R. norvegicus
gagagagagattgact

SEQ ID NO: 504133 - DNA, 16 bp, R. norvegicus
gagagagagcacacat

SEQ ID NO: 504134 - DNA, 16 bp, R. norvegicus
gagagagagcacatgt

SEQ ID NO: 504135 - DNA, 16 bp, R. norvegicus
gagagagagcatgcac

SEQ ID NO: 504136 - DNA, 16 bp, R. norvegicus
gagagagagccactgg

SEQ ID NO: 504137 - DNA, 16 bp, R. norvegicus
gagagagagcgagcat

SEQ ID NO: 504138 - DNA, 16 bp, R. norvegicus
gagagagagcgccaga

SEQ ID NO: 504139 - DNA, 16 bp, R. norvegicus
gagagagaggcagaca

SEQ ID NO: 504140 - DNA, 16 bp, R. norvegicus
gagagagagggagatt

SEQ ID NO: 504141 - DNA, 16 bp, R. norvegicus
gagagagcagagcaga

SEQ ID NO: 504142 - DNA, 16 bp, R. norvegicus
gagagagcagcagatg

SEQ ID NO: 504143 - DNA, 16 bp, R. norvegicus
gagagagcagccagtg

SEQ ID NO: 504144 - DNA, 16 bp, R. norvegicus
gagagagcaggctgag

SEQ ID NO: 504145 - DNA, 16 bp, R. norvegicus
gagagagcatggaggc

SEQ ID NO: 504146 - DNA, 16 bp, R. norvegicus
gagagagccaacccct

SEQ ID NO: 504147 - DNA, 16 bp, R. norvegicus
gagagagcctatctca

SEQ ID NO: 504148 - DNA, 16 bp, R. norvegicus
gagagagctcattgcc

SEQ ID NO: 504149 - DNA, 16 bp, R. norvegicus
gagagagctggtctcc

SEQ ID NO: 504150 - DNA, 16 bp, R. norvegicus
gagagaggactgaagg

SEQ ID NO: 504151 - DNA, 16 bp, R. norvegicus
gagagaggaggagtca

SEQ ID NO: 504152 - DNA, 16 bp, R. norvegicus
gagagaggcaaagact

SEQ ID NO: 504153 - DNA, 16 bp, R. norvegicus
gagagagggagagact

SEQ ID NO: 504154 - DNA, 16 bp, R. norvegicus
gagagagtgacactgg

SEQ ID NO: 504155 - DNA, 16 bp, R. norvegicus
gagagagtgagacaga

SEQ ID NO: 504156 - DNA, 16 bp, R. norvegicus
gagagagtgagagcaa

SEQ ID NO: 504157 - DNA, 16 bp, R. norvegicus
gagagagtgagagtgt

SEQ ID NO: 504158 - DNA, 16 bp, R. norvegicus
gagagagtgtgtgagt

SEQ ID NO: 504159 - DNA, 16 bp, R. norvegicus
gagagagttctacatc

SEQ ID NO: 504160 - DNA, 16 bp, R. norvegicus
gagagagttggagaaa

SEQ ID NO: 504161 - DNA, 16 bp, R. norvegicus
gagagatacagccaga

SEQ ID NO: 504162 - DNA, 16 bp, R. norvegicus
gagagatagaaacaga

SEQ ID NO: 504163 - DNA, 16 bp, R. norvegicus
gagagatggcccagag

SEQ ID NO: 504164 - DNA, 16 bp, R. norvegicus
gagagatggctcagca

SEQ ID NO: 504165 - DNA, 16 bp, R. norvegicus
gagagatggctcggag

SEQ ID NO: 504166 - DNA, 16 bp, R. norvegicus
gagagatttcagagct

SEQ ID NO: 504167 - DNA, 16 bp, R. norvegicus
gagagatttctttttt

SEQ ID NO: 504168 - DNA, 16 bp, R. norvegicus
gagagcaaagagcaag

SEQ ID NO: 504169 - DNA, 16 bp, R. norvegicus
gagagcacagaggaga

SEQ ID NO: 504170 - DNA, 16 bp, R. norvegicus
gagagcacaggagaga

SEQ ID NO: 504171 - DNA, 16 bp, R. norvegicus
gagagcacttactgct

SEQ ID NO: 504172 - DNA, 16 bp, R. norvegicus
gagagcagagcagaga

SEQ ID NO: 504173 - DNA, 16 bp, R. norvegicus
gagagcagagcagagc

SEQ ID NO: 504174 - DNA, 16 bp, R. norvegicus
gagagcagaggcccag

SEQ ID NO: 504175 - DNA, 16 bp, R. norvegicus
gagagcaggagaagtg

SEQ ID NO: 504176 - DNA, 16 bp, R. norvegicus
gagagcaggagagctg

SEQ ID NO: 504177 - DNA, 16 bp, R. norvegicus
gagagcaggccctgca

SEQ ID NO: 504178 - DNA, 16 bp, R. norvegicus
gagagcatcttcaaca

SEQ ID NO: 504179 - DNA, 16 bp, R. norvegicus
gagagcatggcagaga

SEQ ID NO: 504180 - DNA, 16 bp, R. norvegicus
gagagccaatccctga

SEQ ID NO: 504181 - DNA, 16 bp, R. norvegicus
gagagccacagagaag

SEQ ID NO: 504182 - DNA, 16 bp, R. norvegicus
gagagccacctgcttc

SEQ ID NO: 504183 - DNA, 16 bp, R. norvegicus
gagagccactgctctg

SEQ ID NO: 504184 - DNA, 16 bp, R. norvegicus
gagagcccagcccatt

SEQ ID NO: 504185 - DNA, 16 bp, R. norvegicus
gagagccctcactgcc

SEQ ID NO: 504186 - DNA, 16 bp, R. norvegicus
gagagccggatccact

SEQ ID NO: 504187 - DNA, 16 bp, R. norvegicus
gagagcctcaagggtc

SEQ ID NO: 504188 - DNA, 16 bp, R. norvegicus
gagagcgaagattccc

SEQ ID NO: 504189 - DNA, 17 bp, R. norvegicus
gagagcgagagcgagag

SEQ ID NO: 504190 - DNA, 16 bp, R. norvegicus
gagagctacatcttga

SEQ ID NO: 504191 - DNA, 16 bp, R. norvegicus
gagagctatgagtttt

SEQ ID NO: 504192 - DNA, 16 bp, R. norvegicus
gagagctcaaaagcag

SEQ ID NO: 504193 - DNA, 16 bp, R. norvegicus
gagagctcagggaaga

SEQ ID NO: 504194 - DNA, 16 bp, R. norvegicus
gagagctcataagaaa

SEQ ID NO: 504195 - DNA, 16 bp, R. norvegicus
gagagctccaggacag

SEQ ID NO: 504196 - DNA, 16 bp, R. norvegicus
gagagctctacatcca

SEQ ID NO: 504197 - DNA, 16 bp, R. norvegicus
gagagctctgaaaagg

SEQ ID NO: 504198 - DNA, 16 bp, R. norvegicus
gagagctgccaggaga

SEQ ID NO: 504199 - DNA, 16 bp, R. norvegicus
gagagctgctgcaggc

SEQ ID NO: 504200 - DNA, 16 bp, R. norvegicus
gagagctgctgcggcc

SEQ ID NO: 504201 - DNA, 16 bp, R. norvegicus
gagagctgctgtggtc

SEQ ID NO: 504202 - DNA, 16 bp, R. norvegicus
gagagctggagaaata

SEQ ID NO: 504203 - DNA, 16 bp, R. norvegicus
gagagctggatcctca

SEQ ID NO: 504204 - DNA, 16 bp, R. norvegicus
gagagctggccctacc

SEQ ID NO: 504205 - DNA, 16 bp, R. norvegicus
gagagctggccctgcc

SEQ ID NO: 504206 - DNA, 16 bp, R. norvegicus
gagagctgtacagtaa

SEQ ID NO: 504207 - DNA, 16 bp, R. norvegicus
gagagctgtgctaaga

SEQ ID NO: 504208 - DNA, 16 bp, R. norvegicus
gagagctgtgtcccag

SEQ ID NO: 504209 - DNA, 16 bp, R. norvegicus
gagagcttgccctggt

SEQ ID NO: 504210 - DNA, 16 bp, R. norvegicus
gagaggaaaggaggcc

SEQ ID NO: 504211 - DNA, 16 bp, R. norvegicus
gagaggaagaggctgg

SEQ ID NO: 504212 - DNA, 16 bp, R. norvegicus
gagaggaaggctactg

SEQ ID NO: 504213 - DNA, 16 bp, R. norvegicus
gagaggacacagacag

SEQ ID NO: 504214 - DNA, 16 bp, R. norvegicus
gagaggacccagccca

SEQ ID NO: 504215 - DNA, 16 bp, R. norvegicus
gagaggactgaaggag

SEQ ID NO: 504216 - DNA, 45 bp, R. norvegicus
gagaggacttaggcagtaccccacgagcaaacttgagccttggaa

SEQ ID NO: 504217 - DNA, 16 bp, R. norvegicus
gagaggagaaagatcc

SEQ ID NO: 504218 - DNA, 16 bp, R. norvegicus
gagaggagagaggctg

SEQ ID NO: 504219 - DNA, 16 bp, R. norvegicus
gagaggatatggaagc

SEQ ID NO: 504220 - DNA, 16 bp, R. norvegicus
gagaggatatggagac

SEQ ID NO: 504221 - DNA, 16 bp, R. norvegicus
gagaggatgcacctaa

SEQ ID NO: 504222 - DNA, 16 bp, R. norvegicus
gagaggatgggggctt

SEQ ID NO: 504223 - DNA, 16 bp, R. norvegicus
gagaggattgtgggaa

SEQ ID NO: 504224 - DNA, 22 bp, R. norvegicus
gagaggcaaagattaaaacaga

SEQ ID NO: 504225 - DNA, 16 bp, R. norvegicus
gagaggcaagagcagg

SEQ ID NO: 504226 - DNA, 16 bp, R. norvegicus
gagaggcaagtgcaag

SEQ ID NO: 504227 - DNA, 16 bp, R. norvegicus
gagaggcagaaaggca

SEQ ID NO: 504228 - DNA, 16 bp, R. norvegicus
gagaggcagaagcagg

SEQ ID NO: 504229 - DNA, 16 bp, R. norvegicus
gagaggcagacaagac

SEQ ID NO: 504230 - DNA, 16 bp, R. norvegicus
gagaggcagacacaga

SEQ ID NO: 504231 - DNA, 16 bp, R. norvegicus
gagaggcagagatgga

SEQ ID NO: 504232 - DNA, 16 bp, R. norvegicus
gagaggcagagccagg

SEQ ID NO: 504233 - DNA, 16 bp, R. norvegicus
gagaggcagaggcaag

SEQ ID NO: 504234 - DNA, 16 bp, R. norvegicus
gagaggcctctgtcca

SEQ ID NO: 504235 - DNA, 16 bp, R. norvegicus
gagaggcctttggtcc

SEQ ID NO: 504236 - DNA, 16 bp, R. norvegicus
gagaggctctgccagc

SEQ ID NO: 504237 - DNA, 16 bp, R. norvegicus
gagaggctctgtcaga

SEQ ID NO: 504238 - DNA, 16 bp, R. norvegicus
gagaggctgagaccct

SEQ ID NO: 504239 - DNA, 16 bp, R. norvegicus
gagaggctgaggaagg

SEQ ID NO: 504240 - DNA, 16 bp, R. norvegicus
gagaggctgaggagag

SEQ ID NO: 504241 - DNA, 16 bp, R. norvegicus
gagaggctgcagtcag

SEQ ID NO: 504242 - DNA, 16 bp, R. norvegicus
gagaggcttcacccag

SEQ ID NO: 504243 - DNA, 16 bp, R. norvegicus
gagaggctttgctgat

SEQ ID NO: 504244 - DNA, 16 bp, R. norvegicus
gagagggaaactgagg

SEQ ID NO: 504245 - DNA, 16 bp, R. norvegicus
gagagggaactggaag

SEQ ID NO: 504246 - DNA, 16 bp, R. norvegicus
gagagggagctggaga

SEQ ID NO: 504247 - DNA, 16 bp, R. norvegicus
gagagggcacagctgc

SEQ ID NO: 504248 - DNA, 16 bp, R. norvegicus
gagagggcatcagatc

SEQ ID NO: 504249 - DNA, 16 bp, R. norvegicus
gagagggctcagaggt

SEQ ID NO: 504250 - DNA, 16 bp, R. norvegicus
gagaggggaaccagga

SEQ ID NO: 504251 - DNA, 16 bp, R. norvegicus
gagaggggctggggat

SEQ ID NO: 504252 - DNA, 21 bp, R. norvegicus
gagagggtccagaactgcagg

SEQ ID NO: 504253 - DNA, 16 bp, R. norvegicus
gagaggtcaacaagag

SEQ ID NO: 504254 - DNA, 16 bp, R. norvegicus
gagaggtggaagcagg

SEQ ID NO: 504255 - DNA, 16 bp, R. norvegicus
gagaggtggctcagca

SEQ ID NO: 504256 - DNA, 16 bp, R. norvegicus
gagagtcaccatgtgg

SEQ ID NO: 504257 - DNA, 16 bp, R. norvegicus
gagagtcactctcaga

SEQ ID NO: 504258 - DNA, 16 bp, R. norvegicus
gagagtccctctcctc

SEQ ID NO: 504259 - DNA, 16 bp, R. norvegicus
gagagtgacagagaaa

SEQ ID NO: 504260 - DNA, 16 bp, R. norvegicus
gagagtgagggcaagc

SEQ ID NO: 504261 - DNA, 16 bp, R. norvegicus
gagagtggagcaggga

SEQ ID NO: 504262 - DNA, 16 bp, R. norvegicus
gagagtgggaagcctt

SEQ ID NO: 504263 - DNA, 16 bp, R. norvegicus
gagagtgggcaacctt

SEQ ID NO: 504264 - DNA, 16 bp, R. norvegicus
gagagtgtgtatgtga

SEQ ID NO: 504265 - DNA, 16 bp, R. norvegicus
gagagttattaaggaa

SEQ ID NO: 504266 - DNA, 16 bp, R. norvegicus
gagagttccaggccag

SEQ ID NO: 504267 - DNA, 16 bp, R. norvegicus
gagagttcttggcatc

SEQ ID NO: 504268 - DNA, 16 bp, R. norvegicus
gagagttgaaggagct

SEQ ID NO: 504269 - DNA, 16 bp, R. norvegicus
gagagttggacatatc

SEQ ID NO: 504270 - DNA, 16 bp, R. norvegicus
gagatacatctgacat

SEQ ID NO: 504271 - DNA, 16 bp, R. norvegicus
gagatagagacagagg

SEQ ID NO: 504272 - DNA, 16 bp, R. norvegicus
gagatagagatagaga

SEQ ID NO: 504273 - DNA, 16 bp, R. norvegicus
gagatagaggcaagag

SEQ ID NO: 504274 - DNA, 16 bp, R. norvegicus
gagatagaggcagaga

SEQ ID NO: 504275 - DNA, 16 bp, R. norvegicus
gagatatagatagata

SEQ ID NO: 504276 - DNA, 16 bp, R. norvegicus
gagatatctatatctg

SEQ ID NO: 504277 - DNA, 16 bp, R. norvegicus
gagatattagggacca

SEQ ID NO: 504278 - DNA, 16 bp, R. norvegicus
gagatcaacctgcttc

SEQ ID NO: 504279 - DNA, 16 bp, R. norvegicus
gagatcagaggacagt

SEQ ID NO: 504280 - DNA, 16 bp, R. norvegicus
gagatcagcctgcttc

SEQ ID NO: 504281 - DNA, 16 bp, R. norvegicus
gagatcagcctgtctc

SEQ ID NO: 504282 - DNA, 16 bp, R. norvegicus
gagatcaggaaagaga

SEQ ID NO: 504283 - DNA, 16 bp, R. norvegicus
gagatcatgagtcata

SEQ ID NO: 504284 - DNA, 16 bp, R. norvegicus
gagatccacctacttc

SEQ ID NO: 504285 - DNA, 16 bp, R. norvegicus
gagatccactgcctct

SEQ ID NO: 504286 - DNA, 16 bp, R. norvegicus
gagatccaggttcagt

SEQ ID NO: 504287 - DNA, 16 bp, R. norvegicus
gagatcctcctgcctt

SEQ ID NO: 504288 - DNA, 16 bp, R. norvegicus
gagatcctgtctcaaa

SEQ ID NO: 504289 - DNA, 16 bp, R. norvegicus
gagatcctgtttcaaa

SEQ ID NO: 504290 - DNA, 16 bp, R. norvegicus
gagatctacatcttgt

SEQ ID NO: 504291 - DNA, 16 bp, R. norvegicus
gagatctaggccagcc

SEQ ID NO: 504292 - DNA, 16 bp, R. norvegicus
gagatctcagaagatg

SEQ ID NO: 504293 - DNA, 16 bp, R. norvegicus
gagatctgctgccctc

SEQ ID NO: 504294 - DNA, 16 bp, R. norvegicus
gagatctgcttgcctc

SEQ ID NO: 504295 - DNA, 16 bp, R. norvegicus
gagatctgtccatctt

SEQ ID NO: 504296 - DNA, 16 bp, R. norvegicus
gagatcttctacaatt

SEQ ID NO: 504297 - DNA, 16 bp, R. norvegicus
gagatcttcttcaatg

SEQ ID NO: 504298 - DNA, 16 bp, R. norvegicus
gagatcttcttcgatt

SEQ ID NO: 504299 - DNA, 16 bp, R. norvegicus
gagatgactcagtggg

SEQ ID NO: 504300 - DNA, 16 bp, R. norvegicus
gagatgagaatgatgg

SEQ ID NO: 504301 - DNA, 16 bp, R. norvegicus
gagatgcatggtgagg

SEQ ID NO: 504302 - DNA, 16 bp, R. norvegicus
gagatgctctgccaga

SEQ ID NO: 504303 - DNA, 16 bp, R. norvegicus
gagatgctcttccaga

SEQ ID NO: 504304 - DNA, 16 bp, R. norvegicus
gagatgctgagaaggt

SEQ ID NO: 504305 - DNA, 16 bp, R. norvegicus
gagatgctgaggatgc

SEQ ID NO: 504306 - DNA, 16 bp, R. norvegicus
gagatgctggtgagga

SEQ ID NO: 504307 - DNA, 16 bp, R. norvegicus
gagatgctgtcttctg

SEQ ID NO: 504308 - DNA, 16 bp, R. norvegicus
gagatggaaacagaga

SEQ ID NO: 504309 - DNA, 16 bp, R. norvegicus
gagatggacagagaca

SEQ ID NO: 504310 - DNA, 16 bp, R. norvegicus
gagatggaccctcaga

SEQ ID NO: 504311 - DNA, 16 bp, R. norvegicus
gagatggagaaggatg

SEQ ID NO: 504312 - DNA, 16 bp, R. norvegicus
gagatggagacagaaa

SEQ ID NO: 504313 - DNA, 16 bp, R. norvegicus
gagatggagagacaga

SEQ ID NO: 504314 - DNA, 16 bp, R. norvegicus
gagatggagatggaga

SEQ ID NO: 504315 - DNA, 16 bp, R. norvegicus
gagatggaggcagaga

SEQ ID NO: 504316 - DNA, 16 bp, R. norvegicus
gagatggaggcaggag

SEQ ID NO: 504317 - DNA, 16 bp, R. norvegicus
gagatggaggccagcc

SEQ ID NO: 504318 - DNA, 16 bp, R. norvegicus
gagatggcccagcagg

SEQ ID NO: 504319 - DNA, 16 bp, R. norvegicus
gagatggctcagagta

SEQ ID NO: 504320 - DNA, 16 bp, R. norvegicus
gagatggctcagatgt

SEQ ID NO: 504321 - DNA, 16 bp, R. norvegicus
gagatggctcagcagt

SEQ ID NO: 504322 - DNA, 16 bp, R. norvegicus
gagatggctcagtgat

SEQ ID NO: 504323 - DNA, 16 bp, R. norvegicus
gagatggctcatctgt

SEQ ID NO: 504324 - DNA, 16 bp, R. norvegicus
gagatggctccgtggg

SEQ ID NO: 504325 - DNA, 16 bp, R. norvegicus
gagatggctctgaggg

SEQ ID NO: 504326 - DNA, 16 bp, R. norvegicus
gagatggcttctctgt

SEQ ID NO: 504327 - DNA, 16 bp, R. norvegicus
gagatggggctgggga

SEQ ID NO: 504328 - DNA, 16 bp, R. norvegicus
gagatgtataagaaag

SEQ ID NO: 504329 - DNA, 17 bp, R. norvegicus
gagatgtctgtggatga

SEQ ID NO: 504330 - DNA, 16 bp, R. norvegicus
gagatgtggatgagta

SEQ ID NO: 504331 - DNA, 27 bp, R. norvegicus
gagatgtggtgtctgccaactccacca

SEQ ID NO: 504332 - DNA, 16 bp, R. norvegicus
gagatgttaaattttt

SEQ ID NO: 504333 - DNA, 16 bp, R. norvegicus
gagatgttgagaagaa

SEQ ID NO: 504334 - DNA, 16 bp, R. norvegicus
gagattaaagacatgc

SEQ ID NO: 504335 - DNA, 16 bp, R. norvegicus
gagattaagagcactg

SEQ ID NO: 504336 - DNA, 16 bp, R. norvegicus
gagattatgactgtac

SEQ ID NO: 504337 - DNA, 16 bp, R. norvegicus
gagattccacctcaca

SEQ ID NO: 504338 - DNA, 16 bp, R. norvegicus
gagattccatttgtca

SEQ ID NO: 504339 - DNA, 16 bp, R. norvegicus
gagattcccccagaag

SEQ ID NO: 504340 - DNA, 16 bp, R. norvegicus
gagattgccctaagaa

SEQ ID NO: 504341 - DNA, 16 bp, R. norvegicus
gagattgtaagagcca

SEQ ID NO: 504342 - DNA, 16 bp, R. norvegicus
gagatttacatccagt

SEQ ID NO: 504343 - DNA, 16 bp, R. norvegicus
gagatttctctgtgta

SEQ ID NO: 504344 - DNA, 16 bp, R. norvegicus
gagcaaacaggaagtg

SEQ ID NO: 504345 - DNA, 16 bp, R. norvegicus
gagcaaactgaaaagg

SEQ ID NO: 504346 - DNA, 16 bp, R. norvegicus
gagcaaagagctgctg

SEQ ID NO: 504347 - DNA, 16 bp, R. norvegicus
gagcaacaatgccaac

SEQ ID NO: 504348 - DNA, 16 bp, R. norvegicus
gagcaacacagagaaa

SEQ ID NO: 504349 - DNA, 16 bp, R. norvegicus
gagcaactgaggaaga

SEQ ID NO: 504350 - DNA, 16 bp, R. norvegicus
gagcaacttcaggcct

SEQ ID NO: 504351 - DNA, 29 bp, R. norvegicus
gagcaagaaataccccttccagattcagc

SEQ ID NO: 504352 - DNA, 16 bp, R. norvegicus
gagcaagagagcaagg

SEQ ID NO: 504353 - DNA, 16 bp, R. norvegicus
gagcaagaggagcagg

SEQ ID NO: 504354 - DNA, 16 bp, R. norvegicus
gagcaagccaagagga

SEQ ID NO: 504355 - DNA, 16 bp, R. norvegicus
gagcaagccagggaag

SEQ ID NO: 504356 - DNA, 16 bp, R. norvegicus
gagcaaggcagcaggc

SEQ ID NO: 504357 - DNA, 16 bp, R. norvegicus
gagcaaggtcatgctg

SEQ ID NO: 504358 - DNA, 16 bp, R. norvegicus
gagcaagtaaaagaaa

SEQ ID NO: 504359 - DNA, 16 bp, R. norvegicus
gagcaagtgagagaga

SEQ ID NO: 504360 - DNA, 16 bp, R. norvegicus
gagcaattgagaaaga

SEQ ID NO: 504361 - DNA, 16 bp, R. norvegicus
gagcacaaagaagctg

SEQ ID NO: 504362 - DNA, 16 bp, R. norvegicus
gagcacaattctccca

SEQ ID NO: 504363 - DNA, 16 bp, R. norvegicus
gagcacagagacctca

SEQ ID NO: 504364 - DNA, 16 bp, R. norvegicus
gagcacagagcacaga

SEQ ID NO: 504365 - DNA, 16 bp, R. norvegicus
gagcacagaggcagag

SEQ ID NO: 504366 - DNA, 16 bp, R. norvegicus
gagcacagcagagaga

SEQ ID NO: 504367 - DNA, 16 bp, R. norvegicus
gagcacagcagtggga

SEQ ID NO: 504368 - DNA, 16 bp, R. norvegicus
gagcacatcaaaggaa

SEQ ID NO: 504369 - DNA, 16 bp, R. norvegicus
gagcaccaggcacaca

SEQ ID NO: 504370 - DNA, 16 bp, R. norvegicus
gagcaccattggaagg

SEQ ID NO: 504371 - DNA, 16 bp, R. norvegicus
gagcacctgcacaggg

SEQ ID NO: 504372 - DNA, 16 bp, R. norvegicus
gagcacctgctgttct

SEQ ID NO: 504373 - DNA, 16 bp, R. norvegicus
gagcactaaaacctca

SEQ ID NO: 504374 - DNA, 16 bp, R. norvegicus
gagcactccaagaaac

SEQ ID NO: 504375 - DNA, 16 bp, R. norvegicus
gagcactgctgttctt

SEQ ID NO: 504376 - DNA, 16 bp, R. norvegicus
gagcactggcagctct

SEQ ID NO: 504377 - DNA, 16 bp, R. norvegicus
gagcactggctcctct

SEQ ID NO: 504378 - DNA, 16 bp, R. norvegicus
gagcacttactgctct

SEQ ID NO: 504379 - DNA, 16 bp, R. norvegicus
gagcagaaacctggag

SEQ ID NO: 504380 - DNA, 16 bp, R. norvegicus
gagcagaagaaacagg

SEQ ID NO: 504381 - DNA, 16 bp, R. norvegicus
gagcagaagctgctga

SEQ ID NO: 504382 - DNA, 16 bp, R. norvegicus
gagcagacactgaagg

SEQ ID NO: 504383 - DNA, 16 bp, R. norvegicus
gagcagagacagaggg

SEQ ID NO: 504384 - DNA, 16 bp, R. norvegicus
gagcagagactcaagg

SEQ ID NO: 504385 - DNA, 16 bp, R. norvegicus
gagcagagagctgctc

SEQ ID NO: 504386 - DNA, 16 bp, R. norvegicus
gagcagagagctgtgg

SEQ ID NO: 504387 - DNA, 16 bp, R. norvegicus
gagcagagagcttctg

SEQ ID NO: 504388 - DNA, 16 bp, R. norvegicus
gagcagagatggagga

SEQ ID NO: 504389 - DNA, 16 bp, R. norvegicus
gagcagagcagagctg

SEQ ID NO: 504390 - DNA, 16 bp, R. norvegicus
gagcagagcattcctg

SEQ ID NO: 504391 - DNA, 16 bp, R. norvegicus
gagcagagcattgttc

SEQ ID NO: 504392 - DNA, 16 bp, R. norvegicus
gagcagagcctctgct

SEQ ID NO: 504393 - DNA, 16 bp, R. norvegicus
gagcagagctggagaa

SEQ ID NO: 504394 - DNA, 16 bp, R. norvegicus
gagcagaggagagcag

SEQ ID NO: 504395 - DNA, 16 bp, R. norvegicus
gagcagaggatgacag

SEQ ID NO: 504396 - DNA, 16 bp, R. norvegicus
gagcagaggcagaagg

SEQ ID NO: 504397 - DNA, 16 bp, R. norvegicus
gagcagaggcccttgg

SEQ ID NO: 504398 - DNA, 16 bp, R. norvegicus
gagcagaggctgaaga

SEQ ID NO: 504399 - DNA, 16 bp, R. norvegicus
gagcagaggtcagtag

SEQ ID NO: 504400 - DNA, 16 bp, R. norvegicus
gagcagatctctttcc

SEQ ID NO: 504401 - DNA, 17 bp, R. norvegicus
gagcagcaactgaagga

SEQ ID NO: 504402 - DNA, 16 bp, R. norvegicus
gagcagcaagcacagg

SEQ ID NO: 504403 - DNA, 16 bp, R. norvegicus
gagcagcacagggaga

SEQ ID NO: 504404 - DNA, 16 bp, R. norvegicus
gagcagcacagtggag

SEQ ID NO: 504405 - DNA, 16 bp, R. norvegicus
gagcagcagcagcaac

SEQ ID NO: 504406 - DNA, 16 bp, R. norvegicus
gagcagcagcagcaga

SEQ ID NO: 504407 - DNA, 17 bp, R. norvegicus
gagcagcagcagcagct

SEQ ID NO: 504408 - DNA, 16 bp, R. norvegicus
gagcagcagcagcagg

SEQ ID NO: 504409 - DNA, 16 bp, R. norvegicus
gagcagcagcagcagt

SEQ ID NO: 504410 - DNA, 16 bp, R. norvegicus
gagcagcagctgagag

SEQ ID NO: 504411 - DNA, 18 bp, R. norvegicus
gagcagcaggacacctgc

SEQ ID NO: 504412 - DNA, 16 bp, R. norvegicus
gagcagcaggaggaag

SEQ ID NO: 504413 - DNA, 16 bp, R. norvegicus
gagcagcaggaggagc

SEQ ID NO: 504414 - DNA, 16 bp, R. norvegicus
gagcagccagggctcc

SEQ ID NO: 504415 - DNA, 16 bp, R. norvegicus
gagcagccagtattct

SEQ ID NO: 504416 - DNA, 16 bp, R. norvegicus
gagcagccagtgctct

SEQ ID NO: 504417 - DNA, 16 bp, R. norvegicus
gagcagcccaggcaga

SEQ ID NO: 504418 - DNA, 16 bp, R. norvegicus
gagcagctcctgagca

SEQ ID NO: 504419 - DNA, 16 bp, R. norvegicus
gagcagctgcagcagc

SEQ ID NO: 504420 - DNA, 16 bp, R. norvegicus
gagcagctggaggctc

SEQ ID NO: 504421 - DNA, 16 bp, R. norvegicus
gagcagctggtgcttt

SEQ ID NO: 504422 - DNA, 16 bp, R. norvegicus
gagcaggaactcaaga

SEQ ID NO: 504423 - DNA, 16 bp, R. norvegicus
gagcaggaacttggag

SEQ ID NO: 504424 - DNA, 16 bp, R. norvegicus
gagcaggaagcagaga

SEQ ID NO: 504425 - DNA, 16 bp, R. norvegicus
gagcaggaagcagagg

SEQ ID NO: 504426 - DNA, 16 bp, R. norvegicus
gagcaggaagcaggag

SEQ ID NO: 504427 - DNA, 16 bp, R. norvegicus
gagcaggaagctaagg

SEQ ID NO: 504428 - DNA, 16 bp, R. norvegicus
gagcaggaagctgaga

SEQ ID NO: 504429 - DNA, 16 bp, R. norvegicus
gagcaggagcaaatga

SEQ ID NO: 504430 - DNA, 16 bp, R. norvegicus
gagcaggagcagcagc

SEQ ID NO: 504431 - DNA, 16 bp, R. norvegicus
gagcaggagcaggagc

SEQ ID NO: 504432 - DNA, 16 bp, R. norvegicus
gagcaggagcctggag

SEQ ID NO: 504433 - DNA, 16 bp, R. norvegicus
gagcaggagctgagag

SEQ ID NO: 504434 - DNA, 16 bp, R. norvegicus
gagcaggaggaacagg

SEQ ID NO: 504435 - DNA, 16 bp, R. norvegicus
gagcaggaggaagcag

SEQ ID NO: 504436 - DNA, 16 bp, R. norvegicus
gagcaggagtcacaga

SEQ ID NO: 504437 - DNA, 16 bp, R. norvegicus
gagcaggccttccagg

SEQ ID NO: 504438 - DNA, 16 bp, R. norvegicus
gagcaggctggcctcc

SEQ ID NO: 504439 - DNA, 16 bp, R. norvegicus
gagcaggtggtcctgg

SEQ ID NO: 504440 - DNA, 16 bp, R. norvegicus
gagcagtactccattg

SEQ ID NO: 504441 - DNA, 16 bp, R. norvegicus
gagcagtatgtactct

SEQ ID NO: 504442 - DNA, 16 bp, R. norvegicus
gagcagtcagtcagtg

SEQ ID NO: 504443 - DNA, 16 bp, R. norvegicus
gagcagtcagtgctct

SEQ ID NO: 504444 - DNA, 16 bp, R. norvegicus
gagcagtcttctctgg

SEQ ID NO: 504445 - DNA, 16 bp, R. norvegicus
gagcataagccatttt

SEQ ID NO: 504446 - DNA, 16 bp, R. norvegicus
gagcatatattagcag

SEQ ID NO: 504447 - DNA, 16 bp, R. norvegicus
gagcatctcctgcttc

SEQ ID NO: 504448 - DNA, 16 bp, R. norvegicus
gagcatcttcatggaa

SEQ ID NO: 504449 - DNA, 16 bp, R. norvegicus
gagcatgaccttgaac

SEQ ID NO: 504450 - DNA, 16 bp, R. norvegicus
gagcatggagagagca

SEQ ID NO: 504451 - DNA, 16 bp, R. norvegicus
gagcatggcagtgtct

SEQ ID NO: 504452 - DNA, 16 bp, R. norvegicus
gagcatgggagacctc

SEQ ID NO: 504453 - DNA, 16 bp, R. norvegicus
gagcatgtggagaaag

SEQ ID NO: 504454 - DNA, 16 bp, R. norvegicus
gagcatttcatgggag

SEQ ID NO: 504455 - DNA, 16 bp, R. norvegicus
gagcattttctgctct

SEQ ID NO: 504456 - DNA, 16 bp, R. norvegicus
gagcattttcttggtt

SEQ ID NO: 504457 - DNA, 16 bp, R. norvegicus
gagccaaatcacccta

SEQ ID NO: 504458 - DNA, 16 bp, R. norvegicus
gagccaaatggaatta

SEQ ID NO: 504459 - DNA, 16 bp, R. norvegicus
gagccacaccccagct

SEQ ID NO: 504460 - DNA, 16 bp, R. norvegicus
gagccaccatgggggt

SEQ ID NO: 504461 - DNA, 16 bp, R. norvegicus
gagccactgggcctgg

SEQ ID NO: 504462 - DNA, 16 bp, R. norvegicus
gagccagaagagggtg

SEQ ID NO: 504463 - DNA, 16 bp, R. norvegicus
gagccagagaatgaaa

SEQ ID NO: 504464 - DNA, 16 bp, R. norvegicus
gagccagaggaccagg

SEQ ID NO: 504465 - DNA, 16 bp, R. norvegicus
gagccagaggctgggg

SEQ ID NO: 504466 - DNA, 16 bp, R. norvegicus
gagccagaggtaggag

SEQ ID NO: 504467 - DNA, 16 bp, R. norvegicus
gagccagaggtgatgg

SEQ ID NO: 504468 - DNA, 16 bp, R. norvegicus
gagccagccagtaagc

SEQ ID NO: 504469 - DNA, 16 bp, R. norvegicus
gagccagctccccagc

SEQ ID NO: 504470 - DNA, 16 bp, R. norvegicus
gagccaggcatggtgg

SEQ ID NO: 504471 - DNA, 16 bp, R. norvegicus
gagccaggcttggtgg

SEQ ID NO: 504472 - DNA, 16 bp, R. norvegicus
gagccagggatgtggg

SEQ ID NO: 504473 - DNA, 16 bp, R. norvegicus
gagccaggtggagaga

SEQ ID NO: 504474 - DNA, 16 bp, R. norvegicus
gagccagttcaagcca

SEQ ID NO: 504475 - DNA, 16 bp, R. norvegicus
gagccatctctacaga

SEQ ID NO: 504476 - DNA, 16 bp, R. norvegicus
gagccatctctcaaac

SEQ ID NO: 504477 - DNA, 16 bp, R. norvegicus
gagccatctctctggc

SEQ ID NO: 504478 - DNA, 16 bp, R. norvegicus
gagccatctcttagcc

SEQ ID NO: 504479 - DNA, 16 bp, R. norvegicus
gagccatctcttctgc

SEQ ID NO: 504480 - DNA, 16 bp, R. norvegicus
gagccatcttgctgcc

SEQ ID NO: 504481 - DNA, 16 bp, R. norvegicus
gagccatcttgctggt

SEQ ID NO: 504482 - DNA, 16 bp, R. norvegicus
gagccatgggtgcctc

SEQ ID NO: 504483 - DNA, 16 bp, R. norvegicus
gagcccaaggccctgg

SEQ ID NO: 504484 - DNA, 16 bp, R. norvegicus
gagcccaagtctccca

SEQ ID NO: 504485 - DNA, 16 bp, R. norvegicus
gagcccaattccccca

SEQ ID NO: 504486 - DNA, 16 bp, R. norvegicus
gagcccacccccacag

SEQ ID NO: 504487 - DNA, 16 bp, R. norvegicus
gagcccagcataactg

SEQ ID NO: 504488 - DNA, 16 bp, R. norvegicus
gagcccagcctggtct

SEQ ID NO: 504489 - DNA, 16 bp, R. norvegicus
gagccccaacctcact

SEQ ID NO: 504490 - DNA, 16 bp, R. norvegicus
gagccccagccccagc

SEQ ID NO: 504491 - DNA, 16 bp, R. norvegicus
gagccccttccagctc

SEQ ID NO: 504492 - DNA, 16 bp, R. norvegicus
gagcccgagggcagca

SEQ ID NO: 504493 - DNA, 39 bp, R. norvegicus
gagccctagctggactcttgctgctggtctccctagtga

SEQ ID NO: 504494 - DNA, 39 bp, R. norvegicus
gagccggagccggagccggagccggagccggagccggag

SEQ ID NO: 504495 - DNA, 16 bp, R. norvegicus
gagcctaaaaatgagg

SEQ ID NO: 504496 - DNA, 16 bp, R. norvegicus
gagcctatgagaggct

SEQ ID NO: 504497 - DNA, 16 bp, R. norvegicus
gagcctatggggccat

SEQ ID NO: 504498 - DNA, 16 bp, R. norvegicus
gagcctatgggggaca

SEQ ID NO: 504499 - DNA, 16 bp, R. norvegicus
gagcctcctgtctctg

SEQ ID NO: 504500 - DNA, 16 bp, R. norvegicus
gagcctctcagaaaac

SEQ ID NO: 504501 - DNA, 16 bp, R. norvegicus
gagcctctgctccagt

SEQ ID NO: 504502 - DNA, 16 bp, R. norvegicus
gagcctcttcctggct

SEQ ID NO: 504503 - DNA, 16 bp, R. norvegicus
gagcctgaagaggcca

SEQ ID NO: 504504 - DNA, 16 bp, R. norvegicus
gagcctgaagcaggag

SEQ ID NO: 504505 - DNA, 16 bp, R. norvegicus
gagcctgacccacctg

SEQ ID NO: 504506 - DNA, 16 bp, R. norvegicus
gagcctgactgaagag

SEQ ID NO: 504507 - DNA, 16 bp, R. norvegicus
gagcctgaggcagggg

SEQ ID NO: 504508 - DNA, 16 bp, R. norvegicus
gagcctgatcaataca

SEQ ID NO: 504509 - DNA, 16 bp, R. norvegicus
gagcctgccaccctga

SEQ ID NO: 504510 - DNA, 16 bp, R. norvegicus
gagcctgcctcacctg

SEQ ID NO: 504511 - DNA, 16 bp, R. norvegicus
gagcctggagctcacc

SEQ ID NO: 504512 - DNA, 16 bp, R. norvegicus
gagcctggaggcccca

SEQ ID NO: 504513 - DNA, 16 bp, R. norvegicus
gagcctgggtcttctg

SEQ ID NO: 504514 - DNA, 16 bp, R. norvegicus
gagcctgtccctcctg

SEQ ID NO: 504515 - DNA, 16 bp, R. norvegicus
gagcctgtccttcctg

SEQ ID NO: 504516 - DNA, 16 bp, R. norvegicus
gagcctgtgagcctat

SEQ ID NO: 504517 - DNA, 16 bp, R. norvegicus
gagcctgtgagggaca

SEQ ID NO: 504518 - DNA, 16 bp, R. norvegicus
gagcctgtgcctgtgc

SEQ ID NO: 504519 - DNA, 16 bp, R. norvegicus
gagcctgtgtccttgt

SEQ ID NO: 504520 - DNA, 16 bp, R. norvegicus
gagccttcagatgaag

SEQ ID NO: 504521 - DNA, 16 bp, R. norvegicus
gagccttggaacctca

SEQ ID NO: 504522 - DNA, 16 bp, R. norvegicus
gagcgagagagagagc

SEQ ID NO: 504523 - DNA, 16 bp, R. norvegicus
gagcgagagcgagagc

SEQ ID NO: 504524 - DNA, 16 bp, R. norvegicus
gagcgagcgagcgagc

SEQ ID NO: 504525 - DNA, 16 bp, R. norvegicus
gagcgatctctccagc

SEQ ID NO: 504526 - DNA, 16 bp, R. norvegicus
gagcgatggctcagag

SEQ ID NO: 504527 - DNA, 16 bp, R. norvegicus
gagcgtctgcctctgt

SEQ ID NO: 504528 - DNA, 16 bp, R. norvegicus
gagctaaacaaagaag

SEQ ID NO: 504529 - DNA, 16 bp, R. norvegicus
gagctaaatacccaac

SEQ ID NO: 504530 - DNA, 16 bp, R. norvegicus
gagctacaatccagaa

SEQ ID NO: 504531 - DNA, 16 bp, R. norvegicus
gagctacagagtgaga

SEQ ID NO: 504532 - DNA, 16 bp, R. norvegicus
gagctacagatgcaag

SEQ ID NO: 504533 - DNA, 26 bp, R. norvegicus
gagctagggaccgaacccagggcctt

SEQ ID NO: 504534 - DNA, 16 bp, R. norvegicus
gagctataataataaa

SEQ ID NO: 504535 - DNA, 16 bp, R. norvegicus
gagctatatccccaac

SEQ ID NO: 504536 - DNA, 16 bp, R. norvegicus
gagctatctctgcagc

SEQ ID NO: 504537 - DNA, 16 bp, R. norvegicus
gagctcaaggccaacc

SEQ ID NO: 504538 - DNA, 16 bp, R. norvegicus
gagctcacagacactg

SEQ ID NO: 504539 - DNA, 16 bp, R. norvegicus
gagctcacagagacta

SEQ ID NO: 504540 - DNA, 16 bp, R. norvegicus
gagctcaccgccaaga

SEQ ID NO: 504541 - DNA, 16 bp, R. norvegicus
gagctcactcaggatg

SEQ ID NO: 504542 - DNA, 16 bp, R. norvegicus
gagctcactctgcaga

SEQ ID NO: 504543 - DNA, 16 bp, R. norvegicus
gagctcagagctcaga

SEQ ID NO: 504544 - DNA, 18 bp, R. norvegicus
gagctcagagctccgagg

SEQ ID NO: 504545 - DNA, 16 bp, R. norvegicus
gagctcagtggtagag

SEQ ID NO: 504546 - DNA, 16 bp, R. norvegicus
gagctcataaacaaca

SEQ ID NO: 504547 - DNA, 16 bp, R. norvegicus
gagctccagcttcagt

SEQ ID NO: 504548 - DNA, 16 bp, R. norvegicus
gagctccaggatagcc

SEQ ID NO: 504549 - DNA, 16 bp, R. norvegicus
gagctccaggccaatg

SEQ ID NO: 504550 - DNA, 16 bp, R. norvegicus
gagctccaggccagca

SEQ ID NO: 504551 - DNA, 16 bp, R. norvegicus
gagctccaggccagcc

SEQ ID NO: 504552 - DNA, 16 bp, R. norvegicus
gagctccaggctagcc

SEQ ID NO: 504553 - DNA, 16 bp, R. norvegicus
gagctccatctaatgt

SEQ ID NO: 504554 - DNA, 18 bp, R. norvegicus
gagctcctactggtcact

SEQ ID NO: 504555 - DNA, 16 bp, R. norvegicus
gagctcctggagactg

SEQ ID NO: 504556 - DNA, 16 bp, R. norvegicus
gagctcgtcagctcct

SEQ ID NO: 504557 - DNA, 16 bp, R. norvegicus
gagctctcagacactg

SEQ ID NO: 504558 - DNA, 16 bp, R. norvegicus
gagctctcagttcctc

SEQ ID NO: 504559 - DNA, 16 bp, R. norvegicus
gagctctctctcccag

SEQ ID NO: 504560 - DNA, 16 bp, R. norvegicus
gagctctctctccctc

SEQ ID NO: 504561 - DNA, 16 bp, R. norvegicus
gagctctctgcagcgg

SEQ ID NO: 504562 - DNA, 16 bp, R. norvegicus
gagctctgtagaccag

SEQ ID NO: 504563 - DNA, 16 bp, R. norvegicus
gagctctgtgagttca

SEQ ID NO: 504564 - DNA, 16 bp, R. norvegicus
gagctctgtgagtttg

SEQ ID NO: 504565 - DNA, 16 bp, R. norvegicus
gagctctgtggggtct

SEQ ID NO: 504566 - DNA, 16 bp, R. norvegicus
gagctctgtgtgccct

SEQ ID NO: 504567 - DNA, 17 bp, R. norvegicus
gagctcttccagttctt

SEQ ID NO: 504568 - DNA, 16 bp, R. norvegicus
gagctctttcccatag

SEQ ID NO: 504569 - DNA, 16 bp, R. norvegicus
gagctgaaagccagtt

SEQ ID NO: 504570 - DNA, 16 bp, R. norvegicus
gagctgaacaagaaca

SEQ ID NO: 504571 - DNA, 16 bp, R. norvegicus
gagctgaacacccagg

SEQ ID NO: 504572 - DNA, 16 bp, R. norvegicus
gagctgaaccctcaga

SEQ ID NO: 504573 - DNA, 16 bp, R. norvegicus
gagctgaagcagaggc

SEQ ID NO: 504574 - DNA, 16 bp, R. norvegicus
gagctgaagcaggagg

SEQ ID NO: 504575 - DNA, 16 bp, R. norvegicus
gagctgaaggagatgg

SEQ ID NO: 504576 - DNA, 16 bp, R. norvegicus
gagctgaaggagctga

SEQ ID NO: 504577 - DNA, 18 bp, R. norvegicus
gagctgaaggagctgaag

SEQ ID NO: 504578 - DNA, 16 bp, R. norvegicus
gagctgaaggggcttc

SEQ ID NO: 504579 - DNA, 16 bp, R. norvegicus
gagctgagaagaaagt

SEQ ID NO: 504580 - DNA, 20 bp, R. norvegicus
gagctgaggaccaaacccag

SEQ ID NO: 504581 - DNA, 16 bp, R. norvegicus
gagctgaggagaaggt

SEQ ID NO: 504582 - DNA, 16 bp, R. norvegicus
gagctgaggcaggagg

SEQ ID NO: 504583 - DNA, 16 bp, R. norvegicus
gagctgagggggattg

SEQ ID NO: 504584 - DNA, 16 bp, R. norvegicus
gagctgatgcagagga

SEQ ID NO: 504585 - DNA, 16 bp, R. norvegicus
gagctgcagaagaaaa

SEQ ID NO: 504586 - DNA, 16 bp, R. norvegicus
gagctgcagccccagc

SEQ ID NO: 504587 - DNA, 16 bp, R. norvegicus
gagctgcattcccagc

SEQ ID NO: 504588 - DNA, 16 bp, R. norvegicus
gagctgcatttgtcag

SEQ ID NO: 504589 - DNA, 16 bp, R. norvegicus
gagctgcccagcatgg

SEQ ID NO: 504590 - DNA, 16 bp, R. norvegicus
gagctgcccctgcccc

SEQ ID NO: 504591 - DNA, 16 bp, R. norvegicus
gagctgcctgaggatc

SEQ ID NO: 504592 - DNA, 16 bp, R. norvegicus
gagctgcctgcctctg

SEQ ID NO: 504593 - DNA, 16 bp, R. norvegicus
gagctgcctgctgtgg

SEQ ID NO: 504594 - DNA, 16 bp, R. norvegicus
gagctgccttggtcac

SEQ ID NO: 504595 - DNA, 16 bp, R. norvegicus
gagctgctgcaggcag

SEQ ID NO: 504596 - DNA, 16 bp, R. norvegicus
gagctgctgcaggctg

SEQ ID NO: 504597 - DNA, 16 bp, R. norvegicus
gagctgctgctgctgg

SEQ ID NO: 504598 - DNA, 16 bp, R. norvegicus
gagctgctgctggccg

SEQ ID NO: 504599 - DNA, 16 bp, R. norvegicus
gagctggaaaacagaa

SEQ ID NO: 504600 - DNA, 16 bp, R. norvegicus
gagctggacagatatc

SEQ ID NO: 504601 - DNA, 16 bp, R. norvegicus
gagctggacatggtgg

SEQ ID NO: 504602 - DNA, 16 bp, R. norvegicus
gagctggagaagtggc

SEQ ID NO: 504603 - DNA, 16 bp, R. norvegicus
gagctggagaagttta

SEQ ID NO: 504604 - DNA, 16 bp, R. norvegicus
gagctggagaccagcc

SEQ ID NO: 504605 - DNA, 16 bp, R. norvegicus
gagctggagacttgaa

SEQ ID NO: 504606 - DNA, 16 bp, R. norvegicus
gagctggagagacagc

SEQ ID NO: 504607 - DNA, 16 bp, R. norvegicus
gagctggagcgatggc

SEQ ID NO: 504608 - DNA, 16 bp, R. norvegicus
gagctggaggaagctg

SEQ ID NO: 504609 - DNA, 16 bp, R. norvegicus
gagctggaggccagcc

SEQ ID NO: 504610 - DNA, 16 bp, R. norvegicus
gagctggagttacaaa

SEQ ID NO: 504611 - DNA, 16 bp, R. norvegicus
gagctggagttagaag

SEQ ID NO: 504612 - DNA, 16 bp, R. norvegicus
gagctggagttccagg

SEQ ID NO: 504613 - DNA, 16 bp, R. norvegicus
gagctggatgattgcc

SEQ ID NO: 504614 - DNA, 16 bp, R. norvegicus
gagctggatgtggtgg

SEQ ID NO: 504615 - DNA, 16 bp, R. norvegicus
gagctggcaagatggc

SEQ ID NO: 504616 - DNA, 16 bp, R. norvegicus
gagctggccccagggt

SEQ ID NO: 504617 - DNA, 16 bp, R. norvegicus
gagctggccctgaggg

SEQ ID NO: 504618 - DNA, 16 bp, R. norvegicus
gagctggccctgcccc

SEQ ID NO: 504619 - DNA, 16 bp, R. norvegicus
gagctggccctgctgg

SEQ ID NO: 504620 - DNA, 27 bp, R. norvegicus
gagctgggaaccgaacccagggccttg

SEQ ID NO: 504621 - DNA, 16 bp, R. norvegicus
gagctgggattacaag

SEQ ID NO: 504622 - DNA, 16 bp, R. norvegicus
gagctgggccctcccc

SEQ ID NO: 504623 - DNA, 16 bp, R. norvegicus
gagctgggcctggtgg

SEQ ID NO: 504624 - DNA, 16 bp, R. norvegicus
gagctggggaaatggc

SEQ ID NO: 504625 - DNA, 16 bp, R. norvegicus
gagctggggacagaac

SEQ ID NO: 504626 - DNA, 27 bp, R. norvegicus
gagctggggaccaaacccagggccttg

SEQ ID NO: 504627 - DNA, 21 bp, R. norvegicus
gagctggggaccgaacccagc

SEQ ID NO: 504628 - DNA, 26 bp, R. norvegicus
gagctggggaccgaacccagggcctc

SEQ ID NO: 504629 - DNA, 27 bp, R. norvegicus
gagctggggaccgaacccagggccttg

SEQ ID NO: 504630 - DNA, 20 bp, R. norvegicus
gagctggggactgaacccag

SEQ ID NO: 504631 - DNA, 27 bp, R. norvegicus
gagctggggactgaacccagggccttg

SEQ ID NO: 504632 - DNA, 16 bp, R. norvegicus
gagctggggactgagc

SEQ ID NO: 504633 - DNA, 16 bp, R. norvegicus
gagctggggctgtccc

SEQ ID NO: 504634 - DNA, 16 bp, R. norvegicus
gagctggtgcctacct

SEQ ID NO: 504635 - DNA, 16 bp, R. norvegicus
gagctgtccagccggc

SEQ ID NO: 504636 - DNA, 16 bp, R. norvegicus
gagctgtctctccagc

SEQ ID NO: 504637 - DNA, 16 bp, R. norvegicus
gagctgtgggccagga

SEQ ID NO: 504638 - DNA, 16 bp, R. norvegicus
gagctgtggtgatgac

SEQ ID NO: 504639 - DNA, 16 bp, R. norvegicus
gagctgtgtggatgtt

SEQ ID NO: 504640 - DNA, 16 bp, R. norvegicus
gagctgtttcttttct

SEQ ID NO: 504641 - DNA, 16 bp, R. norvegicus
gagcttcagggatctg

SEQ ID NO: 504642 - DNA, 16 bp, R. norvegicus
gagcttcagtacacca

SEQ ID NO: 504643 - DNA, 16 bp, R. norvegicus
gagcttcatctgagcc

SEQ ID NO: 504644 - DNA, 16 bp, R. norvegicus
gagcttccccagtgga

SEQ ID NO: 504645 - DNA, 16 bp, R. norvegicus
gagcttcccttgagga

SEQ ID NO: 504646 - DNA, 16 bp, R. norvegicus
gagcttcctgtggtgg

SEQ ID NO: 504647 - DNA, 16 bp, R. norvegicus
gagcttctggggaagg

SEQ ID NO: 504648 - DNA, 16 bp, R. norvegicus
gagcttctggtggtga

SEQ ID NO: 504649 - DNA, 16 bp, R. norvegicus
gagcttgaaggagctg

SEQ ID NO: 504650 - DNA, 16 bp, R. norvegicus
gagcttgccctggtgg

SEQ ID NO: 504651 - DNA, 16 bp, R. norvegicus
gagcttgctgacagga

SEQ ID NO: 504652 - DNA, 16 bp, R. norvegicus
gagctttccatcttct

SEQ ID NO: 504653 - DNA, 16 bp, R. norvegicus
gagcttttggggctgc

SEQ ID NO: 504654 - DNA, 17 bp, R. norvegicus
gagctttttgaagatct

SEQ ID NO: 504655 - DNA, 16 bp, R. norvegicus
gaggaaaaactgggaa

SEQ ID NO: 504656 - DNA, 16 bp, R. norvegicus
gaggaaaagaaggtct

SEQ ID NO: 504657 - DNA, 16 bp, R. norvegicus
gaggaaaagccctttg

SEQ ID NO: 504658 - DNA, 16 bp, R. norvegicus
gaggaaaaggaagtcc

SEQ ID NO: 504659 - DNA, 16 bp, R. norvegicus
gaggaaaaggtttctt

SEQ ID NO: 504660 - DNA, 16 bp, R. norvegicus
gaggaaaataccaaag

SEQ ID NO: 504661 - DNA, 16 bp, R. norvegicus
gaggaaaatgaaagca

SEQ ID NO: 504662 - DNA, 16 bp, R. norvegicus
gaggaaaatgctagca

SEQ ID NO: 504663 - DNA, 16 bp, R. norvegicus
gaggaaaattggtctg

SEQ ID NO: 504664 - DNA, 16 bp, R. norvegicus
gaggaaacacaagaat

SEQ ID NO: 504665 - DNA, 16 bp, R. norvegicus
gaggaaacacacaaac

SEQ ID NO: 504666 - DNA, 16 bp, R. norvegicus
gaggaaaccaggaaag

SEQ ID NO: 504667 - DNA, 16 bp, R. norvegicus
gaggaaagcaggagtg

SEQ ID NO: 504668 - DNA, 16 bp, R. norvegicus
gaggaaagcaggtcta

SEQ ID NO: 504669 - DNA, 16 bp, R. norvegicus
gaggaaatccagagaa

SEQ ID NO: 504670 - DNA, 16 bp, R. norvegicus
gaggaaatgtctccat

SEQ ID NO: 504671 - DNA, 16 bp, R. norvegicus
gaggaaattcaagaaa

SEQ ID NO: 504672 - DNA, 16 bp, R. norvegicus
gaggaaattccaaaaa

SEQ ID NO: 504673 - DNA, 16 bp, R. norvegicus
gaggaaattcttttct

SEQ ID NO: 504674 - DNA, 16 bp, R. norvegicus
gaggaacaagccgaga

SEQ ID NO: 504675 - DNA, 16 bp, R. norvegicus
gaggaacactgctcac

SEQ ID NO: 504676 - DNA, 19 bp, R. norvegicus
gaggaactatctgaaaagg

SEQ ID NO: 504677 - DNA, 16 bp, R. norvegicus
gaggaactgaactcag

SEQ ID NO: 504678 - DNA, 16 bp, R. norvegicus
gaggaactgagaggag

SEQ ID NO: 504679 - DNA, 16 bp, R. norvegicus
gaggaactgggaggaa

SEQ ID NO: 504680 - DNA, 16 bp, R. norvegicus
gaggaactgtatttaa

SEQ ID NO: 504681 - DNA, 16 bp, R. norvegicus
gaggaactgtgggaag

SEQ ID NO: 504682 - DNA, 16 bp, R. norvegicus
gaggaacttccaaatt

SEQ ID NO: 504683 - DNA, 16 bp, R. norvegicus
gaggaagaactggaag

SEQ ID NO: 504684 - DNA, 16 bp, R. norvegicus
gaggaagaagcagcag

SEQ ID NO: 504685 - DNA, 16 bp, R. norvegicus
gaggaagacagagaca

SEQ ID NO: 504686 - DNA, 16 bp, R. norvegicus
gaggaagagctgagag

SEQ ID NO: 504687 - DNA, 39 bp, R. norvegicus
gaggaagaggaacactcctccattgttggtgggattgca

SEQ ID NO: 504688 - DNA, 16 bp, R. norvegicus
gaggaagatgaagatg

SEQ ID NO: 504689 - DNA, 16 bp, R. norvegicus
gaggaagatggaggat

SEQ ID NO: 504690 - DNA, 16 bp, R. norvegicus
gaggaagcagcaagaa

SEQ ID NO: 504691 - DNA, 16 bp, R. norvegicus
gaggaagccaaggcag

SEQ ID NO: 504692 - DNA, 16 bp, R. norvegicus
gaggaagccaggacag

SEQ ID NO: 504693 - DNA, 16 bp, R. norvegicus
gaggaagccctgagtg

SEQ ID NO: 504694 - DNA, 16 bp, R. norvegicus
gaggaagcttctttga

SEQ ID NO: 504695 - DNA, 16 bp, R. norvegicus
gaggaaggactgggag

SEQ ID NO: 504696 - DNA, 16 bp, R. norvegicus
gaggaaggactgtggg

SEQ ID NO: 504697 - DNA, 16 bp, R. norvegicus
gaggaaggagaaactg

SEQ ID NO: 504698 - DNA, 16 bp, R. norvegicus
gaggaaggagaagctg

SEQ ID NO: 504699 - DNA, 16 bp, R. norvegicus
gaggaaggagatgggc

SEQ ID NO: 504700 - DNA, 16 bp, R. norvegicus
gaggaaggagcctcag

SEQ ID NO: 504701 - DNA, 16 bp, R. norvegicus
gaggaaggagctgatg

SEQ ID NO: 504702 - DNA, 16 bp, R. norvegicus
gaggaaggcagagtgg

SEQ ID NO: 504703 - DNA, 16 bp, R. norvegicus
gaggaaggtgaccctg

SEQ ID NO: 504704 - DNA, 16 bp, R. norvegicus
gaggaagtacatcact

SEQ ID NO: 504705 - DNA, 16 bp, R. norvegicus
gaggaagtttctctga

SEQ ID NO: 504706 - DNA, 16 bp, R. norvegicus
gaggaatctcaaatgg

SEQ ID NO: 504707 - DNA, 16 bp, R. norvegicus
gaggaatcttgcatgg

SEQ ID NO: 504708 - DNA, 16 bp, R. norvegicus
gaggaatggcagaaag

SEQ ID NO: 504709 - DNA, 16 bp, R. norvegicus
gaggaatgtggaagag

SEQ ID NO: 504710 - DNA, 16 bp, R. norvegicus
gaggaattctgaatgg

SEQ ID NO: 504711 - DNA, 17 bp, R. norvegicus
gaggacaaacaactgtg

SEQ ID NO: 504712 - DNA, 16 bp, R. norvegicus
gaggacaacctcagct

SEQ ID NO: 504713 - DNA, 16 bp, R. norvegicus
gaggacaacctgtggg

SEQ ID NO: 504714 - DNA, 16 bp, R. norvegicus
gaggacaacttgaaga

SEQ ID NO: 504715 - DNA, 16 bp, R. norvegicus
gaggacaacttgagag

SEQ ID NO: 504716 - DNA, 16 bp, R. norvegicus
gaggacaactttgggg

SEQ ID NO: 504717 - DNA, 16 bp, R. norvegicus
gaggacacagacagtg

SEQ ID NO: 504718 - DNA, 16 bp, R. norvegicus
gaggacacagagactg

SEQ ID NO: 504719 - DNA, 16 bp, R. norvegicus
gaggacaccctggagt

SEQ ID NO: 504720 - DNA, 16 bp, R. norvegicus
gaggacagagcaagag

SEQ ID NO: 504721 - DNA, 16 bp, R. norvegicus
gaggacagcaacagtg

SEQ ID NO: 504722 - DNA, 16 bp, R. norvegicus
gaggacagccttggct

SEQ ID NO: 504723 - DNA, 16 bp, R. norvegicus
gaggacaggaggacag

SEQ ID NO: 504724 - DNA, 16 bp, R. norvegicus
gaggacagtgtgtgaa

SEQ ID NO: 504725 - DNA, 16 bp, R. norvegicus
gaggacatcaagaaag

SEQ ID NO: 504726 - DNA, 16 bp, R. norvegicus
gaggaccagagtttgg

SEQ ID NO: 504727 - DNA, 16 bp, R. norvegicus
gaggaccagtggaagg

SEQ ID NO: 504728 - DNA, 16 bp, R. norvegicus
gaggacccaggagcag

SEQ ID NO: 504729 - DNA, 16 bp, R. norvegicus
gaggaccccctggctg

SEQ ID NO: 504730 - DNA, 16 bp, R. norvegicus
gaggaccctgttctca

SEQ ID NO: 504731 - DNA, 16 bp, R. norvegicus
gaggaccgagcccagg

SEQ ID NO: 504732 - DNA, 16 bp, R. norvegicus
gaggacctaacccagg

SEQ ID NO: 504733 - DNA, 16 bp, R. norvegicus
gaggacctcagtttga

SEQ ID NO: 504734 - DNA, 16 bp, R. norvegicus
gaggacctgagattga

SEQ ID NO: 504735 - DNA, 16 bp, R. norvegicus
gaggacctgagctcag

SEQ ID NO: 504736 - DNA, 16 bp, R. norvegicus
gaggacctgagttcca

SEQ ID NO: 504737 - DNA, 16 bp, R. norvegicus
gaggacctgatgcaga

SEQ ID NO: 504738 - DNA, 16 bp, R. norvegicus
gaggacctgcattctg

SEQ ID NO: 504739 - DNA, 16 bp, R. norvegicus
gaggacctggagaagg

SEQ ID NO: 504740 - DNA, 16 bp, R. norvegicus
gaggacctgggagaag

SEQ ID NO: 504741 - DNA, 16 bp, R. norvegicus
gaggacctgggttcac

SEQ ID NO: 504742 - DNA, 16 bp, R. norvegicus
gaggacctgggttcca

SEQ ID NO: 504743 - DNA, 16 bp, R. norvegicus
gaggactaggaggagg

SEQ ID NO: 504744 - DNA, 16 bp, R. norvegicus
gaggactcagagagtg

SEQ ID NO: 504745 - DNA, 16 bp, R. norvegicus
gaggactcaggtttga

SEQ ID NO: 504746 - DNA, 16 bp, R. norvegicus
gaggactcttcaggcc

SEQ ID NO: 504747 - DNA, 16 bp, R. norvegicus
gaggactgaagaggct

SEQ ID NO: 504748 - DNA, 16 bp, R. norvegicus
gaggactggagaaatg

SEQ ID NO: 504749 - DNA, 16 bp, R. norvegicus
gaggactggctgctct

SEQ ID NO: 504750 - DNA, 16 bp, R. norvegicus
gaggacttaagttcaa

SEQ ID NO: 504751 - DNA, 16 bp, R. norvegicus
gaggacttgcgtgccc

SEQ ID NO: 504752 - DNA, 16 bp, R. norvegicus
gaggactttgagaagg

SEQ ID NO: 504753 - DNA, 16 bp, R. norvegicus
gaggagaaaccctttg

SEQ ID NO: 504754 - DNA, 16 bp, R. norvegicus
gaggagaaactggaaa

SEQ ID NO: 504755 - DNA, 16 bp, R. norvegicus
gaggagaaactgggaa

SEQ ID NO: 504756 - DNA, 16 bp, R. norvegicus
gaggagaacaccaggc

SEQ ID NO: 504757 - DNA, 17 bp, R. norvegicus
gaggagaaccagatgag

SEQ ID NO: 504758 - DNA, 16 bp, R. norvegicus
gaggagaagaccttgg

SEQ ID NO: 504759 - DNA, 16 bp, R. norvegicus
gaggagaagatggcag

SEQ ID NO: 504760 - DNA, 16 bp, R. norvegicus
gaggagaagattccat

SEQ ID NO: 504761 - DNA, 16 bp, R. norvegicus
gaggagaagccttggt

SEQ ID NO: 504762 - DNA, 16 bp, R. norvegicus
gaggagaagctgagag

SEQ ID NO: 504763 - DNA, 16 bp, R. norvegicus
gaggagaaggagcagc

SEQ ID NO: 504764 - DNA, 16 bp, R. norvegicus
gaggagaagtacagag

SEQ ID NO: 504765 - DNA, 16 bp, R. norvegicus
gaggagacacaaaaat

SEQ ID NO: 504766 - DNA, 16 bp, R. norvegicus
gaggagacagagagtg

SEQ ID NO: 504767 - DNA, 16 bp, R. norvegicus
gaggagacagaggcag

SEQ ID NO: 504768 - DNA, 16 bp, R. norvegicus
gaggagacagcctgtc

SEQ ID NO: 504769 - DNA, 16 bp, R. norvegicus
gaggagacagggatga

SEQ ID NO: 504770 - DNA, 16 bp, R. norvegicus
gaggagactggaagga

SEQ ID NO: 504771 - DNA, 16 bp, R. norvegicus
gaggagactggaggag

SEQ ID NO: 504772 - DNA, 27 bp, R. norvegicus
gaggagagaatgaagcgtttggagaac

SEQ ID NO: 504773 - DNA, 16 bp, R. norvegicus
gaggagagagctgctg

SEQ ID NO: 504774 - DNA, 16 bp, R. norvegicus
gaggagagccagagaa

SEQ ID NO: 504775 - DNA, 16 bp, R. norvegicus
gaggagagctgctaac

SEQ ID NO: 504776 - DNA, 16 bp, R. norvegicus
gaggagaggatgtaga

SEQ ID NO: 504777 - DNA, 16 bp, R. norvegicus
gaggagagggagatcc

SEQ ID NO: 504778 - DNA, 16 bp, R. norvegicus
gaggagataccatgac

SEQ ID NO: 504779 - DNA, 16 bp, R. norvegicus
gaggagatggaggaca

SEQ ID NO: 504780 - DNA, 16 bp, R. norvegicus
gaggagcagaagcagg

SEQ ID NO: 504781 - DNA, 16 bp, R. norvegicus
gaggagcagaagccag

SEQ ID NO: 504782 - DNA, 16 bp, R. norvegicus
gaggagcagaaggcag

SEQ ID NO: 504783 - DNA, 16 bp, R. norvegicus
gaggagcagcaggagc

SEQ ID NO: 504784 - DNA, 16 bp, R. norvegicus
gaggagcagtctggga

SEQ ID NO: 504785 - DNA, 16 bp, R. norvegicus
gaggagcccagaagat

SEQ ID NO: 504786 - DNA, 16 bp, R. norvegicus
gaggagctgaaagttc

SEQ ID NO: 504787 - DNA, 16 bp, R. norvegicus
gaggagctgagaggaa

SEQ ID NO: 504788 - DNA, 16 bp, R. norvegicus
gaggagctgaggcagg

SEQ ID NO: 504789 - DNA, 16 bp, R. norvegicus
gaggagctggaggaag

SEQ ID NO: 504790 - DNA, 16 bp, R. norvegicus
gaggagctggaggagg

SEQ ID NO: 504791 - DNA, 16 bp, R. norvegicus
gaggagctgtccaagg

SEQ ID NO: 504792 - DNA, 16 bp, R. norvegicus
gaggagctgtccgagg

SEQ ID NO: 504793 - DNA, 16 bp, R. norvegicus
gaggagctgtgtgagg

SEQ ID NO: 504794 - DNA, 16 bp, R. norvegicus
gaggaggaagagactg

SEQ ID NO: 504795 - DNA, 16 bp, R. norvegicus
gaggaggaagccacca

SEQ ID NO: 504796 - DNA, 16 bp, R. norvegicus
gaggaggaagctgcag

SEQ ID NO: 504797 - DNA, 16 bp, R. norvegicus
gaggaggaagctgcca

SEQ ID NO: 504798 - DNA, 16 bp, R. norvegicus
gaggaggaagtgctgg

SEQ ID NO: 504799 - DNA, 16 bp, R. norvegicus
gaggaggaatgggata

SEQ ID NO: 504800 - DNA, 16 bp, R. norvegicus
gaggaggagactaagg

SEQ ID NO: 504801 - DNA, 16 bp, R. norvegicus
gaggaggagactgaaa

SEQ ID NO: 504802 - DNA, 16 bp, R. norvegicus
gaggaggagatggcag

SEQ ID NO: 504803 - DNA, 16 bp, R. norvegicus
gaggaggaggagacac

SEQ ID NO: 504804 - DNA, 16 bp, R. norvegicus
gaggaggaggagactg

SEQ ID NO: 504805 - DNA, 16 bp, R. norvegicus
gaggaggaggaggcta

SEQ ID NO: 504806 - DNA, 16 bp, R. norvegicus
gaggaggaggagggct

SEQ ID NO: 504807 - DNA, 16 bp, R. norvegicus
gaggaggaggatgacc

SEQ ID NO: 504808 - DNA, 16 bp, R. norvegicus
gaggaggagggagctg

SEQ ID NO: 504809 - DNA, 16 bp, R. norvegicus
gaggaggatgatgatg

SEQ ID NO: 504810 - DNA, 16 bp, R. norvegicus
gaggaggcaaaggcag

SEQ ID NO: 504811 - DNA, 16 bp, R. norvegicus
gaggaggccagaagag

SEQ ID NO: 504812 - DNA, 16 bp, R. norvegicus
gaggaggccagcacca

SEQ ID NO: 504813 - DNA, 16 bp, R. norvegicus
gaggaggctctcttcc

SEQ ID NO: 504814 - DNA, 16 bp, R. norvegicus
gaggaggctgaggagg

SEQ ID NO: 504815 - DNA, 16 bp, R. norvegicus
gaggaggctgaggcag

SEQ ID NO: 504816 - DNA, 16 bp, R. norvegicus
gaggaggctggagaga

SEQ ID NO: 504817 - DNA, 16 bp, R. norvegicus
gaggaggctggaggag

SEQ ID NO: 504818 - DNA, 16 bp, R. norvegicus
gaggaggctggggaga

SEQ ID NO: 504819 - DNA, 16 bp, R. norvegicus
gaggagggcaacactg

SEQ ID NO: 504820 - DNA, 16 bp, R. norvegicus
gaggagggcagccctg

SEQ ID NO: 504821 - DNA, 16 bp, R. norvegicus
gaggagggctggagag

SEQ ID NO: 504822 - DNA, 16 bp, R. norvegicus
gaggaggtaacaaaaa

SEQ ID NO: 504823 - DNA, 16 bp, R. norvegicus
gaggaggtcctgcaat

SEQ ID NO: 504824 - DNA, 16 bp, R. norvegicus
gaggaggtttgggatg

SEQ ID NO: 504825 - DNA, 16 bp, R. norvegicus
gaggagtcaggggagg

SEQ ID NO: 504826 - DNA, 16 bp, R. norvegicus
gaggagtgttcctttt

SEQ ID NO: 504827 - DNA, 16 bp, R. norvegicus
gaggagttagaaaagg

SEQ ID NO: 504828 - DNA, 16 bp, R. norvegicus
gaggagttagaggaaa

SEQ ID NO: 504829 - DNA, 16 bp, R. norvegicus
gaggagttgaaggcag

SEQ ID NO: 504830 - DNA, 16 bp, R. norvegicus
gaggagtttgagaaag

SEQ ID NO: 504831 - DNA, 28 bp, R. norvegicus
gaggataagcccatccccagcagggtcc

SEQ ID NO: 504832 - DNA, 16 bp, R. norvegicus
gaggatatgtcagcag

SEQ ID NO: 504833 - DNA, 16 bp, R. norvegicus
gaggatcagaaagtca

SEQ ID NO: 504834 - DNA, 16 bp, R. norvegicus
gaggatcaggagttca

SEQ ID NO: 504835 - DNA, 16 bp, R. norvegicus
gaggatccagctttac

SEQ ID NO: 504836 - DNA, 16 bp, R. norvegicus
gaggatcctgagttca

SEQ ID NO: 504837 - DNA, 16 bp, R. norvegicus
gaggatgaccttgtgg

SEQ ID NO: 504838 - DNA, 16 bp, R. norvegicus
gaggatgaggatgatg

SEQ ID NO: 504839 - DNA, 16 bp, R. norvegicus
gaggatgatgaggatg

SEQ ID NO: 504840 - DNA, 16 bp, R. norvegicus
gaggatgatgatgatg

SEQ ID NO: 504841 - DNA, 16 bp, R. norvegicus
gaggatgatggtggtg

SEQ ID NO: 504842 - DNA, 16 bp, R. norvegicus
gaggatgctttgctga

SEQ ID NO: 504843 - DNA, 16 bp, R. norvegicus
gaggatggaacccagg

SEQ ID NO: 504844 - DNA, 16 bp, R. norvegicus
gaggatggcctcattg

SEQ ID NO: 504845 - DNA, 16 bp, R. norvegicus
gaggatgggaccactg

SEQ ID NO: 504846 - DNA, 16 bp, R. norvegicus
gaggatgggctttgag

SEQ ID NO: 504847 - DNA, 16 bp, R. norvegicus
gaggatggggagcgga

SEQ ID NO: 504848 - DNA, 16 bp, R. norvegicus
gaggatgtgaagaaag

SEQ ID NO: 504849 - DNA, 16 bp, R. norvegicus
gaggatgtggacaaag

SEQ ID NO: 504850 - DNA, 16 bp, R. norvegicus
gaggatgtggagaaga

SEQ ID NO: 504851 - DNA, 16 bp, R. norvegicus
gaggatgtggagcaag

SEQ ID NO: 504852 - DNA, 16 bp, R. norvegicus
gaggatgtgtgaatct

SEQ ID NO: 504853 - DNA, 16 bp, R. norvegicus
gaggattcagaactgc

SEQ ID NO: 504854 - DNA, 16 bp, R. norvegicus
gaggcaaaccaggaaa

SEQ ID NO: 504855 - DNA, 16 bp, R. norvegicus
gaggcaaaggcagatg

SEQ ID NO: 504856 - DNA, 16 bp, R. norvegicus
gaggcaaagtttggag

SEQ ID NO: 504857 - DNA, 16 bp, R. norvegicus
gaggcaacatggaggc

SEQ ID NO: 504858 - DNA, 16 bp, R. norvegicus
gaggcaacccagaccc

SEQ ID NO: 504859 - DNA, 16 bp, R. norvegicus
gaggcaagcagatctc

SEQ ID NO: 504860 - DNA, 16 bp, R. norvegicus
gaggcaagcatcacca

SEQ ID NO: 504861 - DNA, 16 bp, R. norvegicus
gaggcaagcgcaggag

SEQ ID NO: 504862 - DNA, 16 bp, R. norvegicus
gaggcagaaacagaca

SEQ ID NO: 504863 - DNA, 16 bp, R. norvegicus
gaggcagaaacaggag

SEQ ID NO: 504864 - DNA, 16 bp, R. norvegicus
gaggcagaaacgcctg

SEQ ID NO: 504865 - DNA, 16 bp, R. norvegicus
gaggcagaactggaga

SEQ ID NO: 504866 - DNA, 16 bp, R. norvegicus
gaggcagaagaagcag

SEQ ID NO: 504867 - DNA, 16 bp, R. norvegicus
gaggcagaagcaagta

SEQ ID NO: 504868 - DNA, 16 bp, R. norvegicus
gaggcagaagcagagg

SEQ ID NO: 504869 - DNA, 16 bp, R. norvegicus
gaggcagaagcagcag

SEQ ID NO: 504870 - DNA, 16 bp, R. norvegicus
gaggcagaaggatcag

SEQ ID NO: 504871 - DNA, 16 bp, R. norvegicus
gaggcagaaggcagag

SEQ ID NO: 504872 - DNA, 16 bp, R. norvegicus
gaggcagaagggagtg

SEQ ID NO: 504873 - DNA, 16 bp, R. norvegicus
gaggcagaatcaggag

SEQ ID NO: 504874 - DNA, 16 bp, R. norvegicus
gaggcagacacagagg

SEQ ID NO: 504875 - DNA, 16 bp, R. norvegicus
gaggcagacactgaag

SEQ ID NO: 504876 - DNA, 16 bp, R. norvegicus
gaggcagacagagaca

SEQ ID NO: 504877 - DNA, 16 bp, R. norvegicus
gaggcagacaggtgga

SEQ ID NO: 504878 - DNA, 16 bp, R. norvegicus
gaggcagagagagtga

SEQ ID NO: 504879 - DNA, 16 bp, R. norvegicus
gaggcagagatagaag

SEQ ID NO: 504880 - DNA, 16 bp, R. norvegicus
gaggcagagatctctg

SEQ ID NO: 504881 - DNA, 16 bp, R. norvegicus
gaggcagagccaggag

SEQ ID NO: 504882 - DNA, 16 bp, R. norvegicus
gaggcagagcttggct

SEQ ID NO: 504883 - DNA, 16 bp, R. norvegicus
gaggcagaggaaagca

SEQ ID NO: 504884 - DNA, 16 bp, R. norvegicus
gaggcagaggagggtg

SEQ ID NO: 504885 - DNA, 16 bp, R. norvegicus
gaggcagaggaggtgg

SEQ ID NO: 504886 - DNA, 16 bp, R. norvegicus
gaggcagaggatctct

SEQ ID NO: 504887 - DNA, 16 bp, R. norvegicus
gaggcagaggcagaag

SEQ ID NO: 504888 - DNA, 16 bp, R. norvegicus
gaggcagaggcagaca

SEQ ID NO: 504889 - DNA, 16 bp, R. norvegicus
gaggcagaggcagacc

SEQ ID NO: 504890 - DNA, 16 bp, R. norvegicus
gaggcagaggcagagc

SEQ ID NO: 504891 - DNA, 16 bp, R. norvegicus
gaggcagaggccagca

SEQ ID NO: 504892 - DNA, 16 bp, R. norvegicus
gaggcagaggcgggca

SEQ ID NO: 504893 - DNA, 16 bp, R. norvegicus
gaggcagaggctgggg

SEQ ID NO: 504894 - DNA, 16 bp, R. norvegicus
gaggcagagggaggtg

SEQ ID NO: 504895 - DNA, 16 bp, R. norvegicus
gaggcagagggatcag

SEQ ID NO: 504896 - DNA, 16 bp, R. norvegicus
gaggcagaggtagaga

SEQ ID NO: 504897 - DNA, 16 bp, R. norvegicus
gaggcagaggtggagg

SEQ ID NO: 504898 - DNA, 16 bp, R. norvegicus
gaggcagaggtgggca

SEQ ID NO: 504899 - DNA, 16 bp, R. norvegicus
gaggcagatacttgca

SEQ ID NO: 504900 - DNA, 16 bp, R. norvegicus
gaggcagatggagaaa

SEQ ID NO: 504901 - DNA, 16 bp, R. norvegicus
gaggcagatggatccc

SEQ ID NO: 504902 - DNA, 16 bp, R. norvegicus
gaggcagcagaggcag

SEQ ID NO: 504903 - DNA, 16 bp, R. norvegicus
gaggcagcagcaggtg

SEQ ID NO: 504904 - DNA, 16 bp, R. norvegicus
gaggcagcccctgctc

SEQ ID NO: 504905 - DNA, 16 bp, R. norvegicus
gaggcagctgcactat

SEQ ID NO: 504906 - DNA, 16 bp, R. norvegicus
gaggcaggaagagcag

SEQ ID NO: 504907 - DNA, 16 bp, R. norvegicus
gaggcaggaagatcag

SEQ ID NO: 504908 - DNA, 16 bp, R. norvegicus
gaggcaggaagggatg

SEQ ID NO: 504909 - DNA, 16 bp, R. norvegicus
gaggcaggaagggggt

SEQ ID NO: 504910 - DNA, 16 bp, R. norvegicus
gaggcaggaaggtgtg

SEQ ID NO: 504911 - DNA, 16 bp, R. norvegicus
gaggcaggaattgaag

SEQ ID NO: 504912 - DNA, 16 bp, R. norvegicus
gaggcaggacatctcc

SEQ ID NO: 504913 - DNA, 16 bp, R. norvegicus
gaggcaggagcagatg

SEQ ID NO: 504914 - DNA, 16 bp, R. norvegicus
gaggcaggagctgaca

SEQ ID NO: 504915 - DNA, 16 bp, R. norvegicus
gaggcaggagctgctg

SEQ ID NO: 504916 - DNA, 16 bp, R. norvegicus
gaggcaggaggatcag

SEQ ID NO: 504917 - DNA, 16 bp, R. norvegicus
gaggcaggaggattgt

SEQ ID NO: 504918 - DNA, 16 bp, R. norvegicus
gaggcaggaggcttgc

SEQ ID NO: 504919 - DNA, 16 bp, R. norvegicus
gaggcaggagtgagtg

SEQ ID NO: 504920 - DNA, 16 bp, R. norvegicus
gaggcaggagtgggag

SEQ ID NO: 504921 - DNA, 16 bp, R. norvegicus
gaggcaggagttgatg

SEQ ID NO: 504922 - DNA, 16 bp, R. norvegicus
gaggcaggcagatctg

SEQ ID NO: 504923 - DNA, 16 bp, R. norvegicus
gaggcaggggcattgc

SEQ ID NO: 504924 - DNA, 16 bp, R. norvegicus
gaggcaggtggatctg

SEQ ID NO: 504925 - DNA, 16 bp, R. norvegicus
gaggcagtaggattgc

SEQ ID NO: 504926 - DNA, 16 bp, R. norvegicus
gaggcagtctctggat

SEQ ID NO: 504927 - DNA, 16 bp, R. norvegicus
gaggcatctctccagc

SEQ ID NO: 504928 - DNA, 16 bp, R. norvegicus
gaggcattttctaaat

SEQ ID NO: 504929 - DNA, 16 bp, R. norvegicus
gaggccaacttggtct

SEQ ID NO: 504930 - DNA, 16 bp, R. norvegicus
gaggccaaggcaggca

SEQ ID NO: 504931 - DNA, 16 bp, R. norvegicus
gaggccacagaagcag

SEQ ID NO: 504932 - DNA, 16 bp, R. norvegicus
gaggccacagagacag

SEQ ID NO: 504933 - DNA, 16 bp, R. norvegicus
gaggccaccaacactg

SEQ ID NO: 504934 - DNA, 16 bp, R. norvegicus
gaggccaccctgagct

SEQ ID NO: 504935 - DNA, 16 bp, R. norvegicus
gaggccagaagagggc

SEQ ID NO: 504936 - DNA, 16 bp, R. norvegicus
gaggccagacaagcca

SEQ ID NO: 504937 - DNA, 16 bp, R. norvegicus
gaggccagacaaggtg

SEQ ID NO: 504938 - DNA, 16 bp, R. norvegicus
gaggccagaggaagat

SEQ ID NO: 504939 - DNA, 16 bp, R. norvegicus
gaggccagaggaggat

SEQ ID NO: 504940 - DNA, 16 bp, R. norvegicus
gaggccagagggcagc

SEQ ID NO: 504941 - DNA, 16 bp, R. norvegicus
gaggccagaggtcacc

SEQ ID NO: 504942 - DNA, 16 bp, R. norvegicus
gaggccagccatgggc

SEQ ID NO: 504943 - DNA, 16 bp, R. norvegicus
gaggccagcctcagct

SEQ ID NO: 504944 - DNA, 16 bp, R. norvegicus
gaggccagcctgagct

SEQ ID NO: 504945 - DNA, 16 bp, R. norvegicus
gaggccagcctggcct

SEQ ID NO: 504946 - DNA, 16 bp, R. norvegicus
gaggccagcctgggct

SEQ ID NO: 504947 - DNA, 16 bp, R. norvegicus
gaggccagcgccatct

SEQ ID NO: 504948 - DNA, 16 bp, R. norvegicus
gaggccagggaaggcc

SEQ ID NO: 504949 - DNA, 16 bp, R. norvegicus
gaggccatggagaagt

SEQ ID NO: 504950 - DNA, 16 bp, R. norvegicus
gaggccatggagaggt

SEQ ID NO: 504951 - DNA, 16 bp, R. norvegicus
gaggccatggaggagt

SEQ ID NO: 504952 - DNA, 16 bp, R. norvegicus
gaggccatggagggac

SEQ ID NO: 504953 - DNA, 16 bp, R. norvegicus
gaggccatggagggct

SEQ ID NO: 504954 - DNA, 16 bp, R. norvegicus
gaggccatggagggtg

SEQ ID NO: 504955 - DNA, 16 bp, R. norvegicus
gaggccattctggtct

SEQ ID NO: 504956 - DNA, 16 bp, R. norvegicus
gaggcccatctcccag

SEQ ID NO: 504957 - DNA, 16 bp, R. norvegicus
gaggccccagagagtt

SEQ ID NO: 504958 - DNA, 16 bp, R. norvegicus
gaggccctcctcctag

SEQ ID NO: 504959 - DNA, 16 bp, R. norvegicus
gaggccctgagttcaa

SEQ ID NO: 504960 - DNA, 16 bp, R. norvegicus
gaggcccttggtcatg

SEQ ID NO: 504961 - DNA, 17 bp, R. norvegicus
gaggccgaagcagaggc

SEQ ID NO: 504962 - DNA, 16 bp, R. norvegicus
gaggccgaggccgagg

SEQ ID NO: 504963 - DNA, 16 bp, R. norvegicus
gaggcctgcctggtct

SEQ ID NO: 504964 - DNA, 16 bp, R. norvegicus
gaggcctggctgtccc

SEQ ID NO: 504965 - DNA, 16 bp, R. norvegicus
gaggcctgtcattgga

SEQ ID NO: 504966 - DNA, 16 bp, R. norvegicus
gaggccttatgcttgt

SEQ ID NO: 504967 - DNA, 16 bp, R. norvegicus
gaggccttgtctcaaa

SEQ ID NO: 504968 - DNA, 16 bp, R. norvegicus
gaggctaaggcaggag

SEQ ID NO: 504969 - DNA, 16 bp, R. norvegicus
gaggctcaaacccagg

SEQ ID NO: 504970 - DNA, 16 bp, R. norvegicus
gaggctcaagaagaag

SEQ ID NO: 504971 - DNA, 17 bp, R. norvegicus
gaggctcaagagagaaa

SEQ ID NO: 504972 - DNA, 16 bp, R. norvegicus
gaggctcagccagagc

SEQ ID NO: 504973 - DNA, 16 bp, R. norvegicus
gaggctcaggcaggag

SEQ ID NO: 504974 - DNA, 16 bp, R. norvegicus
gaggctccaccaagca

SEQ ID NO: 504975 - DNA, 16 bp, R. norvegicus
gaggctccagggagtc

SEQ ID NO: 504976 - DNA, 16 bp, R. norvegicus
gaggctcccaggagcc

SEQ ID NO: 504977 - DNA, 24 bp, R. norvegicus
gaggctcccggaaagagcggtgca

SEQ ID NO: 504978 - DNA, 16 bp, R. norvegicus
gaggctcccggaaggg

SEQ ID NO: 504979 - DNA, 16 bp, R. norvegicus
gaggctcccggagggg

SEQ ID NO: 504980 - DNA, 16 bp, R. norvegicus
gaggctcctgagctcc

SEQ ID NO: 504981 - DNA, 16 bp, R. norvegicus
gaggctctcagaggac

SEQ ID NO: 504982 - DNA, 16 bp, R. norvegicus
gaggctctcaggaccc

SEQ ID NO: 504983 - DNA, 16 bp, R. norvegicus
gaggctctgccaatca

SEQ ID NO: 504984 - DNA, 16 bp, R. norvegicus
gaggctctgctggagc

SEQ ID NO: 504985 - DNA, 16 bp, R. norvegicus
gaggctctgggtttga

SEQ ID NO: 504986 - DNA, 16 bp, R. norvegicus
gaggctctgtctgctg

SEQ ID NO: 504987 - DNA, 16 bp, R. norvegicus
gaggctcttccccagt

SEQ ID NO: 504988 - DNA, 16 bp, R. norvegicus
gaggctcttggttctg

SEQ ID NO: 504989 - DNA, 16 bp, R. norvegicus
gaggctgaagagcgga

SEQ ID NO: 504990 - DNA, 16 bp, R. norvegicus
gaggctgaagcaggag

SEQ ID NO: 504991 - DNA, 16 bp, R. norvegicus
gaggctgaagctggag

SEQ ID NO: 504992 - DNA, 16 bp, R. norvegicus
gaggctgaaggaaagg

SEQ ID NO: 504993 - DNA, 16 bp, R. norvegicus
gaggctgacacaggag

SEQ ID NO: 504994 - DNA, 16 bp, R. norvegicus
gaggctgagagagaag

SEQ ID NO: 504995 - DNA, 16 bp, R. norvegicus
gaggctgagaggcaga

SEQ ID NO: 504996 - DNA, 16 bp, R. norvegicus
gaggctgagcctggag

SEQ ID NO: 504997 - DNA, 16 bp, R. norvegicus
gaggctgaggaagaag

SEQ ID NO: 504998 - DNA, 16 bp, R. norvegicus
gaggctgaggaagagg

SEQ ID NO: 504999 - DNA, 16 bp, R. norvegicus
gaggctgaggaaggaa

SEQ ID NO: 505000 - DNA, 16 bp, R. norvegicus
gaggctgaggaaggag

SEQ ID NO: 505001 - DNA, 16 bp, R. norvegicus
gaggctgaggagagga

SEQ ID NO: 505002 - DNA, 16 bp, R. norvegicus
gaggctgaggaggctg

SEQ ID NO: 505003 - DNA, 16 bp, R. norvegicus
gaggctgaggcagaag

SEQ ID NO: 505004 - DNA, 16 bp, R. norvegicus
gaggctgaggcagcag

SEQ ID NO: 505005 - DNA, 16 bp, R. norvegicus
gaggctgaggcagtag

SEQ ID NO: 505006 - DNA, 16 bp, R. norvegicus
gaggctgagggaagag

SEQ ID NO: 505007 - DNA, 16 bp, R. norvegicus
gaggctgagggaggag

SEQ ID NO: 505008 - DNA, 16 bp, R. norvegicus
gaggctgaggtagaaa

SEQ ID NO: 505009 - DNA, 16 bp, R. norvegicus
gaggctgaggtaggag

SEQ ID NO: 505010 - DNA, 16 bp, R. norvegicus
gaggctgcactctgtg

SEQ ID NO: 505011 - DNA, 16 bp, R. norvegicus
gaggctgcagagagga

SEQ ID NO: 505012 - DNA, 18 bp, R. norvegicus
gaggctgcagagcagagg

SEQ ID NO: 505013 - DNA, 16 bp, R. norvegicus
gaggctgcagagcagg

SEQ ID NO: 505014 - DNA, 16 bp, R. norvegicus
gaggctgcagagggga

SEQ ID NO: 505015 - DNA, 16 bp, R. norvegicus
gaggctgcagagtgga

SEQ ID NO: 505016 - DNA, 16 bp, R. norvegicus
gaggctgcagcaggag

SEQ ID NO: 505017 - DNA, 16 bp, R. norvegicus
gaggctgctgctgctg

SEQ ID NO: 505018 - DNA, 16 bp, R. norvegicus
gaggctggagcaggaa

SEQ ID NO: 505019 - DNA, 16 bp, R. norvegicus
gaggctggagccatag

SEQ ID NO: 505020 - DNA, 16 bp, R. norvegicus
gaggctgggaggctgg

SEQ ID NO: 505021 - DNA, 16 bp, R. norvegicus
gaggctgggctgggct

SEQ ID NO: 505022 - DNA, 16 bp, R. norvegicus
gaggctggggaggctg

SEQ ID NO: 505023 - DNA, 16 bp, R. norvegicus
gaggctggggctccag

SEQ ID NO: 505024 - DNA, 19 bp, R. norvegicus
gaggctgtgagcaccaggg

SEQ ID NO: 505025 - DNA, 16 bp, R. norvegicus
gaggctgtggagaaag

SEQ ID NO: 505026 - DNA, 16 bp, R. norvegicus
gaggctgtggagatgg

SEQ ID NO: 505027 - DNA, 16 bp, R. norvegicus
gaggctgtggaggatg

SEQ ID NO: 505028 - DNA, 16 bp, R. norvegicus
gaggctgtgttccaga

SEQ ID NO: 505029 - DNA, 16 bp, R. norvegicus
gaggctgttggtgaag

SEQ ID NO: 505030 - DNA, 25 bp, R. norvegicus
gaggcttgtttcataggagagatca

SEQ ID NO: 505031 - DNA, 16 bp, R. norvegicus
gagggaaccatggctc

SEQ ID NO: 505032 - DNA, 16 bp, R. norvegicus
gagggaagccagagca

SEQ ID NO: 505033 - DNA, 16 bp, R. norvegicus
gagggaatcctggaga

SEQ ID NO: 505034 - DNA, 16 bp, R. norvegicus
gagggaattaccaaag

SEQ ID NO: 505035 - DNA, 16 bp, R. norvegicus
gagggaccagcaggaa

SEQ ID NO: 505036 - DNA, 16 bp, R. norvegicus
gagggagaaaaggtcc

SEQ ID NO: 505037 - DNA, 16 bp, R. norvegicus
gagggagaaaaggtct

SEQ ID NO: 505038 - DNA, 16 bp, R. norvegicus
gagggagaaggaacac

SEQ ID NO: 505039 - DNA, 16 bp, R. norvegicus
gagggagacaaccctg

SEQ ID NO: 505040 - DNA, 16 bp, R. norvegicus
gagggagacagaaaca

SEQ ID NO: 505041 - DNA, 16 bp, R. norvegicus
gagggagacagacaga

SEQ ID NO: 505042 - DNA, 16 bp, R. norvegicus
gagggagagagagatt

SEQ ID NO: 505043 - DNA, 16 bp, R. norvegicus
gagggagcccaggagg

SEQ ID NO: 505044 - DNA, 16 bp, R. norvegicus
gagggagctgaaggag

SEQ ID NO: 505045 - DNA, 16 bp, R. norvegicus
gagggagctgagagct

SEQ ID NO: 505046 - DNA, 16 bp, R. norvegicus
gagggaggacccagcc

SEQ ID NO: 505047 - DNA, 16 bp, R. norvegicus
gagggaggcaaagatt

SEQ ID NO: 505048 - DNA, 16 bp, R. norvegicus
gagggagggaggactg

SEQ ID NO: 505049 - DNA, 16 bp, R. norvegicus
gagggaggggagcctg

SEQ ID NO: 505050 - DNA, 16 bp, R. norvegicus
gagggagtgagtgagt

SEQ ID NO: 505051 - DNA, 16 bp, R. norvegicus
gagggatgaagcaaag

SEQ ID NO: 505052 - DNA, 16 bp, R. norvegicus
gagggatgtggccacc

SEQ ID NO: 505053 - DNA, 16 bp, R. norvegicus
gagggcacagagacag

SEQ ID NO: 505054 - DNA, 16 bp, R. norvegicus
gagggcacaggatccc

SEQ ID NO: 505055 - DNA, 16 bp, R. norvegicus
gagggcagaccaggaa

SEQ ID NO: 505056 - DNA, 16 bp, R. norvegicus
gagggcagacttcagc

SEQ ID NO: 505057 - DNA, 16 bp, R. norvegicus
gagggcagcaatggag

SEQ ID NO: 505058 - DNA, 16 bp, R. norvegicus
gagggcagcctggact

SEQ ID NO: 505059 - DNA, 16 bp, R. norvegicus
gagggcagcctgggct

SEQ ID NO: 505060 - DNA, 16 bp, R. norvegicus
gagggcatgggatctc

SEQ ID NO: 505061 - DNA, 16 bp, R. norvegicus
gagggccagcagtctc

SEQ ID NO: 505062 - DNA, 16 bp, R. norvegicus
gagggccaggagaaag

SEQ ID NO: 505063 - DNA, 16 bp, R. norvegicus
gagggcctgcaccgcc

SEQ ID NO: 505064 - DNA, 16 bp, R. norvegicus
gagggctatgtgctgc

SEQ ID NO: 505065 - DNA, 16 bp, R. norvegicus
gagggctggacagatg

SEQ ID NO: 505066 - DNA, 16 bp, R. norvegicus
gagggctggagaaatg

SEQ ID NO: 505067 - DNA, 16 bp, R. norvegicus
gagggctggagggctg

SEQ ID NO: 505068 - DNA, 16 bp, R. norvegicus
gagggcttcctggaag

SEQ ID NO: 505069 - DNA, 16 bp, R. norvegicus
gagggcttcctggagg

SEQ ID NO: 505070 - DNA, 16 bp, R. norvegicus
gagggcttctatgaag

SEQ ID NO: 505071 - DNA, 16 bp, R. norvegicus
gaggggaagcagttct

SEQ ID NO: 505072 - DNA, 16 bp, R. norvegicus
gaggggacaaggcaac

SEQ ID NO: 505073 - DNA, 16 bp, R. norvegicus
gaggggacagagacag

SEQ ID NO: 505074 - DNA, 16 bp, R. norvegicus
gaggggctggaagaga

SEQ ID NO: 505075 - DNA, 16 bp, R. norvegicus
gagggggaggagctag

SEQ ID NO: 505076 - DNA, 16 bp, R. norvegicus
gagggggctggagaga

SEQ ID NO: 505077 - DNA, 16 bp, R. norvegicus
gaggggtcagaagctt

SEQ ID NO: 505078 - DNA, 16 bp, R. norvegicus
gaggggttacttccag

SEQ ID NO: 505079 - DNA, 16 bp, R. norvegicus
gagggtaggcctggca

SEQ ID NO: 505080 - DNA, 16 bp, R. norvegicus
gagggtcagaagttca

SEQ ID NO: 505081 - DNA, 16 bp, R. norvegicus
gagggtcaggaaaatg

SEQ ID NO: 505082 - DNA, 16 bp, R. norvegicus
gagggtccttccaacc

SEQ ID NO: 505083 - DNA, 16 bp, R. norvegicus
gagggtgaaggcagag

SEQ ID NO: 505084 - DNA, 16 bp, R. norvegicus
gagggtgaatgggatg

SEQ ID NO: 505085 - DNA, 16 bp, R. norvegicus
gagggtggacctggga

SEQ ID NO: 505086 - DNA, 16 bp, R. norvegicus
gagggtgtttccagag

SEQ ID NO: 505087 - DNA, 16 bp, R. norvegicus
gaggtaaaagacaaca

SEQ ID NO: 505088 - DNA, 16 bp, R. norvegicus
gaggtaaagatgctca

SEQ ID NO: 505089 - DNA, 16 bp, R. norvegicus
gaggtagagaggcagg

SEQ ID NO: 505090 - DNA, 16 bp, R. norvegicus
gaggtatgggatgagg

SEQ ID NO: 505091 - DNA, 16 bp, R. norvegicus
gaggtattggagacca

SEQ ID NO: 505092 - DNA, 16 bp, R. norvegicus
gaggtcaagcagagca

SEQ ID NO: 505093 - DNA, 16 bp, R. norvegicus
gaggtcaattggaaat

SEQ ID NO: 505094 - DNA, 16 bp, R. norvegicus
gaggtcagaagaggac

SEQ ID NO: 505095 - DNA, 16 bp, R. norvegicus
gaggtcagagcccagg

SEQ ID NO: 505096 - DNA, 16 bp, R. norvegicus
gaggtcagaggtcaac

SEQ ID NO: 505097 - DNA, 16 bp, R. norvegicus
gaggtcagaggtcaag

SEQ ID NO: 505098 - DNA, 16 bp, R. norvegicus
gaggtcagaggtcaga

SEQ ID NO: 505099 - DNA, 16 bp, R. norvegicus
gaggtcagaggtcagc

SEQ ID NO: 505100 - DNA, 16 bp, R. norvegicus
gaggtcagagtccaca

SEQ ID NO: 505101 - DNA, 16 bp, R. norvegicus
gaggtcagcctggact

SEQ ID NO: 505102 - DNA, 16 bp, R. norvegicus
gaggtcagcctggtgt

SEQ ID NO: 505103 - DNA, 16 bp, R. norvegicus
gaggtcagggatggtc

SEQ ID NO: 505104 - DNA, 16 bp, R. norvegicus
gaggtcatctatgaag

SEQ ID NO: 505105 - DNA, 16 bp, R. norvegicus
gaggtcctaagttcaa

SEQ ID NO: 505106 - DNA, 21 bp, R. norvegicus
gaggtcctgagaccttctact

SEQ ID NO: 505107 - DNA, 16 bp, R. norvegicus
gaggtcctgagttcag

SEQ ID NO: 505108 - DNA, 16 bp, R. norvegicus
gaggtccttggtccta

SEQ ID NO: 505109 - DNA, 16 bp, R. norvegicus
gaggtctctggcttct

SEQ ID NO: 505110 - DNA, 16 bp, R. norvegicus
gaggtctgttttgtga

SEQ ID NO: 505111 - DNA, 16 bp, R. norvegicus
gaggtcttctatgaac

SEQ ID NO: 505112 - DNA, 16 bp, R. norvegicus
gaggtcttcttcaatg

SEQ ID NO: 505113 - DNA, 16 bp, R. norvegicus
gaggtctttgatctac

SEQ ID NO: 505114 - DNA, 16 bp, R. norvegicus
gaggtgaactctcagg

SEQ ID NO: 505115 - DNA, 16 bp, R. norvegicus
gaggtgaagcccttgg

SEQ ID NO: 505116 - DNA, 17 bp, R. norvegicus
gaggtgatccaggatga

SEQ ID NO: 505117 - DNA, 16 bp, R. norvegicus
gaggtgatggaaaaca

SEQ ID NO: 505118 - DNA, 16 bp, R. norvegicus
gaggtgatggtgatga

SEQ ID NO: 505119 - DNA, 16 bp, R. norvegicus
gaggtgatggtgatgg

SEQ ID NO: 505120 - DNA, 16 bp, R. norvegicus
gaggtgcaggcaggag

SEQ ID NO: 505121 - DNA, 16 bp, R. norvegicus
gaggtgcatgccttta

SEQ ID NO: 505122 - DNA, 16 bp, R. norvegicus
gaggtgctcctgctgg

SEQ ID NO: 505123 - DNA, 16 bp, R. norvegicus
gaggtgctgctggcca

SEQ ID NO: 505124 - DNA, 16 bp, R. norvegicus
gaggtggaaactcagg

SEQ ID NO: 505125 - DNA, 16 bp, R. norvegicus
gaggtggaaagaccca

SEQ ID NO: 505126 - DNA, 16 bp, R. norvegicus
gaggtggaaagattgt

SEQ ID NO: 505127 - DNA, 16 bp, R. norvegicus
gaggtggagagtggta

SEQ ID NO: 505128 - DNA, 16 bp, R. norvegicus
gaggtggaggcagagg

SEQ ID NO: 505129 - DNA, 16 bp, R. norvegicus
gaggtggaggcaggca

SEQ ID NO: 505130 - DNA, 16 bp, R. norvegicus
gaggtggcacggaggt

SEQ ID NO: 505131 - DNA, 16 bp, R. norvegicus
gaggtggcctcttcag

SEQ ID NO: 505132 - DNA, 16 bp, R. norvegicus
gaggtgggaacagagg

SEQ ID NO: 505133 - DNA, 16 bp, R. norvegicus
gaggtgggaagctggt

SEQ ID NO: 505134 - DNA, 16 bp, R. norvegicus
gaggtgggaggaactg

SEQ ID NO: 505135 - DNA, 16 bp, R. norvegicus
gaggtgggcagaagtg

SEQ ID NO: 505136 - DNA, 16 bp, R. norvegicus
gaggtggtggcacaca

SEQ ID NO: 505137 - DNA, 16 bp, R. norvegicus
gaggtggtggtgatga

SEQ ID NO: 505138 - DNA, 16 bp, R. norvegicus
gaggtggttagaagaa

SEQ ID NO: 505139 - DNA, 16 bp, R. norvegicus
gaggtgtaacaaagta

SEQ ID NO: 505140 - DNA, 16 bp, R. norvegicus
gaggtgtgtccctggg

SEQ ID NO: 505141 - DNA, 16 bp, R. norvegicus
gaggttaaaggacaac

SEQ ID NO: 505142 - DNA, 16 bp, R. norvegicus
gaggttgagagagaga

SEQ ID NO: 505143 - DNA, 16 bp, R. norvegicus
gaggttgtaaaaccat

SEQ ID NO: 505144 - DNA, 16 bp, R. norvegicus
gaggttgttctctggc

SEQ ID NO: 505145 - DNA, 16 bp, R. norvegicus
gaggtttccccaacac

SEQ ID NO: 505146 - DNA, 16 bp, R. norvegicus
gaggtttgccaaggag

SEQ ID NO: 505147 - DNA, 16 bp, R. norvegicus
gaggttttagaggaga

SEQ ID NO: 505148 - DNA, 16 bp, R. norvegicus
gaggtttttcttttct

SEQ ID NO: 505149 - DNA, 16 bp, R. norvegicus
gagtaaaatctggagt

SEQ ID NO: 505150 - DNA, 16 bp, R. norvegicus
gagtaacccctcaccc

SEQ ID NO: 505151 - DNA, 16 bp, R. norvegicus
gagtaactgggacccc

SEQ ID NO: 505152 - DNA, 16 bp, R. norvegicus
gagtaagccccaaaag

SEQ ID NO: 505153 - DNA, 16 bp, R. norvegicus
gagtacacaaggacag

SEQ ID NO: 505154 - DNA, 16 bp, R. norvegicus
gagtacaggcagctgg

SEQ ID NO: 505155 - DNA, 16 bp, R. norvegicus
gagtacatacaatgtg

SEQ ID NO: 505156 - DNA, 16 bp, R. norvegicus
gagtaccaactgctct

SEQ ID NO: 505157 - DNA, 17 bp, R. norvegicus
gagtacctcggtgtgac

SEQ ID NO: 505158 - DNA, 24 bp, R. norvegicus
gagtagaagcctacagagaggaat

SEQ ID NO: 505159 - DNA, 16 bp, R. norvegicus
gagtagagcattgtgc

SEQ ID NO: 505160 - DNA, 16 bp, R. norvegicus
gagtataacttcttga

SEQ ID NO: 505161 - DNA, 16 bp, R. norvegicus
gagtatatatcatgtg

SEQ ID NO: 505162 - DNA, 16 bp, R. norvegicus
gagtatatgagtgtgt

SEQ ID NO: 505163 - DNA, 16 bp, R. norvegicus
gagtatatgtccagga

SEQ ID NO: 505164 - DNA, 16 bp, R. norvegicus
gagtatcattaggaat

SEQ ID NO: 505165 - DNA, 16 bp, R. norvegicus
gagtatgtgaatgtgt

SEQ ID NO: 505166 - DNA, 16 bp, R. norvegicus
gagtatttttgcttcg

SEQ ID NO: 505167 - DNA, 16 bp, R. norvegicus
gagtcaagccactgtc

SEQ ID NO: 505168 - DNA, 16 bp, R. norvegicus
gagtcaccctcctcct

SEQ ID NO: 505169 - DNA, 16 bp, R. norvegicus
gagtcacctccccagc

SEQ ID NO: 505170 - DNA, 16 bp, R. norvegicus
gagtcagaaatgtggg

SEQ ID NO: 505171 - DNA, 16 bp, R. norvegicus
gagtcagaagcaggag

SEQ ID NO: 505172 - DNA, 16 bp, R. norvegicus
gagtcagaaggagaga

SEQ ID NO: 505173 - DNA, 16 bp, R. norvegicus
gagtcagacagagaca

SEQ ID NO: 505174 - DNA, 16 bp, R. norvegicus
gagtcagagaagcaga

SEQ ID NO: 505175 - DNA, 16 bp, R. norvegicus
gagtcagagagagatg

SEQ ID NO: 505176 - DNA, 16 bp, R. norvegicus
gagtcagaggagagag

SEQ ID NO: 505177 - DNA, 16 bp, R. norvegicus
gagtcagaggcagccc

SEQ ID NO: 505178 - DNA, 16 bp, R. norvegicus
gagtcagatgcagaca

SEQ ID NO: 505179 - DNA, 16 bp, R. norvegicus
gagtcagatgcagata

SEQ ID NO: 505180 - DNA, 16 bp, R. norvegicus
gagtcagctctctcct

SEQ ID NO: 505181 - DNA, 16 bp, R. norvegicus
gagtcaggcatacttg

SEQ ID NO: 505182 - DNA, 16 bp, R. norvegicus
gagtcagggaaggaag

SEQ ID NO: 505183 - DNA, 16 bp, R. norvegicus
gagtcagttctctcct

SEQ ID NO: 505184 - DNA, 16 bp, R. norvegicus
gagtcatcagagagaa

SEQ ID NO: 505185 - DNA, 16 bp, R. norvegicus
gagtcatcggagagga

SEQ ID NO: 505186 - DNA, 16 bp, R. norvegicus
gagtcatctctgcagc

SEQ ID NO: 505187 - DNA, 17 bp, R. norvegicus
gagtccaaggtcagtcc

SEQ ID NO: 505188 - DNA, 16 bp, R. norvegicus
gagtccacagaagcag

SEQ ID NO: 505189 - DNA, 18 bp, R. norvegicus
gagtccactatgagggga

SEQ ID NO: 505190 - DNA, 16 bp, R. norvegicus
gagtccagaagagggc

SEQ ID NO: 505191 - DNA, 16 bp, R. norvegicus
gagtccagagtccagg

SEQ ID NO: 505192 - DNA, 16 bp, R. norvegicus
gagtccattgatgtaa

SEQ ID NO: 505193 - DNA, 16 bp, R. norvegicus
gagtcccaacaaatgg

SEQ ID NO: 505194 - DNA, 16 bp, R. norvegicus
gagtcccagatggcat

SEQ ID NO: 505195 - DNA, 16 bp, R. norvegicus
gagtcccccagtgagg

SEQ ID NO: 505196 - DNA, 16 bp, R. norvegicus
gagtcccctggagctg

SEQ ID NO: 505197 - DNA, 16 bp, R. norvegicus
gagtccctgaagagag

SEQ ID NO: 505198 - DNA, 16 bp, R. norvegicus
gagtccctggaactag

SEQ ID NO: 505199 - DNA, 16 bp, R. norvegicus
gagtccctgtgctcag

SEQ ID NO: 505200 - DNA, 16 bp, R. norvegicus
gagtcctcagaaaatt

SEQ ID NO: 505201 - DNA, 16 bp, R. norvegicus
gagtcctgagcatctc

SEQ ID NO: 505202 - DNA, 16 bp, R. norvegicus
gagtcctggttttcct

SEQ ID NO: 505203 - DNA, 16 bp, R. norvegicus
gagtctaccaggcagg

SEQ ID NO: 505204 - DNA, 16 bp, R. norvegicus
gagtctcagatgagaa

SEQ ID NO: 505205 - DNA, 16 bp, R. norvegicus
gagtctcctcctggct

SEQ ID NO: 505206 - DNA, 16 bp, R. norvegicus
gagtctctgcatctct

SEQ ID NO: 505207 - DNA, 16 bp, R. norvegicus
gagtctctgccagagt

SEQ ID NO: 505208 - DNA, 16 bp, R. norvegicus
gagtctctgttaagaa

SEQ ID NO: 505209 - DNA, 16 bp, R. norvegicus
gagtctgaagccagcc

SEQ ID NO: 505210 - DNA, 16 bp, R. norvegicus
gagtctgacaccctct

SEQ ID NO: 505211 - DNA, 16 bp, R. norvegicus
gagtctgaggaaaagg

SEQ ID NO: 505212 - DNA, 16 bp, R. norvegicus
gagtctgaggactatg

SEQ ID NO: 505213 - DNA, 16 bp, R. norvegicus
gagtctgccattttcc

SEQ ID NO: 505214 - DNA, 16 bp, R. norvegicus
gagtctgccccacagg

SEQ ID NO: 505215 - DNA, 16 bp, R. norvegicus
gagtctgtctcaaaac

SEQ ID NO: 505216 - DNA, 16 bp, R. norvegicus
gagtctgtctcagaaa

SEQ ID NO: 505217 - DNA, 16 bp, R. norvegicus
gagtcttcattctctt

SEQ ID NO: 505218 - DNA, 16 bp, R. norvegicus
gagtcttgaaattctt

SEQ ID NO: 505219 - DNA, 16 bp, R. norvegicus
gagtcttgtagaagag

SEQ ID NO: 505220 - DNA, 18 bp, R. norvegicus
gagtgaaagactggaaaa

SEQ ID NO: 505221 - DNA, 16 bp, R. norvegicus
gagtgaaagcaaagca

SEQ ID NO: 505222 - DNA, 16 bp, R. norvegicus
gagtgaccagcatgca

SEQ ID NO: 505223 - DNA, 16 bp, R. norvegicus
gagtgaccatggcctg

SEQ ID NO: 505224 - DNA, 17 bp, R. norvegicus
gagtgagaaattaggag

SEQ ID NO: 505225 - DNA, 16 bp, R. norvegicus
gagtgagccaacccaa

SEQ ID NO: 505226 - DNA, 16 bp, R. norvegicus
gagtgagttaactcag

SEQ ID NO: 505227 - DNA, 17 bp, R. norvegicus
gagtgagttccaagaca

SEQ ID NO: 505228 - DNA, 16 bp, R. norvegicus
gagtgatgcattcaca

SEQ ID NO: 505229 - DNA, 16 bp, R. norvegicus
gagtgcaaaaataaat

SEQ ID NO: 505230 - DNA, 17 bp, R. norvegicus
gagtgcataccatgtgt

SEQ ID NO: 505231 - DNA, 16 bp, R. norvegicus
gagtgcccacatgtct

SEQ ID NO: 505232 - DNA, 16 bp, R. norvegicus
gagtgcccacctgagc

SEQ ID NO: 505233 - DNA, 16 bp, R. norvegicus
gagtgcccacctgtcc

SEQ ID NO: 505234 - DNA, 16 bp, R. norvegicus
gagtgcctccaaagag

SEQ ID NO: 505235 - DNA, 16 bp, R. norvegicus
gagtgctacagagggc

SEQ ID NO: 505236 - DNA, 16 bp, R. norvegicus
gagtgctaggattaaa

SEQ ID NO: 505237 - DNA, 16 bp, R. norvegicus
gagtgctatagacctg

SEQ ID NO: 505238 - DNA, 16 bp, R. norvegicus
gagtgctctccctcct

SEQ ID NO: 505239 - DNA, 16 bp, R. norvegicus
gagtgctgagattaca

SEQ ID NO: 505240 - DNA, 16 bp, R. norvegicus
gagtgctgcctactgg

SEQ ID NO: 505241 - DNA, 16 bp, R. norvegicus
gagtgctgctgactgg

SEQ ID NO: 505242 - DNA, 16 bp, R. norvegicus
gagtgcttgactagca

SEQ ID NO: 505243 - DNA, 16 bp, R. norvegicus
gagtgcttgccaagca

SEQ ID NO: 505244 - DNA, 16 bp, R. norvegicus
gagtgcttgcctacca

SEQ ID NO: 505245 - DNA, 16 bp, R. norvegicus
gagtggaaagactctg

SEQ ID NO: 505246 - DNA, 16 bp, R. norvegicus
gagtggaactagaaaa

SEQ ID NO: 505247 - DNA, 16 bp, R. norvegicus
gagtggaccaggaggg

SEQ ID NO: 505248 - DNA, 16 bp, R. norvegicus
gagtggagcagaaact

SEQ ID NO: 505249 - DNA, 16 bp, R. norvegicus
gagtggagcagagagt

SEQ ID NO: 505250 - DNA, 16 bp, R. norvegicus
gagtggatcccagata

SEQ ID NO: 505251 - DNA, 16 bp, R. norvegicus
gagtggcagctacagg

SEQ ID NO: 505252 - DNA, 16 bp, R. norvegicus
gagtggctccagtctg

SEQ ID NO: 505253 - DNA, 16 bp, R. norvegicus
gagtgggaaggcctgg

SEQ ID NO: 505254 - DNA, 16 bp, R. norvegicus
gagtgggcggagctcc

SEQ ID NO: 505255 - DNA, 16 bp, R. norvegicus
gagtggggaaaaggca

SEQ ID NO: 505256 - DNA, 16 bp, R. norvegicus
gagtggggaggcctgg

SEQ ID NO: 505257 - DNA, 16 bp, R. norvegicus
gagtgggtgtggcctc

SEQ ID NO: 505258 - DNA, 16 bp, R. norvegicus
gagtgtccacctctgt

SEQ ID NO: 505259 - DNA, 16 bp, R. norvegicus
gagtgtctgtgtgtgt

SEQ ID NO: 505260 - DNA, 16 bp, R. norvegicus
gagtgtgagagagaga

SEQ ID NO: 505261 - DNA, 16 bp, R. norvegicus
gagtgtgagcactgtg

SEQ ID NO: 505262 - DNA, 16 bp, R. norvegicus
gagtgtgaggcagctg

SEQ ID NO: 505263 - DNA, 16 bp, R. norvegicus
gagtgtgggcaggctg

SEQ ID NO: 505264 - DNA, 16 bp, R. norvegicus
gagtgtgtaggctttc

SEQ ID NO: 505265 - DNA, 16 bp, R. norvegicus
gagtgtgtgagagagt

SEQ ID NO: 505266 - DNA, 16 bp, R. norvegicus
gagtgtgtgagtgagt

SEQ ID NO: 505267 - DNA, 16 bp, R. norvegicus
gagtgtgtgagtgtgt

SEQ ID NO: 505268 - DNA, 16 bp, R. norvegicus
gagtgtgtgagtttgt

SEQ ID NO: 505269 - DNA, 16 bp, R. norvegicus
gagtgtgtgtatgagt

SEQ ID NO: 505270 - DNA, 16 bp, R. norvegicus
gagtgtgtgtatgtgt

SEQ ID NO: 505271 - DNA, 16 bp, R. norvegicus
gagtgtgtgtgactgt

SEQ ID NO: 505272 - DNA, 16 bp, R. norvegicus
gagtgtgtgtggtata

SEQ ID NO: 505273 - DNA, 16 bp, R. norvegicus
gagtgtgtttgtatgt

SEQ ID NO: 505274 - DNA, 16 bp, R. norvegicus
gagtgttccccatgca

SEQ ID NO: 505275 - DNA, 16 bp, R. norvegicus
gagtgttcctcttagc

SEQ ID NO: 505276 - DNA, 16 bp, R. norvegicus
gagttaaacagagaat

SEQ ID NO: 505277 - DNA, 16 bp, R. norvegicus
gagttaaaggcagctg

SEQ ID NO: 505278 - DNA, 16 bp, R. norvegicus
gagttaattttaaatc

SEQ ID NO: 505279 - DNA, 16 bp, R. norvegicus
gagttacagaaggatg

SEQ ID NO: 505280 - DNA, 16 bp, R. norvegicus
gagttacagatggtga

SEQ ID NO: 505281 - DNA, 16 bp, R. norvegicus
gagttagagaaaagat

SEQ ID NO: 505282 - DNA, 16 bp, R. norvegicus
gagttagtagcacagg

SEQ ID NO: 505283 - DNA, 16 bp, R. norvegicus
gagttatctgaaaaga

SEQ ID NO: 505284 - DNA, 16 bp, R. norvegicus
gagttcaaaccccagc

SEQ ID NO: 505285 - DNA, 16 bp, R. norvegicus
gagttcaaagccagcc

SEQ ID NO: 505286 - DNA, 16 bp, R. norvegicus
gagttcaaagccatcc

SEQ ID NO: 505287 - DNA, 16 bp, R. norvegicus
gagttcaaagcccagc

SEQ ID NO: 505288 - DNA, 16 bp, R. norvegicus
gagttcaaatccagca

SEQ ID NO: 505289 - DNA, 16 bp, R. norvegicus
gagttcaagactattc

SEQ ID NO: 505290 - DNA, 16 bp, R. norvegicus
gagttcaaggccagct

SEQ ID NO: 505291 - DNA, 16 bp, R. norvegicus
gagttcaagtccagcc

SEQ ID NO: 505292 - DNA, 26 bp, R. norvegicus
gagttcaatgtccaattttctgagga

SEQ ID NO: 505293 - DNA, 16 bp, R. norvegicus
gagttcacttcccagc

SEQ ID NO: 505294 - DNA, 16 bp, R. norvegicus
gagttcagatccacag

SEQ ID NO: 505295 - DNA, 16 bp, R. norvegicus
gagttcagatcccaga

SEQ ID NO: 505296 - DNA, 16 bp, R. norvegicus
gagttcagattccagc

SEQ ID NO: 505297 - DNA, 16 bp, R. norvegicus
gagttcaggcaatgca

SEQ ID NO: 505298 - DNA, 16 bp, R. norvegicus
gagttcaggtccccag

SEQ ID NO: 505299 - DNA, 16 bp, R. norvegicus
gagttcagttcccagc

SEQ ID NO: 505300 - DNA, 16 bp, R. norvegicus
gagttcagttcctggg

SEQ ID NO: 505301 - DNA, 16 bp, R. norvegicus
gagttcatctaggacc

SEQ ID NO: 505302 - DNA, 16 bp, R. norvegicus
gagttcatcttgatgg

SEQ ID NO: 505303 - DNA, 16 bp, R. norvegicus
gagttcatcttggtag

SEQ ID NO: 505304 - DNA, 16 bp, R. norvegicus
gagttcatgcagttca

SEQ ID NO: 505305 - DNA, 35 bp, R. norvegicus
gagttccaaaatcaagagcaaatggggccttgatg

SEQ ID NO: 505306 - DNA, 16 bp, R. norvegicus
gagttccacaacagcc

SEQ ID NO: 505307 - DNA, 16 bp, R. norvegicus
gagttccagaagagcc

SEQ ID NO: 505308 - DNA, 16 bp, R. norvegicus
gagttccagaccaacc

SEQ ID NO: 505309 - DNA, 16 bp, R. norvegicus
gagttccagaccagcc

SEQ ID NO: 505310 - DNA, 16 bp, R. norvegicus
gagttccagaccagct

SEQ ID NO: 505311 - DNA, 16 bp, R. norvegicus
gagttccagaccagtg

SEQ ID NO: 505312 - DNA, 16 bp, R. norvegicus
gagttccaggacagct

SEQ ID NO: 505313 - DNA, 16 bp, R. norvegicus
gagttccaggccagcc

SEQ ID NO: 505314 - DNA, 16 bp, R. norvegicus
gagttccaggccagtc

SEQ ID NO: 505315 - DNA, 16 bp, R. norvegicus
gagttccaggccatcc

SEQ ID NO: 505316 - DNA, 16 bp, R. norvegicus
gagttccaggctagcc

SEQ ID NO: 505317 - DNA, 16 bp, R. norvegicus
gagttccagggctaca

SEQ ID NO: 505318 - DNA, 16 bp, R. norvegicus
gagttccaggtgagcc

SEQ ID NO: 505319 - DNA, 16 bp, R. norvegicus
gagttccctgggaagg

SEQ ID NO: 505320 - DNA, 16 bp, R. norvegicus
gagttccgggccagcc

SEQ ID NO: 505321 - DNA, 16 bp, R. norvegicus
gagttcctgaacagcc

SEQ ID NO: 505322 - DNA, 16 bp, R. norvegicus
gagttcctgcgcttgc

SEQ ID NO: 505323 - DNA, 16 bp, R. norvegicus
gagttcctggctggcc

SEQ ID NO: 505324 - DNA, 16 bp, R. norvegicus
gagttcctgtgaagga

SEQ ID NO: 505325 - DNA, 16 bp, R. norvegicus
gagttcgtcttggtgg

SEQ ID NO: 505326 - DNA, 16 bp, R. norvegicus
gagttctaagccagcc

SEQ ID NO: 505327 - DNA, 16 bp, R. norvegicus
gagttctacaacttca

SEQ ID NO: 505328 - DNA, 16 bp, R. norvegicus
gagttctacatcctca

SEQ ID NO: 505329 - DNA, 16 bp, R. norvegicus
gagttctaggctagcc

SEQ ID NO: 505330 - DNA, 16 bp, R. norvegicus
gagttctgggaactga

SEQ ID NO: 505331 - DNA, 16 bp, R. norvegicus
gagttctgggattaaa

SEQ ID NO: 505332 - DNA, 16 bp, R. norvegicus
gagttctgtggtagaa

SEQ ID NO: 505333 - DNA, 16 bp, R. norvegicus
gagttctgtggtggaa

SEQ ID NO: 505334 - DNA, 16 bp, R. norvegicus
gagttcttcatcccat

SEQ ID NO: 505335 - DNA, 16 bp, R. norvegicus
gagttgaaggccagct

SEQ ID NO: 505336 - DNA, 16 bp, R. norvegicus
gagttgccttggttgt

SEQ ID NO: 505337 - DNA, 16 bp, R. norvegicus
gagttggaatttgatg

SEQ ID NO: 505338 - DNA, 16 bp, R. norvegicus
gagttggagggcagcc

SEQ ID NO: 505339 - DNA, 16 bp, R. norvegicus
gagttggggagcaccc

SEQ ID NO: 505340 - DNA, 16 bp, R. norvegicus
gagttgtttctattga

SEQ ID NO: 505341 - DNA, 36 bp, R. norvegicus
gagtttatgaaattcgtaggcaaatggctggaactg

SEQ ID NO: 505342 - DNA, 16 bp, R. norvegicus
gagtttattatgtgga

SEQ ID NO: 505343 - DNA, 16 bp, R. norvegicus
gagtttattctggagc

SEQ ID NO: 505344 - DNA, 16 bp, R. norvegicus
gagtttattgtgtgga

SEQ ID NO: 505345 - DNA, 16 bp, R. norvegicus
gagtttcagaacagcc

SEQ ID NO: 505346 - DNA, 17 bp, R. norvegicus
gagtttcagccggtatg

SEQ ID NO: 505347 - DNA, 16 bp, R. norvegicus
gagtttcaggccagcc

SEQ ID NO: 505348 - DNA, 16 bp, R. norvegicus
gagtttcctctgttga

SEQ ID NO: 505349 - DNA, 16 bp, R. norvegicus
gagtttctcagaggac

SEQ ID NO: 505350 - DNA, 16 bp, R. norvegicus
gagtttctctgtgtgt

SEQ ID NO: 505351 - DNA, 16 bp, R. norvegicus
gagtttgaaaccaacc

SEQ ID NO: 505352 - DNA, 16 bp, R. norvegicus
gagtttgaatcccaga

SEQ ID NO: 505353 - DNA, 16 bp, R. norvegicus
gagtttgactatttcc

SEQ ID NO: 505354 - DNA, 16 bp, R. norvegicus
gagtttgactgtgctt

SEQ ID NO: 505355 - DNA, 16 bp, R. norvegicus
gagtttgagccagaag

SEQ ID NO: 505356 - DNA, 16 bp, R. norvegicus
gagtttgagtttgagg

SEQ ID NO: 505357 - DNA, 16 bp, R. norvegicus
gagtttgattctttcc

SEQ ID NO: 505358 - DNA, 16 bp, R. norvegicus
gagtttgcaggataca

SEQ ID NO: 505359 - DNA, 16 bp, R. norvegicus
gagtttggatcccaga

SEQ ID NO: 505360 - DNA, 16 bp, R. norvegicus
gagtttggtgtctgta

SEQ ID NO: 505361 - DNA, 16 bp, R. norvegicus
gagtttggtgttttcc

SEQ ID NO: 505362 - DNA, 16 bp, R. norvegicus
gagtttggttcccagc

SEQ ID NO: 505363 - DNA, 16 bp, R. norvegicus
gagtttggtttccagc

SEQ ID NO: 505364 - DNA, 16 bp, R. norvegicus
gagtttgtggtggctg

SEQ ID NO: 505365 - DNA, 16 bp, R. norvegicus
gagttttacttggtcc

SEQ ID NO: 505366 - DNA, 16 bp, R. norvegicus
gagttttgattgtggg

SEQ ID NO: 505367 - DNA, 16 bp, R. norvegicus
gagttttgcaggaaaa

SEQ ID NO: 505368 - DNA, 17 bp, R. norvegicus
gagttttgctggataca

SEQ ID NO: 505369 - DNA, 43 bp, R. norvegicus
gataaacagttctctgcacccaaatcccgagggagggagagct

SEQ ID NO: 505370 - DNA, 43 bp, R. norvegicus
gataaacagttctctgcacccaaatcccgtgggagggagagct

SEQ ID NO: 505371 - DNA, 20 bp, R. norvegicus
gataaacgatgtgaggaagc

SEQ ID NO: 505372 - DNA, 16 bp, R. norvegicus
gataaagaagctaaaa

SEQ ID NO: 505373 - DNA, 16 bp, R. norvegicus
gataaagacagagaca

SEQ ID NO: 505374 - DNA, 16 bp, R. norvegicus
gataaagatataaacc

SEQ ID NO: 505375 - DNA, 16 bp, R. norvegicus
gataaagatgaggatg

SEQ ID NO: 505376 - DNA, 16 bp, R. norvegicus
gataaatccacagaag

SEQ ID NO: 505377 - DNA, 16 bp, R. norvegicus
gataaatgaatggatg

SEQ ID NO: 505378 - DNA, 16 bp, R. norvegicus
gataacacaagtaaac

SEQ ID NO: 505379 - DNA, 16 bp, R. norvegicus
gataacattttttttc

SEQ ID NO: 505380 - DNA, 16 bp, R. norvegicus
gataaccagatggaga

SEQ ID NO: 505381 - DNA, 16 bp, R. norvegicus
gataacctggtcaatg

SEQ ID NO: 505382 - DNA, 16 bp, R. norvegicus
gataactcagacccaa

SEQ ID NO: 505383 - DNA, 16 bp, R. norvegicus
gataactttaaaaaaa

SEQ ID NO: 505384 - DNA, 16 bp, R. norvegicus
gataagaacaccaacc

SEQ ID NO: 505385 - DNA, 16 bp, R. norvegicus
gataagaatgggctga

SEQ ID NO: 505386 - DNA, 16 bp, R. norvegicus
gataagagtgatgaag

SEQ ID NO: 505387 - DNA, 16 bp, R. norvegicus
gataagatggatgaac

SEQ ID NO: 505388 - DNA, 16 bp, R. norvegicus
gataagattgttgaag

SEQ ID NO: 505389 - DNA, 16 bp, R. norvegicus
gataaggaaagacact

SEQ ID NO: 505390 - DNA, 16 bp, R. norvegicus
gataaggcaaagccta

SEQ ID NO: 505391 - DNA, 16 bp, R. norvegicus
gataagggcacagcag

SEQ ID NO: 505392 - DNA, 16 bp, R. norvegicus
gataataacaattgaa

SEQ ID NO: 505393 - DNA, 55 bp, R. norvegicus
gataatcccatgcgtgctatcggaccaccacggcctaaaactggtcttcaataac

SEQ ID NO: 505394 - DNA, 16 bp, R. norvegicus
gataatgctttaaatt

SEQ ID NO: 505395 - DNA, 16 bp, R. norvegicus
gatacaacctacagac

SEQ ID NO: 505396 - DNA, 16 bp, R. norvegicus
gatacaagaagactga

SEQ ID NO: 505397 - DNA, 16 bp, R. norvegicus
gatacaagagaatttc

SEQ ID NO: 505398 - DNA, 16 bp, R. norvegicus
gatacaatccatacag

SEQ ID NO: 505399 - DNA, 16 bp, R. norvegicus
gatacaccagaatctg

SEQ ID NO: 505400 - DNA, 16 bp, R. norvegicus
gatacactgaaattaa

SEQ ID NO: 505401 - DNA, 16 bp, R. norvegicus
gatacagaaaacatgg

SEQ ID NO: 505402 - DNA, 16 bp, R. norvegicus
gatacagatgggaaaa

SEQ ID NO: 505403 - DNA, 16 bp, R. norvegicus
gatacagattggaaag

SEQ ID NO: 505404 - DNA, 16 bp, R. norvegicus
gatacatgaaaccctg

SEQ ID NO: 505405 - DNA, 16 bp, R. norvegicus
gatacattatataaac

SEQ ID NO: 505406 - DNA, 16 bp, R. norvegicus
gataccattacagatg

SEQ ID NO: 505407 - DNA, 16 bp, R. norvegicus
gatacctgtgcttcct

SEQ ID NO: 505408 - DNA, 18 bp, R. norvegicus
gatacgtggttttgggtt

SEQ ID NO: 505409 - DNA, 16 bp, R. norvegicus
gatactccttgaggga

SEQ ID NO: 505410 - DNA, 16 bp, R. norvegicus
gatagaaaacctagag

SEQ ID NO: 505411 - DNA, 16 bp, R. norvegicus
gatagaaaaccttgga

SEQ ID NO: 505412 - DNA, 16 bp, R. norvegicus
gatagaaacatagata

SEQ ID NO: 505413 - DNA, 16 bp, R. norvegicus
gatagaaagaggcctg

SEQ ID NO: 505414 - DNA, 16 bp, R. norvegicus
gatagaaagcaggcat

SEQ ID NO: 505415 - DNA, 16 bp, R. norvegicus
gatagaaggatggatg

SEQ ID NO: 505416 - DNA, 16 bp, R. norvegicus
gatagaatgttatata

SEQ ID NO: 505417 - DNA, 16 bp, R. norvegicus
gatagacagagacaga

SEQ ID NO: 505418 - DNA, 16 bp, R. norvegicus
gatagagacaaagaga

SEQ ID NO: 505419 - DNA, 16 bp, R. norvegicus
gatagagagaaacaga

SEQ ID NO: 505420 - DNA, 16 bp, R. norvegicus
gatagaggactcatat

SEQ ID NO: 505421 - DNA, 26 bp, R. norvegicus
gatagatagatagatagatagataga

SEQ ID NO: 505422 - DNA, 16 bp, R. norvegicus
gatagatgaatggatg

SEQ ID NO: 505423 - DNA, 16 bp, R. norvegicus
gatagcagctgtgtgc

SEQ ID NO: 505424 - DNA, 16 bp, R. norvegicus
gatagcagtgctaaga

SEQ ID NO: 505425 - DNA, 16 bp, R. norvegicus
gatagcattttctaca

SEQ ID NO: 505426 - DNA, 16 bp, R. norvegicus
gataggctttgaggtt

SEQ ID NO: 505427 - DNA, 16 bp, R. norvegicus
gatagtgaaaattata

SEQ ID NO: 505428 - DNA, 16 bp, R. norvegicus
gatagtgatgatggtg

SEQ ID NO: 505429 - DNA, 16 bp, R. norvegicus
gatatacaaaaccaaa

SEQ ID NO: 505430 - DNA, 16 bp, R. norvegicus
gatatacctgcctctg

SEQ ID NO: 505431 - DNA, 16 bp, R. norvegicus
gatatactggtagaag

SEQ ID NO: 505432 - DNA, 16 bp, R. norvegicus
gatatagctgtctcct

SEQ ID NO: 505433 - DNA, 16 bp, R. norvegicus
gatatagtcaagctga

SEQ ID NO: 505434 - DNA, 16 bp, R. norvegicus
gatatcaacctgcctt

SEQ ID NO: 505435 - DNA, 18 bp, R. norvegicus
gatatctcaattctaaac

SEQ ID NO: 505436 - DNA, 16 bp, R. norvegicus
gatatctgcccagctt

SEQ ID NO: 505437 - DNA, 16 bp, R. norvegicus
gatatgctgaatctaa

SEQ ID NO: 505438 - DNA, 16 bp, R. norvegicus
gatatggaaaaagagg

SEQ ID NO: 505439 - DNA, 16 bp, R. norvegicus
gatatggaaactgaag

SEQ ID NO: 505440 - DNA, 16 bp, R. norvegicus
gatatggaagaaggaa

SEQ ID NO: 505441 - DNA, 16 bp, R. norvegicus
gatatgtgtgtgcatg

SEQ ID NO: 505442 - DNA, 16 bp, R. norvegicus
gatattactcagttga

SEQ ID NO: 505443 - DNA, 16 bp, R. norvegicus
gatattctcattgtgt

SEQ ID NO: 505444 - DNA, 16 bp, R. norvegicus
gatattgctgttcttc

SEQ ID NO: 505445 - DNA, 16 bp, R. norvegicus
gatattggagatgcca

SEQ ID NO: 505446 - DNA, 16 bp, R. norvegicus
gatattggcacagaga

SEQ ID NO: 505447 - DNA, 99 bp, R. norvegicus
gatatttatagaacattctatcctaaagcaaaaggatataccttcttctcagctcctcatggtactttctccaaaattgaccatataattggtcaaaaa

SEQ ID NO: 505448 - DNA, 16 bp, R. norvegicus
gatatttttccccctt

SEQ ID NO: 505449 - DNA, 16 bp, R. norvegicus
gatatttttttccctt

SEQ ID NO: 505450 - DNA, 16 bp, R. norvegicus
gatcaaaaccacaagt

SEQ ID NO: 505451 - DNA, 16 bp, R. norvegicus
gatcaaaatgcagaga

SEQ ID NO: 505452 - DNA, 16 bp, R. norvegicus
gatcaaaatgggaatg

SEQ ID NO: 505453 - DNA, 16 bp, R. norvegicus
gatcaaagtcctggaa

SEQ ID NO: 505454 - DNA, 16 bp, R. norvegicus
gatcaagaaggcttca

SEQ ID NO: 505455 - DNA, 16 bp, R. norvegicus
gatcaagaatcagcaa

SEQ ID NO: 505456 - DNA, 16 bp, R. norvegicus
gatcaagatgctggag

SEQ ID NO: 505457 - DNA, 16 bp, R. norvegicus
gatcaagctcaggtca

SEQ ID NO: 505458 - DNA, 16 bp, R. norvegicus
gatcaaggtaaaaaca

SEQ ID NO: 505459 - DNA, 16 bp, R. norvegicus
gatcacacacatacac

SEQ ID NO: 505460 - DNA, 16 bp, R. norvegicus
gatcacaccttttacc

SEQ ID NO: 505461 - DNA, 16 bp, R. norvegicus
gatcacattgatggat

SEQ ID NO: 505462 - DNA, 16 bp, R. norvegicus
gatcacctgcccaggg

SEQ ID NO: 505463 - DNA, 16 bp, R. norvegicus
gatcactgtggaagag

SEQ ID NO: 505464 - DNA, 16 bp, R. norvegicus
gatcagaaatccaagg

SEQ ID NO: 505465 - DNA, 16 bp, R. norvegicus
gatcagaagttcaaag

SEQ ID NO: 505466 - DNA, 16 bp, R. norvegicus
gatcagagggatgcaa

SEQ ID NO: 505467 - DNA, 16 bp, R. norvegicus
gatcaggaagcagaaa

SEQ ID NO: 505468 - DNA, 16 bp, R. norvegicus
gatcaggaagtcaagg

SEQ ID NO: 505469 - DNA, 17 bp, R. norvegicus
gatcaggatgctggagg

SEQ ID NO: 505470 - DNA, 16 bp, R. norvegicus
gatcagtattcatacc

SEQ ID NO: 505471 - DNA, 16 bp, R. norvegicus
gatcagtcacagagga

SEQ ID NO: 505472 - DNA, 16 bp, R. norvegicus
gatcagtgggtagtgt

SEQ ID NO: 505473 - DNA, 16 bp, R. norvegicus
gatcatacacacacac

SEQ ID NO: 505474 - DNA, 16 bp, R. norvegicus
gatcatcctccagcat

SEQ ID NO: 505475 - DNA, 16 bp, R. norvegicus
gatcatcctgcctcag

SEQ ID NO: 505476 - DNA, 16 bp, R. norvegicus
gatcatgatcatgatc

SEQ ID NO: 505477 - DNA, 16 bp, R. norvegicus
gatcatggaaatggaa

SEQ ID NO: 505478 - DNA, 16 bp, R. norvegicus
gatccaaaagcagcca

SEQ ID NO: 505479 - DNA, 16 bp, R. norvegicus
gatccaaaggcagcca

SEQ ID NO: 505480 - DNA, 16 bp, R. norvegicus
gatccaaaggcagtca

SEQ ID NO: 505481 - DNA, 16 bp, R. norvegicus
gatccaacaccctctt

SEQ ID NO: 505482 - DNA, 16 bp, R. norvegicus
gatccacgaggatgtc

SEQ ID NO: 505483 - DNA, 16 bp, R. norvegicus
gatccagcccatatac

SEQ ID NO: 505484 - DNA, 16 bp, R. norvegicus
gatccagctgcctctg

SEQ ID NO: 505485 - DNA, 16 bp, R. norvegicus
gatccagttggacttg

SEQ ID NO: 505486 - DNA, 16 bp, R. norvegicus
gatccatctctccagc

SEQ ID NO: 505487 - DNA, 16 bp, R. norvegicus
gatcccaaaattccac

SEQ ID NO: 505488 - DNA, 16 bp, R. norvegicus
gatcccactgcagatg

SEQ ID NO: 505489 - DNA, 16 bp, R. norvegicus
gatcccagaagatgga

SEQ ID NO: 505490 - DNA, 16 bp, R. norvegicus
gatcccataccctctt

SEQ ID NO: 505491 - DNA, 16 bp, R. norvegicus
gatcccatttattgat

SEQ ID NO: 505492 - DNA, 16 bp, R. norvegicus
gatccccagagcccat

SEQ ID NO: 505493 - DNA, 16 bp, R. norvegicus
gatccccagctccaaa

SEQ ID NO: 505494 - DNA, 16 bp, R. norvegicus
gatcccccagagctcc

SEQ ID NO: 505495 - DNA, 16 bp, R. norvegicus
gatccccctggaactg

SEQ ID NO: 505496 - DNA, 16 bp, R. norvegicus
gatcccctagaactga

SEQ ID NO: 505497 - DNA, 16 bp, R. norvegicus
gatcccctgaaattgg

SEQ ID NO: 505498 - DNA, 16 bp, R. norvegicus
gatcccctggacctgg

SEQ ID NO: 505499 - DNA, 16 bp, R. norvegicus
gatccctggggttcac

SEQ ID NO: 505500 - DNA, 16 bp, R. norvegicus
gatccctgtgcctgag

SEQ ID NO: 505501 - DNA, 19 bp, R. norvegicus
gatccgaggaagcgagaga

SEQ ID NO: 505502 - DNA, 16 bp, R. norvegicus
gatcctactacaaaag

SEQ ID NO: 505503 - DNA, 16 bp, R. norvegicus
gatcctagcactcagg

SEQ ID NO: 505504 - DNA, 16 bp, R. norvegicus
gatcctcaggaagagc

SEQ ID NO: 505505 - DNA, 16 bp, R. norvegicus
gatcctccagaagagc

SEQ ID NO: 505506 - DNA, 16 bp, R. norvegicus
gatcctcctgcaccat

SEQ ID NO: 505507 - DNA, 16 bp, R. norvegicus
gatcctcctgtttctg

SEQ ID NO: 505508 - DNA, 16 bp, R. norvegicus
gatcctctggcctctg

SEQ ID NO: 505509 - DNA, 16 bp, R. norvegicus
gatcctcttgcttcag

SEQ ID NO: 505510 - DNA, 16 bp, R. norvegicus
gatcctggagagatgt

SEQ ID NO: 505511 - DNA, 16 bp, R. norvegicus
gatcctgggagagcag

SEQ ID NO: 505512 - DNA, 16 bp, R. norvegicus
gatccttcccaaacag

SEQ ID NO: 505513 - DNA, 16 bp, R. norvegicus
gatccttctgtctcag

SEQ ID NO: 505514 - DNA, 16 bp, R. norvegicus
gatccttgatgaagga

SEQ ID NO: 505515 - DNA, 16 bp, R. norvegicus
gatccttttgatgtgt

SEQ ID NO: 505516 - DNA, 33 bp, R. norvegicus
gatcgccatgctgctactacacctataactaat

SEQ ID NO: 505517 - DNA, 16 bp, R. norvegicus
gatcgctgagttcaag

SEQ ID NO: 505518 - DNA, 16 bp, R. norvegicus
gatctaaaccttcaga

SEQ ID NO: 505519 - DNA, 16 bp, R. norvegicus
gatctaagaatggaaa

SEQ ID NO: 505520 - DNA, 16 bp, R. norvegicus
gatctacagagtgagt

SEQ ID NO: 505521 - DNA, 16 bp, R. norvegicus
gatctaggggagaggg

SEQ ID NO: 505522 - DNA, 16 bp, R. norvegicus
gatctagtaaaagtca

SEQ ID NO: 505523 - DNA, 16 bp, R. norvegicus
gatctcagagtttgag

SEQ ID NO: 505524 - DNA, 16 bp, R. norvegicus
gatctcagggctccag

SEQ ID NO: 505525 - DNA, 16 bp, R. norvegicus
gatctcatgtaaccca

SEQ ID NO: 505526 - DNA, 16 bp, R. norvegicus
gatctccgggctgaca

SEQ ID NO: 505527 - DNA, 16 bp, R. norvegicus
gatctcctgtctccgt

SEQ ID NO: 505528 - DNA, 16 bp, R. norvegicus
gatctccttttcctca

SEQ ID NO: 505529 - DNA, 16 bp, R. norvegicus
gatctctcagacactg

SEQ ID NO: 505530 - DNA, 16 bp, R. norvegicus
gatctctcagatgctg

SEQ ID NO: 505531 - DNA, 16 bp, R. norvegicus
gatctctgagttcaag

SEQ ID NO: 505532 - DNA, 16 bp, R. norvegicus
gatctctgtgagttgg

SEQ ID NO: 505533 - DNA, 16 bp, R. norvegicus
gatctcttacccttct

SEQ ID NO: 505534 - DNA, 16 bp, R. norvegicus
gatctcttgagttcca

SEQ ID NO: 505535 - DNA, 18 bp, R. norvegicus
gatctctttacagatggt

SEQ ID NO: 505536 - DNA, 16 bp, R. norvegicus
gatctctttcctgggt

SEQ ID NO: 505537 - DNA, 16 bp, R. norvegicus
gatctgatagggtgca

SEQ ID NO: 505538 - DNA, 16 bp, R. norvegicus
gatctgatattttttt

SEQ ID NO: 505539 - DNA, 16 bp, R. norvegicus
gatctgatgttttctt

SEQ ID NO: 505540 - DNA, 16 bp, R. norvegicus
gatctgcatggctctg

SEQ ID NO: 505541 - DNA, 16 bp, R. norvegicus
gatctgccaacagcag

SEQ ID NO: 505542 - DNA, 16 bp, R. norvegicus
gatctgccttcctctg

SEQ ID NO: 505543 - DNA, 16 bp, R. norvegicus
gatctgctccagtgtc

SEQ ID NO: 505544 - DNA, 16 bp, R. norvegicus
gatctgcttgcctctg

SEQ ID NO: 505545 - DNA, 16 bp, R. norvegicus
gatctggaggagaggg

SEQ ID NO: 505546 - DNA, 16 bp, R. norvegicus
gatctggatggaaatt

SEQ ID NO: 505547 - DNA, 16 bp, R. norvegicus
gatctggcccatgcca

SEQ ID NO: 505548 - DNA, 16 bp, R. norvegicus
gatctggggaaaagta

SEQ ID NO: 505549 - DNA, 16 bp, R. norvegicus
gatctgtatgacaaaa

SEQ ID NO: 505550 - DNA, 16 bp, R. norvegicus
gatcttactatgcaga

SEQ ID NO: 505551 - DNA, 16 bp, R. norvegicus
gatcttagcctttctc

SEQ ID NO: 505552 - DNA, 16 bp, R. norvegicus
gatcttccagaagacc

SEQ ID NO: 505553 - DNA, 16 bp, R. norvegicus
gatcttcctgcctctg

SEQ ID NO: 505554 - DNA, 16 bp, R. norvegicus
gatcttcctgcttcag

SEQ ID NO: 505555 - DNA, 16 bp, R. norvegicus
gatcttctgcaagagc

SEQ ID NO: 505556 - DNA, 16 bp, R. norvegicus
gatcttgatgaaagag

SEQ ID NO: 505557 - DNA, 16 bp, R. norvegicus
gatcttgctgtctctg

SEQ ID NO: 505558 - DNA, 16 bp, R. norvegicus
gatcttttccaaatct

SEQ ID NO: 505559 - DNA, 16 bp, R. norvegicus
gatgaaaaaggagttg

SEQ ID NO: 505560 - DNA, 16 bp, R. norvegicus
gatgaaacactgacca

SEQ ID NO: 505561 - DNA, 16 bp, R. norvegicus
gatgaaacagagaaag

SEQ ID NO: 505562 - DNA, 16 bp, R. norvegicus
gatgaaagaagcacac

SEQ ID NO: 505563 - DNA, 16 bp, R. norvegicus
gatgaaagtcctggaa

SEQ ID NO: 505564 - DNA, 16 bp, R. norvegicus
gatgaaatattttata

SEQ ID NO: 505565 - DNA, 16 bp, R. norvegicus
gatgaaatggaaaatt

SEQ ID NO: 505566 - DNA, 16 bp, R. norvegicus
gatgaaatgttttcct

SEQ ID NO: 505567 - DNA, 16 bp, R. norvegicus
gatgaacaacaatatc

SEQ ID NO: 505568 - DNA, 16 bp, R. norvegicus
gatgaactgaacctct

SEQ ID NO: 505569 - DNA, 16 bp, R. norvegicus
gatgaactgctggagt

SEQ ID NO: 505570 - DNA, 16 bp, R. norvegicus
gatgaagaaactgaag

SEQ ID NO: 505571 - DNA, 16 bp, R. norvegicus
gatgaagaagaagatg

SEQ ID NO: 505572 - DNA, 16 bp, R. norvegicus
gatgaagatgatgatg

SEQ ID NO: 505573 - DNA, 16 bp, R. norvegicus
gatgaagatgatggtg

SEQ ID NO: 505574 - DNA, 17 bp, R. norvegicus
gatgaagcaaagacgtg

SEQ ID NO: 505575 - DNA, 16 bp, R. norvegicus
gatgaagccaagaaat

SEQ ID NO: 505576 - DNA, 16 bp, R. norvegicus
gatgaagctgtagaac

SEQ ID NO: 505577 - DNA, 16 bp, R. norvegicus
gatgaaggcaattcct

SEQ ID NO: 505578 - DNA, 16 bp, R. norvegicus
gatgaagtctctctgg

SEQ ID NO: 505579 - DNA, 16 bp, R. norvegicus
gatgaagttaaaaagt

SEQ ID NO: 505580 - DNA, 16 bp, R. norvegicus
gatgaatatgaactgt

SEQ ID NO: 505581 - DNA, 16 bp, R. norvegicus
gatgaattaatgattt

SEQ ID NO: 505582 - DNA, 16 bp, R. norvegicus
gatgaatttgagaatt

SEQ ID NO: 505583 - DNA, 16 bp, R. norvegicus
gatgaatttgcattct

SEQ ID NO: 505584 - DNA, 16 bp, R. norvegicus
gatgacaatgacaatg

SEQ ID NO: 505585 - DNA, 16 bp, R. norvegicus
gatgacaatggagaac

SEQ ID NO: 505586 - DNA, 16 bp, R. norvegicus
gatgacatcacccaca

SEQ ID NO: 505587 - DNA, 16 bp, R. norvegicus
gatgacccatcctcag

SEQ ID NO: 505588 - DNA, 16 bp, R. norvegicus
gatgaccccataggaa

SEQ ID NO: 505589 - DNA, 16 bp, R. norvegicus
gatgacctgagttcaa

SEQ ID NO: 505590 - DNA, 16 bp, R. norvegicus
gatgacgacgacgaca

SEQ ID NO: 505591 - DNA, 16 bp, R. norvegicus
gatgacgatgacgaca

SEQ ID NO: 505592 - DNA, 16 bp, R. norvegicus
gatgacggtgatgatg

SEQ ID NO: 505593 - DNA, 22 bp, R. norvegicus
gatgactgcagaacctggaaaa

SEQ ID NO: 505594 - DNA, 16 bp, R. norvegicus
gatgactttcttgctt

SEQ ID NO: 505595 - DNA, 16 bp, R. norvegicus
gatgactttgaactcc

SEQ ID NO: 505596 - DNA, 16 bp, R. norvegicus
gatgactttttcttca

SEQ ID NO: 505597 - DNA, 16 bp, R. norvegicus
gatgagaaaacagagg

SEQ ID NO: 505598 - DNA, 16 bp, R. norvegicus
gatgagaaaactgaag

SEQ ID NO: 505599 - DNA, 16 bp, R. norvegicus
gatgagaaagaaggat

SEQ ID NO: 505600 - DNA, 16 bp, R. norvegicus
gatgagaaggggaaca

SEQ ID NO: 505601 - DNA, 16 bp, R. norvegicus
gatgagaatggatcga

SEQ ID NO: 505602 - DNA, 16 bp, R. norvegicus
gatgagagacagacag

SEQ ID NO: 505603 - DNA, 16 bp, R. norvegicus
gatgagatttttaaaa

SEQ ID NO: 505604 - DNA, 16 bp, R. norvegicus
gatgaggaagaggatg

SEQ ID NO: 505605 - DNA, 16 bp, R. norvegicus
gatgaggagatcctca

SEQ ID NO: 505606 - DNA, 16 bp, R. norvegicus
gatgaggatgaggatg

SEQ ID NO: 505607 - DNA, 17 bp, R. norvegicus
gatgaggatgatgagga

SEQ ID NO: 505608 - DNA, 16 bp, R. norvegicus
gatgaggatgtgaaga

SEQ ID NO: 505609 - DNA, 16 bp, R. norvegicus
gatgagggtgatgatg

SEQ ID NO: 505610 - DNA, 16 bp, R. norvegicus
gatgagtttgaaatct

SEQ ID NO: 505611 - DNA, 16 bp, R. norvegicus
gatgataacttctaaa

SEQ ID NO: 505612 - DNA, 16 bp, R. norvegicus
gatgatacaggacttt

SEQ ID NO: 505613 - DNA, 16 bp, R. norvegicus
gatgatattttccatt

SEQ ID NO: 505614 - DNA, 21 bp, R. norvegicus
gatgatcaaaatgtgaatgct

SEQ ID NO: 505615 - DNA, 16 bp, R. norvegicus
gatgatgaagaagaag

SEQ ID NO: 505616 - DNA, 16 bp, R. norvegicus
gatgatgaaggtgatg

SEQ ID NO: 505617 - DNA, 16 bp, R. norvegicus
gatgatgacaacgatg

SEQ ID NO: 505618 - DNA, 16 bp, R. norvegicus
gatgatgaccttgaac

SEQ ID NO: 505619 - DNA, 16 bp, R. norvegicus
gatgatgacgacgaca

SEQ ID NO: 505620 - DNA, 16 bp, R. norvegicus
gatgatgacgatgatg

SEQ ID NO: 505621 - DNA, 21 bp, R. norvegicus
gatgatgatgacgacgacgac

SEQ ID NO: 505622 - DNA, 16 bp, R. norvegicus
gatgatgatgataaag

SEQ ID NO: 505623 - DNA, 16 bp, R. norvegicus
gatgatgatgatattg

SEQ ID NO: 505624 - DNA, 16 bp, R. norvegicus
gatgatgatgatgagt

SEQ ID NO: 505625 - DNA, 16 bp, R. norvegicus
gatgatgatgatgtta

SEQ ID NO: 505626 - DNA, 16 bp, R. norvegicus
gatgatgatgatgttg

SEQ ID NO: 505627 - DNA, 16 bp, R. norvegicus
gatgatgatgatgttt

SEQ ID NO: 505628 - DNA, 16 bp, R. norvegicus
gatgatgatggaggac

SEQ ID NO: 505629 - DNA, 16 bp, R. norvegicus
gatgatgatggtggtg

SEQ ID NO: 505630 - DNA, 16 bp, R. norvegicus
gatgatgatgtgatga

SEQ ID NO: 505631 - DNA, 16 bp, R. norvegicus
gatgatgattttgatg

SEQ ID NO: 505632 - DNA, 16 bp, R. norvegicus
gatgatgccatgcagt

SEQ ID NO: 505633 - DNA, 16 bp, R. norvegicus
gatgatgctaagaagt

SEQ ID NO: 505634 - DNA, 16 bp, R. norvegicus
gatgatggagatgatg

SEQ ID NO: 505635 - DNA, 16 bp, R. norvegicus
gatgatgggagggatg

SEQ ID NO: 505636 - DNA, 16 bp, R. norvegicus
gatgatggtgatgagg

SEQ ID NO: 505637 - DNA, 16 bp, R. norvegicus
gatgatggtggcggtg

SEQ ID NO: 505638 - DNA, 16 bp, R. norvegicus
gatgatggtggtgata

SEQ ID NO: 505639 - DNA, 16 bp, R. norvegicus
gatgatgtcacaggta

SEQ ID NO: 505640 - DNA, 16 bp, R. norvegicus
gatgatgtcactgaga

SEQ ID NO: 505641 - DNA, 16 bp, R. norvegicus
gatgatgttttccagt

SEQ ID NO: 505642 - DNA, 16 bp, R. norvegicus
gatgcaaagaagtgca

SEQ ID NO: 505643 - DNA, 16 bp, R. norvegicus
gatgcaaggaaggaga

SEQ ID NO: 505644 - DNA, 16 bp, R. norvegicus
gatgcagaaatgaacc

SEQ ID NO: 505645 - DNA, 16 bp, R. norvegicus
gatgcagaagcaggtg

SEQ ID NO: 505646 - DNA, 16 bp, R. norvegicus
gatgcagaattctcag

SEQ ID NO: 505647 - DNA, 16 bp, R. norvegicus
gatgcagagacccaga

SEQ ID NO: 505648 - DNA, 16 bp, R. norvegicus
gatgcagaggccctgg

SEQ ID NO: 505649 - DNA, 16 bp, R. norvegicus
gatgcagagtctggag

SEQ ID NO: 505650 - DNA, 16 bp, R. norvegicus
gatgcagatgaggatg

SEQ ID NO: 505651 - DNA, 16 bp, R. norvegicus
gatgcagcattttgct

SEQ ID NO: 505652 - DNA, 16 bp, R. norvegicus
gatgcagctcagctgg

SEQ ID NO: 505653 - DNA, 16 bp, R. norvegicus
gatgcaggagctgatg

SEQ ID NO: 505654 - DNA, 16 bp, R. norvegicus
gatgcaggaggagctg

SEQ ID NO: 505655 - DNA, 16 bp, R. norvegicus
gatgcagtgtgaccag

SEQ ID NO: 505656 - DNA, 16 bp, R. norvegicus
gatgccaagatgtgct

SEQ ID NO: 505657 - DNA, 16 bp, R. norvegicus
gatgccaagcagtgtg

SEQ ID NO: 505658 - DNA, 16 bp, R. norvegicus
gatgccagtatcatgg

SEQ ID NO: 505659 - DNA, 16 bp, R. norvegicus
gatgccattgtctggc

SEQ ID NO: 505660 - DNA, 16 bp, R. norvegicus
gatgccattttcatga

SEQ ID NO: 505661 - DNA, 16 bp, R. norvegicus
gatgcccaacaagacc

SEQ ID NO: 505662 - DNA, 16 bp, R. norvegicus
gatgcccaggagagag

SEQ ID NO: 505663 - DNA, 17 bp, R. norvegicus
gatgcccagtgatatga

SEQ ID NO: 505664 - DNA, 20 bp, R. norvegicus
gatgccccaacatataaaga

SEQ ID NO: 505665 - DNA, 16 bp, R. norvegicus
gatgccctcttctgct

SEQ ID NO: 505666 - DNA, 16 bp, R. norvegicus
gatgccctcttctggc

SEQ ID NO: 505667 - DNA, 16 bp, R. norvegicus
gatgccctctttgggt

SEQ ID NO: 505668 - DNA, 16 bp, R. norvegicus
gatgccctggacctgg

SEQ ID NO: 505669 - DNA, 16 bp, R. norvegicus
gatgccctggagctgg

SEQ ID NO: 505670 - DNA, 16 bp, R. norvegicus
gatgccctgggtgcag

SEQ ID NO: 505671 - DNA, 16 bp, R. norvegicus
gatgcccttcaccaga

SEQ ID NO: 505672 - DNA, 16 bp, R. norvegicus
gatgcccttcatcaga

SEQ ID NO: 505673 - DNA, 16 bp, R. norvegicus
gatgcctttgctgaaa

SEQ ID NO: 505674 - DNA, 16 bp, R. norvegicus
gatgcgaagaaagagg

SEQ ID NO: 505675 - DNA, 16 bp, R. norvegicus
gatgctccccctcccc

SEQ ID NO: 505676 - DNA, 16 bp, R. norvegicus
gatgctcctccaccca

SEQ ID NO: 505677 - DNA, 16 bp, R. norvegicus
gatgctgacaaagcat

SEQ ID NO: 505678 - DNA, 16 bp, R. norvegicus
gatgctgagaaccaaa

SEQ ID NO: 505679 - DNA, 16 bp, R. norvegicus
gatgctgagatgctga

SEQ ID NO: 505680 - DNA, 16 bp, R. norvegicus
gatgctgaggatgctg

SEQ ID NO: 505681 - DNA, 16 bp, R. norvegicus
gatgctgaggcagaag

SEQ ID NO: 505682 - DNA, 16 bp, R. norvegicus
gatgctgccatgctcc

SEQ ID NO: 505683 - DNA, 16 bp, R. norvegicus
gatgctgccattttcc

SEQ ID NO: 505684 - DNA, 16 bp, R. norvegicus
gatgctgccctgctcc

SEQ ID NO: 505685 - DNA, 16 bp, R. norvegicus
gatgctgctgatgctg

SEQ ID NO: 505686 - DNA, 16 bp, R. norvegicus
gatgctgctgctgttg

SEQ ID NO: 505687 - DNA, 16 bp, R. norvegicus
gatgctggaaaggatg

SEQ ID NO: 505688 - DNA, 16 bp, R. norvegicus
gatgctggagaggatg

SEQ ID NO: 505689 - DNA, 16 bp, R. norvegicus
gatgctggagcggtgg

SEQ ID NO: 505690 - DNA, 16 bp, R. norvegicus
gatgctggaggacttg

SEQ ID NO: 505691 - DNA, 16 bp, R. norvegicus
gatgctggaggatttc

SEQ ID NO: 505692 - DNA, 16 bp, R. norvegicus
gatgctggcaaggagg

SEQ ID NO: 505693 - DNA, 16 bp, R. norvegicus
gatgctgggatgctgg

SEQ ID NO: 505694 - DNA, 16 bp, R. norvegicus
gatgctggggactgaa

SEQ ID NO: 505695 - DNA, 16 bp, R. norvegicus
gatgctggggagatgg

SEQ ID NO: 505696 - DNA, 17 bp, R. norvegicus
gatgctgggggacttca

SEQ ID NO: 505697 - DNA, 16 bp, R. norvegicus
gatgctgtacccatcc

SEQ ID NO: 505698 - DNA, 16 bp, R. norvegicus
gatgctgtcattagga

SEQ ID NO: 505699 - DNA, 16 bp, R. norvegicus
gatgctgtctccagcc

SEQ ID NO: 505700 - DNA, 16 bp, R. norvegicus
gatgctgtgcagtggt

SEQ ID NO: 505701 - DNA, 16 bp, R. norvegicus
gatgctttctctcctg

SEQ ID NO: 505702 - DNA, 16 bp, R. norvegicus
gatgcttttgaggagc

SEQ ID NO: 505703 - DNA, 16 bp, R. norvegicus
gatggaaacagatgta

SEQ ID NO: 505704 - DNA, 16 bp, R. norvegicus
gatggaaaccagaagg

SEQ ID NO: 505705 - DNA, 16 bp, R. norvegicus
gatggaaatggaaaag

SEQ ID NO: 505706 - DNA, 16 bp, R. norvegicus
gatggaagaagcaaag

SEQ ID NO: 505707 - DNA, 67 bp, R. norvegicus
gatggaagagagaatctcaggagcagaagattccatagaaatcattgactcaactgtcaaagataac

SEQ ID NO: 505708 - DNA, 16 bp, R. norvegicus
gatggaagagagactc

SEQ ID NO: 505709 - DNA, 17 bp, R. norvegicus
gatggaaggccctcact

SEQ ID NO: 505710 - DNA, 16 bp, R. norvegicus
gatggaattggaaaat

SEQ ID NO: 505711 - DNA, 16 bp, R. norvegicus
gatggacagacaaaca

SEQ ID NO: 505712 - DNA, 16 bp, R. norvegicus
gatggacagatggatg

SEQ ID NO: 505713 - DNA, 16 bp, R. norvegicus
gatggacaggaaactg

SEQ ID NO: 505714 - DNA, 83 bp, R. norvegicus
gatggagaaaccaagatattccatgacaaaaccaaatttacacaatatctttctacaaatccagcactacaaaggataataaa

SEQ ID NO: 505715 - DNA, 16 bp, R. norvegicus
gatggagaaggagctg

SEQ ID NO: 505716 - DNA, 16 bp, R. norvegicus
gatggagagaaccagt

SEQ ID NO: 505717 - DNA, 16 bp, R. norvegicus
gatggagagagacaga

SEQ ID NO: 505718 - DNA, 16 bp, R. norvegicus
gatggagatgatgatg

SEQ ID NO: 505719 - DNA, 16 bp, R. norvegicus
gatggagatgatggag

SEQ ID NO: 505720 - DNA, 16 bp, R. norvegicus
gatggagatggtggtg

SEQ ID NO: 505721 - DNA, 16 bp, R. norvegicus
gatggagcagaaattg

SEQ ID NO: 505722 - DNA, 16 bp, R. norvegicus
gatggagctgctgctg

SEQ ID NO: 505723 - DNA, 16 bp, R. norvegicus
gatggaggaaaaaatt

SEQ ID NO: 505724 - DNA, 16 bp, R. norvegicus
gatggaggacatcaag

SEQ ID NO: 505725 - DNA, 16 bp, R. norvegicus
gatggaggagctgaga

SEQ ID NO: 505726 - DNA, 16 bp, R. norvegicus
gatggaggcagagaag

SEQ ID NO: 505727 - DNA, 16 bp, R. norvegicus
gatggaggcctggctt

SEQ ID NO: 505728 - DNA, 16 bp, R. norvegicus
gatggaggtgatggag

SEQ ID NO: 505729 - DNA, 16 bp, R. norvegicus
gatggatacagaaaat

SEQ ID NO: 505730 - DNA, 16 bp, R. norvegicus
gatggatagacagaga

SEQ ID NO: 505731 - DNA, 16 bp, R. norvegicus
gatggatagatggatg

SEQ ID NO: 505732 - DNA, 16 bp, R. norvegicus
gatggatcccaagatg

SEQ ID NO: 505733 - DNA, 16 bp, R. norvegicus
gatggatcccctggaa

SEQ ID NO: 505734 - DNA, 16 bp, R. norvegicus
gatggatctctgagtt

SEQ ID NO: 505735 - DNA, 16 bp, R. norvegicus
gatggatctctgcatt

SEQ ID NO: 505736 - DNA, 16 bp, R. norvegicus
gatggatgaagcaaat

SEQ ID NO: 505737 - DNA, 16 bp, R. norvegicus
gatggatgatggatgg

SEQ ID NO: 505738 - DNA, 16 bp, R. norvegicus
gatggatggacacaca

SEQ ID NO: 505739 - DNA, 16 bp, R. norvegicus
gatggatggacagatg

SEQ ID NO: 505740 - DNA, 16 bp, R. norvegicus
gatggatggacggatg

SEQ ID NO: 505741 - DNA, 16 bp, R. norvegicus
gatggatggataatga

SEQ ID NO: 505742 - DNA, 16 bp, R. norvegicus
gatggatggatggatg

SEQ ID NO: 505743 - DNA, 16 bp, R. norvegicus
gatggattccaaggtg

SEQ ID NO: 505744 - DNA, 16 bp, R. norvegicus
gatggcaaagccttcc

SEQ ID NO: 505745 - DNA, 16 bp, R. norvegicus
gatggcaagaggcaag

SEQ ID NO: 505746 - DNA, 16 bp, R. norvegicus
gatggcaagaggcagg

SEQ ID NO: 505747 - DNA, 16 bp, R. norvegicus
gatggcaaggatgtgg

SEQ ID NO: 505748 - DNA, 16 bp, R. norvegicus
gatggcactacccaca

SEQ ID NO: 505749 - DNA, 16 bp, R. norvegicus
gatggcactaggcatt

SEQ ID NO: 505750 - DNA, 16 bp, R. norvegicus
gatggcactgacatct

SEQ ID NO: 505751 - DNA, 16 bp, R. norvegicus
gatggcaggcacattc

SEQ ID NO: 505752 - DNA, 16 bp, R. norvegicus
gatggcagtggtggtg

SEQ ID NO: 505753 - DNA, 23 bp, R. norvegicus
gatggcccctctggaaagctgtg

SEQ ID NO: 505754 - DNA, 16 bp, R. norvegicus
gatggcgatgatgatg

SEQ ID NO: 505755 - DNA, 16 bp, R. norvegicus
gatggcgctgacatct

SEQ ID NO: 505756 - DNA, 16 bp, R. norvegicus
gatggctatgaaccac

SEQ ID NO: 505757 - DNA, 16 bp, R. norvegicus
gatggctcagcggtca

SEQ ID NO: 505758 - DNA, 16 bp, R. norvegicus
gatggctcagtggttt

SEQ ID NO: 505759 - DNA, 17 bp, R. norvegicus
gatggctccgcggttaa

SEQ ID NO: 505760 - DNA, 16 bp, R. norvegicus
gatggctctgactgtg

SEQ ID NO: 505761 - DNA, 16 bp, R. norvegicus
gatggctgtgagctgt

SEQ ID NO: 505762 - DNA, 16 bp, R. norvegicus
gatggcttctggtggg

SEQ ID NO: 505763 - DNA, 16 bp, R. norvegicus
gatgggaaaccagaaa

SEQ ID NO: 505764 - DNA, 16 bp, R. norvegicus
gatgggaaccccacag

SEQ ID NO: 505765 - DNA, 16 bp, R. norvegicus
gatgggatgagagggt

SEQ ID NO: 505766 - DNA, 16 bp, R. norvegicus
gatgggcatctcactg

SEQ ID NO: 505767 - DNA, 16 bp, R. norvegicus
gatgggctgtgacctg

SEQ ID NO: 505768 - DNA, 16 bp, R. norvegicus
gatggggaactgtggg

SEQ ID NO: 505769 - DNA, 16 bp, R. norvegicus
gatggggaagatgatg

SEQ ID NO: 505770 - DNA, 16 bp, R. norvegicus
gatggggacacccacc

SEQ ID NO: 505771 - DNA, 16 bp, R. norvegicus
gatggggagacaggag

SEQ ID NO: 505772 - DNA, 16 bp, R. norvegicus
gatggggaggaggtat

SEQ ID NO: 505773 - DNA, 16 bp, R. norvegicus
gatggggatgggaaca

SEQ ID NO: 505774 - DNA, 16 bp, R. norvegicus
gatggggctggagaga

SEQ ID NO: 505775 - DNA, 16 bp, R. norvegicus
gatggggctggaggga

SEQ ID NO: 505776 - DNA, 16 bp, R. norvegicus
gatggggctggggaga

SEQ ID NO: 505777 - DNA, 16 bp, R. norvegicus
gatgggggctggggat

SEQ ID NO: 505778 - DNA, 16 bp, R. norvegicus
gatgggtaaactgagg

SEQ ID NO: 505779 - DNA, 16 bp, R. norvegicus
gatgggtattgcactg

SEQ ID NO: 505780 - DNA, 16 bp, R. norvegicus
gatgggtttaatgaag

SEQ ID NO: 505781 - DNA, 16 bp, R. norvegicus
gatgggtttagtgaag

SEQ ID NO: 505782 - DNA, 16 bp, R. norvegicus
gatgggttttcctgtt

SEQ ID NO: 505783 - DNA, 16 bp, R. norvegicus
gatggtccaacataca

SEQ ID NO: 505784 - DNA, 16 bp, R. norvegicus
gatggtgaacatttct

SEQ ID NO: 505785 - DNA, 16 bp, R. norvegicus
gatggtgacagtgatg

SEQ ID NO: 505786 - DNA, 16 bp, R. norvegicus
gatggtgagaggcaag

SEQ ID NO: 505787 - DNA, 16 bp, R. norvegicus
gatggtgagtggatgg

SEQ ID NO: 505788 - DNA, 16 bp, R. norvegicus
gatggtgatgatgata

SEQ ID NO: 505789 - DNA, 17 bp, R. norvegicus
gatggtgatgatggtgg

SEQ ID NO: 505790 - DNA, 16 bp, R. norvegicus
gatggtgatggtgatg

SEQ ID NO: 505791 - DNA, 16 bp, R. norvegicus
gatggtgcatgtcttt

SEQ ID NO: 505792 - DNA, 16 bp, R. norvegicus
gatggtggagcaggaa

SEQ ID NO: 505793 - DNA, 16 bp, R. norvegicus
gatggtggtgctggtg

SEQ ID NO: 505794 - DNA, 16 bp, R. norvegicus
gatggtggtggagatg

SEQ ID NO: 505795 - DNA, 16 bp, R. norvegicus
gatggtggtggtaatg

SEQ ID NO: 505796 - DNA, 16 bp, R. norvegicus
gatggttgctgttttg

SEQ ID NO: 505797 - DNA, 16 bp, R. norvegicus
gatggttgtgaacctc

SEQ ID NO: 505798 - DNA, 16 bp, R. norvegicus
gatggttgtgaatcac

SEQ ID NO: 505799 - DNA, 16 bp, R. norvegicus
gatggtttaatacacg

SEQ ID NO: 505800 - DNA, 16 bp, R. norvegicus
gatgtaaagaaacagc

SEQ ID NO: 505801 - DNA, 16 bp, R. norvegicus
gatgtaagctttcagc

SEQ ID NO: 505802 - DNA, 16 bp, R. norvegicus
gatgtacatgtgaact

SEQ ID NO: 505803 - DNA, 16 bp, R. norvegicus
gatgtaccacattatc

SEQ ID NO: 505804 - DNA, 16 bp, R. norvegicus
gatgtagacctctcag

SEQ ID NO: 505805 - DNA, 16 bp, R. norvegicus
gatgtagttcagttgg

SEQ ID NO: 505806 - DNA, 16 bp, R. norvegicus
gatgtcacaagtgttg

SEQ ID NO: 505807 - DNA, 16 bp, R. norvegicus
gatgtcagctgagaca

SEQ ID NO: 505808 - DNA, 16 bp, R. norvegicus
gatgtcatacaggccc

SEQ ID NO: 505809 - DNA, 20 bp, R. norvegicus
gatgtccaattttctgagga

SEQ ID NO: 505810 - DNA, 17 bp, R. norvegicus
gatgtcctgacagctaa

SEQ ID NO: 505811 - DNA, 16 bp, R. norvegicus
gatgtcctggtcctct

SEQ ID NO: 505812 - DNA, 16 bp, R. norvegicus
gatgtccttgaacaga

SEQ ID NO: 505813 - DNA, 16 bp, R. norvegicus
gatgtcctttgcctta

SEQ ID NO: 505814 - DNA, 16 bp, R. norvegicus
gatgtctcctgagagg

SEQ ID NO: 505815 - DNA, 16 bp, R. norvegicus
gatgtctccttcctct

SEQ ID NO: 505816 - DNA, 16 bp, R. norvegicus
gatgtctgaccctgtg

SEQ ID NO: 505817 - DNA, 16 bp, R. norvegicus
gatgtctgtctgtctg

SEQ ID NO: 505818 - DNA, 16 bp, R. norvegicus
gatgtcttcctgccag

SEQ ID NO: 505819 - DNA, 16 bp, R. norvegicus
gatgtcttctggcctc

SEQ ID NO: 505820 - DNA, 16 bp, R. norvegicus
gatgtgaagaaagaag

SEQ ID NO: 505821 - DNA, 16 bp, R. norvegicus
gatgtgagaaggccca

SEQ ID NO: 505822 - DNA, 16 bp, R. norvegicus
gatgtggaaaaagaag

SEQ ID NO: 505823 - DNA, 16 bp, R. norvegicus
gatgtggagaaaatgg

SEQ ID NO: 505824 - DNA, 16 bp, R. norvegicus
gatgtggagaaagaaa

SEQ ID NO: 505825 - DNA, 16 bp, R. norvegicus
gatgtggatgctcgca

SEQ ID NO: 505826 - DNA, 16 bp, R. norvegicus
gatgtggatgcttaca

SEQ ID NO: 505827 - DNA, 16 bp, R. norvegicus
gatgtgtggacagagg

SEQ ID NO: 505828 - DNA, 16 bp, R. norvegicus
gatgtgtgtggtgatg

SEQ ID NO: 505829 - DNA, 16 bp, R. norvegicus
gatgtgttttcatttt

SEQ ID NO: 505830 - DNA, 16 bp, R. norvegicus
gatgttagagatgtca

SEQ ID NO: 505831 - DNA, 16 bp, R. norvegicus
gatgttgaaaaagcat

SEQ ID NO: 505832 - DNA, 16 bp, R. norvegicus
gatgttgaacatttca

SEQ ID NO: 505833 - DNA, 30 bp, R. norvegicus
gatgttgaacatttctttaggtgtttctcc

SEQ ID NO: 505834 - DNA, 16 bp, R. norvegicus
gatgttgaatgtttct

SEQ ID NO: 505835 - DNA, 16 bp, R. norvegicus
gatgttgttgatgatg

SEQ ID NO: 505836 - DNA, 16 bp, R. norvegicus
gatgtttatttacagt

SEQ ID NO: 505837 - DNA, 16 bp, R. norvegicus
gatgtttcagttcttc

SEQ ID NO: 505838 - DNA, 16 bp, R. norvegicus
gatgtttgctggccct

SEQ ID NO: 505839 - DNA, 16 bp, R. norvegicus
gatgtttgtgaaggaa

SEQ ID NO: 505840 - DNA, 16 bp, R. norvegicus
gatgtttgtgagctgc

SEQ ID NO: 505841 - DNA, 16 bp, R. norvegicus
gattaaaagtgtgcac

SEQ ID NO: 505842 - DNA, 16 bp, R. norvegicus
gattaaaggtgtgtac

SEQ ID NO: 505843 - DNA, 16 bp, R. norvegicus
gattaaagtcctggaa

SEQ ID NO: 505844 - DNA, 16 bp, R. norvegicus
gattaagaagagacca

SEQ ID NO: 505845 - DNA, 20 bp, R. norvegicus
gattaaggagccagcaggtg

SEQ ID NO: 505846 - DNA, 16 bp, R. norvegicus
gattacaagcacacac

SEQ ID NO: 505847 - DNA, 16 bp, R. norvegicus
gattacagcctgtgga

SEQ ID NO: 505848 - DNA, 16 bp, R. norvegicus
gattaccttatataga

SEQ ID NO: 505849 - DNA, 16 bp, R. norvegicus
gattactaacaaggaa

SEQ ID NO: 505850 - DNA, 16 bp, R. norvegicus
gattactcttccagag

SEQ ID NO: 505851 - DNA, 16 bp, R. norvegicus
gattatgaagagaatg

SEQ ID NO: 505852 - DNA, 16 bp, R. norvegicus
gattatggaaacagaa

SEQ ID NO: 505853 - DNA, 16 bp, R. norvegicus
gattattatgtggtga

SEQ ID NO: 505854 - DNA, 16 bp, R. norvegicus
gattcaatccctagca

SEQ ID NO: 505855 - DNA, 16 bp, R. norvegicus
gattcagatgaggatg

SEQ ID NO: 505856 - DNA, 16 bp, R. norvegicus
gattcagtttctgaga

SEQ ID NO: 505857 - DNA, 16 bp, R. norvegicus
gattcatttacacagt

SEQ ID NO: 505858 - DNA, 16 bp, R. norvegicus
gattcatttttaaaat

SEQ ID NO: 505859 - DNA, 17 bp, R. norvegicus
gattccagaggaaaaca

SEQ ID NO: 505860 - DNA, 16 bp, R. norvegicus
gattccatctcacccc

SEQ ID NO: 505861 - DNA, 16 bp, R. norvegicus
gattccattcccagca

SEQ ID NO: 505862 - DNA, 16 bp, R. norvegicus
gattcccagcattcac

SEQ ID NO: 505863 - DNA, 16 bp, R. norvegicus
gattcccaggacccaa

SEQ ID NO: 505864 - DNA, 16 bp, R. norvegicus
gattccccctgcctct

SEQ ID NO: 505865 - DNA, 16 bp, R. norvegicus
gattccctcttcccca

SEQ ID NO: 505866 - DNA, 16 bp, R. norvegicus
gattcctccagaaatt

SEQ ID NO: 505867 - DNA, 16 bp, R. norvegicus
gattcctctctgcaca

SEQ ID NO: 505868 - DNA, 16 bp, R. norvegicus
gattcctgatcttaga

SEQ ID NO: 505869 - DNA, 16 bp, R. norvegicus
gattcctgcacttgcc

SEQ ID NO: 505870 - DNA, 16 bp, R. norvegicus
gattctattgaccttg

SEQ ID NO: 505871 - DNA, 16 bp, R. norvegicus
gattctcagccatttg

SEQ ID NO: 505872 - DNA, 16 bp, R. norvegicus
gattctcagctcaaag

SEQ ID NO: 505873 - DNA, 16 bp, R. norvegicus
gattctccctcccctt

SEQ ID NO: 505874 - DNA, 16 bp, R. norvegicus
gattctcctgcctcag

SEQ ID NO: 505875 - DNA, 16 bp, R. norvegicus
gattctcctgccttca

SEQ ID NO: 505876 - DNA, 16 bp, R. norvegicus
gattctcctggaagtc

SEQ ID NO: 505877 - DNA, 16 bp, R. norvegicus
gattctctcttctatg

SEQ ID NO: 505878 - DNA, 16 bp, R. norvegicus
gattctgatgggtctg

SEQ ID NO: 505879 - DNA, 25 bp, R. norvegicus
gattctggccaagaggatcaatgtg

SEQ ID NO: 505880 - DNA, 16 bp, R. norvegicus
gattctgggaaatagt

SEQ ID NO: 505881 - DNA, 16 bp, R. norvegicus
gattctgggaaccaaa

SEQ ID NO: 505882 - DNA, 16 bp, R. norvegicus
gattctgttctcagtt

SEQ ID NO: 505883 - DNA, 16 bp, R. norvegicus
gattcttgtgctttct

SEQ ID NO: 505884 - DNA, 16 bp, R. norvegicus
gattcttttctcatat

SEQ ID NO: 505885 - DNA, 16 bp, R. norvegicus
gattgaaaaagctgaa

SEQ ID NO: 505886 - DNA, 16 bp, R. norvegicus
gattgaagagctgaag

SEQ ID NO: 505887 - DNA, 16 bp, R. norvegicus
gattgacacaatggtc

SEQ ID NO: 505888 - DNA, 16 bp, R. norvegicus
gattgaggaagacact

SEQ ID NO: 505889 - DNA, 16 bp, R. norvegicus
gattgcaagctgctac

SEQ ID NO: 505890 - DNA, 16 bp, R. norvegicus
gattgcagggagacaa

SEQ ID NO: 505891 - DNA, 16 bp, R. norvegicus
gattgctctatgccct

SEQ ID NO: 505892 - DNA, 16 bp, R. norvegicus
gattgctgagttcaag

SEQ ID NO: 505893 - DNA, 16 bp, R. norvegicus
gattgcttcaagttgc

SEQ ID NO: 505894 - DNA, 16 bp, R. norvegicus
gattgcttcaagtttt

SEQ ID NO: 505895 - DNA, 16 bp, R. norvegicus
gattgctttcttctct

SEQ ID NO: 505896 - DNA, 16 bp, R. norvegicus
gattggaaaagaagag

SEQ ID NO: 505897 - DNA, 16 bp, R. norvegicus
gattggcaggataaat

SEQ ID NO: 505898 - DNA, 16 bp, R. norvegicus
gattgggagttcaagg

SEQ ID NO: 505899 - DNA, 16 bp, R. norvegicus
gattgggttgcctcat

SEQ ID NO: 505900 - DNA, 18 bp, R. norvegicus
gattggtgcggcatgaac

SEQ ID NO: 505901 - DNA, 16 bp, R. norvegicus
gattgtaggcatgtgc

SEQ ID NO: 505902 - DNA, 16 bp, R. norvegicus
gattgtcatcctggat

SEQ ID NO: 505903 - DNA, 16 bp, R. norvegicus
gattgtcgtcctggat

SEQ ID NO: 505904 - DNA, 16 bp, R. norvegicus
gattgtggagaaagag

SEQ ID NO: 505905 - DNA, 16 bp, R. norvegicus
gattgtttccaacttc

SEQ ID NO: 505906 - DNA, 16 bp, R. norvegicus
gatttaaattttgctt

SEQ ID NO: 505907 - DNA, 16 bp, R. norvegicus
gatttacttacttatt

SEQ ID NO: 505908 - DNA, 16 bp, R. norvegicus
gatttagtgtgtgtgt

SEQ ID NO: 505909 - DNA, 16 bp, R. norvegicus
gatttcacctcagtaa

SEQ ID NO: 505910 - DNA, 17 bp, R. norvegicus
gatttcacctcgtggat

SEQ ID NO: 505911 - DNA, 16 bp, R. norvegicus
gatttcagagctctgg

SEQ ID NO: 505912 - DNA, 16 bp, R. norvegicus
gatttcaggagagcag

SEQ ID NO: 505913 - DNA, 16 bp, R. norvegicus
gatttcatcttggtgg

SEQ ID NO: 505914 - DNA, 30 bp, R. norvegicus
gatttcccgcgactttagaaagggtctctc

SEQ ID NO: 505915 - DNA, 16 bp, R. norvegicus
gatttccctcagtttg

SEQ ID NO: 505916 - DNA, 16 bp, R. norvegicus
gatttcctggtcctct

SEQ ID NO: 505917 - DNA, 16 bp, R. norvegicus
gatttccttttccttt

SEQ ID NO: 505918 - DNA, 16 bp, R. norvegicus
gatttctagaggggaa

SEQ ID NO: 505919 - DNA, 16 bp, R. norvegicus
gatttctctgagtttg

SEQ ID NO: 505920 - DNA, 16 bp, R. norvegicus
gatttcttagtgagtg

SEQ ID NO: 505921 - DNA, 16 bp, R. norvegicus
gatttcttttccttct

SEQ ID NO: 505922 - DNA, 16 bp, R. norvegicus
gatttgaaaatggaaa

SEQ ID NO: 505923 - DNA, 16 bp, R. norvegicus
gatttgaaagcacagg

SEQ ID NO: 505924 - DNA, 16 bp, R. norvegicus
gatttgaagacccaga

SEQ ID NO: 505925 - DNA, 16 bp, R. norvegicus
gatttgatttgcattt

SEQ ID NO: 505926 - DNA, 16 bp, R. norvegicus
gatttggtggctgcat

SEQ ID NO: 505927 - DNA, 16 bp, R. norvegicus
gatttgttcctgtcta

SEQ ID NO: 505928 - DNA, 16 bp, R. norvegicus
gattttaaaatcagaa

SEQ ID NO: 505929 - DNA, 16 bp, R. norvegicus
gattttaagaaagaca

SEQ ID NO: 505930 - DNA, 16 bp, R. norvegicus
gattttactgtactgt

SEQ ID NO: 505931 - DNA, 16 bp, R. norvegicus
gattttagtgaaattg

SEQ ID NO: 505932 - DNA, 17 bp, R. norvegicus
gattttatcaaggccca

SEQ ID NO: 505933 - DNA, 16 bp, R. norvegicus
gattttcaacaaaaag

SEQ ID NO: 505934 - DNA, 16 bp, R. norvegicus
gattttcaaccaaaag

SEQ ID NO: 505935 - DNA, 16 bp, R. norvegicus
gattttcaagttttga

SEQ ID NO: 505936 - DNA, 18 bp, R. norvegicus
gattttctcaaagaacca

SEQ ID NO: 505937 - DNA, 16 bp, R. norvegicus
gattttctttcctggt

SEQ ID NO: 505938 - DNA, 16 bp, R. norvegicus
gattttgaattttctg

SEQ ID NO: 505939 - DNA, 16 bp, R. norvegicus
gatttttattacaaat

SEQ ID NO: 505940 - DNA, 16 bp, R. norvegicus
gatttttccatctttt

SEQ ID NO: 505941 - DNA, 16 bp, R. norvegicus
gatttttgacaaagaa

SEQ ID NO: 505942 - DNA, 16 bp, R. norvegicus
gatttttttcttcact

SEQ ID NO: 505943 - DNA, 16 bp, R. norvegicus
gattttttttccccct

SEQ ID NO: 505944 - DNA, 16 bp, R. norvegicus
gcaaaaaagtgcaggc

SEQ ID NO: 505945 - DNA, 16 bp, R. norvegicus
gcaaaaaatatacaat

SEQ ID NO: 505946 - DNA, 23 bp, R. norvegicus
gcaaaaatccctgaaagaattgc

SEQ ID NO: 505947 - DNA, 16 bp, R. norvegicus
gcaaaacattctttca

SEQ ID NO: 505948 - DNA, 20 bp, R. norvegicus
gcaaaactctcaattaacat

SEQ ID NO: 505949 - DNA, 16 bp, R. norvegicus
gcaaaagcagttcctg

SEQ ID NO: 505950 - DNA, 16 bp, R. norvegicus
gcaaaagcttttcagt

SEQ ID NO: 505951 - DNA, 16 bp, R. norvegicus
gcaaaatacccacaca

SEQ ID NO: 505952 - DNA, 16 bp, R. norvegicus
gcaaaatccatgatgt

SEQ ID NO: 505953 - DNA, 16 bp, R. norvegicus
gcaaaattgaagttat

SEQ ID NO: 505954 - DNA, 16 bp, R. norvegicus
gcaaacacacctcaga

SEQ ID NO: 505955 - DNA, 16 bp, R. norvegicus
gcaaacacaggtgaaa

SEQ ID NO: 505956 - DNA, 16 bp, R. norvegicus
gcaaacaccttcaact

SEQ ID NO: 505957 - DNA, 16 bp, R. norvegicus
gcaaacactgaacatc

SEQ ID NO: 505958 - DNA, 16 bp, R. norvegicus
gcaaacagttccatga

SEQ ID NO: 505959 - DNA, 16 bp, R. norvegicus
gcaaaccacaacattt

SEQ ID NO: 505960 - DNA, 16 bp, R. norvegicus
gcaaacccctccagct

SEQ ID NO: 505961 - DNA, 16 bp, R. norvegicus
gcaaagaaactagcag

SEQ ID NO: 505962 - DNA, 16 bp, R. norvegicus
gcaaagaaattatatt

SEQ ID NO: 505963 - DNA, 16 bp, R. norvegicus
gcaaagaacaaagagc

SEQ ID NO: 505964 - DNA, 16 bp, R. norvegicus
gcaaagaagaagtaaa

SEQ ID NO: 505965 - DNA, 16 bp, R. norvegicus
gcaaagaagaagtcaa

SEQ ID NO: 505966 - DNA, 16 bp, R. norvegicus
gcaaagaataaaacag

SEQ ID NO: 505967 - DNA, 21 bp, R. norvegicus
gcaaagaattcacagctgagg

SEQ ID NO: 505968 - DNA, 16 bp, R. norvegicus
gcaaagagaaagggca

SEQ ID NO: 505969 - DNA, 17 bp, R. norvegicus
gcaaagagccatcctct

SEQ ID NO: 505970 - DNA, 16 bp, R. norvegicus
gcaaagcacccacaca

SEQ ID NO: 505971 - DNA, 16 bp, R. norvegicus
gcaaagctagagccct

SEQ ID NO: 505972 - DNA, 16 bp, R. norvegicus
gcaaagctgagagttc

SEQ ID NO: 505973 - DNA, 16 bp, R. norvegicus
gcaaaggctgctggcc

SEQ ID NO: 505974 - DNA, 16 bp, R. norvegicus
gcaaagggcactgtgg

SEQ ID NO: 505975 - DNA, 20 bp, R. norvegicus
gcaaaggggacgtcccaact

SEQ ID NO: 505976 - DNA, 16 bp, R. norvegicus
gcaaagtcatggctct

SEQ ID NO: 505977 - DNA, 16 bp, R. norvegicus
gcaaagtcctgggttc

SEQ ID NO: 505978 - DNA, 16 bp, R. norvegicus
gcaaagtgacctccaa

SEQ ID NO: 505979 - DNA, 16 bp, R. norvegicus
gcaaatactttaccca

SEQ ID NO: 505980 - DNA, 16 bp, R. norvegicus
gcaaatagacccaaga

SEQ ID NO: 505981 - DNA, 16 bp, R. norvegicus
gcaaatatatatatat

SEQ ID NO: 505982 - DNA, 16 bp, R. norvegicus
gcaaatcaaaacaaac

SEQ ID NO: 505983 - DNA, 16 bp, R. norvegicus
gcaaatcaaaaccaca

SEQ ID NO: 505984 - DNA, 16 bp, R. norvegicus
gcaaatccatccattc

SEQ ID NO: 505985 - DNA, 16 bp, R. norvegicus
gcaaatgagtgggtct

SEQ ID NO: 505986 - DNA, 16 bp, R. norvegicus
gcaaatggacagaaga

SEQ ID NO: 505987 - DNA, 16 bp, R. norvegicus
gcaaatgttcattgca

SEQ ID NO: 505988 - DNA, 16 bp, R. norvegicus
gcaaattcatttggta

SEQ ID NO: 505989 - DNA, 16 bp, R. norvegicus
gcaacaaaaataattg

SEQ ID NO: 505990 - DNA, 16 bp, R. norvegicus
gcaacaaaacgaagag

SEQ ID NO: 505991 - DNA, 16 bp, R. norvegicus
gcaacaaccacagcag

SEQ ID NO: 505992 - DNA, 16 bp, R. norvegicus
gcaacagaaaagtaac

SEQ ID NO: 505993 - DNA, 16 bp, R. norvegicus
gcaacagaagagaatt

SEQ ID NO: 505994 - DNA, 16 bp, R. norvegicus
gcaacagagtcagaga

SEQ ID NO: 505995 - DNA, 16 bp, R. norvegicus
gcaacagcatgagttg

SEQ ID NO: 505996 - DNA, 16 bp, R. norvegicus
gcaacagtcagctgtg

SEQ ID NO: 505997 - DNA, 16 bp, R. norvegicus
gcaacagtcttccggg

SEQ ID NO: 505998 - DNA, 16 bp, R. norvegicus
gcaaccaagagcaatg

SEQ ID NO: 505999 - DNA, 16 bp, R. norvegicus
gcaaccactctggaaa

SEQ ID NO: 506000 - DNA, 17 bp, R. norvegicus
gcaaccagggagacctg

SEQ ID NO: 506001 - DNA, 16 bp, R. norvegicus
gcaaccagtgctccta

SEQ ID NO: 506002 - DNA, 16 bp, R. norvegicus
gcaaccctaaatatct

SEQ ID NO: 506003 - DNA, 16 bp, R. norvegicus
gcaacctcaggaggaa

SEQ ID NO: 506004 - DNA, 18 bp, R. norvegicus
gcaactacagagagctct

SEQ ID NO: 506005 - DNA, 16 bp, R. norvegicus
gcaactcagacccaaa

SEQ ID NO: 506006 - DNA, 16 bp, R. norvegicus
gcaactccagctccag

SEQ ID NO: 506007 - DNA, 16 bp, R. norvegicus
gcaactccagttccag

SEQ ID NO: 506008 - DNA, 16 bp, R. norvegicus
gcaactcttacagagg

SEQ ID NO: 506009 - DNA, 16 bp, R. norvegicus
gcaactcttataaagg

SEQ ID NO: 506010 - DNA, 16 bp, R. norvegicus
gcaactgaaggaacag

SEQ ID NO: 506011 - DNA, 16 bp, R. norvegicus
gcaactgtgggggtgg

SEQ ID NO: 506012 - DNA, 16 bp, R. norvegicus
gcaacttagagaagga

SEQ ID NO: 506013 - DNA, 16 bp, R. norvegicus
gcaacttatagaagaa

SEQ ID NO: 506014 - DNA, 16 bp, R. norvegicus
gcaacttcaggcccaa

SEQ ID NO: 506015 - DNA, 16 bp, R. norvegicus
gcaagaaaattaacat

SEQ ID NO: 506016 - DNA, 16 bp, R. norvegicus
gcaagaaactaatcac

SEQ ID NO: 506017 - DNA, 16 bp, R. norvegicus
gcaagaaagatgcctg

SEQ ID NO: 506018 - DNA, 16 bp, R. norvegicus
gcaagaacagggcagt

SEQ ID NO: 506019 - DNA, 16 bp, R. norvegicus
gcaagaacctggaggc

SEQ ID NO: 506020 - DNA, 16 bp, R. norvegicus
gcaagaagcagctgga

SEQ ID NO: 506021 - DNA, 16 bp, R. norvegicus
gcaagaccaaggactt

SEQ ID NO: 506022 - DNA, 16 bp, R. norvegicus
gcaagagaagccagtg

SEQ ID NO: 506023 - DNA, 16 bp, R. norvegicus
gcaagagacaagcaca

SEQ ID NO: 506024 - DNA, 16 bp, R. norvegicus
gcaagagcaagaggag

SEQ ID NO: 506025 - DNA, 16 bp, R. norvegicus
gcaagagcagcaagca

SEQ ID NO: 506026 - DNA, 16 bp, R. norvegicus
gcaagagcagcaggca

SEQ ID NO: 506027 - DNA, 16 bp, R. norvegicus
gcaagagcagccaggg

SEQ ID NO: 506028 - DNA, 16 bp, R. norvegicus
gcaagaggagctgaga

SEQ ID NO: 506029 - DNA, 16 bp, R. norvegicus
gcaagaggatctctgt

SEQ ID NO: 506030 - DNA, 16 bp, R. norvegicus
gcaagaggcaagtaca

SEQ ID NO: 506031 - DNA, 16 bp, R. norvegicus
gcaagatctctgagtt

SEQ ID NO: 506032 - DNA, 16 bp, R. norvegicus
gcaagattggctatga

SEQ ID NO: 506033 - DNA, 16 bp, R. norvegicus
gcaagcaaatgaacaa

SEQ ID NO: 506034 - DNA, 16 bp, R. norvegicus
gcaagcacaagaacat

SEQ ID NO: 506035 - DNA, 16 bp, R. norvegicus
gcaagcacaaggcctt

SEQ ID NO: 506036 - DNA, 16 bp, R. norvegicus
gcaagcacccttacct

SEQ ID NO: 506037 - DNA, 16 bp, R. norvegicus
gcaagcacctttaccc

SEQ ID NO: 506038 - DNA, 16 bp, R. norvegicus
gcaagcacctttccct

SEQ ID NO: 506039 - DNA, 16 bp, R. norvegicus
gcaagcagagagggag

SEQ ID NO: 506040 - DNA, 16 bp, R. norvegicus
gcaagcatgtggtgca

SEQ ID NO: 506041 - DNA, 16 bp, R. norvegicus
gcaagcattctgccaa

SEQ ID NO: 506042 - DNA, 16 bp, R. norvegicus
gcaagccagtgagcag

SEQ ID NO: 506043 - DNA, 16 bp, R. norvegicus
gcaagccccagggatt

SEQ ID NO: 506044 - DNA, 16 bp, R. norvegicus
gcaagcctgtggagca

SEQ ID NO: 506045 - DNA, 16 bp, R. norvegicus
gcaagcgctttaccca

SEQ ID NO: 506046 - DNA, 16 bp, R. norvegicus
gcaagcgttctaccac

SEQ ID NO: 506047 - DNA, 16 bp, R. norvegicus
gcaagctccaggttca

SEQ ID NO: 506048 - DNA, 16 bp, R. norvegicus
gcaagctgagaaagaa

SEQ ID NO: 506049 - DNA, 16 bp, R. norvegicus
gcaagctgagcaagct

SEQ ID NO: 506050 - DNA, 16 bp, R. norvegicus
gcaagctgagcaagtc

SEQ ID NO: 506051 - DNA, 22 bp, R. norvegicus
gcaagcttaagcccggaccaaa

SEQ ID NO: 506052 - DNA, 16 bp, R. norvegicus
gcaagcttcaggccag

SEQ ID NO: 506053 - DNA, 16 bp, R. norvegicus
gcaaggaaaagatctg

SEQ ID NO: 506054 - DNA, 16 bp, R. norvegicus
gcaaggacagtctcac

SEQ ID NO: 506055 - DNA, 16 bp, R. norvegicus
gcaaggacatcatgaa

SEQ ID NO: 506056 - DNA, 16 bp, R. norvegicus
gcaaggagattacatt

SEQ ID NO: 506057 - DNA, 16 bp, R. norvegicus
gcaaggatgtggaaaa

SEQ ID NO: 506058 - DNA, 16 bp, R. norvegicus
gcaaggatgtggagga

SEQ ID NO: 506059 - DNA, 16 bp, R. norvegicus
gcaaggccccgggttc

SEQ ID NO: 506060 - DNA, 16 bp, R. norvegicus
gcaaggccctgggctc

SEQ ID NO: 506061 - DNA, 16 bp, R. norvegicus
gcaagggcctgggttc

SEQ ID NO: 506062 - DNA, 16 bp, R. norvegicus
gcaaggggagcaccag

SEQ ID NO: 506063 - DNA, 16 bp, R. norvegicus
gcaaggtcctgggttc

SEQ ID NO: 506064 - DNA, 16 bp, R. norvegicus
gcaagtccaaggccag

SEQ ID NO: 506065 - DNA, 16 bp, R. norvegicus
gcaagtggagggaact

SEQ ID NO: 506066 - DNA, 16 bp, R. norvegicus
gcaagtggatttctga

SEQ ID NO: 506067 - DNA, 16 bp, R. norvegicus
gcaagtgtccctgtgg

SEQ ID NO: 506068 - DNA, 16 bp, R. norvegicus
gcaagtgtgtgtgtgt

SEQ ID NO: 506069 - DNA, 16 bp, R. norvegicus
gcaagttcaagaccaa

SEQ ID NO: 506070 - DNA, 16 bp, R. norvegicus
gcaagttgaaaatgaa

SEQ ID NO: 506071 - DNA, 16 bp, R. norvegicus
gcaagttggagagaaa

SEQ ID NO: 506072 - DNA, 16 bp, R. norvegicus
gcaagtttgaagccag

SEQ ID NO: 506073 - DNA, 16 bp, R. norvegicus
gcaagttttataaagg

SEQ ID NO: 506074 - DNA, 16 bp, R. norvegicus
gcaataaacatggatg

SEQ ID NO: 506075 - DNA, 16 bp, R. norvegicus
gcaatagagaaagaca

SEQ ID NO: 506076 - DNA, 16 bp, R. norvegicus
gcaatagcccacagag

SEQ ID NO: 506077 - DNA, 16 bp, R. norvegicus
gcaatcagaaaagaaa

SEQ ID NO: 506078 - DNA, 16 bp, R. norvegicus
gcaatcaggaaagtga

SEQ ID NO: 506079 - DNA, 16 bp, R. norvegicus
gcaatcccacctacaa

SEQ ID NO: 506080 - DNA, 16 bp, R. norvegicus
gcaatcctcctgtctc

SEQ ID NO: 506081 - DNA, 16 bp, R. norvegicus
gcaatcctgcctcagc

SEQ ID NO: 506082 - DNA, 16 bp, R. norvegicus
gcaatgatgaaaataa

SEQ ID NO: 506083 - DNA, 16 bp, R. norvegicus
gcaatgatgataaaaa

SEQ ID NO: 506084 - DNA, 16 bp, R. norvegicus
gcaatgctctctctct

SEQ ID NO: 506085 - DNA, 16 bp, R. norvegicus
gcaatgtgtgctttca

SEQ ID NO: 506086 - DNA, 16 bp, R. norvegicus
gcaattcttataaaag

SEQ ID NO: 506087 - DNA, 18 bp, R. norvegicus
gcaatttgggccttttct

SEQ ID NO: 506088 - DNA, 16 bp, R. norvegicus
gcaattttttttatta

SEQ ID NO: 506089 - DNA, 16 bp, R. norvegicus
gcacaaaacatacagg

SEQ ID NO: 506090 - DNA, 16 bp, R. norvegicus
gcacaaacacagacac

SEQ ID NO: 506091 - DNA, 16 bp, R. norvegicus
gcacaacaaacctcac

SEQ ID NO: 506092 - DNA, 16 bp, R. norvegicus
gcacaacacagcatca

SEQ ID NO: 506093 - DNA, 16 bp, R. norvegicus
gcacaagaagtttgca

SEQ ID NO: 506094 - DNA, 16 bp, R. norvegicus
gcacaaggcattttcc

SEQ ID NO: 506095 - DNA, 16 bp, R. norvegicus
gcacaatgcctgcctg

SEQ ID NO: 506096 - DNA, 16 bp, R. norvegicus
gcacacacacacacag

SEQ ID NO: 506097 - DNA, 16 bp, R. norvegicus
gcacacacacagaaac

SEQ ID NO: 506098 - DNA, 16 bp, R. norvegicus
gcacacacacctacac

SEQ ID NO: 506099 - DNA, 16 bp, R. norvegicus
gcacacacactgagca

SEQ ID NO: 506100 - DNA, 16 bp, R. norvegicus
gcacacacagacacac

SEQ ID NO: 506101 - DNA, 16 bp, R. norvegicus
gcacacacagagaaag

SEQ ID NO: 506102 - DNA, 16 bp, R. norvegicus
gcacacacaggcatac

SEQ ID NO: 506103 - DNA, 16 bp, R. norvegicus
gcacacacatgtggat

SEQ ID NO: 506104 - DNA, 16 bp, R. norvegicus
gcacacacctgtgacc

SEQ ID NO: 506105 - DNA, 16 bp, R. norvegicus
gcacacacgtgtgcat

SEQ ID NO: 506106 - DNA, 16 bp, R. norvegicus
gcacacactcagacac

SEQ ID NO: 506107 - DNA, 16 bp, R. norvegicus
gcacacagacagacac

SEQ ID NO: 506108 - DNA, 16 bp, R. norvegicus
gcacacagagctatga

SEQ ID NO: 506109 - DNA, 16 bp, R. norvegicus
gcacacagaggcagag

SEQ ID NO: 506110 - DNA, 16 bp, R. norvegicus
gcacacagctgtaatc

SEQ ID NO: 506111 - DNA, 16 bp, R. norvegicus
gcacacaggggcagca

SEQ ID NO: 506112 - DNA, 16 bp, R. norvegicus
gcacacaggtgagagg

SEQ ID NO: 506113 - DNA, 16 bp, R. norvegicus
gcacacagtaggtgct

SEQ ID NO: 506114 - DNA, 16 bp, R. norvegicus
gcacacagtcagtcag

SEQ ID NO: 506115 - DNA, 16 bp, R. norvegicus
gcacacagtgcacaca

SEQ ID NO: 506116 - DNA, 16 bp, R. norvegicus
gcacacatatacatac

SEQ ID NO: 506117 - DNA, 16 bp, R. norvegicus
gcacacatggtatgca

SEQ ID NO: 506118 - DNA, 16 bp, R. norvegicus
gcacacctgaaagctc

SEQ ID NO: 506119 - DNA, 16 bp, R. norvegicus
gcacacctggctattg

SEQ ID NO: 506120 - DNA, 16 bp, R. norvegicus
gcacacctgtaatccc

SEQ ID NO: 506121 - DNA, 20 bp, R. norvegicus
gcacacgcacacgcacacgc

SEQ ID NO: 506122 - DNA, 16 bp, R. norvegicus
gcacacgtgcacacac

SEQ ID NO: 506123 - DNA, 16 bp, R. norvegicus
gcacactcacacacac

SEQ ID NO: 506124 - DNA, 16 bp, R. norvegicus
gcacacttagaaacct

SEQ ID NO: 506125 - DNA, 16 bp, R. norvegicus
gcacacttgtgcacac

SEQ ID NO: 506126 - DNA, 16 bp, R. norvegicus
gcacagaacacatgga

SEQ ID NO: 506127 - DNA, 16 bp, R. norvegicus
gcacagaagtacacag

SEQ ID NO: 506128 - DNA, 16 bp, R. norvegicus
gcacagacacagagag

SEQ ID NO: 506129 - DNA, 16 bp, R. norvegicus
gcacagaccctcctgg

SEQ ID NO: 506130 - DNA, 16 bp, R. norvegicus
gcacagagacacagag

SEQ ID NO: 506131 - DNA, 16 bp, R. norvegicus
gcacagaggcagagca

SEQ ID NO: 506132 - DNA, 54 bp, R. norvegicus
gcacagaggttttaaggggtggaccaggaatatagcaaatgccctgataaagct

SEQ ID NO: 506133 - DNA, 16 bp, R. norvegicus
gcacagcacacacaac

SEQ ID NO: 506134 - DNA, 16 bp, R. norvegicus
gcacagcaccttccag

SEQ ID NO: 506135 - DNA, 16 bp, R. norvegicus
gcacagcagcagcagg

SEQ ID NO: 506136 - DNA, 16 bp, R. norvegicus
gcacagcagtcacaga

SEQ ID NO: 506137 - DNA, 16 bp, R. norvegicus
gcacagcatcctgcac

SEQ ID NO: 506138 - DNA, 16 bp, R. norvegicus
gcacagcccacatcag

SEQ ID NO: 506139 - DNA, 16 bp, R. norvegicus
gcacagcccactgtgg

SEQ ID NO: 506140 - DNA, 16 bp, R. norvegicus
gcacagctggagtggg

SEQ ID NO: 506141 - DNA, 16 bp, R. norvegicus
gcacagcttacattgt

SEQ ID NO: 506142 - DNA, 16 bp, R. norvegicus
gcacaggagcaggaaa

SEQ ID NO: 506143 - DNA, 16 bp, R. norvegicus
gcacaggaggagctga

SEQ ID NO: 506144 - DNA, 16 bp, R. norvegicus
gcacaggatggcattg

SEQ ID NO: 506145 - DNA, 16 bp, R. norvegicus
gcacaggcacacagac

SEQ ID NO: 506146 - DNA, 16 bp, R. norvegicus
gcacaggcacaggcag

SEQ ID NO: 506147 - DNA, 16 bp, R. norvegicus
gcacaggcacatacac

SEQ ID NO: 506148 - DNA, 16 bp, R. norvegicus
gcacaggcagaaacca

SEQ ID NO: 506149 - DNA, 16 bp, R. norvegicus
gcacaggcagacatgg

SEQ ID NO: 506150 - DNA, 16 bp, R. norvegicus
gcacaggccctgcagc

SEQ ID NO: 506151 - DNA, 16 bp, R. norvegicus
gcacaggctggcctgg

SEQ ID NO: 506152 - DNA, 16 bp, R. norvegicus
gcacaggctggccttg

SEQ ID NO: 506153 - DNA, 16 bp, R. norvegicus
gcacaggctggctttg

SEQ ID NO: 506154 - DNA, 16 bp, R. norvegicus
gcacagggagcaggag

SEQ ID NO: 506155 - DNA, 16 bp, R. norvegicus
gcacaggggaggcaga

SEQ ID NO: 506156 - DNA, 16 bp, R. norvegicus
gcacagggtcagctct

SEQ ID NO: 506157 - DNA, 37 bp, R. norvegicus
gcacaggtattcctggttgctgccgctgcagagagcc

SEQ ID NO: 506158 - DNA, 16 bp, R. norvegicus
gcacaggtctccctgg

SEQ ID NO: 506159 - DNA, 38 bp, R. norvegicus
gcacaggtcttcctggttgctgccgctgcagagagccc

SEQ ID NO: 506160 - DNA, 16 bp, R. norvegicus
gcacagtggaaggagc

SEQ ID NO: 506161 - DNA, 16 bp, R. norvegicus
gcacagtttcaggcaa

SEQ ID NO: 506162 - DNA, 16 bp, R. norvegicus
gcacataataaagaaa

SEQ ID NO: 506163 - DNA, 16 bp, R. norvegicus
gcacatacacatgcac

SEQ ID NO: 506164 - DNA, 16 bp, R. norvegicus
gcacatgaaggtcaga

SEQ ID NO: 506165 - DNA, 16 bp, R. norvegicus
gcacatgcacacacac

SEQ ID NO: 506166 - DNA, 16 bp, R. norvegicus
gcacatgcacgtacac

SEQ ID NO: 506167 - DNA, 16 bp, R. norvegicus
gcacatgcagaggcca

SEQ ID NO: 506168 - DNA, 16 bp, R. norvegicus
gcacatgcaggcacac

SEQ ID NO: 506169 - DNA, 16 bp, R. norvegicus
gcacatggaggtcaaa

SEQ ID NO: 506170 - DNA, 16 bp, R. norvegicus
gcacatggccctgggt

SEQ ID NO: 506171 - DNA, 16 bp, R. norvegicus
gcacatgtggtcatca

SEQ ID NO: 506172 - DNA, 16 bp, R. norvegicus
gcacatgtgtgaaggt

SEQ ID NO: 506173 - DNA, 16 bp, R. norvegicus
gcacatgtgtgtgctc

SEQ ID NO: 506174 - DNA, 16 bp, R. norvegicus
gcacattgaggggaaa

SEQ ID NO: 506175 - DNA, 16 bp, R. norvegicus
gcacatttaaaaaaaa

SEQ ID NO: 506176 - DNA, 16 bp, R. norvegicus
gcaccaaacacaaggg

SEQ ID NO: 506177 - DNA, 16 bp, R. norvegicus
gcaccaagctgtccct

SEQ ID NO: 506178 - DNA, 16 bp, R. norvegicus
gcaccaaggacacaca

SEQ ID NO: 506179 - DNA, 16 bp, R. norvegicus
gcaccaaggggaggag

SEQ ID NO: 506180 - DNA, 16 bp, R. norvegicus
gcaccaccacacctgc

SEQ ID NO: 506181 - DNA, 16 bp, R. norvegicus
gcaccaccaccacctg

SEQ ID NO: 506182 - DNA, 16 bp, R. norvegicus
gcaccaccactcccag

SEQ ID NO: 506183 - DNA, 16 bp, R. norvegicus
gcaccaccactgccag

SEQ ID NO: 506184 - DNA, 16 bp, R. norvegicus
gcaccaccagaaccca

SEQ ID NO: 506185 - DNA, 16 bp, R. norvegicus
gcaccagaagaaggca

SEQ ID NO: 506186 - DNA, 16 bp, R. norvegicus
gcaccagacacacatg

SEQ ID NO: 506187 - DNA, 16 bp, R. norvegicus
gcaccaggaagtgaaa

SEQ ID NO: 506188 - DNA, 16 bp, R. norvegicus
gcaccaggaagtggaa

SEQ ID NO: 506189 - DNA, 16 bp, R. norvegicus
gcaccaggcctgcctg

SEQ ID NO: 506190 - DNA, 16 bp, R. norvegicus
gcaccagtgggagaag

SEQ ID NO: 506191 - DNA, 16 bp, R. norvegicus
gcaccagtgtcccaga

SEQ ID NO: 506192 - DNA, 16 bp, R. norvegicus
gcaccatccctgcctg

SEQ ID NO: 506193 - DNA, 16 bp, R. norvegicus
gcaccatgcatgcctg

SEQ ID NO: 506194 - DNA, 16 bp, R. norvegicus
gcaccatgcctacctg

SEQ ID NO: 506195 - DNA, 16 bp, R. norvegicus
gcaccatgcctgcatg

SEQ ID NO: 506196 - DNA, 16 bp, R. norvegicus
gcaccatgcctgcctg

SEQ ID NO: 506197 - DNA, 16 bp, R. norvegicus
gcaccatgcttgccta

SEQ ID NO: 506198 - DNA, 16 bp, R. norvegicus
gcaccatgtctacctg

SEQ ID NO: 506199 - DNA, 16 bp, R. norvegicus
gcaccatgtctgcctg

SEQ ID NO: 506200 - DNA, 16 bp, R. norvegicus
gcacccaaatcccatt

SEQ ID NO: 506201 - DNA, 16 bp, R. norvegicus
gcacccacacagtgac

SEQ ID NO: 506202 - DNA, 16 bp, R. norvegicus
gcacccacactttggt

SEQ ID NO: 506203 - DNA, 16 bp, R. norvegicus
gcacccacgtggtggc

SEQ ID NO: 506204 - DNA, 16 bp, R. norvegicus
gcacccagagctgaaa

SEQ ID NO: 506205 - DNA, 16 bp, R. norvegicus
gcacccagggcatctg

SEQ ID NO: 506206 - DNA, 16 bp, R. norvegicus
gcacccatgtttgaaa

SEQ ID NO: 506207 - DNA, 16 bp, R. norvegicus
gcacccctgagactgc

SEQ ID NO: 506208 - DNA, 16 bp, R. norvegicus
gcacccttatggaggc

SEQ ID NO: 506209 - DNA, 16 bp, R. norvegicus
gcaccgccatgcctgg

SEQ ID NO: 506210 - DNA, 16 bp, R. norvegicus
gcacctactgtgtgct

SEQ ID NO: 506211 - DNA, 16 bp, R. norvegicus
gcacctgcacacacac

SEQ ID NO: 506212 - DNA, 50 bp, R. norvegicus
gcacctgcacctgcacctgcacctgcacctgcacctgcacctgcacctgc

SEQ ID NO: 506213 - DNA, 16 bp, R. norvegicus
gcacctggtttgctgt

SEQ ID NO: 506214 - DNA, 16 bp, R. norvegicus
gcacctgtcagaatgg

SEQ ID NO: 506215 - DNA, 16 bp, R. norvegicus
gcacctgtgtgtgcac

SEQ ID NO: 506216 - DNA, 16 bp, R. norvegicus
gcacctttgcctgctg

SEQ ID NO: 506217 - DNA, 16 bp, R. norvegicus
gcacgcacatgcacac

SEQ ID NO: 506218 - DNA, 16 bp, R. norvegicus
gcacgcacatgcgcac

SEQ ID NO: 506219 - DNA, 16 bp, R. norvegicus
gcacgccctggggtgg

SEQ ID NO: 506220 - DNA, 16 bp, R. norvegicus
gcacgcgcgcacacac

SEQ ID NO: 506221 - DNA, 16 bp, R. norvegicus
gcacgggcacaggcac

SEQ ID NO: 506222 - DNA, 16 bp, R. norvegicus
gcacgtatgtctgtgc

SEQ ID NO: 506223 - DNA, 16 bp, R. norvegicus
gcacgtgcacgtgcac

SEQ ID NO: 506224 - DNA, 16 bp, R. norvegicus
gcacgtgggcagcacc

SEQ ID NO: 506225 - DNA, 16 bp, R. norvegicus
gcacgtgtcttttttg

SEQ ID NO: 506226 - DNA, 16 bp, R. norvegicus
gcacgtgtggaggtca

SEQ ID NO: 506227 - DNA, 16 bp, R. norvegicus
gcactactgggaggtg

SEQ ID NO: 506228 - DNA, 16 bp, R. norvegicus
gcactatcagaaggtg

SEQ ID NO: 506229 - DNA, 16 bp, R. norvegicus
gcactcaagctgcagg

SEQ ID NO: 506230 - DNA, 16 bp, R. norvegicus
gcactcacacagacac

SEQ ID NO: 506231 - DNA, 16 bp, R. norvegicus
gcactcacatgcacat

SEQ ID NO: 506232 - DNA, 16 bp, R. norvegicus
gcactcagcagacaga

SEQ ID NO: 506233 - DNA, 16 bp, R. norvegicus
gcactcaggagagaga

SEQ ID NO: 506234 - DNA, 16 bp, R. norvegicus
gcactcatgaactcac

SEQ ID NO: 506235 - DNA, 16 bp, R. norvegicus
gcactcatgcacacac

SEQ ID NO: 506236 - DNA, 16 bp, R. norvegicus
gcactcccaccagcag

SEQ ID NO: 506237 - DNA, 16 bp, R. norvegicus
gcactccttagcttca

SEQ ID NO: 506238 - DNA, 16 bp, R. norvegicus
gcactcgggaggcaga

SEQ ID NO: 506239 - DNA, 16 bp, R. norvegicus
gcactctgcaggcaga

SEQ ID NO: 506240 - DNA, 16 bp, R. norvegicus
gcactctggaggtgga

SEQ ID NO: 506241 - DNA, 16 bp, R. norvegicus
gcactctgggacagga

SEQ ID NO: 506242 - DNA, 16 bp, R. norvegicus
gcactgaacccatcta

SEQ ID NO: 506243 - DNA, 16 bp, R. norvegicus
gcactgactcccaact

SEQ ID NO: 506244 - DNA, 16 bp, R. norvegicus
gcactgactcctcttc

SEQ ID NO: 506245 - DNA, 16 bp, R. norvegicus
gcactgattgcttttc

SEQ ID NO: 506246 - DNA, 16 bp, R. norvegicus
gcactgcacagcacag

SEQ ID NO: 506247 - DNA, 16 bp, R. norvegicus
gcactgcagaggcaga

SEQ ID NO: 506248 - DNA, 16 bp, R. norvegicus
gcactgcagtgctgga

SEQ ID NO: 506249 - DNA, 16 bp, R. norvegicus
gcactgcctgcctccc

SEQ ID NO: 506250 - DNA, 16 bp, R. norvegicus
gcactggaaataattt

SEQ ID NO: 506251 - DNA, 16 bp, R. norvegicus
gcactggcttctcttt

SEQ ID NO: 506252 - DNA, 16 bp, R. norvegicus
gcactgggaaggcaga

SEQ ID NO: 506253 - DNA, 16 bp, R. norvegicus
gcactgggaggtggag

SEQ ID NO: 506254 - DNA, 16 bp, R. norvegicus
gcactgggctggagag

SEQ ID NO: 506255 - DNA, 16 bp, R. norvegicus
gcactgtgagaagcca

SEQ ID NO: 506256 - DNA, 16 bp, R. norvegicus
gcactgtttgagaagg

SEQ ID NO: 506257 - DNA, 16 bp, R. norvegicus
gcactgttttcatttt

SEQ ID NO: 506258 - DNA, 16 bp, R. norvegicus
gcacttaatcctgtag

SEQ ID NO: 506259 - DNA, 16 bp, R. norvegicus
gcacttcctgttcctg

SEQ ID NO: 506260 - DNA, 16 bp, R. norvegicus
gcacttcttggcgtca

SEQ ID NO: 506261 - DNA, 45 bp, R. norvegicus
gcacttgatttttgacaaaggagccaaaaccatcaaatggaaaaa

SEQ ID NO: 506262 - DNA, 16 bp, R. norvegicus
gcacttgcttctcacc

SEQ ID NO: 506263 - DNA, 16 bp, R. norvegicus
gcacttgggaagtgga

SEQ ID NO: 506264 - DNA, 16 bp, R. norvegicus
gcacttgggaggcagg

SEQ ID NO: 506265 - DNA, 16 bp, R. norvegicus
gcacttgggaggctga

SEQ ID NO: 506266 - DNA, 16 bp, R. norvegicus
gcactttctaggcaag

SEQ ID NO: 506267 - DNA, 16 bp, R. norvegicus
gcagaaacaaagccag

SEQ ID NO: 506268 - DNA, 16 bp, R. norvegicus
gcagaaacagctaggc

SEQ ID NO: 506269 - DNA, 16 bp, R. norvegicus
gcagaaacaggaagtg

SEQ ID NO: 506270 - DNA, 16 bp, R. norvegicus
gcagaaacctagaggc

SEQ ID NO: 506271 - DNA, 16 bp, R. norvegicus
gcagaaacctgaagga

SEQ ID NO: 506272 - DNA, 16 bp, R. norvegicus
gcagaaactggaagca

SEQ ID NO: 506273 - DNA, 16 bp, R. norvegicus
gcagaaactggaaggg

SEQ ID NO: 506274 - DNA, 16 bp, R. norvegicus
gcagaaagaaacagta

SEQ ID NO: 506275 - DNA, 16 bp, R. norvegicus
gcagaaagacagagca

SEQ ID NO: 506276 - DNA, 16 bp, R. norvegicus
gcagaaagagacagag

SEQ ID NO: 506277 - DNA, 16 bp, R. norvegicus
gcagaaagaggcagat

SEQ ID NO: 506278 - DNA, 16 bp, R. norvegicus
gcagaaaggaacagga

SEQ ID NO: 506279 - DNA, 16 bp, R. norvegicus
gcagaaaggatggaaa

SEQ ID NO: 506280 - DNA, 16 bp, R. norvegicus
gcagaaagtgaaggaa

SEQ ID NO: 506281 - DNA, 16 bp, R. norvegicus
gcagaaatcatggagg

SEQ ID NO: 506282 - DNA, 16 bp, R. norvegicus
gcagaaatctatcaaa

SEQ ID NO: 506283 - DNA, 16 bp, R. norvegicus
gcagaaatgactcaga

SEQ ID NO: 506284 - DNA, 16 bp, R. norvegicus
gcagaacaaagcaaca

SEQ ID NO: 506285 - DNA, 22 bp, R. norvegicus
gcagaacaatttgcaaattcat

SEQ ID NO: 506286 - DNA, 16 bp, R. norvegicus
gcagaacatggcaagt

SEQ ID NO: 506287 - DNA, 16 bp, R. norvegicus
gcagaacctgaaggaa

SEQ ID NO: 506288 - DNA, 16 bp, R. norvegicus
gcagaactatcagaat

SEQ ID NO: 506289 - DNA, 17 bp, R. norvegicus
gcagaactccaaataga

SEQ ID NO: 506290 - DNA, 16 bp, R. norvegicus
gcagaactggagactc

SEQ ID NO: 506291 - DNA, 16 bp, R. norvegicus
gcagaagaagcagcag

SEQ ID NO: 506292 - DNA, 16 bp, R. norvegicus
gcagaagaaggcagat

SEQ ID NO: 506293 - DNA, 16 bp, R. norvegicus
gcagaagaatcaggag

SEQ ID NO: 506294 - DNA, 16 bp, R. norvegicus
gcagaagactgcctgg

SEQ ID NO: 506295 - DNA, 16 bp, R. norvegicus
gcagaagaggaaactg

SEQ ID NO: 506296 - DNA, 16 bp, R. norvegicus
gcagaagagttggtct

SEQ ID NO: 506297 - DNA, 16 bp, R. norvegicus
gcagaagatgaccttg

SEQ ID NO: 506298 - DNA, 16 bp, R. norvegicus
gcagaagatggggagg

SEQ ID NO: 506299 - DNA, 16 bp, R. norvegicus
gcagaagattccacag

SEQ ID NO: 506300 - DNA, 16 bp, R. norvegicus
gcagaagatttggtct

SEQ ID NO: 506301 - DNA, 16 bp, R. norvegicus
gcagaagcagaagaag

SEQ ID NO: 506302 - DNA, 16 bp, R. norvegicus
gcagaagcagaagcag

SEQ ID NO: 506303 - DNA, 16 bp, R. norvegicus
gcagaagcagacagat

SEQ ID NO: 506304 - DNA, 16 bp, R. norvegicus
gcagaagcagaggcag

SEQ ID NO: 506305 - DNA, 16 bp, R. norvegicus
gcagaagcaggaagct

SEQ ID NO: 506306 - DNA, 16 bp, R. norvegicus
gcagaagcaggaggat

SEQ ID NO: 506307 - DNA, 16 bp, R. norvegicus
gcagaagcaggcagaa

SEQ ID NO: 506308 - DNA, 16 bp, R. norvegicus
gcagaagccacagaag

SEQ ID NO: 506309 - DNA, 16 bp, R. norvegicus
gcagaagccagagcag

SEQ ID NO: 506310 - DNA, 16 bp, R. norvegicus
gcagaagccagaggca

SEQ ID NO: 506311 - DNA, 16 bp, R. norvegicus
gcagaagccgtggagg

SEQ ID NO: 506312 - DNA, 16 bp, R. norvegicus
gcagaagctgcggctg

SEQ ID NO: 506313 - DNA, 17 bp, R. norvegicus
gcagaagctggaaagaa

SEQ ID NO: 506314 - DNA, 16 bp, R. norvegicus
gcagaagctggtggat

SEQ ID NO: 506315 - DNA, 16 bp, R. norvegicus
gcagaagctttgcagt

SEQ ID NO: 506316 - DNA, 16 bp, R. norvegicus
gcagaaggatcaggag

SEQ ID NO: 506317 - DNA, 16 bp, R. norvegicus
gcagaaggcagaggca

SEQ ID NO: 506318 - DNA, 16 bp, R. norvegicus
gcagaaggccctgggt

SEQ ID NO: 506319 - DNA, 16 bp, R. norvegicus
gcagaagtcagttctc

SEQ ID NO: 506320 - DNA, 16 bp, R. norvegicus
gcagaagtggtggtct

SEQ ID NO: 506321 - DNA, 16 bp, R. norvegicus
gcagaagtggtggtgt

SEQ ID NO: 506322 - DNA, 16 bp, R. norvegicus
gcagacaaaacaccca

SEQ ID NO: 506323 - DNA, 16 bp, R. norvegicus
gcagacacacatggga

SEQ ID NO: 506324 - DNA, 16 bp, R. norvegicus
gcagacacagacaaca

SEQ ID NO: 506325 - DNA, 16 bp, R. norvegicus
gcagacacaggagaaa

SEQ ID NO: 506326 - DNA, 16 bp, R. norvegicus
gcagacacaggtggaa

SEQ ID NO: 506327 - DNA, 16 bp, R. norvegicus
gcagacactgagggaa

SEQ ID NO: 506328 - DNA, 16 bp, R. norvegicus
gcagacacttgagagg

SEQ ID NO: 506329 - DNA, 16 bp, R. norvegicus
gcagacagaaactgga

SEQ ID NO: 506330 - DNA, 16 bp, R. norvegicus
gcagacagacagacag

SEQ ID NO: 506331 - DNA, 16 bp, R. norvegicus
gcagacagacaggagc

SEQ ID NO: 506332 - DNA, 16 bp, R. norvegicus
gcagacagacatggtg

SEQ ID NO: 506333 - DNA, 16 bp, R. norvegicus
gcagacagaccagtgg

SEQ ID NO: 506334 - DNA, 16 bp, R. norvegicus
gcagacagaggtggga

SEQ ID NO: 506335 - DNA, 16 bp, R. norvegicus
gcagacaggagccaga

SEQ ID NO: 506336 - DNA, 16 bp, R. norvegicus
gcagacatcccaaggc

SEQ ID NO: 506337 - DNA, 16 bp, R. norvegicus
gcagaccagaactgtg

SEQ ID NO: 506338 - DNA, 16 bp, R. norvegicus
gcagacctcccaggga

SEQ ID NO: 506339 - DNA, 16 bp, R. norvegicus
gcagactctctgcaca

SEQ ID NO: 506340 - DNA, 16 bp, R. norvegicus
gcagactcttcagaca

SEQ ID NO: 506341 - DNA, 17 bp, R. norvegicus
gcagactgatttccaga

SEQ ID NO: 506342 - DNA, 16 bp, R. norvegicus
gcagagaaacttgaag

SEQ ID NO: 506343 - DNA, 16 bp, R. norvegicus
gcagagaactgttcat

SEQ ID NO: 506344 - DNA, 16 bp, R. norvegicus
gcagagaagacagcca

SEQ ID NO: 506345 - DNA, 16 bp, R. norvegicus
gcagagaagaggaagc

SEQ ID NO: 506346 - DNA, 16 bp, R. norvegicus
gcagagaagcctggga

SEQ ID NO: 506347 - DNA, 16 bp, R. norvegicus
gcagagaagctgctga

SEQ ID NO: 506348 - DNA, 16 bp, R. norvegicus
gcagagaatgaagaaa

SEQ ID NO: 506349 - DNA, 16 bp, R. norvegicus
gcagagacaaagacag

SEQ ID NO: 506350 - DNA, 16 bp, R. norvegicus
gcagagacacagacag

SEQ ID NO: 506351 - DNA, 16 bp, R. norvegicus
gcagagacactgggcc

SEQ ID NO: 506352 - DNA, 16 bp, R. norvegicus
gcagagacagaaggat

SEQ ID NO: 506353 - DNA, 16 bp, R. norvegicus
gcagagacagagacag

SEQ ID NO: 506354 - DNA, 16 bp, R. norvegicus
gcagagacagaggcag

SEQ ID NO: 506355 - DNA, 16 bp, R. norvegicus
gcagagacagatggat

SEQ ID NO: 506356 - DNA, 16 bp, R. norvegicus
gcagagacagccaagc

SEQ ID NO: 506357 - DNA, 16 bp, R. norvegicus
gcagagacagcttcct

SEQ ID NO: 506358 - DNA, 16 bp, R. norvegicus
gcagagacaggaaaat

SEQ ID NO: 506359 - DNA, 16 bp, R. norvegicus
gcagagacaggtggat

SEQ ID NO: 506360 - DNA, 16 bp, R. norvegicus
gcagagaccacagaag

SEQ ID NO: 506361 - DNA, 16 bp, R. norvegicus
gcagagactgaaggat

SEQ ID NO: 506362 - DNA, 16 bp, R. norvegicus
gcagagactgacagaa

SEQ ID NO: 506363 - DNA, 16 bp, R. norvegicus
gcagagactgcaggaa

SEQ ID NO: 506364 - DNA, 16 bp, R. norvegicus
gcagagactgggggaa

SEQ ID NO: 506365 - DNA, 16 bp, R. norvegicus
gcagagagacacacag

SEQ ID NO: 506366 - DNA, 16 bp, R. norvegicus
gcagagagacacagag

SEQ ID NO: 506367 - DNA, 16 bp, R. norvegicus
gcagagagacagggag

SEQ ID NO: 506368 - DNA, 16 bp, R. norvegicus
gcagagagaccctggg

SEQ ID NO: 506369 - DNA, 16 bp, R. norvegicus
gcagagagagacagac

SEQ ID NO: 506370 - DNA, 16 bp, R. norvegicus
gcagagagagcagaga

SEQ ID NO: 506371 - DNA, 16 bp, R. norvegicus
gcagagagatggggga

SEQ ID NO: 506372 - DNA, 16 bp, R. norvegicus
gcagagagcagaagag

SEQ ID NO: 506373 - DNA, 16 bp, R. norvegicus
gcagagagccaggagg

SEQ ID NO: 506374 - DNA, 16 bp, R. norvegicus
gcagagagctgctgtg

SEQ ID NO: 506375 - DNA, 16 bp, R. norvegicus
gcagagaggcagcaga

SEQ ID NO: 506376 - DNA, 16 bp, R. norvegicus
gcagagagtgaggaga

SEQ ID NO: 506377 - DNA, 16 bp, R. norvegicus
gcagagcaagccaggg

SEQ ID NO: 506378 - DNA, 16 bp, R. norvegicus
gcagagcactctgtcc

SEQ ID NO: 506379 - DNA, 16 bp, R. norvegicus
gcagagcagaggagag

SEQ ID NO: 506380 - DNA, 16 bp, R. norvegicus
gcagagcagcagaggc

SEQ ID NO: 506381 - DNA, 16 bp, R. norvegicus
gcagagcagcagcagc

SEQ ID NO: 506382 - DNA, 16 bp, R. norvegicus
gcagagcaggagagac

SEQ ID NO: 506383 - DNA, 16 bp, R. norvegicus
gcagagcaggtgagac

SEQ ID NO: 506384 - DNA, 16 bp, R. norvegicus
gcagagcatgctggga

SEQ ID NO: 506385 - DNA, 16 bp, R. norvegicus
gcagagccaagggctt

SEQ ID NO: 506386 - DNA, 16 bp, R. norvegicus
gcagagcccagaagag

SEQ ID NO: 506387 - DNA, 16 bp, R. norvegicus
gcagagcccctcagga

SEQ ID NO: 506388 - DNA, 16 bp, R. norvegicus
gcagagcctcgcagga

SEQ ID NO: 506389 - DNA, 16 bp, R. norvegicus
gcagagcctttcagag

SEQ ID NO: 506390 - DNA, 16 bp, R. norvegicus
gcagagctctgtgagt

SEQ ID NO: 506391 - DNA, 16 bp, R. norvegicus
gcagagctggccctgg

SEQ ID NO: 506392 - DNA, 16 bp, R. norvegicus
gcagagctggctcagt

SEQ ID NO: 506393 - DNA, 16 bp, R. norvegicus
gcagaggaagaggcag

SEQ ID NO: 506394 - DNA, 16 bp, R. norvegicus
gcagaggaaggcaaat

SEQ ID NO: 506395 - DNA, 16 bp, R. norvegicus
gcagaggaatatgggg

SEQ ID NO: 506396 - DNA, 16 bp, R. norvegicus
gcagaggacagcctgg

SEQ ID NO: 506397 - DNA, 16 bp, R. norvegicus
gcagaggaccggggtt

SEQ ID NO: 506398 - DNA, 16 bp, R. norvegicus
gcagaggacctgctgc

SEQ ID NO: 506399 - DNA, 16 bp, R. norvegicus
gcagaggacctggtgc

SEQ ID NO: 506400 - DNA, 16 bp, R. norvegicus
gcagaggaggccagag

SEQ ID NO: 506401 - DNA, 16 bp, R. norvegicus
gcagaggagggcccag

SEQ ID NO: 506402 - DNA, 16 bp, R. norvegicus
gcagaggatcctggtg

SEQ ID NO: 506403 - DNA, 16 bp, R. norvegicus
gcagaggatgatcttg

SEQ ID NO: 506404 - DNA, 16 bp, R. norvegicus
gcagaggcaagtggac

SEQ ID NO: 506405 - DNA, 16 bp, R. norvegicus
gcagaggcaagtggat

SEQ ID NO: 506406 - DNA, 16 bp, R. norvegicus
gcagaggcagaaggat

SEQ ID NO: 506407 - DNA, 16 bp, R. norvegicus
gcagaggcagagagac

SEQ ID NO: 506408 - DNA, 16 bp, R. norvegicus
gcagaggcagaggaag

SEQ ID NO: 506409 - DNA, 16 bp, R. norvegicus
gcagaggcagagggat

SEQ ID NO: 506410 - DNA, 16 bp, R. norvegicus
gcagaggcagaggggc

SEQ ID NO: 506411 - DNA, 16 bp, R. norvegicus
gcagaggcagatgcag

SEQ ID NO: 506412 - DNA, 16 bp, R. norvegicus
gcagaggcagcggcag

SEQ ID NO: 506413 - DNA, 16 bp, R. norvegicus
gcagaggcaggaagag

SEQ ID NO: 506414 - DNA, 16 bp, R. norvegicus
gcagaggcaggaagat

SEQ ID NO: 506415 - DNA, 16 bp, R. norvegicus
gcagaggcaggacgat

SEQ ID NO: 506416 - DNA, 16 bp, R. norvegicus
gcagaggcaggagatc

SEQ ID NO: 506417 - DNA, 16 bp, R. norvegicus
gcagaggcaggctctg

SEQ ID NO: 506418 - DNA, 16 bp, R. norvegicus
gcagaggcagggggat

SEQ ID NO: 506419 - DNA, 16 bp, R. norvegicus
gcagaggcaggtgaat

SEQ ID NO: 506420 - DNA, 16 bp, R. norvegicus
gcagaggcagtggcag

SEQ ID NO: 506421 - DNA, 16 bp, R. norvegicus
gcagaggcagttgaat

SEQ ID NO: 506422 - DNA, 16 bp, R. norvegicus
gcagaggccaaggagg

SEQ ID NO: 506423 - DNA, 16 bp, R. norvegicus
gcagaggccagagagg

SEQ ID NO: 506424 - DNA, 16 bp, R. norvegicus
gcagaggccagaggcc

SEQ ID NO: 506425 - DNA, 16 bp, R. norvegicus
gcagaggccagggaga

SEQ ID NO: 506426 - DNA, 16 bp, R. norvegicus
gcagaggccatggagg

SEQ ID NO: 506427 - DNA, 16 bp, R. norvegicus
gcagaggccattgagg

SEQ ID NO: 506428 - DNA, 16 bp, R. norvegicus
gcagaggccctggagg

SEQ ID NO: 506429 - DNA, 16 bp, R. norvegicus
gcagaggccttggagg

SEQ ID NO: 506430 - DNA, 16 bp, R. norvegicus
gcagaggcggcagagg

SEQ ID NO: 506431 - DNA, 16 bp, R. norvegicus
gcagaggctgaaagaa

SEQ ID NO: 506432 - DNA, 16 bp, R. norvegicus
gcagaggctgaagaaa

SEQ ID NO: 506433 - DNA, 16 bp, R. norvegicus
gcagaggctggaagag

SEQ ID NO: 506434 - DNA, 16 bp, R. norvegicus
gcagaggctgtggaag

SEQ ID NO: 506435 - DNA, 16 bp, R. norvegicus
gcagagggacagaggc

SEQ ID NO: 506436 - DNA, 16 bp, R. norvegicus
gcagaggggcgcagag

SEQ ID NO: 506437 - DNA, 16 bp, R. norvegicus
gcagaggtaggctgat

SEQ ID NO: 506438 - DNA, 16 bp, R. norvegicus
gcagaggtaggtggag

SEQ ID NO: 506439 - DNA, 16 bp, R. norvegicus
gcagaggtcatggaga

SEQ ID NO: 506440 - DNA, 16 bp, R. norvegicus
gcagaggtgctgctgg

SEQ ID NO: 506441 - DNA, 16 bp, R. norvegicus
gcagaggtgggtagat

SEQ ID NO: 506442 - DNA, 16 bp, R. norvegicus
gcagagtatcattaac

SEQ ID NO: 506443 - DNA, 16 bp, R. norvegicus
gcagagtgagctccag

SEQ ID NO: 506444 - DNA, 16 bp, R. norvegicus
gcagagtgtgtgtgtg

SEQ ID NO: 506445 - DNA, 16 bp, R. norvegicus
gcagatatttacagcc

SEQ ID NO: 506446 - DNA, 16 bp, R. norvegicus
gcagatctcagagttc

SEQ ID NO: 506447 - DNA, 16 bp, R. norvegicus
gcagatctctcagttc

SEQ ID NO: 506448 - DNA, 16 bp, R. norvegicus
gcagatctgagttcaa

SEQ ID NO: 506449 - DNA, 16 bp, R. norvegicus
gcagatgaaacaggca

SEQ ID NO: 506450 - DNA, 16 bp, R. norvegicus
gcagatgcaggaggat

SEQ ID NO: 506451 - DNA, 16 bp, R. norvegicus
gcagatgcaggcagat

SEQ ID NO: 506452 - DNA, 16 bp, R. norvegicus
gcagatgctggcaaag

SEQ ID NO: 506453 - DNA, 16 bp, R. norvegicus
gcagatggagagaggg

SEQ ID NO: 506454 - DNA, 16 bp, R. norvegicus
gcagatggatttctgt

SEQ ID NO: 506455 - DNA, 16 bp, R. norvegicus
gcagatgggtttcctg

SEQ ID NO: 506456 - DNA, 16 bp, R. norvegicus
gcagatggttgtgagc

SEQ ID NO: 506457 - DNA, 16 bp, R. norvegicus
gcagatgtcatccaga

SEQ ID NO: 506458 - DNA, 16 bp, R. norvegicus
gcagatgtgcagtttg

SEQ ID NO: 506459 - DNA, 16 bp, R. norvegicus
gcagattcagaggaaa

SEQ ID NO: 506460 - DNA, 16 bp, R. norvegicus
gcagcaaaaataattt

SEQ ID NO: 506461 - DNA, 16 bp, R. norvegicus
gcagcaaaggcagcag

SEQ ID NO: 506462 - DNA, 16 bp, R. norvegicus
gcagcaaccaggaagc

SEQ ID NO: 506463 - DNA, 16 bp, R. norvegicus
gcagcaagcaccttac

SEQ ID NO: 506464 - DNA, 16 bp, R. norvegicus
gcagcaagcagagcag

SEQ ID NO: 506465 - DNA, 16 bp, R. norvegicus
gcagcaatggaaggag

SEQ ID NO: 506466 - DNA, 16 bp, R. norvegicus
gcagcaatggctggag

SEQ ID NO: 506467 - DNA, 16 bp, R. norvegicus
gcagcacagacacttc

SEQ ID NO: 506468 - DNA, 16 bp, R. norvegicus
gcagcaccattcccta

SEQ ID NO: 506469 - DNA, 16 bp, R. norvegicus
gcagcactcaggaaag

SEQ ID NO: 506470 - DNA, 16 bp, R. norvegicus
gcagcactggggaggc

SEQ ID NO: 506471 - DNA, 16 bp, R. norvegicus
gcagcagaaactcaag

SEQ ID NO: 506472 - DNA, 16 bp, R. norvegicus
gcagcagaagcagaag

SEQ ID NO: 506473 - DNA, 16 bp, R. norvegicus
gcagcagaaggaaact

SEQ ID NO: 506474 - DNA, 16 bp, R. norvegicus
gcagcagaaggaggag

SEQ ID NO: 506475 - DNA, 16 bp, R. norvegicus
gcagcagaatgcagag

SEQ ID NO: 506476 - DNA, 16 bp, R. norvegicus
gcagcagagacagcag

SEQ ID NO: 506477 - DNA, 16 bp, R. norvegicus
gcagcagaggaggaag

SEQ ID NO: 506478 - DNA, 16 bp, R. norvegicus
gcagcagaggatgacc

SEQ ID NO: 506479 - DNA, 16 bp, R. norvegicus
gcagcagaggcagcag

SEQ ID NO: 506480 - DNA, 16 bp, R. norvegicus
gcagcagatggcattg

SEQ ID NO: 506481 - DNA, 16 bp, R. norvegicus
gcagcagatgtgcagc

SEQ ID NO: 506482 - DNA, 16 bp, R. norvegicus
gcagcagcaaaggcag

SEQ ID NO: 506483 - DNA, 16 bp, R. norvegicus
gcagcagcacacacct

SEQ ID NO: 506484 - DNA, 16 bp, R. norvegicus
gcagcagcagaagaag

SEQ ID NO: 506485 - DNA, 16 bp, R. norvegicus
gcagcagcagcaaaat

SEQ ID NO: 506486 - DNA, 16 bp, R. norvegicus
gcagcagcagcaacca

SEQ ID NO: 506487 - DNA, 16 bp, R. norvegicus
gcagcagcagcaatag

SEQ ID NO: 506488 - DNA, 16 bp, R. norvegicus
gcagcagcagcacagc

SEQ ID NO: 506489 - DNA, 16 bp, R. norvegicus
gcagcagcagcaccaa

SEQ ID NO: 506490 - DNA, 16 bp, R. norvegicus
gcagcagcagcagaag

SEQ ID NO: 506491 - DNA, 18 bp, R. norvegicus
gcagcagcagcagcaacc

SEQ ID NO: 506492 - DNA, 16 bp, R. norvegicus
gcagcagcagcagcag

SEQ ID NO: 506493 - DNA, 16 bp, R. norvegicus
gcagcagcagcagcgg

SEQ ID NO: 506494 - DNA, 16 bp, R. norvegicus
gcagcagcagcagcgt

SEQ ID NO: 506495 - DNA, 16 bp, R. norvegicus
gcagcagcagcagctg

SEQ ID NO: 506496 - DNA, 16 bp, R. norvegicus
gcagcagcagcaggca

SEQ ID NO: 506497 - DNA, 16 bp, R. norvegicus
gcagcagcagcagggt

SEQ ID NO: 506498 - DNA, 16 bp, R. norvegicus
gcagcagcagcagtgt

SEQ ID NO: 506499 - DNA, 16 bp, R. norvegicus
gcagcagcagcagttt

SEQ ID NO: 506500 - DNA, 16 bp, R. norvegicus
gcagcagcagcatcag

SEQ ID NO: 506501 - DNA, 17 bp, R. norvegicus
gcagcagcagcggcagc

SEQ ID NO: 506502 - DNA, 16 bp, R. norvegicus
gcagcagcagctccat

SEQ ID NO: 506503 - DNA, 16 bp, R. norvegicus
gcagcagcagctgcag

SEQ ID NO: 506504 - DNA, 16 bp, R. norvegicus
gcagcagcagctgctg

SEQ ID NO: 506505 - DNA, 16 bp, R. norvegicus
gcagcagcagggacag

SEQ ID NO: 506506 - DNA, 16 bp, R. norvegicus
gcagcagccaggaggc

SEQ ID NO: 506507 - DNA, 16 bp, R. norvegicus
gcagcagcctggagct

SEQ ID NO: 506508 - DNA, 16 bp, R. norvegicus
gcagcagctcccctgt

SEQ ID NO: 506509 - DNA, 16 bp, R. norvegicus
gcagcagctcctgctt

SEQ ID NO: 506510 - DNA, 16 bp, R. norvegicus
gcagcagctctctgtt

SEQ ID NO: 506511 - DNA, 16 bp, R. norvegicus
gcagcagctgactgtg

SEQ ID NO: 506512 - DNA, 16 bp, R. norvegicus
gcagcagctgcagcca

SEQ ID NO: 506513 - DNA, 16 bp, R. norvegicus
gcagcagctgctgctg

SEQ ID NO: 506514 - DNA, 16 bp, R. norvegicus
gcagcagctgtggtgg

SEQ ID NO: 506515 - DNA, 16 bp, R. norvegicus
gcagcaggaaggcagg

SEQ ID NO: 506516 - DNA, 16 bp, R. norvegicus
gcagcaggagagagag

SEQ ID NO: 506517 - DNA, 16 bp, R. norvegicus
gcagcaggagcatgag

SEQ ID NO: 506518 - DNA, 16 bp, R. norvegicus
gcagcaggagcttgaa

SEQ ID NO: 506519 - DNA, 16 bp, R. norvegicus
gcagcaggaggaagag

SEQ ID NO: 506520 - DNA, 16 bp, R. norvegicus
gcagcaggaggagact

SEQ ID NO: 506521 - DNA, 16 bp, R. norvegicus
gcagcaggaggctgag

SEQ ID NO: 506522 - DNA, 16 bp, R. norvegicus
gcagcaggatcagaag

SEQ ID NO: 506523 - DNA, 16 bp, R. norvegicus
gcagcaggcacagggc

SEQ ID NO: 506524 - DNA, 16 bp, R. norvegicus
gcagcaggcactttac

SEQ ID NO: 506525 - DNA, 16 bp, R. norvegicus
gcagcaggcagagaca

SEQ ID NO: 506526 - DNA, 16 bp, R. norvegicus
gcagcaggggcagcag

SEQ ID NO: 506527 - DNA, 16 bp, R. norvegicus
gcagcaggtgctctta

SEQ ID NO: 506528 - DNA, 16 bp, R. norvegicus
gcagcagtagcagcaa

SEQ ID NO: 506529 - DNA, 16 bp, R. norvegicus
gcagcagtagtagtag

SEQ ID NO: 506530 - DNA, 16 bp, R. norvegicus
gcagcagtatgcaggg

SEQ ID NO: 506531 - DNA, 16 bp, R. norvegicus
gcagcagtggcagcag

SEQ ID NO: 506532 - DNA, 16 bp, R. norvegicus
gcagcagtggcagtgg

SEQ ID NO: 506533 - DNA, 16 bp, R. norvegicus
gcagcatcacagcatc

SEQ ID NO: 506534 - DNA, 16 bp, R. norvegicus
gcagcatgcacaagac

SEQ ID NO: 506535 - DNA, 16 bp, R. norvegicus
gcagcatgcaccagct

SEQ ID NO: 506536 - DNA, 16 bp, R. norvegicus
gcagccacagctgctg

SEQ ID NO: 506537 - DNA, 16 bp, R. norvegicus
gcagccaccaaagcca

SEQ ID NO: 506538 - DNA, 16 bp, R. norvegicus
gcagccactgtggaaa

SEQ ID NO: 506539 - DNA, 16 bp, R. norvegicus
gcagccagcagccagc

SEQ ID NO: 506540 - DNA, 16 bp, R. norvegicus
gcagccaggaggagag

SEQ ID NO: 506541 - DNA, 16 bp, R. norvegicus
gcagccaggaggccca

SEQ ID NO: 506542 - DNA, 16 bp, R. norvegicus
gcagccaggcagccag

SEQ ID NO: 506543 - DNA, 16 bp, R. norvegicus
gcagccagtgctccta

SEQ ID NO: 506544 - DNA, 16 bp, R. norvegicus
gcagccagtgtgctta

SEQ ID NO: 506545 - DNA, 20 bp, R. norvegicus
gcagccatcttccagtaact

SEQ ID NO: 506546 - DNA, 16 bp, R. norvegicus
gcagcccacaactgcc

SEQ ID NO: 506547 - DNA, 16 bp, R. norvegicus
gcagcccagcccctgg

SEQ ID NO: 506548 - DNA, 16 bp, R. norvegicus
gcagcccaggctggcc

SEQ ID NO: 506549 - DNA, 16 bp, R. norvegicus
gcagcccatctccttc

SEQ ID NO: 506550 - DNA, 16 bp, R. norvegicus
gcagccccatatccca

SEQ ID NO: 506551 - DNA, 16 bp, R. norvegicus
gcagccgcagcagcag

SEQ ID NO: 506552 - DNA, 16 bp, R. norvegicus
gcagcctagagaatgg

SEQ ID NO: 506553 - DNA, 16 bp, R. norvegicus
gcagcctcagctgcag

SEQ ID NO: 506554 - DNA, 16 bp, R. norvegicus
gcagcctccggagtgc

SEQ ID NO: 506555 - DNA, 16 bp, R. norvegicus
gcagcctgggctggca

SEQ ID NO: 506556 - DNA, 16 bp, R. norvegicus
gcagcctggggaggaa

SEQ ID NO: 506557 - DNA, 16 bp, R. norvegicus
gcagcctgtccctcct

SEQ ID NO: 506558 - DNA, 16 bp, R. norvegicus
gcagccttctgatgaa

SEQ ID NO: 506559 - DNA, 16 bp, R. norvegicus
gcagccttgatggaga

SEQ ID NO: 506560 - DNA, 16 bp, R. norvegicus
gcagccttgtctcatc

SEQ ID NO: 506561 - DNA, 16 bp, R. norvegicus
gcagccttgtgtagtc

SEQ ID NO: 506562 - DNA, 16 bp, R. norvegicus
gcagcctttcactctg

SEQ ID NO: 506563 - DNA, 16 bp, R. norvegicus
gcagcggttctcaacc

SEQ ID NO: 506564 - DNA, 16 bp, R. norvegicus
gcagctaatggcggcc

SEQ ID NO: 506565 - DNA, 16 bp, R. norvegicus
gcagctaccacagctg

SEQ ID NO: 506566 - DNA, 16 bp, R. norvegicus
gcagctaccaggaaga

SEQ ID NO: 506567 - DNA, 16 bp, R. norvegicus
gcagctagcagaagac

SEQ ID NO: 506568 - DNA, 16 bp, R. norvegicus
gcagctaggagaaggg

SEQ ID NO: 506569 - DNA, 16 bp, R. norvegicus
gcagctataatttcag

SEQ ID NO: 506570 - DNA, 16 bp, R. norvegicus
gcagctcacaaccgtc

SEQ ID NO: 506571 - DNA, 16 bp, R. norvegicus
gcagctcagtgataga

SEQ ID NO: 506572 - DNA, 16 bp, R. norvegicus
gcagctcatgaccatc

SEQ ID NO: 506573 - DNA, 16 bp, R. norvegicus
gcagctccagttccag

SEQ ID NO: 506574 - DNA, 16 bp, R. norvegicus
gcagctcccaggggag

SEQ ID NO: 506575 - DNA, 31 bp, R. norvegicus
gcagctcccttttaccttcgattttgactgt

SEQ ID NO: 506576 - DNA, 16 bp, R. norvegicus
gcagctctcaaccatc

SEQ ID NO: 506577 - DNA, 17 bp, R. norvegicus
gcagctctctactccca

SEQ ID NO: 506578 - DNA, 16 bp, R. norvegicus
gcagctctggccaagt

SEQ ID NO: 506579 - DNA, 16 bp, R. norvegicus
gcagctctggctgtcc

SEQ ID NO: 506580 - DNA, 17 bp, R. norvegicus
gcagctgaaagccacag

SEQ ID NO: 506581 - DNA, 16 bp, R. norvegicus
gcagctgagaagaagg

SEQ ID NO: 506582 - DNA, 16 bp, R. norvegicus
gcagctgcagcagcca

SEQ ID NO: 506583 - DNA, 16 bp, R. norvegicus
gcagctgcctggagga

SEQ ID NO: 506584 - DNA, 16 bp, R. norvegicus
gcagctgcctgtcctg

SEQ ID NO: 506585 - DNA, 16 bp, R. norvegicus
gcagctgcctttgtgg

SEQ ID NO: 506586 - DNA, 16 bp, R. norvegicus
gcagctgctgcctctg

SEQ ID NO: 506587 - DNA, 16 bp, R. norvegicus
gcagctgctgtgtact

SEQ ID NO: 506588 - DNA, 16 bp, R. norvegicus
gcagctggaaacatgg

SEQ ID NO: 506589 - DNA, 16 bp, R. norvegicus
gcagctggaaccatga

SEQ ID NO: 506590 - DNA, 16 bp, R. norvegicus
gcagctggaatcatgg

SEQ ID NO: 506591 - DNA, 16 bp, R. norvegicus
gcagctggagacactg

SEQ ID NO: 506592 - DNA, 16 bp, R. norvegicus
gcagctggagagatgg

SEQ ID NO: 506593 - DNA, 16 bp, R. norvegicus
gcagctggagccacag

SEQ ID NO: 506594 - DNA, 16 bp, R. norvegicus
gcagctggagccctgg

SEQ ID NO: 506595 - DNA, 16 bp, R. norvegicus
gcagctggagccgtgg

SEQ ID NO: 506596 - DNA, 16 bp, R. norvegicus
gcagctggcacaggag

SEQ ID NO: 506597 - DNA, 16 bp, R. norvegicus
gcagctggccggggcc

SEQ ID NO: 506598 - DNA, 16 bp, R. norvegicus
gcagctggtcacacag

SEQ ID NO: 506599 - DNA, 16 bp, R. norvegicus
gcagctgtccttggag

SEQ ID NO: 506600 - DNA, 16 bp, R. norvegicus
gcagcttccacaggag

SEQ ID NO: 506601 - DNA, 16 bp, R. norvegicus
gcagcttggagaggaa

SEQ ID NO: 506602 - DNA, 16 bp, R. norvegicus
gcagctttcttctcag

SEQ ID NO: 506603 - DNA, 16 bp, R. norvegicus
gcaggaaaaaaatcaa

SEQ ID NO: 506604 - DNA, 16 bp, R. norvegicus
gcaggaaaatcagaag

SEQ ID NO: 506605 - DNA, 16 bp, R. norvegicus
gcaggaaatccaggac

SEQ ID NO: 506606 - DNA, 16 bp, R. norvegicus
gcaggaaatggataat

SEQ ID NO: 506607 - DNA, 16 bp, R. norvegicus
gcaggaacaccaggag

SEQ ID NO: 506608 - DNA, 16 bp, R. norvegicus
gcaggaacagcagcag

SEQ ID NO: 506609 - DNA, 16 bp, R. norvegicus
gcaggaaccaggaaga

SEQ ID NO: 506610 - DNA, 16 bp, R. norvegicus
gcaggaaccccagtga

SEQ ID NO: 506611 - DNA, 16 bp, R. norvegicus
gcaggaacctggaagt

SEQ ID NO: 506612 - DNA, 16 bp, R. norvegicus
gcaggaactcaggcag

SEQ ID NO: 506613 - DNA, 16 bp, R. norvegicus
gcaggaactgaaggaa

SEQ ID NO: 506614 - DNA, 16 bp, R. norvegicus
gcaggaactgagacag

SEQ ID NO: 506615 - DNA, 16 bp, R. norvegicus
gcaggaactgcagcag

SEQ ID NO: 506616 - DNA, 16 bp, R. norvegicus
gcaggaactggaagca

SEQ ID NO: 506617 - DNA, 16 bp, R. norvegicus
gcaggaagaattatgg

SEQ ID NO: 506618 - DNA, 16 bp, R. norvegicus
gcaggaagacatggtg

SEQ ID NO: 506619 - DNA, 16 bp, R. norvegicus
gcaggaagaccaggag

SEQ ID NO: 506620 - DNA, 16 bp, R. norvegicus
gcaggaagagcaggag

SEQ ID NO: 506621 - DNA, 16 bp, R. norvegicus
gcaggaagaggtgggt

SEQ ID NO: 506622 - DNA, 16 bp, R. norvegicus
gcaggaagcagggcag

SEQ ID NO: 506623 - DNA, 16 bp, R. norvegicus
gcaggaagcatagcag

SEQ ID NO: 506624 - DNA, 16 bp, R. norvegicus
gcaggaagctgagaga

SEQ ID NO: 506625 - DNA, 16 bp, R. norvegicus
gcaggaagctgtttga

SEQ ID NO: 506626 - DNA, 16 bp, R. norvegicus
gcaggaagtcctgggt

SEQ ID NO: 506627 - DNA, 16 bp, R. norvegicus
gcaggaatagagaccc

SEQ ID NO: 506628 - DNA, 16 bp, R. norvegicus
gcaggacaggaagcag

SEQ ID NO: 506629 - DNA, 24 bp, R. norvegicus
gcaggacccctgcgcctgagacac

SEQ ID NO: 506630 - DNA, 16 bp, R. norvegicus
gcaggaccctggaggc

SEQ ID NO: 506631 - DNA, 16 bp, R. norvegicus
gcaggaccctgggctt

SEQ ID NO: 506632 - DNA, 16 bp, R. norvegicus
gcaggacctccactgt

SEQ ID NO: 506633 - DNA, 16 bp, R. norvegicus
gcaggacctgaagcag

SEQ ID NO: 506634 - DNA, 16 bp, R. norvegicus
gcaggactcaatgaga

SEQ ID NO: 506635 - DNA, 16 bp, R. norvegicus
gcaggactggcccttt

SEQ ID NO: 506636 - DNA, 16 bp, R. norvegicus
gcaggagaactggttc

SEQ ID NO: 506637 - DNA, 16 bp, R. norvegicus
gcaggagaagctgagt

SEQ ID NO: 506638 - DNA, 16 bp, R. norvegicus
gcaggagaaggagctg

SEQ ID NO: 506639 - DNA, 16 bp, R. norvegicus
gcaggagaatcacaaa

SEQ ID NO: 506640 - DNA, 16 bp, R. norvegicus
gcaggagaatcaggag

SEQ ID NO: 506641 - DNA, 16 bp, R. norvegicus
gcaggagaatcatgag

SEQ ID NO: 506642 - DNA, 16 bp, R. norvegicus
gcaggagacactgggc

SEQ ID NO: 506643 - DNA, 16 bp, R. norvegicus
gcaggagacagaggtg

SEQ ID NO: 506644 - DNA, 16 bp, R. norvegicus
gcaggagagctggccc

SEQ ID NO: 506645 - DNA, 16 bp, R. norvegicus
gcaggagatgatggag

SEQ ID NO: 506646 - DNA, 16 bp, R. norvegicus
gcaggagcagaagcag

SEQ ID NO: 506647 - DNA, 16 bp, R. norvegicus
gcaggagcagatgcag

SEQ ID NO: 506648 - DNA, 16 bp, R. norvegicus
gcaggagcaggaacag

SEQ ID NO: 506649 - DNA, 16 bp, R. norvegicus
gcaggagcaggaggaa

SEQ ID NO: 506650 - DNA, 16 bp, R. norvegicus
gcaggagcagtctggg

SEQ ID NO: 506651 - DNA, 16 bp, R. norvegicus
gcaggagcatggcagt

SEQ ID NO: 506652 - DNA, 16 bp, R. norvegicus
gcaggagcctggaggc

SEQ ID NO: 506653 - DNA, 16 bp, R. norvegicus
gcaggagctaatgcag

SEQ ID NO: 506654 - DNA, 16 bp, R. norvegicus
gcaggagctcatgcag

SEQ ID NO: 506655 - DNA, 16 bp, R. norvegicus
gcaggagctgaagggg

SEQ ID NO: 506656 - DNA, 16 bp, R. norvegicus
gcaggagctgctgcag

SEQ ID NO: 506657 - DNA, 16 bp, R. norvegicus
gcaggagctggaaaga

SEQ ID NO: 506658 - DNA, 16 bp, R. norvegicus
gcaggagctggagaga

SEQ ID NO: 506659 - DNA, 16 bp, R. norvegicus
gcaggagctggagcag

SEQ ID NO: 506660 - DNA, 16 bp, R. norvegicus
gcaggagctggtgcag

SEQ ID NO: 506661 - DNA, 16 bp, R. norvegicus
gcaggagctgtccctg

SEQ ID NO: 506662 - DNA, 16 bp, R. norvegicus
gcaggagctgttgcag

SEQ ID NO: 506663 - DNA, 16 bp, R. norvegicus
gcaggaggaccagaag

SEQ ID NO: 506664 - DNA, 16 bp, R. norvegicus
gcaggaggagcaagag

SEQ ID NO: 506665 - DNA, 16 bp, R. norvegicus
gcaggaggagcagcag

SEQ ID NO: 506666 - DNA, 16 bp, R. norvegicus
gcaggaggaggagctg

SEQ ID NO: 506667 - DNA, 16 bp, R. norvegicus
gcaggaggatcaggag

SEQ ID NO: 506668 - DNA, 16 bp, R. norvegicus
gcaggaggatcaggat

SEQ ID NO: 506669 - DNA, 16 bp, R. norvegicus
gcaggaggatgacaag

SEQ ID NO: 506670 - DNA, 16 bp, R. norvegicus
gcaggaggcagagcag

SEQ ID NO: 506671 - DNA, 16 bp, R. norvegicus
gcaggaggtggaggca

SEQ ID NO: 506672 - DNA, 16 bp, R. norvegicus
gcaggagtgaccagga

SEQ ID NO: 506673 - DNA, 16 bp, R. norvegicus
gcaggatctgatgcag

SEQ ID NO: 506674 - DNA, 31 bp, R. norvegicus
gcaggatgtggcaactggaggtctcagtggc

SEQ ID NO: 506675 - DNA, 16 bp, R. norvegicus
gcaggcaaaacagcca

SEQ ID NO: 506676 - DNA, 16 bp, R. norvegicus
gcaggcaacacacaca

SEQ ID NO: 506677 - DNA, 16 bp, R. norvegicus
gcaggcaagacactca

SEQ ID NO: 506678 - DNA, 16 bp, R. norvegicus
gcaggcactcagagtt

SEQ ID NO: 506679 - DNA, 16 bp, R. norvegicus
gcaggcactctaccaa

SEQ ID NO: 506680 - DNA, 16 bp, R. norvegicus
gcaggcagaaactgaa

SEQ ID NO: 506681 - DNA, 16 bp, R. norvegicus
gcaggcagagacagag

SEQ ID NO: 506682 - DNA, 16 bp, R. norvegicus
gcaggcagagacaggc

SEQ ID NO: 506683 - DNA, 16 bp, R. norvegicus
gcaggcagagagagca

SEQ ID NO: 506684 - DNA, 16 bp, R. norvegicus
gcaggcagagctgagg

SEQ ID NO: 506685 - DNA, 16 bp, R. norvegicus
gcaggcagagttcaag

SEQ ID NO: 506686 - DNA, 16 bp, R. norvegicus
gcaggcagcagcagct

SEQ ID NO: 506687 - DNA, 16 bp, R. norvegicus
gcaggcagccaggcag

SEQ ID NO: 506688 - DNA, 16 bp, R. norvegicus
gcaggcaggacagcat

SEQ ID NO: 506689 - DNA, 16 bp, R. norvegicus
gcaggcaggagagctg

SEQ ID NO: 506690 - DNA, 16 bp, R. norvegicus
gcaggcaggcagcagg

SEQ ID NO: 506691 - DNA, 16 bp, R. norvegicus
gcaggcaggcagccag

SEQ ID NO: 506692 - DNA, 16 bp, R. norvegicus
gcaggcatgacagcag

SEQ ID NO: 506693 - DNA, 16 bp, R. norvegicus
gcaggcatggctctgg

SEQ ID NO: 506694 - DNA, 16 bp, R. norvegicus
gcaggccagaagaagg

SEQ ID NO: 506695 - DNA, 16 bp, R. norvegicus
gcaggccaggaagcag

SEQ ID NO: 506696 - DNA, 16 bp, R. norvegicus
gcaggccatctttgga

SEQ ID NO: 506697 - DNA, 16 bp, R. norvegicus
gcaggcccacagcagt

SEQ ID NO: 506698 - DNA, 16 bp, R. norvegicus
gcaggcccttctggtt

SEQ ID NO: 506699 - DNA, 16 bp, R. norvegicus
gcaggcctggtgctgg

SEQ ID NO: 506700 - DNA, 16 bp, R. norvegicus
gcaggcgcaggcgcag

SEQ ID NO: 506701 - DNA, 16 bp, R. norvegicus
gcaggcgtacatgcag

SEQ ID NO: 506702 - DNA, 16 bp, R. norvegicus
gcaggctctgaatgtc

SEQ ID NO: 506703 - DNA, 16 bp, R. norvegicus
gcaggctctgaattgg

SEQ ID NO: 506704 - DNA, 16 bp, R. norvegicus
gcaggctgaccagctc

SEQ ID NO: 506705 - DNA, 16 bp, R. norvegicus
gcaggctgagcaagtc

SEQ ID NO: 506706 - DNA, 16 bp, R. norvegicus
gcaggctggcctcaaa

SEQ ID NO: 506707 - DNA, 16 bp, R. norvegicus
gcaggctggctggctg

SEQ ID NO: 506708 - DNA, 16 bp, R. norvegicus
gcaggcttattcagcc

SEQ ID NO: 506709 - DNA, 16 bp, R. norvegicus
gcaggctttgagatct

SEQ ID NO: 506710 - DNA, 16 bp, R. norvegicus
gcaggctttgggtctg

SEQ ID NO: 506711 - DNA, 16 bp, R. norvegicus
gcagggaagacagagg

SEQ ID NO: 506712 - DNA, 16 bp, R. norvegicus
gcagggacaggcagat

SEQ ID NO: 506713 - DNA, 16 bp, R. norvegicus
gcagggaccatggagg

SEQ ID NO: 506714 - DNA, 16 bp, R. norvegicus
gcagggaccctgacag

SEQ ID NO: 506715 - DNA, 16 bp, R. norvegicus
gcagggagcagtctct

SEQ ID NO: 506716 - DNA, 16 bp, R. norvegicus
gcagggaggtggaagg

SEQ ID NO: 506717 - DNA, 16 bp, R. norvegicus
gcagggatgagcagtg

SEQ ID NO: 506718 - DNA, 16 bp, R. norvegicus
gcagggatgtgtgtgt

SEQ ID NO: 506719 - DNA, 16 bp, R. norvegicus
gcagggattagagagg

SEQ ID NO: 506720 - DNA, 16 bp, R. norvegicus
gcagggcagaaacctg

SEQ ID NO: 506721 - DNA, 16 bp, R. norvegicus
gcagggccagctcacc

SEQ ID NO: 506722 - DNA, 16 bp, R. norvegicus
gcagggccagctctgc

SEQ ID NO: 506723 - DNA, 16 bp, R. norvegicus
gcagggccagctcttc

SEQ ID NO: 506724 - DNA, 16 bp, R. norvegicus
gcagggcccagagagt

SEQ ID NO: 506725 - DNA, 16 bp, R. norvegicus
gcagggcctctaccac

SEQ ID NO: 506726 - DNA, 16 bp, R. norvegicus
gcagggctagctctcc

SEQ ID NO: 506727 - DNA, 16 bp, R. norvegicus
gcagggctggggagat

SEQ ID NO: 506728 - DNA, 16 bp, R. norvegicus
gcagggcttcagcagg

SEQ ID NO: 506729 - DNA, 16 bp, R. norvegicus
gcaggggcagaagcag

SEQ ID NO: 506730 - DNA, 16 bp, R. norvegicus
gcaggggcagcagcag

SEQ ID NO: 506731 - DNA, 16 bp, R. norvegicus
gcaggggctggggctg

SEQ ID NO: 506732 - DNA, 16 bp, R. norvegicus
gcagggggagggagta

SEQ ID NO: 506733 - DNA, 16 bp, R. norvegicus
gcagggggatgactca

SEQ ID NO: 506734 - DNA, 16 bp, R. norvegicus
gcagggggattgtgag

SEQ ID NO: 506735 - DNA, 16 bp, R. norvegicus
gcagggggctggagag

SEQ ID NO: 506736 - DNA, 16 bp, R. norvegicus
gcagggtcctcgttgc

SEQ ID NO: 506737 - DNA, 16 bp, R. norvegicus
gcaggtagatcattgg

SEQ ID NO: 506738 - DNA, 16 bp, R. norvegicus
gcaggtcagctacagt

SEQ ID NO: 506739 - DNA, 16 bp, R. norvegicus
gcaggtcagggagcag

SEQ ID NO: 506740 - DNA, 16 bp, R. norvegicus
gcaggtccctggggct

SEQ ID NO: 506741 - DNA, 16 bp, R. norvegicus
gcaggtctcccaggag

SEQ ID NO: 506742 - DNA, 16 bp, R. norvegicus
gcaggtctgtgccagc

SEQ ID NO: 506743 - DNA, 16 bp, R. norvegicus
gcaggtggacctctgt

SEQ ID NO: 506744 - DNA, 16 bp, R. norvegicus
gcaggtggatctccag

SEQ ID NO: 506745 - DNA, 16 bp, R. norvegicus
gcaggtggcagcagtg

SEQ ID NO: 506746 - DNA, 16 bp, R. norvegicus
gcaggtggccttcctg

SEQ ID NO: 506747 - DNA, 16 bp, R. norvegicus
gcaggtggtcctggct

SEQ ID NO: 506748 - DNA, 16 bp, R. norvegicus
gcaggtggtcctgggg

SEQ ID NO: 506749 - DNA, 16 bp, R. norvegicus
gcaggtgtctctctta

SEQ ID NO: 506750 - DNA, 16 bp, R. norvegicus
gcaggtgtggcggcag

SEQ ID NO: 506751 - DNA, 16 bp, R. norvegicus
gcaggtgtgtgccacc

SEQ ID NO: 506752 - DNA, 16 bp, R. norvegicus
gcaggttcagtgagag

SEQ ID NO: 506753 - DNA, 16 bp, R. norvegicus
gcaggtttgggactcc

SEQ ID NO: 506754 - DNA, 16 bp, R. norvegicus
gcagtaaagagcactt

SEQ ID NO: 506755 - DNA, 16 bp, R. norvegicus
gcagtaggtgtggcct

SEQ ID NO: 506756 - DNA, 16 bp, R. norvegicus
gcagtagtagcagcag

SEQ ID NO: 506757 - DNA, 16 bp, R. norvegicus
gcagtcagcagcagga

SEQ ID NO: 506758 - DNA, 16 bp, R. norvegicus
gcagtcagctgcagga

SEQ ID NO: 506759 - DNA, 16 bp, R. norvegicus
gcagtcatgaaacaga

SEQ ID NO: 506760 - DNA, 16 bp, R. norvegicus
gcagtccaggatgctg

SEQ ID NO: 506761 - DNA, 16 bp, R. norvegicus
gcagtcccaccaacag

SEQ ID NO: 506762 - DNA, 16 bp, R. norvegicus
gcagtccctggatggc

SEQ ID NO: 506763 - DNA, 16 bp, R. norvegicus
gcagtcctcctgcttc

SEQ ID NO: 506764 - DNA, 16 bp, R. norvegicus
gcagtctcaatgaacc

SEQ ID NO: 506765 - DNA, 24 bp, R. norvegicus
gcagtctcttctggtttcccaggc

SEQ ID NO: 506766 - DNA, 16 bp, R. norvegicus
gcagtctggacctcag

SEQ ID NO: 506767 - DNA, 16 bp, R. norvegicus
gcagtcttctctggtg

SEQ ID NO: 506768 - DNA, 16 bp, R. norvegicus
gcagtgaggaccctgc

SEQ ID NO: 506769 - DNA, 16 bp, R. norvegicus
gcagtgatagctggag

SEQ ID NO: 506770 - DNA, 16 bp, R. norvegicus
gcagtgcagagagaaa

SEQ ID NO: 506771 - DNA, 16 bp, R. norvegicus
gcagtgcccacagaag

SEQ ID NO: 506772 - DNA, 16 bp, R. norvegicus
gcagtgctccaagata

SEQ ID NO: 506773 - DNA, 16 bp, R. norvegicus
gcagtgctcctggaga

SEQ ID NO: 506774 - DNA, 16 bp, R. norvegicus
gcagtggaagacagca

SEQ ID NO: 506775 - DNA, 16 bp, R. norvegicus
gcagtggaggcagtgg

SEQ ID NO: 506776 - DNA, 16 bp, R. norvegicus
gcagtggagggagtgg

SEQ ID NO: 506777 - DNA, 16 bp, R. norvegicus
gcagtggcagaggcag

SEQ ID NO: 506778 - DNA, 16 bp, R. norvegicus
gcagtggcagcagtgg

SEQ ID NO: 506779 - DNA, 16 bp, R. norvegicus
gcagtggcccagctat

SEQ ID NO: 506780 - DNA, 16 bp, R. norvegicus
gcagtgggacacagag

SEQ ID NO: 506781 - DNA, 16 bp, R. norvegicus
gcagtggtgcaggatg

SEQ ID NO: 506782 - DNA, 16 bp, R. norvegicus
gcagtggtggcagcag

SEQ ID NO: 506783 - DNA, 16 bp, R. norvegicus
gcagtggtggcatatg

SEQ ID NO: 506784 - DNA, 16 bp, R. norvegicus
gcagtggtggtggcag

SEQ ID NO: 506785 - DNA, 16 bp, R. norvegicus
gcagtggtggtggtgg

SEQ ID NO: 506786 - DNA, 16 bp, R. norvegicus
gcagtggttctcaacc

SEQ ID NO: 506787 - DNA, 16 bp, R. norvegicus
gcagtgtccttgtcaa

SEQ ID NO: 506788 - DNA, 16 bp, R. norvegicus
gcagtgtctggagcta

SEQ ID NO: 506789 - DNA, 16 bp, R. norvegicus
gcagtgtgcagacaga

SEQ ID NO: 506790 - DNA, 16 bp, R. norvegicus
gcagtgtgcaggcaga

SEQ ID NO: 506791 - DNA, 16 bp, R. norvegicus
gcagtgttcaggcagg

SEQ ID NO: 506792 - DNA, 16 bp, R. norvegicus
gcagtgttgctggtct

SEQ ID NO: 506793 - DNA, 17 bp, R. norvegicus
gcagtgttggtggtctc

SEQ ID NO: 506794 - DNA, 16 bp, R. norvegicus
gcagttcagttcacag

SEQ ID NO: 506795 - DNA, 16 bp, R. norvegicus
gcagttcatcaaggag

SEQ ID NO: 506796 - DNA, 16 bp, R. norvegicus
gcagttggagcccagt

SEQ ID NO: 506797 - DNA, 16 bp, R. norvegicus
gcagtttcccaataaa

SEQ ID NO: 506798 - DNA, 16 bp, R. norvegicus
gcagtttctcctccct

SEQ ID NO: 506799 - DNA, 16 bp, R. norvegicus
gcagtttctctgtgta

SEQ ID NO: 506800 - DNA, 16 bp, R. norvegicus
gcagtttctggatgac

SEQ ID NO: 506801 - DNA, 16 bp, R. norvegicus
gcagtttgacaacatg

SEQ ID NO: 506802 - DNA, 16 bp, R. norvegicus
gcagtttgtgtctgac

SEQ ID NO: 506803 - DNA, 16 bp, R. norvegicus
gcataaaccaggtgtg

SEQ ID NO: 506804 - DNA, 16 bp, R. norvegicus
gcataaatattcagaa

SEQ ID NO: 506805 - DNA, 16 bp, R. norvegicus
gcatacacacaagcac

SEQ ID NO: 506806 - DNA, 16 bp, R. norvegicus
gcatagttagactttt

SEQ ID NO: 506807 - DNA, 16 bp, R. norvegicus
gcatataaaaaagaca

SEQ ID NO: 506808 - DNA, 16 bp, R. norvegicus
gcatatactgaaaaga

SEQ ID NO: 506809 - DNA, 16 bp, R. norvegicus
gcatatgcagcagagg

SEQ ID NO: 506810 - DNA, 16 bp, R. norvegicus
gcatattcttttgtgt

SEQ ID NO: 506811 - DNA, 16 bp, R. norvegicus
gcatcaccaacagcat

SEQ ID NO: 506812 - DNA, 16 bp, R. norvegicus
gcatcaccaccaccca

SEQ ID NO: 506813 - DNA, 16 bp, R. norvegicus
gcatcacccacagaat

SEQ ID NO: 506814 - DNA, 16 bp, R. norvegicus
gcatcagcagcagcag

SEQ ID NO: 506815 - DNA, 16 bp, R. norvegicus
gcatcagctccagcct

SEQ ID NO: 506816 - DNA, 16 bp, R. norvegicus
gcatcagctccttcct

SEQ ID NO: 506817 - DNA, 16 bp, R. norvegicus
gcatcatcaatattgt

SEQ ID NO: 506818 - DNA, 23 bp, R. norvegicus
gcatcatttcggtgtcactgaga

SEQ ID NO: 506819 - DNA, 16 bp, R. norvegicus
gcatccacatggtgac

SEQ ID NO: 506820 - DNA, 16 bp, R. norvegicus
gcatccagactttggt

SEQ ID NO: 506821 - DNA, 16 bp, R. norvegicus
gcatccccaggcagct

SEQ ID NO: 506822 - DNA, 16 bp, R. norvegicus
gcatccctgggatgag

SEQ ID NO: 506823 - DNA, 16 bp, R. norvegicus
gcatccctggggtccc

SEQ ID NO: 506824 - DNA, 34 bp, R. norvegicus
gcatcctcgccagcatctgctgtcacctgagttt

SEQ ID NO: 506825 - DNA, 16 bp, R. norvegicus
gcatccttgccagcat

SEQ ID NO: 506826 - DNA, 16 bp, R. norvegicus
gcatctagcaggggag

SEQ ID NO: 506827 - DNA, 16 bp, R. norvegicus
gcatctccaaccctaa

SEQ ID NO: 506828 - DNA, 16 bp, R. norvegicus
gcatctccccaggaaa

SEQ ID NO: 506829 - DNA, 16 bp, R. norvegicus
gcatctcctgcaggag

SEQ ID NO: 506830 - DNA, 16 bp, R. norvegicus
gcatctccttccttgg

SEQ ID NO: 506831 - DNA, 16 bp, R. norvegicus
gcatctgaagtgctga

SEQ ID NO: 506832 - DNA, 16 bp, R. norvegicus
gcatctgaattctttc

SEQ ID NO: 506833 - DNA, 16 bp, R. norvegicus
gcatctgcagtgctga

SEQ ID NO: 506834 - DNA, 16 bp, R. norvegicus
gcatctggaacacata

SEQ ID NO: 506835 - DNA, 18 bp, R. norvegicus
gcatctggaacacatgag

SEQ ID NO: 506836 - DNA, 16 bp, R. norvegicus
gcatctggaagagtcc

SEQ ID NO: 506837 - DNA, 16 bp, R. norvegicus
gcatctgggactttgt

SEQ ID NO: 506838 - DNA, 16 bp, R. norvegicus
gcatctgggtcctttc

SEQ ID NO: 506839 - DNA, 16 bp, R. norvegicus
gcatctgtatcagtaa

SEQ ID NO: 506840 - DNA, 16 bp, R. norvegicus
gcatctgtattggtta

SEQ ID NO: 506841 - DNA, 16 bp, R. norvegicus
gcatctgtctgtctgt

SEQ ID NO: 506842 - DNA, 16 bp, R. norvegicus
gcatgaagacccgagt

SEQ ID NO: 506843 - DNA, 16 bp, R. norvegicus
gcatgagttccaggac

SEQ ID NO: 506844 - DNA, 16 bp, R. norvegicus
gcatgcacacacacac

SEQ ID NO: 506845 - DNA, 16 bp, R. norvegicus
gcatgcacacacccat

SEQ ID NO: 506846 - DNA, 16 bp, R. norvegicus
gcatgcaggagctgga

SEQ ID NO: 506847 - DNA, 16 bp, R. norvegicus
gcatgcaggaggccct

SEQ ID NO: 506848 - DNA, 16 bp, R. norvegicus
gcatgcatgtggaggt

SEQ ID NO: 506849 - DNA, 16 bp, R. norvegicus
gcatgctgacaggaga

SEQ ID NO: 506850 - DNA, 16 bp, R. norvegicus
gcatgctgggaaagca

SEQ ID NO: 506851 - DNA, 21 bp, R. norvegicus
gcatggaagctggaagcaatg

SEQ ID NO: 506852 - DNA, 16 bp, R. norvegicus
gcatggacacacacac

SEQ ID NO: 506853 - DNA, 16 bp, R. norvegicus
gcatggagcaggagga

SEQ ID NO: 506854 - DNA, 16 bp, R. norvegicus
gcatggagctgtttga

SEQ ID NO: 506855 - DNA, 16 bp, R. norvegicus
gcatggcagcaggcag

SEQ ID NO: 506856 - DNA, 16 bp, R. norvegicus
gcatggctgttctctg

SEQ ID NO: 506857 - DNA, 16 bp, R. norvegicus
gcatgggattctttct

SEQ ID NO: 506858 - DNA, 16 bp, R. norvegicus
gcatgggcactgggga

SEQ ID NO: 506859 - DNA, 16 bp, R. norvegicus
gcatgggctggaccta

SEQ ID NO: 506860 - DNA, 16 bp, R. norvegicus
gcatggggggagggtt

SEQ ID NO: 506861 - DNA, 16 bp, R. norvegicus
gcatggtgataaatat

SEQ ID NO: 506862 - DNA, 16 bp, R. norvegicus
gcatggtggcattcag

SEQ ID NO: 506863 - DNA, 16 bp, R. norvegicus
gcatggtggctcacaa

SEQ ID NO: 506864 - DNA, 16 bp, R. norvegicus
gcatggtggggtatct

SEQ ID NO: 506865 - DNA, 16 bp, R. norvegicus
gcatgtaattaaagtg

SEQ ID NO: 506866 - DNA, 16 bp, R. norvegicus
gcatgtacatgtgtgt

SEQ ID NO: 506867 - DNA, 16 bp, R. norvegicus
gcatgtatacctgtgt

SEQ ID NO: 506868 - DNA, 16 bp, R. norvegicus
gcatgtatgcacctgc

SEQ ID NO: 506869 - DNA, 16 bp, R. norvegicus
gcatgtatgcatgtga

SEQ ID NO: 506870 - DNA, 16 bp, R. norvegicus
gcatgtcccagattcc

SEQ ID NO: 506871 - DNA, 16 bp, R. norvegicus
gcatgtctgtacatat

SEQ ID NO: 506872 - DNA, 16 bp, R. norvegicus
gcatgtgagcacacac

SEQ ID NO: 506873 - DNA, 16 bp, R. norvegicus
gcatgtgagtgcagtg

SEQ ID NO: 506874 - DNA, 16 bp, R. norvegicus
gcatgtgcaaggccct

SEQ ID NO: 506875 - DNA, 16 bp, R. norvegicus
gcatgtggtgcacaca

SEQ ID NO: 506876 - DNA, 16 bp, R. norvegicus
gcatgtgtacatgcat

SEQ ID NO: 506877 - DNA, 16 bp, R. norvegicus
gcatgtgtctgtgtgc

SEQ ID NO: 506878 - DNA, 16 bp, R. norvegicus
gcatgtgtgtctttgt

SEQ ID NO: 506879 - DNA, 16 bp, R. norvegicus
gcatgtgtgtttgtgc

SEQ ID NO: 506880 - DNA, 16 bp, R. norvegicus
gcattaaaggtgtgca

SEQ ID NO: 506881 - DNA, 47 bp, R. norvegicus
gcattagtactgataaaatgcctacagagactgaggaggagttacca

SEQ ID NO: 506882 - DNA, 16 bp, R. norvegicus
gcattagttcctgcct

SEQ ID NO: 506883 - DNA, 16 bp, R. norvegicus
gcattcaaatatatga

SEQ ID NO: 506884 - DNA, 16 bp, R. norvegicus
gcattccacagaccac

SEQ ID NO: 506885 - DNA, 16 bp, R. norvegicus
gcattccagacctggg

SEQ ID NO: 506886 - DNA, 16 bp, R. norvegicus
gcattcctcagctgtg

SEQ ID NO: 506887 - DNA, 47 bp, R. norvegicus
gcattcctcagctgtgaattctttgtttagctctgaaccccattttt

SEQ ID NO: 506888 - DNA, 16 bp, R. norvegicus
gcattctacatgctga

SEQ ID NO: 506889 - DNA, 16 bp, R. norvegicus
gcattgaatcccatta

SEQ ID NO: 506890 - DNA, 16 bp, R. norvegicus
gcattgaatctggaga

SEQ ID NO: 506891 - DNA, 16 bp, R. norvegicus
gcattgagaaggttga

SEQ ID NO: 506892 - DNA, 16 bp, R. norvegicus
gcattgctgcagtcag

SEQ ID NO: 506893 - DNA, 16 bp, R. norvegicus
gcattgggtccctgca

SEQ ID NO: 506894 - DNA, 16 bp, R. norvegicus
gcattgtccagcatca

SEQ ID NO: 506895 - DNA, 16 bp, R. norvegicus
gcattgttcagtttcc

SEQ ID NO: 506896 - DNA, 16 bp, R. norvegicus
gcattgttggaggaag

SEQ ID NO: 506897 - DNA, 16 bp, R. norvegicus
gcattgtttagcttcc

SEQ ID NO: 506898 - DNA, 16 bp, R. norvegicus
gcatttatttctctct

SEQ ID NO: 506899 - DNA, 16 bp, R. norvegicus
gcatttcacaaaattc

SEQ ID NO: 506900 - DNA, 16 bp, R. norvegicus
gcatttccttgatgac

SEQ ID NO: 506901 - DNA, 16 bp, R. norvegicus
gcatttctttttgaca

SEQ ID NO: 506902 - DNA, 16 bp, R. norvegicus
gcatttgactttgaat

SEQ ID NO: 506903 - DNA, 16 bp, R. norvegicus
gcatttgagaggcaga

SEQ ID NO: 506904 - DNA, 16 bp, R. norvegicus
gcatttgctgctcctg

SEQ ID NO: 506905 - DNA, 16 bp, R. norvegicus
gcatttgtgtgtgtgc

SEQ ID NO: 506906 - DNA, 16 bp, R. norvegicus
gcatttgttgctcttg

SEQ ID NO: 506907 - DNA, 16 bp, R. norvegicus
gcattttaaaaataaa

SEQ ID NO: 506908 - DNA, 16 bp, R. norvegicus
gcattttacacacaca

SEQ ID NO: 506909 - DNA, 16 bp, R. norvegicus
gcattttcctgtattt

SEQ ID NO: 506910 - DNA, 16 bp, R. norvegicus
gcattttctacaaatg

SEQ ID NO: 506911 - DNA, 16 bp, R. norvegicus
gcattttgattggctg

SEQ ID NO: 506912 - DNA, 16 bp, R. norvegicus
gcatttttcttctctt

SEQ ID NO: 506913 - DNA, 16 bp, R. norvegicus
gcatttttttaaaaag

SEQ ID NO: 506914 - DNA, 16 bp, R. norvegicus
gcattttttttcctct

SEQ ID NO: 506915 - DNA, 16 bp, R. norvegicus
gccaaaaccatccatt

SEQ ID NO: 506916 - DNA, 17 bp, R. norvegicus
gccaaaagcaatctaca

SEQ ID NO: 506917 - DNA, 16 bp, R. norvegicus
gccaaaataaatcttt

SEQ ID NO: 506918 - DNA, 16 bp, R. norvegicus
gccaaacagctccctg

SEQ ID NO: 506919 - DNA, 16 bp, R. norvegicus
gccaaacattaggtgg

SEQ ID NO: 506920 - DNA, 16 bp, R. norvegicus
gccaaacccaaagcag

SEQ ID NO: 506921 - DNA, 16 bp, R. norvegicus
gccaaagaggaagatt

SEQ ID NO: 506922 - DNA, 16 bp, R. norvegicus
gccaaagcaatctaca

SEQ ID NO: 506923 - DNA, 16 bp, R. norvegicus
gccaaagccaaagcca

SEQ ID NO: 506924 - DNA, 16 bp, R. norvegicus
gccaaagctgccaagt

SEQ ID NO: 506925 - DNA, 16 bp, R. norvegicus
gccaacaacaaactaa

SEQ ID NO: 506926 - DNA, 16 bp, R. norvegicus
gccaacaggaaccaga

SEQ ID NO: 506927 - DNA, 16 bp, R. norvegicus
gccaacatcaccctag

SEQ ID NO: 506928 - DNA, 16 bp, R. norvegicus
gccaacatccccccaa

SEQ ID NO: 506929 - DNA, 16 bp, R. norvegicus
gccaaccaatggctgg

SEQ ID NO: 506930 - DNA, 16 bp, R. norvegicus
gccaaccagagctaca

SEQ ID NO: 506931 - DNA, 16 bp, R. norvegicus
gccaaccaggactaca

SEQ ID NO: 506932 - DNA, 16 bp, R. norvegicus
gccaaccattgaactg

SEQ ID NO: 506933 - DNA, 16 bp, R. norvegicus
gccaacctcagctaca

SEQ ID NO: 506934 - DNA, 16 bp, R. norvegicus
gccaacctgggccaca

SEQ ID NO: 506935 - DNA, 16 bp, R. norvegicus
gccaagaacttttcct

SEQ ID NO: 506936 - DNA, 16 bp, R. norvegicus
gccaagaagtgcatgg

SEQ ID NO: 506937 - DNA, 16 bp, R. norvegicus
gccaagcacagtggca

SEQ ID NO: 506938 - DNA, 16 bp, R. norvegicus
gccaagcaggatgtca

SEQ ID NO: 506939 - DNA, 16 bp, R. norvegicus
gccaagccaccagagc

SEQ ID NO: 506940 - DNA, 16 bp, R. norvegicus
gccaagcctgacagcc

SEQ ID NO: 506941 - DNA, 16 bp, R. norvegicus
gccaagcctgaggacc

SEQ ID NO: 506942 - DNA, 16 bp, R. norvegicus
gccaagctctgtctct

SEQ ID NO: 506943 - DNA, 16 bp, R. norvegicus
gccaaggagatggctc

SEQ ID NO: 506944 - DNA, 16 bp, R. norvegicus
gccaaggatgacttta

SEQ ID NO: 506945 - DNA, 16 bp, R. norvegicus
gccaaggatgtgggca

SEQ ID NO: 506946 - DNA, 16 bp, R. norvegicus
gccaaggcaggaattc

SEQ ID NO: 506947 - DNA, 16 bp, R. norvegicus
gccaaggccaaggcca

SEQ ID NO: 506948 - DNA, 16 bp, R. norvegicus
gccaaggctacataaa

SEQ ID NO: 506949 - DNA, 16 bp, R. norvegicus
gccaaggtcaagccag

SEQ ID NO: 506950 - DNA, 17 bp, R. norvegicus
gccaagtccaagaacca

SEQ ID NO: 506951 - DNA, 16 bp, R. norvegicus
gccaatccatcagcat

SEQ ID NO: 506952 - DNA, 16 bp, R. norvegicus
gccaatcttccccaag

SEQ ID NO: 506953 - DNA, 16 bp, R. norvegicus
gccaatgctgatctga

SEQ ID NO: 506954 - DNA, 16 bp, R. norvegicus
gccaatgcttttaacc

SEQ ID NO: 506955 - DNA, 16 bp, R. norvegicus
gccaatggcttatgct

SEQ ID NO: 506956 - DNA, 16 bp, R. norvegicus
gccaatggcttctctc

SEQ ID NO: 506957 - DNA, 16 bp, R. norvegicus
gccaatttcctagaca

SEQ ID NO: 506958 - DNA, 16 bp, R. norvegicus
gccacaacaactgccc

SEQ ID NO: 506959 - DNA, 16 bp, R. norvegicus
gccacaactttggaaa

SEQ ID NO: 506960 - DNA, 16 bp, R. norvegicus
gccacaatccttcctc

SEQ ID NO: 506961 - DNA, 16 bp, R. norvegicus
gccacaattactctga

SEQ ID NO: 506962 - DNA, 16 bp, R. norvegicus
gccacacctcctaaaa

SEQ ID NO: 506963 - DNA, 16 bp, R. norvegicus
gccacacctgcctctg

SEQ ID NO: 506964 - DNA, 16 bp, R. norvegicus
gccacacctggggatc

SEQ ID NO: 506965 - DNA, 16 bp, R. norvegicus
gccacactccagggag

SEQ ID NO: 506966 - DNA, 16 bp, R. norvegicus
gccacagaagcagcaa

SEQ ID NO: 506967 - DNA, 16 bp, R. norvegicus
gccacagacagcaagc

SEQ ID NO: 506968 - DNA, 16 bp, R. norvegicus
gccacagagacagagt

SEQ ID NO: 506969 - DNA, 16 bp, R. norvegicus
gccacagagatggctc

SEQ ID NO: 506970 - DNA, 16 bp, R. norvegicus
gccacagatgtctttg

SEQ ID NO: 506971 - DNA, 16 bp, R. norvegicus
gccacagcagccacag

SEQ ID NO: 506972 - DNA, 16 bp, R. norvegicus
gccacagctctctgtg

SEQ ID NO: 506973 - DNA, 16 bp, R. norvegicus
gccacagtcagagaca

SEQ ID NO: 506974 - DNA, 16 bp, R. norvegicus
gccacagtcaggaagc

SEQ ID NO: 506975 - DNA, 16 bp, R. norvegicus
gccacatggctctggc

SEQ ID NO: 506976 - DNA, 16 bp, R. norvegicus
gccaccaaaaccagtc

SEQ ID NO: 506977 - DNA, 16 bp, R. norvegicus
gccaccaaagcaaaca

SEQ ID NO: 506978 - DNA, 16 bp, R. norvegicus
gccaccaaccagacag

SEQ ID NO: 506979 - DNA, 16 bp, R. norvegicus
gccaccaagatggctc

SEQ ID NO: 506980 - DNA, 16 bp, R. norvegicus
gccaccaagccagaca

SEQ ID NO: 506981 - DNA, 16 bp, R. norvegicus
gccaccaagcctgcct

SEQ ID NO: 506982 - DNA, 16 bp, R. norvegicus
gccaccacacactttc

SEQ ID NO: 506983 - DNA, 16 bp, R. norvegicus
gccaccacacatggct

SEQ ID NO: 506984 - DNA, 16 bp, R. norvegicus
gccaccacacctggct

SEQ ID NO: 506985 - DNA, 16 bp, R. norvegicus
gccaccaccacctcca

SEQ ID NO: 506986 - DNA, 16 bp, R. norvegicus
gccaccaccatcatca

SEQ ID NO: 506987 - DNA, 16 bp, R. norvegicus
gccaccaccatccagc

SEQ ID NO: 506988 - DNA, 16 bp, R. norvegicus
gccaccaccatctggc

SEQ ID NO: 506989 - DNA, 16 bp, R. norvegicus
gccaccacccctggct

SEQ ID NO: 506990 - DNA, 16 bp, R. norvegicus
gccaccacctcccagc

SEQ ID NO: 506991 - DNA, 16 bp, R. norvegicus
gccaccactgccacca

SEQ ID NO: 506992 - DNA, 16 bp, R. norvegicus
gccaccactgcccagc

SEQ ID NO: 506993 - DNA, 16 bp, R. norvegicus
gccaccactgctcagc

SEQ ID NO: 506994 - DNA, 16 bp, R. norvegicus
gccaccactgctgctg

SEQ ID NO: 506995 - DNA, 16 bp, R. norvegicus
gccaccagccaccagc

SEQ ID NO: 506996 - DNA, 16 bp, R. norvegicus
gccaccaggcccagct

SEQ ID NO: 506997 - DNA, 16 bp, R. norvegicus
gccaccagggaacaga

SEQ ID NO: 506998 - DNA, 16 bp, R. norvegicus
gccaccaggttcctgc

SEQ ID NO: 506999 - DNA, 16 bp, R. norvegicus
gccaccatgcccagct

SEQ ID NO: 507000 - DNA, 16 bp, R. norvegicus
gccaccatgcctgtcc

SEQ ID NO: 507001 - DNA, 16 bp, R. norvegicus
gccaccatgctcaact

SEQ ID NO: 507002 - DNA, 16 bp, R. norvegicus
gccaccattagtaaaa

SEQ ID NO: 507003 - DNA, 16 bp, R. norvegicus
gccacccactcacctc

SEQ ID NO: 507004 - DNA, 16 bp, R. norvegicus
gccacccccacagtga

SEQ ID NO: 507005 - DNA, 16 bp, R. norvegicus
gccacccctgagcagg

SEQ ID NO: 507006 - DNA, 16 bp, R. norvegicus
gccaccctacccccaa

SEQ ID NO: 507007 - DNA, 16 bp, R. norvegicus
gccaccctttccagga

SEQ ID NO: 507008 - DNA, 16 bp, R. norvegicus
gccaccgtccagggca

SEQ ID NO: 507009 - DNA, 16 bp, R. norvegicus
gccacctcaccagcct

SEQ ID NO: 507010 - DNA, 16 bp, R. norvegicus
gccacctcaccagtcc

SEQ ID NO: 507011 - DNA, 16 bp, R. norvegicus
gccacctccaccacca

SEQ ID NO: 507012 - DNA, 16 bp, R. norvegicus
gccacctccccagcct

SEQ ID NO: 507013 - DNA, 16 bp, R. norvegicus
gccacctcctgtaacc

SEQ ID NO: 507014 - DNA, 16 bp, R. norvegicus
gccacctctccagtgc

SEQ ID NO: 507015 - DNA, 16 bp, R. norvegicus
gccacctctgcagccc

SEQ ID NO: 507016 - DNA, 16 bp, R. norvegicus
gccacctgcaggagaa

SEQ ID NO: 507017 - DNA, 16 bp, R. norvegicus
gccacctgctggctcc

SEQ ID NO: 507018 - DNA, 16 bp, R. norvegicus
gccacggagagaacat

SEQ ID NO: 507019 - DNA, 16 bp, R. norvegicus
gccacgtgggtgctgg

SEQ ID NO: 507020 - DNA, 16 bp, R. norvegicus
gccactatgcccagcc

SEQ ID NO: 507021 - DNA, 16 bp, R. norvegicus
gccactatgcctggct

SEQ ID NO: 507022 - DNA, 16 bp, R. norvegicus
gccactcaccatcctg

SEQ ID NO: 507023 - DNA, 16 bp, R. norvegicus
gccactccttgggctg

SEQ ID NO: 507024 - DNA, 16 bp, R. norvegicus
gccactgcacactttc

SEQ ID NO: 507025 - DNA, 16 bp, R. norvegicus
gccactgcagttctga

SEQ ID NO: 507026 - DNA, 16 bp, R. norvegicus
gccactgcctggcagc

SEQ ID NO: 507027 - DNA, 17 bp, R. norvegicus
gccactgggaactggga

SEQ ID NO: 507028 - DNA, 16 bp, R. norvegicus
gccactggggaaaatt

SEQ ID NO: 507029 - DNA, 16 bp, R. norvegicus
gccactggtgttctgt

SEQ ID NO: 507030 - DNA, 16 bp, R. norvegicus
gccactgtggaatcca

SEQ ID NO: 507031 - DNA, 16 bp, R. norvegicus
gccacttcaagctctt

SEQ ID NO: 507032 - DNA, 16 bp, R. norvegicus
gccacttcagtctctg

SEQ ID NO: 507033 - DNA, 16 bp, R. norvegicus
gccacttcctgagcca

SEQ ID NO: 507034 - DNA, 16 bp, R. norvegicus
gccacttcctggtgac

SEQ ID NO: 507035 - DNA, 16 bp, R. norvegicus
gccagaaactggagac

SEQ ID NO: 507036 - DNA, 16 bp, R. norvegicus
gccagaaactgtaaag

SEQ ID NO: 507037 - DNA, 16 bp, R. norvegicus
gccagaacctgaccaa

SEQ ID NO: 507038 - DNA, 16 bp, R. norvegicus
gccagaagaccctgga

SEQ ID NO: 507039 - DNA, 16 bp, R. norvegicus
gccagaagatccagga

SEQ ID NO: 507040 - DNA, 24 bp, R. norvegicus
gccagaagatcctggacagatgtc

SEQ ID NO: 507041 - DNA, 16 bp, R. norvegicus
gccagaagctggaaca

SEQ ID NO: 507042 - DNA, 16 bp, R. norvegicus
gccagaatatggaaaa

SEQ ID NO: 507043 - DNA, 16 bp, R. norvegicus
gccagacatggtggtg

SEQ ID NO: 507044 - DNA, 16 bp, R. norvegicus
gccagaccctgaagga

SEQ ID NO: 507045 - DNA, 16 bp, R. norvegicus
gccagagacctgggag

SEQ ID NO: 507046 - DNA, 18 bp, R. norvegicus
gccagagagacagtagaa

SEQ ID NO: 507047 - DNA, 16 bp, R. norvegicus
gccagagcaatcagaa

SEQ ID NO: 507048 - DNA, 16 bp, R. norvegicus
gccagagcactcagac

SEQ ID NO: 507049 - DNA, 16 bp, R. norvegicus
gccagagcagccagtg

SEQ ID NO: 507050 - DNA, 16 bp, R. norvegicus
gccagagcagtgctgg

SEQ ID NO: 507051 - DNA, 16 bp, R. norvegicus
gccagagccctgagag

SEQ ID NO: 507052 - DNA, 16 bp, R. norvegicus
gccagaggacaacctc

SEQ ID NO: 507053 - DNA, 16 bp, R. norvegicus
gccagaggacaacttc

SEQ ID NO: 507054 - DNA, 16 bp, R. norvegicus
gccagaggacaacttg

SEQ ID NO: 507055 - DNA, 16 bp, R. norvegicus
gccagaggaggcagaa

SEQ ID NO: 507056 - DNA, 16 bp, R. norvegicus
gccagaggccagaggc

SEQ ID NO: 507057 - DNA, 16 bp, R. norvegicus
gccagaggcctcagac

SEQ ID NO: 507058 - DNA, 16 bp, R. norvegicus
gccagagggatggctc

SEQ ID NO: 507059 - DNA, 16 bp, R. norvegicus
gccagataaagccatc

SEQ ID NO: 507060 - DNA, 16 bp, R. norvegicus
gccagatatgcaccag

SEQ ID NO: 507061 - DNA, 16 bp, R. norvegicus
gccagatcccctggag

SEQ ID NO: 507062 - DNA, 16 bp, R. norvegicus
gccagatcctctggaa

SEQ ID NO: 507063 - DNA, 16 bp, R. norvegicus
gccagatcctgaccaa

SEQ ID NO: 507064 - DNA, 16 bp, R. norvegicus
gccagatgacaaggtg

SEQ ID NO: 507065 - DNA, 16 bp, R. norvegicus
gccagcaagaatacac

SEQ ID NO: 507066 - DNA, 16 bp, R. norvegicus
gccagcaagccccaag

SEQ ID NO: 507067 - DNA, 16 bp, R. norvegicus
gccagcaaggggcaga

SEQ ID NO: 507068 - DNA, 16 bp, R. norvegicus
gccagcacttctttgc

SEQ ID NO: 507069 - DNA, 16 bp, R. norvegicus
gccagcagatcctgga

SEQ ID NO: 507070 - DNA, 16 bp, R. norvegicus
gccagcagcacctctg

SEQ ID NO: 507071 - DNA, 16 bp, R. norvegicus
gccagcagcctctgct

SEQ ID NO: 507072 - DNA, 16 bp, R. norvegicus
gccagcaggaaggaag

SEQ ID NO: 507073 - DNA, 16 bp, R. norvegicus
gccagcatctgctgcc

SEQ ID NO: 507074 - DNA, 16 bp, R. norvegicus
gccagcatggcctaca

SEQ ID NO: 507075 - DNA, 26 bp, R. norvegicus
gccagcatttgctgtcacctgagttt

SEQ ID NO: 507076 - DNA, 16 bp, R. norvegicus
gccagccagcccagcc

SEQ ID NO: 507077 - DNA, 16 bp, R. norvegicus
gccagccagcctaacc

SEQ ID NO: 507078 - DNA, 16 bp, R. norvegicus
gccagccagcctgcct

SEQ ID NO: 507079 - DNA, 16 bp, R. norvegicus
gccagccagggtcaca

SEQ ID NO: 507080 - DNA, 16 bp, R. norvegicus
gccagccagtcagcca

SEQ ID NO: 507081 - DNA, 16 bp, R. norvegicus
gccagccatgggcaca

SEQ ID NO: 507082 - DNA, 16 bp, R. norvegicus
gccagcccagcctact

SEQ ID NO: 507083 - DNA, 16 bp, R. norvegicus
gccagcccaggcttct

SEQ ID NO: 507084 - DNA, 16 bp, R. norvegicus
gccagccctggccagc

SEQ ID NO: 507085 - DNA, 16 bp, R. norvegicus
gccagcctatgctaca

SEQ ID NO: 507086 - DNA, 16 bp, R. norvegicus
gccagcctcagccaca

SEQ ID NO: 507087 - DNA, 16 bp, R. norvegicus
gccagcctctctctct

SEQ ID NO: 507088 - DNA, 16 bp, R. norvegicus
gccagcctctgctgtc

SEQ ID NO: 507089 - DNA, 16 bp, R. norvegicus
gccagcctgagacaga

SEQ ID NO: 507090 - DNA, 16 bp, R. norvegicus
gccagcctgagccaca

SEQ ID NO: 507091 - DNA, 16 bp, R. norvegicus
gccagcctgagctaca

SEQ ID NO: 507092 - DNA, 16 bp, R. norvegicus
gccagcctgagctata

SEQ ID NO: 507093 - DNA, 16 bp, R. norvegicus
gccagcctgcactaca

SEQ ID NO: 507094 - DNA, 16 bp, R. norvegicus
gccagcctgctctaca

SEQ ID NO: 507095 - DNA, 16 bp, R. norvegicus
gccagcctgctttaca

SEQ ID NO: 507096 - DNA, 16 bp, R. norvegicus
gccagcctggatgctg

SEQ ID NO: 507097 - DNA, 16 bp, R. norvegicus
gccagcctgggctcca

SEQ ID NO: 507098 - DNA, 16 bp, R. norvegicus
gccagcctgggctgtg

SEQ ID NO: 507099 - DNA, 16 bp, R. norvegicus
gccagcctggtctata

SEQ ID NO: 507100 - DNA, 16 bp, R. norvegicus
gccagcctggttcaca

SEQ ID NO: 507101 - DNA, 16 bp, R. norvegicus
gccagcctgtgttaca

SEQ ID NO: 507102 - DNA, 16 bp, R. norvegicus
gccagcctgttctaca

SEQ ID NO: 507103 - DNA, 16 bp, R. norvegicus
gccagccttgtctata

SEQ ID NO: 507104 - DNA, 16 bp, R. norvegicus
gccagcgctacacaga

SEQ ID NO: 507105 - DNA, 16 bp, R. norvegicus
gccagctaataaagac

SEQ ID NO: 507106 - DNA, 16 bp, R. norvegicus
gccagctcaaaggacc

SEQ ID NO: 507107 - DNA, 16 bp, R. norvegicus
gccagctcaggctact

SEQ ID NO: 507108 - DNA, 16 bp, R. norvegicus
gccagctctccagagc

SEQ ID NO: 507109 - DNA, 16 bp, R. norvegicus
gccagctctcccacct

SEQ ID NO: 507110 - DNA, 16 bp, R. norvegicus
gccagctctcctgcac

SEQ ID NO: 507111 - DNA, 16 bp, R. norvegicus
gccagctgcagacagt

SEQ ID NO: 507112 - DNA, 16 bp, R. norvegicus
gccagctttggctaca

SEQ ID NO: 507113 - DNA, 16 bp, R. norvegicus
gccaggaaaacaagag

SEQ ID NO: 507114 - DNA, 16 bp, R. norvegicus
gccaggaacagattga

SEQ ID NO: 507115 - DNA, 16 bp, R. norvegicus
gccaggaacagcctga

SEQ ID NO: 507116 - DNA, 16 bp, R. norvegicus
gccaggaatgaagtca

SEQ ID NO: 507117 - DNA, 16 bp, R. norvegicus
gccaggagagatacta

SEQ ID NO: 507118 - DNA, 16 bp, R. norvegicus
gccaggagcacctgaa

SEQ ID NO: 507119 - DNA, 16 bp, R. norvegicus
gccaggagcagactgt

SEQ ID NO: 507120 - DNA, 16 bp, R. norvegicus
gccaggaggaccttgg

SEQ ID NO: 507121 - DNA, 16 bp, R. norvegicus
gccaggaggagggtct

SEQ ID NO: 507122 - DNA, 16 bp, R. norvegicus
gccaggagggccagaa

SEQ ID NO: 507123 - DNA, 16 bp, R. norvegicus
gccaggaggtggtggc

SEQ ID NO: 507124 - DNA, 16 bp, R. norvegicus
gccaggagttctctgc

SEQ ID NO: 507125 - DNA, 16 bp, R. norvegicus
gccaggatccatgggt

SEQ ID NO: 507126 - DNA, 16 bp, R. norvegicus
gccaggcaagcactct

SEQ ID NO: 507127 - DNA, 16 bp, R. norvegicus
gccaggcacagcagca

SEQ ID NO: 507128 - DNA, 16 bp, R. norvegicus
gccagggaagcaagag

SEQ ID NO: 507129 - DNA, 16 bp, R. norvegicus
gccagggaggcagaga

SEQ ID NO: 507130 - DNA, 16 bp, R. norvegicus
gccagggatgcacaga

SEQ ID NO: 507131 - DNA, 16 bp, R. norvegicus
gccagggcaaggaggt

SEQ ID NO: 507132 - DNA, 16 bp, R. norvegicus
gccagggccacacagg

SEQ ID NO: 507133 - DNA, 16 bp, R. norvegicus
gccagggctacacagt

SEQ ID NO: 507134 - DNA, 16 bp, R. norvegicus
gccaggtagtggtggc

SEQ ID NO: 507135 - DNA, 16 bp, R. norvegicus
gccaggtatgcctgac

SEQ ID NO: 507136 - DNA, 16 bp, R. norvegicus
gccaggtctgctttgg

SEQ ID NO: 507137 - DNA, 16 bp, R. norvegicus
gccaggtgatggtggt

SEQ ID NO: 507138 - DNA, 16 bp, R. norvegicus
gccaggtgcagggctg

SEQ ID NO: 507139 - DNA, 16 bp, R. norvegicus
gccaggtggtggcaca

SEQ ID NO: 507140 - DNA, 16 bp, R. norvegicus
gccaggtgtgatggtg

SEQ ID NO: 507141 - DNA, 16 bp, R. norvegicus
gccagtcctagcaagc

SEQ ID NO: 507142 - DNA, 16 bp, R. norvegicus
gccagtgagactgagg

SEQ ID NO: 507143 - DNA, 16 bp, R. norvegicus
gccagtgagcagcatt

SEQ ID NO: 507144 - DNA, 16 bp, R. norvegicus
gccagtgagtcccaga

SEQ ID NO: 507145 - DNA, 17 bp, R. norvegicus
gccagttatggggactg

SEQ ID NO: 507146 - DNA, 16 bp, R. norvegicus
gccagttatgtgaaca

SEQ ID NO: 507147 - DNA, 16 bp, R. norvegicus
gccagttcaggctctg

SEQ ID NO: 507148 - DNA, 16 bp, R. norvegicus
gccagtttggtctaca

SEQ ID NO: 507149 - DNA, 16 bp, R. norvegicus
gccatcaaccaggcag

SEQ ID NO: 507150 - DNA, 16 bp, R. norvegicus
gccatcaagcctgatg

SEQ ID NO: 507151 - DNA, 16 bp, R. norvegicus
gccatcactgcccagc

SEQ ID NO: 507152 - DNA, 16 bp, R. norvegicus
gccatcaggatgtctc

SEQ ID NO: 507153 - DNA, 16 bp, R. norvegicus
gccatcatcatcatca

SEQ ID NO: 507154 - DNA, 16 bp, R. norvegicus
gccatcatgcccagct

SEQ ID NO: 507155 - DNA, 16 bp, R. norvegicus
gccatcccaccagccc

SEQ ID NO: 507156 - DNA, 16 bp, R. norvegicus
gccatcccagatgaca

SEQ ID NO: 507157 - DNA, 16 bp, R. norvegicus
gccatcccagggctgg

SEQ ID NO: 507158 - DNA, 16 bp, R. norvegicus
gccatccctgcagccc

SEQ ID NO: 507159 - DNA, 16 bp, R. norvegicus
gccatccctgccccct

SEQ ID NO: 507160 - DNA, 16 bp, R. norvegicus
gccatccctgtcattg

SEQ ID NO: 507161 - DNA, 16 bp, R. norvegicus
gccatccctgtgctgg

SEQ ID NO: 507162 - DNA, 16 bp, R. norvegicus
gccatcccttggctgg

SEQ ID NO: 507163 - DNA, 16 bp, R. norvegicus
gccatcctccagaccc

SEQ ID NO: 507164 - DNA, 16 bp, R. norvegicus
gccatcctctgccata

SEQ ID NO: 507165 - DNA, 16 bp, R. norvegicus
gccatcctctgctcca

SEQ ID NO: 507166 - DNA, 16 bp, R. norvegicus
gccatcctgccaaaag

SEQ ID NO: 507167 - DNA, 16 bp, R. norvegicus
gccatcctgctggccc

SEQ ID NO: 507168 - DNA, 16 bp, R. norvegicus
gccatcctggactaca

SEQ ID NO: 507169 - DNA, 16 bp, R. norvegicus
gccatcctggtttaca

SEQ ID NO: 507170 - DNA, 16 bp, R. norvegicus
gccatctccacagccc

SEQ ID NO: 507171 - DNA, 16 bp, R. norvegicus
gccatctcccagcccc

SEQ ID NO: 507172 - DNA, 16 bp, R. norvegicus
gccatctcccaggccc

SEQ ID NO: 507173 - DNA, 16 bp, R. norvegicus
gccatctccccagacc

SEQ ID NO: 507174 - DNA, 16 bp, R. norvegicus
gccatctcctctgccc

SEQ ID NO: 507175 - DNA, 16 bp, R. norvegicus
gccatctcgccagcct

SEQ ID NO: 507176 - DNA, 16 bp, R. norvegicus
gccatctctcaggccc

SEQ ID NO: 507177 - DNA, 16 bp, R. norvegicus
gccatctctccatgcc

SEQ ID NO: 507178 - DNA, 16 bp, R. norvegicus
gccatctctctaccct

SEQ ID NO: 507179 - DNA, 16 bp, R. norvegicus
gccatctctctggacc

SEQ ID NO: 507180 - DNA, 16 bp, R. norvegicus
gccatctctctggcca

SEQ ID NO: 507181 - DNA, 16 bp, R. norvegicus
gccatctctctggcct

SEQ ID NO: 507182 - DNA, 16 bp, R. norvegicus
gccatctctgcagcca

SEQ ID NO: 507183 - DNA, 21 bp, R. norvegicus
gccatctggaaccctggtgca

SEQ ID NO: 507184 - DNA, 16 bp, R. norvegicus
gccatctggtctacct

SEQ ID NO: 507185 - DNA, 16 bp, R. norvegicus
gccatcttcccagcac

SEQ ID NO: 507186 - DNA, 16 bp, R. norvegicus
gccatcttcccagcca

SEQ ID NO: 507187 - DNA, 16 bp, R. norvegicus
gccatcttcccatccc

SEQ ID NO: 507188 - DNA, 16 bp, R. norvegicus
gccatcttctggcctc

SEQ ID NO: 507189 - DNA, 16 bp, R. norvegicus
gccatcttgcaggccc

SEQ ID NO: 507190 - DNA, 16 bp, R. norvegicus
gccatcttgctagcct

SEQ ID NO: 507191 - DNA, 16 bp, R. norvegicus
gccatcttgctggccc

SEQ ID NO: 507192 - DNA, 16 bp, R. norvegicus
gccatctttccagctt

SEQ ID NO: 507193 - DNA, 16 bp, R. norvegicus
gccatgacaaaacacc

SEQ ID NO: 507194 - DNA, 16 bp, R. norvegicus
gccatgaggagctgag

SEQ ID NO: 507195 - DNA, 16 bp, R. norvegicus
gccatgcagcagcagg

SEQ ID NO: 507196 - DNA, 16 bp, R. norvegicus
gccatgcaggtgctgg

SEQ ID NO: 507197 - DNA, 16 bp, R. norvegicus
gccatgcctcctgcca

SEQ ID NO: 507198 - DNA, 16 bp, R. norvegicus
gccatgcctggctttt

SEQ ID NO: 507199 - DNA, 16 bp, R. norvegicus
gccatgctagacttct

SEQ ID NO: 507200 - DNA, 16 bp, R. norvegicus
gccatgctggtcattg

SEQ ID NO: 507201 - DNA, 16 bp, R. norvegicus
gccatgctgtgcttgc

SEQ ID NO: 507202 - DNA, 16 bp, R. norvegicus
gccatggaaagcaagc

SEQ ID NO: 507203 - DNA, 16 bp, R. norvegicus
gccatggagaacaagc

SEQ ID NO: 507204 - DNA, 16 bp, R. norvegicus
gccatggagaaggcct

SEQ ID NO: 507205 - DNA, 16 bp, R. norvegicus
gccatggagggatgtt

SEQ ID NO: 507206 - DNA, 16 bp, R. norvegicus
gccatggcaacagcca

SEQ ID NO: 507207 - DNA, 16 bp, R. norvegicus
gccatggcaggacaat

SEQ ID NO: 507208 - DNA, 16 bp, R. norvegicus
gccatggccatggtgt

SEQ ID NO: 507209 - DNA, 16 bp, R. norvegicus
gccatggcttcttgcc

SEQ ID NO: 507210 - DNA, 16 bp, R. norvegicus
gccatgggcagtggcc

SEQ ID NO: 507211 - DNA, 16 bp, R. norvegicus
gccatggggaaggtat

SEQ ID NO: 507212 - DNA, 16 bp, R. norvegicus
gccatgggtcagccca

SEQ ID NO: 507213 - DNA, 16 bp, R. norvegicus
gccatgggtcctccat

SEQ ID NO: 507214 - DNA, 16 bp, R. norvegicus
gccatggtgctggaga

SEQ ID NO: 507215 - DNA, 16 bp, R. norvegicus
gccatgtatgtgctgg

SEQ ID NO: 507216 - DNA, 16 bp, R. norvegicus
gccatgtgatgtggac

SEQ ID NO: 507217 - DNA, 16 bp, R. norvegicus
gccatgtggatgctgg

SEQ ID NO: 507218 - DNA, 16 bp, R. norvegicus
gccatgtggcccacca

SEQ ID NO: 507219 - DNA, 16 bp, R. norvegicus
gccatgtgggagctgg

SEQ ID NO: 507220 - DNA, 16 bp, R. norvegicus
gccatgttcctgcctt

SEQ ID NO: 507221 - DNA, 16 bp, R. norvegicus
gccatgttgatgtctg

SEQ ID NO: 507222 - DNA, 16 bp, R. norvegicus
gccatgttggaggaag

SEQ ID NO: 507223 - DNA, 16 bp, R. norvegicus
gccatgtttcctgtca

SEQ ID NO: 507224 - DNA, 16 bp, R. norvegicus
gccattagagatttct

SEQ ID NO: 507225 - DNA, 16 bp, R. norvegicus
gccattagtgaaggtg

SEQ ID NO: 507226 - DNA, 16 bp, R. norvegicus
gccattcacagcctgc

SEQ ID NO: 507227 - DNA, 16 bp, R. norvegicus
gccattcagaacctgc

SEQ ID NO: 507228 - DNA, 16 bp, R. norvegicus
gccattccttgagtct

SEQ ID NO: 507229 - DNA, 16 bp, R. norvegicus
gccattctgattgggg

SEQ ID NO: 507230 - DNA, 16 bp, R. norvegicus
gccattgaaagtggtg

SEQ ID NO: 507231 - DNA, 17 bp, R. norvegicus
gccattgcaccctggtt

SEQ ID NO: 507232 - DNA, 16 bp, R. norvegicus
gccattgctgctgcag

SEQ ID NO: 507233 - DNA, 16 bp, R. norvegicus
gccattgctgctgctg

SEQ ID NO: 507234 - DNA, 16 bp, R. norvegicus
gccatttgagtttctt

SEQ ID NO: 507235 - DNA, 16 bp, R. norvegicus
gccatttggtattcct

SEQ ID NO: 507236 - DNA, 16 bp, R. norvegicus
gccattttcttttctt

SEQ ID NO: 507237 - DNA, 16 bp, R. norvegicus
gccattttgcaaggct

SEQ ID NO: 507238 - DNA, 16 bp, R. norvegicus
gccattttgctgaaag

SEQ ID NO: 507239 - DNA, 16 bp, R. norvegicus
gccatttttgctggct

SEQ ID NO: 507240 - DNA, 16 bp, R. norvegicus
gcccaaaacatacagg

SEQ ID NO: 507241 - DNA, 16 bp, R. norvegicus
gcccaaaataaagaaa

SEQ ID NO: 507242 - DNA, 30 bp, R. norvegicus
gcccaaactgcagcttaaccttagctgctt

SEQ ID NO: 507243 - DNA, 16 bp, R. norvegicus
gcccaaataaaaggca

SEQ ID NO: 507244 - DNA, 16 bp, R. norvegicus
gcccaagaggaaacag

SEQ ID NO: 507245 - DNA, 16 bp, R. norvegicus
gcccaagaggagactg

SEQ ID NO: 507246 - DNA, 16 bp, R. norvegicus
gcccaagctggcttca

SEQ ID NO: 507247 - DNA, 16 bp, R. norvegicus
gcccaaggggaaactg

SEQ ID NO: 507248 - DNA, 16 bp, R. norvegicus
gcccaatgccactgaa

SEQ ID NO: 507249 - DNA, 16 bp, R. norvegicus
gcccacaaccatctat

SEQ ID NO: 507250 - DNA, 16 bp, R. norvegicus
gcccacacccagagtg

SEQ ID NO: 507251 - DNA, 16 bp, R. norvegicus
gcccacaccctcagtg

SEQ ID NO: 507252 - DNA, 16 bp, R. norvegicus
gcccacactggccttg

SEQ ID NO: 507253 - DNA, 16 bp, R. norvegicus
gcccacagtccagaca

SEQ ID NO: 507254 - DNA, 16 bp, R. norvegicus
gcccacagttccctgc

SEQ ID NO: 507255 - DNA, 16 bp, R. norvegicus
gcccacatacacacag

SEQ ID NO: 507256 - DNA, 16 bp, R. norvegicus
gcccacatccatggcc

SEQ ID NO: 507257 - DNA, 16 bp, R. norvegicus
gcccacatcccaggcc

SEQ ID NO: 507258 - DNA, 16 bp, R. norvegicus
gcccaccagctctccc

SEQ ID NO: 507259 - DNA, 16 bp, R. norvegicus
gcccacctcaccaggc

SEQ ID NO: 507260 - DNA, 16 bp, R. norvegicus
gcccactctctcacta

SEQ ID NO: 507261 - DNA, 16 bp, R. norvegicus
gcccactggccagcca

SEQ ID NO: 507262 - DNA, 16 bp, R. norvegicus
gcccactgtgggcaga

SEQ ID NO: 507263 - DNA, 16 bp, R. norvegicus
gcccagaaaggtgctg

SEQ ID NO: 507264 - DNA, 16 bp, R. norvegicus
gcccagaactcacaga

SEQ ID NO: 507265 - DNA, 16 bp, R. norvegicus
gcccagaagatcatga

SEQ ID NO: 507266 - DNA, 16 bp, R. norvegicus
gcccagaagctgctgc

SEQ ID NO: 507267 - DNA, 16 bp, R. norvegicus
gcccagaatcccccag

SEQ ID NO: 507268 - DNA, 16 bp, R. norvegicus
gcccagaatggtgtgt

SEQ ID NO: 507269 - DNA, 16 bp, R. norvegicus
gcccagactggcctcc

SEQ ID NO: 507270 - DNA, 16 bp, R. norvegicus
gcccagagagaggaga

SEQ ID NO: 507271 - DNA, 16 bp, R. norvegicus
gcccagagagcacaga

SEQ ID NO: 507272 - DNA, 16 bp, R. norvegicus
gcccagagcccagagc

SEQ ID NO: 507273 - DNA, 16 bp, R. norvegicus
gcccagagctcccagg

SEQ ID NO: 507274 - DNA, 16 bp, R. norvegicus
gcccagatctgaactg

SEQ ID NO: 507275 - DNA, 16 bp, R. norvegicus
gcccagcaaggccatc

SEQ ID NO: 507276 - DNA, 16 bp, R. norvegicus
gcccagcacagcacag

SEQ ID NO: 507277 - DNA, 16 bp, R. norvegicus
gcccagcatattcaaa

SEQ ID NO: 507278 - DNA, 16 bp, R. norvegicus
gcccagcatggtggca

SEQ ID NO: 507279 - DNA, 16 bp, R. norvegicus
gcccagccattggcta

SEQ ID NO: 507280 - DNA, 16 bp, R. norvegicus
gcccagcccagccctg

SEQ ID NO: 507281 - DNA, 16 bp, R. norvegicus
gcccagcccagtgtgg

SEQ ID NO: 507282 - DNA, 16 bp, R. norvegicus
gcccagcccctgggct

SEQ ID NO: 507283 - DNA, 16 bp, R. norvegicus
gcccagccctgccctg

SEQ ID NO: 507284 - DNA, 16 bp, R. norvegicus
gcccagcctcagctgt

SEQ ID NO: 507285 - DNA, 16 bp, R. norvegicus
gcccagccttgatatg

SEQ ID NO: 507286 - DNA, 16 bp, R. norvegicus
gcccagcttcatcaag

SEQ ID NO: 507287 - DNA, 16 bp, R. norvegicus
gcccaggaagtggtac

SEQ ID NO: 507288 - DNA, 16 bp, R. norvegicus
gcccaggaccacctgc

SEQ ID NO: 507289 - DNA, 16 bp, R. norvegicus
gcccaggaccttctgg

SEQ ID NO: 507290 - DNA, 16 bp, R. norvegicus
gcccaggagcagcaga

SEQ ID NO: 507291 - DNA, 19 bp, R. norvegicus
gcccaggagcggcaggaac

SEQ ID NO: 507292 - DNA, 16 bp, R. norvegicus
gcccaggaggctgagg

SEQ ID NO: 507293 - DNA, 16 bp, R. norvegicus
gcccaggaggttcctc

SEQ ID NO: 507294 - DNA, 16 bp, R. norvegicus
gcccaggagtttgaga

SEQ ID NO: 507295 - DNA, 16 bp, R. norvegicus
gcccaggatcttcttg

SEQ ID NO: 507296 - DNA, 16 bp, R. norvegicus
gcccaggcagagtccc

SEQ ID NO: 507297 - DNA, 16 bp, R. norvegicus
gcccaggccactgtgg

SEQ ID NO: 507298 - DNA, 16 bp, R. norvegicus
gcccaggcccagatgg

SEQ ID NO: 507299 - DNA, 16 bp, R. norvegicus
gcccaggccctcctgg

SEQ ID NO: 507300 - DNA, 16 bp, R. norvegicus
gcccaggccctgtggg

SEQ ID NO: 507301 - DNA, 16 bp, R. norvegicus
gcccaggctaacctgg

SEQ ID NO: 507302 - DNA, 16 bp, R. norvegicus
gcccaggctgacctga

SEQ ID NO: 507303 - DNA, 16 bp, R. norvegicus
gcccaggctgactttg

SEQ ID NO: 507304 - DNA, 16 bp, R. norvegicus
gcccaggctggcccag

SEQ ID NO: 507305 - DNA, 16 bp, R. norvegicus
gcccaggctggtctca

SEQ ID NO: 507306 - DNA, 16 bp, R. norvegicus
gcccaggctggtcttg

SEQ ID NO: 507307 - DNA, 16 bp, R. norvegicus
gcccagggaatggtgc

SEQ ID NO: 507308 - DNA, 16 bp, R. norvegicus
gcccagggccagatga

SEQ ID NO: 507309 - DNA, 16 bp, R. norvegicus
gcccagggttcagtcc

SEQ ID NO: 507310 - DNA, 16 bp, R. norvegicus
gcccaggtccaggtgg

SEQ ID NO: 507311 - DNA, 16 bp, R. norvegicus
gcccagtccctggaag

SEQ ID NO: 507312 - DNA, 16 bp, R. norvegicus
gcccagtgcccagtgc

SEQ ID NO: 507313 - DNA, 16 bp, R. norvegicus
gcccagtgtcctgcca

SEQ ID NO: 507314 - DNA, 16 bp, R. norvegicus
gcccagtgtctccagc

SEQ ID NO: 507315 - DNA, 16 bp, R. norvegicus
gcccagtgtgtccagc

SEQ ID NO: 507316 - DNA, 16 bp, R. norvegicus
gcccagtgtttctctc

SEQ ID NO: 507317 - DNA, 16 bp, R. norvegicus
gcccatagaggtcaga

SEQ ID NO: 507318 - DNA, 16 bp, R. norvegicus
gcccatctctgcctcc

SEQ ID NO: 507319 - DNA, 16 bp, R. norvegicus
gcccatgacttctctt

SEQ ID NO: 507320 - DNA, 16 bp, R. norvegicus
gcccatgccaagccca

SEQ ID NO: 507321 - DNA, 16 bp, R. norvegicus
gcccatggagggcaga

SEQ ID NO: 507322 - DNA, 16 bp, R. norvegicus
gcccatgtgtttgagt

SEQ ID NO: 507323 - DNA, 16 bp, R. norvegicus
gccccaaagctcagaa

SEQ ID NO: 507324 - DNA, 17 bp, R. norvegicus
gccccaacatatacaaa

SEQ ID NO: 507325 - DNA, 16 bp, R. norvegicus
gccccaagggttcagg

SEQ ID NO: 507326 - DNA, 16 bp, R. norvegicus
gccccacatctgcctg

SEQ ID NO: 507327 - DNA, 16 bp, R. norvegicus
gccccacctcctaaag

SEQ ID NO: 507328 - DNA, 16 bp, R. norvegicus
gccccacctgggcatc

SEQ ID NO: 507329 - DNA, 17 bp, R. norvegicus
gccccacctgtggccca

SEQ ID NO: 507330 - DNA, 16 bp, R. norvegicus
gccccacttgtggccc

SEQ ID NO: 507331 - DNA, 19 bp, R. norvegicus
gccccagctccgaaaaaaa

SEQ ID NO: 507332 - DNA, 16 bp, R. norvegicus
gccccagctctgggca

SEQ ID NO: 507333 - DNA, 16 bp, R. norvegicus
gccccagtgtagagga

SEQ ID NO: 507334 - DNA, 16 bp, R. norvegicus
gccccatgtcccacac

SEQ ID NO: 507335 - DNA, 16 bp, R. norvegicus
gccccattaagacaga

SEQ ID NO: 507336 - DNA, 16 bp, R. norvegicus
gcccccacagtgacac

SEQ ID NO: 507337 - DNA, 16 bp, R. norvegicus
gcccccacagttacct

SEQ ID NO: 507338 - DNA, 16 bp, R. norvegicus
gcccccaccagattgg

SEQ ID NO: 507339 - DNA, 16 bp, R. norvegicus
gcccccagtccctcac

SEQ ID NO: 507340 - DNA, 16 bp, R. norvegicus
gccccctttcaggaag

SEQ ID NO: 507341 - DNA, 16 bp, R. norvegicus
gccccgcagccctgga

SEQ ID NO: 507342 - DNA, 16 bp, R. norvegicus
gcccctaaagaggaaa

SEQ ID NO: 507343 - DNA, 16 bp, R. norvegicus
gcccctcactggctgc

SEQ ID NO: 507344 - DNA, 16 bp, R. norvegicus
gcccctctgctctgct

SEQ ID NO: 507345 - DNA, 16 bp, R. norvegicus
gcccctgactgcttct

SEQ ID NO: 507346 - DNA, 16 bp, R. norvegicus
gcccctgcctccagag

SEQ ID NO: 507347 - DNA, 16 bp, R. norvegicus
gcccctgctgcccctg

SEQ ID NO: 507348 - DNA, 16 bp, R. norvegicus
gcccctggaactagag

SEQ ID NO: 507349 - DNA, 16 bp, R. norvegicus
gcccctggagctggag

SEQ ID NO: 507350 - DNA, 16 bp, R. norvegicus
gcccctgggctggtgg

SEQ ID NO: 507351 - DNA, 16 bp, R. norvegicus
gcccctgtctctgcct

SEQ ID NO: 507352 - DNA, 16 bp, R. norvegicus
gccccttcctggagct

SEQ ID NO: 507353 - DNA, 16 bp, R. norvegicus
gccccttctgagaagt

SEQ ID NO: 507354 - DNA, 16 bp, R. norvegicus
gccccttctgggaact

SEQ ID NO: 507355 - DNA, 16 bp, R. norvegicus
gcccgagttatcagga

SEQ ID NO: 507356 - DNA, 16 bp, R. norvegicus
gcccgcaggaacagct

SEQ ID NO: 507357 - DNA, 16 bp, R. norvegicus
gccctcaaattataca

SEQ ID NO: 507358 - DNA, 16 bp, R. norvegicus
gccctcaaggaggagt

SEQ ID NO: 507359 - DNA, 16 bp, R. norvegicus
gccctcacagagagct

SEQ ID NO: 507360 - DNA, 16 bp, R. norvegicus
gccctcagcagctctc

SEQ ID NO: 507361 - DNA, 16 bp, R. norvegicus
gccctcagggcttcac

SEQ ID NO: 507362 - DNA, 16 bp, R. norvegicus
gccctccatttctgga

SEQ ID NO: 507363 - DNA, 16 bp, R. norvegicus
gccctcctcccaacaa

SEQ ID NO: 507364 - DNA, 16 bp, R. norvegicus
gccctcctctgacttc

SEQ ID NO: 507365 - DNA, 16 bp, R. norvegicus
gccctcggtcctgtga

SEQ ID NO: 507366 - DNA, 16 bp, R. norvegicus
gccctctgctggtgtg

SEQ ID NO: 507367 - DNA, 16 bp, R. norvegicus
gccctctggaagaaca

SEQ ID NO: 507368 - DNA, 16 bp, R. norvegicus
gccctctggaagagca

SEQ ID NO: 507369 - DNA, 16 bp, R. norvegicus
gccctctgtcagatgg

SEQ ID NO: 507370 - DNA, 16 bp, R. norvegicus
gccctcttcaggtgtg

SEQ ID NO: 507371 - DNA, 18 bp, R. norvegicus
gccctcttctggcctgca

SEQ ID NO: 507372 - DNA, 16 bp, R. norvegicus
gccctcttctggctcc

SEQ ID NO: 507373 - DNA, 16 bp, R. norvegicus
gccctcttgtggtgtg

SEQ ID NO: 507374 - DNA, 16 bp, R. norvegicus
gccctcttttggcctg

SEQ ID NO: 507375 - DNA, 16 bp, R. norvegicus
gccctgaaagaggaaa

SEQ ID NO: 507376 - DNA, 16 bp, R. norvegicus
gccctgacattttcct

SEQ ID NO: 507377 - DNA, 16 bp, R. norvegicus
gccctgacttcctcca

SEQ ID NO: 507378 - DNA, 16 bp, R. norvegicus
gccctgagagccagca

SEQ ID NO: 507379 - DNA, 16 bp, R. norvegicus
gccctgcacctggcct

SEQ ID NO: 507380 - DNA, 16 bp, R. norvegicus
gccctgcagtccaaaa

SEQ ID NO: 507381 - DNA, 16 bp, R. norvegicus
gccctgccacctgagg

SEQ ID NO: 507382 - DNA, 16 bp, R. norvegicus
gccctgcccagccatt

SEQ ID NO: 507383 - DNA, 16 bp, R. norvegicus
gccctgcctgccctgg

SEQ ID NO: 507384 - DNA, 16 bp, R. norvegicus
gccctggaactgcctg

SEQ ID NO: 507385 - DNA, 16 bp, R. norvegicus
gccctggaactggagt

SEQ ID NO: 507386 - DNA, 16 bp, R. norvegicus
gccctggagaacctgt

SEQ ID NO: 507387 - DNA, 16 bp, R. norvegicus
gccctggagctggagt

SEQ ID NO: 507388 - DNA, 16 bp, R. norvegicus
gccctggatctggacc

SEQ ID NO: 507389 - DNA, 16 bp, R. norvegicus
gccctggatctgggtc

SEQ ID NO: 507390 - DNA, 16 bp, R. norvegicus
gccctggattcagtcc

SEQ ID NO: 507391 - DNA, 16 bp, R. norvegicus
gccctggattccatcc

SEQ ID NO: 507392 - DNA, 16 bp, R. norvegicus
gccctggccagccagg

SEQ ID NO: 507393 - DNA, 16 bp, R. norvegicus
gccctggccagccctg

SEQ ID NO: 507394 - DNA, 16 bp, R. norvegicus
gccctggctagcctgg

SEQ ID NO: 507395 - DNA, 16 bp, R. norvegicus
gccctggctcagacaa

SEQ ID NO: 507396 - DNA, 16 bp, R. norvegicus
gccctggctctcctag

SEQ ID NO: 507397 - DNA, 16 bp, R. norvegicus
gccctggctctcctgg

SEQ ID NO: 507398 - DNA, 16 bp, R. norvegicus
gccctggctgctcttc

SEQ ID NO: 507399 - DNA, 16 bp, R. norvegicus
gccctggctgctcttg

SEQ ID NO: 507400 - DNA, 16 bp, R. norvegicus
gccctggctggcctgg

SEQ ID NO: 507401 - DNA, 16 bp, R. norvegicus
gccctggctttgatcc

SEQ ID NO: 507402 - DNA, 16 bp, R. norvegicus
gccctgggagccctgg

SEQ ID NO: 507403 - DNA, 18 bp, R. norvegicus
gccctgggcactgaggac

SEQ ID NO: 507404 - DNA, 16 bp, R. norvegicus
gccctgggtccccagc

SEQ ID NO: 507405 - DNA, 16 bp, R. norvegicus
gccctgggtcctgctg

SEQ ID NO: 507406 - DNA, 16 bp, R. norvegicus
gccctgggtgctgcta

SEQ ID NO: 507407 - DNA, 16 bp, R. norvegicus
gccctgggtgtcctgg

SEQ ID NO: 507408 - DNA, 16 bp, R. norvegicus
gccctgggttcaagtc

SEQ ID NO: 507409 - DNA, 16 bp, R. norvegicus
gccctgggttccatcc

SEQ ID NO: 507410 - DNA, 32 bp, R. norvegicus
gccctgggttcggtccccagctccgaaaaaaa

SEQ ID NO: 507411 - DNA, 16 bp, R. norvegicus
gccctgggttctgcca

SEQ ID NO: 507412 - DNA, 16 bp, R. norvegicus
gccctgggttctgccc

SEQ ID NO: 507413 - DNA, 16 bp, R. norvegicus
gccctgggttctgtcc

SEQ ID NO: 507414 - DNA, 16 bp, R. norvegicus
gccctgggtttgatcc

SEQ ID NO: 507415 - DNA, 16 bp, R. norvegicus
gccctggtgctgtttg

SEQ ID NO: 507416 - DNA, 16 bp, R. norvegicus
gccctggttggcctag

SEQ ID NO: 507417 - DNA, 16 bp, R. norvegicus
gccctgtagtcatgga

SEQ ID NO: 507418 - DNA, 17 bp, R. norvegicus
gccctgtcctggtggta

SEQ ID NO: 507419 - DNA, 16 bp, R. norvegicus
gccctgtggcagagca

SEQ ID NO: 507420 - DNA, 16 bp, R. norvegicus
gccctgtggtctcctg

SEQ ID NO: 507421 - DNA, 16 bp, R. norvegicus
gccctgtgtcttgagt

SEQ ID NO: 507422 - DNA, 16 bp, R. norvegicus
gcccttccagaggact

SEQ ID NO: 507423 - DNA, 16 bp, R. norvegicus
gcccttccatttggag

SEQ ID NO: 507424 - DNA, 16 bp, R. norvegicus
gcccttcccccaccag

SEQ ID NO: 507425 - DNA, 16 bp, R. norvegicus
gcccttgcagaggacc

SEQ ID NO: 507426 - DNA, 16 bp, R. norvegicus
gcccttgctgctcttg

SEQ ID NO: 507427 - DNA, 16 bp, R. norvegicus
gcccttggaattctcc

SEQ ID NO: 507428 - DNA, 16 bp, R. norvegicus
gcccttggaggagccc

SEQ ID NO: 507429 - DNA, 16 bp, R. norvegicus
gcccttgggaggcaga

SEQ ID NO: 507430 - DNA, 16 bp, R. norvegicus
gcccttggtcctctca

SEQ ID NO: 507431 - DNA, 16 bp, R. norvegicus
gcccttggtcctggga

SEQ ID NO: 507432 - DNA, 16 bp, R. norvegicus
gcccttggttctggga

SEQ ID NO: 507433 - DNA, 16 bp, R. norvegicus
gcccttgtgtttggag

SEQ ID NO: 507434 - DNA, 16 bp, R. norvegicus
gccctttcagggagct

SEQ ID NO: 507435 - DNA, 16 bp, R. norvegicus
gccctttcagtccttt

SEQ ID NO: 507436 - DNA, 16 bp, R. norvegicus
gccctttggttggtgg

SEQ ID NO: 507437 - DNA, 16 bp, R. norvegicus
gccgaaagtaactgtg

SEQ ID NO: 507438 - DNA, 16 bp, R. norvegicus
gccgaagagtcaaagt

SEQ ID NO: 507439 - DNA, 16 bp, R. norvegicus
gccgaagcagaggcag

SEQ ID NO: 507440 - DNA, 16 bp, R. norvegicus
gccgaggtgtgcagag

SEQ ID NO: 507441 - DNA, 18 bp, R. norvegicus
gccgccaccaacggcgcc

SEQ ID NO: 507442 - DNA, 16 bp, R. norvegicus
gccgccctcacagaga

SEQ ID NO: 507443 - DNA, 16 bp, R. norvegicus
gccgcttggggaagag

SEQ ID NO: 507444 - DNA, 16 bp, R. norvegicus
gccggaacctgaaggg

SEQ ID NO: 507445 - DNA, 16 bp, R. norvegicus
gccggaagatcctgga

SEQ ID NO: 507446 - DNA, 16 bp, R. norvegicus
gccggcaagaaacacg

SEQ ID NO: 507447 - DNA, 16 bp, R. norvegicus
gccggcgccgaggaga

SEQ ID NO: 507448 - DNA, 16 bp, R. norvegicus
gccgggatctgcgggt

SEQ ID NO: 507449 - DNA, 16 bp, R. norvegicus
gccgggatttgaactc

SEQ ID NO: 507450 - DNA, 16 bp, R. norvegicus
gccgggtgtggtggca

SEQ ID NO: 507451 - DNA, 19 bp, R. norvegicus
gccggtatggcacttagtg

SEQ ID NO: 507452 - DNA, 16 bp, R. norvegicus
gccgtccctccagccc

SEQ ID NO: 507453 - DNA, 16 bp, R. norvegicus
gccgtgtgggtgctgg

SEQ ID NO: 507454 - DNA, 16 bp, R. norvegicus
gccgttcagagcctgc

SEQ ID NO: 507455 - DNA, 16 bp, R. norvegicus
gcctaagaatttaatg

SEQ ID NO: 507456 - DNA, 16 bp, R. norvegicus
gcctacctgcctgctg

SEQ ID NO: 507457 - DNA, 16 bp, R. norvegicus
gcctagaatcccccag

SEQ ID NO: 507458 - DNA, 16 bp, R. norvegicus
gcctagagggccagga

SEQ ID NO: 507459 - DNA, 16 bp, R. norvegicus
gcctagagtgttttca

SEQ ID NO: 507460 - DNA, 16 bp, R. norvegicus
gcctagcaaatgcaag

SEQ ID NO: 507461 - DNA, 16 bp, R. norvegicus
gcctagccttgaccca

SEQ ID NO: 507462 - DNA, 16 bp, R. norvegicus
gcctaggaagctcaag

SEQ ID NO: 507463 - DNA, 16 bp, R. norvegicus
gcctatattcaaccaa

SEQ ID NO: 507464 - DNA, 16 bp, R. norvegicus
gcctatgccccaggga

SEQ ID NO: 507465 - DNA, 16 bp, R. norvegicus
gcctatgtattttctg

SEQ ID NO: 507466 - DNA, 16 bp, R. norvegicus
gcctatttcatctaca

SEQ ID NO: 507467 - DNA, 24 bp, R. norvegicus
gcctcaacatataaaagagacacg

SEQ ID NO: 507468 - DNA, 16 bp, R. norvegicus
gcctcaacctcccaag

SEQ ID NO: 507469 - DNA, 16 bp, R. norvegicus
gcctcaagaagaggtt

SEQ ID NO: 507470 - DNA, 16 bp, R. norvegicus
gcctcaagctcctgct

SEQ ID NO: 507471 - DNA, 16 bp, R. norvegicus
gcctcaagtctctaca

SEQ ID NO: 507472 - DNA, 16 bp, R. norvegicus
gcctcactctcagcct

SEQ ID NO: 507473 - DNA, 16 bp, R. norvegicus
gcctcacttgaggaaa

SEQ ID NO: 507474 - DNA, 16 bp, R. norvegicus
gcctcagaagctgccc

SEQ ID NO: 507475 - DNA, 16 bp, R. norvegicus
gcctcagagagccctt

SEQ ID NO: 507476 - DNA, 16 bp, R. norvegicus
gcctcagagtcacaga

SEQ ID NO: 507477 - DNA, 16 bp, R. norvegicus
gcctcagcctcagctc

SEQ ID NO: 507478 - DNA, 16 bp, R. norvegicus
gcctcagcctccaaag

SEQ ID NO: 507479 - DNA, 16 bp, R. norvegicus
gcctcagcctcccaaa

SEQ ID NO: 507480 - DNA, 16 bp, R. norvegicus
gcctcagcctcccaga

SEQ ID NO: 507481 - DNA, 16 bp, R. norvegicus
gcctcagcctccctgg

SEQ ID NO: 507482 - DNA, 16 bp, R. norvegicus
gcctcagcctcctgag

SEQ ID NO: 507483 - DNA, 16 bp, R. norvegicus
gcctcagctcctgcct

SEQ ID NO: 507484 - DNA, 16 bp, R. norvegicus
gcctcagctgaatcag

SEQ ID NO: 507485 - DNA, 16 bp, R. norvegicus
gcctcagctgctcttc

SEQ ID NO: 507486 - DNA, 16 bp, R. norvegicus
gcctcagcttccaaag

SEQ ID NO: 507487 - DNA, 16 bp, R. norvegicus
gcctcagcttcctcag

SEQ ID NO: 507488 - DNA, 16 bp, R. norvegicus
gcctcaggaatgctgg

SEQ ID NO: 507489 - DNA, 16 bp, R. norvegicus
gcctcagggaaggggg

SEQ ID NO: 507490 - DNA, 16 bp, R. norvegicus
gcctcagtctcacttg

SEQ ID NO: 507491 - DNA, 16 bp, R. norvegicus
gcctcagtcttcccag

SEQ ID NO: 507492 - DNA, 16 bp, R. norvegicus
gcctcagttccacttg

SEQ ID NO: 507493 - DNA, 16 bp, R. norvegicus
gcctcagtttccccat

SEQ ID NO: 507494 - DNA, 16 bp, R. norvegicus
gcctcagtttcctcat

SEQ ID NO: 507495 - DNA, 16 bp, R. norvegicus
gcctcatgcatgctag

SEQ ID NO: 507496 - DNA, 16 bp, R. norvegicus
gcctcattccttctta

SEQ ID NO: 507497 - DNA, 16 bp, R. norvegicus
gcctccaaaaaagaaa

SEQ ID NO: 507498 - DNA, 16 bp, R. norvegicus
gcctccaaggactgtg

SEQ ID NO: 507499 - DNA, 16 bp, R. norvegicus
gcctccacctcctcag

SEQ ID NO: 507500 - DNA, 16 bp, R. norvegicus
gcctccactctctcag

SEQ ID NO: 507501 - DNA, 16 bp, R. norvegicus
gcctccacttcctgag

SEQ ID NO: 507502 - DNA, 16 bp, R. norvegicus
gcctccagagcgctgg

SEQ ID NO: 507503 - DNA, 16 bp, R. norvegicus
gcctccagagggcacc

SEQ ID NO: 507504 - DNA, 16 bp, R. norvegicus
gcctccagcttttcag

SEQ ID NO: 507505 - DNA, 16 bp, R. norvegicus
gcctccatcagattgc

SEQ ID NO: 507506 - DNA, 16 bp, R. norvegicus
gcctccatgcagggac

SEQ ID NO: 507507 - DNA, 16 bp, R. norvegicus
gcctccatttgtgatt

SEQ ID NO: 507508 - DNA, 16 bp, R. norvegicus
gcctcccaagaactgg

SEQ ID NO: 507509 - DNA, 16 bp, R. norvegicus
gcctcccaagtacttg

SEQ ID NO: 507510 - DNA, 16 bp, R. norvegicus
gcctcccaagtgatgg

SEQ ID NO: 507511 - DNA, 16 bp, R. norvegicus
gcctcccaagtgctga

SEQ ID NO: 507512 - DNA, 16 bp, R. norvegicus
gcctcccagatgctgg

SEQ ID NO: 507513 - DNA, 16 bp, R. norvegicus
gcctcccatctcccca

SEQ ID NO: 507514 - DNA, 16 bp, R. norvegicus
gcctcccatgggagca

SEQ ID NO: 507515 - DNA, 16 bp, R. norvegicus
gcctcccatgtgctag

SEQ ID NO: 507516 - DNA, 16 bp, R. norvegicus
gcctccccaagtgctg

SEQ ID NO: 507517 - DNA, 16 bp, R. norvegicus
gcctccccttctctga

SEQ ID NO: 507518 - DNA, 16 bp, R. norvegicus
gcctccctctgccttg

SEQ ID NO: 507519 - DNA, 16 bp, R. norvegicus
gcctccctgcctctgc

SEQ ID NO: 507520 - DNA, 16 bp, R. norvegicus
gcctccgcagagagct

SEQ ID NO: 507521 - DNA, 16 bp, R. norvegicus
gcctcctcagtccaga

SEQ ID NO: 507522 - DNA, 16 bp, R. norvegicus
gcctcctcccaagtgc

SEQ ID NO: 507523 - DNA, 16 bp, R. norvegicus
gcctcctcctggctgc

SEQ ID NO: 507524 - DNA, 16 bp, R. norvegicus
gcctcctcttccacat

SEQ ID NO: 507525 - DNA, 16 bp, R. norvegicus
gcctcctcttccatgg

SEQ ID NO: 507526 - DNA, 16 bp, R. norvegicus
gcctcctgagccctgg

SEQ ID NO: 507527 - DNA, 16 bp, R. norvegicus
gcctcctgagtgtgga

SEQ ID NO: 507528 - DNA, 16 bp, R. norvegicus
gcctcctgcatgctgg

SEQ ID NO: 507529 - DNA, 16 bp, R. norvegicus
gcctcctgcctgctgc

SEQ ID NO: 507530 - DNA, 16 bp, R. norvegicus
gcctcctgctcctgct

SEQ ID NO: 507531 - DNA, 16 bp, R. norvegicus
gcctcctggatgctgg

SEQ ID NO: 507532 - DNA, 16 bp, R. norvegicus
gcctcctggcctcctg

SEQ ID NO: 507533 - DNA, 16 bp, R. norvegicus
gcctcctggctgctgc

SEQ ID NO: 507534 - DNA, 16 bp, R. norvegicus
gcctctacctcccagt

SEQ ID NO: 507535 - DNA, 16 bp, R. norvegicus
gcctctacctcctaag

SEQ ID NO: 507536 - DNA, 16 bp, R. norvegicus
gcctctacctctgcct

SEQ ID NO: 507537 - DNA, 16 bp, R. norvegicus
gcctctatcagatgta

SEQ ID NO: 507538 - DNA, 26 bp, R. norvegicus
gcctctattacatggtagtctgaggc

SEQ ID NO: 507539 - DNA, 16 bp, R. norvegicus
gcctctcaaaggacag

SEQ ID NO: 507540 - DNA, 16 bp, R. norvegicus
gcctctcaagagacag

SEQ ID NO: 507541 - DNA, 16 bp, R. norvegicus
gcctctcagagactga

SEQ ID NO: 507542 - DNA, 16 bp, R. norvegicus
gcctctcagagctcac

SEQ ID NO: 507543 - DNA, 16 bp, R. norvegicus
gcctctcaggagatac

SEQ ID NO: 507544 - DNA, 16 bp, R. norvegicus
gcctctcatgtgctgg

SEQ ID NO: 507545 - DNA, 16 bp, R. norvegicus
gcctctcctcacccca

SEQ ID NO: 507546 - DNA, 16 bp, R. norvegicus
gcctctcctggcttct

SEQ ID NO: 507547 - DNA, 16 bp, R. norvegicus
gcctctctattccatg

SEQ ID NO: 507548 - DNA, 16 bp, R. norvegicus
gcctctctcagtgaag

SEQ ID NO: 507549 - DNA, 16 bp, R. norvegicus
gcctctctctgcctct

SEQ ID NO: 507550 - DNA, 16 bp, R. norvegicus
gcctctctctgttgta

SEQ ID NO: 507551 - DNA, 16 bp, R. norvegicus
gcctctctgatgatgg

SEQ ID NO: 507552 - DNA, 16 bp, R. norvegicus
gcctctgaagaaagga

SEQ ID NO: 507553 - DNA, 16 bp, R. norvegicus
gcctctgagaacagga

SEQ ID NO: 507554 - DNA, 16 bp, R. norvegicus
gcctctgcagacacca

SEQ ID NO: 507555 - DNA, 16 bp, R. norvegicus
gcctctgcctcagcct

SEQ ID NO: 507556 - DNA, 16 bp, R. norvegicus
gcctctgcctccacag

SEQ ID NO: 507557 - DNA, 16 bp, R. norvegicus
gcctctgcctccagtg

SEQ ID NO: 507558 - DNA, 16 bp, R. norvegicus
gcctctgcctcccaaa

SEQ ID NO: 507559 - DNA, 16 bp, R. norvegicus
gcctctgcctcccaag

SEQ ID NO: 507560 - DNA, 16 bp, R. norvegicus
gcctctgcctcccagg

SEQ ID NO: 507561 - DNA, 16 bp, R. norvegicus
gcctctgcctcctgaa

SEQ ID NO: 507562 - DNA, 16 bp, R. norvegicus
gcctctgcctcctgca

SEQ ID NO: 507563 - DNA, 16 bp, R. norvegicus
gcctctgcctcctggt

SEQ ID NO: 507564 - DNA, 16 bp, R. norvegicus
gcctctgcctctagag

SEQ ID NO: 507565 - DNA, 16 bp, R. norvegicus
gcctctgcctctctct

SEQ ID NO: 507566 - DNA, 16 bp, R. norvegicus
gcctctgcctctgcat

SEQ ID NO: 507567 - DNA, 16 bp, R. norvegicus
gcctctgcctctggag

SEQ ID NO: 507568 - DNA, 16 bp, R. norvegicus
gcctctgcctctgggg

SEQ ID NO: 507569 - DNA, 16 bp, R. norvegicus
gcctctgcctgctgag

SEQ ID NO: 507570 - DNA, 16 bp, R. norvegicus
gcctctgctgacctgc

SEQ ID NO: 507571 - DNA, 16 bp, R. norvegicus
gcctctgctgcctctg

SEQ ID NO: 507572 - DNA, 16 bp, R. norvegicus
gcctctgctgctgctg

SEQ ID NO: 507573 - DNA, 16 bp, R. norvegicus
gcctctgcttcccaag

SEQ ID NO: 507574 - DNA, 16 bp, R. norvegicus
gcctctgcttccccaa

SEQ ID NO: 507575 - DNA, 16 bp, R. norvegicus
gcctctgcttcctcag

SEQ ID NO: 507576 - DNA, 16 bp, R. norvegicus
gcctctgcttcctggg

SEQ ID NO: 507577 - DNA, 16 bp, R. norvegicus
gcctctggagtactgg

SEQ ID NO: 507578 - DNA, 16 bp, R. norvegicus
gcctctggattcctgg

SEQ ID NO: 507579 - DNA, 16 bp, R. norvegicus
gcctctggctcctgct

SEQ ID NO: 507580 - DNA, 16 bp, R. norvegicus
gcctctggcttctgct

SEQ ID NO: 507581 - DNA, 16 bp, R. norvegicus
gcctctgggaactgga

SEQ ID NO: 507582 - DNA, 16 bp, R. norvegicus
gcctctggttcctggc

SEQ ID NO: 507583 - DNA, 16 bp, R. norvegicus
gcctctgtatctgctg

SEQ ID NO: 507584 - DNA, 16 bp, R. norvegicus
gcctctgtatttgtca

SEQ ID NO: 507585 - DNA, 16 bp, R. norvegicus
gcctctgtctcctgtg

SEQ ID NO: 507586 - DNA, 16 bp, R. norvegicus
gcctctgtctctgaag

SEQ ID NO: 507587 - DNA, 16 bp, R. norvegicus
gcctctgtctttgtca

SEQ ID NO: 507588 - DNA, 16 bp, R. norvegicus
gcctctgtgagcactg

SEQ ID NO: 507589 - DNA, 16 bp, R. norvegicus
gcctctgtgccttcca

SEQ ID NO: 507590 - DNA, 16 bp, R. norvegicus
gcctctgtttcttcat

SEQ ID NO: 507591 - DNA, 16 bp, R. norvegicus
gcctcttaggagacag

SEQ ID NO: 507592 - DNA, 16 bp, R. norvegicus
gcctcttcctccccag

SEQ ID NO: 507593 - DNA, 16 bp, R. norvegicus
gcctcttctgcctgta

SEQ ID NO: 507594 - DNA, 16 bp, R. norvegicus
gcctgaacctgaagga

SEQ ID NO: 507595 - DNA, 16 bp, R. norvegicus
gcctgaagaaaagaag

SEQ ID NO: 507596 - DNA, 16 bp, R. norvegicus
gcctgaagaaacagga

SEQ ID NO: 507597 - DNA, 16 bp, R. norvegicus
gcctgaagaacagtgg

SEQ ID NO: 507598 - DNA, 16 bp, R. norvegicus
gcctgaagacctgagc

SEQ ID NO: 507599 - DNA, 16 bp, R. norvegicus
gcctgaagatcctgga

SEQ ID NO: 507600 - DNA, 16 bp, R. norvegicus
gcctgaagccctgggt

SEQ ID NO: 507601 - DNA, 16 bp, R. norvegicus
gcctgaatgccaccat

SEQ ID NO: 507602 - DNA, 16 bp, R. norvegicus
gcctgacagaagcttt

SEQ ID NO: 507603 - DNA, 16 bp, R. norvegicus
gcctgactggatgctg

SEQ ID NO: 507604 - DNA, 16 bp, R. norvegicus
gcctgagaacttggga

SEQ ID NO: 507605 - DNA, 16 bp, R. norvegicus
gcctgagagcagaggt

SEQ ID NO: 507606 - DNA, 16 bp, R. norvegicus
gcctgagatgaagcct

SEQ ID NO: 507607 - DNA, 16 bp, R. norvegicus
gcctgagcatcctcag

SEQ ID NO: 507608 - DNA, 16 bp, R. norvegicus
gcctgaggacagtctg

SEQ ID NO: 507609 - DNA, 16 bp, R. norvegicus
gcctgagtccacagaa

SEQ ID NO: 507610 - DNA, 16 bp, R. norvegicus
gcctgagtggctggtg

SEQ ID NO: 507611 - DNA, 16 bp, R. norvegicus
gcctgcaaccccagct

SEQ ID NO: 507612 - DNA, 16 bp, R. norvegicus
gcctgcacttccctgc

SEQ ID NO: 507613 - DNA, 16 bp, R. norvegicus
gcctgcagaagccaga

SEQ ID NO: 507614 - DNA, 16 bp, R. norvegicus
gcctgcagaggccaga

SEQ ID NO: 507615 - DNA, 16 bp, R. norvegicus
gcctgcagctgcccaa

SEQ ID NO: 507616 - DNA, 16 bp, R. norvegicus
gcctgcaggctgccat

SEQ ID NO: 507617 - DNA, 16 bp, R. norvegicus
gcctgcatcttcttca

SEQ ID NO: 507618 - DNA, 16 bp, R. norvegicus
gcctgcatgcctggga

SEQ ID NO: 507619 - DNA, 16 bp, R. norvegicus
gcctgcatgtctgtgt

SEQ ID NO: 507620 - DNA, 16 bp, R. norvegicus
gcctgcatgtgtgtct

SEQ ID NO: 507621 - DNA, 16 bp, R. norvegicus
gcctgccaccctgact

SEQ ID NO: 507622 - DNA, 16 bp, R. norvegicus
gcctgccatcccagca

SEQ ID NO: 507623 - DNA, 16 bp, R. norvegicus
gcctgcccgcctgcct

SEQ ID NO: 507624 - DNA, 16 bp, R. norvegicus
gcctgcctacctgcct

SEQ ID NO: 507625 - DNA, 16 bp, R. norvegicus
gcctgcctcacatggg

SEQ ID NO: 507626 - DNA, 16 bp, R. norvegicus
gcctgcctctaccttc

SEQ ID NO: 507627 - DNA, 16 bp, R. norvegicus
gcctgcctgccagccc

SEQ ID NO: 507628 - DNA, 16 bp, R. norvegicus
gcctgcctgcctacct

SEQ ID NO: 507629 - DNA, 16 bp, R. norvegicus
gcctgcctgcctgatg

SEQ ID NO: 507630 - DNA, 16 bp, R. norvegicus
gcctgcctgcctgcca

SEQ ID NO: 507631 - DNA, 16 bp, R. norvegicus
gcctgcctgcctgccc

SEQ ID NO: 507632 - DNA, 16 bp, R. norvegicus
gcctgcctgcctgtcc

SEQ ID NO: 507633 - DNA, 16 bp, R. norvegicus
gcctgcctgcctgtgt

SEQ ID NO: 507634 - DNA, 16 bp, R. norvegicus
gcctgcctgccttccc

SEQ ID NO: 507635 - DNA, 16 bp, R. norvegicus
gcctgcctgccttcct

SEQ ID NO: 507636 - DNA, 16 bp, R. norvegicus
gcctgcctgctgctgc

SEQ ID NO: 507637 - DNA, 16 bp, R. norvegicus
gcctgcctggatgatg

SEQ ID NO: 507638 - DNA, 16 bp, R. norvegicus
gcctgcctggctgcct

SEQ ID NO: 507639 - DNA, 16 bp, R. norvegicus
gcctgcctgtctcctg

SEQ ID NO: 507640 - DNA, 16 bp, R. norvegicus
gcctgccttccttcct

SEQ ID NO: 507641 - DNA, 16 bp, R. norvegicus
gcctgctaggcaagca

SEQ ID NO: 507642 - DNA, 16 bp, R. norvegicus
gcctgctcagcctgct

SEQ ID NO: 507643 - DNA, 16 bp, R. norvegicus
gcctgctcttctctga

SEQ ID NO: 507644 - DNA, 16 bp, R. norvegicus
gcctgctgccatgctc

SEQ ID NO: 507645 - DNA, 16 bp, R. norvegicus
gcctgctgcctgctgt

SEQ ID NO: 507646 - DNA, 16 bp, R. norvegicus
gcctgctgtcatgctc

SEQ ID NO: 507647 - DNA, 16 bp, R. norvegicus
gcctgcttagaggata

SEQ ID NO: 507648 - DNA, 16 bp, R. norvegicus
gcctgcttctgccttc

SEQ ID NO: 507649 - DNA, 16 bp, R. norvegicus
gcctgcttctgctccc

SEQ ID NO: 507650 - DNA, 16 bp, R. norvegicus
gcctgcttctgtctcc

SEQ ID NO: 507651 - DNA, 16 bp, R. norvegicus
gcctgctttccttcct

SEQ ID NO: 507652 - DNA, 16 bp, R. norvegicus
gcctgcttttccagag

SEQ ID NO: 507653 - DNA, 16 bp, R. norvegicus
gcctggaaactgagaa

SEQ ID NO: 507654 - DNA, 16 bp, R. norvegicus
gcctggacctcacaga

SEQ ID NO: 507655 - DNA, 16 bp, R. norvegicus
gcctggactacagaat

SEQ ID NO: 507656 - DNA, 16 bp, R. norvegicus
gcctggagaaatggct

SEQ ID NO: 507657 - DNA, 16 bp, R. norvegicus
gcctggagaggccaga

SEQ ID NO: 507658 - DNA, 16 bp, R. norvegicus
gcctggagccctctgg

SEQ ID NO: 507659 - DNA, 16 bp, R. norvegicus
gcctggagctcacaga

SEQ ID NO: 507660 - DNA, 16 bp, R. norvegicus
gcctggagctcaccaa

SEQ ID NO: 507661 - DNA, 16 bp, R. norvegicus
gcctggaggattcctg

SEQ ID NO: 507662 - DNA, 16 bp, R. norvegicus
gcctggatgctgcctt

SEQ ID NO: 507663 - DNA, 16 bp, R. norvegicus
gcctggatggtagctg

SEQ ID NO: 507664 - DNA, 16 bp, R. norvegicus
gcctggcacacagcag

SEQ ID NO: 507665 - DNA, 16 bp, R. norvegicus
gcctggcacacagtgg

SEQ ID NO: 507666 - DNA, 16 bp, R. norvegicus
gcctggcagacctgta

SEQ ID NO: 507667 - DNA, 16 bp, R. norvegicus
gcctggccccacttcc

SEQ ID NO: 507668 - DNA, 16 bp, R. norvegicus
gcctggcccctttccc

SEQ ID NO: 507669 - DNA, 16 bp, R. norvegicus
gcctggctggaggaag

SEQ ID NO: 507670 - DNA, 24 bp, R. norvegicus
gcctgggaaaccagaagagactga

SEQ ID NO: 507671 - DNA, 24 bp, R. norvegicus
gcctgggaaaccagaagagactgc

SEQ ID NO: 507672 - DNA, 16 bp, R. norvegicus
gcctgggacagaggga

SEQ ID NO: 507673 - DNA, 16 bp, R. norvegicus
gcctgggatgaagcct

SEQ ID NO: 507674 - DNA, 16 bp, R. norvegicus
gcctgggatggagcct

SEQ ID NO: 507675 - DNA, 16 bp, R. norvegicus
gcctggggctggagag

SEQ ID NO: 507676 - DNA, 16 bp, R. norvegicus
gcctggggctggggat

SEQ ID NO: 507677 - DNA, 16 bp, R. norvegicus
gcctggtctggactca

SEQ ID NO: 507678 - DNA, 16 bp, R. norvegicus
gcctggtcttcagagc

SEQ ID NO: 507679 - DNA, 16 bp, R. norvegicus
gcctggtgaacaccag

SEQ ID NO: 507680 - DNA, 16 bp, R. norvegicus
gcctggtgcaggagga

SEQ ID NO: 507681 - DNA, 16 bp, R. norvegicus
gcctggtgcccagaga

SEQ ID NO: 507682 - DNA, 16 bp, R. norvegicus
gcctggtgcctgagga

SEQ ID NO: 507683 - DNA, 16 bp, R. norvegicus
gcctggtgcctggtgc

SEQ ID NO: 507684 - DNA, 16 bp, R. norvegicus
gcctggtgctcacaga

SEQ ID NO: 507685 - DNA, 16 bp, R. norvegicus
gcctggtgtggtctgt

SEQ ID NO: 507686 - DNA, 16 bp, R. norvegicus
gcctggtgtggtggca

SEQ ID NO: 507687 - DNA, 16 bp, R. norvegicus
gcctgtagaagaatgc

SEQ ID NO: 507688 - DNA, 16 bp, R. norvegicus
gcctgtagtcctagca

SEQ ID NO: 507689 - DNA, 16 bp, R. norvegicus
gcctgtattcccagca

SEQ ID NO: 507690 - DNA, 16 bp, R. norvegicus
gcctgtcactgggcct

SEQ ID NO: 507691 - DNA, 16 bp, R. norvegicus
gcctgtcaggagacag

SEQ ID NO: 507692 - DNA, 16 bp, R. norvegicus
gcctgtcccacatgtg

SEQ ID NO: 507693 - DNA, 16 bp, R. norvegicus
gcctgtctgcacctgt

SEQ ID NO: 507694 - DNA, 16 bp, R. norvegicus
gcctgtctgcctccca

SEQ ID NO: 507695 - DNA, 16 bp, R. norvegicus
gcctgtctgcctgctg

SEQ ID NO: 507696 - DNA, 16 bp, R. norvegicus
gcctgtgatcccagtg

SEQ ID NO: 507697 - DNA, 16 bp, R. norvegicus
gcctgtgccaccacca

SEQ ID NO: 507698 - DNA, 16 bp, R. norvegicus
gcctgtgcctgtgcct

SEQ ID NO: 507699 - DNA, 16 bp, R. norvegicus
gcctgtgctgccacca

SEQ ID NO: 507700 - DNA, 16 bp, R. norvegicus
gcctgtggatgccaga

SEQ ID NO: 507701 - DNA, 16 bp, R. norvegicus
gcctgtggggacattt

SEQ ID NO: 507702 - DNA, 16 bp, R. norvegicus
gcctgtgtctctgtct

SEQ ID NO: 507703 - DNA, 16 bp, R. norvegicus
gcctgtgtgcgtgtgc

SEQ ID NO: 507704 - DNA, 16 bp, R. norvegicus
gcctgtgtgctgtgtg

SEQ ID NO: 507705 - DNA, 16 bp, R. norvegicus
gcctgtgtgtcatgag

SEQ ID NO: 507706 - DNA, 16 bp, R. norvegicus
gcctgtgttttgagtt

SEQ ID NO: 507707 - DNA, 16 bp, R. norvegicus
gcctgttccaggaatg

SEQ ID NO: 507708 - DNA, 20 bp, R. norvegicus
gcctgttcttggccttgtcc

SEQ ID NO: 507709 - DNA, 16 bp, R. norvegicus
gcctgtttattctttg

SEQ ID NO: 507710 - DNA, 16 bp, R. norvegicus
gccttaaacttgctat

SEQ ID NO: 507711 - DNA, 16 bp, R. norvegicus
gccttagcattcccct

SEQ ID NO: 507712 - DNA, 16 bp, R. norvegicus
gccttatctggcatca

SEQ ID NO: 507713 - DNA, 16 bp, R. norvegicus
gccttcaacagaggaa

SEQ ID NO: 507714 - DNA, 16 bp, R. norvegicus
gccttcagatgaggat

SEQ ID NO: 507715 - DNA, 16 bp, R. norvegicus
gccttcagctgctgtg

SEQ ID NO: 507716 - DNA, 19 bp, R. norvegicus
gccttcagctgttcctgtg

SEQ ID NO: 507717 - DNA, 16 bp, R. norvegicus
gccttcaggaaacaca

SEQ ID NO: 507718 - DNA, 16 bp, R. norvegicus
gccttccaagggctgg

SEQ ID NO: 507719 - DNA, 16 bp, R. norvegicus
gccttccaagtgctgg

SEQ ID NO: 507720 - DNA, 16 bp, R. norvegicus
gccttccaagtgttgg

SEQ ID NO: 507721 - DNA, 16 bp, R. norvegicus
gccttccagaagcttt

SEQ ID NO: 507722 - DNA, 16 bp, R. norvegicus
gccttccagcttgttg

SEQ ID NO: 507723 - DNA, 16 bp, R. norvegicus
gccttccccaccatga

SEQ ID NO: 507724 - DNA, 16 bp, R. norvegicus
gccttcctctacacta

SEQ ID NO: 507725 - DNA, 16 bp, R. norvegicus
gccttcctggaggaag

SEQ ID NO: 507726 - DNA, 16 bp, R. norvegicus
gccttcctggaggagg

SEQ ID NO: 507727 - DNA, 17 bp, R. norvegicus
gccttcggcagtgtgat

SEQ ID NO: 507728 - DNA, 16 bp, R. norvegicus
gccttctaaatatttg

SEQ ID NO: 507729 - DNA, 16 bp, R. norvegicus
gccttctatgaaggtc

SEQ ID NO: 507730 - DNA, 16 bp, R. norvegicus
gccttctccatggtgg

SEQ ID NO: 507731 - DNA, 16 bp, R. norvegicus
gccttctctccagtcc

SEQ ID NO: 507732 - DNA, 16 bp, R. norvegicus
gccttctctggcatca

SEQ ID NO: 507733 - DNA, 16 bp, R. norvegicus
gccttctctgtggctc

SEQ ID NO: 507734 - DNA, 16 bp, R. norvegicus
gccttctgcctcagcc

SEQ ID NO: 507735 - DNA, 16 bp, R. norvegicus
gccttctgtgttcctc

SEQ ID NO: 507736 - DNA, 16 bp, R. norvegicus
gccttcttctgctgtg

SEQ ID NO: 507737 - DNA, 16 bp, R. norvegicus
gccttgaagtcagaga

SEQ ID NO: 507738 - DNA, 16 bp, R. norvegicus
gccttgcagaagcttt

SEQ ID NO: 507739 - DNA, 16 bp, R. norvegicus
gccttgctcatggtgt

SEQ ID NO: 507740 - DNA, 16 bp, R. norvegicus
gccttgctgggcacca

SEQ ID NO: 507741 - DNA, 16 bp, R. norvegicus
gccttggcaggacaaa

SEQ ID NO: 507742 - DNA, 16 bp, R. norvegicus
gccttggcaggatcaa

SEQ ID NO: 507743 - DNA, 16 bp, R. norvegicus
gccttggcaggatgaa

SEQ ID NO: 507744 - DNA, 16 bp, R. norvegicus
gccttggctgacctgg

SEQ ID NO: 507745 - DNA, 16 bp, R. norvegicus
gccttggctgtgctgg

SEQ ID NO: 507746 - DNA, 16 bp, R. norvegicus
gccttgggaggaccaa

SEQ ID NO: 507747 - DNA, 16 bp, R. norvegicus
gccttgggaggcagag

SEQ ID NO: 507748 - DNA, 16 bp, R. norvegicus
gccttggggttgggga

SEQ ID NO: 507749 - DNA, 16 bp, R. norvegicus
gccttgggttcggtcc

SEQ ID NO: 507750 - DNA, 16 bp, R. norvegicus
gccttggtcagagaag

SEQ ID NO: 507751 - DNA, 16 bp, R. norvegicus
gccttgtctggtccct

SEQ ID NO: 507752 - DNA, 16 bp, R. norvegicus
gccttgtgcttcccag

SEQ ID NO: 507753 - DNA, 16 bp, R. norvegicus
gccttgtgcttcctaa

SEQ ID NO: 507754 - DNA, 16 bp, R. norvegicus
gccttgtgtttcctag

SEQ ID NO: 507755 - DNA, 16 bp, R. norvegicus
gccttgttctcctggt

SEQ ID NO: 507756 - DNA, 16 bp, R. norvegicus
gccttgttggagaaag

SEQ ID NO: 507757 - DNA, 16 bp, R. norvegicus
gccttgttggaggaga

SEQ ID NO: 507758 - DNA, 16 bp, R. norvegicus
gccttgttggggacca

SEQ ID NO: 507759 - DNA, 16 bp, R. norvegicus
gcctttaaaaattatt

SEQ ID NO: 507760 - DNA, 16 bp, R. norvegicus
gcctttaatcccagca

SEQ ID NO: 507761 - DNA, 16 bp, R. norvegicus
gcctttaatcccagta

SEQ ID NO: 507762 - DNA, 16 bp, R. norvegicus
gcctttacccactgag

SEQ ID NO: 507763 - DNA, 16 bp, R. norvegicus
gcctttagtcccagca

SEQ ID NO: 507764 - DNA, 16 bp, R. norvegicus
gcctttccccactgag

SEQ ID NO: 507765 - DNA, 16 bp, R. norvegicus
gcctttccttaagtct

SEQ ID NO: 507766 - DNA, 16 bp, R. norvegicus
gcctttctcaggatga

SEQ ID NO: 507767 - DNA, 16 bp, R. norvegicus
gcctttctctaaggga

SEQ ID NO: 507768 - DNA, 16 bp, R. norvegicus
gcctttctggaggaag

SEQ ID NO: 507769 - DNA, 16 bp, R. norvegicus
gcctttcttgaagtcc

SEQ ID NO: 507770 - DNA, 16 bp, R. norvegicus
gcctttgatgggtctg

SEQ ID NO: 507771 - DNA, 16 bp, R. norvegicus
gcctttgcctacagag

SEQ ID NO: 507772 - DNA, 16 bp, R. norvegicus
gcctttgcctctgcct

SEQ ID NO: 507773 - DNA, 16 bp, R. norvegicus
gcctttgcctttgcct

SEQ ID NO: 507774 - DNA, 16 bp, R. norvegicus
gcctttgcgtattaca

SEQ ID NO: 507775 - DNA, 16 bp, R. norvegicus
gcctttggaggccaga

SEQ ID NO: 507776 - DNA, 16 bp, R. norvegicus
gcctttgtctctgagg

SEQ ID NO: 507777 - DNA, 16 bp, R. norvegicus
gcctttttttataata

SEQ ID NO: 507778 - DNA, 16 bp, R. norvegicus
gcgagagagacagaga

SEQ ID NO: 507779 - DNA, 17 bp, R. norvegicus
gcgagagcgagagagag

SEQ ID NO: 507780 - DNA, 16 bp, R. norvegicus
gcgagcacaaggccct

SEQ ID NO: 507781 - DNA, 16 bp, R. norvegicus
gcgagcgcgcgcgcac

SEQ ID NO: 507782 - DNA, 16 bp, R. norvegicus
gcgaggaggtggagaa

SEQ ID NO: 507783 - DNA, 16 bp, R. norvegicus
gcgaggatgtggggaa

SEQ ID NO: 507784 - DNA, 16 bp, R. norvegicus
gcgatgagctctctct

SEQ ID NO: 507785 - DNA, 16 bp, R. norvegicus
gcgatggtgtggcatt

SEQ ID NO: 507786 - DNA, 17 bp, R. norvegicus
gcgattcctctctgtag

SEQ ID NO: 507787 - DNA, 16 bp, R. norvegicus
gcgcacacacacacac

SEQ ID NO: 507788 - DNA, 16 bp, R. norvegicus
gcgcacacacacaggc

SEQ ID NO: 507789 - DNA, 16 bp, R. norvegicus
gcgcacacacagacac

SEQ ID NO: 507790 - DNA, 16 bp, R. norvegicus
gcgcacacgcacacac

SEQ ID NO: 507791 - DNA, 16 bp, R. norvegicus
gcgcacgcgcacgcgc

SEQ ID NO: 507792 - DNA, 16 bp, R. norvegicus
gcgcacgcgcgcgcac

SEQ ID NO: 507793 - DNA, 16 bp, R. norvegicus
gcgcagccttcactgt

SEQ ID NO: 507794 - DNA, 16 bp, R. norvegicus
gcgcaggcctttaatc

SEQ ID NO: 507795 - DNA, 16 bp, R. norvegicus
gcgcatgtgcaagagt

SEQ ID NO: 507796 - DNA, 16 bp, R. norvegicus
gcgccatcctgagact

SEQ ID NO: 507797 - DNA, 16 bp, R. norvegicus
gcgccccctgctggtc

SEQ ID NO: 507798 - DNA, 16 bp, R. norvegicus
gcgccctcctgtggta

SEQ ID NO: 507799 - DNA, 16 bp, R. norvegicus
gcgccctctactggag

SEQ ID NO: 507800 - DNA, 17 bp, R. norvegicus
gcgccgaggagagcctc

SEQ ID NO: 507801 - DNA, 16 bp, R. norvegicus
gcgcctgggaggccag

SEQ ID NO: 507802 - DNA, 16 bp, R. norvegicus
gcgcgcgcaagaaaaa

SEQ ID NO: 507803 - DNA, 16 bp, R. norvegicus
gcgcgcgcgagagaga

SEQ ID NO: 507804 - DNA, 16 bp, R. norvegicus
gcgcgcgcgtgtgtct

SEQ ID NO: 507805 - DNA, 16 bp, R. norvegicus
gcgcgtgcacgcgtgc

SEQ ID NO: 507806 - DNA, 16 bp, R. norvegicus
gcgcgtgtgcgtgtgc

SEQ ID NO: 507807 - DNA, 16 bp, R. norvegicus
gcgctcctgaggctgc

SEQ ID NO: 507808 - DNA, 16 bp, R. norvegicus
gcgctgctgctgctgc

SEQ ID NO: 507809 - DNA, 16 bp, R. norvegicus
gcgctggcctccgctg

SEQ ID NO: 507810 - DNA, 27 bp, R. norvegicus
gcgctggggaccgaacccagggccttg

SEQ ID NO: 507811 - DNA, 16 bp, R. norvegicus
gcggaaaaagctattg

SEQ ID NO: 507812 - DNA, 17 bp, R. norvegicus
gcggaaggccctgggtt

SEQ ID NO: 507813 - DNA, 16 bp, R. norvegicus
gcggagaaagcatttg

SEQ ID NO: 507814 - DNA, 16 bp, R. norvegicus
gcggagctgctgcagc

SEQ ID NO: 507815 - DNA, 16 bp, R. norvegicus
gcggatcccgggcccg

SEQ ID NO: 507816 - DNA, 16 bp, R. norvegicus
gcggcagagacactgg

SEQ ID NO: 507817 - DNA, 16 bp, R. norvegicus
gcggcagaggcagagg

SEQ ID NO: 507818 - DNA, 16 bp, R. norvegicus
gcggcagcagcaacca

SEQ ID NO: 507819 - DNA, 16 bp, R. norvegicus
gcggcagcagcagcgg

SEQ ID NO: 507820 - DNA, 16 bp, R. norvegicus
gcggcagcagccagga

SEQ ID NO: 507821 - DNA, 16 bp, R. norvegicus
gcggccctctacatct

SEQ ID NO: 507822 - DNA, 16 bp, R. norvegicus
gcggcggctgctgctg

SEQ ID NO: 507823 - DNA, 16 bp, R. norvegicus
gcggctagagacactg

SEQ ID NO: 507824 - DNA, 20 bp, R. norvegicus
gcggtcctgctgctcctggg

SEQ ID NO: 507825 - DNA, 16 bp, R. norvegicus
gcggtggcacacacct

SEQ ID NO: 507826 - DNA, 16 bp, R. norvegicus
gcggtggctggagaca

SEQ ID NO: 507827 - DNA, 25 bp, R. norvegicus
gcggtgtctcaggcaggtgtcctgc

SEQ ID NO: 507828 - DNA, 16 bp, R. norvegicus
gcgtccttctttgtgt

SEQ ID NO: 507829 - DNA, 16 bp, R. norvegicus
gcgtgcaccaccacac

SEQ ID NO: 507830 - DNA, 16 bp, R. norvegicus
gcgtgcatgtgcgtgc

SEQ ID NO: 507831 - DNA, 16 bp, R. norvegicus
gcgtggagccactgag

SEQ ID NO: 507832 - DNA, 16 bp, R. norvegicus
gcgtggctcagtggtt

SEQ ID NO: 507833 - DNA, 16 bp, R. norvegicus
gcgtgtgcatgcgtgt

SEQ ID NO: 507834 - DNA, 16 bp, R. norvegicus
gcgtgtgcatgtatgt

SEQ ID NO: 507835 - DNA, 16 bp, R. norvegicus
gcgtgtgcgtgtgcgc

SEQ ID NO: 507836 - DNA, 16 bp, R. norvegicus
gcgtgtgtgtatatgt

SEQ ID NO: 507837 - DNA, 16 bp, R. norvegicus
gcgtgtgtgtgtgtgc

SEQ ID NO: 507838 - DNA, 16 bp, R. norvegicus
gctaaaactacagaga

SEQ ID NO: 507839 - DNA, 16 bp, R. norvegicus
gctaaacaaccacagc

SEQ ID NO: 507840 - DNA, 16 bp, R. norvegicus
gctaaagcaggaggat

SEQ ID NO: 507841 - DNA, 16 bp, R. norvegicus
gctaaatcaggaacag

SEQ ID NO: 507842 - DNA, 16 bp, R. norvegicus
gctaacaacaacaaca

SEQ ID NO: 507843 - DNA, 16 bp, R. norvegicus
gctaacctggaactca

SEQ ID NO: 507844 - DNA, 16 bp, R. norvegicus
gctaacctggtctaca

SEQ ID NO: 507845 - DNA, 16 bp, R. norvegicus
gctaagagcacttgct

SEQ ID NO: 507846 - DNA, 16 bp, R. norvegicus
gctaagatcaagaaaa

SEQ ID NO: 507847 - DNA, 16 bp, R. norvegicus
gctaagcagagaattc

SEQ ID NO: 507848 - DNA, 16 bp, R. norvegicus
gctaaggaagcaggca

SEQ ID NO: 507849 - DNA, 16 bp, R. norvegicus
gctaagggcactggct

SEQ ID NO: 507850 - DNA, 16 bp, R. norvegicus
gctaataggccatcag

SEQ ID NO: 507851 - DNA, 16 bp, R. norvegicus
gctaatatcaaataaa

SEQ ID NO: 507852 - DNA, 16 bp, R. norvegicus
gctacaacttcaagaa

SEQ ID NO: 507853 - DNA, 16 bp, R. norvegicus
gctacaatgtattcat

SEQ ID NO: 507854 - DNA, 16 bp, R. norvegicus
gctacacacagaaacc

SEQ ID NO: 507855 - DNA, 16 bp, R. norvegicus
gctacacagagaaact

SEQ ID NO: 507856 - DNA, 16 bp, R. norvegicus
gctacactgtgagacc

SEQ ID NO: 507857 - DNA, 16 bp, R. norvegicus
gctacagagaaaaacc

SEQ ID NO: 507858 - DNA, 16 bp, R. norvegicus
gctacagagagagacc

SEQ ID NO: 507859 - DNA, 16 bp, R. norvegicus
gctacagaggacagag

SEQ ID NO: 507860 - DNA, 16 bp, R. norvegicus
gctacaggaagtggcc

SEQ ID NO: 507861 - DNA, 16 bp, R. norvegicus
gctacaggaggtggtc

SEQ ID NO: 507862 - DNA, 16 bp, R. norvegicus
gctacagtgtacagtg

SEQ ID NO: 507863 - DNA, 16 bp, R. norvegicus
gctacatagagaccct

SEQ ID NO: 507864 - DNA, 16 bp, R. norvegicus
gctacatagcaagact

SEQ ID NO: 507865 - DNA, 16 bp, R. norvegicus
gctacatagtgagacc

SEQ ID NO: 507866 - DNA, 16 bp, R. norvegicus
gctacatagtgaggcc

SEQ ID NO: 507867 - DNA, 16 bp, R. norvegicus
gctacatatatagcag

SEQ ID NO: 507868 - DNA, 16 bp, R. norvegicus
gctacatatgaggtca

SEQ ID NO: 507869 - DNA, 16 bp, R. norvegicus
gctacatctccagcct

SEQ ID NO: 507870 - DNA, 16 bp, R. norvegicus
gctacatgggtgctgg

SEQ ID NO: 507871 - DNA, 16 bp, R. norvegicus
gctaccaccacccagc

SEQ ID NO: 507872 - DNA, 16 bp, R. norvegicus
gctaccactgcctggc

SEQ ID NO: 507873 - DNA, 16 bp, R. norvegicus
gctaccatgcttcctg

SEQ ID NO: 507874 - DNA, 16 bp, R. norvegicus
gctacccagagaaacc

SEQ ID NO: 507875 - DNA, 16 bp, R. norvegicus
gctacccttccagagg

SEQ ID NO: 507876 - DNA, 16 bp, R. norvegicus
gctacctaggcagttg

SEQ ID NO: 507877 - DNA, 16 bp, R. norvegicus
gctacctcctgctgtt

SEQ ID NO: 507878 - DNA, 16 bp, R. norvegicus
gctacctgagaccttg

SEQ ID NO: 507879 - DNA, 16 bp, R. norvegicus
gctacgggattgtcat

SEQ ID NO: 507880 - DNA, 16 bp, R. norvegicus
gctactctgtgggttc

SEQ ID NO: 507881 - DNA, 16 bp, R. norvegicus
gctactggaggagaaa

SEQ ID NO: 507882 - DNA, 16 bp, R. norvegicus
gctactggtttgctgc

SEQ ID NO: 507883 - DNA, 16 bp, R. norvegicus
gctacttcatcactgt

SEQ ID NO: 507884 - DNA, 16 bp, R. norvegicus
gctagaacaaacgaaa

SEQ ID NO: 507885 - DNA, 16 bp, R. norvegicus
gctagagagctggctc

SEQ ID NO: 507886 - DNA, 16 bp, R. norvegicus
gctagagatgtggctc

SEQ ID NO: 507887 - DNA, 16 bp, R. norvegicus
gctagcaggcctgcat

SEQ ID NO: 507888 - DNA, 16 bp, R. norvegicus
gctagcctgggcaact

SEQ ID NO: 507889 - DNA, 16 bp, R. norvegicus
gctaggatttgaactc

SEQ ID NO: 507890 - DNA, 16 bp, R. norvegicus
gctaggctcctgactg

SEQ ID NO: 507891 - DNA, 16 bp, R. norvegicus
gctagtgaccagcctg

SEQ ID NO: 507892 - DNA, 16 bp, R. norvegicus
gctagtgataatgtaa

SEQ ID NO: 507893 - DNA, 16 bp, R. norvegicus
gctatagctgggtcct

SEQ ID NO: 507894 - DNA, 16 bp, R. norvegicus
gctatagtgtgtcaca

SEQ ID NO: 507895 - DNA, 16 bp, R. norvegicus
gctatataaaccaggc

SEQ ID NO: 507896 - DNA, 16 bp, R. norvegicus
gctatcaaaaaaatga

SEQ ID NO: 507897 - DNA, 16 bp, R. norvegicus
gctatcctcaaacttg

SEQ ID NO: 507898 - DNA, 16 bp, R. norvegicus
gctatcctggaactca

SEQ ID NO: 507899 - DNA, 16 bp, R. norvegicus
gctatcctggaactcg

SEQ ID NO: 507900 - DNA, 18 bp, R. norvegicus
gctatcggaccaccacag

SEQ ID NO: 507901 - DNA, 16 bp, R. norvegicus
gctatcttcccagccc

SEQ ID NO: 507902 - DNA, 16 bp, R. norvegicus
gctatgaacatactgg

SEQ ID NO: 507903 - DNA, 16 bp, R. norvegicus
gctatgacaaaacact

SEQ ID NO: 507904 - DNA, 16 bp, R. norvegicus
gctatgaggaaaactc

SEQ ID NO: 507905 - DNA, 16 bp, R. norvegicus
gctatgcagaccaggc

SEQ ID NO: 507906 - DNA, 24 bp, R. norvegicus
gctatgctgtggtgcaagaacagg

SEQ ID NO: 507907 - DNA, 16 bp, R. norvegicus
gctatggagggatgct

SEQ ID NO: 507908 - DNA, 16 bp, R. norvegicus
gctatgggagaaactg

SEQ ID NO: 507909 - DNA, 16 bp, R. norvegicus
gctatgggtttgctgt

SEQ ID NO: 507910 - DNA, 16 bp, R. norvegicus
gctatggtgtactcac

SEQ ID NO: 507911 - DNA, 16 bp, R. norvegicus
gctatgtctccagccc

SEQ ID NO: 507912 - DNA, 16 bp, R. norvegicus
gctatgttgcccaggc

SEQ ID NO: 507913 - DNA, 16 bp, R. norvegicus
gctattaagaataagg

SEQ ID NO: 507914 - DNA, 16 bp, R. norvegicus
gctattctcttctctc

SEQ ID NO: 507915 - DNA, 16 bp, R. norvegicus
gctatttcatattgtt

SEQ ID NO: 507916 - DNA, 16 bp, R. norvegicus
gctcaaagccagcctg

SEQ ID NO: 507917 - DNA, 16 bp, R. norvegicus
gctcaaagccctgggt

SEQ ID NO: 507918 - DNA, 16 bp, R. norvegicus
gctcaacaagagggaa

SEQ ID NO: 507919 - DNA, 16 bp, R. norvegicus
gctcaagaagaaggac

SEQ ID NO: 507920 - DNA, 16 bp, R. norvegicus
gctcaagaagaaggag

SEQ ID NO: 507921 - DNA, 16 bp, R. norvegicus
gctcaagaagtttcag

SEQ ID NO: 507922 - DNA, 16 bp, R. norvegicus
gctcaagaccctgggt

SEQ ID NO: 507923 - DNA, 16 bp, R. norvegicus
gctcaaggacagcctg

SEQ ID NO: 507924 - DNA, 16 bp, R. norvegicus
gctcaaggggaggtcc

SEQ ID NO: 507925 - DNA, 16 bp, R. norvegicus
gctcaagttcaagtgg

SEQ ID NO: 507926 - DNA, 16 bp, R. norvegicus
gctcaatcacagaaaa

SEQ ID NO: 507927 - DNA, 16 bp, R. norvegicus
gctcacaaacatctgt

SEQ ID NO: 507928 - DNA, 16 bp, R. norvegicus
gctcacaactgcctgt

SEQ ID NO: 507929 - DNA, 16 bp, R. norvegicus
gctcacactcacctgg

SEQ ID NO: 507930 - DNA, 16 bp, R. norvegicus
gctcacagccacctgc

SEQ ID NO: 507931 - DNA, 16 bp, R. norvegicus
gctcacagccagctgt

SEQ ID NO: 507932 - DNA, 16 bp, R. norvegicus
gctcacagccttctgt

SEQ ID NO: 507933 - DNA, 16 bp, R. norvegicus
gctcacagtgcagctg

SEQ ID NO: 507934 - DNA, 16 bp, R. norvegicus
gctcacattcatggcc

SEQ ID NO: 507935 - DNA, 16 bp, R. norvegicus
gctcacattcctgtcc

SEQ ID NO: 507936 - DNA, 20 bp, R. norvegicus
gctcaccatcactgagagca

SEQ ID NO: 507937 - DNA, 16 bp, R. norvegicus
gctcacccactcctgc

SEQ ID NO: 507938 - DNA, 16 bp, R. norvegicus
gctcactaggcaagcg

SEQ ID NO: 507939 - DNA, 16 bp, R. norvegicus
gctcactggctgctct

SEQ ID NO: 507940 - DNA, 16 bp, R. norvegicus
gctcactggtcagcca

SEQ ID NO: 507941 - DNA, 16 bp, R. norvegicus
gctcagaagttaagag

SEQ ID NO: 507942 - DNA, 16 bp, R. norvegicus
gctcagaggagaccac

SEQ ID NO: 507943 - DNA, 16 bp, R. norvegicus
gctcagaggttaagag

SEQ ID NO: 507944 - DNA, 16 bp, R. norvegicus
gctcagatccattttg

SEQ ID NO: 507945 - DNA, 16 bp, R. norvegicus
gctcagcagccaagag

SEQ ID NO: 507946 - DNA, 16 bp, R. norvegicus
gctcagcaggcagagg

SEQ ID NO: 507947 - DNA, 16 bp, R. norvegicus
gctcagcagttaggag

SEQ ID NO: 507948 - DNA, 16 bp, R. norvegicus
gctcagcagttgggag

SEQ ID NO: 507949 - DNA, 16 bp, R. norvegicus
gctcagccagagtgtg

SEQ ID NO: 507950 - DNA, 16 bp, R. norvegicus
gctcagccatctctct

SEQ ID NO: 507951 - DNA, 16 bp, R. norvegicus
gctcagcccactgtgg

SEQ ID NO: 507952 - DNA, 16 bp, R. norvegicus
gctcagcccagcccag

SEQ ID NO: 507953 - DNA, 16 bp, R. norvegicus
gctcagcccattgtgg

SEQ ID NO: 507954 - DNA, 16 bp, R. norvegicus
gctcagcctcctcctc

SEQ ID NO: 507955 - DNA, 16 bp, R. norvegicus
gctcagcctgctgtct

SEQ ID NO: 507956 - DNA, 16 bp, R. norvegicus
gctcagcctgcttcct

SEQ ID NO: 507957 - DNA, 16 bp, R. norvegicus
gctcagcctgctttca

SEQ ID NO: 507958 - DNA, 16 bp, R. norvegicus
gctcagcctgggctac

SEQ ID NO: 507959 - DNA, 16 bp, R. norvegicus
gctcagcggttaagaa

SEQ ID NO: 507960 - DNA, 16 bp, R. norvegicus
gctcagctacctttct

SEQ ID NO: 507961 - DNA, 16 bp, R. norvegicus
gctcagctcagcccag

SEQ ID NO: 507962 - DNA, 16 bp, R. norvegicus
gctcagctgctttctt

SEQ ID NO: 507963 - DNA, 16 bp, R. norvegicus
gctcagctggtaaagg

SEQ ID NO: 507964 - DNA, 16 bp, R. norvegicus
gctcagctggtgaagt

SEQ ID NO: 507965 - DNA, 16 bp, R. norvegicus
gctcagcttactctct

SEQ ID NO: 507966 - DNA, 16 bp, R. norvegicus
gctcagcttctcctgg

SEQ ID NO: 507967 - DNA, 16 bp, R. norvegicus
gctcaggaaaaaaaaa

SEQ ID NO: 507968 - DNA, 16 bp, R. norvegicus
gctcaggaagaaggaa

SEQ ID NO: 507969 - DNA, 16 bp, R. norvegicus
gctcaggagatgctca

SEQ ID NO: 507970 - DNA, 16 bp, R. norvegicus
gctcaggaggcagagg

SEQ ID NO: 507971 - DNA, 16 bp, R. norvegicus
gctcaggcacaggctc

SEQ ID NO: 507972 - DNA, 16 bp, R. norvegicus
gctcaggccaggccca

SEQ ID NO: 507973 - DNA, 16 bp, R. norvegicus
gctcaggctcaggctc

SEQ ID NO: 507974 - DNA, 16 bp, R. norvegicus
gctcagggattggtag

SEQ ID NO: 507975 - DNA, 16 bp, R. norvegicus
gctcagggcagcttgg

SEQ ID NO: 507976 - DNA, 16 bp, R. norvegicus
gctcagggccagatgg

SEQ ID NO: 507977 - DNA, 16 bp, R. norvegicus
gctcaggtaaacccag

SEQ ID NO: 507978 - DNA, 16 bp, R. norvegicus
gctcaggttgcttggc

SEQ ID NO: 507979 - DNA, 16 bp, R. norvegicus
gctcagtgacagaaca

SEQ ID NO: 507980 - DNA, 16 bp, R. norvegicus
gctcagtggtaaagtg

SEQ ID NO: 507981 - DNA, 16 bp, R. norvegicus
gctcagtggtagagct

SEQ ID NO: 507982 - DNA, 19 bp, R. norvegicus
gctcagtggtagagtgctt

SEQ ID NO: 507983 - DNA, 16 bp, R. norvegicus
gctcagtggtagcaag

SEQ ID NO: 507984 - DNA, 16 bp, R. norvegicus
gctcagtggtcaagag

SEQ ID NO: 507985 - DNA, 16 bp, R. norvegicus
gctcagtggttaaaca

SEQ ID NO: 507986 - DNA, 16 bp, R. norvegicus
gctcagtggttacagc

SEQ ID NO: 507987 - DNA, 16 bp, R. norvegicus
gctcagtggttaggag

SEQ ID NO: 507988 - DNA, 16 bp, R. norvegicus
gctcatcactgaagga

SEQ ID NO: 507989 - DNA, 16 bp, R. norvegicus
gctcatccctggggaa

SEQ ID NO: 507990 - DNA, 16 bp, R. norvegicus
gctcatcctgagaaag

SEQ ID NO: 507991 - DNA, 16 bp, R. norvegicus
gctcatgaagtcttcc

SEQ ID NO: 507992 - DNA, 16 bp, R. norvegicus
gctcatgcagaggcca

SEQ ID NO: 507993 - DNA, 16 bp, R. norvegicus
gctcatgtcttctctt

SEQ ID NO: 507994 - DNA, 16 bp, R. norvegicus
gctcatttctgggatc

SEQ ID NO: 507995 - DNA, 16 bp, R. norvegicus
gctccaacctcataga

SEQ ID NO: 507996 - DNA, 16 bp, R. norvegicus
gctccaagatcaagaa

SEQ ID NO: 507997 - DNA, 16 bp, R. norvegicus
gctccaagcatccaca

SEQ ID NO: 507998 - DNA, 16 bp, R. norvegicus
gctccaatgggaggag

SEQ ID NO: 507999 - DNA, 16 bp, R. norvegicus
gctccaccacacctgg

SEQ ID NO: 508000 - DNA, 16 bp, R. norvegicus
gctccaccagcagctg

SEQ ID NO: 508001 - DNA, 16 bp, R. norvegicus
gctccaccgctgagct

SEQ ID NO: 508002 - DNA, 16 bp, R. norvegicus
gctccactgtgctgcc

SEQ ID NO: 508003 - DNA, 16 bp, R. norvegicus
gctccagaaaaaagaa

SEQ ID NO: 508004 - DNA, 16 bp, R. norvegicus
gctccagatacatatg

SEQ ID NO: 508005 - DNA, 16 bp, R. norvegicus
gctccagcaccaggcc

SEQ ID NO: 508006 - DNA, 16 bp, R. norvegicus
gctccagctaaccaga

SEQ ID NO: 508007 - DNA, 16 bp, R. norvegicus
gctccagctccatatg

SEQ ID NO: 508008 - DNA, 16 bp, R. norvegicus
gctccagctgcttatg

SEQ ID NO: 508009 - DNA, 16 bp, R. norvegicus
gctccagctgtcctgg

SEQ ID NO: 508010 - DNA, 16 bp, R. norvegicus
gctccaggaatcctcc

SEQ ID NO: 508011 - DNA, 16 bp, R. norvegicus
gctccaggacagaagc

SEQ ID NO: 508012 - DNA, 16 bp, R. norvegicus
gctccaggacagtcag

SEQ ID NO: 508013 - DNA, 16 bp, R. norvegicus
gctccaggcaggtccc

SEQ ID NO: 508014 - DNA, 16 bp, R. norvegicus
gctccaggccagtcag

SEQ ID NO: 508015 - DNA, 16 bp, R. norvegicus
gctccaggggatctgg

SEQ ID NO: 508016 - DNA, 16 bp, R. norvegicus
gctccagtcagagaca

SEQ ID NO: 508017 - DNA, 16 bp, R. norvegicus
gctccagtgggggagg

SEQ ID NO: 508018 - DNA, 16 bp, R. norvegicus
gctccatctatttcaa

SEQ ID NO: 508019 - DNA, 16 bp, R. norvegicus
gctccatgctgccccc

SEQ ID NO: 508020 - DNA, 16 bp, R. norvegicus
gctccatgtggtctgt

SEQ ID NO: 508021 - DNA, 16 bp, R. norvegicus
gctccattcatttgcc

SEQ ID NO: 508022 - DNA, 16 bp, R. norvegicus
gctcccaggactgtgt

SEQ ID NO: 508023 - DNA, 16 bp, R. norvegicus
gctccccctgctgctg

SEQ ID NO: 508024 - DNA, 16 bp, R. norvegicus
gctcccctaactgggc

SEQ ID NO: 508025 - DNA, 16 bp, R. norvegicus
gctcccggaaagagca

SEQ ID NO: 508026 - DNA, 16 bp, R. norvegicus
gctcccgtggggaggg

SEQ ID NO: 508027 - DNA, 16 bp, R. norvegicus
gctccgggtagagagc

SEQ ID NO: 508028 - DNA, 16 bp, R. norvegicus
gctcctagagactgaa

SEQ ID NO: 508029 - DNA, 16 bp, R. norvegicus
gctcctatctaaagga

SEQ ID NO: 508030 - DNA, 16 bp, R. norvegicus
gctcctcagaaaactg

SEQ ID NO: 508031 - DNA, 16 bp, R. norvegicus
gctcctccagaggact

SEQ ID NO: 508032 - DNA, 17 bp, R. norvegicus
gctcctccattgttggt

SEQ ID NO: 508033 - DNA, 16 bp, R. norvegicus
gctcctcctccctgca

SEQ ID NO: 508034 - DNA, 16 bp, R. norvegicus
gctcctcctgcaccag

SEQ ID NO: 508035 - DNA, 16 bp, R. norvegicus
gctcctcctgccccat

SEQ ID NO: 508036 - DNA, 16 bp, R. norvegicus
gctcctcctgctccat

SEQ ID NO: 508037 - DNA, 16 bp, R. norvegicus
gctcctctgtcctggg

SEQ ID NO: 508038 - DNA, 16 bp, R. norvegicus
gctcctgagacacaca

SEQ ID NO: 508039 - DNA, 16 bp, R. norvegicus
gctcctgagattttct

SEQ ID NO: 508040 - DNA, 16 bp, R. norvegicus
gctcctgcagagggcc

SEQ ID NO: 508041 - DNA, 16 bp, R. norvegicus
gctcctgccctgatga

SEQ ID NO: 508042 - DNA, 16 bp, R. norvegicus
gctcctgcctccaggc

SEQ ID NO: 508043 - DNA, 16 bp, R. norvegicus
gctcctgccttcaagt

SEQ ID NO: 508044 - DNA, 19 bp, R. norvegicus
gctcctgctgctgctgctc

SEQ ID NO: 508045 - DNA, 16 bp, R. norvegicus
gctcctggaccctccc

SEQ ID NO: 508046 - DNA, 16 bp, R. norvegicus
gctcctggaggccaga

SEQ ID NO: 508047 - DNA, 16 bp, R. norvegicus
gctcctggagtctgtg

SEQ ID NO: 508048 - DNA, 16 bp, R. norvegicus
gctcctggattggcag

SEQ ID NO: 508049 - DNA, 16 bp, R. norvegicus
gctcctggcagctggc

SEQ ID NO: 508050 - DNA, 16 bp, R. norvegicus
gctcctggccatgacc

SEQ ID NO: 508051 - DNA, 16 bp, R. norvegicus
gctcctggcttccttc

SEQ ID NO: 508052 - DNA, 16 bp, R. norvegicus
gctcctgggaggcaga

SEQ ID NO: 508053 - DNA, 17 bp, R. norvegicus
gctcctgggccctcctc

SEQ ID NO: 508054 - DNA, 16 bp, R. norvegicus
gctcctggtgactgac

SEQ ID NO: 508055 - DNA, 16 bp, R. norvegicus
gctcctgtcagccagc

SEQ ID NO: 508056 - DNA, 16 bp, R. norvegicus
gctcctgtctacctgc

SEQ ID NO: 508057 - DNA, 16 bp, R. norvegicus
gctcctgtgtccacca

SEQ ID NO: 508058 - DNA, 16 bp, R. norvegicus
gctccttcagtgcttt

SEQ ID NO: 508059 - DNA, 16 bp, R. norvegicus
gctccttccctgactt

SEQ ID NO: 508060 - DNA, 16 bp, R. norvegicus
gctccttcctctctga

SEQ ID NO: 508061 - DNA, 16 bp, R. norvegicus
gctccttctccagcac

SEQ ID NO: 508062 - DNA, 16 bp, R. norvegicus
gctccttctccagcat

SEQ ID NO: 508063 - DNA, 16 bp, R. norvegicus
gctccttctgggagcc

SEQ ID NO: 508064 - DNA, 16 bp, R. norvegicus
gctccttctgtgtctg

SEQ ID NO: 508065 - DNA, 16 bp, R. norvegicus
gctcctttgtcaagga

SEQ ID NO: 508066 - DNA, 16 bp, R. norvegicus
gctcgcaaccatctgt

SEQ ID NO: 508067 - DNA, 16 bp, R. norvegicus
gctcgcattgccaagc

SEQ ID NO: 508068 - DNA, 16 bp, R. norvegicus
gctcgctcagcctgct

SEQ ID NO: 508069 - DNA, 16 bp, R. norvegicus
gctctaagatcagcaa

SEQ ID NO: 508070 - DNA, 16 bp, R. norvegicus
gctctaccactgtgcc

SEQ ID NO: 508071 - DNA, 16 bp, R. norvegicus
gctctacctctgagcc

SEQ ID NO: 508072 - DNA, 16 bp, R. norvegicus
gctctactctgactag

SEQ ID NO: 508073 - DNA, 16 bp, R. norvegicus
gctctagaagaaaagg

SEQ ID NO: 508074 - DNA, 16 bp, R. norvegicus
gctctcaatcactgag

SEQ ID NO: 508075 - DNA, 16 bp, R. norvegicus
gctctcagccactgct

SEQ ID NO: 508076 - DNA, 16 bp, R. norvegicus
gctctcatctcatcac

SEQ ID NO: 508077 - DNA, 16 bp, R. norvegicus
gctctcccacctgcca

SEQ ID NO: 508078 - DNA, 16 bp, R. norvegicus
gctctcccagaggaca

SEQ ID NO: 508079 - DNA, 16 bp, R. norvegicus
gctctcccttctcaga

SEQ ID NO: 508080 - DNA, 16 bp, R. norvegicus
gctctcctctcctctg

SEQ ID NO: 508081 - DNA, 16 bp, R. norvegicus
gctctcctgcctgctg

SEQ ID NO: 508082 - DNA, 16 bp, R. norvegicus
gctctcctggaattca

SEQ ID NO: 508083 - DNA, 16 bp, R. norvegicus
gctctccttcctggag

SEQ ID NO: 508084 - DNA, 16 bp, R. norvegicus
gctctcgctcttgctc

SEQ ID NO: 508085 - DNA, 16 bp, R. norvegicus
gctctctaatactgct

SEQ ID NO: 508086 - DNA, 16 bp, R. norvegicus
gctctctcaatgaact

SEQ ID NO: 508087 - DNA, 16 bp, R. norvegicus
gctctctcagaagaag

SEQ ID NO: 508088 - DNA, 16 bp, R. norvegicus
gctctctctctcacac

SEQ ID NO: 508089 - DNA, 16 bp, R. norvegicus
gctctctgctgagaga

SEQ ID NO: 508090 - DNA, 16 bp, R. norvegicus
gctctctggaggcaga

SEQ ID NO: 508091 - DNA, 16 bp, R. norvegicus
gctctctggctccctg

SEQ ID NO: 508092 - DNA, 16 bp, R. norvegicus
gctctctggctctctg

SEQ ID NO: 508093 - DNA, 16 bp, R. norvegicus
gctctcttcatggtgc

SEQ ID NO: 508094 - DNA, 16 bp, R. norvegicus
gctctcttccccacag

SEQ ID NO: 508095 - DNA, 16 bp, R. norvegicus
gctctcttgccctctt

SEQ ID NO: 508096 - DNA, 16 bp, R. norvegicus
gctctcttggaactca

SEQ ID NO: 508097 - DNA, 16 bp, R. norvegicus
gctctctttgcctgct

SEQ ID NO: 508098 - DNA, 16 bp, R. norvegicus
gctctgaaaaaaagga

SEQ ID NO: 508099 - DNA, 16 bp, R. norvegicus
gctctgaaaagaaaaa

SEQ ID NO: 508100 - DNA, 16 bp, R. norvegicus
gctctgaaacacccag

SEQ ID NO: 508101 - DNA, 16 bp, R. norvegicus
gctctgaaccccactt

SEQ ID NO: 508102 - DNA, 16 bp, R. norvegicus
gctctgaaccccatgt

SEQ ID NO: 508103 - DNA, 16 bp, R. norvegicus
gctctgaagtctttga

SEQ ID NO: 508104 - DNA, 16 bp, R. norvegicus
gctctgaataaactct

SEQ ID NO: 508105 - DNA, 16 bp, R. norvegicus
gctctgacacactcag

SEQ ID NO: 508106 - DNA, 16 bp, R. norvegicus
gctctgactgtcctgg

SEQ ID NO: 508107 - DNA, 16 bp, R. norvegicus
gctctgagtgcctaca

SEQ ID NO: 508108 - DNA, 16 bp, R. norvegicus
gctctgagttcaaggc

SEQ ID NO: 508109 - DNA, 16 bp, R. norvegicus
gctctgatgccttctt

SEQ ID NO: 508110 - DNA, 16 bp, R. norvegicus
gctctgcagcctcagc

SEQ ID NO: 508111 - DNA, 16 bp, R. norvegicus
gctctgcagcctccgg

SEQ ID NO: 508112 - DNA, 16 bp, R. norvegicus
gctctgcaggctcagg

SEQ ID NO: 508113 - DNA, 16 bp, R. norvegicus
gctctgcatcccattt

SEQ ID NO: 508114 - DNA, 16 bp, R. norvegicus
gctctgccagagcctt

SEQ ID NO: 508115 - DNA, 16 bp, R. norvegicus
gctctgccagagctgg

SEQ ID NO: 508116 - DNA, 16 bp, R. norvegicus
gctctgcccagggagt

SEQ ID NO: 508117 - DNA, 18 bp, R. norvegicus
gctctgcctctgcctctg

SEQ ID NO: 508118 - DNA, 16 bp, R. norvegicus
gctctgctactgagct

SEQ ID NO: 508119 - DNA, 16 bp, R. norvegicus
gctctgctgcagatcg

SEQ ID NO: 508120 - DNA, 16 bp, R. norvegicus
gctctgctgcttgctg

SEQ ID NO: 508121 - DNA, 16 bp, R. norvegicus
gctctgctttcaggtg

SEQ ID NO: 508122 - DNA, 16 bp, R. norvegicus
gctctgctttcattgt

SEQ ID NO: 508123 - DNA, 16 bp, R. norvegicus
gctctggctttcctgg

SEQ ID NO: 508124 - DNA, 16 bp, R. norvegicus
gctctgggaaaaaaaa

SEQ ID NO: 508125 - DNA, 16 bp, R. norvegicus
gctctgggcagagggt

SEQ ID NO: 508126 - DNA, 16 bp, R. norvegicus
gctctggggagctggg

SEQ ID NO: 508127 - DNA, 16 bp, R. norvegicus
gctctgggtcctggga

SEQ ID NO: 508128 - DNA, 16 bp, R. norvegicus
gctctgggtgtcctgg

SEQ ID NO: 508129 - DNA, 16 bp, R. norvegicus
gctctggtggggtttg

SEQ ID NO: 508130 - DNA, 16 bp, R. norvegicus
gctctgtaccaggctg

SEQ ID NO: 508131 - DNA, 16 bp, R. norvegicus
gctctgtcagagcctg

SEQ ID NO: 508132 - DNA, 16 bp, R. norvegicus
gctctgtctgagctga

SEQ ID NO: 508133 - DNA, 16 bp, R. norvegicus
gctctgtgctcctatg

SEQ ID NO: 508134 - DNA, 16 bp, R. norvegicus
gctctgtggttggtgg

SEQ ID NO: 508135 - DNA, 16 bp, R. norvegicus
gctctgtgtcatggag

SEQ ID NO: 508136 - DNA, 16 bp, R. norvegicus
gctctgtttggtgcag

SEQ ID NO: 508137 - DNA, 19 bp, R. norvegicus
gctcttaaccactgagcca

SEQ ID NO: 508138 - DNA, 16 bp, R. norvegicus
gctcttacacacacac

SEQ ID NO: 508139 - DNA, 16 bp, R. norvegicus
gctcttatctgctgag

SEQ ID NO: 508140 - DNA, 16 bp, R. norvegicus
gctcttccaaaggttc

SEQ ID NO: 508141 - DNA, 16 bp, R. norvegicus
gctcttccagaagttc

SEQ ID NO: 508142 - DNA, 16 bp, R. norvegicus
gctcttccagtggacc

SEQ ID NO: 508143 - DNA, 31 bp, R. norvegicus
gctcttccagttctttctctgattccttcaa

SEQ ID NO: 508144 - DNA, 16 bp, R. norvegicus
gctcttcccgaggtcc

SEQ ID NO: 508145 - DNA, 16 bp, R. norvegicus
gctcttcctcattttc

SEQ ID NO: 508146 - DNA, 16 bp, R. norvegicus
gctcttcctgaagacc

SEQ ID NO: 508147 - DNA, 16 bp, R. norvegicus
gctcttctaaaggacc

SEQ ID NO: 508148 - DNA, 16 bp, R. norvegicus
gctcttctacaggacc

SEQ ID NO: 508149 - DNA, 16 bp, R. norvegicus
gctcttctagtccttt

SEQ ID NO: 508150 - DNA, 16 bp, R. norvegicus
gctcttctttctccac

SEQ ID NO: 508151 - DNA, 16 bp, R. norvegicus
gctcttgcaaaggatc

SEQ ID NO: 508152 - DNA, 16 bp, R. norvegicus
gctcttgcagaagatt

SEQ ID NO: 508153 - DNA, 16 bp, R. norvegicus
gctcttgcagaggact

SEQ ID NO: 508154 - DNA, 16 bp, R. norvegicus
gctcttgcagagggct

SEQ ID NO: 508155 - DNA, 16 bp, R. norvegicus
gctcttgtcggcctgc

SEQ ID NO: 508156 - DNA, 16 bp, R. norvegicus
gctctttaaaaaaaaa

SEQ ID NO: 508157 - DNA, 16 bp, R. norvegicus
gctctttcaaattcat

SEQ ID NO: 508158 - DNA, 16 bp, R. norvegicus
gctctttcagaggaca

SEQ ID NO: 508159 - DNA, 16 bp, R. norvegicus
gctctttcagaggact

SEQ ID NO: 508160 - DNA, 16 bp, R. norvegicus
gctctttccatcttct

SEQ ID NO: 508161 - DNA, 16 bp, R. norvegicus
gctctttgagttcttt

SEQ ID NO: 508162 - DNA, 16 bp, R. norvegicus
gctcttttccctctgt

SEQ ID NO: 508163 - DNA, 16 bp, R. norvegicus
gctcttttgtgactgg

SEQ ID NO: 508164 - DNA, 16 bp, R. norvegicus
gctgaaagaaaacaga

SEQ ID NO: 508165 - DNA, 16 bp, R. norvegicus
gctgaaagaaaccctt

SEQ ID NO: 508166 - DNA, 16 bp, R. norvegicus
gctgaaagccaaggct

SEQ ID NO: 508167 - DNA, 16 bp, R. norvegicus
gctgaaatcaatgaag

SEQ ID NO: 508168 - DNA, 16 bp, R. norvegicus
gctgaaattaataaaa

SEQ ID NO: 508169 - DNA, 16 bp, R. norvegicus
gctgaagaaggagctg

SEQ ID NO: 508170 - DNA, 16 bp, R. norvegicus
gctgaagaatattgaa

SEQ ID NO: 508171 - DNA, 16 bp, R. norvegicus
gctgaagacctgtagg

SEQ ID NO: 508172 - DNA, 16 bp, R. norvegicus
gctgaagacttggcct

SEQ ID NO: 508173 - DNA, 16 bp, R. norvegicus
gctgaagagaaggctc

SEQ ID NO: 508174 - DNA, 16 bp, R. norvegicus
gctgaagaggagggtg

SEQ ID NO: 508175 - DNA, 16 bp, R. norvegicus
gctgaagaggcagagg

SEQ ID NO: 508176 - DNA, 16 bp, R. norvegicus
gctgaagatggccttg

SEQ ID NO: 508177 - DNA, 16 bp, R. norvegicus
gctgaagatgtttgca

SEQ ID NO: 508178 - DNA, 16 bp, R. norvegicus
gctgaagcagaaagat

SEQ ID NO: 508179 - DNA, 16 bp, R. norvegicus
gctgaagcaggaagat

SEQ ID NO: 508180 - DNA, 16 bp, R. norvegicus
gctgaagcaggagaat

SEQ ID NO: 508181 - DNA, 16 bp, R. norvegicus
gctgaagccatggatc

SEQ ID NO: 508182 - DNA, 17 bp, R. norvegicus
gctgaaggagctgaagg

SEQ ID NO: 508183 - DNA, 16 bp, R. norvegicus
gctgaaggaggcagag

SEQ ID NO: 508184 - DNA, 16 bp, R. norvegicus
gctgaaggagtttgaa

SEQ ID NO: 508185 - DNA, 16 bp, R. norvegicus
gctgaaggcaggtaca

SEQ ID NO: 508186 - DNA, 16 bp, R. norvegicus
gctgaaggggctgaag

SEQ ID NO: 508187 - DNA, 16 bp, R. norvegicus
gctgacacactctctg

SEQ ID NO: 508188 - DNA, 16 bp, R. norvegicus
gctgacaggagcccaa

SEQ ID NO: 508189 - DNA, 16 bp, R. norvegicus
gctgacaggatccaga

SEQ ID NO: 508190 - DNA, 17 bp, R. norvegicus
gctgacatatggtcttt

SEQ ID NO: 508191 - DNA, 16 bp, R. norvegicus
gctgacattgaactca

SEQ ID NO: 508192 - DNA, 16 bp, R. norvegicus
gctgaccactctggtt

SEQ ID NO: 508193 - DNA, 16 bp, R. norvegicus
gctgacccagaactca

SEQ ID NO: 508194 - DNA, 16 bp, R. norvegicus
gctgacctgagtttga

SEQ ID NO: 508195 - DNA, 16 bp, R. norvegicus
gctgacctggaaccca

SEQ ID NO: 508196 - DNA, 16 bp, R. norvegicus
gctgacctggagctca

SEQ ID NO: 508197 - DNA, 16 bp, R. norvegicus
gctgactgaaacagat

SEQ ID NO: 508198 - DNA, 16 bp, R. norvegicus
gctgacttagaactca

SEQ ID NO: 508199 - DNA, 16 bp, R. norvegicus
gctgagaaacaccaaa

SEQ ID NO: 508200 - DNA, 16 bp, R. norvegicus
gctgagaaacaccgaa

SEQ ID NO: 508201 - DNA, 16 bp, R. norvegicus
gctgagaaagcagttg

SEQ ID NO: 508202 - DNA, 16 bp, R. norvegicus
gctgagaaatatcaaa

SEQ ID NO: 508203 - DNA, 16 bp, R. norvegicus
gctgagaagctgctgg

SEQ ID NO: 508204 - DNA, 16 bp, R. norvegicus
gctgagaaggtcctcc

SEQ ID NO: 508205 - DNA, 16 bp, R. norvegicus
gctgagacagaagaat

SEQ ID NO: 508206 - DNA, 16 bp, R. norvegicus
gctgagacaggaggat

SEQ ID NO: 508207 - DNA, 16 bp, R. norvegicus
gctgagactgctggtc

SEQ ID NO: 508208 - DNA, 33 bp, R. norvegicus
gctgagactgtcaatcagattgtagaaagaact

SEQ ID NO: 508209 - DNA, 16 bp, R. norvegicus
gctgagagacactggg

SEQ ID NO: 508210 - DNA, 16 bp, R. norvegicus
gctgagagggaggctc

SEQ ID NO: 508211 - DNA, 29 bp, R. norvegicus
gctgagagttagtataagttacagagaaa

SEQ ID NO: 508212 - DNA, 16 bp, R. norvegicus
gctgagattctctctt

SEQ ID NO: 508213 - DNA, 16 bp, R. norvegicus
gctgagcaaaccatgg

SEQ ID NO: 508214 - DNA, 16 bp, R. norvegicus
gctgagcacagtggtg

SEQ ID NO: 508215 - DNA, 16 bp, R. norvegicus
gctgagcaccagcatc

SEQ ID NO: 508216 - DNA, 16 bp, R. norvegicus
gctgagccacctctgc

SEQ ID NO: 508217 - DNA, 16 bp, R. norvegicus
gctgagccaggaggat

SEQ ID NO: 508218 - DNA, 16 bp, R. norvegicus
gctgagccatgtctcc

SEQ ID NO: 508219 - DNA, 16 bp, R. norvegicus
gctgagccctctcccc

SEQ ID NO: 508220 - DNA, 16 bp, R. norvegicus
gctgagccctctctcc

SEQ ID NO: 508221 - DNA, 16 bp, R. norvegicus
gctgagcctgagcctg

SEQ ID NO: 508222 - DNA, 16 bp, R. norvegicus
gctgagccttctcttc

SEQ ID NO: 508223 - DNA, 16 bp, R. norvegicus
gctgagctgcctggaa

SEQ ID NO: 508224 - DNA, 16 bp, R. norvegicus
gctgagctgtctctcc

SEQ ID NO: 508225 - DNA, 16 bp, R. norvegicus
gctgagctgtctctct

SEQ ID NO: 508226 - DNA, 16 bp, R. norvegicus
gctgaggaacattgaa

SEQ ID NO: 508227 - DNA, 16 bp, R. norvegicus
gctgaggaagaaatta

SEQ ID NO: 508228 - DNA, 16 bp, R. norvegicus
gctgaggaccaaacct

SEQ ID NO: 508229 - DNA, 16 bp, R. norvegicus
gctgaggagaagggca

SEQ ID NO: 508230 - DNA, 16 bp, R. norvegicus
gctgaggaggaaggag

SEQ ID NO: 508231 - DNA, 16 bp, R. norvegicus
gctgaggaggagggca

SEQ ID NO: 508232 - DNA, 16 bp, R. norvegicus
gctgaggaggagggcc

SEQ ID NO: 508233 - DNA, 16 bp, R. norvegicus
gctgaggatgcccttg

SEQ ID NO: 508234 - DNA, 16 bp, R. norvegicus
gctgaggatggccttg

SEQ ID NO: 508235 - DNA, 16 bp, R. norvegicus
gctgaggatgtggctc

SEQ ID NO: 508236 - DNA, 16 bp, R. norvegicus
gctgaggcaggagaag

SEQ ID NO: 508237 - DNA, 16 bp, R. norvegicus
gctgaggcaggaggac

SEQ ID NO: 508238 - DNA, 16 bp, R. norvegicus
gctgaggcaggaggat

SEQ ID NO: 508239 - DNA, 16 bp, R. norvegicus
gctgaggcaggaggct

SEQ ID NO: 508240 - DNA, 16 bp, R. norvegicus
gctgaggcagggtctc

SEQ ID NO: 508241 - DNA, 17 bp, R. norvegicus
gctgaggcatcccttga

SEQ ID NO: 508242 - DNA, 16 bp, R. norvegicus
gctgaggccagacaag

SEQ ID NO: 508243 - DNA, 16 bp, R. norvegicus
gctgaggctgagaaag

SEQ ID NO: 508244 - DNA, 16 bp, R. norvegicus
gctgaggctgagcctg

SEQ ID NO: 508245 - DNA, 16 bp, R. norvegicus
gctgaggctgaggctg

SEQ ID NO: 508246 - DNA, 16 bp, R. norvegicus
gctgaggctggaggat

SEQ ID NO: 508247 - DNA, 16 bp, R. norvegicus
gctgaggctggggctg

SEQ ID NO: 508248 - DNA, 16 bp, R. norvegicus
gctgaggcttggcacc

SEQ ID NO: 508249 - DNA, 16 bp, R. norvegicus
gctgagggcgtggctc

SEQ ID NO: 508250 - DNA, 16 bp, R. norvegicus
gctgagggtgctgttg

SEQ ID NO: 508251 - DNA, 16 bp, R. norvegicus
gctgagggttggggat

SEQ ID NO: 508252 - DNA, 16 bp, R. norvegicus
gctgaggtggctgagg

SEQ ID NO: 508253 - DNA, 16 bp, R. norvegicus
gctgagttcaatccct

SEQ ID NO: 508254 - DNA, 16 bp, R. norvegicus
gctgagttcattttga

SEQ ID NO: 508255 - DNA, 17 bp, R. norvegicus
gctgatacagatgagga

SEQ ID NO: 508256 - DNA, 16 bp, R. norvegicus
gctgatatctggtctt

SEQ ID NO: 508257 - DNA, 16 bp, R. norvegicus
gctgatgaggatgagg

SEQ ID NO: 508258 - DNA, 16 bp, R. norvegicus
gctgatgccaagaaac

SEQ ID NO: 508259 - DNA, 16 bp, R. norvegicus
gctgatgccaagaaga

SEQ ID NO: 508260 - DNA, 16 bp, R. norvegicus
gctgatgccaagaagc

SEQ ID NO: 508261 - DNA, 16 bp, R. norvegicus
gctgatgccaagcagt

SEQ ID NO: 508262 - DNA, 16 bp, R. norvegicus
gctgatgctgaggcca

SEQ ID NO: 508263 - DNA, 16 bp, R. norvegicus
gctgatggtgatggtg

SEQ ID NO: 508264 - DNA, 16 bp, R. norvegicus
gctgatggtggtggtg

SEQ ID NO: 508265 - DNA, 16 bp, R. norvegicus
gctgatgtcatacaga

SEQ ID NO: 508266 - DNA, 16 bp, R. norvegicus
gctgatgtggaggcca

SEQ ID NO: 508267 - DNA, 16 bp, R. norvegicus
gctgatgttaagattc

SEQ ID NO: 508268 - DNA, 16 bp, R. norvegicus
gctgcaagggaaaagg

SEQ ID NO: 508269 - DNA, 16 bp, R. norvegicus
gctgcaagggaggctg

SEQ ID NO: 508270 - DNA, 16 bp, R. norvegicus
gctgcaatgtgtgctt

SEQ ID NO: 508271 - DNA, 16 bp, R. norvegicus
gctgcacagagaagcc

SEQ ID NO: 508272 - DNA, 16 bp, R. norvegicus
gctgcaccttcaccag

SEQ ID NO: 508273 - DNA, 16 bp, R. norvegicus
gctgcagagagcccga

SEQ ID NO: 508274 - DNA, 16 bp, R. norvegicus
gctgcagaggccatgg

SEQ ID NO: 508275 - DNA, 16 bp, R. norvegicus
gctgcagcaggtgagg

SEQ ID NO: 508276 - DNA, 16 bp, R. norvegicus
gctgcagccagcaagg

SEQ ID NO: 508277 - DNA, 16 bp, R. norvegicus
gctgcagctgcagaga

SEQ ID NO: 508278 - DNA, 16 bp, R. norvegicus
gctgcagctgcatatg

SEQ ID NO: 508279 - DNA, 16 bp, R. norvegicus
gctgcaggacagactg

SEQ ID NO: 508280 - DNA, 16 bp, R. norvegicus
gctgcaggagaaagct

SEQ ID NO: 508281 - DNA, 16 bp, R. norvegicus
gctgcaggagagaaag

SEQ ID NO: 508282 - DNA, 16 bp, R. norvegicus
gctgcaggaggaagcc

SEQ ID NO: 508283 - DNA, 16 bp, R. norvegicus
gctgcaggcttggtgg

SEQ ID NO: 508284 - DNA, 16 bp, R. norvegicus
gctgcaggtgctgctt

SEQ ID NO: 508285 - DNA, 16 bp, R. norvegicus
gctgcagtcctgccag

SEQ ID NO: 508286 - DNA, 16 bp, R. norvegicus
gctgccaaggaagggc

SEQ ID NO: 508287 - DNA, 16 bp, R. norvegicus
gctgccacagcctctg

SEQ ID NO: 508288 - DNA, 17 bp, R. norvegicus
gctgccacagcggagag

SEQ ID NO: 508289 - DNA, 16 bp, R. norvegicus
gctgccacctggtggc

SEQ ID NO: 508290 - DNA, 16 bp, R. norvegicus
gctgccactccagggc

SEQ ID NO: 508291 - DNA, 16 bp, R. norvegicus
gctgccactgggagcc

SEQ ID NO: 508292 - DNA, 16 bp, R. norvegicus
gctgccagctcagaga

SEQ ID NO: 508293 - DNA, 16 bp, R. norvegicus
gctgccatgcttcccc

SEQ ID NO: 508294 - DNA, 16 bp, R. norvegicus
gctgccatgtctggct

SEQ ID NO: 508295 - DNA, 16 bp, R. norvegicus
gctgccatgttccctg

SEQ ID NO: 508296 - DNA, 16 bp, R. norvegicus
gctgcccaactgtatg

SEQ ID NO: 508297 - DNA, 16 bp, R. norvegicus
gctgcccaagtacctg

SEQ ID NO: 508298 - DNA, 16 bp, R. norvegicus
gctgcccacccctgcc

SEQ ID NO: 508299 - DNA, 16 bp, R. norvegicus
gctgcccacctcctgc

SEQ ID NO: 508300 - DNA, 16 bp, R. norvegicus
gctgcccactgcctgc

SEQ ID NO: 508301 - DNA, 16 bp, R. norvegicus
gctgcccattctcttc

SEQ ID NO: 508302 - DNA, 16 bp, R. norvegicus
gctgcccctgcccctg

SEQ ID NO: 508303 - DNA, 16 bp, R. norvegicus
gctgcccctgctgccc

SEQ ID NO: 508304 - DNA, 16 bp, R. norvegicus
gctgcccctgtgtgct

SEQ ID NO: 508305 - DNA, 16 bp, R. norvegicus
gctgccctcacaaaga

SEQ ID NO: 508306 - DNA, 16 bp, R. norvegicus
gctgccctcgggctct

SEQ ID NO: 508307 - DNA, 16 bp, R. norvegicus
gctgccctctcctggc

SEQ ID NO: 508308 - DNA, 16 bp, R. norvegicus
gctgccctctgaaagg

SEQ ID NO: 508309 - DNA, 16 bp, R. norvegicus
gctgccctctgacctt

SEQ ID NO: 508310 - DNA, 16 bp, R. norvegicus
gctgccctctggcctc

SEQ ID NO: 508311 - DNA, 16 bp, R. norvegicus
gctgccctgggagacg

SEQ ID NO: 508312 - DNA, 16 bp, R. norvegicus
gctgccctgtctggcc

SEQ ID NO: 508313 - DNA, 16 bp, R. norvegicus
gctgcccttgaacttg

SEQ ID NO: 508314 - DNA, 16 bp, R. norvegicus
gctgccctttgacctc

SEQ ID NO: 508315 - DNA, 16 bp, R. norvegicus
gctgccgaggatgtgg

SEQ ID NO: 508316 - DNA, 16 bp, R. norvegicus
gctgccgccgcggaga

SEQ ID NO: 508317 - DNA, 16 bp, R. norvegicus
gctgccgctgccgctg

SEQ ID NO: 508318 - DNA, 16 bp, R. norvegicus
gctgccgctgctgctg

SEQ ID NO: 508319 - DNA, 16 bp, R. norvegicus
gctgcctagttggtgg

SEQ ID NO: 508320 - DNA, 16 bp, R. norvegicus
gctgcctcaggagtgc

SEQ ID NO: 508321 - DNA, 17 bp, R. norvegicus
gctgcctctgcagagag

SEQ ID NO: 508322 - DNA, 16 bp, R. norvegicus
gctgcctctgctcaca

SEQ ID NO: 508323 - DNA, 16 bp, R. norvegicus
gctgcctctgctgacc

SEQ ID NO: 508324 - DNA, 16 bp, R. norvegicus
gctgcctcttcctcta

SEQ ID NO: 508325 - DNA, 16 bp, R. norvegicus
gctgcctgaaagccag

SEQ ID NO: 508326 - DNA, 16 bp, R. norvegicus
gctgcctgcagatctg

SEQ ID NO: 508327 - DNA, 16 bp, R. norvegicus
gctgcctgcctgctgc

SEQ ID NO: 508328 - DNA, 16 bp, R. norvegicus
gctgcctgcctttgga

SEQ ID NO: 508329 - DNA, 16 bp, R. norvegicus
gctgcctgctgatcca

SEQ ID NO: 508330 - DNA, 16 bp, R. norvegicus
gctgcctggaaggcag

SEQ ID NO: 508331 - DNA, 16 bp, R. norvegicus
gctgcctggctggtgg

SEQ ID NO: 508332 - DNA, 16 bp, R. norvegicus
gctgcctgggtggttg

SEQ ID NO: 508333 - DNA, 16 bp, R. norvegicus
gctgcggctgcggctg

SEQ ID NO: 508334 - DNA, 16 bp, R. norvegicus
gctgcggctgctgctg

SEQ ID NO: 508335 - DNA, 17 bp, R. norvegicus
gctgctaatctgtctaa

SEQ ID NO: 508336 - DNA, 16 bp, R. norvegicus
gctgctactgctgcta

SEQ ID NO: 508337 - DNA, 16 bp, R. norvegicus
gctgctagcattcact

SEQ ID NO: 508338 - DNA, 16 bp, R. norvegicus
gctgctccctgggcca

SEQ ID NO: 508339 - DNA, 16 bp, R. norvegicus
gctgctcctgctcctc

SEQ ID NO: 508340 - DNA, 16 bp, R. norvegicus
gctgctcctgctgctc

SEQ ID NO: 508341 - DNA, 16 bp, R. norvegicus
gctgctcctgctgctg

SEQ ID NO: 508342 - DNA, 16 bp, R. norvegicus
gctgctcctggaccct

SEQ ID NO: 508343 - DNA, 16 bp, R. norvegicus
gctgctcctgggtttg

SEQ ID NO: 508344 - DNA, 16 bp, R. norvegicus
gctgctcctgtgggcc

SEQ ID NO: 508345 - DNA, 16 bp, R. norvegicus
gctgctcctgtgtgct

SEQ ID NO: 508346 - DNA, 16 bp, R. norvegicus
gctgctctccagagga

SEQ ID NO: 508347 - DNA, 16 bp, R. norvegicus
gctgctctccatgacc

SEQ ID NO: 508348 - DNA, 16 bp, R. norvegicus
gctgctctcccagaag

SEQ ID NO: 508349 - DNA, 16 bp, R. norvegicus
gctgctctctgacctc

SEQ ID NO: 508350 - DNA, 16 bp, R. norvegicus
gctgctcttcatgatc

SEQ ID NO: 508351 - DNA, 16 bp, R. norvegicus
gctgctcttccagaga

SEQ ID NO: 508352 - DNA, 16 bp, R. norvegicus
gctgctcttccagagg

SEQ ID NO: 508353 - DNA, 16 bp, R. norvegicus
gctgctcttccaggag

SEQ ID NO: 508354 - DNA, 16 bp, R. norvegicus
gctgctcttccagggg

SEQ ID NO: 508355 - DNA, 16 bp, R. norvegicus
gctgctcttcctcctc

SEQ ID NO: 508356 - DNA, 16 bp, R. norvegicus
gctgctcttcctgaag

SEQ ID NO: 508357 - DNA, 16 bp, R. norvegicus
gctgctcttgccccct

SEQ ID NO: 508358 - DNA, 16 bp, R. norvegicus
gctgctcttggcccct

SEQ ID NO: 508359 - DNA, 16 bp, R. norvegicus
gctgctgaaccctgtg

SEQ ID NO: 508360 - DNA, 16 bp, R. norvegicus
gctgctgacctctgtg

SEQ ID NO: 508361 - DNA, 16 bp, R. norvegicus
gctgctgcagctgctg

SEQ ID NO: 508362 - DNA, 16 bp, R. norvegicus
gctgctgcaggaagtc

SEQ ID NO: 508363 - DNA, 16 bp, R. norvegicus
gctgctgcaggaggtg

SEQ ID NO: 508364 - DNA, 16 bp, R. norvegicus
gctgctgcagggccat

SEQ ID NO: 508365 - DNA, 16 bp, R. norvegicus
gctgctgcagtctctg

SEQ ID NO: 508366 - DNA, 16 bp, R. norvegicus
gctgctgccagctctg

SEQ ID NO: 508367 - DNA, 16 bp, R. norvegicus
gctgctgccgctgcag

SEQ ID NO: 508368 - DNA, 16 bp, R. norvegicus
gctgctgccgctgctg

SEQ ID NO: 508369 - DNA, 16 bp, R. norvegicus
gctgctgcctggatct

SEQ ID NO: 508370 - DNA, 16 bp, R. norvegicus
gctgctgcctttgctg

SEQ ID NO: 508371 - DNA, 16 bp, R. norvegicus
gctgctgcctttggat

SEQ ID NO: 508372 - DNA, 19 bp, R. norvegicus
gctgctgctactgctgctg

SEQ ID NO: 508373 - DNA, 16 bp, R. norvegicus
gctgctgctccccctg

SEQ ID NO: 508374 - DNA, 16 bp, R. norvegicus
gctgctgctctgctgc

SEQ ID NO: 508375 - DNA, 16 bp, R. norvegicus
gctgctgctcttgcag

SEQ ID NO: 508376 - DNA, 16 bp, R. norvegicus
gctgctgctcttgctg

SEQ ID NO: 508377 - DNA, 16 bp, R. norvegicus
gctgctgctgacctgt

SEQ ID NO: 508378 - DNA, 16 bp, R. norvegicus
gctgctgctgatgttg

SEQ ID NO: 508379 - DNA, 16 bp, R. norvegicus
gctgctgctgattcct

SEQ ID NO: 508380 - DNA, 16 bp, R. norvegicus
gctgctgctgcagctg

SEQ ID NO: 508381 - DNA, 16 bp, R. norvegicus
gctgctgctgcggctg

SEQ ID NO: 508382 - DNA, 16 bp, R. norvegicus
gctgctgctgctactt

SEQ ID NO: 508383 - DNA, 16 bp, R. norvegicus
gctgctgctgctcctc

SEQ ID NO: 508384 - DNA, 16 bp, R. norvegicus
gctgctgctgctctcc

SEQ ID NO: 508385 - DNA, 16 bp, R. norvegicus
gctgctgctgctctct

SEQ ID NO: 508386 - DNA, 16 bp, R. norvegicus
gctgctgctgctctgg

SEQ ID NO: 508387 - DNA, 16 bp, R. norvegicus
gctgctgctgctcttc

SEQ ID NO: 508388 - DNA, 16 bp, R. norvegicus
gctgctgctgctgagt

SEQ ID NO: 508389 - DNA, 16 bp, R. norvegicus
gctgctgctgctgatg

SEQ ID NO: 508390 - DNA, 16 bp, R. norvegicus
gctgctgctgctgcac

SEQ ID NO: 508391 - DNA, 16 bp, R. norvegicus
gctgctgctgctgcct

SEQ ID NO: 508392 - DNA, 16 bp, R. norvegicus
gctgctgctgctgctt

SEQ ID NO: 508393 - DNA, 16 bp, R. norvegicus
gctgctgctgctggaa

SEQ ID NO: 508394 - DNA, 16 bp, R. norvegicus
gctgctgctgctggga

SEQ ID NO: 508395 - DNA, 16 bp, R. norvegicus
gctgctgctgctgggt

SEQ ID NO: 508396 - DNA, 16 bp, R. norvegicus
gctgctgctgctggtg

SEQ ID NO: 508397 - DNA, 16 bp, R. norvegicus
gctgctgctgctgtat

SEQ ID NO: 508398 - DNA, 16 bp, R. norvegicus
gctgctgctgctgtca

SEQ ID NO: 508399 - DNA, 16 bp, R. norvegicus
gctgctgctgctgtct

SEQ ID NO: 508400 - DNA, 16 bp, R. norvegicus
gctgctgctgctgtgg

SEQ ID NO: 508401 - DNA, 16 bp, R. norvegicus
gctgctgctgctgttc

SEQ ID NO: 508402 - DNA, 16 bp, R. norvegicus
gctgctgctgcttcct

SEQ ID NO: 508403 - DNA, 16 bp, R. norvegicus
gctgctgctgctttgg

SEQ ID NO: 508404 - DNA, 16 bp, R. norvegicus
gctgctgctgcttttg

SEQ ID NO: 508405 - DNA, 16 bp, R. norvegicus
gctgctgctggccggg

SEQ ID NO: 508406 - DNA, 17 bp, R. norvegicus
gctgctgctggccggga

SEQ ID NO: 508407 - DNA, 16 bp, R. norvegicus
gctgctgctggctgtg

SEQ ID NO: 508408 - DNA, 16 bp, R. norvegicus
gctgctgctgtcactg

SEQ ID NO: 508409 - DNA, 16 bp, R. norvegicus
gctgctgctgtccttg

SEQ ID NO: 508410 - DNA, 16 bp, R. norvegicus
gctgctgctgttactg

SEQ ID NO: 508411 - DNA, 16 bp, R. norvegicus
gctgctgctgttgatg

SEQ ID NO: 508412 - DNA, 21 bp, R. norvegicus
gctgctgctgttgctgctgct

SEQ ID NO: 508413 - DNA, 16 bp, R. norvegicus
gctgctgctgttgctt

SEQ ID NO: 508414 - DNA, 16 bp, R. norvegicus
gctgctgcttctcctc

SEQ ID NO: 508415 - DNA, 16 bp, R. norvegicus
gctgctgcttcttcct

SEQ ID NO: 508416 - DNA, 16 bp, R. norvegicus
gctgctggaattcacc

SEQ ID NO: 508417 - DNA, 16 bp, R. norvegicus
gctgctggctgctggc

SEQ ID NO: 508418 - DNA, 16 bp, R. norvegicus
gctgctggctgctggt

SEQ ID NO: 508419 - DNA, 16 bp, R. norvegicus
gctgctggggaagaaa

SEQ ID NO: 508420 - DNA, 16 bp, R. norvegicus
gctgctgggggaggga

SEQ ID NO: 508421 - DNA, 17 bp, R. norvegicus
gctgctggtgctgctgg

SEQ ID NO: 508422 - DNA, 16 bp, R. norvegicus
gctgctggtggaagac

SEQ ID NO: 508423 - DNA, 16 bp, R. norvegicus
gctgctggtggtgatg

SEQ ID NO: 508424 - DNA, 16 bp, R. norvegicus
gctgctggtgtgtgtg

SEQ ID NO: 508425 - DNA, 16 bp, R. norvegicus
gctgctgtctgcaagc

SEQ ID NO: 508426 - DNA, 16 bp, R. norvegicus
gctgctgtgaacatgg

SEQ ID NO: 508427 - DNA, 16 bp, R. norvegicus
gctgctgtgcaggctg

SEQ ID NO: 508428 - DNA, 16 bp, R. norvegicus
gctgctgtgcctggct

SEQ ID NO: 508429 - DNA, 16 bp, R. norvegicus
gctgctgtgctgctgt

SEQ ID NO: 508430 - DNA, 16 bp, R. norvegicus
gctgctgtggctgctg

SEQ ID NO: 508431 - DNA, 16 bp, R. norvegicus
gctgctgtgggccagg

SEQ ID NO: 508432 - DNA, 16 bp, R. norvegicus
gctgctgtgggccggg

SEQ ID NO: 508433 - DNA, 16 bp, R. norvegicus
gctgctgtgtgtgtgt

SEQ ID NO: 508434 - DNA, 16 bp, R. norvegicus
gctgctgttaacagtt

SEQ ID NO: 508435 - DNA, 16 bp, R. norvegicus
gctgctgttcttgttg

SEQ ID NO: 508436 - DNA, 16 bp, R. norvegicus
gctgctgttgctgctt

SEQ ID NO: 508437 - DNA, 16 bp, R. norvegicus
gctgctgttgttgcta

SEQ ID NO: 508438 - DNA, 16 bp, R. norvegicus
gctgcttaccagcttg

SEQ ID NO: 508439 - DNA, 16 bp, R. norvegicus
gctgcttatgggatgg

SEQ ID NO: 508440 - DNA, 16 bp, R. norvegicus
gctgcttcctctgcct

SEQ ID NO: 508441 - DNA, 16 bp, R. norvegicus
gctgcttctgaggact

SEQ ID NO: 508442 - DNA, 16 bp, R. norvegicus
gctgcttctgctgctg

SEQ ID NO: 508443 - DNA, 16 bp, R. norvegicus
gctgcttgctgccatg

SEQ ID NO: 508444 - DNA, 16 bp, R. norvegicus
gctgcttgctggagaa

SEQ ID NO: 508445 - DNA, 16 bp, R. norvegicus
gctgcttgctgggcct

SEQ ID NO: 508446 - DNA, 16 bp, R. norvegicus
gctgcttgtccagagg

SEQ ID NO: 508447 - DNA, 16 bp, R. norvegicus
gctgctttctaattct

SEQ ID NO: 508448 - DNA, 16 bp, R. norvegicus
gctgctttttgggtct

SEQ ID NO: 508449 - DNA, 16 bp, R. norvegicus
gctggaactacaggca

SEQ ID NO: 508450 - DNA, 16 bp, R. norvegicus
gctggaactgaagcag

SEQ ID NO: 508451 - DNA, 16 bp, R. norvegicus
gctggaagacacaggc

SEQ ID NO: 508452 - DNA, 16 bp, R. norvegicus
gctggaaggagagaac

SEQ ID NO: 508453 - DNA, 16 bp, R. norvegicus
gctggaaggagctgag

SEQ ID NO: 508454 - DNA, 16 bp, R. norvegicus
gctggaaggatggctc

SEQ ID NO: 508455 - DNA, 16 bp, R. norvegicus
gctggaatcctgaaga

SEQ ID NO: 508456 - DNA, 16 bp, R. norvegicus
gctggaatggataact

SEQ ID NO: 508457 - DNA, 16 bp, R. norvegicus
gctggaattagaggtg

SEQ ID NO: 508458 - DNA, 16 bp, R. norvegicus
gctggaattgaaggtg

SEQ ID NO: 508459 - DNA, 16 bp, R. norvegicus
gctggaatttcaggca

SEQ ID NO: 508460 - DNA, 16 bp, R. norvegicus
gctggacaatgccatt

SEQ ID NO: 508461 - DNA, 16 bp, R. norvegicus
gctggacacccagtga

SEQ ID NO: 508462 - DNA, 16 bp, R. norvegicus
gctggacccacagaag

SEQ ID NO: 508463 - DNA, 16 bp, R. norvegicus
gctggaccctccagtg

SEQ ID NO: 508464 - DNA, 16 bp, R. norvegicus
gctggactggagggag

SEQ ID NO: 508465 - DNA, 16 bp, R. norvegicus
gctggacttacaggtg

SEQ ID NO: 508466 - DNA, 16 bp, R. norvegicus
gctggacttcagtact

SEQ ID NO: 508467 - DNA, 16 bp, R. norvegicus
gctggagaaaaggctc

SEQ ID NO: 508468 - DNA, 16 bp, R. norvegicus
gctggagaaacagctc

SEQ ID NO: 508469 - DNA, 16 bp, R. norvegicus
gctggagaagaaactg

SEQ ID NO: 508470 - DNA, 16 bp, R. norvegicus
gctggagaagaagctg

SEQ ID NO: 508471 - DNA, 16 bp, R. norvegicus
gctggagaaggacctg

SEQ ID NO: 508472 - DNA, 16 bp, R. norvegicus
gctggagaaggagatg

SEQ ID NO: 508473 - DNA, 16 bp, R. norvegicus
gctggagaaggagccg

SEQ ID NO: 508474 - DNA, 16 bp, R. norvegicus
gctggagaaggagctt

SEQ ID NO: 508475 - DNA, 16 bp, R. norvegicus
gctggagaaggaggtg

SEQ ID NO: 508476 - DNA, 16 bp, R. norvegicus
gctggagacactgggc

SEQ ID NO: 508477 - DNA, 16 bp, R. norvegicus
gctggagacagggctc

SEQ ID NO: 508478 - DNA, 16 bp, R. norvegicus
gctggagacccagaag

SEQ ID NO: 508479 - DNA, 16 bp, R. norvegicus
gctggagacctggctc

SEQ ID NO: 508480 - DNA, 16 bp, R. norvegicus
gctggagagaagactc

SEQ ID NO: 508481 - DNA, 16 bp, R. norvegicus
gctggagagaaggctc

SEQ ID NO: 508482 - DNA, 16 bp, R. norvegicus
gctggagagaccgctc

SEQ ID NO: 508483 - DNA, 16 bp, R. norvegicus
gctggagagactgctc

SEQ ID NO: 508484 - DNA, 16 bp, R. norvegicus
gctggagagatgattc

SEQ ID NO: 508485 - DNA, 16 bp, R. norvegicus
gctggagagatggtgg

SEQ ID NO: 508486 - DNA, 16 bp, R. norvegicus
gctggagagcaggctc

SEQ ID NO: 508487 - DNA, 18 bp, R. norvegicus
gctggagaggatgcggag

SEQ ID NO: 508488 - DNA, 16 bp, R. norvegicus
gctggagaggcccctc

SEQ ID NO: 508489 - DNA, 16 bp, R. norvegicus
gctggagaggtggaga

SEQ ID NO: 508490 - DNA, 16 bp, R. norvegicus
gctggagagtggctca

SEQ ID NO: 508491 - DNA, 16 bp, R. norvegicus
gctggagatgtggctt

SEQ ID NO: 508492 - DNA, 16 bp, R. norvegicus
gctggagcagaagctg

SEQ ID NO: 508493 - DNA, 16 bp, R. norvegicus
gctggagcagtggctc

SEQ ID NO: 508494 - DNA, 16 bp, R. norvegicus
gctggagccatggctc

SEQ ID NO: 508495 - DNA, 16 bp, R. norvegicus
gctggagccatgggtc

SEQ ID NO: 508496 - DNA, 17 bp, R. norvegicus
gctggagctgctgggtg

SEQ ID NO: 508497 - DNA, 16 bp, R. norvegicus
gctggaggaagatgag

SEQ ID NO: 508498 - DNA, 16 bp, R. norvegicus
gctggaggaagcagag

SEQ ID NO: 508499 - DNA, 16 bp, R. norvegicus
gctggaggaagctaag

SEQ ID NO: 508500 - DNA, 16 bp, R. norvegicus
gctggaggaaggagga

SEQ ID NO: 508501 - DNA, 16 bp, R. norvegicus
gctggaggaagtgtgt

SEQ ID NO: 508502 - DNA, 16 bp, R. norvegicus
gctggaggacatcaag

SEQ ID NO: 508503 - DNA, 16 bp, R. norvegicus
gctggaggacttccag

SEQ ID NO: 508504 - DNA, 16 bp, R. norvegicus
gctggaggagcagaga

SEQ ID NO: 508505 - DNA, 16 bp, R. norvegicus
gctggaggagctgagt

SEQ ID NO: 508506 - DNA, 16 bp, R. norvegicus
gctggaggaggccaga

SEQ ID NO: 508507 - DNA, 16 bp, R. norvegicus
gctggaggagttcaag

SEQ ID NO: 508508 - DNA, 16 bp, R. norvegicus
gctggaggctggggag

SEQ ID NO: 508509 - DNA, 16 bp, R. norvegicus
gctggagtgatagctc

SEQ ID NO: 508510 - DNA, 16 bp, R. norvegicus
gctggagttaaaggtg

SEQ ID NO: 508511 - DNA, 16 bp, R. norvegicus
gctggatcccccagtg

SEQ ID NO: 508512 - DNA, 17 bp, R. norvegicus
gctggatcctcaggcac

SEQ ID NO: 508513 - DNA, 16 bp, R. norvegicus
gctggatctccagaaa

SEQ ID NO: 508514 - DNA, 16 bp, R. norvegicus
gctggatctttgagaa

SEQ ID NO: 508515 - DNA, 16 bp, R. norvegicus
gctggatgatttctct

SEQ ID NO: 508516 - DNA, 16 bp, R. norvegicus
gctggatgtcctgccc

SEQ ID NO: 508517 - DNA, 16 bp, R. norvegicus
gctggcagacatggtg

SEQ ID NO: 508518 - DNA, 16 bp, R. norvegicus
gctggcattaaaggta

SEQ ID NO: 508519 - DNA, 16 bp, R. norvegicus
gctggccaatgagctc

SEQ ID NO: 508520 - DNA, 16 bp, R. norvegicus
gctggccaccaagcct

SEQ ID NO: 508521 - DNA, 16 bp, R. norvegicus
gctggccaggaattca

SEQ ID NO: 508522 - DNA, 16 bp, R. norvegicus
gctggccagggagccc

SEQ ID NO: 508523 - DNA, 16 bp, R. norvegicus
gctggccagtgagcct

SEQ ID NO: 508524 - DNA, 16 bp, R. norvegicus
gctggccagtgagttc

SEQ ID NO: 508525 - DNA, 16 bp, R. norvegicus
gctggccagttggagt

SEQ ID NO: 508526 - DNA, 16 bp, R. norvegicus
gctggccctgagctca

SEQ ID NO: 508527 - DNA, 16 bp, R. norvegicus
gctggccctggtggag

SEQ ID NO: 508528 - DNA, 16 bp, R. norvegicus
gctggccctggtggtg

SEQ ID NO: 508529 - DNA, 16 bp, R. norvegicus
gctggccgaggtgggc

SEQ ID NO: 508530 - DNA, 16 bp, R. norvegicus
gctggcctcaaactca

SEQ ID NO: 508531 - DNA, 16 bp, R. norvegicus
gctggcctcaaatgca

SEQ ID NO: 508532 - DNA, 16 bp, R. norvegicus
gctggcctccaaatca

SEQ ID NO: 508533 - DNA, 16 bp, R. norvegicus
gctggcctctacttct

SEQ ID NO: 508534 - DNA, 16 bp, R. norvegicus
gctggcctctgcctcc

SEQ ID NO: 508535 - DNA, 16 bp, R. norvegicus
gctggcctctgccttc

SEQ ID NO: 508536 - DNA, 16 bp, R. norvegicus
gctggcctctttgaaa

SEQ ID NO: 508537 - DNA, 16 bp, R. norvegicus
gctggcctggaactaa

SEQ ID NO: 508538 - DNA, 16 bp, R. norvegicus
gctggcctggaactca

SEQ ID NO: 508539 - DNA, 16 bp, R. norvegicus
gctggcctggaactgg

SEQ ID NO: 508540 - DNA, 16 bp, R. norvegicus
gctggccttgaacacc

SEQ ID NO: 508541 - DNA, 16 bp, R. norvegicus
gctggccttgaacctc

SEQ ID NO: 508542 - DNA, 16 bp, R. norvegicus
gctggccttgaactca

SEQ ID NO: 508543 - DNA, 16 bp, R. norvegicus
gctggccttgaactcc

SEQ ID NO: 508544 - DNA, 16 bp, R. norvegicus
gctggccttgaactcg

SEQ ID NO: 508545 - DNA, 16 bp, R. norvegicus
gctggccttgaacttg

SEQ ID NO: 508546 - DNA, 16 bp, R. norvegicus
gctggccttgatctca

SEQ ID NO: 508547 - DNA, 16 bp, R. norvegicus
gctggctagagtccct

SEQ ID NO: 508548 - DNA, 16 bp, R. norvegicus
gctggctccccctcct

SEQ ID NO: 508549 - DNA, 16 bp, R. norvegicus
gctggctgatcacatt

SEQ ID NO: 508550 - DNA, 16 bp, R. norvegicus
gctggctgccttgtct

SEQ ID NO: 508551 - DNA, 16 bp, R. norvegicus
gctggctgctgccgcc

SEQ ID NO: 508552 - DNA, 16 bp, R. norvegicus
gctggctgctgggctg

SEQ ID NO: 508553 - DNA, 16 bp, R. norvegicus
gctggctggacttcct

SEQ ID NO: 508554 - DNA, 16 bp, R. norvegicus
gctggctggagatttt

SEQ ID NO: 508555 - DNA, 16 bp, R. norvegicus
gctggctggctggcag

SEQ ID NO: 508556 - DNA, 16 bp, R. norvegicus
gctggctgtggtggca

SEQ ID NO: 508557 - DNA, 16 bp, R. norvegicus
gctggcttacagtttt

SEQ ID NO: 508558 - DNA, 16 bp, R. norvegicus
gctggctttgatctca

SEQ ID NO: 508559 - DNA, 16 bp, R. norvegicus
gctgggaaaccaggaa

SEQ ID NO: 508560 - DNA, 16 bp, R. norvegicus
gctgggaaactgggaa

SEQ ID NO: 508561 - DNA, 16 bp, R. norvegicus
gctgggaacagaaccc

SEQ ID NO: 508562 - DNA, 16 bp, R. norvegicus
gctgggaaccagaccc

SEQ ID NO: 508563 - DNA, 16 bp, R. norvegicus
gctgggaagacagctc

SEQ ID NO: 508564 - DNA, 16 bp, R. norvegicus
gctgggaaggatgtgg

SEQ ID NO: 508565 - DNA, 16 bp, R. norvegicus
gctgggaatgtatggc

SEQ ID NO: 508566 - DNA, 16 bp, R. norvegicus
gctgggaatgtggctc

SEQ ID NO: 508567 - DNA, 16 bp, R. norvegicus
gctgggaattgaatct

SEQ ID NO: 508568 - DNA, 16 bp, R. norvegicus
gctgggacttgaacct

SEQ ID NO: 508569 - DNA, 16 bp, R. norvegicus
gctgggactttaacac

SEQ ID NO: 508570 - DNA, 16 bp, R. norvegicus
gctgggaggagccaca

SEQ ID NO: 508571 - DNA, 16 bp, R. norvegicus
gctgggaggagctggg

SEQ ID NO: 508572 - DNA, 16 bp, R. norvegicus
gctgggaggaggagga

SEQ ID NO: 508573 - DNA, 16 bp, R. norvegicus
gctgggaggagtggag

SEQ ID NO: 508574 - DNA, 16 bp, R. norvegicus
gctgggaggtggagac

SEQ ID NO: 508575 - DNA, 16 bp, R. norvegicus
gctgggaggtggtggt

SEQ ID NO: 508576 - DNA, 16 bp, R. norvegicus
gctgggagtggtggtg

SEQ ID NO: 508577 - DNA, 16 bp, R. norvegicus
gctgggatcagcaagg

SEQ ID NO: 508578 - DNA, 16 bp, R. norvegicus
gctgggatgacaggcc

SEQ ID NO: 508579 - DNA, 16 bp, R. norvegicus
gctgggattaaagaag

SEQ ID NO: 508580 - DNA, 16 bp, R. norvegicus
gctgggattaaaggga

SEQ ID NO: 508581 - DNA, 16 bp, R. norvegicus
gctgggattaaagtat

SEQ ID NO: 508582 - DNA, 16 bp, R. norvegicus
gctgggattaaagtca

SEQ ID NO: 508583 - DNA, 16 bp, R. norvegicus
gctgggattaaatgcc

SEQ ID NO: 508584 - DNA, 16 bp, R. norvegicus
gctgggattacaagct

SEQ ID NO: 508585 - DNA, 16 bp, R. norvegicus
gctgggcaagtgctct

SEQ ID NO: 508586 - DNA, 16 bp, R. norvegicus
gctgggcagaagagaa

SEQ ID NO: 508587 - DNA, 16 bp, R. norvegicus
gctgggcagttcccac

SEQ ID NO: 508588 - DNA, 16 bp, R. norvegicus
gctgggcatggagcct

SEQ ID NO: 508589 - DNA, 16 bp, R. norvegicus
gctgggccctcctgca

SEQ ID NO: 508590 - DNA, 16 bp, R. norvegicus
gctgggctctcccaca

SEQ ID NO: 508591 - DNA, 16 bp, R. norvegicus
gctgggctctggtggt

SEQ ID NO: 508592 - DNA, 16 bp, R. norvegicus
gctgggctgctgggct

SEQ ID NO: 508593 - DNA, 16 bp, R. norvegicus
gctgggctggctggct

SEQ ID NO: 508594 - DNA, 16 bp, R. norvegicus
gctgggctgggcacag

SEQ ID NO: 508595 - DNA, 16 bp, R. norvegicus
gctgggctgtagctca

SEQ ID NO: 508596 - DNA, 16 bp, R. norvegicus
gctgggctgtgctgtg

SEQ ID NO: 508597 - DNA, 16 bp, R. norvegicus
gctgggctgtgtttct

SEQ ID NO: 508598 - DNA, 16 bp, R. norvegicus
gctgggctttgaactc

SEQ ID NO: 508599 - DNA, 16 bp, R. norvegicus
gctggggaccaaactc

SEQ ID NO: 508600 - DNA, 36 bp, R. norvegicus
gctggggaccgaacccagggccttgcgcttcctagg

SEQ ID NO: 508601 - DNA, 16 bp, R. norvegicus
gctggggacctggagc

SEQ ID NO: 508602 - DNA, 16 bp, R. norvegicus
gctggggactgagccc

SEQ ID NO: 508603 - DNA, 16 bp, R. norvegicus
gctggggagatggctc

SEQ ID NO: 508604 - DNA, 16 bp, R. norvegicus
gctggggagatgggtc

SEQ ID NO: 508605 - DNA, 16 bp, R. norvegicus
gctggggagctggctc

SEQ ID NO: 508606 - DNA, 16 bp, R. norvegicus
gctggggcagggctgg

SEQ ID NO: 508607 - DNA, 16 bp, R. norvegicus
gctggggctgcagctc

SEQ ID NO: 508608 - DNA, 16 bp, R. norvegicus
gctggggctggagagg

SEQ ID NO: 508609 - DNA, 16 bp, R. norvegicus
gctggggctgggactg

SEQ ID NO: 508610 - DNA, 16 bp, R. norvegicus
gctggggctggggctc

SEQ ID NO: 508611 - DNA, 16 bp, R. norvegicus
gctggggttacaggtg

SEQ ID NO: 508612 - DNA, 16 bp, R. norvegicus
gctggggttggagaga

SEQ ID NO: 508613 - DNA, 16 bp, R. norvegicus
gctgggtataaaaata

SEQ ID NO: 508614 - DNA, 16 bp, R. norvegicus
gctgggtccccaggta

SEQ ID NO: 508615 - DNA, 16 bp, R. norvegicus
gctgggtctcacggag

SEQ ID NO: 508616 - DNA, 16 bp, R. norvegicus
gctgggtgtctcagct

SEQ ID NO: 508617 - DNA, 16 bp, R. norvegicus
gctggtaccaatttgt

SEQ ID NO: 508618 - DNA, 16 bp, R. norvegicus
gctggtacctcaggga

SEQ ID NO: 508619 - DNA, 16 bp, R. norvegicus
gctggtcagacagcct

SEQ ID NO: 508620 - DNA, 16 bp, R. norvegicus
gctggtcatggtggca

SEQ ID NO: 508621 - DNA, 16 bp, R. norvegicus
gctggtcctgaactca

SEQ ID NO: 508622 - DNA, 16 bp, R. norvegicus
gctggtcctgcagatc

SEQ ID NO: 508623 - DNA, 16 bp, R. norvegicus
gctggtcctggttgct

SEQ ID NO: 508624 - DNA, 16 bp, R. norvegicus
gctggtctgccaggaa

SEQ ID NO: 508625 - DNA, 16 bp, R. norvegicus
gctggtcttcagtgta

SEQ ID NO: 508626 - DNA, 16 bp, R. norvegicus
gctggtcttgaattcc

SEQ ID NO: 508627 - DNA, 16 bp, R. norvegicus
gctggtgagatggctc

SEQ ID NO: 508628 - DNA, 16 bp, R. norvegicus
gctggtgcaactggag

SEQ ID NO: 508629 - DNA, 16 bp, R. norvegicus
gctggtgcctttgttc

SEQ ID NO: 508630 - DNA, 16 bp, R. norvegicus
gctggtgctgatgctg

SEQ ID NO: 508631 - DNA, 16 bp, R. norvegicus
gctggtggatgctgcc

SEQ ID NO: 508632 - DNA, 16 bp, R. norvegicus
gctggtggccagcaag

SEQ ID NO: 508633 - DNA, 16 bp, R. norvegicus
gctggtggtcctgggg

SEQ ID NO: 508634 - DNA, 16 bp, R. norvegicus
gctggtggtgatgatg

SEQ ID NO: 508635 - DNA, 16 bp, R. norvegicus
gctggtggtgcacacc

SEQ ID NO: 508636 - DNA, 16 bp, R. norvegicus
gctggtgtctgctgcc

SEQ ID NO: 508637 - DNA, 16 bp, R. norvegicus
gctggttccagtgtgg

SEQ ID NO: 508638 - DNA, 16 bp, R. norvegicus
gctggttgctgccgct

SEQ ID NO: 508639 - DNA, 16 bp, R. norvegicus
gctggtttccaccttc

SEQ ID NO: 508640 - DNA, 16 bp, R. norvegicus
gctgtacatatggggt

SEQ ID NO: 508641 - DNA, 16 bp, R. norvegicus
gctgtagacacaggag

SEQ ID NO: 508642 - DNA, 16 bp, R. norvegicus
gctgtagctgtggctg

SEQ ID NO: 508643 - DNA, 16 bp, R. norvegicus
gctgtcaagatgctga

SEQ ID NO: 508644 - DNA, 16 bp, R. norvegicus
gctgtcaagctactaa

SEQ ID NO: 508645 - DNA, 16 bp, R. norvegicus
gctgtcaaggtgctaa

SEQ ID NO: 508646 - DNA, 16 bp, R. norvegicus
gctgtcacctgagtgt

SEQ ID NO: 508647 - DNA, 16 bp, R. norvegicus
gctgtcaggcaaggcc

SEQ ID NO: 508648 - DNA, 16 bp, R. norvegicus
gctgtccagaaaagga

SEQ ID NO: 508649 - DNA, 16 bp, R. norvegicus
gctgtccaggctgcct

SEQ ID NO: 508650 - DNA, 16 bp, R. norvegicus
gctgtccagggtctgt

SEQ ID NO: 508651 - DNA, 16 bp, R. norvegicus
gctgtcccacagctct

SEQ ID NO: 508652 - DNA, 16 bp, R. norvegicus
gctgtcccacagtcct

SEQ ID NO: 508653 - DNA, 16 bp, R. norvegicus
gctgtccctgactctg

SEQ ID NO: 508654 - DNA, 16 bp, R. norvegicus
gctgtccctgagcctg

SEQ ID NO: 508655 - DNA, 16 bp, R. norvegicus
gctgtccctgctgctg

SEQ ID NO: 508656 - DNA, 16 bp, R. norvegicus
gctgtcctagaactga

SEQ ID NO: 508657 - DNA, 16 bp, R. norvegicus
gctgtcctcaaattca

SEQ ID NO: 508658 - DNA, 16 bp, R. norvegicus
gctgtcctctgagggg

SEQ ID NO: 508659 - DNA, 16 bp, R. norvegicus
gctgtcctctgagttt

SEQ ID NO: 508660 - DNA, 16 bp, R. norvegicus
gctgtcctgctgtgtg

SEQ ID NO: 508661 - DNA, 16 bp, R. norvegicus
gctgtcctgggactca

SEQ ID NO: 508662 - DNA, 16 bp, R. norvegicus
gctgtctataactcca

SEQ ID NO: 508663 - DNA, 16 bp, R. norvegicus
gctgtctccccagctc

SEQ ID NO: 508664 - DNA, 16 bp, R. norvegicus
gctgtctctacaactt

SEQ ID NO: 508665 - DNA, 16 bp, R. norvegicus
gctgtctctcaggagc

SEQ ID NO: 508666 - DNA, 16 bp, R. norvegicus
gctgtctctccagctc

SEQ ID NO: 508667 - DNA, 16 bp, R. norvegicus
gctgtctctccagtcc

SEQ ID NO: 508668 - DNA, 16 bp, R. norvegicus
gctgtctctcctcagg

SEQ ID NO: 508669 - DNA, 16 bp, R. norvegicus
gctgtctctcttagaa

SEQ ID NO: 508670 - DNA, 16 bp, R. norvegicus
gctgtctctgactgga

SEQ ID NO: 508671 - DNA, 16 bp, R. norvegicus
gctgtctctgattgga

SEQ ID NO: 508672 - DNA, 16 bp, R. norvegicus
gctgtctctgctgggt

SEQ ID NO: 508673 - DNA, 16 bp, R. norvegicus
gctgtctgtctctgta

SEQ ID NO: 508674 - DNA, 16 bp, R. norvegicus
gctgtcttcaccagaa

SEQ ID NO: 508675 - DNA, 16 bp, R. norvegicus
gctgtcttcagacata

SEQ ID NO: 508676 - DNA, 16 bp, R. norvegicus
gctgtcttctggtctc

SEQ ID NO: 508677 - DNA, 16 bp, R. norvegicus
gctgtgaacacacacc

SEQ ID NO: 508678 - DNA, 16 bp, R. norvegicus
gctgtgaagagactcc

SEQ ID NO: 508679 - DNA, 16 bp, R. norvegicus
gctgtgaatttgaaag

SEQ ID NO: 508680 - DNA, 16 bp, R. norvegicus
gctgtgacaaaatact

SEQ ID NO: 508681 - DNA, 16 bp, R. norvegicus
gctgtgacaagcagtt

SEQ ID NO: 508682 - DNA, 16 bp, R. norvegicus
gctgtgacaggcagac

SEQ ID NO: 508683 - DNA, 16 bp, R. norvegicus
gctgtgacctggaagt

SEQ ID NO: 508684 - DNA, 16 bp, R. norvegicus
gctgtgagcatctgtc

SEQ ID NO: 508685 - DNA, 16 bp, R. norvegicus
gctgtgagccaccaca

SEQ ID NO: 508686 - DNA, 16 bp, R. norvegicus
gctgtgagctgccatg

SEQ ID NO: 508687 - DNA, 16 bp, R. norvegicus
gctgtgcaagctgact

SEQ ID NO: 508688 - DNA, 16 bp, R. norvegicus
gctgtgcaattttatg

SEQ ID NO: 508689 - DNA, 16 bp, R. norvegicus
gctgtgcagaagcttt

SEQ ID NO: 508690 - DNA, 16 bp, R. norvegicus
gctgtgcagccatccc

SEQ ID NO: 508691 - DNA, 16 bp, R. norvegicus
gctgtgcctacatctt

SEQ ID NO: 508692 - DNA, 16 bp, R. norvegicus
gctgtgcctgtgcctg

SEQ ID NO: 508693 - DNA, 16 bp, R. norvegicus
gctgtgctagtggaca

SEQ ID NO: 508694 - DNA, 16 bp, R. norvegicus
gctgtgctcactgtgt

SEQ ID NO: 508695 - DNA, 16 bp, R. norvegicus
gctgtgctctgacctc

SEQ ID NO: 508696 - DNA, 16 bp, R. norvegicus
gctgtgctgaaacacc

SEQ ID NO: 508697 - DNA, 16 bp, R. norvegicus
gctgtgctgactcctg

SEQ ID NO: 508698 - DNA, 16 bp, R. norvegicus
gctgtgctgagctgag

SEQ ID NO: 508699 - DNA, 16 bp, R. norvegicus
gctgtgctgagctgtg

SEQ ID NO: 508700 - DNA, 16 bp, R. norvegicus
gctgtgctggaactca

SEQ ID NO: 508701 - DNA, 16 bp, R. norvegicus
gctgtgctgggctgtg

SEQ ID NO: 508702 - DNA, 16 bp, R. norvegicus
gctgtgctgtgctgag

SEQ ID NO: 508703 - DNA, 16 bp, R. norvegicus
gctgtgctgtgctgtg

SEQ ID NO: 508704 - DNA, 16 bp, R. norvegicus
gctgtgctgtgtgctg

SEQ ID NO: 508705 - DNA, 16 bp, R. norvegicus
gctgtggacagtctga

SEQ ID NO: 508706 - DNA, 16 bp, R. norvegicus
gctgtggaggagtgct

SEQ ID NO: 508707 - DNA, 16 bp, R. norvegicus
gctgtggctgctgctg

SEQ ID NO: 508708 - DNA, 16 bp, R. norvegicus
gctgtggctgtaaact

SEQ ID NO: 508709 - DNA, 16 bp, R. norvegicus
gctgtggggacaggaa

SEQ ID NO: 508710 - DNA, 16 bp, R. norvegicus
gctgtggggctgggga

SEQ ID NO: 508711 - DNA, 16 bp, R. norvegicus
gctgtggtgaccccca

SEQ ID NO: 508712 - DNA, 16 bp, R. norvegicus
gctgtgtatatatata

SEQ ID NO: 508713 - DNA, 16 bp, R. norvegicus
gctgtgtctcaggcag

SEQ ID NO: 508714 - DNA, 16 bp, R. norvegicus
gctgtgtctccaggag

SEQ ID NO: 508715 - DNA, 16 bp, R. norvegicus
gctgtgtctctaagga

SEQ ID NO: 508716 - DNA, 16 bp, R. norvegicus
gctgtgtctctgagga

SEQ ID NO: 508717 - DNA, 16 bp, R. norvegicus
gctgtgtgacttcagg

SEQ ID NO: 508718 - DNA, 16 bp, R. norvegicus
gctgtgtgactttggg

SEQ ID NO: 508719 - DNA, 16 bp, R. norvegicus
gctgtgtgccaccatg

SEQ ID NO: 508720 - DNA, 16 bp, R. norvegicus
gctgtgtgctgtgtgg

SEQ ID NO: 508721 - DNA, 16 bp, R. norvegicus
gctgtgtgggctgaga

SEQ ID NO: 508722 - DNA, 16 bp, R. norvegicus
gctgtgtgtgctgctg

SEQ ID NO: 508723 - DNA, 16 bp, R. norvegicus
gctgttcatcatcaaa

SEQ ID NO: 508724 - DNA, 16 bp, R. norvegicus
gctgttccaggaaacc

SEQ ID NO: 508725 - DNA, 16 bp, R. norvegicus
gctgttcctgggctgg

SEQ ID NO: 508726 - DNA, 16 bp, R. norvegicus
gctgttcctgtggcct

SEQ ID NO: 508727 - DNA, 16 bp, R. norvegicus
gctgttgaggtgggag

SEQ ID NO: 508728 - DNA, 16 bp, R. norvegicus
gctgttgcagaggacc

SEQ ID NO: 508729 - DNA, 16 bp, R. norvegicus
gctgttgctgctgttg

SEQ ID NO: 508730 - DNA, 16 bp, R. norvegicus
gctgttgtgttttata

SEQ ID NO: 508731 - DNA, 16 bp, R. norvegicus
gctgttgttgttgctg

SEQ ID NO: 508732 - DNA, 16 bp, R. norvegicus
gctgtttcatcaccaa

SEQ ID NO: 508733 - DNA, 16 bp, R. norvegicus
gctgtttctgagagtg

SEQ ID NO: 508734 - DNA, 16 bp, R. norvegicus
gctgtttctgctggat

SEQ ID NO: 508735 - DNA, 16 bp, R. norvegicus
gctgtttgacctggtc

SEQ ID NO: 508736 - DNA, 16 bp, R. norvegicus
gctgtttgggaaggat

SEQ ID NO: 508737 - DNA, 16 bp, R. norvegicus
gctgttttttcctaat

SEQ ID NO: 508738 - DNA, 16 bp, R. norvegicus
gcttacagctttagag

SEQ ID NO: 508739 - DNA, 16 bp, R. norvegicus
gcttacctctcaccat

SEQ ID NO: 508740 - DNA, 16 bp, R. norvegicus
gcttacttcttctgac

SEQ ID NO: 508741 - DNA, 16 bp, R. norvegicus
gcttagttgattctat

SEQ ID NO: 508742 - DNA, 16 bp, R. norvegicus
gcttataatttagcaa

SEQ ID NO: 508743 - DNA, 16 bp, R. norvegicus
gcttatacccaaaaga

SEQ ID NO: 508744 - DNA, 16 bp, R. norvegicus
gcttatatttccacat

SEQ ID NO: 508745 - DNA, 16 bp, R. norvegicus
gcttatgttcttgcac

SEQ ID NO: 508746 - DNA, 16 bp, R. norvegicus
gcttcaagatctggat

SEQ ID NO: 508747 - DNA, 16 bp, R. norvegicus
gcttcaagtctctctc

SEQ ID NO: 508748 - DNA, 16 bp, R. norvegicus
gcttcagaagaggaag

SEQ ID NO: 508749 - DNA, 16 bp, R. norvegicus
gcttcagcaccatgcc

SEQ ID NO: 508750 - DNA, 16 bp, R. norvegicus
gcttcaggaagctgtc

SEQ ID NO: 508751 - DNA, 16 bp, R. norvegicus
gcttcaggaagttcct

SEQ ID NO: 508752 - DNA, 16 bp, R. norvegicus
gcttcagtgcaccatg

SEQ ID NO: 508753 - DNA, 16 bp, R. norvegicus
gcttcagtgtctgtga

SEQ ID NO: 508754 - DNA, 16 bp, R. norvegicus
gcttcagttccttcct

SEQ ID NO: 508755 - DNA, 16 bp, R. norvegicus
gcttcatgaaattcac

SEQ ID NO: 508756 - DNA, 16 bp, R. norvegicus
gcttcatgcacatgac

SEQ ID NO: 508757 - DNA, 16 bp, R. norvegicus
gcttcattatgttcat

SEQ ID NO: 508758 - DNA, 16 bp, R. norvegicus
gcttccagaaaaacac

SEQ ID NO: 508759 - DNA, 16 bp, R. norvegicus
gcttccagcagaaggc

SEQ ID NO: 508760 - DNA, 16 bp, R. norvegicus
gcttccaggactgggc

SEQ ID NO: 508761 - DNA, 16 bp, R. norvegicus
gcttccagggactaca

SEQ ID NO: 508762 - DNA, 16 bp, R. norvegicus
gcttccatccccagca

SEQ ID NO: 508763 - DNA, 16 bp, R. norvegicus
gcttccccacccactc

SEQ ID NO: 508764 - DNA, 16 bp, R. norvegicus
gcttcccctcccccag

SEQ ID NO: 508765 - DNA, 16 bp, R. norvegicus
gcttcccctcctcatc

SEQ ID NO: 508766 - DNA, 16 bp, R. norvegicus
gcttccctgccctggc

SEQ ID NO: 508767 - DNA, 16 bp, R. norvegicus
gcttccctggagctgg

SEQ ID NO: 508768 - DNA, 16 bp, R. norvegicus
gcttcccttcccagat

SEQ ID NO: 508769 - DNA, 16 bp, R. norvegicus
gcttcccttcccccag

SEQ ID NO: 508770 - DNA, 16 bp, R. norvegicus
gcttcctaggcaagcg

SEQ ID NO: 508771 - DNA, 16 bp, R. norvegicus
gcttcctaggtaagcg

SEQ ID NO: 508772 - DNA, 16 bp, R. norvegicus
gcttcctccagcagca

SEQ ID NO: 508773 - DNA, 16 bp, R. norvegicus
gcttcctcccatgatg

SEQ ID NO: 508774 - DNA, 16 bp, R. norvegicus
gcttcctccctgctgg

SEQ ID NO: 508775 - DNA, 16 bp, R. norvegicus
gcttcctctggcagca

SEQ ID NO: 508776 - DNA, 16 bp, R. norvegicus
gcttcctgaatgctag

SEQ ID NO: 508777 - DNA, 16 bp, R. norvegicus
gcttcctgagttcttt

SEQ ID NO: 508778 - DNA, 16 bp, R. norvegicus
gcttcctgccctgctt

SEQ ID NO: 508779 - DNA, 16 bp, R. norvegicus
gcttcctgcctcttac

SEQ ID NO: 508780 - DNA, 16 bp, R. norvegicus
gcttcctgctcctgcc

SEQ ID NO: 508781 - DNA, 16 bp, R. norvegicus
gcttcctgctcttgca

SEQ ID NO: 508782 - DNA, 16 bp, R. norvegicus
gcttcctggaggagga

SEQ ID NO: 508783 - DNA, 16 bp, R. norvegicus
gcttcctggaggaggt

SEQ ID NO: 508784 - DNA, 16 bp, R. norvegicus
gcttcctggctgctgt

SEQ ID NO: 508785 - DNA, 16 bp, R. norvegicus
gcttccttacagagca

SEQ ID NO: 508786 - DNA, 16 bp, R. norvegicus
gcttccttctgcagca

SEQ ID NO: 508787 - DNA, 16 bp, R. norvegicus
gcttcctttgtcctgt

SEQ ID NO: 508788 - DNA, 16 bp, R. norvegicus
gcttctatgactcctg

SEQ ID NO: 508789 - DNA, 16 bp, R. norvegicus
gcttctattcctgcct

SEQ ID NO: 508790 - DNA, 16 bp, R. norvegicus
gcttctcaagtgctgg

SEQ ID NO: 508791 - DNA, 16 bp, R. norvegicus
gcttctcagaagacag

SEQ ID NO: 508792 - DNA, 16 bp, R. norvegicus
gcttctcagccatgca

SEQ ID NO: 508793 - DNA, 16 bp, R. norvegicus
gcttctcctccttttg

SEQ ID NO: 508794 - DNA, 16 bp, R. norvegicus
gcttctcctggcttct

SEQ ID NO: 508795 - DNA, 16 bp, R. norvegicus
gcttctcctgtaccat

SEQ ID NO: 508796 - DNA, 16 bp, R. norvegicus
gcttctccttccattg

SEQ ID NO: 508797 - DNA, 16 bp, R. norvegicus
gcttctccttcccttg

SEQ ID NO: 508798 - DNA, 16 bp, R. norvegicus
gcttctccttcctttg

SEQ ID NO: 508799 - DNA, 16 bp, R. norvegicus
gcttctctccatggca

SEQ ID NO: 508800 - DNA, 16 bp, R. norvegicus
gcttctctctgcagtg

SEQ ID NO: 508801 - DNA, 16 bp, R. norvegicus
gcttctctctgcttct

SEQ ID NO: 508802 - DNA, 16 bp, R. norvegicus
gcttctctgcttcctc

SEQ ID NO: 508803 - DNA, 16 bp, R. norvegicus
gcttctcttgcagagg

SEQ ID NO: 508804 - DNA, 16 bp, R. norvegicus
gcttctgcctcccaag

SEQ ID NO: 508805 - DNA, 16 bp, R. norvegicus
gcttctgcctcccagg

SEQ ID NO: 508806 - DNA, 16 bp, R. norvegicus
gcttctgccttccaaa

SEQ ID NO: 508807 - DNA, 16 bp, R. norvegicus
gcttctgctgctgctg

SEQ ID NO: 508808 - DNA, 16 bp, R. norvegicus
gcttctgcttcagctc

SEQ ID NO: 508809 - DNA, 16 bp, R. norvegicus
gcttctgcttctcaag

SEQ ID NO: 508810 - DNA, 16 bp, R. norvegicus
gcttctggctatcaca

SEQ ID NO: 508811 - DNA, 20 bp, R. norvegicus
gcttctggctattataaaca

SEQ ID NO: 508812 - DNA, 16 bp, R. norvegicus
gcttctggctgttatg

SEQ ID NO: 508813 - DNA, 16 bp, R. norvegicus
gcttctgggttaggga

SEQ ID NO: 508814 - DNA, 16 bp, R. norvegicus
gcttctgtctccagca

SEQ ID NO: 508815 - DNA, 16 bp, R. norvegicus
gcttctgtctctcaag

SEQ ID NO: 508816 - DNA, 16 bp, R. norvegicus
gcttcttccagcattt

SEQ ID NO: 508817 - DNA, 16 bp, R. norvegicus
gcttcttccagctttt

SEQ ID NO: 508818 - DNA, 16 bp, R. norvegicus
gcttcttccaggaact

SEQ ID NO: 508819 - DNA, 16 bp, R. norvegicus
gcttcttggctattca

SEQ ID NO: 508820 - DNA, 16 bp, R. norvegicus
gcttcttgtatactta

SEQ ID NO: 508821 - DNA, 16 bp, R. norvegicus
gcttcttgttgggtct

SEQ ID NO: 508822 - DNA, 16 bp, R. norvegicus
gcttgaaggctgagga

SEQ ID NO: 508823 - DNA, 16 bp, R. norvegicus
gcttgaccctcctata

SEQ ID NO: 508824 - DNA, 22 bp, R. norvegicus
gcttgactacggcccttggtgg

SEQ ID NO: 508825 - DNA, 16 bp, R. norvegicus
gcttgactgtcctgga

SEQ ID NO: 508826 - DNA, 16 bp, R. norvegicus
gcttgaggatccagct

SEQ ID NO: 508827 - DNA, 16 bp, R. norvegicus
gcttgagggcagcctg

SEQ ID NO: 508828 - DNA, 16 bp, R. norvegicus
gcttgccgccaagcct

SEQ ID NO: 508829 - DNA, 16 bp, R. norvegicus
gcttgcctaccatgca

SEQ ID NO: 508830 - DNA, 16 bp, R. norvegicus
gcttgcctagcatata

SEQ ID NO: 508831 - DNA, 16 bp, R. norvegicus
gcttgcctaggaagta

SEQ ID NO: 508832 - DNA, 16 bp, R. norvegicus
gcttgcctaggaagtg

SEQ ID NO: 508833 - DNA, 16 bp, R. norvegicus
gcttgccttccttcct

SEQ ID NO: 508834 - DNA, 16 bp, R. norvegicus
gcttgctaggcaaacg

SEQ ID NO: 508835 - DNA, 16 bp, R. norvegicus
gcttgctaggcaagcg

SEQ ID NO: 508836 - DNA, 16 bp, R. norvegicus
gcttgctcagcctgca

SEQ ID NO: 508837 - DNA, 16 bp, R. norvegicus
gcttgctcaggctgct

SEQ ID NO: 508838 - DNA, 16 bp, R. norvegicus
gcttgctccccatggt

SEQ ID NO: 508839 - DNA, 16 bp, R. norvegicus
gcttgctccttgtggc

SEQ ID NO: 508840 - DNA, 16 bp, R. norvegicus
gcttgctggctaccag

SEQ ID NO: 508841 - DNA, 16 bp, R. norvegicus
gcttgctggcttgctc

SEQ ID NO: 508842 - DNA, 16 bp, R. norvegicus
gcttgcttgcttgctt

SEQ ID NO: 508843 - DNA, 16 bp, R. norvegicus
gcttgcttgcttgttc

SEQ ID NO: 508844 - DNA, 16 bp, R. norvegicus
gcttggaaaatggttt

SEQ ID NO: 508845 - DNA, 16 bp, R. norvegicus
gcttggaacagaaaag

SEQ ID NO: 508846 - DNA, 16 bp, R. norvegicus
gcttggcaatgcgagc

SEQ ID NO: 508847 - DNA, 16 bp, R. norvegicus
gcttgggatttgaact

SEQ ID NO: 508848 - DNA, 16 bp, R. norvegicus
gcttgggttcctgtgc

SEQ ID NO: 508849 - DNA, 16 bp, R. norvegicus
gcttggtgcaccaagg

SEQ ID NO: 508850 - DNA, 16 bp, R. norvegicus
gcttggtgcaggagga

SEQ ID NO: 508851 - DNA, 16 bp, R. norvegicus
gcttgtgagccacctg

SEQ ID NO: 508852 - DNA, 16 bp, R. norvegicus
gcttgtgatcccagca

SEQ ID NO: 508853 - DNA, 16 bp, R. norvegicus
gcttgtggccaagcct

SEQ ID NO: 508854 - DNA, 16 bp, R. norvegicus
gcttgtgtcaagttgt

SEQ ID NO: 508855 - DNA, 16 bp, R. norvegicus
gcttgtgtctttttat

SEQ ID NO: 508856 - DNA, 16 bp, R. norvegicus
gcttgtgtgcttgtgt

SEQ ID NO: 508857 - DNA, 16 bp, R. norvegicus
gcttgttaaacttttt

SEQ ID NO: 508858 - DNA, 16 bp, R. norvegicus
gcttgttttttgggac

SEQ ID NO: 508859 - DNA, 16 bp, R. norvegicus
gctttaagaccctttt

SEQ ID NO: 508860 - DNA, 16 bp, R. norvegicus
gctttaatacccttgt

SEQ ID NO: 508861 - DNA, 16 bp, R. norvegicus
gctttacttcttggca

SEQ ID NO: 508862 - DNA, 16 bp, R. norvegicus
gctttagcaaagtttc

SEQ ID NO: 508863 - DNA, 16 bp, R. norvegicus
gctttagttcctggga

SEQ ID NO: 508864 - DNA, 16 bp, R. norvegicus
gctttatccaacaatc

SEQ ID NO: 508865 - DNA, 64 bp, R. norvegicus
gctttatgaaattcgtaggcaaatggttggaactggaaaatatcatcctgagtgagctaaccca

SEQ ID NO: 508866 - DNA, 51 bp, R. norvegicus
gctttatgaaattcgtaggcaaatggttggaactggaaaatatcattctga

SEQ ID NO: 508867 - DNA, 16 bp, R. norvegicus
gctttatgtcaacttg

SEQ ID NO: 508868 - DNA, 16 bp, R. norvegicus
gctttatttggttggg

SEQ ID NO: 508869 - DNA, 16 bp, R. norvegicus
gctttattttctaagt

SEQ ID NO: 508870 - DNA, 16 bp, R. norvegicus
gctttcaaggcaaaca

SEQ ID NO: 508871 - DNA, 16 bp, R. norvegicus
gctttcaagttattag

SEQ ID NO: 508872 - DNA, 16 bp, R. norvegicus
gctttcagaaaacact

SEQ ID NO: 508873 - DNA, 16 bp, R. norvegicus
gctttcctctcaccat

SEQ ID NO: 508874 - DNA, 16 bp, R. norvegicus
gctttctccttccacc

SEQ ID NO: 508875 - DNA, 16 bp, R. norvegicus
gctttctctcccacag

SEQ ID NO: 508876 - DNA, 16 bp, R. norvegicus
gctttctgctgtttct

SEQ ID NO: 508877 - DNA, 16 bp, R. norvegicus
gctttctgtgaagcta

SEQ ID NO: 508878 - DNA, 16 bp, R. norvegicus
gctttcttatacagcc

SEQ ID NO: 508879 - DNA, 16 bp, R. norvegicus
gctttcttctcaccct

SEQ ID NO: 508880 - DNA, 16 bp, R. norvegicus
gctttcttctgcctga

SEQ ID NO: 508881 - DNA, 16 bp, R. norvegicus
gctttcttcttacaga

SEQ ID NO: 508882 - DNA, 16 bp, R. norvegicus
gctttgaagtttcaga

SEQ ID NO: 508883 - DNA, 16 bp, R. norvegicus
gctttgaggcagggtc

SEQ ID NO: 508884 - DNA, 16 bp, R. norvegicus
gctttgaggtttcaaa

SEQ ID NO: 508885 - DNA, 16 bp, R. norvegicus
gctttgattgtgtccc

SEQ ID NO: 508886 - DNA, 16 bp, R. norvegicus
gctttgatttttcaaa

SEQ ID NO: 508887 - DNA, 16 bp, R. norvegicus
gctttgcaattgtatg

SEQ ID NO: 508888 - DNA, 16 bp, R. norvegicus
gctttgccagcttgga

SEQ ID NO: 508889 - DNA, 16 bp, R. norvegicus
gctttgctgcagaagg

SEQ ID NO: 508890 - DNA, 16 bp, R. norvegicus
gctttgctgtatatgg

SEQ ID NO: 508891 - DNA, 16 bp, R. norvegicus
gctttgctttgctctg

SEQ ID NO: 508892 - DNA, 16 bp, R. norvegicus
gctttggaacagcagg

SEQ ID NO: 508893 - DNA, 16 bp, R. norvegicus
gctttggcttctttgt

SEQ ID NO: 508894 - DNA, 16 bp, R. norvegicus
gctttggtcaaatgta

SEQ ID NO: 508895 - DNA, 16 bp, R. norvegicus
gctttggtggaggaag

SEQ ID NO: 508896 - DNA, 16 bp, R. norvegicus
gctttgtccttttcag

SEQ ID NO: 508897 - DNA, 16 bp, R. norvegicus
gcttttaaaaatgttt

SEQ ID NO: 508898 - DNA, 16 bp, R. norvegicus
gcttttaaatgtttta

SEQ ID NO: 508899 - DNA, 16 bp, R. norvegicus
gcttttaatatctttc

SEQ ID NO: 508900 - DNA, 16 bp, R. norvegicus
gcttttagattacaaa

SEQ ID NO: 508901 - DNA, 16 bp, R. norvegicus
gcttttatgaggatgc

SEQ ID NO: 508902 - DNA, 16 bp, R. norvegicus
gcttttatgagggtgt

SEQ ID NO: 508903 - DNA, 16 bp, R. norvegicus
gcttttatggtatttg

SEQ ID NO: 508904 - DNA, 16 bp, R. norvegicus
gcttttccagagggcc

SEQ ID NO: 508905 - DNA, 16 bp, R. norvegicus
gcttttctgcagaagg

SEQ ID NO: 508906 - DNA, 16 bp, R. norvegicus
gcttttgccagcttta

SEQ ID NO: 508907 - DNA, 16 bp, R. norvegicus
gcttttggcaacatgg

SEQ ID NO: 508908 - DNA, 16 bp, R. norvegicus
gcttttgggataggcc

SEQ ID NO: 508909 - DNA, 16 bp, R. norvegicus
gcttttgtaaagcaaa

SEQ ID NO: 508910 - DNA, 16 bp, R. norvegicus
gcttttgtcagagtat

SEQ ID NO: 508911 - DNA, 16 bp, R. norvegicus
gctttttaaaaatgta

SEQ ID NO: 508912 - DNA, 16 bp, R. norvegicus
gctttttacaaggaga

SEQ ID NO: 508913 - DNA, 16 bp, R. norvegicus
gctttttacatggatt

SEQ ID NO: 508914 - DNA, 16 bp, R. norvegicus
gctttttctcctattg

SEQ ID NO: 508915 - DNA, 16 bp, R. norvegicus
gctttttgccttttac

SEQ ID NO: 508916 - DNA, 16 bp, R. norvegicus
gcttttttttaaaaaa

SEQ ID NO: 508917 - DNA, 16 bp, R. norvegicus
ggaaaaaaagatagca

SEQ ID NO: 508918 - DNA, 16 bp, R. norvegicus
ggaaaaaaagcatttt

SEQ ID NO: 508919 - DNA, 16 bp, R. norvegicus
ggaaaaaaataaacct

SEQ ID NO: 508920 - DNA, 16 bp, R. norvegicus
ggaaaaaaggtagcat

SEQ ID NO: 508921 - DNA, 16 bp, R. norvegicus
ggaaaaacatgggaaa

SEQ ID NO: 508922 - DNA, 16 bp, R. norvegicus
ggaaaaacatttaggt

SEQ ID NO: 508923 - DNA, 43 bp, R. norvegicus
ggaaaaactagggaagcatctggaacacatgggcactggaaaa

SEQ ID NO: 508924 - DNA, 16 bp, R. norvegicus
ggaaaaactggaagaa

SEQ ID NO: 508925 - DNA, 16 bp, R. norvegicus
ggaaaaagatagcatt

SEQ ID NO: 508926 - DNA, 16 bp, R. norvegicus
ggaaaaaggtcaagtt

SEQ ID NO: 508927 - DNA, 16 bp, R. norvegicus
ggaaaaatctgggaag

SEQ ID NO: 508928 - DNA, 16 bp, R. norvegicus
ggaaaacacaaattaa

SEQ ID NO: 508929 - DNA, 16 bp, R. norvegicus
ggaaaacaccagacgc

SEQ ID NO: 508930 - DNA, 16 bp, R. norvegicus
ggaaaacagaggagcc

SEQ ID NO: 508931 - DNA, 16 bp, R. norvegicus
ggaaaacatttcccaa

SEQ ID NO: 508932 - DNA, 16 bp, R. norvegicus
ggaaaaccatcaaagt

SEQ ID NO: 508933 - DNA, 16 bp, R. norvegicus
ggaaaaccatcaccgt

SEQ ID NO: 508934 - DNA, 16 bp, R. norvegicus
ggaaaacctagaaaag

SEQ ID NO: 508935 - DNA, 16 bp, R. norvegicus
ggaaaactggaagaag

SEQ ID NO: 508936 - DNA, 16 bp, R. norvegicus
ggaaaacttcaacaca

SEQ ID NO: 508937 - DNA, 16 bp, R. norvegicus
ggaaaagaagagatca

SEQ ID NO: 508938 - DNA, 16 bp, R. norvegicus
ggaaaagaaggtctag

SEQ ID NO: 508939 - DNA, 16 bp, R. norvegicus
ggaaaagaagtcaaat

SEQ ID NO: 508940 - DNA, 16 bp, R. norvegicus
ggaaaagaatatgatc

SEQ ID NO: 508941 - DNA, 16 bp, R. norvegicus
ggaaaagagactgaag

SEQ ID NO: 508942 - DNA, 16 bp, R. norvegicus
ggaaaagagactgagg

SEQ ID NO: 508943 - DNA, 16 bp, R. norvegicus
ggaaaagatctggata

SEQ ID NO: 508944 - DNA, 16 bp, R. norvegicus
ggaaaagcagcaagca

SEQ ID NO: 508945 - DNA, 16 bp, R. norvegicus
ggaaaagctgaagacc

SEQ ID NO: 508946 - DNA, 16 bp, R. norvegicus
ggaaaaggagaacatg

SEQ ID NO: 508947 - DNA, 16 bp, R. norvegicus
ggaaaagggttccaag

SEQ ID NO: 508948 - DNA, 16 bp, R. norvegicus
ggaaaataccaaaggc

SEQ ID NO: 508949 - DNA, 16 bp, R. norvegicus
ggaaaatatcttcctg

SEQ ID NO: 508950 - DNA, 16 bp, R. norvegicus
ggaaaatatgcaagaa

SEQ ID NO: 508951 - DNA, 16 bp, R. norvegicus
ggaaaatatggaggaa

SEQ ID NO: 508952 - DNA, 16 bp, R. norvegicus
ggaaaatcaagatgga

SEQ ID NO: 508953 - DNA, 16 bp, R. norvegicus
ggaaaatcttcaggaa

SEQ ID NO: 508954 - DNA, 16 bp, R. norvegicus
ggaaaatgaagggggc

SEQ ID NO: 508955 - DNA, 16 bp, R. norvegicus
ggaaaatggaaaaagc

SEQ ID NO: 508956 - DNA, 16 bp, R. norvegicus
ggaaaatggttcagtg

SEQ ID NO: 508957 - DNA, 16 bp, R. norvegicus
ggaaaattccacaagc

SEQ ID NO: 508958 - DNA, 16 bp, R. norvegicus
ggaaaattccagaaag

SEQ ID NO: 508959 - DNA, 16 bp, R. norvegicus
ggaaaatttggctttg

SEQ ID NO: 508960 - DNA, 16 bp, R. norvegicus
ggaaacaaacctcaga

SEQ ID NO: 508961 - DNA, 16 bp, R. norvegicus
ggaaacaaagtcacaa

SEQ ID NO: 508962 - DNA, 16 bp, R. norvegicus
ggaaacaaccgtggat

SEQ ID NO: 508963 - DNA, 16 bp, R. norvegicus
ggaaacacaaaagtca

SEQ ID NO: 508964 - DNA, 16 bp, R. norvegicus
ggaaacacacctcagg

SEQ ID NO: 508965 - DNA, 16 bp, R. norvegicus
ggaaacaccctcacag

SEQ ID NO: 508966 - DNA, 16 bp, R. norvegicus
ggaaacactgtctcaa

SEQ ID NO: 508967 - DNA, 16 bp, R. norvegicus
ggaaacagaaaccaca

SEQ ID NO: 508968 - DNA, 16 bp, R. norvegicus
ggaaacagaaactgaa

SEQ ID NO: 508969 - DNA, 16 bp, R. norvegicus
ggaaacagaaagtgtg

SEQ ID NO: 508970 - DNA, 16 bp, R. norvegicus
ggaaacagaaattaag

SEQ ID NO: 508971 - DNA, 16 bp, R. norvegicus
ggaaacagaaattaca

SEQ ID NO: 508972 - DNA, 16 bp, R. norvegicus
ggaaacagaaattaga

SEQ ID NO: 508973 - DNA, 16 bp, R. norvegicus
ggaaacagaagttaaa

SEQ ID NO: 508974 - DNA, 16 bp, R. norvegicus
ggaaacagaggcaagc

SEQ ID NO: 508975 - DNA, 16 bp, R. norvegicus
ggaaacagcagcagca

SEQ ID NO: 508976 - DNA, 16 bp, R. norvegicus
ggaaacatccatatca

SEQ ID NO: 508977 - DNA, 16 bp, R. norvegicus
ggaaaccaaactctgg

SEQ ID NO: 508978 - DNA, 16 bp, R. norvegicus
ggaaaccaggaaagtg

SEQ ID NO: 508979 - DNA, 16 bp, R. norvegicus
ggaaaccaggaagagg

SEQ ID NO: 508980 - DNA, 16 bp, R. norvegicus
ggaaaccaggaatggg

SEQ ID NO: 508981 - DNA, 16 bp, R. norvegicus
ggaaacctcaaagctc

SEQ ID NO: 508982 - DNA, 16 bp, R. norvegicus
ggaaacggtggcacag

SEQ ID NO: 508983 - DNA, 16 bp, R. norvegicus
ggaaactgaacaacac

SEQ ID NO: 508984 - DNA, 16 bp, R. norvegicus
ggaaactgagactcag

SEQ ID NO: 508985 - DNA, 16 bp, R. norvegicus
ggaaactgaggcagag

SEQ ID NO: 508986 - DNA, 16 bp, R. norvegicus
ggaaactgaggcccag

SEQ ID NO: 508987 - DNA, 16 bp, R. norvegicus
ggaaactgaggcctag

SEQ ID NO: 508988 - DNA, 16 bp, R. norvegicus
ggaaactgagtcccag

SEQ ID NO: 508989 - DNA, 16 bp, R. norvegicus
ggaaactggaaagggg

SEQ ID NO: 508990 - DNA, 16 bp, R. norvegicus
ggaaactttctcatgt

SEQ ID NO: 508991 - DNA, 16 bp, R. norvegicus
ggaaagaaaaagtcaa

SEQ ID NO: 508992 - DNA, 16 bp, R. norvegicus
ggaaagaaaccagatg

SEQ ID NO: 508993 - DNA, 16 bp, R. norvegicus
ggaaagaacaggaatt

SEQ ID NO: 508994 - DNA, 16 bp, R. norvegicus
ggaaagaccacccaga

SEQ ID NO: 508995 - DNA, 16 bp, R. norvegicus
ggaaagagagctcacc

SEQ ID NO: 508996 - DNA, 16 bp, R. norvegicus
ggaaagagatctgctc

SEQ ID NO: 508997 - DNA, 16 bp, R. norvegicus
ggaaagatctcccctg

SEQ ID NO: 508998 - DNA, 16 bp, R. norvegicus
ggaaagatgaagaatt

SEQ ID NO: 508999 - DNA, 16 bp, R. norvegicus
ggaaagatgactcagt

SEQ ID NO: 509000 - DNA, 16 bp, R. norvegicus
ggaaagcaagctgagc

SEQ ID NO: 509001 - DNA, 16 bp, R. norvegicus
ggaaagcagaacacac

SEQ ID NO: 509002 - DNA, 16 bp, R. norvegicus
ggaaagcagactgagc

SEQ ID NO: 509003 - DNA, 16 bp, R. norvegicus
ggaaagcagaggcaag

SEQ ID NO: 509004 - DNA, 16 bp, R. norvegicus
ggaaagcaggctgagc

SEQ ID NO: 509005 - DNA, 16 bp, R. norvegicus
ggaaagcctgggctac

SEQ ID NO: 509006 - DNA, 16 bp, R. norvegicus
ggaaagcttcccagaa

SEQ ID NO: 509007 - DNA, 16 bp, R. norvegicus
ggaaaggaagaagcta

SEQ ID NO: 509008 - DNA, 16 bp, R. norvegicus
ggaaaggaagaattca

SEQ ID NO: 509009 - DNA, 16 bp, R. norvegicus
ggaaaggaagatctgc

SEQ ID NO: 509010 - DNA, 16 bp, R. norvegicus
ggaaaggacatccaga

SEQ ID NO: 509011 - DNA, 16 bp, R. norvegicus
ggaaaggaggaagtca

SEQ ID NO: 509012 - DNA, 16 bp, R. norvegicus
ggaaaggaggtcaaag

SEQ ID NO: 509013 - DNA, 16 bp, R. norvegicus
ggaaaggcagccagtg

SEQ ID NO: 509014 - DNA, 16 bp, R. norvegicus
ggaaaggcagggaata

SEQ ID NO: 509015 - DNA, 16 bp, R. norvegicus
ggaaaggcatggtggc

SEQ ID NO: 509016 - DNA, 16 bp, R. norvegicus
ggaaaggctagaagaa

SEQ ID NO: 509017 - DNA, 16 bp, R. norvegicus
ggaaaggctgaaagaa

SEQ ID NO: 509018 - DNA, 16 bp, R. norvegicus
ggaaagggaagccctg

SEQ ID NO: 509019 - DNA, 16 bp, R. norvegicus
ggaaagggaagctatt

SEQ ID NO: 509020 - DNA, 16 bp, R. norvegicus
ggaaagggaagtcctt

SEQ ID NO: 509021 - DNA, 17 bp, R. norvegicus
ggaaagggaataacact

SEQ ID NO: 509022 - DNA, 16 bp, R. norvegicus
ggaaagggagaagtca

SEQ ID NO: 509023 - DNA, 16 bp, R. norvegicus
ggaaagggatgcctca

SEQ ID NO: 509024 - DNA, 16 bp, R. norvegicus
ggaaagtcagagcagg

SEQ ID NO: 509025 - DNA, 16 bp, R. norvegicus
ggaaagtctggaagaa

SEQ ID NO: 509026 - DNA, 16 bp, R. norvegicus
ggaaagtgatagagga

SEQ ID NO: 509027 - DNA, 16 bp, R. norvegicus
ggaaagtgtataaggc

SEQ ID NO: 509028 - DNA, 16 bp, R. norvegicus
ggaaagtgtgcggtgg

SEQ ID NO: 509029 - DNA, 16 bp, R. norvegicus
ggaaataaatggggca

SEQ ID NO: 509030 - DNA, 17 bp, R. norvegicus
ggaaatactcaagttaa

SEQ ID NO: 509031 - DNA, 16 bp, R. norvegicus
ggaaatattttaattt

SEQ ID NO: 509032 - DNA, 16 bp, R. norvegicus
ggaaatcattctggag

SEQ ID NO: 509033 - DNA, 16 bp, R. norvegicus
ggaaatccaggaccca

SEQ ID NO: 509034 - DNA, 16 bp, R. norvegicus
ggaaatccatcaaggt

SEQ ID NO: 509035 - DNA, 16 bp, R. norvegicus
ggaaatcctcctgcct

SEQ ID NO: 509036 - DNA, 17 bp, R. norvegicus
ggaaatcctgtctagag

SEQ ID NO: 509037 - DNA, 16 bp, R. norvegicus
ggaaatctggaaaggg

SEQ ID NO: 509038 - DNA, 16 bp, R. norvegicus
ggaaatgaacttgggt

SEQ ID NO: 509039 - DNA, 16 bp, R. norvegicus
ggaaatgaagaaatca

SEQ ID NO: 509040 - DNA, 16 bp, R. norvegicus
ggaaatgaaggcacaa

SEQ ID NO: 509041 - DNA, 16 bp, R. norvegicus
ggaaatgacaccttca

SEQ ID NO: 509042 - DNA, 16 bp, R. norvegicus
ggaaatgacacttttc

SEQ ID NO: 509043 - DNA, 16 bp, R. norvegicus
ggaaatgacatctttc

SEQ ID NO: 509044 - DNA, 20 bp, R. norvegicus
ggaaatgcaaatcaaaacac

SEQ ID NO: 509045 - DNA, 16 bp, R. norvegicus
ggaaatgcaaatgaaa

SEQ ID NO: 509046 - DNA, 16 bp, R. norvegicus
ggaaatgcagggacaa

SEQ ID NO: 509047 - DNA, 16 bp, R. norvegicus
ggaaatggaaaatttt

SEQ ID NO: 509048 - DNA, 16 bp, R. norvegicus
ggaaatggaggcaaag

SEQ ID NO: 509049 - DNA, 16 bp, R. norvegicus
ggaaatggaggggacc

SEQ ID NO: 509050 - DNA, 16 bp, R. norvegicus
ggaaatggatggaatt

SEQ ID NO: 509051 - DNA, 16 bp, R. norvegicus
ggaaatggctcagtag

SEQ ID NO: 509052 - DNA, 16 bp, R. norvegicus
ggaaatgtctccatga

SEQ ID NO: 509053 - DNA, 16 bp, R. norvegicus
ggaaattaataaatcc

SEQ ID NO: 509054 - DNA, 16 bp, R. norvegicus
ggaaattgaagatctc

SEQ ID NO: 509055 - DNA, 16 bp, R. norvegicus
ggaaattgggaactta

SEQ ID NO: 509056 - DNA, 16 bp, R. norvegicus
ggaaattttctccagt

SEQ ID NO: 509057 - DNA, 16 bp, R. norvegicus
ggaaattttctttatt

SEQ ID NO: 509058 - DNA, 16 bp, R. norvegicus
ggaaatttttttcagt

SEQ ID NO: 509059 - DNA, 16 bp, R. norvegicus
ggaacaaaaaggccat

SEQ ID NO: 509060 - DNA, 16 bp, R. norvegicus
ggaacaaaattgaaga

SEQ ID NO: 509061 - DNA, 16 bp, R. norvegicus
ggaacaaagaaagaat

SEQ ID NO: 509062 - DNA, 16 bp, R. norvegicus
ggaacaaatgcagaga

SEQ ID NO: 509063 - DNA, 16 bp, R. norvegicus
ggaacaagatgttgaa

SEQ ID NO: 509064 - DNA, 16 bp, R. norvegicus
ggaacactcctccctt

SEQ ID NO: 509065 - DNA, 16 bp, R. norvegicus
ggaacagacagccacc

SEQ ID NO: 509066 - DNA, 16 bp, R. norvegicus
ggaacagcagaagacc

SEQ ID NO: 509067 - DNA, 16 bp, R. norvegicus
ggaacagctgaagagc

SEQ ID NO: 509068 - DNA, 16 bp, R. norvegicus
ggaacaggaagcagag

SEQ ID NO: 509069 - DNA, 16 bp, R. norvegicus
ggaacaggagagatgg

SEQ ID NO: 509070 - DNA, 16 bp, R. norvegicus
ggaacagtctggccag

SEQ ID NO: 509071 - DNA, 16 bp, R. norvegicus
ggaacatggcagtgtc

SEQ ID NO: 509072 - DNA, 16 bp, R. norvegicus
ggaacattgtagaaga

SEQ ID NO: 509073 - DNA, 16 bp, R. norvegicus
ggaaccaaacccaggt

SEQ ID NO: 509074 - DNA, 16 bp, R. norvegicus
ggaaccaaatttgggt

SEQ ID NO: 509075 - DNA, 21 bp, R. norvegicus
ggaaccaacatcgccggtgcc

SEQ ID NO: 509076 - DNA, 16 bp, R. norvegicus
ggaaccagaaggaaac

SEQ ID NO: 509077 - DNA, 16 bp, R. norvegicus
ggaaccaggagaagac

SEQ ID NO: 509078 - DNA, 33 bp, R. norvegicus
ggaacccagatgcccttcaacagaggaatggat

SEQ ID NO: 509079 - DNA, 16 bp, R. norvegicus
ggaacccccattcaga

SEQ ID NO: 509080 - DNA, 16 bp, R. norvegicus
ggaacccctatggaag

SEQ ID NO: 509081 - DNA, 16 bp, R. norvegicus
ggaaccctgactgaga

SEQ ID NO: 509082 - DNA, 16 bp, R. norvegicus
ggaacctcataaaatt

SEQ ID NO: 509083 - DNA, 16 bp, R. norvegicus
ggaacctggaggccgg

SEQ ID NO: 509084 - DNA, 16 bp, R. norvegicus
ggaactatgggaatgt

SEQ ID NO: 509085 - DNA, 16 bp, R. norvegicus
ggaactcaagcaggaa

SEQ ID NO: 509086 - DNA, 16 bp, R. norvegicus
ggaactcaagcaggag

SEQ ID NO: 509087 - DNA, 16 bp, R. norvegicus
ggaactcacatgaaga

SEQ ID NO: 509088 - DNA, 16 bp, R. norvegicus
ggaactcactgaatta

SEQ ID NO: 509089 - DNA, 16 bp, R. norvegicus
ggaactccagttccag

SEQ ID NO: 509090 - DNA, 16 bp, R. norvegicus
ggaactcccacctcct

SEQ ID NO: 509091 - DNA, 16 bp, R. norvegicus
ggaactcctacagctg

SEQ ID NO: 509092 - DNA, 16 bp, R. norvegicus
ggaactcgctatgtag

SEQ ID NO: 509093 - DNA, 16 bp, R. norvegicus
ggaactctcagctctt

SEQ ID NO: 509094 - DNA, 16 bp, R. norvegicus
ggaactctgagtttga

SEQ ID NO: 509095 - DNA, 16 bp, R. norvegicus
ggaactctgggaagaa

SEQ ID NO: 509096 - DNA, 16 bp, R. norvegicus
ggaactgaaaatatca

SEQ ID NO: 509097 - DNA, 16 bp, R. norvegicus
ggaactgaacttacag

SEQ ID NO: 509098 - DNA, 16 bp, R. norvegicus
ggaactgaagaaaagg

SEQ ID NO: 509099 - DNA, 16 bp, R. norvegicus
ggaactgaagcagaaa

SEQ ID NO: 509100 - DNA, 16 bp, R. norvegicus
ggaactgaaggagctg

SEQ ID NO: 509101 - DNA, 16 bp, R. norvegicus
ggaactgaggcatcct

SEQ ID NO: 509102 - DNA, 16 bp, R. norvegicus
ggaactgccactccag

SEQ ID NO: 509103 - DNA, 16 bp, R. norvegicus
ggaactggaaaatacc

SEQ ID NO: 509104 - DNA, 16 bp, R. norvegicus
ggaactggaatcacag

SEQ ID NO: 509105 - DNA, 16 bp, R. norvegicus
ggaactggagaaaatt

SEQ ID NO: 509106 - DNA, 16 bp, R. norvegicus
ggaactggagttacaa

SEQ ID NO: 509107 - DNA, 16 bp, R. norvegicus
ggaactggagttacag

SEQ ID NO: 509108 - DNA, 16 bp, R. norvegicus
ggaactggggtagcca

SEQ ID NO: 509109 - DNA, 16 bp, R. norvegicus
ggaactgggtggtcag

SEQ ID NO: 509110 - DNA, 16 bp, R. norvegicus
ggaactggtgagatgt

SEQ ID NO: 509111 - DNA, 16 bp, R. norvegicus
ggaactggtggaccat

SEQ ID NO: 509112 - DNA, 16 bp, R. norvegicus
ggaactgtgtctgtct

SEQ ID NO: 509113 - DNA, 16 bp, R. norvegicus
ggaactgtttgaaagg

SEQ ID NO: 509114 - DNA, 16 bp, R. norvegicus
ggaacttgaagagtcc

SEQ ID NO: 509115 - DNA, 16 bp, R. norvegicus
ggaacttgccaccaag

SEQ ID NO: 509116 - DNA, 16 bp, R. norvegicus
ggaacttgctatgtaa

SEQ ID NO: 509117 - DNA, 16 bp, R. norvegicus
ggaacttttcttctat

SEQ ID NO: 509118 - DNA, 16 bp, R. norvegicus
ggaagaaaatgtattt

SEQ ID NO: 509119 - DNA, 16 bp, R. norvegicus
ggaagaaagcattttc

SEQ ID NO: 509120 - DNA, 16 bp, R. norvegicus
ggaagaaaggatttgt

SEQ ID NO: 509121 - DNA, 16 bp, R. norvegicus
ggaagaaaggtttatt

SEQ ID NO: 509122 - DNA, 16 bp, R. norvegicus
ggaagaaagtgtttat

SEQ ID NO: 509123 - DNA, 16 bp, R. norvegicus
ggaagaaagtttattt

SEQ ID NO: 509124 - DNA, 16 bp, R. norvegicus
ggaagaaataaatggt

SEQ ID NO: 509125 - DNA, 16 bp, R. norvegicus
ggaagaaatacaggaa

SEQ ID NO: 509126 - DNA, 16 bp, R. norvegicus
ggaagaaatcaaaata

SEQ ID NO: 509127 - DNA, 16 bp, R. norvegicus
ggaagaaatcttcctc

SEQ ID NO: 509128 - DNA, 16 bp, R. norvegicus
ggaagaaattcagaag

SEQ ID NO: 509129 - DNA, 16 bp, R. norvegicus
ggaagaacaacaatac

SEQ ID NO: 509130 - DNA, 16 bp, R. norvegicus
ggaagaacaacaatta

SEQ ID NO: 509131 - DNA, 16 bp, R. norvegicus
ggaagaacaacatcaa

SEQ ID NO: 509132 - DNA, 16 bp, R. norvegicus
ggaagaacagccagag

SEQ ID NO: 509133 - DNA, 16 bp, R. norvegicus
ggaagaacagctggtg

SEQ ID NO: 509134 - DNA, 16 bp, R. norvegicus
ggaagaaccaagatgg

SEQ ID NO: 509135 - DNA, 16 bp, R. norvegicus
ggaagaacctcaaaca

SEQ ID NO: 509136 - DNA, 16 bp, R. norvegicus
ggaagaactgaagaag

SEQ ID NO: 509137 - DNA, 16 bp, R. norvegicus
ggaagaactggaagag

SEQ ID NO: 509138 - DNA, 16 bp, R. norvegicus
ggaagaagaaagattc

SEQ ID NO: 509139 - DNA, 16 bp, R. norvegicus
ggaagaagacaaaata

SEQ ID NO: 509140 - DNA, 16 bp, R. norvegicus
ggaagaagagaacatg

SEQ ID NO: 509141 - DNA, 16 bp, R. norvegicus
ggaagaagaggcaggc

SEQ ID NO: 509142 - DNA, 16 bp, R. norvegicus
ggaagaagcaagcagg

SEQ ID NO: 509143 - DNA, 16 bp, R. norvegicus
ggaagaagctaaggag

SEQ ID NO: 509144 - DNA, 16 bp, R. norvegicus
ggaagaaggaaggctt

SEQ ID NO: 509145 - DNA, 16 bp, R. norvegicus
ggaagaaggcatcaga

SEQ ID NO: 509146 - DNA, 16 bp, R. norvegicus
ggaagaagtcaaagca

SEQ ID NO: 509147 - DNA, 16 bp, R. norvegicus
ggaagaagtgtgtcat

SEQ ID NO: 509148 - DNA, 16 bp, R. norvegicus
ggaagaagttgtggag

SEQ ID NO: 509149 - DNA, 16 bp, R. norvegicus
ggaagaatacatatct

SEQ ID NO: 509150 - DNA, 16 bp, R. norvegicus
ggaagaatctggaaca

SEQ ID NO: 509151 - DNA, 19 bp, R. norvegicus
ggaagaatgcccacataca

SEQ ID NO: 509152 - DNA, 16 bp, R. norvegicus
ggaagaattccaggaa

SEQ ID NO: 509153 - DNA, 16 bp, R. norvegicus
ggaagaattggaggaa

SEQ ID NO: 509154 - DNA, 16 bp, R. norvegicus
ggaagacagaacctca

SEQ ID NO: 509155 - DNA, 16 bp, R. norvegicus
ggaagacaggggcact

SEQ ID NO: 509156 - DNA, 16 bp, R. norvegicus
ggaagacagtctccag

SEQ ID NO: 509157 - DNA, 16 bp, R. norvegicus
ggaagaccttgtctca

SEQ ID NO: 509158 - DNA, 16 bp, R. norvegicus
ggaagactgttgcctc

SEQ ID NO: 509159 - DNA, 16 bp, R. norvegicus
ggaagacttcatgagc

SEQ ID NO: 509160 - DNA, 16 bp, R. norvegicus
ggaagagacagacaga

SEQ ID NO: 509161 - DNA, 16 bp, R. norvegicus
ggaagagaccactaac

SEQ ID NO: 509162 - DNA, 16 bp, R. norvegicus
ggaagagagaatgtca

SEQ ID NO: 509163 - DNA, 16 bp, R. norvegicus
ggaagagagtcagaga

SEQ ID NO: 509164 - DNA, 16 bp, R. norvegicus
ggaagagatctgctct

SEQ ID NO: 509165 - DNA, 16 bp, R. norvegicus
ggaagagattaggagt

SEQ ID NO: 509166 - DNA, 16 bp, R. norvegicus
ggaagagcaagcagtg

SEQ ID NO: 509167 - DNA, 16 bp, R. norvegicus
ggaagagcacacagtg

SEQ ID NO: 509168 - DNA, 16 bp, R. norvegicus
ggaagagcactcagtg

SEQ ID NO: 509169 - DNA, 16 bp, R. norvegicus
ggaagagcacttgcct

SEQ ID NO: 509170 - DNA, 16 bp, R. norvegicus
ggaagagcagacagag

SEQ ID NO: 509171 - DNA, 16 bp, R. norvegicus
ggaagagcagcaagtg

SEQ ID NO: 509172 - DNA, 16 bp, R. norvegicus
ggaagagcagcagtct

SEQ ID NO: 509173 - DNA, 16 bp, R. norvegicus
ggaagagcagccagaa

SEQ ID NO: 509174 - DNA, 16 bp, R. norvegicus
ggaagagcagccggtg

SEQ ID NO: 509175 - DNA, 16 bp, R. norvegicus
ggaagagcagctggta

SEQ ID NO: 509176 - DNA, 16 bp, R. norvegicus
ggaagagcaggaagtg

SEQ ID NO: 509177 - DNA, 16 bp, R. norvegicus
ggaagagcctcaagca

SEQ ID NO: 509178 - DNA, 16 bp, R. norvegicus
ggaagagctagagaaa

SEQ ID NO: 509179 - DNA, 16 bp, R. norvegicus
ggaagagctgagaatg

SEQ ID NO: 509180 - DNA, 16 bp, R. norvegicus
ggaagagctggagaag

SEQ ID NO: 509181 - DNA, 16 bp, R. norvegicus
ggaagagcttcaaaca

SEQ ID NO: 509182 - DNA, 16 bp, R. norvegicus
ggaagaggaagagact

SEQ ID NO: 509183 - DNA, 16 bp, R. norvegicus
ggaagaggaagatctg

SEQ ID NO: 509184 - DNA, 16 bp, R. norvegicus
ggaagaggagaagact

SEQ ID NO: 509185 - DNA, 16 bp, R. norvegicus
ggaagaggaggaaact

SEQ ID NO: 509186 - DNA, 16 bp, R. norvegicus
ggaagaggaggagcct

SEQ ID NO: 509187 - DNA, 16 bp, R. norvegicus
ggaagaggatactgca

SEQ ID NO: 509188 - DNA, 16 bp, R. norvegicus
ggaagaggctgctcag

SEQ ID NO: 509189 - DNA, 16 bp, R. norvegicus
ggaagagtcagttttc

SEQ ID NO: 509190 - DNA, 16 bp, R. norvegicus
ggaagagtccagagca

SEQ ID NO: 509191 - DNA, 16 bp, R. norvegicus
ggaagagttggaagaa

SEQ ID NO: 509192 - DNA, 16 bp, R. norvegicus
ggaagagtttatttca

SEQ ID NO: 509193 - DNA, 16 bp, R. norvegicus
ggaagagtttgaagag

SEQ ID NO: 509194 - DNA, 16 bp, R. norvegicus
ggaagatagataatca

SEQ ID NO: 509195 - DNA, 16 bp, R. norvegicus
ggaagatcaaaatgtg

SEQ ID NO: 509196 - DNA, 16 bp, R. norvegicus
ggaagatcaggagttc

SEQ ID NO: 509197 - DNA, 16 bp, R. norvegicus
ggaagatctcagaaga

SEQ ID NO: 509198 - DNA, 16 bp, R. norvegicus
ggaagatctctgagtt

SEQ ID NO: 509199 - DNA, 16 bp, R. norvegicus
ggaagatgaccttgaa

SEQ ID NO: 509200 - DNA, 16 bp, R. norvegicus
ggaagatgactttgac

SEQ ID NO: 509201 - DNA, 16 bp, R. norvegicus
ggaagatggaaagatc

SEQ ID NO: 509202 - DNA, 16 bp, R. norvegicus
ggaagatggagctgaa

SEQ ID NO: 509203 - DNA, 16 bp, R. norvegicus
ggaagatggctctgtg

SEQ ID NO: 509204 - DNA, 18 bp, R. norvegicus
ggaagatggtcatgtacc

SEQ ID NO: 509205 - DNA, 16 bp, R. norvegicus
ggaagattcccaactt

SEQ ID NO: 509206 - DNA, 16 bp, R. norvegicus
ggaagatttattgtga

SEQ ID NO: 509207 - DNA, 16 bp, R. norvegicus
ggaagcaatgaatagc

SEQ ID NO: 509208 - DNA, 16 bp, R. norvegicus
ggaagcagaagcaggg

SEQ ID NO: 509209 - DNA, 16 bp, R. norvegicus
ggaagcagaagctgat

SEQ ID NO: 509210 - DNA, 16 bp, R. norvegicus
ggaagcagaattcctc

SEQ ID NO: 509211 - DNA, 16 bp, R. norvegicus
ggaagcagagaagctg

SEQ ID NO: 509212 - DNA, 16 bp, R. norvegicus
ggaagcagagatggga

SEQ ID NO: 509213 - DNA, 16 bp, R. norvegicus
ggaagcagaggcagaa

SEQ ID NO: 509214 - DNA, 16 bp, R. norvegicus
ggaagcagagggagat

SEQ ID NO: 509215 - DNA, 16 bp, R. norvegicus
ggaagcaggaagcaga

SEQ ID NO: 509216 - DNA, 18 bp, R. norvegicus
ggaagcaggagctgatgc

SEQ ID NO: 509217 - DNA, 16 bp, R. norvegicus
ggaagcaggaggagca

SEQ ID NO: 509218 - DNA, 16 bp, R. norvegicus
ggaagcagggtggaca

SEQ ID NO: 509219 - DNA, 16 bp, R. norvegicus
ggaagccaatcttctc

SEQ ID NO: 509220 - DNA, 16 bp, R. norvegicus
ggaagccactgcctgg

SEQ ID NO: 509221 - DNA, 16 bp, R. norvegicus
ggaagccagagaacaa

SEQ ID NO: 509222 - DNA, 16 bp, R. norvegicus
ggaagcccagaggcct

SEQ ID NO: 509223 - DNA, 16 bp, R. norvegicus
ggaagcccatatagaa

SEQ ID NO: 509224 - DNA, 16 bp, R. norvegicus
ggaagccctggttgct

SEQ ID NO: 509225 - DNA, 16 bp, R. norvegicus
ggaagcccttggtcat

SEQ ID NO: 509226 - DNA, 16 bp, R. norvegicus
ggaagcccttgttctt

SEQ ID NO: 509227 - DNA, 16 bp, R. norvegicus
ggaagcctcatctcag

SEQ ID NO: 509228 - DNA, 16 bp, R. norvegicus
ggaagcctgtgagctg

SEQ ID NO: 509229 - DNA, 16 bp, R. norvegicus
ggaagccttgtcttgt

SEQ ID NO: 509230 - DNA, 16 bp, R. norvegicus
ggaagcgcaaagccct

SEQ ID NO: 509231 - DNA, 16 bp, R. norvegicus
ggaagctcattggctg

SEQ ID NO: 509232 - DNA, 16 bp, R. norvegicus
ggaagctcccagaaag

SEQ ID NO: 509233 - DNA, 16 bp, R. norvegicus
ggaagctctggtggct

SEQ ID NO: 509234 - DNA, 16 bp, R. norvegicus
ggaagctctggttgat

SEQ ID NO: 509235 - DNA, 16 bp, R. norvegicus
ggaagctgaagaggag

SEQ ID NO: 509236 - DNA, 16 bp, R. norvegicus
ggaagctgaagccttc

SEQ ID NO: 509237 - DNA, 16 bp, R. norvegicus
ggaagctgagagttct

SEQ ID NO: 509238 - DNA, 16 bp, R. norvegicus
ggaagctgaggaagga

SEQ ID NO: 509239 - DNA, 16 bp, R. norvegicus
ggaagctgaggcaggg

SEQ ID NO: 509240 - DNA, 16 bp, R. norvegicus
ggaagctgagggctca

SEQ ID NO: 509241 - DNA, 16 bp, R. norvegicus
ggaagctgctctctgg

SEQ ID NO: 509242 - DNA, 16 bp, R. norvegicus
ggaagctggagcagga

SEQ ID NO: 509243 - DNA, 16 bp, R. norvegicus
ggaagctgggaaaggg

SEQ ID NO: 509244 - DNA, 16 bp, R. norvegicus
ggaagctgggaaggag

SEQ ID NO: 509245 - DNA, 16 bp, R. norvegicus
ggaagctgtcttatga

SEQ ID NO: 509246 - DNA, 16 bp, R. norvegicus
ggaagcttcctccctg

SEQ ID NO: 509247 - DNA, 16 bp, R. norvegicus
ggaaggaaaaagtcaa

SEQ ID NO: 509248 - DNA, 16 bp, R. norvegicus
ggaaggaaacaaaata

SEQ ID NO: 509249 - DNA, 16 bp, R. norvegicus
ggaaggaactcaagca

SEQ ID NO: 509250 - DNA, 16 bp, R. norvegicus
ggaaggaagagattca

SEQ ID NO: 509251 - DNA, 16 bp, R. norvegicus
ggaaggaagcaagcaa

SEQ ID NO: 509252 - DNA, 16 bp, R. norvegicus
ggaaggaaggaaatca

SEQ ID NO: 509253 - DNA, 16 bp, R. norvegicus
ggaaggaaggaagact

SEQ ID NO: 509254 - DNA, 16 bp, R. norvegicus
ggaaggaaggaagatc

SEQ ID NO: 509255 - DNA, 16 bp, R. norvegicus
ggaaggaaggaagcct

SEQ ID NO: 509256 - DNA, 16 bp, R. norvegicus
ggaaggaaggggttta

SEQ ID NO: 509257 - DNA, 16 bp, R. norvegicus
ggaaggactgaagaag

SEQ ID NO: 509258 - DNA, 16 bp, R. norvegicus
ggaaggagaagacctt

SEQ ID NO: 509259 - DNA, 16 bp, R. norvegicus
ggaaggagagaactgg

SEQ ID NO: 509260 - DNA, 16 bp, R. norvegicus
ggaaggagaggaccaa

SEQ ID NO: 509261 - DNA, 16 bp, R. norvegicus
ggaaggagaggcaggt

SEQ ID NO: 509262 - DNA, 16 bp, R. norvegicus
ggaaggagaggccctt

SEQ ID NO: 509263 - DNA, 16 bp, R. norvegicus
ggaaggagatgccaag

SEQ ID NO: 509264 - DNA, 16 bp, R. norvegicus
ggaaggagctggagag

SEQ ID NO: 509265 - DNA, 16 bp, R. norvegicus
ggaaggaggatgctca

SEQ ID NO: 509266 - DNA, 16 bp, R. norvegicus
ggaaggaggctggaga

SEQ ID NO: 509267 - DNA, 16 bp, R. norvegicus
ggaaggatcttgtccc

SEQ ID NO: 509268 - DNA, 16 bp, R. norvegicus
ggaaggatgggcagaa

SEQ ID NO: 509269 - DNA, 16 bp, R. norvegicus
ggaaggatttgtaagg

SEQ ID NO: 509270 - DNA, 16 bp, R. norvegicus
ggaaggcagacagaca

SEQ ID NO: 509271 - DNA, 16 bp, R. norvegicus
ggaaggcagaggagac

SEQ ID NO: 509272 - DNA, 16 bp, R. norvegicus
ggaaggccacacctcc

SEQ ID NO: 509273 - DNA, 16 bp, R. norvegicus
ggaaggcccagaagat

SEQ ID NO: 509274 - DNA, 16 bp, R. norvegicus
ggaaggccccaaggcc

SEQ ID NO: 509275 - DNA, 17 bp, R. norvegicus
ggaaggcgaagccctgg

SEQ ID NO: 509276 - DNA, 16 bp, R. norvegicus
ggaaggctccaaggcc

SEQ ID NO: 509277 - DNA, 16 bp, R. norvegicus
ggaagggactgtgtga

SEQ ID NO: 509278 - DNA, 16 bp, R. norvegicus
ggaagggagggacctg

SEQ ID NO: 509279 - DNA, 16 bp, R. norvegicus
ggaagggcagctgggg

SEQ ID NO: 509280 - DNA, 16 bp, R. norvegicus
ggaagggctggggaga

SEQ ID NO: 509281 - DNA, 16 bp, R. norvegicus
ggaaggggaaaccctg

SEQ ID NO: 509282 - DNA, 16 bp, R. norvegicus
ggaaggggaagccaag

SEQ ID NO: 509283 - DNA, 16 bp, R. norvegicus
ggaaggggaagccttt

SEQ ID NO: 509284 - DNA, 16 bp, R. norvegicus
ggaaggtatctgctga

SEQ ID NO: 509285 - DNA, 16 bp, R. norvegicus
ggaaggtcacccagga

SEQ ID NO: 509286 - DNA, 16 bp, R. norvegicus
ggaaggtttaatatac

SEQ ID NO: 509287 - DNA, 22 bp, R. norvegicus
ggaagtaatagaagccttctag

SEQ ID NO: 509288 - DNA, 16 bp, R. norvegicus
ggaagtcaaagcagga

SEQ ID NO: 509289 - DNA, 16 bp, R. norvegicus
ggaagtcaagacagga

SEQ ID NO: 509290 - DNA, 16 bp, R. norvegicus
ggaagtcaccatgggg

SEQ ID NO: 509291 - DNA, 16 bp, R. norvegicus
ggaagtcagggcagaa

SEQ ID NO: 509292 - DNA, 16 bp, R. norvegicus
ggaagtcagtacagga

SEQ ID NO: 509293 - DNA, 16 bp, R. norvegicus
ggaagtccaagaatcc

SEQ ID NO: 509294 - DNA, 16 bp, R. norvegicus
ggaagtccccagctcc

SEQ ID NO: 509295 - DNA, 16 bp, R. norvegicus
ggaagtctgctgtgag

SEQ ID NO: 509296 - DNA, 16 bp, R. norvegicus
ggaagtgaggcaggag

SEQ ID NO: 509297 - DNA, 16 bp, R. norvegicus
ggaagtgcccaaggat

SEQ ID NO: 509298 - DNA, 16 bp, R. norvegicus
ggaagtgcccagtcct

SEQ ID NO: 509299 - DNA, 16 bp, R. norvegicus
ggaagtggaaccagcc

SEQ ID NO: 509300 - DNA, 16 bp, R. norvegicus
ggaagtggaggcagga

SEQ ID NO: 509301 - DNA, 16 bp, R. norvegicus
ggaagtggcactttta

SEQ ID NO: 509302 - DNA, 16 bp, R. norvegicus
ggaagtggccagtggc

SEQ ID NO: 509303 - DNA, 16 bp, R. norvegicus
ggaagtggctggtcac

SEQ ID NO: 509304 - DNA, 16 bp, R. norvegicus
ggaagtgtctgcctgt

SEQ ID NO: 509305 - DNA, 16 bp, R. norvegicus
ggaagttatcttctat

SEQ ID NO: 509306 - DNA, 16 bp, R. norvegicus
ggaagttctttccatc

SEQ ID NO: 509307 - DNA, 16 bp, R. norvegicus
ggaagtttgggagtgg

SEQ ID NO: 509308 - DNA, 16 bp, R. norvegicus
ggaatagccattacaa

SEQ ID NO: 509309 - DNA, 16 bp, R. norvegicus
ggaatatatgtgtata

SEQ ID NO: 509310 - DNA, 17 bp, R. norvegicus
ggaatattatggtgcca

SEQ ID NO: 509311 - DNA, 16 bp, R. norvegicus
ggaatcagggaaagaa

SEQ ID NO: 509312 - DNA, 16 bp, R. norvegicus
ggaatccaggactcaa

SEQ ID NO: 509313 - DNA, 16 bp, R. norvegicus
ggaatcccagtgagga

SEQ ID NO: 509314 - DNA, 16 bp, R. norvegicus
ggaatccccatccctg

SEQ ID NO: 509315 - DNA, 16 bp, R. norvegicus
ggaatcctatgccctc

SEQ ID NO: 509316 - DNA, 16 bp, R. norvegicus
ggaatcctgaagaaat

SEQ ID NO: 509317 - DNA, 16 bp, R. norvegicus
ggaatcctgaagaagt

SEQ ID NO: 509318 - DNA, 16 bp, R. norvegicus
ggaatctgaaggcagg

SEQ ID NO: 509319 - DNA, 16 bp, R. norvegicus
ggaatctgacatcctc

SEQ ID NO: 509320 - DNA, 16 bp, R. norvegicus
ggaatgcagaggcagg

SEQ ID NO: 509321 - DNA, 16 bp, R. norvegicus
ggaatgccaggacagg

SEQ ID NO: 509322 - DNA, 16 bp, R. norvegicus
ggaatgctgggggctg

SEQ ID NO: 509323 - DNA, 16 bp, R. norvegicus
ggaatggaatgtggtg

SEQ ID NO: 509324 - DNA, 16 bp, R. norvegicus
ggaatggagcagagac

SEQ ID NO: 509325 - DNA, 16 bp, R. norvegicus
ggaatggaggagtgtt

SEQ ID NO: 509326 - DNA, 16 bp, R. norvegicus
ggaatggatatgtgtg

SEQ ID NO: 509327 - DNA, 16 bp, R. norvegicus
ggaatgggatgaagaa

SEQ ID NO: 509328 - DNA, 16 bp, R. norvegicus
ggaatgggatgagaaa

SEQ ID NO: 509329 - DNA, 16 bp, R. norvegicus
ggaatgggggcttatg

SEQ ID NO: 509330 - DNA, 16 bp, R. norvegicus
ggaatggtgtcaccca

SEQ ID NO: 509331 - DNA, 16 bp, R. norvegicus
ggaatgtagttcagtg

SEQ ID NO: 509332 - DNA, 16 bp, R. norvegicus
ggaatgtcagaagcta

SEQ ID NO: 509333 - DNA, 16 bp, R. norvegicus
ggaatgtcggggtggg

SEQ ID NO: 509334 - DNA, 16 bp, R. norvegicus
ggaattaaaaatggat

SEQ ID NO: 509335 - DNA, 16 bp, R. norvegicus
ggaattaaaggcgtgt

SEQ ID NO: 509336 - DNA, 16 bp, R. norvegicus
ggaattacagacaatt

SEQ ID NO: 509337 - DNA, 16 bp, R. norvegicus
ggaattagaaaatatt

SEQ ID NO: 509338 - DNA, 16 bp, R. norvegicus
ggaattatttttgtgt

SEQ ID NO: 509339 - DNA, 16 bp, R. norvegicus
ggaattctactcagct

SEQ ID NO: 509340 - DNA, 16 bp, R. norvegicus
ggaattctgggaagaa

SEQ ID NO: 509341 - DNA, 16 bp, R. norvegicus
ggaattgaaccctgat

SEQ ID NO: 509342 - DNA, 16 bp, R. norvegicus
ggaattgcaaactgat

SEQ ID NO: 509343 - DNA, 16 bp, R. norvegicus
ggaattgccttcagca

SEQ ID NO: 509344 - DNA, 16 bp, R. norvegicus
ggaattggaatgtgtg

SEQ ID NO: 509345 - DNA, 16 bp, R. norvegicus
ggaattggttctctcc

SEQ ID NO: 509346 - DNA, 16 bp, R. norvegicus
ggaatttgggagtgct

SEQ ID NO: 509347 - DNA, 16 bp, R. norvegicus
ggaattttccatgaac

SEQ ID NO: 509348 - DNA, 16 bp, R. norvegicus
ggaatttttgaagtca

SEQ ID NO: 509349 - DNA, 16 bp, R. norvegicus
ggacaaaatggcaagc

SEQ ID NO: 509350 - DNA, 16 bp, R. norvegicus
ggacaaacagactgag

SEQ ID NO: 509351 - DNA, 16 bp, R. norvegicus
ggacaaagacaggaga

SEQ ID NO: 509352 - DNA, 16 bp, R. norvegicus
ggacaaagagtagagc

SEQ ID NO: 509353 - DNA, 16 bp, R. norvegicus
ggacaaagctgctgag

SEQ ID NO: 509354 - DNA, 16 bp, R. norvegicus
ggacaaaggctgcctt

SEQ ID NO: 509355 - DNA, 16 bp, R. norvegicus
ggacaacctgcaggag

SEQ ID NO: 509356 - DNA, 16 bp, R. norvegicus
ggacaaccttgaactc

SEQ ID NO: 509357 - DNA, 16 bp, R. norvegicus
ggacaacttgctggag

SEQ ID NO: 509358 - DNA, 16 bp, R. norvegicus
ggacaactttcagaag

SEQ ID NO: 509359 - DNA, 16 bp, R. norvegicus
ggacaagaaaaggctg

SEQ ID NO: 509360 - DNA, 16 bp, R. norvegicus
ggacaagctgccttgc

SEQ ID NO: 509361 - DNA, 16 bp, R. norvegicus
ggacaatcctgagacc

SEQ ID NO: 509362 - DNA, 16 bp, R. norvegicus
ggacaattgatgctga

SEQ ID NO: 509363 - DNA, 16 bp, R. norvegicus
ggacacaatctctgtg

SEQ ID NO: 509364 - DNA, 16 bp, R. norvegicus
ggacacacagaagcag

SEQ ID NO: 509365 - DNA, 16 bp, R. norvegicus
ggacacaccctctgtg

SEQ ID NO: 509366 - DNA, 16 bp, R. norvegicus
ggacacactctgtgtc

SEQ ID NO: 509367 - DNA, 16 bp, R. norvegicus
ggacacagaaggacca

SEQ ID NO: 509368 - DNA, 16 bp, R. norvegicus
ggacacagagaaaaca

SEQ ID NO: 509369 - DNA, 16 bp, R. norvegicus
ggacacagccagagct

SEQ ID NO: 509370 - DNA, 16 bp, R. norvegicus
ggacacaggaaccaag

SEQ ID NO: 509371 - DNA, 16 bp, R. norvegicus
ggacacagggaagcag

SEQ ID NO: 509372 - DNA, 16 bp, R. norvegicus
ggacacagtggttagg

SEQ ID NO: 509373 - DNA, 16 bp, R. norvegicus
ggacacatcctccact

SEQ ID NO: 509374 - DNA, 16 bp, R. norvegicus
ggacacatcggctaca

SEQ ID NO: 509375 - DNA, 16 bp, R. norvegicus
ggacacattatgcaga

SEQ ID NO: 509376 - DNA, 16 bp, R. norvegicus
ggacacattctccact

SEQ ID NO: 509377 - DNA, 16 bp, R. norvegicus
ggacaccaatggaagg

SEQ ID NO: 509378 - DNA, 16 bp, R. norvegicus
ggacaccatgaaaaga

SEQ ID NO: 509379 - DNA, 16 bp, R. norvegicus
ggacaccctctctgtg

SEQ ID NO: 509380 - DNA, 16 bp, R. norvegicus
ggacactatgaaaaga

SEQ ID NO: 509381 - DNA, 16 bp, R. norvegicus
ggacactgtgctctgg

SEQ ID NO: 509382 - DNA, 16 bp, R. norvegicus
ggacagaaccatggct

SEQ ID NO: 509383 - DNA, 16 bp, R. norvegicus
ggacagaatcaggtat

SEQ ID NO: 509384 - DNA, 16 bp, R. norvegicus
ggacagacggatggac

SEQ ID NO: 509385 - DNA, 16 bp, R. norvegicus
ggacagactctctgtg

SEQ ID NO: 509386 - DNA, 16 bp, R. norvegicus
ggacagactctgaatg

SEQ ID NO: 509387 - DNA, 16 bp, R. norvegicus
ggacagagacaaagag

SEQ ID NO: 509388 - DNA, 16 bp, R. norvegicus
ggacagagacacagag

SEQ ID NO: 509389 - DNA, 16 bp, R. norvegicus
ggacagagacagggac

SEQ ID NO: 509390 - DNA, 16 bp, R. norvegicus
ggacagagcaagagca

SEQ ID NO: 509391 - DNA, 16 bp, R. norvegicus
ggacagagcatggaaa

SEQ ID NO: 509392 - DNA, 16 bp, R. norvegicus
ggacagcaggcacatt

SEQ ID NO: 509393 - DNA, 16 bp, R. norvegicus
ggacagccaaagctat

SEQ ID NO: 509394 - DNA, 16 bp, R. norvegicus
ggacagccaagcttag

SEQ ID NO: 509395 - DNA, 16 bp, R. norvegicus
ggacagccaggactac

SEQ ID NO: 509396 - DNA, 16 bp, R. norvegicus
ggacagccaggactgt

SEQ ID NO: 509397 - DNA, 16 bp, R. norvegicus
ggacagccaggggcta

SEQ ID NO: 509398 - DNA, 16 bp, R. norvegicus
ggacagcccaggctac

SEQ ID NO: 509399 - DNA, 16 bp, R. norvegicus
ggacagcccctgttcc

SEQ ID NO: 509400 - DNA, 16 bp, R. norvegicus
ggacagcctgggctgt

SEQ ID NO: 509401 - DNA, 16 bp, R. norvegicus
ggacagcctgttctac

SEQ ID NO: 509402 - DNA, 16 bp, R. norvegicus
ggacagctcctcacaa

SEQ ID NO: 509403 - DNA, 16 bp, R. norvegicus
ggacagctcctcggac

SEQ ID NO: 509404 - DNA, 16 bp, R. norvegicus
ggacagctgcctagtc

SEQ ID NO: 509405 - DNA, 16 bp, R. norvegicus
ggacagcttgtgggag

SEQ ID NO: 509406 - DNA, 16 bp, R. norvegicus
ggacaggaaggaagtg

SEQ ID NO: 509407 - DNA, 16 bp, R. norvegicus
ggacaggacaggacag

SEQ ID NO: 509408 - DNA, 16 bp, R. norvegicus
ggacaggactcctggg

SEQ ID NO: 509409 - DNA, 16 bp, R. norvegicus
ggacaggagctggatg

SEQ ID NO: 509410 - DNA, 16 bp, R. norvegicus
ggacaggcagaaggga

SEQ ID NO: 509411 - DNA, 16 bp, R. norvegicus
ggacagggaggaaact

SEQ ID NO: 509412 - DNA, 16 bp, R. norvegicus
ggacaggtcatggaaa

SEQ ID NO: 509413 - DNA, 16 bp, R. norvegicus
ggacagtcatggctac

SEQ ID NO: 509414 - DNA, 16 bp, R. norvegicus
ggacagtgacagaggc

SEQ ID NO: 509415 - DNA, 16 bp, R. norvegicus
ggacagtgccttccag

SEQ ID NO: 509416 - DNA, 16 bp, R. norvegicus
ggacagtggccacctc

SEQ ID NO: 509417 - DNA, 16 bp, R. norvegicus
ggacagtgtgtgaaag

SEQ ID NO: 509418 - DNA, 16 bp, R. norvegicus
ggacataatgaaagca

SEQ ID NO: 509419 - DNA, 16 bp, R. norvegicus
ggacataccttcttct

SEQ ID NO: 509420 - DNA, 16 bp, R. norvegicus
ggacatcagggttctt

SEQ ID NO: 509421 - DNA, 16 bp, R. norvegicus
ggacattaagaactca

SEQ ID NO: 509422 - DNA, 16 bp, R. norvegicus
ggacattcttgaaaaa

SEQ ID NO: 509423 - DNA, 16 bp, R. norvegicus
ggacattgaactaccc

SEQ ID NO: 509424 - DNA, 16 bp, R. norvegicus
ggaccaaacctattca

SEQ ID NO: 509425 - DNA, 16 bp, R. norvegicus
ggaccaagaagatgac

SEQ ID NO: 509426 - DNA, 16 bp, R. norvegicus
ggaccaagagttcaaa

SEQ ID NO: 509427 - DNA, 16 bp, R. norvegicus
ggaccaagtaaaactc

SEQ ID NO: 509428 - DNA, 16 bp, R. norvegicus
ggaccaagttttcaaa

SEQ ID NO: 509429 - DNA, 16 bp, R. norvegicus
ggaccaccacagccta

SEQ ID NO: 509430 - DNA, 16 bp, R. norvegicus
ggaccagaaaagaaat

SEQ ID NO: 509431 - DNA, 16 bp, R. norvegicus
ggaccagaaggctgaa

SEQ ID NO: 509432 - DNA, 16 bp, R. norvegicus
ggaccagccagagctc

SEQ ID NO: 509433 - DNA, 16 bp, R. norvegicus
ggaccagccctttcac

SEQ ID NO: 509434 - DNA, 16 bp, R. norvegicus
ggaccaggaaggggat

SEQ ID NO: 509435 - DNA, 16 bp, R. norvegicus
ggaccaggcagaaggg

SEQ ID NO: 509436 - DNA, 16 bp, R. norvegicus
ggaccaggtcagctcc

SEQ ID NO: 509437 - DNA, 16 bp, R. norvegicus
ggaccatgcctgcctg

SEQ ID NO: 509438 - DNA, 16 bp, R. norvegicus
ggacccaactatacca

SEQ ID NO: 509439 - DNA, 16 bp, R. norvegicus
ggacccaaggcttccc

SEQ ID NO: 509440 - DNA, 16 bp, R. norvegicus
ggacccaagggaggat

SEQ ID NO: 509441 - DNA, 16 bp, R. norvegicus
ggacccacagctccag

SEQ ID NO: 509442 - DNA, 16 bp, R. norvegicus
ggacccacatgaggac

SEQ ID NO: 509443 - DNA, 16 bp, R. norvegicus
ggacccacatggtgga

SEQ ID NO: 509444 - DNA, 16 bp, R. norvegicus
ggacccacctgaagac

SEQ ID NO: 509445 - DNA, 16 bp, R. norvegicus
ggacccagaaccagaa

SEQ ID NO: 509446 - DNA, 16 bp, R. norvegicus
ggacccagtccactgt

SEQ ID NO: 509447 - DNA, 17 bp, R. norvegicus
ggaccccttgtgggcct

SEQ ID NO: 509448 - DNA, 16 bp, R. norvegicus
ggaccctcagaagtgc

SEQ ID NO: 509449 - DNA, 16 bp, R. norvegicus
ggaccctgaaagaaac

SEQ ID NO: 509450 - DNA, 16 bp, R. norvegicus
ggaccgcagcagctcc

SEQ ID NO: 509451 - DNA, 16 bp, R. norvegicus
ggaccgcagcagctct

SEQ ID NO: 509452 - DNA, 16 bp, R. norvegicus
ggacctcaatggaaga

SEQ ID NO: 509453 - DNA, 16 bp, R. norvegicus
ggacctcaggaagagt

SEQ ID NO: 509454 - DNA, 16 bp, R. norvegicus
ggacctcatggaggca

SEQ ID NO: 509455 - DNA, 16 bp, R. norvegicus
ggacctccaggaggcc

SEQ ID NO: 509456 - DNA, 16 bp, R. norvegicus
ggacctccccatcaaa

SEQ ID NO: 509457 - DNA, 16 bp, R. norvegicus
ggacctctggaagaag

SEQ ID NO: 509458 - DNA, 16 bp, R. norvegicus
ggacctgaacctgggt

SEQ ID NO: 509459 - DNA, 16 bp, R. norvegicus
ggacctgagttcagac

SEQ ID NO: 509460 - DNA, 16 bp, R. norvegicus
ggacctgagttccatt

SEQ ID NO: 509461 - DNA, 16 bp, R. norvegicus
ggacctgatgtcctct

SEQ ID NO: 509462 - DNA, 16 bp, R. norvegicus
ggacctgctgctgctg

SEQ ID NO: 509463 - DNA, 16 bp, R. norvegicus
ggacctggagaagggg

SEQ ID NO: 509464 - DNA, 16 bp, R. norvegicus
ggacctggagctacag

SEQ ID NO: 509465 - DNA, 16 bp, R. norvegicus
ggacctgggtggaaga

SEQ ID NO: 509466 - DNA, 16 bp, R. norvegicus
ggacctggttctcagt

SEQ ID NO: 509467 - DNA, 16 bp, R. norvegicus
ggacctgtcactggac

SEQ ID NO: 509468 - DNA, 16 bp, R. norvegicus
ggacctgttccttctg

SEQ ID NO: 509469 - DNA, 16 bp, R. norvegicus
ggacggaacccaggac

SEQ ID NO: 509470 - DNA, 16 bp, R. norvegicus
ggacggacagacagac

SEQ ID NO: 509471 - DNA, 16 bp, R. norvegicus
ggacggatggatggat

SEQ ID NO: 509472 - DNA, 17 bp, R. norvegicus
ggacggcctgggtacaa

SEQ ID NO: 509473 - DNA, 16 bp, R. norvegicus
ggactaaagatgtgtg

SEQ ID NO: 509474 - DNA, 16 bp, R. norvegicus
ggactagaagagcttg

SEQ ID NO: 509475 - DNA, 16 bp, R. norvegicus
ggactatatagcaaga

SEQ ID NO: 509476 - DNA, 16 bp, R. norvegicus
ggactatgatctggaa

SEQ ID NO: 509477 - DNA, 16 bp, R. norvegicus
ggactatgcaaagaat

SEQ ID NO: 509478 - DNA, 16 bp, R. norvegicus
ggactcaattccctaa

SEQ ID NO: 509479 - DNA, 16 bp, R. norvegicus
ggactcaggactcaca

SEQ ID NO: 509480 - DNA, 16 bp, R. norvegicus
ggactctaaccctcta

SEQ ID NO: 509481 - DNA, 16 bp, R. norvegicus
ggactctcagctcctt

SEQ ID NO: 509482 - DNA, 16 bp, R. norvegicus
ggactctcccagatgc

SEQ ID NO: 509483 - DNA, 16 bp, R. norvegicus
ggactgaaagagttga

SEQ ID NO: 509484 - DNA, 16 bp, R. norvegicus
ggactgaaatcaacca

SEQ ID NO: 509485 - DNA, 16 bp, R. norvegicus
ggactgaacacaggga

SEQ ID NO: 509486 - DNA, 16 bp, R. norvegicus
ggactgaacttctgaa

SEQ ID NO: 509487 - DNA, 16 bp, R. norvegicus
ggactgaagcatctgc

SEQ ID NO: 509488 - DNA, 16 bp, R. norvegicus
ggactgaaggagctgt

SEQ ID NO: 509489 - DNA, 16 bp, R. norvegicus
ggactgaatctcagaa

SEQ ID NO: 509490 - DNA, 21 bp, R. norvegicus
ggactgacagggacctaaata

SEQ ID NO: 509491 - DNA, 16 bp, R. norvegicus
ggactgacctaggtcc

SEQ ID NO: 509492 - DNA, 16 bp, R. norvegicus
ggactgagcctctgaa

SEQ ID NO: 509493 - DNA, 16 bp, R. norvegicus
ggactgagctggagag

SEQ ID NO: 509494 - DNA, 16 bp, R. norvegicus
ggactgaggagatggc

SEQ ID NO: 509495 - DNA, 16 bp, R. norvegicus
ggactgcccataccct

SEQ ID NO: 509496 - DNA, 16 bp, R. norvegicus
ggactggaaaatatca

SEQ ID NO: 509497 - DNA, 16 bp, R. norvegicus
ggactggactggactg

SEQ ID NO: 509498 - DNA, 16 bp, R. norvegicus
ggactggagaggtagc

SEQ ID NO: 509499 - DNA, 16 bp, R. norvegicus
ggactggaggagctga

SEQ ID NO: 509500 - DNA, 16 bp, R. norvegicus
ggactggaggagtgga

SEQ ID NO: 509501 - DNA, 16 bp, R. norvegicus
ggactggatccccagg

SEQ ID NO: 509502 - DNA, 19 bp, R. norvegicus
ggactgggactcctgcacc

SEQ ID NO: 509503 - DNA, 16 bp, R. norvegicus
ggactgggagatggct

SEQ ID NO: 509504 - DNA, 16 bp, R. norvegicus
ggactgggagcagagg

SEQ ID NO: 509505 - DNA, 16 bp, R. norvegicus
ggactgggtttggacc

SEQ ID NO: 509506 - DNA, 16 bp, R. norvegicus
ggactgtgaacagagt

SEQ ID NO: 509507 - DNA, 16 bp, R. norvegicus
ggactgttctcttcca

SEQ ID NO: 509508 - DNA, 16 bp, R. norvegicus
ggacttaaggcctgct

SEQ ID NO: 509509 - DNA, 16 bp, R. norvegicus
ggacttcaagaaaaac

SEQ ID NO: 509510 - DNA, 16 bp, R. norvegicus
ggacttcaagagagac

SEQ ID NO: 509511 - DNA, 16 bp, R. norvegicus
ggacttccagtggaag

SEQ ID NO: 509512 - DNA, 16 bp, R. norvegicus
ggacttcctgaagctt

SEQ ID NO: 509513 - DNA, 16 bp, R. norvegicus
ggacttcctggatgtt

SEQ ID NO: 509514 - DNA, 16 bp, R. norvegicus
ggacttctgggagagc

SEQ ID NO: 509515 - DNA, 16 bp, R. norvegicus
ggacttgaactctgga

SEQ ID NO: 509516 - DNA, 16 bp, R. norvegicus
ggacttgctgtggtag

SEQ ID NO: 509517 - DNA, 16 bp, R. norvegicus
ggacttggagaagtgg

SEQ ID NO: 509518 - DNA, 16 bp, R. norvegicus
ggactttggtggtatc

SEQ ID NO: 509519 - DNA, 16 bp, R. norvegicus
ggagaaaaccaacttc

SEQ ID NO: 509520 - DNA, 16 bp, R. norvegicus
ggagaaaaccctggag

SEQ ID NO: 509521 - DNA, 16 bp, R. norvegicus
ggagaaaaggtgacca

SEQ ID NO: 509522 - DNA, 16 bp, R. norvegicus
ggagaaaatacagaga

SEQ ID NO: 509523 - DNA, 17 bp, R. norvegicus
ggagaaaatcaacaaga

SEQ ID NO: 509524 - DNA, 16 bp, R. norvegicus
ggagaaaatgtgtcac

SEQ ID NO: 509525 - DNA, 16 bp, R. norvegicus
ggagaaaattcaaaaa

SEQ ID NO: 509526 - DNA, 16 bp, R. norvegicus
ggagaaaatttcatga

SEQ ID NO: 509527 - DNA, 16 bp, R. norvegicus
ggagaaacagctcagt

SEQ ID NO: 509528 - DNA, 16 bp, R. norvegicus
ggagaaactaacagaa

SEQ ID NO: 509529 - DNA, 16 bp, R. norvegicus
ggagaaactgagagaa

SEQ ID NO: 509530 - DNA, 16 bp, R. norvegicus
ggagaaactgaggctg

SEQ ID NO: 509531 - DNA, 16 bp, R. norvegicus
ggagaaagaactgaga

SEQ ID NO: 509532 - DNA, 16 bp, R. norvegicus
ggagaaagaatttatt

SEQ ID NO: 509533 - DNA, 16 bp, R. norvegicus
ggagaaagagtttatt

SEQ ID NO: 509534 - DNA, 16 bp, R. norvegicus
ggagaaagatttattt

SEQ ID NO: 509535 - DNA, 16 bp, R. norvegicus
ggagaaaggaacactc

SEQ ID NO: 509536 - DNA, 16 bp, R. norvegicus
ggagaaaggatgttct

SEQ ID NO: 509537 - DNA, 16 bp, R. norvegicus
ggagaaataagaacac

SEQ ID NO: 509538 - DNA, 16 bp, R. norvegicus
ggagaaatcaccatcc

SEQ ID NO: 509539 - DNA, 16 bp, R. norvegicus
ggagaaatctgagaag

SEQ ID NO: 509540 - DNA, 16 bp, R. norvegicus
ggagaaatgactcagc

SEQ ID NO: 509541 - DNA, 16 bp, R. norvegicus
ggagaaatgccaacac

SEQ ID NO: 509542 - DNA, 16 bp, R. norvegicus
ggagaaatgggctctg

SEQ ID NO: 509543 - DNA, 16 bp, R. norvegicus
ggagaacagcgagcag

SEQ ID NO: 509544 - DNA, 16 bp, R. norvegicus
ggagaacaggcagctg

SEQ ID NO: 509545 - DNA, 16 bp, R. norvegicus
ggagaacattctggaa

SEQ ID NO: 509546 - DNA, 16 bp, R. norvegicus
ggagaactccaggttt

SEQ ID NO: 509547 - DNA, 37 bp, R. norvegicus
ggagaactcgagctccagcgaccagccccacttccac

SEQ ID NO: 509548 - DNA, 16 bp, R. norvegicus
ggagaactctgagaag

SEQ ID NO: 509549 - DNA, 16 bp, R. norvegicus
ggagaactgagctctg

SEQ ID NO: 509550 - DNA, 16 bp, R. norvegicus
ggagaactgggctctg

SEQ ID NO: 509551 - DNA, 16 bp, R. norvegicus
ggagaagaaacacagg

SEQ ID NO: 509552 - DNA, 16 bp, R. norvegicus
ggagaagaaactggga

SEQ ID NO: 509553 - DNA, 16 bp, R. norvegicus
ggagaagagcttgagg

SEQ ID NO: 509554 - DNA, 16 bp, R. norvegicus
ggagaagagtctgagg

SEQ ID NO: 509555 - DNA, 16 bp, R. norvegicus
ggagaagatgtggaga

SEQ ID NO: 509556 - DNA, 16 bp, R. norvegicus
ggagaagcagaggcag

SEQ ID NO: 509557 - DNA, 16 bp, R. norvegicus
ggagaagcagcagaga

SEQ ID NO: 509558 - DNA, 16 bp, R. norvegicus
ggagaagctagagaaa

SEQ ID NO: 509559 - DNA, 16 bp, R. norvegicus
ggagaagctgagagaa

SEQ ID NO: 509560 - DNA, 16 bp, R. norvegicus
ggagaagctgagagtt

SEQ ID NO: 509561 - DNA, 16 bp, R. norvegicus
ggagaagctgaggaag

SEQ ID NO: 509562 - DNA, 16 bp, R. norvegicus
ggagaagctgaggcag

SEQ ID NO: 509563 - DNA, 16 bp, R. norvegicus
ggagaagctgcccaga

SEQ ID NO: 509564 - DNA, 16 bp, R. norvegicus
ggagaagctgtggcag

SEQ ID NO: 509565 - DNA, 16 bp, R. norvegicus
ggagaaggagctgagg

SEQ ID NO: 509566 - DNA, 16 bp, R. norvegicus
ggagaaggcacagcag

SEQ ID NO: 509567 - DNA, 16 bp, R. norvegicus
ggagaaggcatcagat

SEQ ID NO: 509568 - DNA, 16 bp, R. norvegicus
ggagaagggactgaag

SEQ ID NO: 509569 - DNA, 16 bp, R. norvegicus
ggagaaggtgctgaga

SEQ ID NO: 509570 - DNA, 16 bp, R. norvegicus
ggagaaggtgtggcct

SEQ ID NO: 509571 - DNA, 16 bp, R. norvegicus
ggagaaggttctagtg

SEQ ID NO: 509572 - DNA, 16 bp, R. norvegicus
ggagaagtctgagctc

SEQ ID NO: 509573 - DNA, 16 bp, R. norvegicus
ggagaagtgaagatct

SEQ ID NO: 509574 - DNA, 16 bp, R. norvegicus
ggagaagtgtgtcact

SEQ ID NO: 509575 - DNA, 16 bp, R. norvegicus
ggagaatcaggagttc

SEQ ID NO: 509576 - DNA, 16 bp, R. norvegicus
ggagaatggaacctgg

SEQ ID NO: 509577 - DNA, 16 bp, R. norvegicus
ggagaatggcagcatc

SEQ ID NO: 509578 - DNA, 16 bp, R. norvegicus
ggagaatgggcagcct

SEQ ID NO: 509579 - DNA, 16 bp, R. norvegicus
ggagaatgtggagaaa

SEQ ID NO: 509580 - DNA, 16 bp, R. norvegicus
ggagacaaaaccatca

SEQ ID NO: 509581 - DNA, 16 bp, R. norvegicus
ggagacaacccagatg

SEQ ID NO: 509582 - DNA, 16 bp, R. norvegicus
ggagacaagaggatcc

SEQ ID NO: 509583 - DNA, 16 bp, R. norvegicus
ggagacaagcctctgg

SEQ ID NO: 509584 - DNA, 16 bp, R. norvegicus
ggagacacacctcaga

SEQ ID NO: 509585 - DNA, 16 bp, R. norvegicus
ggagacacagacacag

SEQ ID NO: 509586 - DNA, 16 bp, R. norvegicus
ggagacacaggagaga

SEQ ID NO: 509587 - DNA, 16 bp, R. norvegicus
ggagacagaaattaaa

SEQ ID NO: 509588 - DNA, 16 bp, R. norvegicus
ggagacagacagaaag

SEQ ID NO: 509589 - DNA, 16 bp, R. norvegicus
ggagacagacagagac

SEQ ID NO: 509590 - DNA, 16 bp, R. norvegicus
ggagacagagactcca

SEQ ID NO: 509591 - DNA, 16 bp, R. norvegicus
ggagacagagcaggag

SEQ ID NO: 509592 - DNA, 16 bp, R. norvegicus
ggagacagagccccaa

SEQ ID NO: 509593 - DNA, 16 bp, R. norvegicus
ggagacagaggcagac

SEQ ID NO: 509594 - DNA, 16 bp, R. norvegicus
ggagacagaggcagag

SEQ ID NO: 509595 - DNA, 16 bp, R. norvegicus
ggagacagaggctgga

SEQ ID NO: 509596 - DNA, 16 bp, R. norvegicus
ggagacagatcaactt

SEQ ID NO: 509597 - DNA, 16 bp, R. norvegicus
ggagacataaaaacag

SEQ ID NO: 509598 - DNA, 17 bp, R. norvegicus
ggagacataactaaaga

SEQ ID NO: 509599 - DNA, 16 bp, R. norvegicus
ggagacatcctgcctc

SEQ ID NO: 509600 - DNA, 16 bp, R. norvegicus
ggagacatggagacag

SEQ ID NO: 509601 - DNA, 16 bp, R. norvegicus
ggagacatgggtccct

SEQ ID NO: 509602 - DNA, 16 bp, R. norvegicus
ggagaccagaagaagg

SEQ ID NO: 509603 - DNA, 16 bp, R. norvegicus
ggagaccagaagagag

SEQ ID NO: 509604 - DNA, 16 bp, R. norvegicus
ggagaccagaagggtc

SEQ ID NO: 509605 - DNA, 16 bp, R. norvegicus
ggagaccagagaacaa

SEQ ID NO: 509606 - DNA, 16 bp, R. norvegicus
ggagaccagcagcaag

SEQ ID NO: 509607 - DNA, 16 bp, R. norvegicus
ggagaccaggctgagt

SEQ ID NO: 509608 - DNA, 16 bp, R. norvegicus
ggagaccagttttctc

SEQ ID NO: 509609 - DNA, 16 bp, R. norvegicus
ggagacccctgagaca

SEQ ID NO: 509610 - DNA, 16 bp, R. norvegicus
ggagaccctcctccta

SEQ ID NO: 509611 - DNA, 20 bp, R. norvegicus
ggagacctacaggaacctca

SEQ ID NO: 509612 - DNA, 16 bp, R. norvegicus
ggagacctcccatgga

SEQ ID NO: 509613 - DNA, 16 bp, R. norvegicus
ggagacctggccctgg

SEQ ID NO: 509614 - DNA, 17 bp, R. norvegicus
ggagacctttaaggact

SEQ ID NO: 509615 - DNA, 16 bp, R. norvegicus
ggagactactgggaca

SEQ ID NO: 509616 - DNA, 16 bp, R. norvegicus
ggagactccaagatgt

SEQ ID NO: 509617 - DNA, 16 bp, R. norvegicus
ggagactgagacagga

SEQ ID NO: 509618 - DNA, 16 bp, R. norvegicus
ggagactgcagctaca

SEQ ID NO: 509619 - DNA, 16 bp, R. norvegicus
ggagactgctggtctt

SEQ ID NO: 509620 - DNA, 16 bp, R. norvegicus
ggagactggaaaggag

SEQ ID NO: 509621 - DNA, 16 bp, R. norvegicus
ggagactggagactgg

SEQ ID NO: 509622 - DNA, 16 bp, R. norvegicus
ggagactggagagatg

SEQ ID NO: 509623 - DNA, 16 bp, R. norvegicus
ggagactggaggaggc

SEQ ID NO: 509624 - DNA, 16 bp, R. norvegicus
ggagactggctcctct

SEQ ID NO: 509625 - DNA, 16 bp, R. norvegicus
ggagactgggggagtt

SEQ ID NO: 509626 - DNA, 16 bp, R. norvegicus
ggagagaaacagaatg

SEQ ID NO: 509627 - DNA, 16 bp, R. norvegicus
ggagagaaagaaggct

SEQ ID NO: 509628 - DNA, 16 bp, R. norvegicus
ggagagaaagaaggtt

SEQ ID NO: 509629 - DNA, 16 bp, R. norvegicus
ggagagaaagttgaag

SEQ ID NO: 509630 - DNA, 16 bp, R. norvegicus
ggagagaaccctggag

SEQ ID NO: 509631 - DNA, 16 bp, R. norvegicus
ggagagaagagagtca

SEQ ID NO: 509632 - DNA, 16 bp, R. norvegicus
ggagagaagcacagag

SEQ ID NO: 509633 - DNA, 16 bp, R. norvegicus
ggagagaagctgctga

SEQ ID NO: 509634 - DNA, 16 bp, R. norvegicus
ggagagaagtgactcc

SEQ ID NO: 509635 - DNA, 16 bp, R. norvegicus
ggagagaagtgacttc

SEQ ID NO: 509636 - DNA, 16 bp, R. norvegicus
ggagagaatgggcagc

SEQ ID NO: 509637 - DNA, 16 bp, R. norvegicus
ggagagacacagagag

SEQ ID NO: 509638 - DNA, 16 bp, R. norvegicus
ggagagacagttcagc

SEQ ID NO: 509639 - DNA, 16 bp, R. norvegicus
ggagagactggagaga

SEQ ID NO: 509640 - DNA, 16 bp, R. norvegicus
ggagagactggagctg

SEQ ID NO: 509641 - DNA, 16 bp, R. norvegicus
ggagagactgggaagg

SEQ ID NO: 509642 - DNA, 17 bp, R. norvegicus
ggagagagacagagaca

SEQ ID NO: 509643 - DNA, 16 bp, R. norvegicus
ggagagagactgaagg

SEQ ID NO: 509644 - DNA, 16 bp, R. norvegicus
ggagagagagctggac

SEQ ID NO: 509645 - DNA, 16 bp, R. norvegicus
ggagagagctgaactc

SEQ ID NO: 509646 - DNA, 16 bp, R. norvegicus
ggagagatacagagag

SEQ ID NO: 509647 - DNA, 16 bp, R. norvegicus
ggagagatgatggctc

SEQ ID NO: 509648 - DNA, 16 bp, R. norvegicus
ggagagatggcacagg

SEQ ID NO: 509649 - DNA, 16 bp, R. norvegicus
ggagagatggctcagc

SEQ ID NO: 509650 - DNA, 16 bp, R. norvegicus
ggagagcacagccaga

SEQ ID NO: 509651 - DNA, 16 bp, R. norvegicus
ggagagcactgactcc

SEQ ID NO: 509652 - DNA, 16 bp, R. norvegicus
ggagagcagagagcag

SEQ ID NO: 509653 - DNA, 16 bp, R. norvegicus
ggagagcagccagtgc

SEQ ID NO: 509654 - DNA, 16 bp, R. norvegicus
ggagagcctgtctcaa

SEQ ID NO: 509655 - DNA, 16 bp, R. norvegicus
ggagagcggggtggat

SEQ ID NO: 509656 - DNA, 16 bp, R. norvegicus
ggagagctcaaaagca

SEQ ID NO: 509657 - DNA, 16 bp, R. norvegicus
ggagagctgctggtct

SEQ ID NO: 509658 - DNA, 16 bp, R. norvegicus
ggagagctggccctgc

SEQ ID NO: 509659 - DNA, 16 bp, R. norvegicus
ggagagctggctctgc

SEQ ID NO: 509660 - DNA, 16 bp, R. norvegicus
ggagagctgggaggtg

SEQ ID NO: 509661 - DNA, 16 bp, R. norvegicus
ggagagcttttctaat

SEQ ID NO: 509662 - DNA, 16 bp, R. norvegicus
ggagaggaaactggaa

SEQ ID NO: 509663 - DNA, 41 bp, R. norvegicus
ggagaggacttaggcagtaccccacgagcaaacttgagcct

SEQ ID NO: 509664 - DNA, 16 bp, R. norvegicus
ggagaggagactggaa

SEQ ID NO: 509665 - DNA, 16 bp, R. norvegicus
ggagaggagctgagag

SEQ ID NO: 509666 - DNA, 16 bp, R. norvegicus
ggagaggatgtgccta

SEQ ID NO: 509667 - DNA, 16 bp, R. norvegicus
ggagaggccatccaga

SEQ ID NO: 509668 - DNA, 16 bp, R. norvegicus
ggagaggcccctggtc

SEQ ID NO: 509669 - DNA, 16 bp, R. norvegicus
ggagaggcctttggtc

SEQ ID NO: 509670 - DNA, 16 bp, R. norvegicus
ggagaggctggagaga

SEQ ID NO: 509671 - DNA, 16 bp, R. norvegicus
ggagaggctggagagg

SEQ ID NO: 509672 - DNA, 16 bp, R. norvegicus
ggagaggctgggagag

SEQ ID NO: 509673 - DNA, 16 bp, R. norvegicus
ggagagggagatccgg

SEQ ID NO: 509674 - DNA, 16 bp, R. norvegicus
ggagaggtggcttggt

SEQ ID NO: 509675 - DNA, 16 bp, R. norvegicus
ggagaggtggttctgg

SEQ ID NO: 509676 - DNA, 16 bp, R. norvegicus
ggagagtgggccctgc

SEQ ID NO: 509677 - DNA, 17 bp, R. norvegicus
ggagagtgtgtccaaat

SEQ ID NO: 509678 - DNA, 16 bp, R. norvegicus
ggagagttgggctctg

SEQ ID NO: 509679 - DNA, 16 bp, R. norvegicus
ggagagttggttcagc

SEQ ID NO: 509680 - DNA, 16 bp, R. norvegicus
ggagataaacttgaag

SEQ ID NO: 509681 - DNA, 16 bp, R. norvegicus
ggagataaagcttttg

SEQ ID NO: 509682 - DNA, 16 bp, R. norvegicus
ggagataagagtggat

SEQ ID NO: 509683 - DNA, 16 bp, R. norvegicus
ggagatacagagacaa

SEQ ID NO: 509684 - DNA, 16 bp, R. norvegicus
ggagatagaaaaacta

SEQ ID NO: 509685 - DNA, 16 bp, R. norvegicus
ggagatagaggatgag

SEQ ID NO: 509686 - DNA, 16 bp, R. norvegicus
ggagatcaaagggaaa

SEQ ID NO: 509687 - DNA, 16 bp, R. norvegicus
ggagatcagctctctc

SEQ ID NO: 509688 - DNA, 16 bp, R. norvegicus
ggagatccagccttgg

SEQ ID NO: 509689 - DNA, 16 bp, R. norvegicus
ggagatccctggagct

SEQ ID NO: 509690 - DNA, 16 bp, R. norvegicus
ggagatctccagacag

SEQ ID NO: 509691 - DNA, 16 bp, R. norvegicus
ggagatctctgaattc

SEQ ID NO: 509692 - DNA, 16 bp, R. norvegicus
ggagatctctgagttc

SEQ ID NO: 509693 - DNA, 16 bp, R. norvegicus
ggagatctgcgccgct

SEQ ID NO: 509694 - DNA, 16 bp, R. norvegicus
ggagatgaaggcaaga

SEQ ID NO: 509695 - DNA, 16 bp, R. norvegicus
ggagatgatgtgccta

SEQ ID NO: 509696 - DNA, 16 bp, R. norvegicus
ggagatgcctttgcag

SEQ ID NO: 509697 - DNA, 16 bp, R. norvegicus
ggagatgcttttgtgg

SEQ ID NO: 509698 - DNA, 16 bp, R. norvegicus
ggagatggagacagag

SEQ ID NO: 509699 - DNA, 16 bp, R. norvegicus
ggagatggagacagga

SEQ ID NO: 509700 - DNA, 16 bp, R. norvegicus
ggagatggagcctgaa

SEQ ID NO: 509701 - DNA, 16 bp, R. norvegicus
ggagatggagctgaga

SEQ ID NO: 509702 - DNA, 16 bp, R. norvegicus
ggagatggaggcagaa

SEQ ID NO: 509703 - DNA, 16 bp, R. norvegicus
ggagatggctcagctg

SEQ ID NO: 509704 - DNA, 16 bp, R. norvegicus
ggagatggctctgtgg

SEQ ID NO: 509705 - DNA, 16 bp, R. norvegicus
ggagatggcttagtag

SEQ ID NO: 509706 - DNA, 16 bp, R. norvegicus
ggagatgggctttgag

SEQ ID NO: 509707 - DNA, 17 bp, R. norvegicus
ggagattccacctcaca

SEQ ID NO: 509708 - DNA, 49 bp, R. norvegicus
ggagatttcaacacaccactctcatcaatggacagatcatggaaacaga

SEQ ID NO: 509709 - DNA, 16 bp, R. norvegicus
ggagcaaaaactgaag

SEQ ID NO: 509710 - DNA, 16 bp, R. norvegicus
ggagcaagagcaggag

SEQ ID NO: 509711 - DNA, 16 bp, R. norvegicus
ggagcaagaggacaga

SEQ ID NO: 509712 - DNA, 16 bp, R. norvegicus
ggagcaagccagtgaa

SEQ ID NO: 509713 - DNA, 16 bp, R. norvegicus
ggagcaccacccacag

SEQ ID NO: 509714 - DNA, 16 bp, R. norvegicus
ggagcacccatataga

SEQ ID NO: 509715 - DNA, 16 bp, R. norvegicus
ggagcaccctcagaga

SEQ ID NO: 509716 - DNA, 16 bp, R. norvegicus
ggagcactggctgttc

SEQ ID NO: 509717 - DNA, 16 bp, R. norvegicus
ggagcagaaacagaag

SEQ ID NO: 509718 - DNA, 16 bp, R. norvegicus
ggagcagaagaattgg

SEQ ID NO: 509719 - DNA, 16 bp, R. norvegicus
ggagcagaagactcca

SEQ ID NO: 509720 - DNA, 16 bp, R. norvegicus
ggagcagaaggagcag

SEQ ID NO: 509721 - DNA, 16 bp, R. norvegicus
ggagcagaaggcagga

SEQ ID NO: 509722 - DNA, 16 bp, R. norvegicus
ggagcagacactgagg

SEQ ID NO: 509723 - DNA, 16 bp, R. norvegicus
ggagcagagacagaca

SEQ ID NO: 509724 - DNA, 16 bp, R. norvegicus
ggagcagagactgatg

SEQ ID NO: 509725 - DNA, 16 bp, R. norvegicus
ggagcagagactggag

SEQ ID NO: 509726 - DNA, 16 bp, R. norvegicus
ggagcagagagctgtg

SEQ ID NO: 509727 - DNA, 16 bp, R. norvegicus
ggagcagagccagcag

SEQ ID NO: 509728 - DNA, 16 bp, R. norvegicus
ggagcagaggcagaaa

SEQ ID NO: 509729 - DNA, 16 bp, R. norvegicus
ggagcagagggctgct

SEQ ID NO: 509730 - DNA, 16 bp, R. norvegicus
ggagcagatcaaggct

SEQ ID NO: 509731 - DNA, 16 bp, R. norvegicus
ggagcagatcttcctg

SEQ ID NO: 509732 - DNA, 16 bp, R. norvegicus
ggagcagatgtagaga

SEQ ID NO: 509733 - DNA, 16 bp, R. norvegicus
ggagcagattccacat

SEQ ID NO: 509734 - DNA, 16 bp, R. norvegicus
ggagcagctgcagcag

SEQ ID NO: 509735 - DNA, 16 bp, R. norvegicus
ggagcaggagaggtgg

SEQ ID NO: 509736 - DNA, 16 bp, R. norvegicus
ggagcaggagcaagag

SEQ ID NO: 509737 - DNA, 16 bp, R. norvegicus
ggagcaggagctgatg

SEQ ID NO: 509738 - DNA, 16 bp, R. norvegicus
ggagcaggaggagctg

SEQ ID NO: 509739 - DNA, 16 bp, R. norvegicus
ggagcaggaggcagct

SEQ ID NO: 509740 - DNA, 16 bp, R. norvegicus
ggagcaggctttgagg

SEQ ID NO: 509741 - DNA, 16 bp, R. norvegicus
ggagcagggctgaggc

SEQ ID NO: 509742 - DNA, 16 bp, R. norvegicus
ggagcaggtgtccttg

SEQ ID NO: 509743 - DNA, 16 bp, R. norvegicus
ggagcagtagctggga

SEQ ID NO: 509744 - DNA, 16 bp, R. norvegicus
ggagcagtctggcctg

SEQ ID NO: 509745 - DNA, 16 bp, R. norvegicus
ggagcatacacaggct

SEQ ID NO: 509746 - DNA, 16 bp, R. norvegicus
ggagcatcttcaaaga

SEQ ID NO: 509747 - DNA, 16 bp, R. norvegicus
ggagcatgtctctttg

SEQ ID NO: 509748 - DNA, 16 bp, R. norvegicus
ggagcatgtgtttttg

SEQ ID NO: 509749 - DNA, 16 bp, R. norvegicus
ggagccaaggcaggaa

SEQ ID NO: 509750 - DNA, 16 bp, R. norvegicus
ggagccacagggcagc

SEQ ID NO: 509751 - DNA, 16 bp, R. norvegicus
ggagccaccagggctg

SEQ ID NO: 509752 - DNA, 16 bp, R. norvegicus
ggagccacccctgggc

SEQ ID NO: 509753 - DNA, 16 bp, R. norvegicus
ggagccaccctactct

SEQ ID NO: 509754 - DNA, 16 bp, R. norvegicus
ggagccagaagagggc

SEQ ID NO: 509755 - DNA, 16 bp, R. norvegicus
ggagccagaggcagag

SEQ ID NO: 509756 - DNA, 16 bp, R. norvegicus
ggagccaggcatggtg

SEQ ID NO: 509757 - DNA, 16 bp, R. norvegicus
ggagccagggagccag

SEQ ID NO: 509758 - DNA, 16 bp, R. norvegicus
ggagccagggagtgga

SEQ ID NO: 509759 - DNA, 16 bp, R. norvegicus
ggagcccaactcccag

SEQ ID NO: 509760 - DNA, 16 bp, R. norvegicus
ggagcccaagctggcc

SEQ ID NO: 509761 - DNA, 16 bp, R. norvegicus
ggagcccaattttccc

SEQ ID NO: 509762 - DNA, 16 bp, R. norvegicus
ggagcccacagaggcc

SEQ ID NO: 509763 - DNA, 16 bp, R. norvegicus
ggagcccagaaaatca

SEQ ID NO: 509764 - DNA, 16 bp, R. norvegicus
ggagcccccgcaccac

SEQ ID NO: 509765 - DNA, 16 bp, R. norvegicus
ggagcccctgtgcact

SEQ ID NO: 509766 - DNA, 16 bp, R. norvegicus
ggagccctcaggacat

SEQ ID NO: 509767 - DNA, 16 bp, R. norvegicus
ggagccctgggagccc

SEQ ID NO: 509768 - DNA, 16 bp, R. norvegicus
ggagccgcccagctgt

SEQ ID NO: 509769 - DNA, 16 bp, R. norvegicus
ggagcctcgtggagga

SEQ ID NO: 509770 - DNA, 16 bp, R. norvegicus
ggagcctctggaagag

SEQ ID NO: 509771 - DNA, 16 bp, R. norvegicus
ggagcctgaggcagaa

SEQ ID NO: 509772 - DNA, 16 bp, R. norvegicus
ggagcctgaggcagct

SEQ ID NO: 509773 - DNA, 16 bp, R. norvegicus
ggagcctgaggcagga

SEQ ID NO: 509774 - DNA, 16 bp, R. norvegicus
ggagcctgatgtggat

SEQ ID NO: 509775 - DNA, 16 bp, R. norvegicus
ggagcctgggtcctct

SEQ ID NO: 509776 - DNA, 16 bp, R. norvegicus
ggagcctgtgtgtgtg

SEQ ID NO: 509777 - DNA, 16 bp, R. norvegicus
ggagccttgctagagg

SEQ ID NO: 509778 - DNA, 16 bp, R. norvegicus
ggagctagagagacag

SEQ ID NO: 509779 - DNA, 16 bp, R. norvegicus
ggagctatattaaagg

SEQ ID NO: 509780 - DNA, 16 bp, R. norvegicus
ggagctatcctggcct

SEQ ID NO: 509781 - DNA, 16 bp, R. norvegicus
ggagctcaaggccagc

SEQ ID NO: 509782 - DNA, 16 bp, R. norvegicus
ggagctcaccagtttg

SEQ ID NO: 509783 - DNA, 16 bp, R. norvegicus
ggagctcactggctag

SEQ ID NO: 509784 - DNA, 16 bp, R. norvegicus
ggagctcagaggacag

SEQ ID NO: 509785 - DNA, 16 bp, R. norvegicus
ggagctcatggaggca

SEQ ID NO: 509786 - DNA, 16 bp, R. norvegicus
ggagctccggttggtt

SEQ ID NO: 509787 - DNA, 16 bp, R. norvegicus
ggagctcctgctgtgc

SEQ ID NO: 509788 - DNA, 16 bp, R. norvegicus
ggagctcctggaactg

SEQ ID NO: 509789 - DNA, 16 bp, R. norvegicus
ggagctctgggagatc

SEQ ID NO: 509790 - DNA, 16 bp, R. norvegicus
ggagctctgggagttc

SEQ ID NO: 509791 - DNA, 16 bp, R. norvegicus
ggagctctggggaggt

SEQ ID NO: 509792 - DNA, 16 bp, R. norvegicus
ggagctctgggtgggg

SEQ ID NO: 509793 - DNA, 16 bp, R. norvegicus
ggagctgaagcagagg

SEQ ID NO: 509794 - DNA, 16 bp, R. norvegicus
ggagctgaagcaggag

SEQ ID NO: 509795 - DNA, 16 bp, R. norvegicus
ggagctgaagggactt

SEQ ID NO: 509796 - DNA, 16 bp, R. norvegicus
ggagctgaaggggagg

SEQ ID NO: 509797 - DNA, 16 bp, R. norvegicus
ggagctgaaggggctg

SEQ ID NO: 509798 - DNA, 16 bp, R. norvegicus
ggagctgaaggggttg

SEQ ID NO: 509799 - DNA, 16 bp, R. norvegicus
ggagctgaatcctgtg

SEQ ID NO: 509800 - DNA, 16 bp, R. norvegicus
ggagctgaggacggaa

SEQ ID NO: 509801 - DNA, 16 bp, R. norvegicus
ggagctgaggagatgg

SEQ ID NO: 509802 - DNA, 16 bp, R. norvegicus
ggagctgaggaggagg

SEQ ID NO: 509803 - DNA, 16 bp, R. norvegicus
ggagctgaggcaggag

SEQ ID NO: 509804 - DNA, 16 bp, R. norvegicus
ggagctgatgcagaag

SEQ ID NO: 509805 - DNA, 16 bp, R. norvegicus
ggagctgatgcaggag

SEQ ID NO: 509806 - DNA, 16 bp, R. norvegicus
ggagctgatggagagg

SEQ ID NO: 509807 - DNA, 16 bp, R. norvegicus
ggagctggaacagcag

SEQ ID NO: 509808 - DNA, 16 bp, R. norvegicus
ggagctggagaaggag

SEQ ID NO: 509809 - DNA, 16 bp, R. norvegicus
ggagctggagaagtgg

SEQ ID NO: 509810 - DNA, 16 bp, R. norvegicus
ggagctggagacacag

SEQ ID NO: 509811 - DNA, 16 bp, R. norvegicus
ggagctggagaccaaa

SEQ ID NO: 509812 - DNA, 16 bp, R. norvegicus
ggagctggagagagag

SEQ ID NO: 509813 - DNA, 16 bp, R. norvegicus
ggagctggagatgtgg

SEQ ID NO: 509814 - DNA, 16 bp, R. norvegicus
ggagctggagctggag

SEQ ID NO: 509815 - DNA, 16 bp, R. norvegicus
ggagctggagctgggg

SEQ ID NO: 509816 - DNA, 16 bp, R. norvegicus
ggagctggaggagctg

SEQ ID NO: 509817 - DNA, 16 bp, R. norvegicus
ggagctggctctggag

SEQ ID NO: 509818 - DNA, 16 bp, R. norvegicus
ggagctggggacagaa

SEQ ID NO: 509819 - DNA, 16 bp, R. norvegicus
ggagctggggacccag

SEQ ID NO: 509820 - DNA, 16 bp, R. norvegicus
ggagctggggagatga

SEQ ID NO: 509821 - DNA, 16 bp, R. norvegicus
ggagctggggagctgg

SEQ ID NO: 509822 - DNA, 16 bp, R. norvegicus
ggagctggggatcaaa

SEQ ID NO: 509823 - DNA, 16 bp, R. norvegicus
ggagctggtgcagaag

SEQ ID NO: 509824 - DNA, 16 bp, R. norvegicus
ggagctgtctgaggag

SEQ ID NO: 509825 - DNA, 16 bp, R. norvegicus
ggagctgtgagtgagg

SEQ ID NO: 509826 - DNA, 16 bp, R. norvegicus
ggagctgtgggacagg

SEQ ID NO: 509827 - DNA, 16 bp, R. norvegicus
ggagctgtgggcctgg

SEQ ID NO: 509828 - DNA, 16 bp, R. norvegicus
ggagctgtggttggtt

SEQ ID NO: 509829 - DNA, 16 bp, R. norvegicus
ggagctgtgtgaccag

SEQ ID NO: 509830 - DNA, 16 bp, R. norvegicus
ggagcttatataggga

SEQ ID NO: 509831 - DNA, 16 bp, R. norvegicus
ggagcttgagcatagg

SEQ ID NO: 509832 - DNA, 16 bp, R. norvegicus
ggagcttgcaacccct

SEQ ID NO: 509833 - DNA, 16 bp, R. norvegicus
ggaggaaaaaaaaatc

SEQ ID NO: 509834 - DNA, 16 bp, R. norvegicus
ggaggaaaaggtttat

SEQ ID NO: 509835 - DNA, 16 bp, R. norvegicus
ggaggaaacagatgaa

SEQ ID NO: 509836 - DNA, 16 bp, R. norvegicus
ggaggaaagcatttat

SEQ ID NO: 509837 - DNA, 16 bp, R. norvegicus
ggaggaaagcgtttat

SEQ ID NO: 509838 - DNA, 16 bp, R. norvegicus
ggaggaaaggccatcc

SEQ ID NO: 509839 - DNA, 16 bp, R. norvegicus
ggaggaaagggttcat

SEQ ID NO: 509840 - DNA, 16 bp, R. norvegicus
ggaggaaagggtttat

SEQ ID NO: 509841 - DNA, 16 bp, R. norvegicus
ggaggaaatggacaaa

SEQ ID NO: 509842 - DNA, 16 bp, R. norvegicus
ggaggaactgggaggg

SEQ ID NO: 509843 - DNA, 16 bp, R. norvegicus
ggaggaagagaccaag

SEQ ID NO: 509844 - DNA, 16 bp, R. norvegicus
ggaggaagatgatgat

SEQ ID NO: 509845 - DNA, 16 bp, R. norvegicus
ggaggaagctgaagag

SEQ ID NO: 509846 - DNA, 16 bp, R. norvegicus
ggaggaagctgaggaa

SEQ ID NO: 509847 - DNA, 16 bp, R. norvegicus
ggaggaaggaatgctg

SEQ ID NO: 509848 - DNA, 16 bp, R. norvegicus
ggaggaaggcagcttt

SEQ ID NO: 509849 - DNA, 16 bp, R. norvegicus
ggaggaagggctggag

SEQ ID NO: 509850 - DNA, 16 bp, R. norvegicus
ggaggaaggggaaact

SEQ ID NO: 509851 - DNA, 16 bp, R. norvegicus
ggaggaagttaggtca

SEQ ID NO: 509852 - DNA, 16 bp, R. norvegicus
ggaggaagttctgtct

SEQ ID NO: 509853 - DNA, 16 bp, R. norvegicus
ggaggaatcagagaaa

SEQ ID NO: 509854 - DNA, 16 bp, R. norvegicus
ggaggaatgctgcttc

SEQ ID NO: 509855 - DNA, 16 bp, R. norvegicus
ggaggaatgggatgtg

SEQ ID NO: 509856 - DNA, 16 bp, R. norvegicus
ggaggaatttaagaaa

SEQ ID NO: 509857 - DNA, 16 bp, R. norvegicus
ggaggacaagcccttg

SEQ ID NO: 509858 - DNA, 16 bp, R. norvegicus
ggaggacagcctgggc

SEQ ID NO: 509859 - DNA, 16 bp, R. norvegicus
ggaggaccaacagtct

SEQ ID NO: 509860 - DNA, 16 bp, R. norvegicus
ggaggaccagcagact

SEQ ID NO: 509861 - DNA, 16 bp, R. norvegicus
ggaggacctgactctg

SEQ ID NO: 509862 - DNA, 16 bp, R. norvegicus
ggaggacctgagtttg

SEQ ID NO: 509863 - DNA, 17 bp, R. norvegicus
ggaggacggtgtagggt

SEQ ID NO: 509864 - DNA, 16 bp, R. norvegicus
ggaggactctctagaa

SEQ ID NO: 509865 - DNA, 16 bp, R. norvegicus
ggaggactgggaggag

SEQ ID NO: 509866 - DNA, 16 bp, R. norvegicus
ggaggactttaagaaa

SEQ ID NO: 509867 - DNA, 16 bp, R. norvegicus
ggaggactttttggga

SEQ ID NO: 509868 - DNA, 16 bp, R. norvegicus
ggaggagaaactgcag

SEQ ID NO: 509869 - DNA, 16 bp, R. norvegicus
ggaggagaaactgtgg

SEQ ID NO: 509870 - DNA, 16 bp, R. norvegicus
ggaggagaaccccttg

SEQ ID NO: 509871 - DNA, 16 bp, R. norvegicus
ggaggagaagccattg

SEQ ID NO: 509872 - DNA, 16 bp, R. norvegicus
ggaggagaagcccatg

SEQ ID NO: 509873 - DNA, 16 bp, R. norvegicus
ggaggagaatcccttg

SEQ ID NO: 509874 - DNA, 16 bp, R. norvegicus
ggaggagactggagaa

SEQ ID NO: 509875 - DNA, 16 bp, R. norvegicus
ggaggagactggagga

SEQ ID NO: 509876 - DNA, 16 bp, R. norvegicus
ggaggagactggggag

SEQ ID NO: 509877 - DNA, 16 bp, R. norvegicus
ggaggagaggccctgg

SEQ ID NO: 509878 - DNA, 16 bp, R. norvegicus
ggaggagaggcccttc

SEQ ID NO: 509879 - DNA, 16 bp, R. norvegicus
ggaggagaggctgcag

SEQ ID NO: 509880 - DNA, 16 bp, R. norvegicus
ggaggagcacaagaag

SEQ ID NO: 509881 - DNA, 16 bp, R. norvegicus
ggaggagcactctcat

SEQ ID NO: 509882 - DNA, 16 bp, R. norvegicus
ggaggagcactgctta

SEQ ID NO: 509883 - DNA, 16 bp, R. norvegicus
ggaggagcagagagcc

SEQ ID NO: 509884 - DNA, 16 bp, R. norvegicus
ggaggagcagccagtg

SEQ ID NO: 509885 - DNA, 16 bp, R. norvegicus
ggaggagcaggaacat

SEQ ID NO: 509886 - DNA, 16 bp, R. norvegicus
ggaggagcaggagttc

SEQ ID NO: 509887 - DNA, 16 bp, R. norvegicus
ggaggagccaagagtt

SEQ ID NO: 509888 - DNA, 16 bp, R. norvegicus
ggaggagccacagcag

SEQ ID NO: 509889 - DNA, 16 bp, R. norvegicus
ggaggagcctctgggg

SEQ ID NO: 509890 - DNA, 16 bp, R. norvegicus
ggaggagcgctgctta

SEQ ID NO: 509891 - DNA, 16 bp, R. norvegicus
ggaggagctagagaaa

SEQ ID NO: 509892 - DNA, 16 bp, R. norvegicus
ggaggagctgagcgtt

SEQ ID NO: 509893 - DNA, 16 bp, R. norvegicus
ggaggagctgaggagg

SEQ ID NO: 509894 - DNA, 16 bp, R. norvegicus
ggaggagctgctgcag

SEQ ID NO: 509895 - DNA, 16 bp, R. norvegicus
ggaggagctggagaaa

SEQ ID NO: 509896 - DNA, 16 bp, R. norvegicus
ggaggagctggagaag

SEQ ID NO: 509897 - DNA, 16 bp, R. norvegicus
ggaggagctggagaga

SEQ ID NO: 509898 - DNA, 16 bp, R. norvegicus
ggaggagctggaggag

SEQ ID NO: 509899 - DNA, 16 bp, R. norvegicus
ggaggagctggaggga

SEQ ID NO: 509900 - DNA, 16 bp, R. norvegicus
ggaggaggaagtggcc

SEQ ID NO: 509901 - DNA, 16 bp, R. norvegicus
ggaggaggaagtggct

SEQ ID NO: 509902 - DNA, 16 bp, R. norvegicus
ggaggaggagaaactg

SEQ ID NO: 509903 - DNA, 16 bp, R. norvegicus
ggaggaggaggaacac

SEQ ID NO: 509904 - DNA, 16 bp, R. norvegicus
ggaggaggaggaagct

SEQ ID NO: 509905 - DNA, 16 bp, R. norvegicus
ggaggaggaggaagtc

SEQ ID NO: 509906 - DNA, 16 bp, R. norvegicus
ggaggaggaggaccac

SEQ ID NO: 509907 - DNA, 16 bp, R. norvegicus
ggaggaggaggagact

SEQ ID NO: 509908 - DNA, 16 bp, R. norvegicus
ggaggaggaggagcct

SEQ ID NO: 509909 - DNA, 16 bp, R. norvegicus
ggaggaggaggagctt

SEQ ID NO: 509910 - DNA, 16 bp, R. norvegicus
ggaggaggatgaccct

SEQ ID NO: 509911 - DNA, 16 bp, R. norvegicus
ggaggaggatggttca

SEQ ID NO: 509912 - DNA, 16 bp, R. norvegicus
ggaggaggcagagaca

SEQ ID NO: 509913 - DNA, 16 bp, R. norvegicus
ggaggaggcagagctg

SEQ ID NO: 509914 - DNA, 17 bp, R. norvegicus
ggaggaggctgaggagg

SEQ ID NO: 509915 - DNA, 16 bp, R. norvegicus
ggaggaggctggagtg

SEQ ID NO: 509916 - DNA, 16 bp, R. norvegicus
ggaggagggcagcaat

SEQ ID NO: 509917 - DNA, 16 bp, R. norvegicus
ggaggagtagaggcag

SEQ ID NO: 509918 - DNA, 16 bp, R. norvegicus
ggaggagtgtacctct

SEQ ID NO: 509919 - DNA, 16 bp, R. norvegicus
ggaggagtgtccctct

SEQ ID NO: 509920 - DNA, 16 bp, R. norvegicus
ggaggagttagagaaa

SEQ ID NO: 509921 - DNA, 16 bp, R. norvegicus
ggaggagttgaaggca

SEQ ID NO: 509922 - DNA, 16 bp, R. norvegicus
ggaggagttgcacaag

SEQ ID NO: 509923 - DNA, 16 bp, R. norvegicus
ggaggagttggagaaa

SEQ ID NO: 509924 - DNA, 16 bp, R. norvegicus
ggaggatcactgtgag

SEQ ID NO: 509925 - DNA, 16 bp, R. norvegicus
ggaggatccctgggac

SEQ ID NO: 509926 - DNA, 16 bp, R. norvegicus
ggaggatgaggagttc

SEQ ID NO: 509927 - DNA, 16 bp, R. norvegicus
ggaggatgcctttgat

SEQ ID NO: 509928 - DNA, 16 bp, R. norvegicus
ggaggcaaaaggatca

SEQ ID NO: 509929 - DNA, 16 bp, R. norvegicus
ggaggcaaaccaggaa

SEQ ID NO: 509930 - DNA, 16 bp, R. norvegicus
ggaggcaaagacagga

SEQ ID NO: 509931 - DNA, 16 bp, R. norvegicus
ggaggcaagggcaggc

SEQ ID NO: 509932 - DNA, 16 bp, R. norvegicus
ggaggcactcagagct

SEQ ID NO: 509933 - DNA, 16 bp, R. norvegicus
ggaggcagaaagaatg

SEQ ID NO: 509934 - DNA, 16 bp, R. norvegicus
ggaggcagaaagatca

SEQ ID NO: 509935 - DNA, 16 bp, R. norvegicus
ggaggcagaagaaagc

SEQ ID NO: 509936 - DNA, 16 bp, R. norvegicus
ggaggcagaagaatca

SEQ ID NO: 509937 - DNA, 16 bp, R. norvegicus
ggaggcagaagcagtt

SEQ ID NO: 509938 - DNA, 16 bp, R. norvegicus
ggaggcagaagctggc

SEQ ID NO: 509939 - DNA, 16 bp, R. norvegicus
ggaggcagaattcctc

SEQ ID NO: 509940 - DNA, 16 bp, R. norvegicus
ggaggcagacaggaag

SEQ ID NO: 509941 - DNA, 16 bp, R. norvegicus
ggaggcagacaggcag

SEQ ID NO: 509942 - DNA, 16 bp, R. norvegicus
ggaggcagagaccaga

SEQ ID NO: 509943 - DNA, 16 bp, R. norvegicus
ggaggcagagagacca

SEQ ID NO: 509944 - DNA, 16 bp, R. norvegicus
ggaggcagagatgggc

SEQ ID NO: 509945 - DNA, 16 bp, R. norvegicus
ggaggcagaggcaaga

SEQ ID NO: 509946 - DNA, 16 bp, R. norvegicus
ggaggcagaggcagaa

SEQ ID NO: 509947 - DNA, 16 bp, R. norvegicus
ggaggcagaggccagc

SEQ ID NO: 509948 - DNA, 16 bp, R. norvegicus
ggaggcagaggctgac

SEQ ID NO: 509949 - DNA, 16 bp, R. norvegicus
ggaggcagaggctggt

SEQ ID NO: 509950 - DNA, 16 bp, R. norvegicus
ggaggcaggaggctgg

SEQ ID NO: 509951 - DNA, 16 bp, R. norvegicus
ggaggcaggggcagac

SEQ ID NO: 509952 - DNA, 16 bp, R. norvegicus
ggaggcatggaggagt

SEQ ID NO: 509953 - DNA, 16 bp, R. norvegicus
ggaggcatttcctcag

SEQ ID NO: 509954 - DNA, 16 bp, R. norvegicus
ggaggccaaagcagga

SEQ ID NO: 509955 - DNA, 16 bp, R. norvegicus
ggaggccaacctgggc

SEQ ID NO: 509956 - DNA, 16 bp, R. norvegicus
ggaggccaaggcagaa

SEQ ID NO: 509957 - DNA, 16 bp, R. norvegicus
ggaggccagaagaagg

SEQ ID NO: 509958 - DNA, 16 bp, R. norvegicus
ggaggccagagcagga

SEQ ID NO: 509959 - DNA, 16 bp, R. norvegicus
ggaggccagggagtgg

SEQ ID NO: 509960 - DNA, 16 bp, R. norvegicus
ggaggccagggcagga

SEQ ID NO: 509961 - DNA, 16 bp, R. norvegicus
ggaggccatggaggag

SEQ ID NO: 509962 - DNA, 16 bp, R. norvegicus
ggaggcccttggtggg

SEQ ID NO: 509963 - DNA, 16 bp, R. norvegicus
ggaggccgaggcaggc

SEQ ID NO: 509964 - DNA, 16 bp, R. norvegicus
ggaggcctcacctcag

SEQ ID NO: 509965 - DNA, 16 bp, R. norvegicus
ggaggctcacaactgc

SEQ ID NO: 509966 - DNA, 16 bp, R. norvegicus
ggaggctccttcctct

SEQ ID NO: 509967 - DNA, 16 bp, R. norvegicus
ggaggctctaaggcct

SEQ ID NO: 509968 - DNA, 16 bp, R. norvegicus
ggaggctgaaggagga

SEQ ID NO: 509969 - DNA, 16 bp, R. norvegicus
ggaggctgagaaagga

SEQ ID NO: 509970 - DNA, 16 bp, R. norvegicus
ggaggctgagccagga

SEQ ID NO: 509971 - DNA, 16 bp, R. norvegicus
ggaggctgaggaaaga

SEQ ID NO: 509972 - DNA, 16 bp, R. norvegicus
ggaggctgaggagagg

SEQ ID NO: 509973 - DNA, 16 bp, R. norvegicus
ggaggctgaggcaagg

SEQ ID NO: 509974 - DNA, 16 bp, R. norvegicus
ggaggctgaggctgag

SEQ ID NO: 509975 - DNA, 16 bp, R. norvegicus
ggaggctgagtcagga

SEQ ID NO: 509976 - DNA, 16 bp, R. norvegicus
ggaggctggaaagatg

SEQ ID NO: 509977 - DNA, 16 bp, R. norvegicus
ggaggctggagaggtg

SEQ ID NO: 509978 - DNA, 16 bp, R. norvegicus
ggaggctggagcagga

SEQ ID NO: 509979 - DNA, 16 bp, R. norvegicus
ggaggctgtagaggcc

SEQ ID NO: 509980 - DNA, 16 bp, R. norvegicus
ggaggctttgataaaa

SEQ ID NO: 509981 - DNA, 16 bp, R. norvegicus
ggagggaaaaccggga

SEQ ID NO: 509982 - DNA, 16 bp, R. norvegicus
ggagggaactggaaaa

SEQ ID NO: 509983 - DNA, 16 bp, R. norvegicus
ggagggacccctggct

SEQ ID NO: 509984 - DNA, 16 bp, R. norvegicus
ggagggacctgtgtgg

SEQ ID NO: 509985 - DNA, 16 bp, R. norvegicus
ggagggactgaaggag

SEQ ID NO: 509986 - DNA, 16 bp, R. norvegicus
ggagggacttggaagg

SEQ ID NO: 509987 - DNA, 16 bp, R. norvegicus
ggagggagagcagctt

SEQ ID NO: 509988 - DNA, 16 bp, R. norvegicus
ggagggagatcctcga

SEQ ID NO: 509989 - DNA, 16 bp, R. norvegicus
ggagggagcatggagg

SEQ ID NO: 509990 - DNA, 16 bp, R. norvegicus
ggagggaggacatcag

SEQ ID NO: 509991 - DNA, 16 bp, R. norvegicus
ggagggatgcctcagc

SEQ ID NO: 509992 - DNA, 16 bp, R. norvegicus
ggagggcccagcccag

SEQ ID NO: 509993 - DNA, 20 bp, R. norvegicus
ggagggcccaggagcagcag

SEQ ID NO: 509994 - DNA, 16 bp, R. norvegicus
ggagggcttcaagaaa

SEQ ID NO: 509995 - DNA, 16 bp, R. norvegicus
ggaggggaaactgtgg

SEQ ID NO: 509996 - DNA, 16 bp, R. norvegicus
ggaggggaaccccata

SEQ ID NO: 509997 - DNA, 16 bp, R. norvegicus
ggaggggaagctcttg

SEQ ID NO: 509998 - DNA, 16 bp, R. norvegicus
ggaggggacatggagg

SEQ ID NO: 509999 - DNA, 16 bp, R. norvegicus
ggaggggagactggga

SEQ ID NO: 510000 - DNA, 16 bp, R. norvegicus
ggaggggaggctgcag

SEQ ID NO: 510001 - DNA, 16 bp, R. norvegicus
ggaggggcaggctctg

SEQ ID NO: 510002 - DNA, 16 bp, R. norvegicus
ggaggggctgaaggag

SEQ ID NO: 510003 - DNA, 16 bp, R. norvegicus
ggaggggctgggaaga

SEQ ID NO: 510004 - DNA, 16 bp, R. norvegicus
ggagggggaacaccat

SEQ ID NO: 510005 - DNA, 16 bp, R. norvegicus
ggagggggaagccctg

SEQ ID NO: 510006 - DNA, 16 bp, R. norvegicus
ggagggtgaggcagga

SEQ ID NO: 510007 - DNA, 16 bp, R. norvegicus
ggagggtggaccagga

SEQ ID NO: 510008 - DNA, 16 bp, R. norvegicus
ggaggtagaaacagaa

SEQ ID NO: 510009 - DNA, 16 bp, R. norvegicus
ggaggtcagaggacca

SEQ ID NO: 510010 - DNA, 16 bp, R. norvegicus
ggaggtcctccaacag

SEQ ID NO: 510011 - DNA, 16 bp, R. norvegicus
ggaggtctggtggagt

SEQ ID NO: 510012 - DNA, 16 bp, R. norvegicus
ggaggtcttcaagaaa

SEQ ID NO: 510013 - DNA, 16 bp, R. norvegicus
ggaggtgagctttgag

SEQ ID NO: 510014 - DNA, 16 bp, R. norvegicus
ggaggtggaagcaaga

SEQ ID NO: 510015 - DNA, 16 bp, R. norvegicus
ggaggtggagccttgt

SEQ ID NO: 510016 - DNA, 16 bp, R. norvegicus
ggaggtggaggcaggc

SEQ ID NO: 510017 - DNA, 16 bp, R. norvegicus
ggaggtggaggctgga

SEQ ID NO: 510018 - DNA, 16 bp, R. norvegicus
ggaggtggccaaggtc

SEQ ID NO: 510019 - DNA, 16 bp, R. norvegicus
ggaggtgggagctgat

SEQ ID NO: 510020 - DNA, 16 bp, R. norvegicus
ggaggtgggcagtgag

SEQ ID NO: 510021 - DNA, 16 bp, R. norvegicus
ggaggtgggctttaag

SEQ ID NO: 510022 - DNA, 16 bp, R. norvegicus
ggaggtgtggccttgt

SEQ ID NO: 510023 - DNA, 21 bp, R. norvegicus
ggagtaggcttatatttcact

SEQ ID NO: 510024 - DNA, 16 bp, R. norvegicus
ggagtcacaacccaca

SEQ ID NO: 510025 - DNA, 16 bp, R. norvegicus
ggagtcagttctgtcc

SEQ ID NO: 510026 - DNA, 16 bp, R. norvegicus
ggagtcattttcttca

SEQ ID NO: 510027 - DNA, 16 bp, R. norvegicus
ggagtccaaggtcatc

SEQ ID NO: 510028 - DNA, 16 bp, R. norvegicus
ggagtctaaattcttg

SEQ ID NO: 510029 - DNA, 16 bp, R. norvegicus
ggagtctactttcttg

SEQ ID NO: 510030 - DNA, 16 bp, R. norvegicus
ggagtgacactatttg

SEQ ID NO: 510031 - DNA, 16 bp, R. norvegicus
ggagtgcaccaccatg

SEQ ID NO: 510032 - DNA, 16 bp, R. norvegicus
ggagtggaatagctgg

SEQ ID NO: 510033 - DNA, 16 bp, R. norvegicus
ggagtggactttgaga

SEQ ID NO: 510034 - DNA, 16 bp, R. norvegicus
ggagtggatccaacag

SEQ ID NO: 510035 - DNA, 16 bp, R. norvegicus
ggagtggctctgtttg

SEQ ID NO: 510036 - DNA, 16 bp, R. norvegicus
ggagtgggagcattca

SEQ ID NO: 510037 - DNA, 16 bp, R. norvegicus
ggagtgggcttcaaga

SEQ ID NO: 510038 - DNA, 16 bp, R. norvegicus
ggagtggtaaagctgg

SEQ ID NO: 510039 - DNA, 16 bp, R. norvegicus
ggagtgtttcccttcc

SEQ ID NO: 510040 - DNA, 16 bp, R. norvegicus
ggagttacaggtggtc

SEQ ID NO: 510041 - DNA, 16 bp, R. norvegicus
ggagttagaaaaagga

SEQ ID NO: 510042 - DNA, 16 bp, R. norvegicus
ggagttgatgcagaag

SEQ ID NO: 510043 - DNA, 16 bp, R. norvegicus
ggagttggagttacag

SEQ ID NO: 510044 - DNA, 16 bp, R. norvegicus
ggagtttgaggccagc

SEQ ID NO: 510045 - DNA, 16 bp, R. norvegicus
ggagtttgcaacacca

SEQ ID NO: 510046 - DNA, 16 bp, R. norvegicus
ggagtttgccctgctg

SEQ ID NO: 510047 - DNA, 48 bp, R. norvegicus
ggagtttgggtctgccgggaggacaggtttcttagaaggctctgattt

SEQ ID NO: 510048 - DNA, 16 bp, R. norvegicus
ggagtttggtgtctgc

SEQ ID NO: 510049 - DNA, 16 bp, R. norvegicus
ggataaaacacacaca

SEQ ID NO: 510050 - DNA, 16 bp, R. norvegicus
ggataaagaaaatatg

SEQ ID NO: 510051 - DNA, 16 bp, R. norvegicus
ggataacttgcaggag

SEQ ID NO: 510052 - DNA, 16 bp, R. norvegicus
ggataaggagttcaag

SEQ ID NO: 510053 - DNA, 16 bp, R. norvegicus
ggataatgtctctgtg

SEQ ID NO: 510054 - DNA, 16 bp, R. norvegicus
ggatacaaataagaaa

SEQ ID NO: 510055 - DNA, 16 bp, R. norvegicus
ggatacacagagaaac

SEQ ID NO: 510056 - DNA, 16 bp, R. norvegicus
ggatacacattcttct

SEQ ID NO: 510057 - DNA, 16 bp, R. norvegicus
ggatacagaaaatgtt

SEQ ID NO: 510058 - DNA, 16 bp, R. norvegicus
ggatacagagagctgt

SEQ ID NO: 510059 - DNA, 16 bp, R. norvegicus
ggatacagattggaaa

SEQ ID NO: 510060 - DNA, 16 bp, R. norvegicus
ggatacaggaacctag

SEQ ID NO: 510061 - DNA, 16 bp, R. norvegicus
ggatacccagggggcc

SEQ ID NO: 510062 - DNA, 16 bp, R. norvegicus
ggatactgtaacctgg

SEQ ID NO: 510063 - DNA, 16 bp, R. norvegicus
ggatagatttctatag

SEQ ID NO: 510064 - DNA, 16 bp, R. norvegicus
ggatagtgaaaactac

SEQ ID NO: 510065 - DNA, 31 bp, R. norvegicus
ggatagtgattccccctgaagtccttttatt

SEQ ID NO: 510066 - DNA, 16 bp, R. norvegicus
ggatataaaatgaact

SEQ ID NO: 510067 - DNA, 16 bp, R. norvegicus
ggatatagaacctgaa

SEQ ID NO: 510068 - DNA, 16 bp, R. norvegicus
ggatatagctcagtgg

SEQ ID NO: 510069 - DNA, 16 bp, R. norvegicus
ggatatagcttagtgg

SEQ ID NO: 510070 - DNA, 16 bp, R. norvegicus
ggatatgcatggtatg

SEQ ID NO: 510071 - DNA, 16 bp, R. norvegicus
ggatatggaaaactat

SEQ ID NO: 510072 - DNA, 16 bp, R. norvegicus
ggatatggaaacaaag

SEQ ID NO: 510073 - DNA, 16 bp, R. norvegicus
ggatattgaacaatgc

SEQ ID NO: 510074 - DNA, 16 bp, R. norvegicus
ggatattttatttact

SEQ ID NO: 510075 - DNA, 16 bp, R. norvegicus
ggatattttctgtatt

SEQ ID NO: 510076 - DNA, 16 bp, R. norvegicus
ggatcaaactcaggtt

SEQ ID NO: 510077 - DNA, 16 bp, R. norvegicus
ggatcaaagacctcta

SEQ ID NO: 510078 - DNA, 16 bp, R. norvegicus
ggatcaagaacctcaa

SEQ ID NO: 510079 - DNA, 16 bp, R. norvegicus
ggatcacagacctcca

SEQ ID NO: 510080 - DNA, 16 bp, R. norvegicus
ggatcacagagacagc

SEQ ID NO: 510081 - DNA, 16 bp, R. norvegicus
ggatcacaggcatgtg

SEQ ID NO: 510082 - DNA, 16 bp, R. norvegicus
ggatcacatatcagat

SEQ ID NO: 510083 - DNA, 16 bp, R. norvegicus
ggatcaccaaccagac

SEQ ID NO: 510084 - DNA, 16 bp, R. norvegicus
ggatcactgtgagttt

SEQ ID NO: 510085 - DNA, 16 bp, R. norvegicus
ggatcacttaaatata

SEQ ID NO: 510086 - DNA, 16 bp, R. norvegicus
ggatcagaaattttga

SEQ ID NO: 510087 - DNA, 26 bp, R. norvegicus
ggatccacaggcagttcaatgtccaa

SEQ ID NO: 510088 - DNA, 16 bp, R. norvegicus
ggatccacatggtgga

SEQ ID NO: 510089 - DNA, 16 bp, R. norvegicus
ggatccagatcttgag

SEQ ID NO: 510090 - DNA, 16 bp, R. norvegicus
ggatccagcattttgt

SEQ ID NO: 510091 - DNA, 16 bp, R. norvegicus
ggatccatctgtctct

SEQ ID NO: 510092 - DNA, 16 bp, R. norvegicus
ggatcccaaggtggag

SEQ ID NO: 510093 - DNA, 17 bp, R. norvegicus
ggatcccattacagatg

SEQ ID NO: 510094 - DNA, 16 bp, R. norvegicus
ggatccccaggtgtgg

SEQ ID NO: 510095 - DNA, 16 bp, R. norvegicus
ggatcccccagtgcag

SEQ ID NO: 510096 - DNA, 16 bp, R. norvegicus
ggatcccctggaactg

SEQ ID NO: 510097 - DNA, 16 bp, R. norvegicus
ggatccctgaagctca

SEQ ID NO: 510098 - DNA, 16 bp, R. norvegicus
ggatccctgagctcag

SEQ ID NO: 510099 - DNA, 16 bp, R. norvegicus
ggatccctgaggctgg

SEQ ID NO: 510100 - DNA, 16 bp, R. norvegicus
ggatccgggcctttcc

SEQ ID NO: 510101 - DNA, 16 bp, R. norvegicus
ggatcctcagaaccca

SEQ ID NO: 510102 - DNA, 16 bp, R. norvegicus
ggatcctctccctgac

SEQ ID NO: 510103 - DNA, 16 bp, R. norvegicus
ggatcctctgggactg

SEQ ID NO: 510104 - DNA, 16 bp, R. norvegicus
ggatcctgtttttgca

SEQ ID NO: 510105 - DNA, 16 bp, R. norvegicus
ggatccttgtcaacag

SEQ ID NO: 510106 - DNA, 16 bp, R. norvegicus
ggatctctgagttctg

SEQ ID NO: 510107 - DNA, 16 bp, R. norvegicus
ggatctctgagtttga

SEQ ID NO: 510108 - DNA, 16 bp, R. norvegicus
ggatctgaacacaggt

SEQ ID NO: 510109 - DNA, 16 bp, R. norvegicus
ggatctgaaggcagca

SEQ ID NO: 510110 - DNA, 16 bp, R. norvegicus
ggatctgatgccttct

SEQ ID NO: 510111 - DNA, 16 bp, R. norvegicus
ggatctgctgctcctg

SEQ ID NO: 510112 - DNA, 16 bp, R. norvegicus
ggatctgggccatgcc

SEQ ID NO: 510113 - DNA, 16 bp, R. norvegicus
ggatctgggttacctc

SEQ ID NO: 510114 - DNA, 16 bp, R. norvegicus
ggatctttctggtttc

SEQ ID NO: 510115 - DNA, 16 bp, R. norvegicus
ggatcttttagctttc

SEQ ID NO: 510116 - DNA, 16 bp, R. norvegicus
ggatgaaaatgtagaa

SEQ ID NO: 510117 - DNA, 16 bp, R. norvegicus
ggatgaaatcaaccaa

SEQ ID NO: 510118 - DNA, 16 bp, R. norvegicus
ggatgaaatggaaatt

SEQ ID NO: 510119 - DNA, 16 bp, R. norvegicus
ggatgaaatgtacaat

SEQ ID NO: 510120 - DNA, 16 bp, R. norvegicus
ggatgaaattttccag

SEQ ID NO: 510121 - DNA, 16 bp, R. norvegicus
ggatgaagatctctcc

SEQ ID NO: 510122 - DNA, 16 bp, R. norvegicus
ggatgaagatgtagaa

SEQ ID NO: 510123 - DNA, 16 bp, R. norvegicus
ggatgaagcagagaag

SEQ ID NO: 510124 - DNA, 16 bp, R. norvegicus
ggatgaagcctacatg

SEQ ID NO: 510125 - DNA, 16 bp, R. norvegicus
ggatgaagcctacctg

SEQ ID NO: 510126 - DNA, 16 bp, R. norvegicus
ggatgaagtaaagaag

SEQ ID NO: 510127 - DNA, 16 bp, R. norvegicus
ggatgaatcctcaggt

SEQ ID NO: 510128 - DNA, 16 bp, R. norvegicus
ggatgacatttgaaat

SEQ ID NO: 510129 - DNA, 16 bp, R. norvegicus
ggatgaccaaaatgag

SEQ ID NO: 510130 - DNA, 16 bp, R. norvegicus
ggatgaccaaactgca

SEQ ID NO: 510131 - DNA, 16 bp, R. norvegicus
ggatgaccaaagtgtg

SEQ ID NO: 510132 - DNA, 16 bp, R. norvegicus
ggatgacttcaagaaa

SEQ ID NO: 510133 - DNA, 16 bp, R. norvegicus
ggatgacttttttttt

SEQ ID NO: 510134 - DNA, 16 bp, R. norvegicus
ggatgagacaagggag

SEQ ID NO: 510135 - DNA, 16 bp, R. norvegicus
ggatgagcaggagaaa

SEQ ID NO: 510136 - DNA, 16 bp, R. norvegicus
ggatgaggaagggaac

SEQ ID NO: 510137 - DNA, 16 bp, R. norvegicus
ggatgaggcagaagga

SEQ ID NO: 510138 - DNA, 16 bp, R. norvegicus
ggatgatattttctca

SEQ ID NO: 510139 - DNA, 16 bp, R. norvegicus
ggatgatcattttgat

SEQ ID NO: 510140 - DNA, 16 bp, R. norvegicus
ggatgatctttttgat

SEQ ID NO: 510141 - DNA, 16 bp, R. norvegicus
ggatgatgattcctcc

SEQ ID NO: 510142 - DNA, 16 bp, R. norvegicus
ggatgatggatgaatg

SEQ ID NO: 510143 - DNA, 16 bp, R. norvegicus
ggatgatggttttgat

SEQ ID NO: 510144 - DNA, 16 bp, R. norvegicus
ggatgcagagatggct

SEQ ID NO: 510145 - DNA, 16 bp, R. norvegicus
ggatgcagagcaaagg

SEQ ID NO: 510146 - DNA, 16 bp, R. norvegicus
ggatgccctggtgaag

SEQ ID NO: 510147 - DNA, 16 bp, R. norvegicus
ggatgcccttgaactt

SEQ ID NO: 510148 - DNA, 17 bp, R. norvegicus
ggatgcgccgcactagg

SEQ ID NO: 510149 - DNA, 16 bp, R. norvegicus
ggatgctgagaagaag

SEQ ID NO: 510150 - DNA, 16 bp, R. norvegicus
ggatgctgccatattc

SEQ ID NO: 510151 - DNA, 16 bp, R. norvegicus
ggatgctggcagccaa

SEQ ID NO: 510152 - DNA, 16 bp, R. norvegicus
ggatgctgggaaccca

SEQ ID NO: 510153 - DNA, 16 bp, R. norvegicus
ggatgctgggagccaa

SEQ ID NO: 510154 - DNA, 16 bp, R. norvegicus
ggatgctgggtgctgg

SEQ ID NO: 510155 - DNA, 16 bp, R. norvegicus
ggatgcttcaggcctt

SEQ ID NO: 510156 - DNA, 16 bp, R. norvegicus
ggatgctttggagaaa

SEQ ID NO: 510157 - DNA, 16 bp, R. norvegicus
ggatggagaaatggct

SEQ ID NO: 510158 - DNA, 16 bp, R. norvegicus
ggatggagaaatggtt

SEQ ID NO: 510159 - DNA, 16 bp, R. norvegicus
ggatggagaagaaagc

SEQ ID NO: 510160 - DNA, 16 bp, R. norvegicus
ggatggagacaggaag

SEQ ID NO: 510161 - DNA, 16 bp, R. norvegicus
ggatggagagacagag

SEQ ID NO: 510162 - DNA, 16 bp, R. norvegicus
ggatggagagacggct

SEQ ID NO: 510163 - DNA, 16 bp, R. norvegicus
ggatggaggagcaccc

SEQ ID NO: 510164 - DNA, 16 bp, R. norvegicus
ggatggagggcagcag

SEQ ID NO: 510165 - DNA, 16 bp, R. norvegicus
ggatggatccccagtg

SEQ ID NO: 510166 - DNA, 16 bp, R. norvegicus
ggatggatgatgggta

SEQ ID NO: 510167 - DNA, 16 bp, R. norvegicus
ggatggatggaatgga

SEQ ID NO: 510168 - DNA, 16 bp, R. norvegicus
ggatggatggatgatg

SEQ ID NO: 510169 - DNA, 16 bp, R. norvegicus
ggatggatggtggatg

SEQ ID NO: 510170 - DNA, 16 bp, R. norvegicus
ggatggcaaccctatc

SEQ ID NO: 510171 - DNA, 16 bp, R. norvegicus
ggatggctgtgaggga

SEQ ID NO: 510172 - DNA, 16 bp, R. norvegicus
ggatggcttttccttt

SEQ ID NO: 510173 - DNA, 16 bp, R. norvegicus
ggatggggaactgggg

SEQ ID NO: 510174 - DNA, 16 bp, R. norvegicus
ggatggggaatgggat

SEQ ID NO: 510175 - DNA, 16 bp, R. norvegicus
ggatggggtcaccaac

SEQ ID NO: 510176 - DNA, 16 bp, R. norvegicus
ggatgggtgctgctta

SEQ ID NO: 510177 - DNA, 16 bp, R. norvegicus
ggatggtattttgctg

SEQ ID NO: 510178 - DNA, 16 bp, R. norvegicus
ggatggtgagtggctg

SEQ ID NO: 510179 - DNA, 16 bp, R. norvegicus
ggatggttcagattta

SEQ ID NO: 510180 - DNA, 16 bp, R. norvegicus
ggatggttcagcagtt

SEQ ID NO: 510181 - DNA, 16 bp, R. norvegicus
ggatgtagatctctcc

SEQ ID NO: 510182 - DNA, 16 bp, R. norvegicus
ggatgtagctcactgg

SEQ ID NO: 510183 - DNA, 16 bp, R. norvegicus
ggatgtagcttagtgg

SEQ ID NO: 510184 - DNA, 19 bp, R. norvegicus
ggatgtcggcgccatcttt

SEQ ID NO: 510185 - DNA, 16 bp, R. norvegicus
ggatgtcgggggctgg

SEQ ID NO: 510186 - DNA, 16 bp, R. norvegicus
ggatgtggaaaaagaa

SEQ ID NO: 510187 - DNA, 16 bp, R. norvegicus
ggatgtggagaaaaag

SEQ ID NO: 510188 - DNA, 16 bp, R. norvegicus
ggatgtggagcaaggg

SEQ ID NO: 510189 - DNA, 16 bp, R. norvegicus
ggatgtgtatttctgg

SEQ ID NO: 510190 - DNA, 16 bp, R. norvegicus
ggatgttgaattttgt

SEQ ID NO: 510191 - DNA, 16 bp, R. norvegicus
ggatgttgagaagaca

SEQ ID NO: 510192 - DNA, 16 bp, R. norvegicus
ggatgttggattttgt

SEQ ID NO: 510193 - DNA, 16 bp, R. norvegicus
ggatgttggcctggaa

SEQ ID NO: 510194 - DNA, 16 bp, R. norvegicus
ggattaaagctgtgca

SEQ ID NO: 510195 - DNA, 16 bp, R. norvegicus
ggattaaaggcaagtg

SEQ ID NO: 510196 - DNA, 16 bp, R. norvegicus
ggattaaaggtgtgca

SEQ ID NO: 510197 - DNA, 16 bp, R. norvegicus
ggattacaaatgtgca

SEQ ID NO: 510198 - DNA, 16 bp, R. norvegicus
ggattacaggtgtgtg

SEQ ID NO: 510199 - DNA, 16 bp, R. norvegicus
ggattaccatgagttc

SEQ ID NO: 510200 - DNA, 16 bp, R. norvegicus
ggattcaaactcagat

SEQ ID NO: 510201 - DNA, 16 bp, R. norvegicus
ggattcaaggcccata

SEQ ID NO: 510202 - DNA, 16 bp, R. norvegicus
ggattcagaaatgtgg

SEQ ID NO: 510203 - DNA, 16 bp, R. norvegicus
ggattccaatggagga

SEQ ID NO: 510204 - DNA, 16 bp, R. norvegicus
ggattccctggagctg

SEQ ID NO: 510205 - DNA, 16 bp, R. norvegicus
ggattcctgagtgtga

SEQ ID NO: 510206 - DNA, 16 bp, R. norvegicus
ggattctctggaagag

SEQ ID NO: 510207 - DNA, 16 bp, R. norvegicus
ggattctgggagagag

SEQ ID NO: 510208 - DNA, 16 bp, R. norvegicus
ggattcttatggaaga

SEQ ID NO: 510209 - DNA, 16 bp, R. norvegicus
ggattgaaagaaaaca

SEQ ID NO: 510210 - DNA, 16 bp, R. norvegicus
ggattgaaggaattga

SEQ ID NO: 510211 - DNA, 16 bp, R. norvegicus
ggattgctgactggta

SEQ ID NO: 510212 - DNA, 16 bp, R. norvegicus
ggattgcttaaatata

SEQ ID NO: 510213 - DNA, 16 bp, R. norvegicus
ggattggcaggattta

SEQ ID NO: 510214 - DNA, 16 bp, R. norvegicus
ggattgggcatcataa

SEQ ID NO: 510215 - DNA, 16 bp, R. norvegicus
ggattggggctgggga

SEQ ID NO: 510216 - DNA, 16 bp, R. norvegicus
ggattggtagaattaa

SEQ ID NO: 510217 - DNA, 16 bp, R. norvegicus
ggattggtatttgatg

SEQ ID NO: 510218 - DNA, 18 bp, R. norvegicus
ggattgtggttatggaga

SEQ ID NO: 510219 - DNA, 16 bp, R. norvegicus
ggatttaatgaaaatg

SEQ ID NO: 510220 - DNA, 16 bp, R. norvegicus
ggatttagaaaatgtg

SEQ ID NO: 510221 - DNA, 16 bp, R. norvegicus
ggatttctatgagttc

SEQ ID NO: 510222 - DNA, 16 bp, R. norvegicus
ggatttctctctctct

SEQ ID NO: 510223 - DNA, 16 bp, R. norvegicus
ggatttctgatgcttt

SEQ ID NO: 510224 - DNA, 16 bp, R. norvegicus
ggatttctgtgattcc

SEQ ID NO: 510225 - DNA, 16 bp, R. norvegicus
ggatttctgtgattct

SEQ ID NO: 510226 - DNA, 16 bp, R. norvegicus
ggatttcttgaatgtt

SEQ ID NO: 510227 - DNA, 16 bp, R. norvegicus
ggatttgataaagaca

SEQ ID NO: 510228 - DNA, 16 bp, R. norvegicus
ggatttggaaagcagt

SEQ ID NO: 510229 - DNA, 16 bp, R. norvegicus
ggatttgtttggctta

SEQ ID NO: 510230 - DNA, 16 bp, R. norvegicus
ggattttctgcacttc

SEQ ID NO: 510231 - DNA, 16 bp, R. norvegicus
ggattttgatggtgat

SEQ ID NO: 510232 - DNA, 16 bp, R. norvegicus
ggatttttgcaattcc

SEQ ID NO: 510233 - DNA, 16 bp, R. norvegicus
ggatttttttcccttt

SEQ ID NO: 510234 - DNA, 16 bp, R. norvegicus
ggcaaaaagcagccac

SEQ ID NO: 510235 - DNA, 16 bp, R. norvegicus
ggcaaaaccaagggct

SEQ ID NO: 510236 - DNA, 16 bp, R. norvegicus
ggcaaaagagtcagag

SEQ ID NO: 510237 - DNA, 25 bp, R. norvegicus
ggcaaaagtgctagtccaacccaca

SEQ ID NO: 510238 - DNA, 16 bp, R. norvegicus
ggcaaacagaatccaa

SEQ ID NO: 510239 - DNA, 16 bp, R. norvegicus
ggcaaagaagaaataa

SEQ ID NO: 510240 - DNA, 16 bp, R. norvegicus
ggcaaagacactgtca

SEQ ID NO: 510241 - DNA, 16 bp, R. norvegicus
ggcaaagacttggtgc

SEQ ID NO: 510242 - DNA, 16 bp, R. norvegicus
ggcaaagatgggcaga

SEQ ID NO: 510243 - DNA, 16 bp, R. norvegicus
ggcaaagcccaacaca

SEQ ID NO: 510244 - DNA, 16 bp, R. norvegicus
ggcaaaggacaatgtt

SEQ ID NO: 510245 - DNA, 16 bp, R. norvegicus
ggcaaaggacactgct

SEQ ID NO: 510246 - DNA, 16 bp, R. norvegicus
ggcaaataaacccttt

SEQ ID NO: 510247 - DNA, 16 bp, R. norvegicus
ggcaaatgaatggaac

SEQ ID NO: 510248 - DNA, 16 bp, R. norvegicus
ggcaaatggaatgaag

SEQ ID NO: 510249 - DNA, 64 bp, R. norvegicus
ggcaaatggttggaactggaaaatatcatcctgagtgagctaacccaatcacagaaagacatat

SEQ ID NO: 510250 - DNA, 16 bp, R. norvegicus
ggcaacacagcaagac

SEQ ID NO: 510251 - DNA, 16 bp, R. norvegicus
ggcaacagagtcagaa

SEQ ID NO: 510252 - DNA, 16 bp, R. norvegicus
ggcaacagatgcacag

SEQ ID NO: 510253 - DNA, 16 bp, R. norvegicus
ggcaacagcaacagca

SEQ ID NO: 510254 - DNA, 16 bp, R. norvegicus
ggcaacatgtacaaga

SEQ ID NO: 510255 - DNA, 50 bp, R. norvegicus
ggcaaccaacagattgggaaaagatctttaccaatcctacaacagatagt

SEQ ID NO: 510256 - DNA, 16 bp, R. norvegicus
ggcaaccaccagattg

SEQ ID NO: 510257 - DNA, 16 bp, R. norvegicus
ggcaaccagatcttgg

SEQ ID NO: 510258 - DNA, 16 bp, R. norvegicus
ggcaaccccaaaccca

SEQ ID NO: 510259 - DNA, 16 bp, R. norvegicus
ggcaaccccatccttc

SEQ ID NO: 510260 - DNA, 16 bp, R. norvegicus
ggcaagaaataataaa

SEQ ID NO: 510261 - DNA, 16 bp, R. norvegicus
ggcaagaacccagatg

SEQ ID NO: 510262 - DNA, 16 bp, R. norvegicus
ggcaagaacctggagg

SEQ ID NO: 510263 - DNA, 16 bp, R. norvegicus
ggcaagagagtcagag

SEQ ID NO: 510264 - DNA, 16 bp, R. norvegicus
ggcaagagcagagaac

SEQ ID NO: 510265 - DNA, 16 bp, R. norvegicus
ggcaagatcaccaggg

SEQ ID NO: 510266 - DNA, 16 bp, R. norvegicus
ggcaagatggctctgt

SEQ ID NO: 510267 - DNA, 16 bp, R. norvegicus
ggcaagattccaccca

SEQ ID NO: 510268 - DNA, 16 bp, R. norvegicus
ggcaagcacatgaacc

SEQ ID NO: 510269 - DNA, 16 bp, R. norvegicus
ggcaagcgcaagaacc

SEQ ID NO: 510270 - DNA, 16 bp, R. norvegicus
ggcaagctctgggttt

SEQ ID NO: 510271 - DNA, 16 bp, R. norvegicus
ggcaagctctttacca

SEQ ID NO: 510272 - DNA, 16 bp, R. norvegicus
ggcaagctgtacccta

SEQ ID NO: 510273 - DNA, 16 bp, R. norvegicus
ggcaaggacaggaacc

SEQ ID NO: 510274 - DNA, 16 bp, R. norvegicus
ggcaaggaggtgggag

SEQ ID NO: 510275 - DNA, 17 bp, R. norvegicus
ggcaaggatgcggagaa

SEQ ID NO: 510276 - DNA, 16 bp, R. norvegicus
ggcaaggatggggaga

SEQ ID NO: 510277 - DNA, 16 bp, R. norvegicus
ggcaaggatgtggagt

SEQ ID NO: 510278 - DNA, 16 bp, R. norvegicus
ggcaagggcaagggca

SEQ ID NO: 510279 - DNA, 16 bp, R. norvegicus
ggcaagtgcaagacca

SEQ ID NO: 510280 - DNA, 16 bp, R. norvegicus
ggcaagtgctttaccc

SEQ ID NO: 510281 - DNA, 16 bp, R. norvegicus
ggcaagtggtctacca

SEQ ID NO: 510282 - DNA, 16 bp, R. norvegicus
ggcaagttcactggcc

SEQ ID NO: 510283 - DNA, 16 bp, R. norvegicus
ggcaatcagtgctctt

SEQ ID NO: 510284 - DNA, 16 bp, R. norvegicus
ggcaatgagcaggatg

SEQ ID NO: 510285 - DNA, 16 bp, R. norvegicus
ggcacacacagagaca

SEQ ID NO: 510286 - DNA, 16 bp, R. norvegicus
ggcacacaccaccatg

SEQ ID NO: 510287 - DNA, 16 bp, R. norvegicus
ggcacacaggcacaca

SEQ ID NO: 510288 - DNA, 16 bp, R. norvegicus
ggcacacaggcaggca

SEQ ID NO: 510289 - DNA, 16 bp, R. norvegicus
ggcacacatgtggtac

SEQ ID NO: 510290 - DNA, 16 bp, R. norvegicus
ggcacacctggctgtt

SEQ ID NO: 510291 - DNA, 16 bp, R. norvegicus
ggcacacctgtgaagg

SEQ ID NO: 510292 - DNA, 16 bp, R. norvegicus
ggcacagagaatgtat

SEQ ID NO: 510293 - DNA, 16 bp, R. norvegicus
ggcacagcatgtgtca

SEQ ID NO: 510294 - DNA, 16 bp, R. norvegicus
ggcacagcttgagcat

SEQ ID NO: 510295 - DNA, 16 bp, R. norvegicus
ggcacaggcagagagg

SEQ ID NO: 510296 - DNA, 16 bp, R. norvegicus
ggcacagtccactctg

SEQ ID NO: 510297 - DNA, 16 bp, R. norvegicus
ggcaccaaccaggaag

SEQ ID NO: 510298 - DNA, 16 bp, R. norvegicus
ggcaccagagggagga

SEQ ID NO: 510299 - DNA, 16 bp, R. norvegicus
ggcaccaggaacacat

SEQ ID NO: 510300 - DNA, 16 bp, R. norvegicus
ggcaccaggcattcat

SEQ ID NO: 510301 - DNA, 16 bp, R. norvegicus
ggcaccatgaccatgg

SEQ ID NO: 510302 - DNA, 16 bp, R. norvegicus
ggcaccccttccccca

SEQ ID NO: 510303 - DNA, 16 bp, R. norvegicus
ggcactaagagctatg

SEQ ID NO: 510304 - DNA, 16 bp, R. norvegicus
ggcactacccaaagac

SEQ ID NO: 510305 - DNA, 16 bp, R. norvegicus
ggcactcaagcagcag

SEQ ID NO: 510306 - DNA, 16 bp, R. norvegicus
ggcactctgcagtttc

SEQ ID NO: 510307 - DNA, 16 bp, R. norvegicus
ggcactgaggcaggag

SEQ ID NO: 510308 - DNA, 16 bp, R. norvegicus
ggcactgaggtgggag

SEQ ID NO: 510309 - DNA, 16 bp, R. norvegicus
ggcactgcagtgctgg

SEQ ID NO: 510310 - DNA, 16 bp, R. norvegicus
ggcactggaaaaactt

SEQ ID NO: 510311 - DNA, 16 bp, R. norvegicus
ggcactggagaaattt

SEQ ID NO: 510312 - DNA, 16 bp, R. norvegicus
ggcactggagaaggag

SEQ ID NO: 510313 - DNA, 16 bp, R. norvegicus
ggcactggagctgcag

SEQ ID NO: 510314 - DNA, 16 bp, R. norvegicus
ggcactggcctcctct

SEQ ID NO: 510315 - DNA, 16 bp, R. norvegicus
ggcactgggcacacac

SEQ ID NO: 510316 - DNA, 16 bp, R. norvegicus
ggcactgggcgactct

SEQ ID NO: 510317 - DNA, 16 bp, R. norvegicus
ggcacttcctagagat

SEQ ID NO: 510318 - DNA, 16 bp, R. norvegicus
ggcacttcctgtgttt

SEQ ID NO: 510319 - DNA, 16 bp, R. norvegicus
ggcagaaacagaagga

SEQ ID NO: 510320 - DNA, 16 bp, R. norvegicus
ggcagaaacaggagaa

SEQ ID NO: 510321 - DNA, 16 bp, R. norvegicus
ggcagaaactatgaag

SEQ ID NO: 510322 - DNA, 16 bp, R. norvegicus
ggcagaaagaatggaa

SEQ ID NO: 510323 - DNA, 16 bp, R. norvegicus
ggcagaactggagaag

SEQ ID NO: 510324 - DNA, 16 bp, R. norvegicus
ggcagaagatatactg

SEQ ID NO: 510325 - DNA, 16 bp, R. norvegicus
ggcagaagcaagagga

SEQ ID NO: 510326 - DNA, 16 bp, R. norvegicus
ggcagaagcagataga

SEQ ID NO: 510327 - DNA, 16 bp, R. norvegicus
ggcagaagcagatgaa

SEQ ID NO: 510328 - DNA, 16 bp, R. norvegicus
ggcagaagcagatgga

SEQ ID NO: 510329 - DNA, 16 bp, R. norvegicus
ggcagaagcagcagct

SEQ ID NO: 510330 - DNA, 16 bp, R. norvegicus
ggcagaagcaggaagc

SEQ ID NO: 510331 - DNA, 16 bp, R. norvegicus
ggcagaagccatggag

SEQ ID NO: 510332 - DNA, 16 bp, R. norvegicus
ggcagaagctggtgga

SEQ ID NO: 510333 - DNA, 16 bp, R. norvegicus
ggcagaaggaacacca

SEQ ID NO: 510334 - DNA, 16 bp, R. norvegicus
ggcagaaggaggcaga

SEQ ID NO: 510335 - DNA, 16 bp, R. norvegicus
ggcagaaggattatga

SEQ ID NO: 510336 - DNA, 16 bp, R. norvegicus
ggcagaatctatccca

SEQ ID NO: 510337 - DNA, 16 bp, R. norvegicus
ggcagacaaaatgatg

SEQ ID NO: 510338 - DNA, 16 bp, R. norvegicus
ggcagacaagcatggg

SEQ ID NO: 510339 - DNA, 18 bp, R. norvegicus
ggcagacacacctgggaa

SEQ ID NO: 510340 - DNA, 16 bp, R. norvegicus
ggcagacacagcagag

SEQ ID NO: 510341 - DNA, 16 bp, R. norvegicus
ggcagacacaggtgaa

SEQ ID NO: 510342 - DNA, 17 bp, R. norvegicus
ggcagacacgcctggaa

SEQ ID NO: 510343 - DNA, 16 bp, R. norvegicus
ggcagacagacagata

SEQ ID NO: 510344 - DNA, 16 bp, R. norvegicus
ggcagacagagagaga

SEQ ID NO: 510345 - DNA, 16 bp, R. norvegicus
ggcagacaggagctgg

SEQ ID NO: 510346 - DNA, 16 bp, R. norvegicus
ggcagacaggcagcag

SEQ ID NO: 510347 - DNA, 16 bp, R. norvegicus
ggcagacaggcctggg

SEQ ID NO: 510348 - DNA, 16 bp, R. norvegicus
ggcagacattgtgctg

SEQ ID NO: 510349 - DNA, 16 bp, R. norvegicus
ggcagagaaagatgga

SEQ ID NO: 510350 - DNA, 16 bp, R. norvegicus
ggcagagaaggcagag

SEQ ID NO: 510351 - DNA, 16 bp, R. norvegicus
ggcagagaatagagag

SEQ ID NO: 510352 - DNA, 16 bp, R. norvegicus
ggcagagacagaagaa

SEQ ID NO: 510353 - DNA, 16 bp, R. norvegicus
ggcagagacagaggag

SEQ ID NO: 510354 - DNA, 16 bp, R. norvegicus
ggcagagacagaggca

SEQ ID NO: 510355 - DNA, 16 bp, R. norvegicus
ggcagagacaggagaa

SEQ ID NO: 510356 - DNA, 16 bp, R. norvegicus
ggcagagagtgaggag

SEQ ID NO: 510357 - DNA, 16 bp, R. norvegicus
ggcagagatggagaag

SEQ ID NO: 510358 - DNA, 16 bp, R. norvegicus
ggcagagcagagagga

SEQ ID NO: 510359 - DNA, 16 bp, R. norvegicus
ggcagagccagaaaca

SEQ ID NO: 510360 - DNA, 16 bp, R. norvegicus
ggcagagcctctgagg

SEQ ID NO: 510361 - DNA, 16 bp, R. norvegicus
ggcagagctggagaag

SEQ ID NO: 510362 - DNA, 16 bp, R. norvegicus
ggcagaggaagacaga

SEQ ID NO: 510363 - DNA, 16 bp, R. norvegicus
ggcagaggaaggtgga

SEQ ID NO: 510364 - DNA, 16 bp, R. norvegicus
ggcagaggacccaggt

SEQ ID NO: 510365 - DNA, 16 bp, R. norvegicus
ggcagaggcagaagga

SEQ ID NO: 510366 - DNA, 16 bp, R. norvegicus
ggcagaggcagcctgg

SEQ ID NO: 510367 - DNA, 16 bp, R. norvegicus
ggcagaggcaggagtg

SEQ ID NO: 510368 - DNA, 16 bp, R. norvegicus
ggcagaggcaggcagg

SEQ ID NO: 510369 - DNA, 16 bp, R. norvegicus
ggcagaggcaggggca

SEQ ID NO: 510370 - DNA, 16 bp, R. norvegicus
ggcagaggcaggtgac

SEQ ID NO: 510371 - DNA, 16 bp, R. norvegicus
ggcagaggccatgtga

SEQ ID NO: 510372 - DNA, 16 bp, R. norvegicus
ggcagaggctggtgga

SEQ ID NO: 510373 - DNA, 16 bp, R. norvegicus
ggcagagggagacaga

SEQ ID NO: 510374 - DNA, 16 bp, R. norvegicus
ggcagaggggctggag

SEQ ID NO: 510375 - DNA, 16 bp, R. norvegicus
ggcagataagaaaatt

SEQ ID NO: 510376 - DNA, 16 bp, R. norvegicus
ggcagatacacacaca

SEQ ID NO: 510377 - DNA, 16 bp, R. norvegicus
ggcagatctctatgaa

SEQ ID NO: 510378 - DNA, 16 bp, R. norvegicus
ggcagatctctgcaag

SEQ ID NO: 510379 - DNA, 16 bp, R. norvegicus
ggcagatgctcacagc

SEQ ID NO: 510380 - DNA, 16 bp, R. norvegicus
ggcagatggacagaca

SEQ ID NO: 510381 - DNA, 16 bp, R. norvegicus
ggcagatggatctctg

SEQ ID NO: 510382 - DNA, 16 bp, R. norvegicus
ggcagatgtggtgctg

SEQ ID NO: 510383 - DNA, 16 bp, R. norvegicus
ggcagcaaccgaggag

SEQ ID NO: 510384 - DNA, 16 bp, R. norvegicus
ggcagcaagccagtaa

SEQ ID NO: 510385 - DNA, 16 bp, R. norvegicus
ggcagcaccatcccat

SEQ ID NO: 510386 - DNA, 22 bp, R. norvegicus
ggcagcaccccacgagcgaacc

SEQ ID NO: 510387 - DNA, 16 bp, R. norvegicus
ggcagcagaaagcagg

SEQ ID NO: 510388 - DNA, 16 bp, R. norvegicus
ggcagcagacaccagc

SEQ ID NO: 510389 - DNA, 16 bp, R. norvegicus
ggcagcagacagcaca

SEQ ID NO: 510390 - DNA, 16 bp, R. norvegicus
ggcagcagatggcatt

SEQ ID NO: 510391 - DNA, 16 bp, R. norvegicus
ggcagcagcagcagag

SEQ ID NO: 510392 - DNA, 16 bp, R. norvegicus
ggcagcagcagcagca

SEQ ID NO: 510393 - DNA, 16 bp, R. norvegicus
ggcagcagcagcagcc

SEQ ID NO: 510394 - DNA, 16 bp, R. norvegicus
ggcagcagcggcagca

SEQ ID NO: 510395 - DNA, 16 bp, R. norvegicus
ggcagcagcttgacag

SEQ ID NO: 510396 - DNA, 16 bp, R. norvegicus
ggcagcaggaagagaa

SEQ ID NO: 510397 - DNA, 16 bp, R. norvegicus
ggcagcaggaagagag

SEQ ID NO: 510398 - DNA, 16 bp, R. norvegicus
ggcagcaggaagagca

SEQ ID NO: 510399 - DNA, 16 bp, R. norvegicus
ggcagcaggcaggcac

SEQ ID NO: 510400 - DNA, 16 bp, R. norvegicus
ggcagcagtgcagctg

SEQ ID NO: 510401 - DNA, 16 bp, R. norvegicus
ggcagcatacatgggc

SEQ ID NO: 510402 - DNA, 16 bp, R. norvegicus
ggcagcatccaccagc

SEQ ID NO: 510403 - DNA, 16 bp, R. norvegicus
ggcagcatccaggcag

SEQ ID NO: 510404 - DNA, 16 bp, R. norvegicus
ggcagcatcctggcag

SEQ ID NO: 510405 - DNA, 16 bp, R. norvegicus
ggcagccagagctaca

SEQ ID NO: 510406 - DNA, 16 bp, R. norvegicus
ggcagccaggactaca

SEQ ID NO: 510407 - DNA, 16 bp, R. norvegicus
ggcagccaggagaaga

SEQ ID NO: 510408 - DNA, 16 bp, R. norvegicus
ggcagccaggaggagg

SEQ ID NO: 510409 - DNA, 16 bp, R. norvegicus
ggcagccatccttggg

SEQ ID NO: 510410 - DNA, 16 bp, R. norvegicus
ggcagcccagtaggag

SEQ ID NO: 510411 - DNA, 16 bp, R. norvegicus
ggcagcccagtgtctc

SEQ ID NO: 510412 - DNA, 16 bp, R. norvegicus
ggcagcctacagattg

SEQ ID NO: 510413 - DNA, 16 bp, R. norvegicus
ggcagcctggttcctg

SEQ ID NO: 510414 - DNA, 16 bp, R. norvegicus
ggcagcggtggtggtg

SEQ ID NO: 510415 - DNA, 16 bp, R. norvegicus
ggcagctcccacacag

SEQ ID NO: 510416 - DNA, 16 bp, R. norvegicus
ggcagctcctcagaaa

SEQ ID NO: 510417 - DNA, 16 bp, R. norvegicus
ggcagctgaggcagga

SEQ ID NO: 510418 - DNA, 16 bp, R. norvegicus
ggcagctgcaggccag

SEQ ID NO: 510419 - DNA, 16 bp, R. norvegicus
ggcagctggagagatg

SEQ ID NO: 510420 - DNA, 16 bp, R. norvegicus
ggcagctggcacactc

SEQ ID NO: 510421 - DNA, 16 bp, R. norvegicus
ggcagctgggaggagg

SEQ ID NO: 510422 - DNA, 16 bp, R. norvegicus
ggcagctgtccttgga

SEQ ID NO: 510423 - DNA, 16 bp, R. norvegicus
ggcagctgtgagctgc

SEQ ID NO: 510424 - DNA, 16 bp, R. norvegicus
ggcagcttcttctgga

SEQ ID NO: 510425 - DNA, 16 bp, R. norvegicus
ggcagctttcctgcag

SEQ ID NO: 510426 - DNA, 16 bp, R. norvegicus
ggcaggaaaggcatat

SEQ ID NO: 510427 - DNA, 16 bp, R. norvegicus
ggcaggaacctggaag

SEQ ID NO: 510428 - DNA, 16 bp, R. norvegicus
ggcaggaactggaggc

SEQ ID NO: 510429 - DNA, 16 bp, R. norvegicus
ggcaggaagatcatga

SEQ ID NO: 510430 - DNA, 16 bp, R. norvegicus
ggcaggaagattgctg

SEQ ID NO: 510431 - DNA, 16 bp, R. norvegicus
ggcaggaagcaggagc

SEQ ID NO: 510432 - DNA, 16 bp, R. norvegicus
ggcaggaatcagaagg

SEQ ID NO: 510433 - DNA, 16 bp, R. norvegicus
ggcaggaccaagagct

SEQ ID NO: 510434 - DNA, 16 bp, R. norvegicus
ggcaggaccactgcct

SEQ ID NO: 510435 - DNA, 16 bp, R. norvegicus
ggcaggaccagctctc

SEQ ID NO: 510436 - DNA, 16 bp, R. norvegicus
ggcaggacctctgcct

SEQ ID NO: 510437 - DNA, 16 bp, R. norvegicus
ggcaggagaagcagga

SEQ ID NO: 510438 - DNA, 16 bp, R. norvegicus
ggcaggagaatatggc

SEQ ID NO: 510439 - DNA, 16 bp, R. norvegicus
ggcaggagagaactga

SEQ ID NO: 510440 - DNA, 16 bp, R. norvegicus
ggcaggagagacagct

SEQ ID NO: 510441 - DNA, 16 bp, R. norvegicus
ggcaggagcagaagca

SEQ ID NO: 510442 - DNA, 16 bp, R. norvegicus
ggcaggagcaggcagg

SEQ ID NO: 510443 - DNA, 16 bp, R. norvegicus
ggcaggagcaggggca

SEQ ID NO: 510444 - DNA, 16 bp, R. norvegicus
ggcaggagcctggaga

SEQ ID NO: 510445 - DNA, 16 bp, R. norvegicus
ggcaggagcctggagg

SEQ ID NO: 510446 - DNA, 16 bp, R. norvegicus
ggcaggagctcaagca

SEQ ID NO: 510447 - DNA, 16 bp, R. norvegicus
ggcaggaggatggcca

SEQ ID NO: 510448 - DNA, 16 bp, R. norvegicus
ggcaggaggattttga

SEQ ID NO: 510449 - DNA, 16 bp, R. norvegicus
ggcaggaggcatggca

SEQ ID NO: 510450 - DNA, 16 bp, R. norvegicus
ggcaggagggttgctg

SEQ ID NO: 510451 - DNA, 16 bp, R. norvegicus
ggcaggagtgtgaggc

SEQ ID NO: 510452 - DNA, 16 bp, R. norvegicus
ggcaggagtttgaggc

SEQ ID NO: 510453 - DNA, 16 bp, R. norvegicus
ggcaggatcctttgat

SEQ ID NO: 510454 - DNA, 16 bp, R. norvegicus
ggcaggatctgaagca

SEQ ID NO: 510455 - DNA, 16 bp, R. norvegicus
ggcaggcagagctctg

SEQ ID NO: 510456 - DNA, 16 bp, R. norvegicus
ggcaggcagatgtcta

SEQ ID NO: 510457 - DNA, 16 bp, R. norvegicus
ggcaggcaggcaagca

SEQ ID NO: 510458 - DNA, 16 bp, R. norvegicus
ggcaggcagggatggt

SEQ ID NO: 510459 - DNA, 16 bp, R. norvegicus
ggcaggcagtgaaagg

SEQ ID NO: 510460 - DNA, 16 bp, R. norvegicus
ggcaggcatggagcag

SEQ ID NO: 510461 - DNA, 16 bp, R. norvegicus
ggcaggcctggtgctg

SEQ ID NO: 510462 - DNA, 16 bp, R. norvegicus
ggcaggcggatctgag

SEQ ID NO: 510463 - DNA, 16 bp, R. norvegicus
ggcaggcttggtgcag

SEQ ID NO: 510464 - DNA, 16 bp, R. norvegicus
ggcagggacaggggca

SEQ ID NO: 510465 - DNA, 16 bp, R. norvegicus
ggcagggagatgggaa

SEQ ID NO: 510466 - DNA, 16 bp, R. norvegicus
ggcagggaggctttga

SEQ ID NO: 510467 - DNA, 16 bp, R. norvegicus
ggcagggatggcatca

SEQ ID NO: 510468 - DNA, 16 bp, R. norvegicus
ggcagggccaaggact

SEQ ID NO: 510469 - DNA, 16 bp, R. norvegicus
ggcagggggatcacaa

SEQ ID NO: 510470 - DNA, 16 bp, R. norvegicus
ggcaggggtgggaagt

SEQ ID NO: 510471 - DNA, 16 bp, R. norvegicus
ggcaggtggcaggtgg

SEQ ID NO: 510472 - DNA, 17 bp, R. norvegicus
ggcaggttgccaccatg

SEQ ID NO: 510473 - DNA, 40 bp, R. norvegicus
ggcagtaccccacgagcaaacttgagccttggaaccgcag

SEQ ID NO: 510474 - DNA, 16 bp, R. norvegicus
ggcagtagctgagagc

SEQ ID NO: 510475 - DNA, 22 bp, R. norvegicus
ggcagtattacagagcaatagt

SEQ ID NO: 510476 - DNA, 16 bp, R. norvegicus
ggcagtcatggtgctg

SEQ ID NO: 510477 - DNA, 16 bp, R. norvegicus
ggcagtcattaaaagt

SEQ ID NO: 510478 - DNA, 16 bp, R. norvegicus
ggcagtccctggatgg

SEQ ID NO: 510479 - DNA, 16 bp, R. norvegicus
ggcagtccctgtcatc

SEQ ID NO: 510480 - DNA, 16 bp, R. norvegicus
ggcagtccctgtcatg

SEQ ID NO: 510481 - DNA, 16 bp, R. norvegicus
ggcagtcctcctgttg

SEQ ID NO: 510482 - DNA, 16 bp, R. norvegicus
ggcagtcctctctcag

SEQ ID NO: 510483 - DNA, 16 bp, R. norvegicus
ggcagtgaaattagca

SEQ ID NO: 510484 - DNA, 16 bp, R. norvegicus
ggcagtgagcaggatg

SEQ ID NO: 510485 - DNA, 16 bp, R. norvegicus
ggcagtgatggcagtg

SEQ ID NO: 510486 - DNA, 16 bp, R. norvegicus
ggcagtgctggtggtc

SEQ ID NO: 510487 - DNA, 16 bp, R. norvegicus
ggcagtggaattagca

SEQ ID NO: 510488 - DNA, 16 bp, R. norvegicus
ggcagtgggcagtggg

SEQ ID NO: 510489 - DNA, 16 bp, R. norvegicus
ggcagtggtggtacac

SEQ ID NO: 510490 - DNA, 16 bp, R. norvegicus
ggcagtggtggtgcac

SEQ ID NO: 510491 - DNA, 16 bp, R. norvegicus
ggcagtgtctcaggcg

SEQ ID NO: 510492 - DNA, 16 bp, R. norvegicus
ggcagtgttggtggtc

SEQ ID NO: 510493 - DNA, 16 bp, R. norvegicus
ggcagttggagccctg

SEQ ID NO: 510494 - DNA, 16 bp, R. norvegicus
ggcagttgtgagcctc

SEQ ID NO: 510495 - DNA, 16 bp, R. norvegicus
ggcagtttgtggtttt

SEQ ID NO: 510496 - DNA, 16 bp, R. norvegicus
ggcatatcaaattgca

SEQ ID NO: 510497 - DNA, 16 bp, R. norvegicus
ggcatatgcctttaat

SEQ ID NO: 510498 - DNA, 16 bp, R. norvegicus
ggcatcaataggaaga

SEQ ID NO: 510499 - DNA, 16 bp, R. norvegicus
ggcatcatcagagtcc

SEQ ID NO: 510500 - DNA, 18 bp, R. norvegicus
ggcatccatggaagaaga

SEQ ID NO: 510501 - DNA, 16 bp, R. norvegicus
ggcatcggatcccgtt

SEQ ID NO: 510502 - DNA, 16 bp, R. norvegicus
ggcatctggattgttt

SEQ ID NO: 510503 - DNA, 16 bp, R. norvegicus
ggcatctgggtctttc

SEQ ID NO: 510504 - DNA, 16 bp, R. norvegicus
ggcatcttcttaatta

SEQ ID NO: 510505 - DNA, 16 bp, R. norvegicus
ggcatctttggaagtt

SEQ ID NO: 510506 - DNA, 16 bp, R. norvegicus
ggcatcttttcggtat

SEQ ID NO: 510507 - DNA, 16 bp, R. norvegicus
ggcatgaaggggtcat

SEQ ID NO: 510508 - DNA, 19 bp, R. norvegicus
ggcatgaccttgattcaag

SEQ ID NO: 510509 - DNA, 16 bp, R. norvegicus
ggcatgcagccctgga

SEQ ID NO: 510510 - DNA, 16 bp, R. norvegicus
ggcatgcctggtgccc

SEQ ID NO: 510511 - DNA, 16 bp, R. norvegicus
ggcatgctgacaggaa

SEQ ID NO: 510512 - DNA, 16 bp, R. norvegicus
ggcatgctgggtgaca

SEQ ID NO: 510513 - DNA, 42 bp, R. norvegicus
ggcatggagaactcgagctccagcgaccagccccacttccac

SEQ ID NO: 510514 - DNA, 16 bp, R. norvegicus
ggcatggcagcatcca

SEQ ID NO: 510515 - DNA, 16 bp, R. norvegicus
ggcatggcggtgcaca

SEQ ID NO: 510516 - DNA, 16 bp, R. norvegicus
ggcatggtgcaggcag

SEQ ID NO: 510517 - DNA, 16 bp, R. norvegicus
ggcatggtggcaggca

SEQ ID NO: 510518 - DNA, 16 bp, R. norvegicus
ggcatggtggctggag

SEQ ID NO: 510519 - DNA, 16 bp, R. norvegicus
ggcatgtcactgtggg

SEQ ID NO: 510520 - DNA, 16 bp, R. norvegicus
ggcatgtcagaaacag

SEQ ID NO: 510521 - DNA, 16 bp, R. norvegicus
ggcatgtgccaccagg

SEQ ID NO: 510522 - DNA, 16 bp, R. norvegicus
ggcattaactcttctt

SEQ ID NO: 510523 - DNA, 16 bp, R. norvegicus
ggcattcctctgctgt

SEQ ID NO: 510524 - DNA, 16 bp, R. norvegicus
ggcattgaattcctga

SEQ ID NO: 510525 - DNA, 16 bp, R. norvegicus
ggcattgctcagctgt

SEQ ID NO: 510526 - DNA, 16 bp, R. norvegicus
ggcattgctgcagtca

SEQ ID NO: 510527 - DNA, 16 bp, R. norvegicus
ggcatttctgtcacag

SEQ ID NO: 510528 - DNA, 16 bp, R. norvegicus
ggcattttattaatta

SEQ ID NO: 510529 - DNA, 16 bp, R. norvegicus
ggcattttcaacaaat

SEQ ID NO: 510530 - DNA, 16 bp, R. norvegicus
ggcattttctcaattg

SEQ ID NO: 510531 - DNA, 16 bp, R. norvegicus
ggcattttcttgattg

SEQ ID NO: 510532 - DNA, 17 bp, R. norvegicus
ggccaaaaggctgaaga

SEQ ID NO: 510533 - DNA, 16 bp, R. norvegicus
ggccaaagcagtggcc

SEQ ID NO: 510534 - DNA, 16 bp, R. norvegicus
ggccaaagtgcagatg

SEQ ID NO: 510535 - DNA, 16 bp, R. norvegicus
ggccaacaactccaaa

SEQ ID NO: 510536 - DNA, 16 bp, R. norvegicus
ggccaacaaggccatc

SEQ ID NO: 510537 - DNA, 16 bp, R. norvegicus
ggccaacctgctctac

SEQ ID NO: 510538 - DNA, 16 bp, R. norvegicus
ggccaacctgggctgc

SEQ ID NO: 510539 - DNA, 16 bp, R. norvegicus
ggccaagcctctcagg

SEQ ID NO: 510540 - DNA, 16 bp, R. norvegicus
ggccaaggaagagcag

SEQ ID NO: 510541 - DNA, 16 bp, R. norvegicus
ggccaaggagcagcag

SEQ ID NO: 510542 - DNA, 16 bp, R. norvegicus
ggccaagggcttcccc

SEQ ID NO: 510543 - DNA, 16 bp, R. norvegicus
ggccaagtcactccca

SEQ ID NO: 510544 - DNA, 16 bp, R. norvegicus
ggccaagtgtgtgctc

SEQ ID NO: 510545 - DNA, 16 bp, R. norvegicus
ggccaatactcagata

SEQ ID NO: 510546 - DNA, 16 bp, R. norvegicus
ggccaatgaaaaccaa

SEQ ID NO: 510547 - DNA, 16 bp, R. norvegicus
ggccaatgccagcagc

SEQ ID NO: 510548 - DNA, 16 bp, R. norvegicus
ggccacaactcctaat

SEQ ID NO: 510549 - DNA, 16 bp, R. norvegicus
ggccacacctacacca

SEQ ID NO: 510550 - DNA, 16 bp, R. norvegicus
ggccacacctcctcca

SEQ ID NO: 510551 - DNA, 16 bp, R. norvegicus
ggccacccactcatct

SEQ ID NO: 510552 - DNA, 16 bp, R. norvegicus
ggccacctgcaggaga

SEQ ID NO: 510553 - DNA, 16 bp, R. norvegicus
ggccacgcccacagtg

SEQ ID NO: 510554 - DNA, 17 bp, R. norvegicus
ggccactatggggtctt

SEQ ID NO: 510555 - DNA, 16 bp, R. norvegicus
ggccactcagagcctg

SEQ ID NO: 510556 - DNA, 16 bp, R. norvegicus
ggccactgtgcccagc

SEQ ID NO: 510557 - DNA, 16 bp, R. norvegicus
ggccagaagaaggaat

SEQ ID NO: 510558 - DNA, 16 bp, R. norvegicus
ggccagaagagaacat

SEQ ID NO: 510559 - DNA, 16 bp, R. norvegicus
ggccagacagggctac

SEQ ID NO: 510560 - DNA, 16 bp, R. norvegicus
ggccagagagaaggct

SEQ ID NO: 510561 - DNA, 16 bp, R. norvegicus
ggccagaggacaggtt

SEQ ID NO: 510562 - DNA, 16 bp, R. norvegicus
ggccagaggcagaggc

SEQ ID NO: 510563 - DNA, 16 bp, R. norvegicus
ggccagagtgttctgc

SEQ ID NO: 510564 - DNA, 16 bp, R. norvegicus
ggccagagttcagttc

SEQ ID NO: 510565 - DNA, 16 bp, R. norvegicus
ggccagcaagttccag

SEQ ID NO: 510566 - DNA, 16 bp, R. norvegicus
ggccagcagcctttgc

SEQ ID NO: 510567 - DNA, 16 bp, R. norvegicus
ggccagcatggactac

SEQ ID NO: 510568 - DNA, 16 bp, R. norvegicus
ggccagccagccagcc

SEQ ID NO: 510569 - DNA, 16 bp, R. norvegicus
ggccagcctgagctcc

SEQ ID NO: 510570 - DNA, 16 bp, R. norvegicus
ggccagcctgggcaac

SEQ ID NO: 510571 - DNA, 16 bp, R. norvegicus
ggccagcctggtacag

SEQ ID NO: 510572 - DNA, 16 bp, R. norvegicus
ggccagcctggtgtgc

SEQ ID NO: 510573 - DNA, 16 bp, R. norvegicus
ggccagcctgttctat

SEQ ID NO: 510574 - DNA, 16 bp, R. norvegicus
ggccagcttgggctat

SEQ ID NO: 510575 - DNA, 16 bp, R. norvegicus
ggccaggaaccagagg

SEQ ID NO: 510576 - DNA, 16 bp, R. norvegicus
ggccaggaagcagaga

SEQ ID NO: 510577 - DNA, 16 bp, R. norvegicus
ggccaggatctggcaa

SEQ ID NO: 510578 - DNA, 16 bp, R. norvegicus
ggccaggcaggaaccc

SEQ ID NO: 510579 - DNA, 16 bp, R. norvegicus
ggccaggcctgcacaa

SEQ ID NO: 510580 - DNA, 16 bp, R. norvegicus
ggccaggctgcctggg

SEQ ID NO: 510581 - DNA, 16 bp, R. norvegicus
ggccagggaagtgggc

SEQ ID NO: 510582 - DNA, 16 bp, R. norvegicus
ggccagggatgagggc

SEQ ID NO: 510583 - DNA, 16 bp, R. norvegicus
ggccagggccagggcc

SEQ ID NO: 510584 - DNA, 16 bp, R. norvegicus
ggccaggggctgggga

SEQ ID NO: 510585 - DNA, 16 bp, R. norvegicus
ggccagtaaatacctt

SEQ ID NO: 510586 - DNA, 16 bp, R. norvegicus
ggccagtcagagctac

SEQ ID NO: 510587 - DNA, 16 bp, R. norvegicus
ggccagtgagaccctg

SEQ ID NO: 510588 - DNA, 16 bp, R. norvegicus
ggccagtgagatggct

SEQ ID NO: 510589 - DNA, 16 bp, R. norvegicus
ggccagtgtggtctat

SEQ ID NO: 510590 - DNA, 16 bp, R. norvegicus
ggccagttctgcacag

SEQ ID NO: 510591 - DNA, 16 bp, R. norvegicus
ggccatccagacactg

SEQ ID NO: 510592 - DNA, 16 bp, R. norvegicus
ggccatccagtgacca

SEQ ID NO: 510593 - DNA, 16 bp, R. norvegicus
ggccatctcctgtagc

SEQ ID NO: 510594 - DNA, 16 bp, R. norvegicus
ggccatctttccagcc

SEQ ID NO: 510595 - DNA, 16 bp, R. norvegicus
ggccatggaggagtgt

SEQ ID NO: 510596 - DNA, 16 bp, R. norvegicus
ggccatgggttcggtc

SEQ ID NO: 510597 - DNA, 16 bp, R. norvegicus
ggccatgttcagtctg

SEQ ID NO: 510598 - DNA, 16 bp, R. norvegicus
ggccatgttcttctgg

SEQ ID NO: 510599 - DNA, 16 bp, R. norvegicus
ggccatgttggaggaa

SEQ ID NO: 510600 - DNA, 16 bp, R. norvegicus
ggccatgttttcatga

SEQ ID NO: 510601 - DNA, 16 bp, R. norvegicus
ggccatgttttcttga

SEQ ID NO: 510602 - DNA, 16 bp, R. norvegicus
ggccattagatattcc

SEQ ID NO: 510603 - DNA, 16 bp, R. norvegicus
ggccattcagagcctg

SEQ ID NO: 510604 - DNA, 16 bp, R. norvegicus
ggccattcttccagag

SEQ ID NO: 510605 - DNA, 16 bp, R. norvegicus
ggccattttcatttaa

SEQ ID NO: 510606 - DNA, 16 bp, R. norvegicus
ggcccaaacccagggc

SEQ ID NO: 510607 - DNA, 16 bp, R. norvegicus
ggcccaagaagaacct

SEQ ID NO: 510608 - DNA, 16 bp, R. norvegicus
ggcccaagggcttccc

SEQ ID NO: 510609 - DNA, 16 bp, R. norvegicus
ggcccacagctctctg

SEQ ID NO: 510610 - DNA, 16 bp, R. norvegicus
ggcccacaggaacagc

SEQ ID NO: 510611 - DNA, 16 bp, R. norvegicus
ggcccactctgagaag

SEQ ID NO: 510612 - DNA, 16 bp, R. norvegicus
ggcccagagagagcag

SEQ ID NO: 510613 - DNA, 16 bp, R. norvegicus
ggcccagagagatggc

SEQ ID NO: 510614 - DNA, 16 bp, R. norvegicus
ggcccagaggcagtat

SEQ ID NO: 510615 - DNA, 16 bp, R. norvegicus
ggcccagatcttcctg

SEQ ID NO: 510616 - DNA, 16 bp, R. norvegicus
ggcccagcccaccgtg

SEQ ID NO: 510617 - DNA, 16 bp, R. norvegicus
ggcccagggacccctg

SEQ ID NO: 510618 - DNA, 16 bp, R. norvegicus
ggcccaggtgagctag

SEQ ID NO: 510619 - DNA, 16 bp, R. norvegicus
ggcccagtccattgtg

SEQ ID NO: 510620 - DNA, 16 bp, R. norvegicus
ggcccagtgattaaga

SEQ ID NO: 510621 - DNA, 16 bp, R. norvegicus
ggcccagtgtctctgc

SEQ ID NO: 510622 - DNA, 16 bp, R. norvegicus
ggcccatgggaagtgg

SEQ ID NO: 510623 - DNA, 16 bp, R. norvegicus
ggccccacacaaagct

SEQ ID NO: 510624 - DNA, 22 bp, R. norvegicus
ggccccagaattgtatgttcca

SEQ ID NO: 510625 - DNA, 16 bp, R. norvegicus
ggcccccaaggcctgg

SEQ ID NO: 510626 - DNA, 16 bp, R. norvegicus
ggcccccattggctca

SEQ ID NO: 510627 - DNA, 16 bp, R. norvegicus
ggccccgaggctcaag

SEQ ID NO: 510628 - DNA, 16 bp, R. norvegicus
ggcccctgtgcaccag

SEQ ID NO: 510629 - DNA, 16 bp, R. norvegicus
ggccctaggttccatc

SEQ ID NO: 510630 - DNA, 16 bp, R. norvegicus
ggccctcaaggagatg

SEQ ID NO: 510631 - DNA, 16 bp, R. norvegicus
ggccctcaatccttcc

SEQ ID NO: 510632 - DNA, 16 bp, R. norvegicus
ggccctcccccacagg

SEQ ID NO: 510633 - DNA, 16 bp, R. norvegicus
ggccctcctccatcaa

SEQ ID NO: 510634 - DNA, 16 bp, R. norvegicus
ggccctctgggcctct

SEQ ID NO: 510635 - DNA, 16 bp, R. norvegicus
ggccctgcagcagcag

SEQ ID NO: 510636 - DNA, 16 bp, R. norvegicus
ggccctgcccactgtg

SEQ ID NO: 510637 - DNA, 16 bp, R. norvegicus
ggccctggaactggag

SEQ ID NO: 510638 - DNA, 16 bp, R. norvegicus
ggccctggcagagcct

SEQ ID NO: 510639 - DNA, 16 bp, R. norvegicus
ggccctggcctctcct

SEQ ID NO: 510640 - DNA, 16 bp, R. norvegicus
ggccctggcttcagtc

SEQ ID NO: 510641 - DNA, 16 bp, R. norvegicus
ggccctgtaccttgcc

SEQ ID NO: 510642 - DNA, 16 bp, R. norvegicus
ggccctgtgtctgaag

SEQ ID NO: 510643 - DNA, 16 bp, R. norvegicus
ggccctgttggaatag

SEQ ID NO: 510644 - DNA, 16 bp, R. norvegicus
ggccgaggcaggagaa

SEQ ID NO: 510645 - DNA, 16 bp, R. norvegicus
ggccgaggcaggagga

SEQ ID NO: 510646 - DNA, 16 bp, R. norvegicus
ggccgccattctccag

SEQ ID NO: 510647 - DNA, 16 bp, R. norvegicus
ggccggcgtctgtctg

SEQ ID NO: 510648 - DNA, 16 bp, R. norvegicus
ggccgggatcagtgag

SEQ ID NO: 510649 - DNA, 16 bp, R. norvegicus
ggccgtgcgcttccta

SEQ ID NO: 510650 - DNA, 16 bp, R. norvegicus
ggcctagggagccctc

SEQ ID NO: 510651 - DNA, 16 bp, R. norvegicus
ggcctcaaaactcaca

SEQ ID NO: 510652 - DNA, 16 bp, R. norvegicus
ggcctcaaactttcta

SEQ ID NO: 510653 - DNA, 16 bp, R. norvegicus
ggcctcaacatataca

SEQ ID NO: 510654 - DNA, 16 bp, R. norvegicus
ggcctcaagtccccaa

SEQ ID NO: 510655 - DNA, 16 bp, R. norvegicus
ggcctcaatggataca

SEQ ID NO: 510656 - DNA, 16 bp, R. norvegicus
ggcctcagactcagaa

SEQ ID NO: 510657 - DNA, 16 bp, R. norvegicus
ggcctcagccttggct

SEQ ID NO: 510658 - DNA, 16 bp, R. norvegicus
ggcctcagctccccaa

SEQ ID NO: 510659 - DNA, 16 bp, R. norvegicus
ggcctcaggtggcagc

SEQ ID NO: 510660 - DNA, 16 bp, R. norvegicus
ggcctcagtgggaaag

SEQ ID NO: 510661 - DNA, 16 bp, R. norvegicus
ggcctcatctcagctg

SEQ ID NO: 510662 - DNA, 16 bp, R. norvegicus
ggcctcatctggcatc

SEQ ID NO: 510663 - DNA, 16 bp, R. norvegicus
ggcctcatggaggcat

SEQ ID NO: 510664 - DNA, 16 bp, R. norvegicus
ggcctccaaggacacc

SEQ ID NO: 510665 - DNA, 16 bp, R. norvegicus
ggcctccaaggagtaa

SEQ ID NO: 510666 - DNA, 16 bp, R. norvegicus
ggcctccacaagtgtt

SEQ ID NO: 510667 - DNA, 16 bp, R. norvegicus
ggcctcccttcccatt

SEQ ID NO: 510668 - DNA, 16 bp, R. norvegicus
ggcctcctcactccct

SEQ ID NO: 510669 - DNA, 16 bp, R. norvegicus
ggcctcctcctctgag

SEQ ID NO: 510670 - DNA, 16 bp, R. norvegicus
ggcctcctgggagttt

SEQ ID NO: 510671 - DNA, 16 bp, R. norvegicus
ggcctccttccttggg

SEQ ID NO: 510672 - DNA, 16 bp, R. norvegicus
ggcctctccagcagcc

SEQ ID NO: 510673 - DNA, 16 bp, R. norvegicus
ggcctctctgcctctg

SEQ ID NO: 510674 - DNA, 16 bp, R. norvegicus
ggcctctcttcccatt

SEQ ID NO: 510675 - DNA, 16 bp, R. norvegicus
ggcctctgcagacact

SEQ ID NO: 510676 - DNA, 16 bp, R. norvegicus
ggcctctgcagcagct

SEQ ID NO: 510677 - DNA, 16 bp, R. norvegicus
ggcctctgccatccat

SEQ ID NO: 510678 - DNA, 16 bp, R. norvegicus
ggcctctgctgctgct

SEQ ID NO: 510679 - DNA, 16 bp, R. norvegicus
ggcctctgggaaccag

SEQ ID NO: 510680 - DNA, 16 bp, R. norvegicus
ggcctctgggtcccca

SEQ ID NO: 510681 - DNA, 16 bp, R. norvegicus
ggcctctgtgggctct

SEQ ID NO: 510682 - DNA, 16 bp, R. norvegicus
ggcctctgtgggtact

SEQ ID NO: 510683 - DNA, 16 bp, R. norvegicus
ggcctgaacccagggc

SEQ ID NO: 510684 - DNA, 16 bp, R. norvegicus
ggcctgaccttcaaca

SEQ ID NO: 510685 - DNA, 16 bp, R. norvegicus
ggcctgactgtctctg

SEQ ID NO: 510686 - DNA, 16 bp, R. norvegicus
ggcctgcaaggaggct

SEQ ID NO: 510687 - DNA, 16 bp, R. norvegicus
ggcctgcacttccttg

SEQ ID NO: 510688 - DNA, 16 bp, R. norvegicus
ggcctgcatgcttgtc

SEQ ID NO: 510689 - DNA, 16 bp, R. norvegicus
ggcctgcctggatgct

SEQ ID NO: 510690 - DNA, 16 bp, R. norvegicus
ggcctgctcagcctgc

SEQ ID NO: 510691 - DNA, 16 bp, R. norvegicus
ggcctgctttgtgact

SEQ ID NO: 510692 - DNA, 16 bp, R. norvegicus
ggcctggaaaccagaa

SEQ ID NO: 510693 - DNA, 16 bp, R. norvegicus
ggcctggaactcaaaa

SEQ ID NO: 510694 - DNA, 16 bp, R. norvegicus
ggcctggaactcattc

SEQ ID NO: 510695 - DNA, 16 bp, R. norvegicus
ggcctggaactctcag

SEQ ID NO: 510696 - DNA, 16 bp, R. norvegicus
ggcctggatccccagg

SEQ ID NO: 510697 - DNA, 16 bp, R. norvegicus
ggcctggcccaagagg

SEQ ID NO: 510698 - DNA, 16 bp, R. norvegicus
ggcctggctgtcctga

SEQ ID NO: 510699 - DNA, 16 bp, R. norvegicus
ggcctgtacttctttg

SEQ ID NO: 510700 - DNA, 16 bp, R. norvegicus
ggcctgtcattggagg

SEQ ID NO: 510701 - DNA, 16 bp, R. norvegicus
ggcctgtcttccttct

SEQ ID NO: 510702 - DNA, 16 bp, R. norvegicus
ggcctgttttatgact

SEQ ID NO: 510703 - DNA, 16 bp, R. norvegicus
ggccttcaataacaat

SEQ ID NO: 510704 - DNA, 16 bp, R. norvegicus
ggccttcacctacaga

SEQ ID NO: 510705 - DNA, 16 bp, R. norvegicus
ggccttcagctctggg

SEQ ID NO: 510706 - DNA, 16 bp, R. norvegicus
ggccttccagagactg

SEQ ID NO: 510707 - DNA, 16 bp, R. norvegicus
ggccttgaactcagat

SEQ ID NO: 510708 - DNA, 16 bp, R. norvegicus
ggccttgctgaaggag

SEQ ID NO: 510709 - DNA, 16 bp, R. norvegicus
ggccttggctgtcctg

SEQ ID NO: 510710 - DNA, 16 bp, R. norvegicus
ggccttgggcttgcta

SEQ ID NO: 510711 - DNA, 16 bp, R. norvegicus
ggccttggggcttccc

SEQ ID NO: 510712 - DNA, 16 bp, R. norvegicus
ggccttggggtctccc

SEQ ID NO: 510713 - DNA, 16 bp, R. norvegicus
ggccttggtccttggg

SEQ ID NO: 510714 - DNA, 16 bp, R. norvegicus
ggccttgtctgagaag

SEQ ID NO: 510715 - DNA, 16 bp, R. norvegicus
ggccttgttggaagga

SEQ ID NO: 510716 - DNA, 16 bp, R. norvegicus
ggcctttaaagagaaa

SEQ ID NO: 510717 - DNA, 16 bp, R. norvegicus
ggcctttactcctctc

SEQ ID NO: 510718 - DNA, 16 bp, R. norvegicus
ggcgagaaagaggagc

SEQ ID NO: 510719 - DNA, 16 bp, R. norvegicus
ggcgaggaggtggaga

SEQ ID NO: 510720 - DNA, 16 bp, R. norvegicus
ggcgatcctcctgcct

SEQ ID NO: 510721 - DNA, 16 bp, R. norvegicus
ggcgccagattcacct

SEQ ID NO: 510722 - DNA, 16 bp, R. norvegicus
ggcgctcctggagact

SEQ ID NO: 510723 - DNA, 16 bp, R. norvegicus
ggcgctggaggagctg

SEQ ID NO: 510724 - DNA, 16 bp, R. norvegicus
ggcggagttgagggag

SEQ ID NO: 510725 - DNA, 18 bp, R. norvegicus
ggcggcaatgggaggagg

SEQ ID NO: 510726 - DNA, 16 bp, R. norvegicus
ggcggcccagtgtctc

SEQ ID NO: 510727 - DNA, 16 bp, R. norvegicus
ggcgggcaggcaggca

SEQ ID NO: 510728 - DNA, 16 bp, R. norvegicus
ggcgtctgtctgtctg

SEQ ID NO: 510729 - DNA, 16 bp, R. norvegicus
ggcgtgcctgcctctc

SEQ ID NO: 510730 - DNA, 16 bp, R. norvegicus
ggcgttaccatttatt

SEQ ID NO: 510731 - DNA, 16 bp, R. norvegicus
ggcgttttcttgattg

SEQ ID NO: 510732 - DNA, 16 bp, R. norvegicus
ggctaaccctgaactc

SEQ ID NO: 510733 - DNA, 16 bp, R. norvegicus
ggctaacctgaaactc

SEQ ID NO: 510734 - DNA, 16 bp, R. norvegicus
ggctacaactgcatat

SEQ ID NO: 510735 - DNA, 16 bp, R. norvegicus
ggctacacaatgagac

SEQ ID NO: 510736 - DNA, 16 bp, R. norvegicus
ggctacacagagaact

SEQ ID NO: 510737 - DNA, 16 bp, R. norvegicus
ggctacacagcaagat

SEQ ID NO: 510738 - DNA, 16 bp, R. norvegicus
ggctacaccttcacca

SEQ ID NO: 510739 - DNA, 16 bp, R. norvegicus
ggctacacgaagaaac

SEQ ID NO: 510740 - DNA, 16 bp, R. norvegicus
ggctacactgggatcc

SEQ ID NO: 510741 - DNA, 16 bp, R. norvegicus
ggctacagaaggattc

SEQ ID NO: 510742 - DNA, 16 bp, R. norvegicus
ggctacagagagaccc

SEQ ID NO: 510743 - DNA, 16 bp, R. norvegicus
ggctacagcaacaggg

SEQ ID NO: 510744 - DNA, 16 bp, R. norvegicus
ggctacaggagaccct

SEQ ID NO: 510745 - DNA, 16 bp, R. norvegicus
ggctacatagtgagtt

SEQ ID NO: 510746 - DNA, 16 bp, R. norvegicus
ggctacatgaaactct

SEQ ID NO: 510747 - DNA, 16 bp, R. norvegicus
ggctaccctctgctac

SEQ ID NO: 510748 - DNA, 16 bp, R. norvegicus
ggctactcagagaaac

SEQ ID NO: 510749 - DNA, 16 bp, R. norvegicus
ggctagcagccttcag

SEQ ID NO: 510750 - DNA, 16 bp, R. norvegicus
ggctagcctcaaactc

SEQ ID NO: 510751 - DNA, 16 bp, R. norvegicus
ggctagcctgagctat

SEQ ID NO: 510752 - DNA, 16 bp, R. norvegicus
ggctagcctggtccac

SEQ ID NO: 510753 - DNA, 16 bp, R. norvegicus
ggctaggctggctggc

SEQ ID NO: 510754 - DNA, 16 bp, R. norvegicus
ggctatccagtctctg

SEQ ID NO: 510755 - DNA, 16 bp, R. norvegicus
ggctatcctaaaagct

SEQ ID NO: 510756 - DNA, 16 bp, R. norvegicus
ggctatcctggaaccc

SEQ ID NO: 510757 - DNA, 16 bp, R. norvegicus
ggctatctgctgagga

SEQ ID NO: 510758 - DNA, 16 bp, R. norvegicus
ggctatggtggtacag

SEQ ID NO: 510759 - DNA, 16 bp, R. norvegicus
ggctattataaacaaa

SEQ ID NO: 510760 - DNA, 16 bp, R. norvegicus
ggctattgtgaatggg

SEQ ID NO: 510761 - DNA, 16 bp, R. norvegicus
ggctcacaaacacctg

SEQ ID NO: 510762 - DNA, 16 bp, R. norvegicus
ggctcacaaccatcta

SEQ ID NO: 510763 - DNA, 16 bp, R. norvegicus
ggctcaccaaccagcc

SEQ ID NO: 510764 - DNA, 16 bp, R. norvegicus
ggctcacccacaccca

SEQ ID NO: 510765 - DNA, 16 bp, R. norvegicus
ggctcacctgtgcctt

SEQ ID NO: 510766 - DNA, 16 bp, R. norvegicus
ggctcacggagactga

SEQ ID NO: 510767 - DNA, 16 bp, R. norvegicus
ggctcagcaggaaaag

SEQ ID NO: 510768 - DNA, 16 bp, R. norvegicus
ggctcagccagagcat

SEQ ID NO: 510769 - DNA, 16 bp, R. norvegicus
ggctcagctgtgaaga

SEQ ID NO: 510770 - DNA, 16 bp, R. norvegicus
ggctcaggcagagcct

SEQ ID NO: 510771 - DNA, 16 bp, R. norvegicus
ggctcagggaacacca

SEQ ID NO: 510772 - DNA, 16 bp, R. norvegicus
ggctcagggatttcta

SEQ ID NO: 510773 - DNA, 16 bp, R. norvegicus
ggctcagtccccagct

SEQ ID NO: 510774 - DNA, 16 bp, R. norvegicus
ggctcagtgatgaaga

SEQ ID NO: 510775 - DNA, 16 bp, R. norvegicus
ggctcagtggatgaag

SEQ ID NO: 510776 - DNA, 16 bp, R. norvegicus
ggctcagtgggaaaag

SEQ ID NO: 510777 - DNA, 16 bp, R. norvegicus
ggctcagtggtaaagc

SEQ ID NO: 510778 - DNA, 16 bp, R. norvegicus
ggctcagtttgagatg

SEQ ID NO: 510779 - DNA, 16 bp, R. norvegicus
ggctcatggttccaga

SEQ ID NO: 510780 - DNA, 16 bp, R. norvegicus
ggctcatgtgtttgaa

SEQ ID NO: 510781 - DNA, 16 bp, R. norvegicus
ggctccacccagcagt

SEQ ID NO: 510782 - DNA, 16 bp, R. norvegicus
ggctccaccttcctgc

SEQ ID NO: 510783 - DNA, 16 bp, R. norvegicus
ggctccagatgcctgt

SEQ ID NO: 510784 - DNA, 16 bp, R. norvegicus
ggctccatgccccagt

SEQ ID NO: 510785 - DNA, 16 bp, R. norvegicus
ggctccccacccactc

SEQ ID NO: 510786 - DNA, 16 bp, R. norvegicus
ggctcccctctcagtg

SEQ ID NO: 510787 - DNA, 16 bp, R. norvegicus
ggctccccttccactg

SEQ ID NO: 510788 - DNA, 16 bp, R. norvegicus
ggctcctcttccagag

SEQ ID NO: 510789 - DNA, 16 bp, R. norvegicus
ggctcctggaaagggc

SEQ ID NO: 510790 - DNA, 16 bp, R. norvegicus
ggctcctgggagcctc

SEQ ID NO: 510791 - DNA, 16 bp, R. norvegicus
ggctcctgtcagcttg

SEQ ID NO: 510792 - DNA, 16 bp, R. norvegicus
ggctcctgtcggcctg

SEQ ID NO: 510793 - DNA, 16 bp, R. norvegicus
ggctcctgtgggcctg

SEQ ID NO: 510794 - DNA, 16 bp, R. norvegicus
ggctcctttctctgta

SEQ ID NO: 510795 - DNA, 16 bp, R. norvegicus
ggctcctttctctgtg

SEQ ID NO: 510796 - DNA, 16 bp, R. norvegicus
ggctcctttttcaaaa

SEQ ID NO: 510797 - DNA, 16 bp, R. norvegicus
ggctcctttttctgtg

SEQ ID NO: 510798 - DNA, 16 bp, R. norvegicus
ggctcgtgtgtgtgtg

SEQ ID NO: 510799 - DNA, 16 bp, R. norvegicus
ggctctcagccttcct

SEQ ID NO: 510800 - DNA, 16 bp, R. norvegicus
ggctctccaccttcct

SEQ ID NO: 510801 - DNA, 16 bp, R. norvegicus
ggctctcctggaagtc

SEQ ID NO: 510802 - DNA, 16 bp, R. norvegicus
ggctctctgcagacac

SEQ ID NO: 510803 - DNA, 16 bp, R. norvegicus
ggctctctgctcccag

SEQ ID NO: 510804 - DNA, 16 bp, R. norvegicus
ggctctctgctgcggc

SEQ ID NO: 510805 - DNA, 16 bp, R. norvegicus
ggctctgaagatgcca

SEQ ID NO: 510806 - DNA, 16 bp, R. norvegicus
ggctctgaggcaggag

SEQ ID NO: 510807 - DNA, 16 bp, R. norvegicus
ggctctgccagagact

SEQ ID NO: 510808 - DNA, 16 bp, R. norvegicus
ggctctgccagagctc

SEQ ID NO: 510809 - DNA, 16 bp, R. norvegicus
ggctctgccagggcct

SEQ ID NO: 510810 - DNA, 16 bp, R. norvegicus
ggctctgcccagcagc

SEQ ID NO: 510811 - DNA, 16 bp, R. norvegicus
ggctctggctctggct

SEQ ID NO: 510812 - DNA, 16 bp, R. norvegicus
ggctctggctttggag

SEQ ID NO: 510813 - DNA, 16 bp, R. norvegicus
ggctctgggctctggg

SEQ ID NO: 510814 - DNA, 16 bp, R. norvegicus
ggctctggggctctgg

SEQ ID NO: 510815 - DNA, 16 bp, R. norvegicus
ggctctggggttggtt

SEQ ID NO: 510816 - DNA, 16 bp, R. norvegicus
ggctctggtcagcatg

SEQ ID NO: 510817 - DNA, 16 bp, R. norvegicus
ggctctggtgatgcca

SEQ ID NO: 510818 - DNA, 16 bp, R. norvegicus
ggctctggttaaactc

SEQ ID NO: 510819 - DNA, 16 bp, R. norvegicus
ggctctgttggaggag

SEQ ID NO: 510820 - DNA, 16 bp, R. norvegicus
ggctcttccagcacca

SEQ ID NO: 510821 - DNA, 16 bp, R. norvegicus
ggctcttgtcagcaag

SEQ ID NO: 510822 - DNA, 16 bp, R. norvegicus
ggctctttggaaagtc

SEQ ID NO: 510823 - DNA, 16 bp, R. norvegicus
ggctctttggagagtc

SEQ ID NO: 510824 - DNA, 16 bp, R. norvegicus
ggctcttttcagagcc

SEQ ID NO: 510825 - DNA, 16 bp, R. norvegicus
ggctgaaagaaaacgg

SEQ ID NO: 510826 - DNA, 16 bp, R. norvegicus
ggctgaaagagaggaa

SEQ ID NO: 510827 - DNA, 16 bp, R. norvegicus
ggctgaactcattgcc

SEQ ID NO: 510828 - DNA, 16 bp, R. norvegicus
ggctgaactggaactc

SEQ ID NO: 510829 - DNA, 16 bp, R. norvegicus
ggctgaacttgaattc

SEQ ID NO: 510830 - DNA, 16 bp, R. norvegicus
ggctgaagagttggct

SEQ ID NO: 510831 - DNA, 16 bp, R. norvegicus
ggctgaagcaggagaa

SEQ ID NO: 510832 - DNA, 16 bp, R. norvegicus
ggctgacacaggagga

SEQ ID NO: 510833 - DNA, 16 bp, R. norvegicus
ggctgacagaaactgg

SEQ ID NO: 510834 - DNA, 16 bp, R. norvegicus
ggctgacctctgacct

SEQ ID NO: 510835 - DNA, 16 bp, R. norvegicus
ggctgagaaaatggct

SEQ ID NO: 510836 - DNA, 16 bp, R. norvegicus
ggctgagaagcaccta

SEQ ID NO: 510837 - DNA, 16 bp, R. norvegicus
ggctgagaatgaaatt

SEQ ID NO: 510838 - DNA, 16 bp, R. norvegicus
ggctgagaggcaggag

SEQ ID NO: 510839 - DNA, 16 bp, R. norvegicus
ggctgagagggaggat

SEQ ID NO: 510840 - DNA, 16 bp, R. norvegicus
ggctgagataggagga

SEQ ID NO: 510841 - DNA, 16 bp, R. norvegicus
ggctgagatgcaccta

SEQ ID NO: 510842 - DNA, 16 bp, R. norvegicus
ggctgagcccagagca

SEQ ID NO: 510843 - DNA, 16 bp, R. norvegicus
ggctgagctgggctgg

SEQ ID NO: 510844 - DNA, 16 bp, R. norvegicus
ggctgaggaacaccta

SEQ ID NO: 510845 - DNA, 16 bp, R. norvegicus
ggctgaggagaaggct

SEQ ID NO: 510846 - DNA, 16 bp, R. norvegicus
ggctgaggagacagct

SEQ ID NO: 510847 - DNA, 16 bp, R. norvegicus
ggctgaggcagaaaga

SEQ ID NO: 510848 - DNA, 16 bp, R. norvegicus
ggctgaggcagaaggc

SEQ ID NO: 510849 - DNA, 16 bp, R. norvegicus
ggctgaggcaggaaga

SEQ ID NO: 510850 - DNA, 16 bp, R. norvegicus
ggctgaggcctggctg

SEQ ID NO: 510851 - DNA, 16 bp, R. norvegicus
ggctgaggcgggagga

SEQ ID NO: 510852 - DNA, 16 bp, R. norvegicus
ggctgaggctggagag

SEQ ID NO: 510853 - DNA, 16 bp, R. norvegicus
ggctgaggctggggct

SEQ ID NO: 510854 - DNA, 16 bp, R. norvegicus
ggctgaggcttggctg

SEQ ID NO: 510855 - DNA, 16 bp, R. norvegicus
ggctgagggaagagaa

SEQ ID NO: 510856 - DNA, 16 bp, R. norvegicus
ggctgagggtggcaag

SEQ ID NO: 510857 - DNA, 16 bp, R. norvegicus
ggctgatcaaggggag

SEQ ID NO: 510858 - DNA, 16 bp, R. norvegicus
ggctgattgagaagga

SEQ ID NO: 510859 - DNA, 16 bp, R. norvegicus
ggctgcaatgaatata

SEQ ID NO: 510860 - DNA, 16 bp, R. norvegicus
ggctgcactggctgct

SEQ ID NO: 510861 - DNA, 16 bp, R. norvegicus
ggctgcagacaggaag

SEQ ID NO: 510862 - DNA, 16 bp, R. norvegicus
ggctgcagagcgggag

SEQ ID NO: 510863 - DNA, 16 bp, R. norvegicus
ggctgcagagtggagg

SEQ ID NO: 510864 - DNA, 16 bp, R. norvegicus
ggctgcagcaggagga

SEQ ID NO: 510865 - DNA, 16 bp, R. norvegicus
ggctgcagcccctgga

SEQ ID NO: 510866 - DNA, 16 bp, R. norvegicus
ggctgcagccttgcgg

SEQ ID NO: 510867 - DNA, 16 bp, R. norvegicus
ggctgcaggccagaag

SEQ ID NO: 510868 - DNA, 16 bp, R. norvegicus
ggctgcaggctgcagg

SEQ ID NO: 510869 - DNA, 16 bp, R. norvegicus
ggctgcatccaggcag

SEQ ID NO: 510870 - DNA, 16 bp, R. norvegicus
ggctgccagcatctgc

SEQ ID NO: 510871 - DNA, 16 bp, R. norvegicus
ggctgccaggaagcag

SEQ ID NO: 510872 - DNA, 16 bp, R. norvegicus
ggctgcctggatgctg

SEQ ID NO: 510873 - DNA, 16 bp, R. norvegicus
ggctgctcctccagaa

SEQ ID NO: 510874 - DNA, 16 bp, R. norvegicus
ggctgctcctccagag

SEQ ID NO: 510875 - DNA, 16 bp, R. norvegicus
ggctgctctggaccca

SEQ ID NO: 510876 - DNA, 16 bp, R. norvegicus
ggctgctcttccaaag

SEQ ID NO: 510877 - DNA, 16 bp, R. norvegicus
ggctgctgcagctgct

SEQ ID NO: 510878 - DNA, 16 bp, R. norvegicus
ggctgctgctcttcca

SEQ ID NO: 510879 - DNA, 16 bp, R. norvegicus
ggctgctggagaggcc

SEQ ID NO: 510880 - DNA, 16 bp, R. norvegicus
ggctgctgggctgctg

SEQ ID NO: 510881 - DNA, 16 bp, R. norvegicus
ggctgctgggggagaa

SEQ ID NO: 510882 - DNA, 16 bp, R. norvegicus
ggctgctggtcttcct

SEQ ID NO: 510883 - DNA, 16 bp, R. norvegicus
ggctgctgtctgcaag

SEQ ID NO: 510884 - DNA, 16 bp, R. norvegicus
ggctgcttccttctac

SEQ ID NO: 510885 - DNA, 16 bp, R. norvegicus
ggctgctttggactgt

SEQ ID NO: 510886 - DNA, 16 bp, R. norvegicus
ggctggaaaacagctt

SEQ ID NO: 510887 - DNA, 16 bp, R. norvegicus
ggctggaaaaccactt

SEQ ID NO: 510888 - DNA, 16 bp, R. norvegicus
ggctggaacattatct

SEQ ID NO: 510889 - DNA, 16 bp, R. norvegicus
ggctggaacctggagg

SEQ ID NO: 510890 - DNA, 16 bp, R. norvegicus
ggctggaccctccctc

SEQ ID NO: 510891 - DNA, 16 bp, R. norvegicus
ggctggagaaatggca

SEQ ID NO: 510892 - DNA, 16 bp, R. norvegicus
ggctggagacactggg

SEQ ID NO: 510893 - DNA, 16 bp, R. norvegicus
ggctggagacagcatc

SEQ ID NO: 510894 - DNA, 16 bp, R. norvegicus
ggctggagacatggct

SEQ ID NO: 510895 - DNA, 16 bp, R. norvegicus
ggctggagagactgct

SEQ ID NO: 510896 - DNA, 16 bp, R. norvegicus
ggctggagagagagag

SEQ ID NO: 510897 - DNA, 16 bp, R. norvegicus
ggctggagagagagct

SEQ ID NO: 510898 - DNA, 16 bp, R. norvegicus
ggctggagagagatgg

SEQ ID NO: 510899 - DNA, 16 bp, R. norvegicus
ggctggagagatagct

SEQ ID NO: 510900 - DNA, 16 bp, R. norvegicus
ggctggagagatagtt

SEQ ID NO: 510901 - DNA, 16 bp, R. norvegicus
ggctggagaggaagct

SEQ ID NO: 510902 - DNA, 16 bp, R. norvegicus
ggctggagatgtggct

SEQ ID NO: 510903 - DNA, 16 bp, R. norvegicus
ggctggagattttcca

SEQ ID NO: 510904 - DNA, 16 bp, R. norvegicus
ggctggagcagcagct

SEQ ID NO: 510905 - DNA, 16 bp, R. norvegicus
ggctggagcaggagga

SEQ ID NO: 510906 - DNA, 16 bp, R. norvegicus
ggctggagcctgtgat

SEQ ID NO: 510907 - DNA, 16 bp, R. norvegicus
ggctggagctggagag

SEQ ID NO: 510908 - DNA, 17 bp, R. norvegicus
ggctggaggaagctgag

SEQ ID NO: 510909 - DNA, 16 bp, R. norvegicus
ggctggaggacttcaa

SEQ ID NO: 510910 - DNA, 16 bp, R. norvegicus
ggctggaggagctgag

SEQ ID NO: 510911 - DNA, 16 bp, R. norvegicus
ggctggaggtcctggg

SEQ ID NO: 510912 - DNA, 16 bp, R. norvegicus
ggctggatccccaagt

SEQ ID NO: 510913 - DNA, 16 bp, R. norvegicus
ggctggatccccaggt

SEQ ID NO: 510914 - DNA, 16 bp, R. norvegicus
ggctggatgaggaaag

SEQ ID NO: 510915 - DNA, 16 bp, R. norvegicus
ggctggcaagaaggct

SEQ ID NO: 510916 - DNA, 16 bp, R. norvegicus
ggctggcaagatgact

SEQ ID NO: 510917 - DNA, 16 bp, R. norvegicus
ggctggcaagatggct

SEQ ID NO: 510918 - DNA, 16 bp, R. norvegicus
ggctggcagccagcaa

SEQ ID NO: 510919 - DNA, 16 bp, R. norvegicus
ggctggcattgtctgc

SEQ ID NO: 510920 - DNA, 16 bp, R. norvegicus
ggctggcatttgcatt

SEQ ID NO: 510921 - DNA, 16 bp, R. norvegicus
ggctggccagcaggcc

SEQ ID NO: 510922 - DNA, 16 bp, R. norvegicus
ggctggcccagagctc

SEQ ID NO: 510923 - DNA, 16 bp, R. norvegicus
ggctggcctcaagttt

SEQ ID NO: 510924 - DNA, 16 bp, R. norvegicus
ggctggcctccaaccc

SEQ ID NO: 510925 - DNA, 16 bp, R. norvegicus
ggctggcctccagagg

SEQ ID NO: 510926 - DNA, 16 bp, R. norvegicus
ggctggcctcttttat

SEQ ID NO: 510927 - DNA, 16 bp, R. norvegicus
ggctggcctgaaactc

SEQ ID NO: 510928 - DNA, 16 bp, R. norvegicus
ggctggccttaactca

SEQ ID NO: 510929 - DNA, 16 bp, R. norvegicus
ggctggccttcctggt

SEQ ID NO: 510930 - DNA, 16 bp, R. norvegicus
ggctggccttggactt

SEQ ID NO: 510931 - DNA, 16 bp, R. norvegicus
ggctggctcacccatg

SEQ ID NO: 510932 - DNA, 16 bp, R. norvegicus
ggctggctggccagtg

SEQ ID NO: 510933 - DNA, 16 bp, R. norvegicus
ggctggctggctggct

SEQ ID NO: 510934 - DNA, 16 bp, R. norvegicus
ggctgggaagatggct

SEQ ID NO: 510935 - DNA, 16 bp, R. norvegicus
ggctgggagagatggc

SEQ ID NO: 510936 - DNA, 16 bp, R. norvegicus
ggctgggagtgtggct

SEQ ID NO: 510937 - DNA, 16 bp, R. norvegicus
ggctgggcagggcaga

SEQ ID NO: 510938 - DNA, 16 bp, R. norvegicus
ggctgggccctccctc

SEQ ID NO: 510939 - DNA, 16 bp, R. norvegicus
ggctgggctggagaga

SEQ ID NO: 510940 - DNA, 16 bp, R. norvegicus
ggctgggctgtgctgt

SEQ ID NO: 510941 - DNA, 16 bp, R. norvegicus
ggctgggcttggtggc

SEQ ID NO: 510942 - DNA, 16 bp, R. norvegicus
ggctggggaaagaggc

SEQ ID NO: 510943 - DNA, 16 bp, R. norvegicus
ggctggggagatgcct

SEQ ID NO: 510944 - DNA, 16 bp, R. norvegicus
ggctggggaggtgact

SEQ ID NO: 510945 - DNA, 16 bp, R. norvegicus
ggctggggaggtggct

SEQ ID NO: 510946 - DNA, 16 bp, R. norvegicus
ggctggggaggtggtt

SEQ ID NO: 510947 - DNA, 16 bp, R. norvegicus
ggctggggatgtaact

SEQ ID NO: 510948 - DNA, 16 bp, R. norvegicus
ggctggggcagcagtg

SEQ ID NO: 510949 - DNA, 16 bp, R. norvegicus
ggctggggctcacttg

SEQ ID NO: 510950 - DNA, 16 bp, R. norvegicus
ggctggggctgaggct

SEQ ID NO: 510951 - DNA, 16 bp, R. norvegicus
ggctggggtcctgccg

SEQ ID NO: 510952 - DNA, 16 bp, R. norvegicus
ggctggggtcctgggc

SEQ ID NO: 510953 - DNA, 16 bp, R. norvegicus
ggctggggttggggat

SEQ ID NO: 510954 - DNA, 16 bp, R. norvegicus
ggctgggtcctcctgc

SEQ ID NO: 510955 - DNA, 16 bp, R. norvegicus
ggctggtctggaactc

SEQ ID NO: 510956 - DNA, 16 bp, R. norvegicus
ggctggtgagatggct

SEQ ID NO: 510957 - DNA, 16 bp, R. norvegicus
ggctggtgagggctga

SEQ ID NO: 510958 - DNA, 16 bp, R. norvegicus
ggctggtggccctggg

SEQ ID NO: 510959 - DNA, 17 bp, R. norvegicus
ggctgtatatgatgaag

SEQ ID NO: 510960 - DNA, 16 bp, R. norvegicus
ggctgtatatggatgg

SEQ ID NO: 510961 - DNA, 16 bp, R. norvegicus
ggctgtcccacagcct

SEQ ID NO: 510962 - DNA, 16 bp, R. norvegicus
ggctgtcctgggactt

SEQ ID NO: 510963 - DNA, 16 bp, R. norvegicus
ggctgtctctgactct

SEQ ID NO: 510964 - DNA, 16 bp, R. norvegicus
ggctgtgactgtggct

SEQ ID NO: 510965 - DNA, 16 bp, R. norvegicus
ggctgtgaggagggag

SEQ ID NO: 510966 - DNA, 16 bp, R. norvegicus
ggctgtgagtatctgt

SEQ ID NO: 510967 - DNA, 16 bp, R. norvegicus
ggctgtgcagccatcc

SEQ ID NO: 510968 - DNA, 16 bp, R. norvegicus
ggctgtggctatggct

SEQ ID NO: 510969 - DNA, 16 bp, R. norvegicus
ggctgtggctcctgtg

SEQ ID NO: 510970 - DNA, 16 bp, R. norvegicus
ggctgtggctctcagg

SEQ ID NO: 510971 - DNA, 16 bp, R. norvegicus
ggctgtggctttcagc

SEQ ID NO: 510972 - DNA, 16 bp, R. norvegicus
ggctgtgggcctctgc

SEQ ID NO: 510973 - DNA, 16 bp, R. norvegicus
ggctgtgggtatctgc

SEQ ID NO: 510974 - DNA, 16 bp, R. norvegicus
ggctgtggtgaggctg

SEQ ID NO: 510975 - DNA, 16 bp, R. norvegicus
ggctgtgtcactcagg

SEQ ID NO: 510976 - DNA, 16 bp, R. norvegicus
ggctgtgtgtctgagg

SEQ ID NO: 510977 - DNA, 16 bp, R. norvegicus
ggctgttccttcagcc

SEQ ID NO: 510978 - DNA, 16 bp, R. norvegicus
ggctgttggtcctggg

SEQ ID NO: 510979 - DNA, 16 bp, R. norvegicus
ggcttaacagtgatgt

SEQ ID NO: 510980 - DNA, 16 bp, R. norvegicus
ggcttataatttttta

SEQ ID NO: 510981 - DNA, 16 bp, R. norvegicus
ggcttatggactggaa

SEQ ID NO: 510982 - DNA, 16 bp, R. norvegicus
ggcttatgtctggaaa

SEQ ID NO: 510983 - DNA, 16 bp, R. norvegicus
ggcttcacagtgagac

SEQ ID NO: 510984 - DNA, 16 bp, R. norvegicus
ggcttcagagaaggaa

SEQ ID NO: 510985 - DNA, 16 bp, R. norvegicus
ggcttcatatcagctg

SEQ ID NO: 510986 - DNA, 16 bp, R. norvegicus
ggcttcatcacaggca

SEQ ID NO: 510987 - DNA, 16 bp, R. norvegicus
ggcttcattcccagca

SEQ ID NO: 510988 - DNA, 16 bp, R. norvegicus
ggcttccagcccctca

SEQ ID NO: 510989 - DNA, 16 bp, R. norvegicus
ggcttccaggactcaa

SEQ ID NO: 510990 - DNA, 16 bp, R. norvegicus
ggcttcccaagtgctg

SEQ ID NO: 510991 - DNA, 60 bp, R. norvegicus
ggcttccccttccactggtgctcttactaggatattcattgcttcctatgaggtcagagt

SEQ ID NO: 510992 - DNA, 16 bp, R. norvegicus
ggcttcctcctgcagc

SEQ ID NO: 510993 - DNA, 16 bp, R. norvegicus
ggcttcctctgctccc

SEQ ID NO: 510994 - DNA, 16 bp, R. norvegicus
ggcttcctcttccact

SEQ ID NO: 510995 - DNA, 16 bp, R. norvegicus
ggcttcctctttaaga

SEQ ID NO: 510996 - DNA, 16 bp, R. norvegicus
ggcttcctgcatgctg

SEQ ID NO: 510997 - DNA, 16 bp, R. norvegicus
ggcttcctgcctctta

SEQ ID NO: 510998 - DNA, 16 bp, R. norvegicus
ggcttcctggaggaag

SEQ ID NO: 510999 - DNA, 16 bp, R. norvegicus
ggcttcctggaggagg

SEQ ID NO: 511000 - DNA, 16 bp, R. norvegicus
ggcttccttacagagc

SEQ ID NO: 511001 - DNA, 16 bp, R. norvegicus
ggcttctccccttctc

SEQ ID NO: 511002 - DNA, 16 bp, R. norvegicus
ggcttctctgcccctc

SEQ ID NO: 511003 - DNA, 16 bp, R. norvegicus
ggcttctctggcaagg

SEQ ID NO: 511004 - DNA, 16 bp, R. norvegicus
ggcttctgcatcaact

SEQ ID NO: 511005 - DNA, 16 bp, R. norvegicus
ggcttcttctgtgatt

SEQ ID NO: 511006 - DNA, 16 bp, R. norvegicus
ggcttgatggcaaaca

SEQ ID NO: 511007 - DNA, 16 bp, R. norvegicus
ggcttgctcagtttgt

SEQ ID NO: 511008 - DNA, 16 bp, R. norvegicus
ggcttgcttcccctgg

SEQ ID NO: 511009 - DNA, 16 bp, R. norvegicus
ggcttggcatcatgaa

SEQ ID NO: 511010 - DNA, 16 bp, R. norvegicus
ggcttggggttggaga

SEQ ID NO: 511011 - DNA, 16 bp, R. norvegicus
ggcttggtggcaggtg

SEQ ID NO: 511012 - DNA, 16 bp, R. norvegicus
ggctttcagctctgga

SEQ ID NO: 511013 - DNA, 16 bp, R. norvegicus
ggctttcgccagcctt

SEQ ID NO: 511014 - DNA, 16 bp, R. norvegicus
ggctttctctctctct

SEQ ID NO: 511015 - DNA, 16 bp, R. norvegicus
ggctttctggtgtttc

SEQ ID NO: 511016 - DNA, 16 bp, R. norvegicus
ggctttgctggaggaa

SEQ ID NO: 511017 - DNA, 16 bp, R. norvegicus
ggctttgctggaggag

SEQ ID NO: 511018 - DNA, 16 bp, R. norvegicus
ggcttttatagaccag

SEQ ID NO: 511019 - DNA, 16 bp, R. norvegicus
ggcttttgaaacctaa

SEQ ID NO: 511020 - DNA, 16 bp, R. norvegicus
ggcttttgatctggat

SEQ ID NO: 511021 - DNA, 16 bp, R. norvegicus
ggctttttctacaact

SEQ ID NO: 511022 - DNA, 16 bp, R. norvegicus
gggaaaaaattttcca

SEQ ID NO: 511023 - DNA, 16 bp, R. norvegicus
gggaaaaaggtcaagc

SEQ ID NO: 511024 - DNA, 16 bp, R. norvegicus
gggaaaaatatcttca

SEQ ID NO: 511025 - DNA, 16 bp, R. norvegicus
gggaaaaatgtcaaat

SEQ ID NO: 511026 - DNA, 16 bp, R. norvegicus
gggaaaacacacacac

SEQ ID NO: 511027 - DNA, 16 bp, R. norvegicus
gggaaaagatcaagta

SEQ ID NO: 511028 - DNA, 16 bp, R. norvegicus
gggaaaaggggaacat

SEQ ID NO: 511029 - DNA, 16 bp, R. norvegicus
gggaaaaggtggcaca

SEQ ID NO: 511030 - DNA, 16 bp, R. norvegicus
gggaaaatatctttat

SEQ ID NO: 511031 - DNA, 16 bp, R. norvegicus
gggaaaatccaccaag

SEQ ID NO: 511032 - DNA, 16 bp, R. norvegicus
gggaaaatggaaacca

SEQ ID NO: 511033 - DNA, 24 bp, R. norvegicus
gggaaaatgtcaacttaaagaaga

SEQ ID NO: 511034 - DNA, 16 bp, R. norvegicus
gggaaacaaaggcagg

SEQ ID NO: 511035 - DNA, 16 bp, R. norvegicus
gggaaacaaagtcaca

SEQ ID NO: 511036 - DNA, 16 bp, R. norvegicus
gggaaacaacacccct

SEQ ID NO: 511037 - DNA, 16 bp, R. norvegicus
gggaaacagaagagac

SEQ ID NO: 511038 - DNA, 16 bp, R. norvegicus
gggaaacaggaagcca

SEQ ID NO: 511039 - DNA, 16 bp, R. norvegicus
gggaaacatggaaagg

SEQ ID NO: 511040 - DNA, 16 bp, R. norvegicus
gggaaaccagaagaga

SEQ ID NO: 511041 - DNA, 16 bp, R. norvegicus
gggaaaccaggaaaag

SEQ ID NO: 511042 - DNA, 16 bp, R. norvegicus
gggaaaccgaggcaca

SEQ ID NO: 511043 - DNA, 16 bp, R. norvegicus
gggaaactgaagagaa

SEQ ID NO: 511044 - DNA, 16 bp, R. norvegicus
gggaaactgagaccca

SEQ ID NO: 511045 - DNA, 16 bp, R. norvegicus
gggaaactgaggcaga

SEQ ID NO: 511046 - DNA, 16 bp, R. norvegicus
gggaaactgaggctca

SEQ ID NO: 511047 - DNA, 16 bp, R. norvegicus
gggaaactgcacagtg

SEQ ID NO: 511048 - DNA, 16 bp, R. norvegicus
gggaaactggaaagag

SEQ ID NO: 511049 - DNA, 47 bp, R. norvegicus
gggaaagaacccagatgcccttcaacagaggaatggatacagaaaat

SEQ ID NO: 511050 - DNA, 16 bp, R. norvegicus
gggaaagaactgaagg

SEQ ID NO: 511051 - DNA, 16 bp, R. norvegicus
gggaaagactgaagaa

SEQ ID NO: 511052 - DNA, 16 bp, R. norvegicus
gggaaagactgaagga

SEQ ID NO: 511053 - DNA, 16 bp, R. norvegicus
gggaaagcccaacata

SEQ ID NO: 511054 - DNA, 17 bp, R. norvegicus
gggaaagcctgggaggt

SEQ ID NO: 511055 - DNA, 16 bp, R. norvegicus
gggaaaggaaagacca

SEQ ID NO: 511056 - DNA, 17 bp, R. norvegicus
gggaaaggacgccctgg

SEQ ID NO: 511057 - DNA, 16 bp, R. norvegicus
gggaaaggatgtgcct

SEQ ID NO: 511058 - DNA, 16 bp, R. norvegicus
gggaaagggaataaca

SEQ ID NO: 511059 - DNA, 16 bp, R. norvegicus
gggaaaggggaaatcc

SEQ ID NO: 511060 - DNA, 16 bp, R. norvegicus
gggaaagggggtgcct

SEQ ID NO: 511061 - DNA, 16 bp, R. norvegicus
gggaaatattctccct

SEQ ID NO: 511062 - DNA, 16 bp, R. norvegicus
gggaaatgccaggatg

SEQ ID NO: 511063 - DNA, 16 bp, R. norvegicus
gggaaatggttcagtg

SEQ ID NO: 511064 - DNA, 16 bp, R. norvegicus
gggaaatttatcctaa

SEQ ID NO: 511065 - DNA, 16 bp, R. norvegicus
gggaaattttcctgaa

SEQ ID NO: 511066 - DNA, 16 bp, R. norvegicus
gggaaatttttctaaa

SEQ ID NO: 511067 - DNA, 16 bp, R. norvegicus
gggaacaaatacagaa

SEQ ID NO: 511068 - DNA, 16 bp, R. norvegicus
gggaacagtcagaggg

SEQ ID NO: 511069 - DNA, 16 bp, R. norvegicus
gggaaccaaactccag

SEQ ID NO: 511070 - DNA, 16 bp, R. norvegicus
gggaacccagaagaga

SEQ ID NO: 511071 - DNA, 16 bp, R. norvegicus
gggaacccagaggctg

SEQ ID NO: 511072 - DNA, 16 bp, R. norvegicus
gggaacccaggaaagg

SEQ ID NO: 511073 - DNA, 16 bp, R. norvegicus
gggaaccccaactgag

SEQ ID NO: 511074 - DNA, 16 bp, R. norvegicus
gggaaccctccagaat

SEQ ID NO: 511075 - DNA, 16 bp, R. norvegicus
gggaacctgaaggaaa

SEQ ID NO: 511076 - DNA, 16 bp, R. norvegicus
gggaactcaacatcag

SEQ ID NO: 511077 - DNA, 16 bp, R. norvegicus
gggaactgaaactggg

SEQ ID NO: 511078 - DNA, 16 bp, R. norvegicus
gggaactgaactcaga

SEQ ID NO: 511079 - DNA, 16 bp, R. norvegicus
gggaactggatgtaga

SEQ ID NO: 511080 - DNA, 16 bp, R. norvegicus
gggaacttgtagagcc

SEQ ID NO: 511081 - DNA, 16 bp, R. norvegicus
gggaagaaaaatattc

SEQ ID NO: 511082 - DNA, 16 bp, R. norvegicus
gggaagaaaataatct

SEQ ID NO: 511083 - DNA, 16 bp, R. norvegicus
gggaagaaatatggag

SEQ ID NO: 511084 - DNA, 16 bp, R. norvegicus
gggaagaacccagatg

SEQ ID NO: 511085 - DNA, 16 bp, R. norvegicus
gggaagaactgaagaa

SEQ ID NO: 511086 - DNA, 16 bp, R. norvegicus
gggaagaactgactcc

SEQ ID NO: 511087 - DNA, 16 bp, R. norvegicus
gggaagaaggtcaagt

SEQ ID NO: 511088 - DNA, 16 bp, R. norvegicus
gggaagactcaggagg

SEQ ID NO: 511089 - DNA, 16 bp, R. norvegicus
gggaagactcccagct

SEQ ID NO: 511090 - DNA, 16 bp, R. norvegicus
gggaagagaagccttt

SEQ ID NO: 511091 - DNA, 16 bp, R. norvegicus
gggaagagcctcgaat

SEQ ID NO: 511092 - DNA, 16 bp, R. norvegicus
gggaagagctggagga

SEQ ID NO: 511093 - DNA, 16 bp, R. norvegicus
gggaagaggaggagtc

SEQ ID NO: 511094 - DNA, 16 bp, R. norvegicus
gggaagagggaacctc

SEQ ID NO: 511095 - DNA, 16 bp, R. norvegicus
gggaagatgtctcagt

SEQ ID NO: 511096 - DNA, 16 bp, R. norvegicus
gggaagcaaaggcaag

SEQ ID NO: 511097 - DNA, 16 bp, R. norvegicus
gggaagcagaagcagg

SEQ ID NO: 511098 - DNA, 16 bp, R. norvegicus
gggaagcagaggcaga

SEQ ID NO: 511099 - DNA, 16 bp, R. norvegicus
gggaagcagaggctgg

SEQ ID NO: 511100 - DNA, 16 bp, R. norvegicus
gggaagccagaagaaa

SEQ ID NO: 511101 - DNA, 16 bp, R. norvegicus
gggaagccagagcagg

SEQ ID NO: 511102 - DNA, 16 bp, R. norvegicus
gggaagccatggagaa

SEQ ID NO: 511103 - DNA, 16 bp, R. norvegicus
gggaagccccaaggcc

SEQ ID NO: 511104 - DNA, 16 bp, R. norvegicus
gggaagctgaggcagg

SEQ ID NO: 511105 - DNA, 16 bp, R. norvegicus
gggaagctgaggctgg

SEQ ID NO: 511106 - DNA, 16 bp, R. norvegicus
gggaagcttctggaac

SEQ ID NO: 511107 - DNA, 16 bp, R. norvegicus
gggaaggagtgggcag

SEQ ID NO: 511108 - DNA, 16 bp, R. norvegicus
gggaaggattgaagga

SEQ ID NO: 511109 - DNA, 16 bp, R. norvegicus
gggaagggcagcccag

SEQ ID NO: 511110 - DNA, 16 bp, R. norvegicus
gggaagggctggagag

SEQ ID NO: 511111 - DNA, 16 bp, R. norvegicus
gggaaggggttcacag

SEQ ID NO: 511112 - DNA, 16 bp, R. norvegicus
gggaaggtcatccaga

SEQ ID NO: 511113 - DNA, 16 bp, R. norvegicus
gggaaggtggaggcag

SEQ ID NO: 511114 - DNA, 16 bp, R. norvegicus
gggaagtgagagactc

SEQ ID NO: 511115 - DNA, 16 bp, R. norvegicus
gggaagtgaggcagga

SEQ ID NO: 511116 - DNA, 16 bp, R. norvegicus
gggaagttggtctgaa

SEQ ID NO: 511117 - DNA, 16 bp, R. norvegicus
gggaatacactttatt

SEQ ID NO: 511118 - DNA, 16 bp, R. norvegicus
gggaatagaaaccctg

SEQ ID NO: 511119 - DNA, 16 bp, R. norvegicus
gggaatcaaacccaga

SEQ ID NO: 511120 - DNA, 16 bp, R. norvegicus
gggaatcaaacttagg

SEQ ID NO: 511121 - DNA, 16 bp, R. norvegicus
gggaatcaccatcttt

SEQ ID NO: 511122 - DNA, 16 bp, R. norvegicus
gggaatccaatgctct

SEQ ID NO: 511123 - DNA, 16 bp, R. norvegicus
gggaatccagtgccct

SEQ ID NO: 511124 - DNA, 16 bp, R. norvegicus
gggaatccctgggtcc

SEQ ID NO: 511125 - DNA, 16 bp, R. norvegicus
gggaatctgatgccct

SEQ ID NO: 511126 - DNA, 16 bp, R. norvegicus
gggaatcttctctctc

SEQ ID NO: 511127 - DNA, 16 bp, R. norvegicus
gggaatgacagggtgg

SEQ ID NO: 511128 - DNA, 16 bp, R. norvegicus
gggaatgccagagcag

SEQ ID NO: 511129 - DNA, 16 bp, R. norvegicus
gggaatggaatgtggt

SEQ ID NO: 511130 - DNA, 16 bp, R. norvegicus
gggaatgggatccaca

SEQ ID NO: 511131 - DNA, 16 bp, R. norvegicus
gggaatggggaggcct

SEQ ID NO: 511132 - DNA, 16 bp, R. norvegicus
gggaatggggataaca

SEQ ID NO: 511133 - DNA, 16 bp, R. norvegicus
gggaatgtcagagcag

SEQ ID NO: 511134 - DNA, 16 bp, R. norvegicus
gggaatgtcagtgcag

SEQ ID NO: 511135 - DNA, 16 bp, R. norvegicus
gggacaaaaaatggag

SEQ ID NO: 511136 - DNA, 16 bp, R. norvegicus
gggacaaaactggaga

SEQ ID NO: 511137 - DNA, 16 bp, R. norvegicus
gggacaaagagtagag

SEQ ID NO: 511138 - DNA, 16 bp, R. norvegicus
gggacaaccctgagga

SEQ ID NO: 511139 - DNA, 16 bp, R. norvegicus
gggacaatcctgagag

SEQ ID NO: 511140 - DNA, 16 bp, R. norvegicus
gggacacagctctctg

SEQ ID NO: 511141 - DNA, 16 bp, R. norvegicus
gggacacccattgaag

SEQ ID NO: 511142 - DNA, 16 bp, R. norvegicus
gggacagaaacagaga

SEQ ID NO: 511143 - DNA, 16 bp, R. norvegicus
gggacagaacccagag

SEQ ID NO: 511144 - DNA, 16 bp, R. norvegicus
gggacagaattgaaga

SEQ ID NO: 511145 - DNA, 16 bp, R. norvegicus
gggacagccagggctg

SEQ ID NO: 511146 - DNA, 16 bp, R. norvegicus
gggacaggaccctttg

SEQ ID NO: 511147 - DNA, 16 bp, R. norvegicus
gggacagggacaaaga

SEQ ID NO: 511148 - DNA, 16 bp, R. norvegicus
gggacagggacagctc

SEQ ID NO: 511149 - DNA, 16 bp, R. norvegicus
gggacatccaggaggc

SEQ ID NO: 511150 - DNA, 16 bp, R. norvegicus
gggacattcagtttga

SEQ ID NO: 511151 - DNA, 16 bp, R. norvegicus
gggaccaaatccaggg

SEQ ID NO: 511152 - DNA, 16 bp, R. norvegicus
gggaccacaggcaaga

SEQ ID NO: 511153 - DNA, 16 bp, R. norvegicus
gggaccagaaggaaca

SEQ ID NO: 511154 - DNA, 16 bp, R. norvegicus
gggaccagccacagga

SEQ ID NO: 511155 - DNA, 16 bp, R. norvegicus
gggaccagctggagct

SEQ ID NO: 511156 - DNA, 16 bp, R. norvegicus
gggacccaaaccagga

SEQ ID NO: 511157 - DNA, 16 bp, R. norvegicus
gggacccagggaccca

SEQ ID NO: 511158 - DNA, 16 bp, R. norvegicus
gggaccccagtgaagg

SEQ ID NO: 511159 - DNA, 18 bp, R. norvegicus
gggaccccgagcagcaaa

SEQ ID NO: 511160 - DNA, 16 bp, R. norvegicus
gggaccccttctcagt

SEQ ID NO: 511161 - DNA, 16 bp, R. norvegicus
gggacccggttctcag

SEQ ID NO: 511162 - DNA, 16 bp, R. norvegicus
gggaccctcatgaaga

SEQ ID NO: 511163 - DNA, 16 bp, R. norvegicus
gggaccctgcccccag

SEQ ID NO: 511164 - DNA, 16 bp, R. norvegicus
gggaccctgctctcag

SEQ ID NO: 511165 - DNA, 16 bp, R. norvegicus
gggaccctgtctcaga

SEQ ID NO: 511166 - DNA, 16 bp, R. norvegicus
gggacccttttccttc

SEQ ID NO: 511167 - DNA, 16 bp, R. norvegicus
gggacctatgactcca

SEQ ID NO: 511168 - DNA, 16 bp, R. norvegicus
gggacctcagtggagg

SEQ ID NO: 511169 - DNA, 16 bp, R. norvegicus
gggacctcataaaatg

SEQ ID NO: 511170 - DNA, 16 bp, R. norvegicus
gggacggacacacaca

SEQ ID NO: 511171 - DNA, 33 bp, R. norvegicus
gggactacaacaccagaatgactgtttcttggg

SEQ ID NO: 511172 - DNA, 16 bp, R. norvegicus
gggactcaagtctctc

SEQ ID NO: 511173 - DNA, 16 bp, R. norvegicus
gggactccacaagaag

SEQ ID NO: 511174 - DNA, 17 bp, R. norvegicus
gggactcccggtaaaca

SEQ ID NO: 511175 - DNA, 16 bp, R. norvegicus
gggactcctcagcaac

SEQ ID NO: 511176 - DNA, 16 bp, R. norvegicus
gggactgacagggacc

SEQ ID NO: 511177 - DNA, 16 bp, R. norvegicus
gggactgacctaggcc

SEQ ID NO: 511178 - DNA, 16 bp, R. norvegicus
gggactggagaaaatt

SEQ ID NO: 511179 - DNA, 16 bp, R. norvegicus
gggactgggaagagag

SEQ ID NO: 511180 - DNA, 16 bp, R. norvegicus
gggactgggaggaaga

SEQ ID NO: 511181 - DNA, 16 bp, R. norvegicus
gggactgggaggagag

SEQ ID NO: 511182 - DNA, 16 bp, R. norvegicus
gggactgtgcctctgg

SEQ ID NO: 511183 - DNA, 16 bp, R. norvegicus
gggacttcctgaagcc

SEQ ID NO: 511184 - DNA, 16 bp, R. norvegicus
gggacttctcagtctc

SEQ ID NO: 511185 - DNA, 16 bp, R. norvegicus
gggacttgaacaaaga

SEQ ID NO: 511186 - DNA, 16 bp, R. norvegicus
gggacttgggaagaag

SEQ ID NO: 511187 - DNA, 16 bp, R. norvegicus
gggagaaaagcaatca

SEQ ID NO: 511188 - DNA, 16 bp, R. norvegicus
gggagaaactgtacca

SEQ ID NO: 511189 - DNA, 16 bp, R. norvegicus
gggagaaagcaggcag

SEQ ID NO: 511190 - DNA, 16 bp, R. norvegicus
gggagaaagtgagcag

SEQ ID NO: 511191 - DNA, 16 bp, R. norvegicus
gggagaacctggaagc

SEQ ID NO: 511192 - DNA, 16 bp, R. norvegicus
gggagaacctggaggc

SEQ ID NO: 511193 - DNA, 16 bp, R. norvegicus
gggagaacctggaggt

SEQ ID NO: 511194 - DNA, 16 bp, R. norvegicus
gggagaacctggcagc

SEQ ID NO: 511195 - DNA, 16 bp, R. norvegicus
gggagaagagtttgaa

SEQ ID NO: 511196 - DNA, 16 bp, R. norvegicus
gggagaatgtggagaa

SEQ ID NO: 511197 - DNA, 16 bp, R. norvegicus
gggagacacaggcagg

SEQ ID NO: 511198 - DNA, 16 bp, R. norvegicus
gggagacagaaacaga

SEQ ID NO: 511199 - DNA, 16 bp, R. norvegicus
gggagaccagaccaga

SEQ ID NO: 511200 - DNA, 16 bp, R. norvegicus
gggagaccagcagcaa

SEQ ID NO: 511201 - DNA, 16 bp, R. norvegicus
gggagaccagttctct

SEQ ID NO: 511202 - DNA, 16 bp, R. norvegicus
gggagactgggaggag

SEQ ID NO: 511203 - DNA, 16 bp, R. norvegicus
gggagacttcaacagc

SEQ ID NO: 511204 - DNA, 16 bp, R. norvegicus
gggagacttttttttt

SEQ ID NO: 511205 - DNA, 16 bp, R. norvegicus
gggagagaccctgcct

SEQ ID NO: 511206 - DNA, 16 bp, R. norvegicus
gggagagagaccttac

SEQ ID NO: 511207 - DNA, 16 bp, R. norvegicus
gggagagagagattga

SEQ ID NO: 511208 - DNA, 16 bp, R. norvegicus
gggagagcacttgcct

SEQ ID NO: 511209 - DNA, 16 bp, R. norvegicus
gggagagcaggctcag

SEQ ID NO: 511210 - DNA, 16 bp, R. norvegicus
gggagagcatcctcat

SEQ ID NO: 511211 - DNA, 16 bp, R. norvegicus
gggagagctggcccag

SEQ ID NO: 511212 - DNA, 16 bp, R. norvegicus
gggagagctggccttg

SEQ ID NO: 511213 - DNA, 16 bp, R. norvegicus
gggagagctggtcctg

SEQ ID NO: 511214 - DNA, 16 bp, R. norvegicus
gggagaggacagcctg

SEQ ID NO: 511215 - DNA, 16 bp, R. norvegicus
gggagaggagagcctg

SEQ ID NO: 511216 - DNA, 16 bp, R. norvegicus
gggagaggcttttgtc

SEQ ID NO: 511217 - DNA, 16 bp, R. norvegicus
gggagagtgaccccat

SEQ ID NO: 511218 - DNA, 16 bp, R. norvegicus
gggagatagctcagct

SEQ ID NO: 511219 - DNA, 16 bp, R. norvegicus
gggagatataacaaca

SEQ ID NO: 511220 - DNA, 16 bp, R. norvegicus
gggagatggctcagtg

SEQ ID NO: 511221 - DNA, 16 bp, R. norvegicus
gggagatggctcggtg

SEQ ID NO: 511222 - DNA, 16 bp, R. norvegicus
gggagattgagaaatt

SEQ ID NO: 511223 - DNA, 16 bp, R. norvegicus
gggagattgtccagag

SEQ ID NO: 511224 - DNA, 16 bp, R. norvegicus
gggagcaccctcatag

SEQ ID NO: 511225 - DNA, 16 bp, R. norvegicus
gggagcagaagcaggc

SEQ ID NO: 511226 - DNA, 16 bp, R. norvegicus
gggagcagagactgag

SEQ ID NO: 511227 - DNA, 16 bp, R. norvegicus
gggagcagatgcagaa

SEQ ID NO: 511228 - DNA, 16 bp, R. norvegicus
gggagcagccaagaga

SEQ ID NO: 511229 - DNA, 16 bp, R. norvegicus
gggagcagtctcttct

SEQ ID NO: 511230 - DNA, 16 bp, R. norvegicus
gggagcagtgagcagg

SEQ ID NO: 511231 - DNA, 16 bp, R. norvegicus
gggagcatctccagga

SEQ ID NO: 511232 - DNA, 16 bp, R. norvegicus
gggagcatctctggga

SEQ ID NO: 511233 - DNA, 16 bp, R. norvegicus
gggagcatggagggag

SEQ ID NO: 511234 - DNA, 16 bp, R. norvegicus
gggagccatggctcca

SEQ ID NO: 511235 - DNA, 16 bp, R. norvegicus
gggagcccagaagcct

SEQ ID NO: 511236 - DNA, 16 bp, R. norvegicus
gggagcccaggagggt

SEQ ID NO: 511237 - DNA, 16 bp, R. norvegicus
gggagccccaagggtc

SEQ ID NO: 511238 - DNA, 16 bp, R. norvegicus
gggagctagagagatg

SEQ ID NO: 511239 - DNA, 16 bp, R. norvegicus
gggagctcctagagac

SEQ ID NO: 511240 - DNA, 16 bp, R. norvegicus
gggagctctcagagac

SEQ ID NO: 511241 - DNA, 16 bp, R. norvegicus
gggagctgaggcagga

SEQ ID NO: 511242 - DNA, 16 bp, R. norvegicus
gggagctgcccagctg

SEQ ID NO: 511243 - DNA, 16 bp, R. norvegicus
gggagctggagagctg

SEQ ID NO: 511244 - DNA, 16 bp, R. norvegicus
gggagctggagttaca

SEQ ID NO: 511245 - DNA, 16 bp, R. norvegicus
gggagctgggcagtgg

SEQ ID NO: 511246 - DNA, 16 bp, R. norvegicus
gggagctgtgggatgg

SEQ ID NO: 511247 - DNA, 16 bp, R. norvegicus
gggaggaaacacagga

SEQ ID NO: 511248 - DNA, 16 bp, R. norvegicus
gggaggacagcaaggc

SEQ ID NO: 511249 - DNA, 16 bp, R. norvegicus
gggaggacccagccca

SEQ ID NO: 511250 - DNA, 16 bp, R. norvegicus
gggaggaccctccaga

SEQ ID NO: 511251 - DNA, 16 bp, R. norvegicus
gggaggactgggagga

SEQ ID NO: 511252 - DNA, 16 bp, R. norvegicus
gggaggagactgcact

SEQ ID NO: 511253 - DNA, 16 bp, R. norvegicus
gggaggagctggagga

SEQ ID NO: 511254 - DNA, 16 bp, R. norvegicus
gggaggagctgggaga

SEQ ID NO: 511255 - DNA, 16 bp, R. norvegicus
gggaggcagaagcaga

SEQ ID NO: 511256 - DNA, 16 bp, R. norvegicus
gggaggcagagctggg

SEQ ID NO: 511257 - DNA, 16 bp, R. norvegicus
gggaggcagaggcagc

SEQ ID NO: 511258 - DNA, 16 bp, R. norvegicus
gggaggccctgggtcc

SEQ ID NO: 511259 - DNA, 16 bp, R. norvegicus
gggaggctgaggcagg

SEQ ID NO: 511260 - DNA, 16 bp, R. norvegicus
gggagggacctggaag

SEQ ID NO: 511261 - DNA, 16 bp, R. norvegicus
gggagggacctgggag

SEQ ID NO: 511262 - DNA, 16 bp, R. norvegicus
gggagggagacacaga

SEQ ID NO: 511263 - DNA, 16 bp, R. norvegicus
gggagggcccagccca

SEQ ID NO: 511264 - DNA, 16 bp, R. norvegicus
gggagggccccgccca

SEQ ID NO: 511265 - DNA, 16 bp, R. norvegicus
gggagggtccagccca

SEQ ID NO: 511266 - DNA, 16 bp, R. norvegicus
gggaggtaaagacagg

SEQ ID NO: 511267 - DNA, 16 bp, R. norvegicus
gggaggtagaggccag

SEQ ID NO: 511268 - DNA, 16 bp, R. norvegicus
gggaggtgaacaccct

SEQ ID NO: 511269 - DNA, 16 bp, R. norvegicus
gggaggtggaagcagg

SEQ ID NO: 511270 - DNA, 16 bp, R. norvegicus
gggaggtggacctgtt

SEQ ID NO: 511271 - DNA, 16 bp, R. norvegicus
gggaggtggctcagcg

SEQ ID NO: 511272 - DNA, 16 bp, R. norvegicus
gggaggttgagaacca

SEQ ID NO: 511273 - DNA, 16 bp, R. norvegicus
gggagtgctgcttact

SEQ ID NO: 511274 - DNA, 16 bp, R. norvegicus
gggagtggacttgttt

SEQ ID NO: 511275 - DNA, 16 bp, R. norvegicus
gggataaagatggaga

SEQ ID NO: 511276 - DNA, 16 bp, R. norvegicus
gggataagcttaaatt

SEQ ID NO: 511277 - DNA, 16 bp, R. norvegicus
gggataagggaggtac

SEQ ID NO: 511278 - DNA, 23 bp, R. norvegicus
gggatacagatcggaaaagaaga

SEQ ID NO: 511279 - DNA, 16 bp, R. norvegicus
gggatagagagatggc

SEQ ID NO: 511280 - DNA, 16 bp, R. norvegicus
gggatagcaaacagga

SEQ ID NO: 511281 - DNA, 16 bp, R. norvegicus
gggatagtgattctcc

SEQ ID NO: 511282 - DNA, 16 bp, R. norvegicus
gggatataaattggca

SEQ ID NO: 511283 - DNA, 16 bp, R. norvegicus
gggatatttccagctt

SEQ ID NO: 511284 - DNA, 16 bp, R. norvegicus
gggatcagcgaggttt

SEQ ID NO: 511285 - DNA, 16 bp, R. norvegicus
gggatccaatggcctc

SEQ ID NO: 511286 - DNA, 16 bp, R. norvegicus
gggatccaggaaaggg

SEQ ID NO: 511287 - DNA, 16 bp, R. norvegicus
gggatccatctgcctc

SEQ ID NO: 511288 - DNA, 16 bp, R. norvegicus
gggatccccattggag

SEQ ID NO: 511289 - DNA, 16 bp, R. norvegicus
gggatccgattccctc

SEQ ID NO: 511290 - DNA, 16 bp, R. norvegicus
gggatcctgcctggct

SEQ ID NO: 511291 - DNA, 16 bp, R. norvegicus
gggatcctgtctcaaa

SEQ ID NO: 511292 - DNA, 18 bp, R. norvegicus
gggatctccgggtcgaca

SEQ ID NO: 511293 - DNA, 16 bp, R. norvegicus
gggatctgatgccctt

SEQ ID NO: 511294 - DNA, 16 bp, R. norvegicus
gggatgcagctcagtt

SEQ ID NO: 511295 - DNA, 16 bp, R. norvegicus
gggatgcatggatggt

SEQ ID NO: 511296 - DNA, 16 bp, R. norvegicus
gggatgccctgggtcc

SEQ ID NO: 511297 - DNA, 16 bp, R. norvegicus
gggatgcctcagaatg

SEQ ID NO: 511298 - DNA, 16 bp, R. norvegicus
gggatggaaccccagg

SEQ ID NO: 511299 - DNA, 16 bp, R. norvegicus
gggatggaagaggtcc

SEQ ID NO: 511300 - DNA, 16 bp, R. norvegicus
gggatggatacccagg

SEQ ID NO: 511301 - DNA, 16 bp, R. norvegicus
gggatggatccacagg

SEQ ID NO: 511302 - DNA, 16 bp, R. norvegicus
gggatggatcccctgg

SEQ ID NO: 511303 - DNA, 16 bp, R. norvegicus
gggatggatgtgtacc

SEQ ID NO: 511304 - DNA, 16 bp, R. norvegicus
gggatggatgtgtatg

SEQ ID NO: 511305 - DNA, 16 bp, R. norvegicus
gggatggcaaccccat

SEQ ID NO: 511306 - DNA, 16 bp, R. norvegicus
gggatggcacaaccca

SEQ ID NO: 511307 - DNA, 16 bp, R. norvegicus
gggatggcaccaatga

SEQ ID NO: 511308 - DNA, 16 bp, R. norvegicus
gggatgggaaactggg

SEQ ID NO: 511309 - DNA, 16 bp, R. norvegicus
gggatggggaactgtg

SEQ ID NO: 511310 - DNA, 16 bp, R. norvegicus
gggatggggccaccca

SEQ ID NO: 511311 - DNA, 17 bp, R. norvegicus
gggatgtcaaaggggaa

SEQ ID NO: 511312 - DNA, 16 bp, R. norvegicus
gggatgtggagacagg

SEQ ID NO: 511313 - DNA, 16 bp, R. norvegicus
gggatgtggccaccca

SEQ ID NO: 511314 - DNA, 16 bp, R. norvegicus
gggatgtgggcagagg

SEQ ID NO: 511315 - DNA, 16 bp, R. norvegicus
gggattaaagacattt

SEQ ID NO: 511316 - DNA, 16 bp, R. norvegicus
gggattaaaggcatgt

SEQ ID NO: 511317 - DNA, 16 bp, R. norvegicus
gggattaaaggccacc

SEQ ID NO: 511318 - DNA, 16 bp, R. norvegicus
gggattaaaggtgtga

SEQ ID NO: 511319 - DNA, 16 bp, R. norvegicus
gggattataggcatgc

SEQ ID NO: 511320 - DNA, 16 bp, R. norvegicus
gggattccaggtgtgc

SEQ ID NO: 511321 - DNA, 16 bp, R. norvegicus
gggattcgatgccctc

SEQ ID NO: 511322 - DNA, 16 bp, R. norvegicus
gggattctgttctcag

SEQ ID NO: 511323 - DNA, 16 bp, R. norvegicus
gggattcttggaagga

SEQ ID NO: 511324 - DNA, 16 bp, R. norvegicus
gggattgaatccaggg

SEQ ID NO: 511325 - DNA, 16 bp, R. norvegicus
gggattggatagagga

SEQ ID NO: 511326 - DNA, 19 bp, R. norvegicus
gggattggtggagcatgaa

SEQ ID NO: 511327 - DNA, 16 bp, R. norvegicus
gggatttcctgaagct

SEQ ID NO: 511328 - DNA, 16 bp, R. norvegicus
gggatttggctgcaga

SEQ ID NO: 511329 - DNA, 16 bp, R. norvegicus
gggattttcttttctt

SEQ ID NO: 511330 - DNA, 16 bp, R. norvegicus
gggatttttgtatttc

SEQ ID NO: 511331 - DNA, 16 bp, R. norvegicus
gggcaaagctgccagg

SEQ ID NO: 511332 - DNA, 16 bp, R. norvegicus
gggcaagaggagaggt

SEQ ID NO: 511333 - DNA, 16 bp, R. norvegicus
gggcaaggccctgggt

SEQ ID NO: 511334 - DNA, 16 bp, R. norvegicus
gggcaagtggggctta

SEQ ID NO: 511335 - DNA, 16 bp, R. norvegicus
gggcacaatgaaaaga

SEQ ID NO: 511336 - DNA, 16 bp, R. norvegicus
gggcacaggcacacac

SEQ ID NO: 511337 - DNA, 16 bp, R. norvegicus
gggcacaggtgagcca

SEQ ID NO: 511338 - DNA, 16 bp, R. norvegicus
gggcacagtctggact

SEQ ID NO: 511339 - DNA, 16 bp, R. norvegicus
gggcacagtggcacac

SEQ ID NO: 511340 - DNA, 16 bp, R. norvegicus
gggcacatgtggggca

SEQ ID NO: 511341 - DNA, 16 bp, R. norvegicus
gggcaccaaatctcat

SEQ ID NO: 511342 - DNA, 16 bp, R. norvegicus
gggcaccagtggaaag

SEQ ID NO: 511343 - DNA, 16 bp, R. norvegicus
gggcaccagtggaagg

SEQ ID NO: 511344 - DNA, 16 bp, R. norvegicus
gggcactggagaaaag

SEQ ID NO: 511345 - DNA, 16 bp, R. norvegicus
gggcactggctgctct

SEQ ID NO: 511346 - DNA, 16 bp, R. norvegicus
gggcagaaaccctcat

SEQ ID NO: 511347 - DNA, 16 bp, R. norvegicus
gggcagaagagggtgt

SEQ ID NO: 511348 - DNA, 16 bp, R. norvegicus
gggcagaagatcctgg

SEQ ID NO: 511349 - DNA, 16 bp, R. norvegicus
gggcagaagctgctga

SEQ ID NO: 511350 - DNA, 16 bp, R. norvegicus
gggcagaagtggcagt

SEQ ID NO: 511351 - DNA, 16 bp, R. norvegicus
gggcagaagtggcggt

SEQ ID NO: 511352 - DNA, 16 bp, R. norvegicus
gggcagacaggcctgg

SEQ ID NO: 511353 - DNA, 16 bp, R. norvegicus
gggcagacttcagcaa

SEQ ID NO: 511354 - DNA, 16 bp, R. norvegicus
gggcagagaaaggcag

SEQ ID NO: 511355 - DNA, 16 bp, R. norvegicus
gggcagagaaggacag

SEQ ID NO: 511356 - DNA, 16 bp, R. norvegicus
gggcagagacagagac

SEQ ID NO: 511357 - DNA, 16 bp, R. norvegicus
gggcagagaggtagga

SEQ ID NO: 511358 - DNA, 16 bp, R. norvegicus
gggcagagcagggcag

SEQ ID NO: 511359 - DNA, 16 bp, R. norvegicus
gggcagagctggagag

SEQ ID NO: 511360 - DNA, 16 bp, R. norvegicus
gggcagatgtcataga

SEQ ID NO: 511361 - DNA, 16 bp, R. norvegicus
gggcagcaagatggct

SEQ ID NO: 511362 - DNA, 16 bp, R. norvegicus
gggcagcagcagcagg

SEQ ID NO: 511363 - DNA, 16 bp, R. norvegicus
gggcagcaggcagcag

SEQ ID NO: 511364 - DNA, 16 bp, R. norvegicus
gggcagcaggcagtgg

SEQ ID NO: 511365 - DNA, 16 bp, R. norvegicus
gggcagcaggctgtga

SEQ ID NO: 511366 - DNA, 16 bp, R. norvegicus
gggcagcatggagctg

SEQ ID NO: 511367 - DNA, 16 bp, R. norvegicus
gggcagctcacagcca

SEQ ID NO: 511368 - DNA, 16 bp, R. norvegicus
gggcagctctgaatgg

SEQ ID NO: 511369 - DNA, 16 bp, R. norvegicus
gggcagctggagtctg

SEQ ID NO: 511370 - DNA, 16 bp, R. norvegicus
gggcagctttgtcttg

SEQ ID NO: 511371 - DNA, 16 bp, R. norvegicus
gggcaggaactcaggg

SEQ ID NO: 511372 - DNA, 16 bp, R. norvegicus
gggcaggagctgaagc

SEQ ID NO: 511373 - DNA, 16 bp, R. norvegicus
gggcagggacctggag

SEQ ID NO: 511374 - DNA, 16 bp, R. norvegicus
gggcaggtggtcctgg

SEQ ID NO: 511375 - DNA, 16 bp, R. norvegicus
gggcagtctctggatg

SEQ ID NO: 511376 - DNA, 16 bp, R. norvegicus
gggcagtctgtggatg

SEQ ID NO: 511377 - DNA, 16 bp, R. norvegicus
gggcagtgagtgggat

SEQ ID NO: 511378 - DNA, 16 bp, R. norvegicus
gggcagtggtggcgca

SEQ ID NO: 511379 - DNA, 16 bp, R. norvegicus
gggcatcaagacttca

SEQ ID NO: 511380 - DNA, 16 bp, R. norvegicus
gggcatcatgggagag

SEQ ID NO: 511381 - DNA, 16 bp, R. norvegicus
gggcatcctgtgtagt

SEQ ID NO: 511382 - DNA, 16 bp, R. norvegicus
gggcatcggatcctgt

SEQ ID NO: 511383 - DNA, 16 bp, R. norvegicus
gggcatcttttgggtg

SEQ ID NO: 511384 - DNA, 16 bp, R. norvegicus
gggcatggaagaagga

SEQ ID NO: 511385 - DNA, 16 bp, R. norvegicus
gggcatggggaggaga

SEQ ID NO: 511386 - DNA, 16 bp, R. norvegicus
gggcatgtttgtcccg

SEQ ID NO: 511387 - DNA, 16 bp, R. norvegicus
gggcattctgagcttt

SEQ ID NO: 511388 - DNA, 16 bp, R. norvegicus
gggcatttcagctaat

SEQ ID NO: 511389 - DNA, 16 bp, R. norvegicus
gggcatttctccagtt

SEQ ID NO: 511390 - DNA, 16 bp, R. norvegicus
gggccaacagaaagaa

SEQ ID NO: 511391 - DNA, 16 bp, R. norvegicus
gggccaatatatggaa

SEQ ID NO: 511392 - DNA, 16 bp, R. norvegicus
gggccacaacaactgg

SEQ ID NO: 511393 - DNA, 17 bp, R. norvegicus
gggccactggagagcct

SEQ ID NO: 511394 - DNA, 16 bp, R. norvegicus
gggccagaaagatggc

SEQ ID NO: 511395 - DNA, 16 bp, R. norvegicus
gggccagaagaaagaa

SEQ ID NO: 511396 - DNA, 16 bp, R. norvegicus
gggccagaagaggaca

SEQ ID NO: 511397 - DNA, 16 bp, R. norvegicus
gggccagaccaggcag

SEQ ID NO: 511398 - DNA, 16 bp, R. norvegicus
gggccagcaaggtggc

SEQ ID NO: 511399 - DNA, 16 bp, R. norvegicus
gggccagctctcctga

SEQ ID NO: 511400 - DNA, 16 bp, R. norvegicus
gggccaggagcagcag

SEQ ID NO: 511401 - DNA, 16 bp, R. norvegicus
gggccatctgtgtgac

SEQ ID NO: 511402 - DNA, 16 bp, R. norvegicus
gggccatggtccagat

SEQ ID NO: 511403 - DNA, 16 bp, R. norvegicus
gggccatgtgcttgct

SEQ ID NO: 511404 - DNA, 16 bp, R. norvegicus
gggccattgctgtttt

SEQ ID NO: 511405 - DNA, 16 bp, R. norvegicus
gggcccaatcaggggc

SEQ ID NO: 511406 - DNA, 16 bp, R. norvegicus
gggcccaattctccca

SEQ ID NO: 511407 - DNA, 27 bp, R. norvegicus
gggcccaggagcagcaggacccctgcc

SEQ ID NO: 511408 - DNA, 16 bp, R. norvegicus
gggcccccattggagg

SEQ ID NO: 511409 - DNA, 16 bp, R. norvegicus
gggcccctccatgtgt

SEQ ID NO: 511410 - DNA, 16 bp, R. norvegicus
gggccctccagtctct

SEQ ID NO: 511411 - DNA, 16 bp, R. norvegicus
gggccctgatggtgct

SEQ ID NO: 511412 - DNA, 16 bp, R. norvegicus
gggccctgttctcagt

SEQ ID NO: 511413 - DNA, 16 bp, R. norvegicus
gggccggggagatggc

SEQ ID NO: 511414 - DNA, 16 bp, R. norvegicus
gggcctccagtgtctt

SEQ ID NO: 511415 - DNA, 16 bp, R. norvegicus
gggcctcccctcccag

SEQ ID NO: 511416 - DNA, 16 bp, R. norvegicus
gggcctctcctcccac

SEQ ID NO: 511417 - DNA, 16 bp, R. norvegicus
gggcctggacagatgt

SEQ ID NO: 511418 - DNA, 16 bp, R. norvegicus
gggcctggtgcccagg

SEQ ID NO: 511419 - DNA, 16 bp, R. norvegicus
gggccttcacaggacc

SEQ ID NO: 511420 - DNA, 16 bp, R. norvegicus
gggccttccaactgga

SEQ ID NO: 511421 - DNA, 16 bp, R. norvegicus
gggccttgcgctctct

SEQ ID NO: 511422 - DNA, 16 bp, R. norvegicus
gggcgacacagagaaa

SEQ ID NO: 511423 - DNA, 16 bp, R. norvegicus
gggctaaagtcctggt

SEQ ID NO: 511424 - DNA, 16 bp, R. norvegicus
gggctacacagtgagc

SEQ ID NO: 511425 - DNA, 16 bp, R. norvegicus
gggctacctagagaaa

SEQ ID NO: 511426 - DNA, 16 bp, R. norvegicus
gggctccagtgatgcc

SEQ ID NO: 511427 - DNA, 16 bp, R. norvegicus
gggctccctggccagc

SEQ ID NO: 511428 - DNA, 16 bp, R. norvegicus
gggctcctgggaagtg

SEQ ID NO: 511429 - DNA, 16 bp, R. norvegicus
gggctctgccactgag

SEQ ID NO: 511430 - DNA, 16 bp, R. norvegicus
gggctgaaatccacca

SEQ ID NO: 511431 - DNA, 16 bp, R. norvegicus
gggctgaaggaactga

SEQ ID NO: 511432 - DNA, 16 bp, R. norvegicus
gggctgaatccccagg

SEQ ID NO: 511433 - DNA, 16 bp, R. norvegicus
gggctgagaagaaatg

SEQ ID NO: 511434 - DNA, 16 bp, R. norvegicus
gggctgaggagaaggc

SEQ ID NO: 511435 - DNA, 16 bp, R. norvegicus
gggctgaggagaggga

SEQ ID NO: 511436 - DNA, 16 bp, R. norvegicus
gggctgaggatgtggc

SEQ ID NO: 511437 - DNA, 16 bp, R. norvegicus
gggctgatattgggat

SEQ ID NO: 511438 - DNA, 16 bp, R. norvegicus
gggctgatggacaaga

SEQ ID NO: 511439 - DNA, 16 bp, R. norvegicus
gggctgccaccagaag

SEQ ID NO: 511440 - DNA, 16 bp, R. norvegicus
gggctgctggagaggc

SEQ ID NO: 511441 - DNA, 16 bp, R. norvegicus
gggctggaaactgttg

SEQ ID NO: 511442 - DNA, 16 bp, R. norvegicus
gggctggaaagaaggc

SEQ ID NO: 511443 - DNA, 16 bp, R. norvegicus
gggctggaagatggct

SEQ ID NO: 511444 - DNA, 16 bp, R. norvegicus
gggctggagacacagc

SEQ ID NO: 511445 - DNA, 16 bp, R. norvegicus
gggctggagagttggc

SEQ ID NO: 511446 - DNA, 16 bp, R. norvegicus
gggctggaggtgtggc

SEQ ID NO: 511447 - DNA, 16 bp, R. norvegicus
gggctggagtgatggc

SEQ ID NO: 511448 - DNA, 16 bp, R. norvegicus
gggctggattcccagg

SEQ ID NO: 511449 - DNA, 16 bp, R. norvegicus
gggctggcctacaggt

SEQ ID NO: 511450 - DNA, 16 bp, R. norvegicus
gggctgggaatatagc

SEQ ID NO: 511451 - DNA, 16 bp, R. norvegicus
gggctgggcagtggtg

SEQ ID NO: 511452 - DNA, 16 bp, R. norvegicus
gggctggggactgaac

SEQ ID NO: 511453 - DNA, 18 bp, R. norvegicus
gggctggggatttagctc

SEQ ID NO: 511454 - DNA, 21 bp, R. norvegicus
gggctggggatttagctcagt

SEQ ID NO: 511455 - DNA, 16 bp, R. norvegicus
gggctggggctgggac

SEQ ID NO: 511456 - DNA, 16 bp, R. norvegicus
gggctggtgggatggc

SEQ ID NO: 511457 - DNA, 16 bp, R. norvegicus
gggctggtggtcccgg

SEQ ID NO: 511458 - DNA, 16 bp, R. norvegicus
gggctggtgttcctgg

SEQ ID NO: 511459 - DNA, 16 bp, R. norvegicus
gggctggttgtcctgg

SEQ ID NO: 511460 - DNA, 16 bp, R. norvegicus
gggctgtgcagccatc

SEQ ID NO: 511461 - DNA, 16 bp, R. norvegicus
gggctgtgctgtgctg

SEQ ID NO: 511462 - DNA, 16 bp, R. norvegicus
gggctgtggtgggcag

SEQ ID NO: 511463 - DNA, 16 bp, R. norvegicus
gggcttatatccaaag

SEQ ID NO: 511464 - DNA, 16 bp, R. norvegicus
gggcttatcagggttt

SEQ ID NO: 511465 - DNA, 16 bp, R. norvegicus
gggcttccctacagcc

SEQ ID NO: 511466 - DNA, 16 bp, R. norvegicus
gggcttctacctcttt

SEQ ID NO: 511467 - DNA, 16 bp, R. norvegicus
gggcttctccttccct

SEQ ID NO: 511468 - DNA, 16 bp, R. norvegicus
gggcttctgcttccac

SEQ ID NO: 511469 - DNA, 16 bp, R. norvegicus
gggcttcttcttgttt

SEQ ID NO: 511470 - DNA, 16 bp, R. norvegicus
gggcttgcgaccccat

SEQ ID NO: 511471 - DNA, 16 bp, R. norvegicus
gggcttggggtcagag

SEQ ID NO: 511472 - DNA, 16 bp, R. norvegicus
gggcttgtgagatggc

SEQ ID NO: 511473 - DNA, 16 bp, R. norvegicus
gggctttccaaatgca

SEQ ID NO: 511474 - DNA, 16 bp, R. norvegicus
gggctttgagatcctc

SEQ ID NO: 511475 - DNA, 16 bp, R. norvegicus
gggctttgaggtgtca

SEQ ID NO: 511476 - DNA, 16 bp, R. norvegicus
gggctttgagttggcc

SEQ ID NO: 511477 - DNA, 16 bp, R. norvegicus
gggctttgcacttgct

SEQ ID NO: 511478 - DNA, 16 bp, R. norvegicus
gggctttgtatgttta

SEQ ID NO: 511479 - DNA, 16 bp, R. norvegicus
gggctttgtgcatgct

SEQ ID NO: 511480 - DNA, 16 bp, R. norvegicus
ggggaaaaaaaaactt

SEQ ID NO: 511481 - DNA, 16 bp, R. norvegicus
ggggaaaaaaaacctt

SEQ ID NO: 511482 - DNA, 16 bp, R. norvegicus
ggggaaaaaaacccta

SEQ ID NO: 511483 - DNA, 16 bp, R. norvegicus
ggggaaaaaaatcact

SEQ ID NO: 511484 - DNA, 16 bp, R. norvegicus
ggggaaaaaagccttc

SEQ ID NO: 511485 - DNA, 16 bp, R. norvegicus
ggggaaactgaggccc

SEQ ID NO: 511486 - DNA, 16 bp, R. norvegicus
ggggaaactgtggttg

SEQ ID NO: 511487 - DNA, 16 bp, R. norvegicus
ggggaaagaacgcccc

SEQ ID NO: 511488 - DNA, 16 bp, R. norvegicus
ggggaaagcctcaacc

SEQ ID NO: 511489 - DNA, 16 bp, R. norvegicus
ggggaaaggacgcccc

SEQ ID NO: 511490 - DNA, 16 bp, R. norvegicus
ggggaaatggaagcaa

SEQ ID NO: 511491 - DNA, 16 bp, R. norvegicus
ggggaaatggagacag

SEQ ID NO: 511492 - DNA, 16 bp, R. norvegicus
ggggaaatggcagtga

SEQ ID NO: 511493 - DNA, 16 bp, R. norvegicus
ggggaaatttcacaag

SEQ ID NO: 511494 - DNA, 16 bp, R. norvegicus
ggggaaattttcttct

SEQ ID NO: 511495 - DNA, 16 bp, R. norvegicus
ggggaacaggatcagg

SEQ ID NO: 511496 - DNA, 16 bp, R. norvegicus
ggggaactggaggtag

SEQ ID NO: 511497 - DNA, 16 bp, R. norvegicus
ggggaagaaaggcttt

SEQ ID NO: 511498 - DNA, 16 bp, R. norvegicus
ggggaagaagtacaga

SEQ ID NO: 511499 - DNA, 16 bp, R. norvegicus
ggggaagaagtatgtg

SEQ ID NO: 511500 - DNA, 16 bp, R. norvegicus
ggggaagagcctcgaa

SEQ ID NO: 511501 - DNA, 16 bp, R. norvegicus
ggggaagaggacctgt

SEQ ID NO: 511502 - DNA, 16 bp, R. norvegicus
ggggaagcaaaccagt

SEQ ID NO: 511503 - DNA, 16 bp, R. norvegicus
ggggaaggagctgaag

SEQ ID NO: 511504 - DNA, 16 bp, R. norvegicus
ggggaagggaagccca

SEQ ID NO: 511505 - DNA, 16 bp, R. norvegicus
ggggaaggggaagctc

SEQ ID NO: 511506 - DNA, 16 bp, R. norvegicus
ggggaagtctctggtc

SEQ ID NO: 511507 - DNA, 16 bp, R. norvegicus
ggggaatacccatatg

SEQ ID NO: 511508 - DNA, 16 bp, R. norvegicus
ggggaatgccagggca

SEQ ID NO: 511509 - DNA, 16 bp, R. norvegicus
ggggaatgcctgggtg

SEQ ID NO: 511510 - DNA, 28 bp, R. norvegicus
ggggacaagcaacatcaccattagtcat

SEQ ID NO: 511511 - DNA, 16 bp, R. norvegicus
ggggacagagacagag

SEQ ID NO: 511512 - DNA, 16 bp, R. norvegicus
ggggacagggaccctc

SEQ ID NO: 511513 - DNA, 16 bp, R. norvegicus
ggggacatagctcagt

SEQ ID NO: 511514 - DNA, 16 bp, R. norvegicus
ggggaccacattctca

SEQ ID NO: 511515 - DNA, 16 bp, R. norvegicus
ggggaccagagttcag

SEQ ID NO: 511516 - DNA, 16 bp, R. norvegicus
ggggacccaggttcaa

SEQ ID NO: 511517 - DNA, 16 bp, R. norvegicus
ggggaccccattctca

SEQ ID NO: 511518 - DNA, 16 bp, R. norvegicus
ggggacccctgtggaa

SEQ ID NO: 511519 - DNA, 49 bp, R. norvegicus
ggggacctattctcagttcagtggtttgctgctggcattcgcctctata

SEQ ID NO: 511520 - DNA, 16 bp, R. norvegicus
ggggactcaagtctct

SEQ ID NO: 511521 - DNA, 16 bp, R. norvegicus
ggggactccattctca

SEQ ID NO: 511522 - DNA, 16 bp, R. norvegicus
ggggactctggagagg

SEQ ID NO: 511523 - DNA, 16 bp, R. norvegicus
ggggactgagcccagg

SEQ ID NO: 511524 - DNA, 16 bp, R. norvegicus
ggggactggagagatg

SEQ ID NO: 511525 - DNA, 16 bp, R. norvegicus
ggggactggcgcaccc

SEQ ID NO: 511526 - DNA, 16 bp, R. norvegicus
ggggagaaagctggac

SEQ ID NO: 511527 - DNA, 16 bp, R. norvegicus
ggggagaagagggttt

SEQ ID NO: 511528 - DNA, 16 bp, R. norvegicus
ggggagaagccgtggc

SEQ ID NO: 511529 - DNA, 16 bp, R. norvegicus
ggggagaagctaggag

SEQ ID NO: 511530 - DNA, 16 bp, R. norvegicus
ggggagagagttggac

SEQ ID NO: 511531 - DNA, 16 bp, R. norvegicus
ggggagatggctcggt

SEQ ID NO: 511532 - DNA, 16 bp, R. norvegicus
ggggagccacagagaa

SEQ ID NO: 511533 - DNA, 16 bp, R. norvegicus
ggggagcggcaggacc

SEQ ID NO: 511534 - DNA, 22 bp, R. norvegicus
ggggagctattgtcctcctggg

SEQ ID NO: 511535 - DNA, 16 bp, R. norvegicus
ggggaggaggaactgg

SEQ ID NO: 511536 - DNA, 16 bp, R. norvegicus
ggggagggactgtgtg

SEQ ID NO: 511537 - DNA, 16 bp, R. norvegicus
ggggagggcagatgtg

SEQ ID NO: 511538 - DNA, 24 bp, R. norvegicus
ggggagggcagcaatggggggagg

SEQ ID NO: 511539 - DNA, 16 bp, R. norvegicus
ggggagggcccagaag

SEQ ID NO: 511540 - DNA, 16 bp, R. norvegicus
ggggagggcggaaatg

SEQ ID NO: 511541 - DNA, 17 bp, R. norvegicus
ggggagggcggcaatgg

SEQ ID NO: 511542 - DNA, 16 bp, R. norvegicus
ggggaggtccagcctt

SEQ ID NO: 511543 - DNA, 16 bp, R. norvegicus
ggggataacatttgaa

SEQ ID NO: 511544 - DNA, 16 bp, R. norvegicus
ggggatacccaggagg

SEQ ID NO: 511545 - DNA, 16 bp, R. norvegicus
ggggatatggagactg

SEQ ID NO: 511546 - DNA, 16 bp, R. norvegicus
ggggatgcagaggcag

SEQ ID NO: 511547 - DNA, 16 bp, R. norvegicus
ggggatgctgggaatt

SEQ ID NO: 511548 - DNA, 16 bp, R. norvegicus
ggggatggaaacagga

SEQ ID NO: 511549 - DNA, 16 bp, R. norvegicus
ggggatggcttacagg

SEQ ID NO: 511550 - DNA, 35 bp, R. norvegicus
ggggatttagctcagtggtagagcgcttgcctagc

SEQ ID NO: 511551 - DNA, 16 bp, R. norvegicus
ggggatttatggatgg

SEQ ID NO: 511552 - DNA, 16 bp, R. norvegicus
ggggattttggcctgg

SEQ ID NO: 511553 - DNA, 16 bp, R. norvegicus
ggggcacagctggcac

SEQ ID NO: 511554 - DNA, 16 bp, R. norvegicus
ggggcacaggctgggg

SEQ ID NO: 511555 - DNA, 16 bp, R. norvegicus
ggggcagactgtgata

SEQ ID NO: 511556 - DNA, 16 bp, R. norvegicus
ggggcagaggcaggtg

SEQ ID NO: 511557 - DNA, 16 bp, R. norvegicus
ggggcagcagcagcag

SEQ ID NO: 511558 - DNA, 16 bp, R. norvegicus
ggggcagccatcttcc

SEQ ID NO: 511559 - DNA, 16 bp, R. norvegicus
ggggcagcctgggcta

SEQ ID NO: 511560 - DNA, 16 bp, R. norvegicus
ggggcaggagagtgtg

SEQ ID NO: 511561 - DNA, 16 bp, R. norvegicus
ggggcaggagctgatg

SEQ ID NO: 511562 - DNA, 16 bp, R. norvegicus
ggggcagtcagagatg

SEQ ID NO: 511563 - DNA, 16 bp, R. norvegicus
ggggcagtgcagagag

SEQ ID NO: 511564 - DNA, 16 bp, R. norvegicus
ggggcattaagccttc

SEQ ID NO: 511565 - DNA, 16 bp, R. norvegicus
ggggccaaagaggaag

SEQ ID NO: 511566 - DNA, 16 bp, R. norvegicus
ggggccaagcagcccc

SEQ ID NO: 511567 - DNA, 16 bp, R. norvegicus
ggggccagcctggtct

SEQ ID NO: 511568 - DNA, 16 bp, R. norvegicus
ggggccagctctcctg

SEQ ID NO: 511569 - DNA, 16 bp, R. norvegicus
ggggccccaggaaaag

SEQ ID NO: 511570 - DNA, 19 bp, R. norvegicus
ggggccttgcgcttcctag

SEQ ID NO: 511571 - DNA, 16 bp, R. norvegicus
ggggctcaagactcca

SEQ ID NO: 511572 - DNA, 16 bp, R. norvegicus
ggggctcatgacccca

SEQ ID NO: 511573 - DNA, 16 bp, R. norvegicus
ggggctccagacccca

SEQ ID NO: 511574 - DNA, 16 bp, R. norvegicus
ggggctctctgcagcg

SEQ ID NO: 511575 - DNA, 16 bp, R. norvegicus
ggggctctctgcaggg

SEQ ID NO: 511576 - DNA, 16 bp, R. norvegicus
ggggctctgacaccct

SEQ ID NO: 511577 - DNA, 16 bp, R. norvegicus
ggggctgagtgagaat

SEQ ID NO: 511578 - DNA, 16 bp, R. norvegicus
ggggctggaggagctg

SEQ ID NO: 511579 - DNA, 16 bp, R. norvegicus
ggggctgggttacagg

SEQ ID NO: 511580 - DNA, 16 bp, R. norvegicus
ggggctggtgagatgg

SEQ ID NO: 511581 - DNA, 16 bp, R. norvegicus
ggggctgtttgccatc

SEQ ID NO: 511582 - DNA, 16 bp, R. norvegicus
ggggcttatggactgg

SEQ ID NO: 511583 - DNA, 16 bp, R. norvegicus
gggggaacaaaattat

SEQ ID NO: 511584 - DNA, 16 bp, R. norvegicus
gggggaagaggacctg

SEQ ID NO: 511585 - DNA, 16 bp, R. norvegicus
gggggacaggatcagg

SEQ ID NO: 511586 - DNA, 16 bp, R. norvegicus
gggggacattcttatt

SEQ ID NO: 511587 - DNA, 16 bp, R. norvegicus
gggggagagcccagga

SEQ ID NO: 511588 - DNA, 16 bp, R. norvegicus
gggggagcaaaggctc

SEQ ID NO: 511589 - DNA, 16 bp, R. norvegicus
gggggagggagagtca

SEQ ID NO: 511590 - DNA, 16 bp, R. norvegicus
gggggatatttgcctg

SEQ ID NO: 511591 - DNA, 16 bp, R. norvegicus
gggggatttctgtgag

SEQ ID NO: 511592 - DNA, 16 bp, R. norvegicus
gggggcaagcagcctc

SEQ ID NO: 511593 - DNA, 16 bp, R. norvegicus
gggggcacaggctggg

SEQ ID NO: 511594 - DNA, 16 bp, R. norvegicus
gggggcatgttccagc

SEQ ID NO: 511595 - DNA, 16 bp, R. norvegicus
gggggccagcctggtc

SEQ ID NO: 511596 - DNA, 16 bp, R. norvegicus
gggggctccaggaaaa

SEQ ID NO: 511597 - DNA, 16 bp, R. norvegicus
gggggctggacagatg

SEQ ID NO: 511598 - DNA, 16 bp, R. norvegicus
gggggtctcaagcccc

SEQ ID NO: 511599 - DNA, 16 bp, R. norvegicus
gggggtgaactgggtg

SEQ ID NO: 511600 - DNA, 16 bp, R. norvegicus
gggggtgcctctgcgg

SEQ ID NO: 511601 - DNA, 16 bp, R. norvegicus
ggggtcacatatcaga

SEQ ID NO: 511602 - DNA, 16 bp, R. norvegicus
ggggtcatctaagacc

SEQ ID NO: 511603 - DNA, 16 bp, R. norvegicus
ggggtccccacaacat

SEQ ID NO: 511604 - DNA, 16 bp, R. norvegicus
ggggtccctgagctca

SEQ ID NO: 511605 - DNA, 35 bp, R. norvegicus
ggggtcctattctcagttcagtggtttgctgctgg

SEQ ID NO: 511606 - DNA, 16 bp, R. norvegicus
ggggtcctgtcctcag

SEQ ID NO: 511607 - DNA, 16 bp, R. norvegicus
ggggtctccaaagcaa

SEQ ID NO: 511608 - DNA, 16 bp, R. norvegicus
ggggtctcgacccaca

SEQ ID NO: 511609 - DNA, 16 bp, R. norvegicus
ggggtctcttcacagc

SEQ ID NO: 511610 - DNA, 16 bp, R. norvegicus
ggggtgaagaactcag

SEQ ID NO: 511611 - DNA, 16 bp, R. norvegicus
ggggtgaccaggagga

SEQ ID NO: 511612 - DNA, 16 bp, R. norvegicus
ggggtgcctggactgt

SEQ ID NO: 511613 - DNA, 16 bp, R. norvegicus
ggggtgctgctttctg

SEQ ID NO: 511614 - DNA, 16 bp, R. norvegicus
ggggtggagcctagac

SEQ ID NO: 511615 - DNA, 16 bp, R. norvegicus
ggggtgggcttggaga

SEQ ID NO: 511616 - DNA, 16 bp, R. norvegicus
ggggtgggctttgagg

SEQ ID NO: 511617 - DNA, 16 bp, R. norvegicus
ggggtggtacccaagg

SEQ ID NO: 511618 - DNA, 16 bp, R. norvegicus
ggggttgggctttgag

SEQ ID NO: 511619 - DNA, 16 bp, R. norvegicus
ggggttggtgcttgcc

SEQ ID NO: 511620 - DNA, 16 bp, R. norvegicus
ggggtttctggaggag

SEQ ID NO: 511621 - DNA, 16 bp, R. norvegicus
ggggtttgaggccagc

SEQ ID NO: 511622 - DNA, 16 bp, R. norvegicus
ggggtttgcaaccaca

SEQ ID NO: 511623 - DNA, 16 bp, R. norvegicus
gggtaaactgaggcag

SEQ ID NO: 511624 - DNA, 16 bp, R. norvegicus
gggtaagagcactggc

SEQ ID NO: 511625 - DNA, 16 bp, R. norvegicus
gggtacatagtgagac

SEQ ID NO: 511626 - DNA, 16 bp, R. norvegicus
gggtacattccccaag

SEQ ID NO: 511627 - DNA, 16 bp, R. norvegicus
gggtagcagagatgaa

SEQ ID NO: 511628 - DNA, 16 bp, R. norvegicus
gggtatatgccaagga

SEQ ID NO: 511629 - DNA, 48 bp, R. norvegicus
gggtatatgcccaagagaggtatagctggatcctcaggcagttcaata

SEQ ID NO: 511630 - DNA, 16 bp, R. norvegicus
gggtatatgcccagga

SEQ ID NO: 511631 - DNA, 16 bp, R. norvegicus
gggtatccagtatttg

SEQ ID NO: 511632 - DNA, 16 bp, R. norvegicus
gggtatggtggtacac

SEQ ID NO: 511633 - DNA, 16 bp, R. norvegicus
gggtattgcaacccca

SEQ ID NO: 511634 - DNA, 16 bp, R. norvegicus
gggtattttcttgatt

SEQ ID NO: 511635 - DNA, 16 bp, R. norvegicus
gggtcaaggacctcaa

SEQ ID NO: 511636 - DNA, 17 bp, R. norvegicus
gggtcacccgttttcag

SEQ ID NO: 511637 - DNA, 16 bp, R. norvegicus
gggtcacctaagacca

SEQ ID NO: 511638 - DNA, 16 bp, R. norvegicus
gggtcagctctgggca

SEQ ID NO: 511639 - DNA, 16 bp, R. norvegicus
gggtcaggctctgaat

SEQ ID NO: 511640 - DNA, 16 bp, R. norvegicus
gggtcatcctcctcct

SEQ ID NO: 511641 - DNA, 16 bp, R. norvegicus
gggtcatgcagatagg

SEQ ID NO: 511642 - DNA, 16 bp, R. norvegicus
gggtcatttctgggtc

SEQ ID NO: 511643 - DNA, 16 bp, R. norvegicus
gggtccagcctagtgc

SEQ ID NO: 511644 - DNA, 16 bp, R. norvegicus
gggtcccagtgctcag

SEQ ID NO: 511645 - DNA, 16 bp, R. norvegicus
gggtccccaatggggg

SEQ ID NO: 511646 - DNA, 16 bp, R. norvegicus
gggtcccccacctcct

SEQ ID NO: 511647 - DNA, 16 bp, R. norvegicus
gggtccctgggtccct

SEQ ID NO: 511648 - DNA, 16 bp, R. norvegicus
gggtcctcagcaagaa

SEQ ID NO: 511649 - DNA, 16 bp, R. norvegicus
gggtcctgacccacag

SEQ ID NO: 511650 - DNA, 16 bp, R. norvegicus
gggtcctgggaacttc

SEQ ID NO: 511651 - DNA, 16 bp, R. norvegicus
gggtcctgggaattga

SEQ ID NO: 511652 - DNA, 16 bp, R. norvegicus
gggtctcactaagttg

SEQ ID NO: 511653 - DNA, 16 bp, R. norvegicus
gggtctcactgcatag

SEQ ID NO: 511654 - DNA, 16 bp, R. norvegicus
gggtctcatgttgccc

SEQ ID NO: 511655 - DNA, 16 bp, R. norvegicus
gggtctccaagcccat

SEQ ID NO: 511656 - DNA, 16 bp, R. norvegicus
gggtctccagggcttc

SEQ ID NO: 511657 - DNA, 16 bp, R. norvegicus
gggtctcctggaagag

SEQ ID NO: 511658 - DNA, 16 bp, R. norvegicus
gggtctgagagcagag

SEQ ID NO: 511659 - DNA, 16 bp, R. norvegicus
gggtctggagagatgg

SEQ ID NO: 511660 - DNA, 16 bp, R. norvegicus
gggtctggagggctgt

SEQ ID NO: 511661 - DNA, 16 bp, R. norvegicus
gggtctgggtgcagag

SEQ ID NO: 511662 - DNA, 16 bp, R. norvegicus
gggtctggttgcttga

SEQ ID NO: 511663 - DNA, 16 bp, R. norvegicus
gggtctgtttgacatc

SEQ ID NO: 511664 - DNA, 16 bp, R. norvegicus
gggtctgttttcattt

SEQ ID NO: 511665 - DNA, 16 bp, R. norvegicus
gggtcttcctgcctca

SEQ ID NO: 511666 - DNA, 16 bp, R. norvegicus
gggtgaatatgatcaa

SEQ ID NO: 511667 - DNA, 16 bp, R. norvegicus
gggtgacatttgaaat

SEQ ID NO: 511668 - DNA, 16 bp, R. norvegicus
gggtgacccctgtgaa

SEQ ID NO: 511669 - DNA, 16 bp, R. norvegicus
gggtgacctcaaactc

SEQ ID NO: 511670 - DNA, 16 bp, R. norvegicus
gggtgagagagctgga

SEQ ID NO: 511671 - DNA, 16 bp, R. norvegicus
gggtgaggaggcagga

SEQ ID NO: 511672 - DNA, 16 bp, R. norvegicus
gggtgagttcactggc

SEQ ID NO: 511673 - DNA, 16 bp, R. norvegicus
gggtgcacatatctgt

SEQ ID NO: 511674 - DNA, 16 bp, R. norvegicus
gggtgcagagaactca

SEQ ID NO: 511675 - DNA, 16 bp, R. norvegicus
gggtgcagagagctgt

SEQ ID NO: 511676 - DNA, 16 bp, R. norvegicus
gggtgcagcgaacttt

SEQ ID NO: 511677 - DNA, 16 bp, R. norvegicus
gggtgcaggaggagct

SEQ ID NO: 511678 - DNA, 16 bp, R. norvegicus
gggtgcagggtgcagg

SEQ ID NO: 511679 - DNA, 16 bp, R. norvegicus
gggtgcctctgcaggc

SEQ ID NO: 511680 - DNA, 16 bp, R. norvegicus
gggtgctctcccacct

SEQ ID NO: 511681 - DNA, 16 bp, R. norvegicus
gggtgctgcttatgag

SEQ ID NO: 511682 - DNA, 16 bp, R. norvegicus
gggtgctgcttgctgg

SEQ ID NO: 511683 - DNA, 16 bp, R. norvegicus
gggtgctggagactga

SEQ ID NO: 511684 - DNA, 16 bp, R. norvegicus
gggtgctgggaaccaa

SEQ ID NO: 511685 - DNA, 16 bp, R. norvegicus
gggtgctgggaactga

SEQ ID NO: 511686 - DNA, 16 bp, R. norvegicus
gggtgctggggaccca

SEQ ID NO: 511687 - DNA, 16 bp, R. norvegicus
gggtgcttgctgctct

SEQ ID NO: 511688 - DNA, 16 bp, R. norvegicus
gggtggaacccagggc

SEQ ID NO: 511689 - DNA, 16 bp, R. norvegicus
gggtggagcctctcag

SEQ ID NO: 511690 - DNA, 16 bp, R. norvegicus
gggtggcaggaagggt

SEQ ID NO: 511691 - DNA, 16 bp, R. norvegicus
gggtggccccatcctc

SEQ ID NO: 511692 - DNA, 16 bp, R. norvegicus
gggtgggaaagcacag

SEQ ID NO: 511693 - DNA, 16 bp, R. norvegicus
gggtgggggagcacct

SEQ ID NO: 511694 - DNA, 16 bp, R. norvegicus
gggtgtaattgcttct

SEQ ID NO: 511695 - DNA, 16 bp, R. norvegicus
gggtgtactggctggt

SEQ ID NO: 511696 - DNA, 16 bp, R. norvegicus
gggtgtctctggcagg

SEQ ID NO: 511697 - DNA, 16 bp, R. norvegicus
gggtgttgaatttgtc

SEQ ID NO: 511698 - DNA, 16 bp, R. norvegicus
gggtgttgcaggagtg

SEQ ID NO: 511699 - DNA, 16 bp, R. norvegicus
gggtgtttcctgagag

SEQ ID NO: 511700 - DNA, 16 bp, R. norvegicus
gggttacaggcatgtg

SEQ ID NO: 511701 - DNA, 16 bp, R. norvegicus
gggttacggggatgtt

SEQ ID NO: 511702 - DNA, 16 bp, R. norvegicus
gggttatttccatgtg

SEQ ID NO: 511703 - DNA, 16 bp, R. norvegicus
gggttcaattcccacc

SEQ ID NO: 511704 - DNA, 16 bp, R. norvegicus
gggttcagtcagagag

SEQ ID NO: 511705 - DNA, 16 bp, R. norvegicus
gggttcagtctccagc

SEQ ID NO: 511706 - DNA, 16 bp, R. norvegicus
gggttccaggtcagcc

SEQ ID NO: 511707 - DNA, 16 bp, R. norvegicus
gggttcctctttctcc

SEQ ID NO: 511708 - DNA, 16 bp, R. norvegicus
gggttctccagagtca

SEQ ID NO: 511709 - DNA, 16 bp, R. norvegicus
gggttctctagaggaa

SEQ ID NO: 511710 - DNA, 16 bp, R. norvegicus
gggttctctggtggaa

SEQ ID NO: 511711 - DNA, 16 bp, R. norvegicus
gggttctgggaactga

SEQ ID NO: 511712 - DNA, 16 bp, R. norvegicus
gggttgccctccttct

SEQ ID NO: 511713 - DNA, 16 bp, R. norvegicus
gggttgcctccctgat

SEQ ID NO: 511714 - DNA, 16 bp, R. norvegicus
gggttggagagaaggc

SEQ ID NO: 511715 - DNA, 21 bp, R. norvegicus
gggttggggatttagctcagc

SEQ ID NO: 511716 - DNA, 23 bp, R. norvegicus
gggttggggatttggctcagtgg

SEQ ID NO: 511717 - DNA, 16 bp, R. norvegicus
gggttggtgaagattt

SEQ ID NO: 511718 - DNA, 16 bp, R. norvegicus
gggtttcccttccact

SEQ ID NO: 511719 - DNA, 16 bp, R. norvegicus
gggtttctctcctgtt

SEQ ID NO: 511720 - DNA, 16 bp, R. norvegicus
gggtttgatcctcaga

SEQ ID NO: 511721 - DNA, 16 bp, R. norvegicus
gggtttgcagaaggga

SEQ ID NO: 511722 - DNA, 16 bp, R. norvegicus
gggtttggagggagaa

SEQ ID NO: 511723 - DNA, 16 bp, R. norvegicus
gggtttggttcccagc

SEQ ID NO: 511724 - DNA, 16 bp, R. norvegicus
gggttttattactgtg

SEQ ID NO: 511725 - DNA, 16 bp, R. norvegicus
gggttttctggaagag

SEQ ID NO: 511726 - DNA, 16 bp, R. norvegicus
gggttttgctgctgtg

SEQ ID NO: 511727 - DNA, 16 bp, R. norvegicus
gggttttgggaactga

SEQ ID NO: 511728 - DNA, 16 bp, R. norvegicus
gggtttttctgtgtaa

SEQ ID NO: 511729 - DNA, 16 bp, R. norvegicus
ggtaaaatgtccattt

SEQ ID NO: 511730 - DNA, 16 bp, R. norvegicus
ggtaaagacatttttc

SEQ ID NO: 511731 - DNA, 16 bp, R. norvegicus
ggtaaagacctttttc

SEQ ID NO: 511732 - DNA, 26 bp, R. norvegicus
ggtaaagcccaaaataaggaggcaag

SEQ ID NO: 511733 - DNA, 42 bp, R. norvegicus
ggtaaagcccaacataaggaggcaagctataacctagaagaa

SEQ ID NO: 511734 - DNA, 16 bp, R. norvegicus
ggtaaataaaaatgcc

SEQ ID NO: 511735 - DNA, 19 bp, R. norvegicus
ggtaacgatatggagcaaa

SEQ ID NO: 511736 - DNA, 16 bp, R. norvegicus
ggtaactccagctcca

SEQ ID NO: 511737 - DNA, 16 bp, R. norvegicus
ggtaactttattttct

SEQ ID NO: 511738 - DNA, 16 bp, R. norvegicus
ggtaagccagggtgtg

SEQ ID NO: 511739 - DNA, 16 bp, R. norvegicus
ggtaaggctctgacag

SEQ ID NO: 511740 - DNA, 42 bp, R. norvegicus
ggtaattggactggagaattcgatttcttaatggatcagcta

SEQ ID NO: 511741 - DNA, 16 bp, R. norvegicus
ggtacaaagagtggag

SEQ ID NO: 511742 - DNA, 16 bp, R. norvegicus
ggtacaaggagagaac

SEQ ID NO: 511743 - DNA, 16 bp, R. norvegicus
ggtacacagacataca

SEQ ID NO: 511744 - DNA, 16 bp, R. norvegicus
ggtacacccttataga

SEQ ID NO: 511745 - DNA, 16 bp, R. norvegicus
ggtacagagaactgtg

SEQ ID NO: 511746 - DNA, 16 bp, R. norvegicus
ggtacagagccaggca

SEQ ID NO: 511747 - DNA, 16 bp, R. norvegicus
ggtacaggaagagctg

SEQ ID NO: 511748 - DNA, 16 bp, R. norvegicus
ggtacatgcctgtgat

SEQ ID NO: 511749 - DNA, 16 bp, R. norvegicus
ggtacatgtacacaca

SEQ ID NO: 511750 - DNA, 16 bp, R. norvegicus
ggtacccattggagga

SEQ ID NO: 511751 - DNA, 16 bp, R. norvegicus
ggtaccccattctcag

SEQ ID NO: 511752 - DNA, 16 bp, R. norvegicus
ggtacctggaatctgt

SEQ ID NO: 511753 - DNA, 16 bp, R. norvegicus
ggtactggaggagctg

SEQ ID NO: 511754 - DNA, 16 bp, R. norvegicus
ggtactggtgcactga

SEQ ID NO: 511755 - DNA, 16 bp, R. norvegicus
ggtacttccttctaca

SEQ ID NO: 511756 - DNA, 16 bp, R. norvegicus
ggtactttctgcaaaa

SEQ ID NO: 511757 - DNA, 17 bp, R. norvegicus
ggtagaaacaaaaagga

SEQ ID NO: 511758 - DNA, 16 bp, R. norvegicus
ggtagaagaagaaaac

SEQ ID NO: 511759 - DNA, 16 bp, R. norvegicus
ggtagaatgcctgcct

SEQ ID NO: 511760 - DNA, 16 bp, R. norvegicus
ggtagaccgcctgaaa

SEQ ID NO: 511761 - DNA, 16 bp, R. norvegicus
ggtagagacaggaggg

SEQ ID NO: 511762 - DNA, 16 bp, R. norvegicus
ggtagagagattgctg

SEQ ID NO: 511763 - DNA, 16 bp, R. norvegicus
ggtagagatcttttcc

SEQ ID NO: 511764 - DNA, 23 bp, R. norvegicus
ggtagagcacttgcctagcaagc

SEQ ID NO: 511765 - DNA, 16 bp, R. norvegicus
ggtagagctggccctg

SEQ ID NO: 511766 - DNA, 16 bp, R. norvegicus
ggtagaggcagaagga

SEQ ID NO: 511767 - DNA, 16 bp, R. norvegicus
ggtagagtgtttgcct

SEQ ID NO: 511768 - DNA, 16 bp, R. norvegicus
ggtagcacaggccttt

SEQ ID NO: 511769 - DNA, 16 bp, R. norvegicus
ggtagcccagttaggg

SEQ ID NO: 511770 - DNA, 16 bp, R. norvegicus
ggtagtgctccctctg

SEQ ID NO: 511771 - DNA, 16 bp, R. norvegicus
ggtagtgtctgtgttt

SEQ ID NO: 511772 - DNA, 16 bp, R. norvegicus
ggtatagctggatctt

SEQ ID NO: 511773 - DNA, 16 bp, R. norvegicus
ggtatagctgggtctt

SEQ ID NO: 511774 - DNA, 16 bp, R. norvegicus
ggtatatatatatata

SEQ ID NO: 511775 - DNA, 16 bp, R. norvegicus
ggtatatgcctataat

SEQ ID NO: 511776 - DNA, 16 bp, R. norvegicus
ggtatccagggcttgt

SEQ ID NO: 511777 - DNA, 16 bp, R. norvegicus
ggtatctccttcttta

SEQ ID NO: 511778 - DNA, 16 bp, R. norvegicus
ggtatggaatgtggaa

SEQ ID NO: 511779 - DNA, 16 bp, R. norvegicus
ggtattagccataaag

SEQ ID NO: 511780 - DNA, 16 bp, R. norvegicus
ggtattccagatgaat

SEQ ID NO: 511781 - DNA, 16 bp, R. norvegicus
ggtattcctgtcactg

SEQ ID NO: 511782 - DNA, 16 bp, R. norvegicus
ggtattcttgttcacc

SEQ ID NO: 511783 - DNA, 16 bp, R. norvegicus
ggtattgtcttcagca

SEQ ID NO: 511784 - DNA, 16 bp, R. norvegicus
ggtatttgaaaaactg

SEQ ID NO: 511785 - DNA, 16 bp, R. norvegicus
ggtattttgaactttt

SEQ ID NO: 511786 - DNA, 16 bp, R. norvegicus
ggtattttgatgaaga

SEQ ID NO: 511787 - DNA, 16 bp, R. norvegicus
ggtattttgatgagga

SEQ ID NO: 511788 - DNA, 16 bp, R. norvegicus
ggtattttgatgggta

SEQ ID NO: 511789 - DNA, 16 bp, R. norvegicus
ggtatttttattaaca

SEQ ID NO: 511790 - DNA, 16 bp, R. norvegicus
ggtcaaagggcaactt

SEQ ID NO: 511791 - DNA, 16 bp, R. norvegicus
ggtcaaaggtcaaagg

SEQ ID NO: 511792 - DNA, 16 bp, R. norvegicus
ggtcaacagctccctg

SEQ ID NO: 511793 - DNA, 16 bp, R. norvegicus
ggtcaagctgctgaca

SEQ ID NO: 511794 - DNA, 20 bp, R. norvegicus
ggtcaaggaattgtggaaag

SEQ ID NO: 511795 - DNA, 16 bp, R. norvegicus
ggtcaagtccaagtgg

SEQ ID NO: 511796 - DNA, 16 bp, R. norvegicus
ggtcacagcaatagaa

SEQ ID NO: 511797 - DNA, 16 bp, R. norvegicus
ggtcacaggagaggct

SEQ ID NO: 511798 - DNA, 16 bp, R. norvegicus
ggtcacagtttcagaa

SEQ ID NO: 511799 - DNA, 16 bp, R. norvegicus
ggtcacatatcaggta

SEQ ID NO: 511800 - DNA, 16 bp, R. norvegicus
ggtcacattgtgtcca

SEQ ID NO: 511801 - DNA, 16 bp, R. norvegicus
ggtcacttggagaaga

SEQ ID NO: 511802 - DNA, 16 bp, R. norvegicus
ggtcacttggaggaga

SEQ ID NO: 511803 - DNA, 16 bp, R. norvegicus
ggtcactttgagcaga

SEQ ID NO: 511804 - DNA, 16 bp, R. norvegicus
ggtcagaactggaaaa

SEQ ID NO: 511805 - DNA, 16 bp, R. norvegicus
ggtcagaagaagcagg

SEQ ID NO: 511806 - DNA, 16 bp, R. norvegicus
ggtcagaagacaactt

SEQ ID NO: 511807 - DNA, 16 bp, R. norvegicus
ggtcagaagaggacac

SEQ ID NO: 511808 - DNA, 16 bp, R. norvegicus
ggtcagaagagggtgt

SEQ ID NO: 511809 - DNA, 16 bp, R. norvegicus
ggtcagaagcttctgt

SEQ ID NO: 511810 - DNA, 16 bp, R. norvegicus
ggtcagaagtctggtg

SEQ ID NO: 511811 - DNA, 16 bp, R. norvegicus
ggtcagaagttcaggg

SEQ ID NO: 511812 - DNA, 16 bp, R. norvegicus
ggtcagacctgctttt

SEQ ID NO: 511813 - DNA, 16 bp, R. norvegicus
ggtcagagatgatgat

SEQ ID NO: 511814 - DNA, 16 bp, R. norvegicus
ggtcagaggtcagaag

SEQ ID NO: 511815 - DNA, 35 bp, R. norvegicus
ggtcagagtccagggtcagtccatgtatagtcttt

SEQ ID NO: 511816 - DNA, 16 bp, R. norvegicus
ggtcagattccagggt

SEQ ID NO: 511817 - DNA, 16 bp, R. norvegicus
ggtcagcagttctcaa

SEQ ID NO: 511818 - DNA, 16 bp, R. norvegicus
ggtcagcctgggcttc

SEQ ID NO: 511819 - DNA, 16 bp, R. norvegicus
ggtcagctggagaagc

SEQ ID NO: 511820 - DNA, 16 bp, R. norvegicus
ggtcaggaggcaggag

SEQ ID NO: 511821 - DNA, 16 bp, R. norvegicus
ggtcaggagtttgcac

SEQ ID NO: 511822 - DNA, 16 bp, R. norvegicus
ggtcaggcactgatgg

SEQ ID NO: 511823 - DNA, 16 bp, R. norvegicus
ggtcagggaggaaaca

SEQ ID NO: 511824 - DNA, 16 bp, R. norvegicus
ggtcaggggtcagagg

SEQ ID NO: 511825 - DNA, 17 bp, R. norvegicus
ggtcagtccatgtatag

SEQ ID NO: 511826 - DNA, 16 bp, R. norvegicus
ggtcagtgtggtggag

SEQ ID NO: 511827 - DNA, 16 bp, R. norvegicus
ggtcatcccagagctg

SEQ ID NO: 511828 - DNA, 16 bp, R. norvegicus
ggtcatcctgggctat

SEQ ID NO: 511829 - DNA, 16 bp, R. norvegicus
ggtcatgcagacaggc

SEQ ID NO: 511830 - DNA, 16 bp, R. norvegicus
ggtcatggagagcagc

SEQ ID NO: 511831 - DNA, 16 bp, R. norvegicus
ggtcatgtcactgctg

SEQ ID NO: 511832 - DNA, 16 bp, R. norvegicus
ggtcattactccctta

SEQ ID NO: 511833 - DNA, 16 bp, R. norvegicus
ggtcattcagaacctg

SEQ ID NO: 511834 - DNA, 16 bp, R. norvegicus
ggtcattctcagctac

SEQ ID NO: 511835 - DNA, 16 bp, R. norvegicus
ggtccaacttgggatc

SEQ ID NO: 511836 - DNA, 16 bp, R. norvegicus
ggtccacaggaagaca

SEQ ID NO: 511837 - DNA, 16 bp, R. norvegicus
ggtccaccaagcctgg

SEQ ID NO: 511838 - DNA, 16 bp, R. norvegicus
ggtccaccagagaact

SEQ ID NO: 511839 - DNA, 16 bp, R. norvegicus
ggtccaccccaacatc

SEQ ID NO: 511840 - DNA, 16 bp, R. norvegicus
ggtccacttcccccac

SEQ ID NO: 511841 - DNA, 16 bp, R. norvegicus
ggtccagagagctgtg

SEQ ID NO: 511842 - DNA, 16 bp, R. norvegicus
ggtccagccttgacag

SEQ ID NO: 511843 - DNA, 16 bp, R. norvegicus
ggtccaggagcagcag

SEQ ID NO: 511844 - DNA, 18 bp, R. norvegicus
ggtccagttattcagggt

SEQ ID NO: 511845 - DNA, 16 bp, R. norvegicus
ggtcccaagaaacatg

SEQ ID NO: 511846 - DNA, 16 bp, R. norvegicus
ggtcccagactgaata

SEQ ID NO: 511847 - DNA, 16 bp, R. norvegicus
ggtcccagggactgaa

SEQ ID NO: 511848 - DNA, 16 bp, R. norvegicus
ggtcccagggcttccc

SEQ ID NO: 511849 - DNA, 16 bp, R. norvegicus
ggtccccagctccaag

SEQ ID NO: 511850 - DNA, 16 bp, R. norvegicus
ggtccccagctcccca

SEQ ID NO: 511851 - DNA, 16 bp, R. norvegicus
ggtccccagctccggg

SEQ ID NO: 511852 - DNA, 16 bp, R. norvegicus
ggtccccagctcctgg

SEQ ID NO: 511853 - DNA, 19 bp, R. norvegicus
ggtccctagagtcattcct

SEQ ID NO: 511854 - DNA, 18 bp, R. norvegicus
ggtccctggagtcatccc

SEQ ID NO: 511855 - DNA, 22 bp, R. norvegicus
ggtccctggagtcattcctgtg

SEQ ID NO: 511856 - DNA, 16 bp, R. norvegicus
ggtccctgggctcagt

SEQ ID NO: 511857 - DNA, 16 bp, R. norvegicus
ggtccctggggctcac

SEQ ID NO: 511858 - DNA, 16 bp, R. norvegicus
ggtcctcagctccagg

SEQ ID NO: 511859 - DNA, 16 bp, R. norvegicus
ggtcctccagaagagc

SEQ ID NO: 511860 - DNA, 16 bp, R. norvegicus
ggtcctccagaagagt

SEQ ID NO: 511861 - DNA, 16 bp, R. norvegicus
ggtcctctgcaaaggc

SEQ ID NO: 511862 - DNA, 16 bp, R. norvegicus
ggtcctctggaggagc

SEQ ID NO: 511863 - DNA, 16 bp, R. norvegicus
ggtcctctttatgtat

SEQ ID NO: 511864 - DNA, 16 bp, R. norvegicus
ggtcctgagctcaatt

SEQ ID NO: 511865 - DNA, 16 bp, R. norvegicus
ggtcctgcccctactg

SEQ ID NO: 511866 - DNA, 16 bp, R. norvegicus
ggtcctgcggctcctg

SEQ ID NO: 511867 - DNA, 16 bp, R. norvegicus
ggtcctgctaagactc

SEQ ID NO: 511868 - DNA, 16 bp, R. norvegicus
ggtcctgctgcagctg

SEQ ID NO: 511869 - DNA, 16 bp, R. norvegicus
ggtcctgctgtctctg

SEQ ID NO: 511870 - DNA, 16 bp, R. norvegicus
ggtcctgggctccttt

SEQ ID NO: 511871 - DNA, 16 bp, R. norvegicus
ggtcctgggtcctggg

SEQ ID NO: 511872 - DNA, 16 bp, R. norvegicus
ggtcctgggttctaga

SEQ ID NO: 511873 - DNA, 16 bp, R. norvegicus
ggtcctgggttttata

SEQ ID NO: 511874 - DNA, 16 bp, R. norvegicus
ggtcctgtgaaggctg

SEQ ID NO: 511875 - DNA, 16 bp, R. norvegicus
ggtcctgtggaggctg

SEQ ID NO: 511876 - DNA, 16 bp, R. norvegicus
ggtccttctcagccat

SEQ ID NO: 511877 - DNA, 16 bp, R. norvegicus
ggtccttctgcctctg

SEQ ID NO: 511878 - DNA, 16 bp, R. norvegicus
ggtcgagggggaccca

SEQ ID NO: 511879 - DNA, 16 bp, R. norvegicus
ggtcgcttggagcaga

SEQ ID NO: 511880 - DNA, 16 bp, R. norvegicus
ggtcggaagaagaaag

SEQ ID NO: 511881 - DNA, 16 bp, R. norvegicus
ggtctacagatcaagt

SEQ ID NO: 511882 - DNA, 16 bp, R. norvegicus
ggtctattttggagaa

SEQ ID NO: 511883 - DNA, 16 bp, R. norvegicus
ggtctcactatgtaac

SEQ ID NO: 511884 - DNA, 16 bp, R. norvegicus
ggtctcagtttcccca

SEQ ID NO: 511885 - DNA, 16 bp, R. norvegicus
ggtctccaaggcaact

SEQ ID NO: 511886 - DNA, 16 bp, R. norvegicus
ggtctccatgagttca

SEQ ID NO: 511887 - DNA, 16 bp, R. norvegicus
ggtctcccaggaatgc

SEQ ID NO: 511888 - DNA, 16 bp, R. norvegicus
ggtctcccctcccact

SEQ ID NO: 511889 - DNA, 16 bp, R. norvegicus
ggtctcctccacacag

SEQ ID NO: 511890 - DNA, 16 bp, R. norvegicus
ggtctcctggaactgg

SEQ ID NO: 511891 - DNA, 16 bp, R. norvegicus
ggtctctcctctcatt

SEQ ID NO: 511892 - DNA, 16 bp, R. norvegicus
ggtctctcctgccctg

SEQ ID NO: 511893 - DNA, 16 bp, R. norvegicus
ggtctctgagtgtctg

SEQ ID NO: 511894 - DNA, 16 bp, R. norvegicus
ggtctctgcctcagaa

SEQ ID NO: 511895 - DNA, 16 bp, R. norvegicus
ggtctctgctcccaga

SEQ ID NO: 511896 - DNA, 16 bp, R. norvegicus
ggtctctgtgagtctg

SEQ ID NO: 511897 - DNA, 16 bp, R. norvegicus
ggtctcttctccagtc

SEQ ID NO: 511898 - DNA, 16 bp, R. norvegicus
ggtctgaaaccaaaca

SEQ ID NO: 511899 - DNA, 16 bp, R. norvegicus
ggtctgagttaccaca

SEQ ID NO: 511900 - DNA, 16 bp, R. norvegicus
ggtctgcagctccagt

SEQ ID NO: 511901 - DNA, 16 bp, R. norvegicus
ggtctgctctcctgag

SEQ ID NO: 511902 - DNA, 16 bp, R. norvegicus
ggtctggttgattgat

SEQ ID NO: 511903 - DNA, 16 bp, R. norvegicus
ggtctgtatgccatct

SEQ ID NO: 511904 - DNA, 16 bp, R. norvegicus
ggtctgtcagttttaa

SEQ ID NO: 511905 - DNA, 16 bp, R. norvegicus
ggtcttaaagtccaca

SEQ ID NO: 511906 - DNA, 16 bp, R. norvegicus
ggtcttcactggtctt

SEQ ID NO: 511907 - DNA, 47 bp, R. norvegicus
ggtcttcagctgttcctgtgggcctgtgtcttgagttcaccaggcag

SEQ ID NO: 511908 - DNA, 16 bp, R. norvegicus
ggtcttccctcctcag

SEQ ID NO: 511909 - DNA, 16 bp, R. norvegicus
ggtcttccctctgctc

SEQ ID NO: 511910 - DNA, 16 bp, R. norvegicus
ggtcttccttccttct

SEQ ID NO: 511911 - DNA, 16 bp, R. norvegicus
ggtcttctgcatatat

SEQ ID NO: 511912 - DNA, 16 bp, R. norvegicus
ggtcttctggaagagc

SEQ ID NO: 511913 - DNA, 16 bp, R. norvegicus
ggtcttgaacttacag

SEQ ID NO: 511914 - DNA, 16 bp, R. norvegicus
ggtctttgagaaaatc

SEQ ID NO: 511915 - DNA, 16 bp, R. norvegicus
ggtctttggcttttcc

SEQ ID NO: 511916 - DNA, 16 bp, R. norvegicus
ggtcttttaaggacag

SEQ ID NO: 511917 - DNA, 16 bp, R. norvegicus
ggtgaaaagtctggtg

SEQ ID NO: 511918 - DNA, 16 bp, R. norvegicus
ggtgaacttggggaca

SEQ ID NO: 511919 - DNA, 16 bp, R. norvegicus
ggtgaagaaatcacag

SEQ ID NO: 511920 - DNA, 16 bp, R. norvegicus
ggtgaagaatgtgact

SEQ ID NO: 511921 - DNA, 16 bp, R. norvegicus
ggtgaagactcccagc

SEQ ID NO: 511922 - DNA, 16 bp, R. norvegicus
ggtgaaggagaacgat

SEQ ID NO: 511923 - DNA, 16 bp, R. norvegicus
ggtgaataccagcagc

SEQ ID NO: 511924 - DNA, 16 bp, R. norvegicus
ggtgaatgccatcagc

SEQ ID NO: 511925 - DNA, 16 bp, R. norvegicus
ggtgacagacagacag

SEQ ID NO: 511926 - DNA, 16 bp, R. norvegicus
ggtgacagcagatgtg

SEQ ID NO: 511927 - DNA, 16 bp, R. norvegicus
ggtgacagcaggtgct

SEQ ID NO: 511928 - DNA, 16 bp, R. norvegicus
ggtgacagtgatggtg

SEQ ID NO: 511929 - DNA, 16 bp, R. norvegicus
ggtgacccccaaccac

SEQ ID NO: 511930 - DNA, 16 bp, R. norvegicus
ggtgacccctgtgaaa

SEQ ID NO: 511931 - DNA, 16 bp, R. norvegicus
ggtgacctggagtgtg

SEQ ID NO: 511932 - DNA, 16 bp, R. norvegicus
ggtgactgggaggagg

SEQ ID NO: 511933 - DNA, 16 bp, R. norvegicus
ggtgagacgctttgtt

SEQ ID NO: 511934 - DNA, 16 bp, R. norvegicus
ggtgagcagtgtaccc

SEQ ID NO: 511935 - DNA, 16 bp, R. norvegicus
ggtgagcatgagtgtg

SEQ ID NO: 511936 - DNA, 16 bp, R. norvegicus
ggtgagcttcaggttc

SEQ ID NO: 511937 - DNA, 16 bp, R. norvegicus
ggtgaggcaggctctg

SEQ ID NO: 511938 - DNA, 16 bp, R. norvegicus
ggtgagggagcacact

SEQ ID NO: 511939 - DNA, 24 bp, R. norvegicus
ggtgataaggatggatcgatctgc

SEQ ID NO: 511940 - DNA, 16 bp, R. norvegicus
ggtgatagatgataga

SEQ ID NO: 511941 - DNA, 16 bp, R. norvegicus
ggtgatcagcagtctc

SEQ ID NO: 511942 - DNA, 16 bp, R. norvegicus
ggtgatccaggatgac

SEQ ID NO: 511943 - DNA, 16 bp, R. norvegicus
ggtgatcctcatgctg

SEQ ID NO: 511944 - DNA, 16 bp, R. norvegicus
ggtgatgaacagcatg

SEQ ID NO: 511945 - DNA, 16 bp, R. norvegicus
ggtgatgagaagaagg

SEQ ID NO: 511946 - DNA, 16 bp, R. norvegicus
ggtgatgagaatggat

SEQ ID NO: 511947 - DNA, 16 bp, R. norvegicus
ggtgatgaggatgagg

SEQ ID NO: 511948 - DNA, 16 bp, R. norvegicus
ggtgatgatgaagatg

SEQ ID NO: 511949 - DNA, 16 bp, R. norvegicus
ggtgatgatgaggatg

SEQ ID NO: 511950 - DNA, 16 bp, R. norvegicus
ggtgatgatgctggtg

SEQ ID NO: 511951 - DNA, 16 bp, R. norvegicus
ggtgatgctgatgctg

SEQ ID NO: 511952 - DNA, 16 bp, R. norvegicus
ggtgatgctggtggtg

SEQ ID NO: 511953 - DNA, 16 bp, R. norvegicus
ggtgatggacagcaat

SEQ ID NO: 511954 - DNA, 16 bp, R. norvegicus
ggtgatggagatggtg

SEQ ID NO: 511955 - DNA, 16 bp, R. norvegicus
ggtgatggtgatgata

SEQ ID NO: 511956 - DNA, 16 bp, R. norvegicus
ggtgatggtgttgatg

SEQ ID NO: 511957 - DNA, 16 bp, R. norvegicus
ggtgatgttggtgatg

SEQ ID NO: 511958 - DNA, 16 bp, R. norvegicus
ggtgatttctccagaa

SEQ ID NO: 511959 - DNA, 16 bp, R. norvegicus
ggtgcaacttttggga

SEQ ID NO: 511960 - DNA, 16 bp, R. norvegicus
ggtgcaagaggagctg

SEQ ID NO: 511961 - DNA, 16 bp, R. norvegicus
ggtgcaatgtgaccag

SEQ ID NO: 511962 - DNA, 16 bp, R. norvegicus
ggtgcacaggggctcc

SEQ ID NO: 511963 - DNA, 16 bp, R. norvegicus
ggtgcaccagggacag

SEQ ID NO: 511964 - DNA, 16 bp, R. norvegicus
ggtgcagcctcagtgg

SEQ ID NO: 511965 - DNA, 16 bp, R. norvegicus
ggtgcaggaagctgtt

SEQ ID NO: 511966 - DNA, 16 bp, R. norvegicus
ggtgcaggaagtgctg

SEQ ID NO: 511967 - DNA, 16 bp, R. norvegicus
ggtgcaggagagctgg

SEQ ID NO: 511968 - DNA, 16 bp, R. norvegicus
ggtgcaggaggagcag

SEQ ID NO: 511969 - DNA, 16 bp, R. norvegicus
ggtgcaggaggggctg

SEQ ID NO: 511970 - DNA, 16 bp, R. norvegicus
ggtgcaggagtcccag

SEQ ID NO: 511971 - DNA, 16 bp, R. norvegicus
ggtgcaggcactggca

SEQ ID NO: 511972 - DNA, 16 bp, R. norvegicus
ggtgcaggcagaaatc

SEQ ID NO: 511973 - DNA, 16 bp, R. norvegicus
ggtgcaggctgacagg

SEQ ID NO: 511974 - DNA, 16 bp, R. norvegicus
ggtgcagtgtgtgttt

SEQ ID NO: 511975 - DNA, 16 bp, R. norvegicus
ggtgccacacaccttt

SEQ ID NO: 511976 - DNA, 16 bp, R. norvegicus
ggtgccacccacagtg

SEQ ID NO: 511977 - DNA, 16 bp, R. norvegicus
ggtgcccaagaaggcc

SEQ ID NO: 511978 - DNA, 16 bp, R. norvegicus
ggtgcccagcacccac

SEQ ID NO: 511979 - DNA, 16 bp, R. norvegicus
ggtgcccaggcccctg

SEQ ID NO: 511980 - DNA, 16 bp, R. norvegicus
ggtgcccagggaggcc

SEQ ID NO: 511981 - DNA, 16 bp, R. norvegicus
ggtgccctagcatttg

SEQ ID NO: 511982 - DNA, 16 bp, R. norvegicus
ggtgcctcctctccca

SEQ ID NO: 511983 - DNA, 16 bp, R. norvegicus
ggtgcctgcagaagcc

SEQ ID NO: 511984 - DNA, 16 bp, R. norvegicus
ggtgcctgccaccaag

SEQ ID NO: 511985 - DNA, 16 bp, R. norvegicus
ggtgccttcttctggt

SEQ ID NO: 511986 - DNA, 16 bp, R. norvegicus
ggtgctagagattgaa

SEQ ID NO: 511987 - DNA, 16 bp, R. norvegicus
ggtgctagaggagctg

SEQ ID NO: 511988 - DNA, 21 bp, R. norvegicus
ggtgctcttaaccactgagcc

SEQ ID NO: 511989 - DNA, 18 bp, R. norvegicus
ggtgctcttaacctctga

SEQ ID NO: 511990 - DNA, 16 bp, R. norvegicus
ggtgctgagaaccaaa

SEQ ID NO: 511991 - DNA, 16 bp, R. norvegicus
ggtgctgagaagaatg

SEQ ID NO: 511992 - DNA, 16 bp, R. norvegicus
ggtgctgatggtgctg

SEQ ID NO: 511993 - DNA, 16 bp, R. norvegicus
ggtgctgccaagactg

SEQ ID NO: 511994 - DNA, 16 bp, R. norvegicus
ggtgctgctaagactg

SEQ ID NO: 511995 - DNA, 16 bp, R. norvegicus
ggtgctgctggccaag

SEQ ID NO: 511996 - DNA, 16 bp, R. norvegicus
ggtgctggagaaatgg

SEQ ID NO: 511997 - DNA, 16 bp, R. norvegicus
ggtgctggagaggaag

SEQ ID NO: 511998 - DNA, 16 bp, R. norvegicus
ggtgctggagatggag

SEQ ID NO: 511999 - DNA, 16 bp, R. norvegicus
ggtgctggaggagcag

SEQ ID NO: 512000 - DNA, 16 bp, R. norvegicus
ggtgctggaggagccg

SEQ ID NO: 512001 - DNA, 16 bp, R. norvegicus
ggtgctggaggagctg

SEQ ID NO: 512002 - DNA, 16 bp, R. norvegicus
ggtgctggaggaggag

SEQ ID NO: 512003 - DNA, 16 bp, R. norvegicus
ggtgctggctctgcat

SEQ ID NO: 512004 - DNA, 16 bp, R. norvegicus
ggtgctgggaaccaaa

SEQ ID NO: 512005 - DNA, 16 bp, R. norvegicus
ggtgctgggaacccaa

SEQ ID NO: 512006 - DNA, 16 bp, R. norvegicus
ggtgctgggaactgca

SEQ ID NO: 512007 - DNA, 16 bp, R. norvegicus
ggtgctgggaattgaa

SEQ ID NO: 512008 - DNA, 16 bp, R. norvegicus
ggtgctgggagctgaa

SEQ ID NO: 512009 - DNA, 16 bp, R. norvegicus
ggtgctggggattgaa

SEQ ID NO: 512010 - DNA, 16 bp, R. norvegicus
ggtgctggtgctgctg

SEQ ID NO: 512011 - DNA, 16 bp, R. norvegicus
ggtgctgtccaatgag

SEQ ID NO: 512012 - DNA, 16 bp, R. norvegicus
ggtgctgttggtataa

SEQ ID NO: 512013 - DNA, 16 bp, R. norvegicus
ggtgcttcctcagaaa

SEQ ID NO: 512014 - DNA, 16 bp, R. norvegicus
ggtgcttgccactaag

SEQ ID NO: 512015 - DNA, 16 bp, R. norvegicus
ggtgctttgaatatgc

SEQ ID NO: 512016 - DNA, 16 bp, R. norvegicus
ggtggaactggagact

SEQ ID NO: 512017 - DNA, 16 bp, R. norvegicus
ggtggaacttctgggg

SEQ ID NO: 512018 - DNA, 16 bp, R. norvegicus
ggtggaacttttggaa

SEQ ID NO: 512019 - DNA, 16 bp, R. norvegicus
ggtggaagcaggaaga

SEQ ID NO: 512020 - DNA, 16 bp, R. norvegicus
ggtggaatctcagttt

SEQ ID NO: 512021 - DNA, 16 bp, R. norvegicus
ggtggacaacagctgt

SEQ ID NO: 512022 - DNA, 16 bp, R. norvegicus
ggtggacagatgggag

SEQ ID NO: 512023 - DNA, 16 bp, R. norvegicus
ggtggagaaatggctc

SEQ ID NO: 512024 - DNA, 16 bp, R. norvegicus
ggtggagaaggagctg

SEQ ID NO: 512025 - DNA, 16 bp, R. norvegicus
ggtggagacaggaggg

SEQ ID NO: 512026 - DNA, 16 bp, R. norvegicus
ggtggagactggagga

SEQ ID NO: 512027 - DNA, 16 bp, R. norvegicus
ggtggagctggagaga

SEQ ID NO: 512028 - DNA, 16 bp, R. norvegicus
ggtggaggcagagaag

SEQ ID NO: 512029 - DNA, 16 bp, R. norvegicus
ggtggagggagagaac

SEQ ID NO: 512030 - DNA, 16 bp, R. norvegicus
ggtggatctctctgag

SEQ ID NO: 512031 - DNA, 16 bp, R. norvegicus
ggtggatctctgcatt

SEQ ID NO: 512032 - DNA, 16 bp, R. norvegicus
ggtggatgaagcaaag

SEQ ID NO: 512033 - DNA, 16 bp, R. norvegicus
ggtggatgccaagaag

SEQ ID NO: 512034 - DNA, 16 bp, R. norvegicus
ggtggatgctctcagc

SEQ ID NO: 512035 - DNA, 16 bp, R. norvegicus
ggtggatgcttgcagt

SEQ ID NO: 512036 - DNA, 16 bp, R. norvegicus
ggtggatggatgctgg

SEQ ID NO: 512037 - DNA, 16 bp, R. norvegicus
ggtggatggctcctga

SEQ ID NO: 512038 - DNA, 16 bp, R. norvegicus
ggtggatgtatgtata

SEQ ID NO: 512039 - DNA, 16 bp, R. norvegicus
ggtggatttttccttt

SEQ ID NO: 512040 - DNA, 16 bp, R. norvegicus
ggtggcagcagcatgg

SEQ ID NO: 512041 - DNA, 16 bp, R. norvegicus
ggtggcaggagagaac

SEQ ID NO: 512042 - DNA, 16 bp, R. norvegicus
ggtggcaggagcagga

SEQ ID NO: 512043 - DNA, 16 bp, R. norvegicus
ggtggcaggcaggcag

SEQ ID NO: 512044 - DNA, 16 bp, R. norvegicus
ggtggcaggtggcagg

SEQ ID NO: 512045 - DNA, 16 bp, R. norvegicus
ggtggcagtggtggca

SEQ ID NO: 512046 - DNA, 16 bp, R. norvegicus
ggtggcagtggtggtg

SEQ ID NO: 512047 - DNA, 16 bp, R. norvegicus
ggtggccaagaacctg

SEQ ID NO: 512048 - DNA, 16 bp, R. norvegicus
ggtggctcacgaccat

SEQ ID NO: 512049 - DNA, 16 bp, R. norvegicus
ggtggctcagagctgg

SEQ ID NO: 512050 - DNA, 16 bp, R. norvegicus
ggtggctgaggtggct

SEQ ID NO: 512051 - DNA, 16 bp, R. norvegicus
ggtggctgcagatggg

SEQ ID NO: 512052 - DNA, 16 bp, R. norvegicus
ggtggcttagtgtctg

SEQ ID NO: 512053 - DNA, 16 bp, R. norvegicus
ggtggcttctctggag

SEQ ID NO: 512054 - DNA, 16 bp, R. norvegicus
ggtgggaagaagcaag

SEQ ID NO: 512055 - DNA, 16 bp, R. norvegicus
ggtgggaagcaccctc

SEQ ID NO: 512056 - DNA, 16 bp, R. norvegicus
ggtgggagagaagttt

SEQ ID NO: 512057 - DNA, 16 bp, R. norvegicus
ggtgggagagggagca

SEQ ID NO: 512058 - DNA, 16 bp, R. norvegicus
ggtgggagcatggtag

SEQ ID NO: 512059 - DNA, 16 bp, R. norvegicus
ggtgggaggcaggaag

SEQ ID NO: 512060 - DNA, 16 bp, R. norvegicus
ggtgggatcatggcag

SEQ ID NO: 512061 - DNA, 16 bp, R. norvegicus
ggtgggcagcacctct

SEQ ID NO: 512062 - DNA, 16 bp, R. norvegicus
ggtggggacaggagga

SEQ ID NO: 512063 - DNA, 16 bp, R. norvegicus
ggtggggagacagaga

SEQ ID NO: 512064 - DNA, 16 bp, R. norvegicus
ggtggggcctgaagaa

SEQ ID NO: 512065 - DNA, 16 bp, R. norvegicus
ggtgggggcatcctct

SEQ ID NO: 512066 - DNA, 16 bp, R. norvegicus
ggtgggggctagcccc

SEQ ID NO: 512067 - DNA, 16 bp, R. norvegicus
ggtgggttttgagtta

SEQ ID NO: 512068 - DNA, 16 bp, R. norvegicus
ggtggtactgggttct

SEQ ID NO: 512069 - DNA, 16 bp, R. norvegicus
ggtggtcaatcctttg

SEQ ID NO: 512070 - DNA, 16 bp, R. norvegicus
ggtggtcatgggttct

SEQ ID NO: 512071 - DNA, 16 bp, R. norvegicus
ggtggtccagtatctg

SEQ ID NO: 512072 - DNA, 16 bp, R. norvegicus
ggtggtcccatccctc

SEQ ID NO: 512073 - DNA, 16 bp, R. norvegicus
ggtggtgagaagaaga

SEQ ID NO: 512074 - DNA, 16 bp, R. norvegicus
ggtggtgatgctgatg

SEQ ID NO: 512075 - DNA, 16 bp, R. norvegicus
ggtggtgcaagccttt

SEQ ID NO: 512076 - DNA, 16 bp, R. norvegicus
ggtggtgcacaggaca

SEQ ID NO: 512077 - DNA, 16 bp, R. norvegicus
ggtggtgcaggtcttt

SEQ ID NO: 512078 - DNA, 16 bp, R. norvegicus
ggtggtgcatatcttt

SEQ ID NO: 512079 - DNA, 16 bp, R. norvegicus
ggtggtgccacctctg

SEQ ID NO: 512080 - DNA, 16 bp, R. norvegicus
ggtggtgctgttcctg

SEQ ID NO: 512081 - DNA, 16 bp, R. norvegicus
ggtggtggaaaagaaa

SEQ ID NO: 512082 - DNA, 16 bp, R. norvegicus
ggtggtggaagagaaa

SEQ ID NO: 512083 - DNA, 16 bp, R. norvegicus
ggtggtggagacactg

SEQ ID NO: 512084 - DNA, 16 bp, R. norvegicus
ggtggtggcagcagtg

SEQ ID NO: 512085 - DNA, 16 bp, R. norvegicus
ggtggtggcagtggtg

SEQ ID NO: 512086 - DNA, 16 bp, R. norvegicus
ggtggtgggctacaag

SEQ ID NO: 512087 - DNA, 16 bp, R. norvegicus
ggtggtgggggagcac

SEQ ID NO: 512088 - DNA, 16 bp, R. norvegicus
ggtggtggtgcaggcc

SEQ ID NO: 512089 - DNA, 16 bp, R. norvegicus
ggtggtggtggcagca

SEQ ID NO: 512090 - DNA, 16 bp, R. norvegicus
ggtggtggtggcatat

SEQ ID NO: 512091 - DNA, 16 bp, R. norvegicus
ggtggtggtggtgaca

SEQ ID NO: 512092 - DNA, 16 bp, R. norvegicus
ggtggtggtggtgact

SEQ ID NO: 512093 - DNA, 16 bp, R. norvegicus
ggtggtggtggtggca

SEQ ID NO: 512094 - DNA, 16 bp, R. norvegicus
ggtggtgtctcaggca

SEQ ID NO: 512095 - DNA, 16 bp, R. norvegicus
ggtggtgtgcaggcag

SEQ ID NO: 512096 - DNA, 16 bp, R. norvegicus
ggtggtgttttctctg

SEQ ID NO: 512097 - DNA, 16 bp, R. norvegicus
ggtggttctgagttct

SEQ ID NO: 512098 - DNA, 16 bp, R. norvegicus
ggtggttttgtccctg

SEQ ID NO: 512099 - DNA, 16 bp, R. norvegicus
ggtgtacatacagaca

SEQ ID NO: 512100 - DNA, 16 bp, R. norvegicus
ggtgtacgtgtgtgtg

SEQ ID NO: 512101 - DNA, 16 bp, R. norvegicus
ggtgtatctgaagata

SEQ ID NO: 512102 - DNA, 16 bp, R. norvegicus
ggtgtcccaggagctg

SEQ ID NO: 512103 - DNA, 16 bp, R. norvegicus
ggtgtctcagaagcag

SEQ ID NO: 512104 - DNA, 16 bp, R. norvegicus
ggtgtctcagaggcag

SEQ ID NO: 512105 - DNA, 16 bp, R. norvegicus
ggtgtctgaggaggcc

SEQ ID NO: 512106 - DNA, 16 bp, R. norvegicus
ggtgtctgcttgctga

SEQ ID NO: 512107 - DNA, 16 bp, R. norvegicus
ggtgtctgcttggttg

SEQ ID NO: 512108 - DNA, 16 bp, R. norvegicus
ggtgtgaagatggagc

SEQ ID NO: 512109 - DNA, 16 bp, R. norvegicus
ggtgtgactgtaacca

SEQ ID NO: 512110 - DNA, 16 bp, R. norvegicus
ggtgtgagggtgtcag

SEQ ID NO: 512111 - DNA, 16 bp, R. norvegicus
ggtgtgcagtggaatg

SEQ ID NO: 512112 - DNA, 16 bp, R. norvegicus
ggtgtgcatgtggagg

SEQ ID NO: 512113 - DNA, 16 bp, R. norvegicus
ggtgtgcccttgttgg

SEQ ID NO: 512114 - DNA, 16 bp, R. norvegicus
ggtgtgctcacaaaaa

SEQ ID NO: 512115 - DNA, 16 bp, R. norvegicus
ggtgtggacttgttgg

SEQ ID NO: 512116 - DNA, 16 bp, R. norvegicus
ggtgtggatgaagaca

SEQ ID NO: 512117 - DNA, 16 bp, R. norvegicus
ggtgtgggttcctcag

SEQ ID NO: 512118 - DNA, 16 bp, R. norvegicus
ggtgtggtgaccccaa

SEQ ID NO: 512119 - DNA, 16 bp, R. norvegicus
ggtgtggtggtgtgca

SEQ ID NO: 512120 - DNA, 16 bp, R. norvegicus
ggtgtgtaccaccaca

SEQ ID NO: 512121 - DNA, 16 bp, R. norvegicus
ggtgtgtaccaccact

SEQ ID NO: 512122 - DNA, 16 bp, R. norvegicus
ggtgtgtccccatgcc

SEQ ID NO: 512123 - DNA, 16 bp, R. norvegicus
ggtgtgtctgaagacg

SEQ ID NO: 512124 - DNA, 16 bp, R. norvegicus
ggtgtgtctgaagcag

SEQ ID NO: 512125 - DNA, 16 bp, R. norvegicus
ggtgtgtctgaggaca

SEQ ID NO: 512126 - DNA, 16 bp, R. norvegicus
ggtgtgtgccactata

SEQ ID NO: 512127 - DNA, 16 bp, R. norvegicus
ggtgtgtggggtcatt

SEQ ID NO: 512128 - DNA, 16 bp, R. norvegicus
ggtgtgtgtatatgtg

SEQ ID NO: 512129 - DNA, 16 bp, R. norvegicus
ggtgtgtgtctctgtg

SEQ ID NO: 512130 - DNA, 16 bp, R. norvegicus
ggtgtgttactgtggg

SEQ ID NO: 512131 - DNA, 16 bp, R. norvegicus
ggtgtgttccaggcag

SEQ ID NO: 512132 - DNA, 16 bp, R. norvegicus
ggtgtgttcctctttc

SEQ ID NO: 512133 - DNA, 16 bp, R. norvegicus
ggtgttcaccaggcag

SEQ ID NO: 512134 - DNA, 16 bp, R. norvegicus
ggtgttccaaggagag

SEQ ID NO: 512135 - DNA, 16 bp, R. norvegicus
ggtgttcctcctgtct

SEQ ID NO: 512136 - DNA, 16 bp, R. norvegicus
ggtgttccttcggcct

SEQ ID NO: 512137 - DNA, 16 bp, R. norvegicus
ggtgttccttctccct

SEQ ID NO: 512138 - DNA, 16 bp, R. norvegicus
ggtgttgaggtggaag

SEQ ID NO: 512139 - DNA, 16 bp, R. norvegicus
ggtgttggaaactgaa

SEQ ID NO: 512140 - DNA, 16 bp, R. norvegicus
ggtgttggagcccctg

SEQ ID NO: 512141 - DNA, 16 bp, R. norvegicus
ggtgttggaggagctg

SEQ ID NO: 512142 - DNA, 16 bp, R. norvegicus
ggtgttggattccctg

SEQ ID NO: 512143 - DNA, 16 bp, R. norvegicus
ggtgttgggaaccaaa

SEQ ID NO: 512144 - DNA, 16 bp, R. norvegicus
ggtgttgttctccttg

SEQ ID NO: 512145 - DNA, 17 bp, R. norvegicus
ggtgtttactacttggt

SEQ ID NO: 512146 - DNA, 16 bp, R. norvegicus
ggtgtttagtgttttc

SEQ ID NO: 512147 - DNA, 16 bp, R. norvegicus
ggtgttttcctttgga

SEQ ID NO: 512148 - DNA, 16 bp, R. norvegicus
ggtgttttcttctgga

SEQ ID NO: 512149 - DNA, 16 bp, R. norvegicus
ggtgttttgcctgtgt

SEQ ID NO: 512150 - DNA, 16 bp, R. norvegicus
ggttaactctttgtga

SEQ ID NO: 512151 - DNA, 16 bp, R. norvegicus
ggttaagagtacttgc

SEQ ID NO: 512152 - DNA, 16 bp, R. norvegicus
ggttacaagctccttc

SEQ ID NO: 512153 - DNA, 16 bp, R. norvegicus
ggttacacagaaaaac

SEQ ID NO: 512154 - DNA, 16 bp, R. norvegicus
ggttacctaactcagg

SEQ ID NO: 512155 - DNA, 16 bp, R. norvegicus
ggttacctgcataaga

SEQ ID NO: 512156 - DNA, 16 bp, R. norvegicus
ggttataccaacagca

SEQ ID NO: 512157 - DNA, 16 bp, R. norvegicus
ggttatctgataggat

SEQ ID NO: 512158 - DNA, 16 bp, R. norvegicus
ggttatgtagagagac

SEQ ID NO: 512159 - DNA, 16 bp, R. norvegicus
ggttcaagtcccagaa

SEQ ID NO: 512160 - DNA, 16 bp, R. norvegicus
ggttcaatctccagca

SEQ ID NO: 512161 - DNA, 16 bp, R. norvegicus
ggttcaattcccagca

SEQ ID NO: 512162 - DNA, 16 bp, R. norvegicus
ggttcaatttccagca

SEQ ID NO: 512163 - DNA, 16 bp, R. norvegicus
ggttcacagtttcaga

SEQ ID NO: 512164 - DNA, 17 bp, R. norvegicus
ggttcacctcagagcag

SEQ ID NO: 512165 - DNA, 16 bp, R. norvegicus
ggttcagagagagaga

SEQ ID NO: 512166 - DNA, 16 bp, R. norvegicus
ggttcagcagcttctg

SEQ ID NO: 512167 - DNA, 16 bp, R. norvegicus
ggttcagtccccatct

SEQ ID NO: 512168 - DNA, 17 bp, R. norvegicus
ggttcagtcctcagctc

SEQ ID NO: 512169 - DNA, 16 bp, R. norvegicus
ggttcagtttccagta

SEQ ID NO: 512170 - DNA, 16 bp, R. norvegicus
ggttcatcttctctca

SEQ ID NO: 512171 - DNA, 16 bp, R. norvegicus
ggttcatttctggttc

SEQ ID NO: 512172 - DNA, 16 bp, R. norvegicus
ggttccagatggcttt

SEQ ID NO: 512173 - DNA, 16 bp, R. norvegicus
ggttcccatgctcagt

SEQ ID NO: 512174 - DNA, 16 bp, R. norvegicus
ggttcccgtggaggag

SEQ ID NO: 512175 - DNA, 16 bp, R. norvegicus
ggttccctgagctcca

SEQ ID NO: 512176 - DNA, 16 bp, R. norvegicus
ggttcctccatcttgt

SEQ ID NO: 512177 - DNA, 16 bp, R. norvegicus
ggttcctgacctcagt

SEQ ID NO: 512178 - DNA, 16 bp, R. norvegicus
ggttcctgccagcaag

SEQ ID NO: 512179 - DNA, 16 bp, R. norvegicus
ggttcctgccctgagt

SEQ ID NO: 512180 - DNA, 16 bp, R. norvegicus
ggttcctgccctggtt

SEQ ID NO: 512181 - DNA, 16 bp, R. norvegicus
ggttcctgccttgatt

SEQ ID NO: 512182 - DNA, 16 bp, R. norvegicus
ggttcctgtggaggtc

SEQ ID NO: 512183 - DNA, 16 bp, R. norvegicus
ggttcctgttggcctg

SEQ ID NO: 512184 - DNA, 16 bp, R. norvegicus
ggttcgattcccagca

SEQ ID NO: 512185 - DNA, 16 bp, R. norvegicus
ggttctccctcccttt

SEQ ID NO: 512186 - DNA, 16 bp, R. norvegicus
ggttctcttcaagagc

SEQ ID NO: 512187 - DNA, 16 bp, R. norvegicus
ggttctgatgaagtca

SEQ ID NO: 512188 - DNA, 16 bp, R. norvegicus
ggttctgccaagactg

SEQ ID NO: 512189 - DNA, 16 bp, R. norvegicus
ggttctggagatggaa

SEQ ID NO: 512190 - DNA, 16 bp, R. norvegicus
ggttctggttctggtt

SEQ ID NO: 512191 - DNA, 16 bp, R. norvegicus
ggttctgtcaaggctg

SEQ ID NO: 512192 - DNA, 16 bp, R. norvegicus
ggttctgtgacagtga

SEQ ID NO: 512193 - DNA, 16 bp, R. norvegicus
ggttcttcaattctat

SEQ ID NO: 512194 - DNA, 16 bp, R. norvegicus
ggttcttgtcagcatg

SEQ ID NO: 512195 - DNA, 16 bp, R. norvegicus
ggttgaaagtcgattt

SEQ ID NO: 512196 - DNA, 16 bp, R. norvegicus
ggttgacattgttatt

SEQ ID NO: 512197 - DNA, 16 bp, R. norvegicus
ggttgaccaatggaat

SEQ ID NO: 512198 - DNA, 16 bp, R. norvegicus
ggttgactccaagcat

SEQ ID NO: 512199 - DNA, 16 bp, R. norvegicus
ggttgagaagtaccta

SEQ ID NO: 512200 - DNA, 16 bp, R. norvegicus
ggttgagttcccagca

SEQ ID NO: 512201 - DNA, 16 bp, R. norvegicus
ggttgatatcattgtt

SEQ ID NO: 512202 - DNA, 16 bp, R. norvegicus
ggttgatattcttgtt

SEQ ID NO: 512203 - DNA, 16 bp, R. norvegicus
ggttgctatgaatatt

SEQ ID NO: 512204 - DNA, 16 bp, R. norvegicus
ggttgctgggttgctg

SEQ ID NO: 512205 - DNA, 16 bp, R. norvegicus
ggttggacccacagtg

SEQ ID NO: 512206 - DNA, 16 bp, R. norvegicus
ggttggagagaaggct

SEQ ID NO: 512207 - DNA, 16 bp, R. norvegicus
ggttggcctggaattc

SEQ ID NO: 512208 - DNA, 16 bp, R. norvegicus
ggttggctggctggct

SEQ ID NO: 512209 - DNA, 17 bp, R. norvegicus
ggttgggtctctctctc

SEQ ID NO: 512210 - DNA, 16 bp, R. norvegicus
ggttggtgaagatctt

SEQ ID NO: 512211 - DNA, 16 bp, R. norvegicus
ggttggtggctcagtc

SEQ ID NO: 512212 - DNA, 16 bp, R. norvegicus
ggttggttggcattgt

SEQ ID NO: 512213 - DNA, 16 bp, R. norvegicus
ggttgtgagccactgg

SEQ ID NO: 512214 - DNA, 16 bp, R. norvegicus
ggttgtttgatttgca

SEQ ID NO: 512215 - DNA, 16 bp, R. norvegicus
ggtttaatttaaaaaa

SEQ ID NO: 512216 - DNA, 16 bp, R. norvegicus
ggtttacaagaatttt

SEQ ID NO: 512217 - DNA, 16 bp, R. norvegicus
ggtttagctcttcctc

SEQ ID NO: 512218 - DNA, 16 bp, R. norvegicus
ggtttagtagatctcc

SEQ ID NO: 512219 - DNA, 22 bp, R. norvegicus
ggtttagtgcagaattctatca

SEQ ID NO: 512220 - DNA, 16 bp, R. norvegicus
ggtttatagtgtcagg

SEQ ID NO: 512221 - DNA, 16 bp, R. norvegicus
ggtttatggactggaa

SEQ ID NO: 512222 - DNA, 16 bp, R. norvegicus
ggtttattcagctcac

SEQ ID NO: 512223 - DNA, 16 bp, R. norvegicus
ggtttatttgtctccc

SEQ ID NO: 512224 - DNA, 16 bp, R. norvegicus
ggtttcaaaaacccat

SEQ ID NO: 512225 - DNA, 16 bp, R. norvegicus
ggtttcagagctaaac

SEQ ID NO: 512226 - DNA, 16 bp, R. norvegicus
ggtttcagctcctttg

SEQ ID NO: 512227 - DNA, 16 bp, R. norvegicus
ggtttcatgtagtcca

SEQ ID NO: 512228 - DNA, 16 bp, R. norvegicus
ggtttccactgctgtg

SEQ ID NO: 512229 - DNA, 16 bp, R. norvegicus
ggtttccagggcaaca

SEQ ID NO: 512230 - DNA, 16 bp, R. norvegicus
ggtttccatgacaaca

SEQ ID NO: 512231 - DNA, 16 bp, R. norvegicus
ggtttccattcctgca

SEQ ID NO: 512232 - DNA, 16 bp, R. norvegicus
ggtttcccagccaaca

SEQ ID NO: 512233 - DNA, 16 bp, R. norvegicus
ggtttcccaggagtgt

SEQ ID NO: 512234 - DNA, 16 bp, R. norvegicus
ggtttcccaggcttct

SEQ ID NO: 512235 - DNA, 16 bp, R. norvegicus
ggtttcccctctgtaa

SEQ ID NO: 512236 - DNA, 16 bp, R. norvegicus
ggtttcctcttccaaa

SEQ ID NO: 512237 - DNA, 16 bp, R. norvegicus
ggtttcctcttcccaa

SEQ ID NO: 512238 - DNA, 16 bp, R. norvegicus
ggtttcctgtcttgtt

SEQ ID NO: 512239 - DNA, 16 bp, R. norvegicus
ggtttctccagctatg

SEQ ID NO: 512240 - DNA, 16 bp, R. norvegicus
ggtttctctatgtagc

SEQ ID NO: 512241 - DNA, 16 bp, R. norvegicus
ggtttctctgtctatg

SEQ ID NO: 512242 - DNA, 16 bp, R. norvegicus
ggtttctctgtgtagt

SEQ ID NO: 512243 - DNA, 16 bp, R. norvegicus
ggtttctgcatcagct

SEQ ID NO: 512244 - DNA, 16 bp, R. norvegicus
ggtttctgcctatgcc

SEQ ID NO: 512245 - DNA, 16 bp, R. norvegicus
ggtttctgcctgggcc

SEQ ID NO: 512246 - DNA, 16 bp, R. norvegicus
ggtttctgggaattga

SEQ ID NO: 512247 - DNA, 16 bp, R. norvegicus
ggtttctgttgcttac

SEQ ID NO: 512248 - DNA, 16 bp, R. norvegicus
ggtttctttattgctt

SEQ ID NO: 512249 - DNA, 16 bp, R. norvegicus
ggtttgattcccagca

SEQ ID NO: 512250 - DNA, 16 bp, R. norvegicus
ggtttgatttccaaca

SEQ ID NO: 512251 - DNA, 16 bp, R. norvegicus
ggtttgcattcttcta

SEQ ID NO: 512252 - DNA, 16 bp, R. norvegicus
ggtttgctgtatatta

SEQ ID NO: 512253 - DNA, 16 bp, R. norvegicus
ggtttggagaccttta

SEQ ID NO: 512254 - DNA, 16 bp, R. norvegicus
ggtttggaggaaagaa

SEQ ID NO: 512255 - DNA, 16 bp, R. norvegicus
ggtttggggctggaga

SEQ ID NO: 512256 - DNA, 16 bp, R. norvegicus
ggtttggtggctgtat

SEQ ID NO: 512257 - DNA, 17 bp, R. norvegicus
ggtttgtaacttgggct

SEQ ID NO: 512258 - DNA, 16 bp, R. norvegicus
ggtttgtctgatcctg

SEQ ID NO: 512259 - DNA, 16 bp, R. norvegicus
ggtttgtgccaccaca

SEQ ID NO: 512260 - DNA, 16 bp, R. norvegicus
ggttttataggaaatg

SEQ ID NO: 512261 - DNA, 16 bp, R. norvegicus
ggttttcattgctgtg

SEQ ID NO: 512262 - DNA, 16 bp, R. norvegicus
ggttttgaaaaaaatt

SEQ ID NO: 512263 - DNA, 16 bp, R. norvegicus
ggttttgaactcagga

SEQ ID NO: 512264 - DNA, 16 bp, R. norvegicus
ggttttgcctcctttg

SEQ ID NO: 512265 - DNA, 16 bp, R. norvegicus
ggttttgctgactgag

SEQ ID NO: 512266 - DNA, 16 bp, R. norvegicus
ggttttggatcctttg

SEQ ID NO: 512267 - DNA, 16 bp, R. norvegicus
ggttttggcccctttg

SEQ ID NO: 512268 - DNA, 16 bp, R. norvegicus
ggttttgttctttcat

SEQ ID NO: 512269 - DNA, 16 bp, R. norvegicus
ggttttttgagacagg

SEQ ID NO: 512270 - DNA, 16 bp, R. norvegicus
gtaaaaaccaaaccaa

SEQ ID NO: 512271 - DNA, 16 bp, R. norvegicus
gtaaaaagagaaccag

SEQ ID NO: 512272 - DNA, 16 bp, R. norvegicus
gtaaaaagtctttaat

SEQ ID NO: 512273 - DNA, 16 bp, R. norvegicus
gtaaaagttctgtaca

SEQ ID NO: 512274 - DNA, 16 bp, R. norvegicus
gtaaacaaatggaatg

SEQ ID NO: 512275 - DNA, 16 bp, R. norvegicus
gtaaacaagtagaagc

SEQ ID NO: 512276 - DNA, 16 bp, R. norvegicus
gtaaaccataagccat

SEQ ID NO: 512277 - DNA, 16 bp, R. norvegicus
gtaaagaagaaaaagc

SEQ ID NO: 512278 - DNA, 16 bp, R. norvegicus
gtaaagcattttctta

SEQ ID NO: 512279 - DNA, 16 bp, R. norvegicus
gtaaagcggaaaaagg

SEQ ID NO: 512280 - DNA, 16 bp, R. norvegicus
gtaaaggctcttgctg

SEQ ID NO: 512281 - DNA, 16 bp, R. norvegicus
gtaaagggcttgctgt

SEQ ID NO: 512282 - DNA, 16 bp, R. norvegicus
gtaaagtgcctgctgc

SEQ ID NO: 512283 - DNA, 25 bp, R. norvegicus
gtaaagtggaaggatgtcttaactg

SEQ ID NO: 512284 - DNA, 16 bp, R. norvegicus
gtaaataaatacataa

SEQ ID NO: 512285 - DNA, 16 bp, R. norvegicus
gtaaataacaaatacc

SEQ ID NO: 512286 - DNA, 16 bp, R. norvegicus
gtaaataagaaataca

SEQ ID NO: 512287 - DNA, 16 bp, R. norvegicus
gtaaatatgtatgtgt

SEQ ID NO: 512288 - DNA, 16 bp, R. norvegicus
gtaaatccagctccag

SEQ ID NO: 512289 - DNA, 16 bp, R. norvegicus
gtaaatgctctaccac

SEQ ID NO: 512290 - DNA, 16 bp, R. norvegicus
gtaaatgctcttaact

SEQ ID NO: 512291 - DNA, 16 bp, R. norvegicus
gtaaatggaaacaatg

SEQ ID NO: 512292 - DNA, 16 bp, R. norvegicus
gtaaatgtaatttaaa

SEQ ID NO: 512293 - DNA, 16 bp, R. norvegicus
gtaaatgtagcacatt

SEQ ID NO: 512294 - DNA, 19 bp, R. norvegicus
gtaaattggatgtattctg

SEQ ID NO: 512295 - DNA, 16 bp, R. norvegicus
gtaacaacaataataa

SEQ ID NO: 512296 - DNA, 16 bp, R. norvegicus
gtaacaacagaaactg

SEQ ID NO: 512297 - DNA, 16 bp, R. norvegicus
gtaacagtcctggctg

SEQ ID NO: 512298 - DNA, 16 bp, R. norvegicus
gtaaccagccatgtgg

SEQ ID NO: 512299 - DNA, 16 bp, R. norvegicus
gtaaccatggaaacag

SEQ ID NO: 512300 - DNA, 16 bp, R. norvegicus
gtaaccattggactga

SEQ ID NO: 512301 - DNA, 16 bp, R. norvegicus
gtaaccctactgtgcc

SEQ ID NO: 512302 - DNA, 16 bp, R. norvegicus
gtaaccttactcagga

SEQ ID NO: 512303 - DNA, 16 bp, R. norvegicus
gtaactacagaaacca

SEQ ID NO: 512304 - DNA, 16 bp, R. norvegicus
gtaagagaacttcaga

SEQ ID NO: 512305 - DNA, 16 bp, R. norvegicus
gtaagagctgttggca

SEQ ID NO: 512306 - DNA, 16 bp, R. norvegicus
gtaagatctgatgttt

SEQ ID NO: 512307 - DNA, 16 bp, R. norvegicus
gtaagatgggatctca

SEQ ID NO: 512308 - DNA, 16 bp, R. norvegicus
gtaagcaagtagaagc

SEQ ID NO: 512309 - DNA, 16 bp, R. norvegicus
gtaagccaccatgtgg

SEQ ID NO: 512310 - DNA, 43 bp, R. norvegicus
gtaaggcagcagtagtagaaggacaggccactctcgaggtagt

SEQ ID NO: 512311 - DNA, 16 bp, R. norvegicus
gtaaggctgtggcaga

SEQ ID NO: 512312 - DNA, 21 bp, R. norvegicus
gtaagtccgcagacaagggag

SEQ ID NO: 512313 - DNA, 16 bp, R. norvegicus
gtaagtggatggatgg

SEQ ID NO: 512314 - DNA, 23 bp, R. norvegicus
gtaagtttactcaaacaacaagg

SEQ ID NO: 512315 - DNA, 16 bp, R. norvegicus
gtaagtttgaggacag

SEQ ID NO: 512316 - DNA, 16 bp, R. norvegicus
gtaagtttgaggccaa

SEQ ID NO: 512317 - DNA, 16 bp, R. norvegicus
gtaataaaatagactt

SEQ ID NO: 512318 - DNA, 16 bp, R. norvegicus
gtaataaacaccatga

SEQ ID NO: 512319 - DNA, 16 bp, R. norvegicus
gtaatattccgttgtg

SEQ ID NO: 512320 - DNA, 16 bp, R. norvegicus
gtaatcctcctgcttc

SEQ ID NO: 512321 - DNA, 16 bp, R. norvegicus
gtaatggaaaggaaag

SEQ ID NO: 512322 - DNA, 16 bp, R. norvegicus
gtaatggaggagtgtt

SEQ ID NO: 512323 - DNA, 16 bp, R. norvegicus
gtaatggggggaggat

SEQ ID NO: 512324 - DNA, 16 bp, R. norvegicus
gtaattgtcaaagcca

SEQ ID NO: 512325 - DNA, 16 bp, R. norvegicus
gtaattgtgagttttg

SEQ ID NO: 512326 - DNA, 16 bp, R. norvegicus
gtaatttacagattca

SEQ ID NO: 512327 - DNA, 16 bp, R. norvegicus
gtaatttgaacttttg

SEQ ID NO: 512328 - DNA, 16 bp, R. norvegicus
gtaattttataaagaa

SEQ ID NO: 512329 - DNA, 16 bp, R. norvegicus
gtacaacaaagccaag

SEQ ID NO: 512330 - DNA, 16 bp, R. norvegicus
gtacaagaaaattgaa

SEQ ID NO: 512331 - DNA, 16 bp, R. norvegicus
gtacaaggagagaaga

SEQ ID NO: 512332 - DNA, 16 bp, R. norvegicus
gtacaaggctggaaaa

SEQ ID NO: 512333 - DNA, 16 bp, R. norvegicus
gtacaatgaggagctg

SEQ ID NO: 512334 - DNA, 16 bp, R. norvegicus
gtacacaatggagtac

SEQ ID NO: 512335 - DNA, 16 bp, R. norvegicus
gtacacacacacatac

SEQ ID NO: 512336 - DNA, 16 bp, R. norvegicus
gtacacacacatcaca

SEQ ID NO: 512337 - DNA, 16 bp, R. norvegicus
gtacacacagagacac

SEQ ID NO: 512338 - DNA, 16 bp, R. norvegicus
gtacacagacagacag

SEQ ID NO: 512339 - DNA, 16 bp, R. norvegicus
gtacacagacatgcac

SEQ ID NO: 512340 - DNA, 16 bp, R. norvegicus
gtacacaggcacacac

SEQ ID NO: 512341 - DNA, 16 bp, R. norvegicus
gtacacatctttaatc

SEQ ID NO: 512342 - DNA, 16 bp, R. norvegicus
gtacacatgtatgtgt

SEQ ID NO: 512343 - DNA, 16 bp, R. norvegicus
gtacaccaccacacct

SEQ ID NO: 512344 - DNA, 16 bp, R. norvegicus
gtacacgtgtgtatgt

SEQ ID NO: 512345 - DNA, 16 bp, R. norvegicus
gtacactgtcctcaga

SEQ ID NO: 512346 - DNA, 16 bp, R. norvegicus
gtacagaaacagacag

SEQ ID NO: 512347 - DNA, 16 bp, R. norvegicus
gtacagaaagacagaa

SEQ ID NO: 512348 - DNA, 16 bp, R. norvegicus
gtacagaacaaagaat

SEQ ID NO: 512349 - DNA, 16 bp, R. norvegicus
gtacagagacaggctg

SEQ ID NO: 512350 - DNA, 16 bp, R. norvegicus
gtacagagctgaacaa

SEQ ID NO: 512351 - DNA, 16 bp, R. norvegicus
gtacagagggctgtgg

SEQ ID NO: 512352 - DNA, 16 bp, R. norvegicus
gtacagcaaaggacac

SEQ ID NO: 512353 - DNA, 114 bp, R. norvegicus
gtacaggaaatccaggactcaatgagaagatcaaacctaaggataataggtatagaagagagtgaagactcccagctcaaaggaccagtaaatatcttcaacaaaatcatagaa

SEQ ID NO: 512354 - DNA, 16 bp, R. norvegicus
gtacataaagaaatgt

SEQ ID NO: 512355 - DNA, 16 bp, R. norvegicus
gtacatcctcttggag

SEQ ID NO: 512356 - DNA, 16 bp, R. norvegicus
gtacatcttctctgac

SEQ ID NO: 512357 - DNA, 16 bp, R. norvegicus
gtacatgcacatgcac

SEQ ID NO: 512358 - DNA, 16 bp, R. norvegicus
gtacatgcccaagagt

SEQ ID NO: 512359 - DNA, 16 bp, R. norvegicus
gtacatgtgtacatgc

SEQ ID NO: 512360 - DNA, 16 bp, R. norvegicus
gtacatgtgtgcctgt

SEQ ID NO: 512361 - DNA, 16 bp, R. norvegicus
gtacattgtagctgtt

SEQ ID NO: 512362 - DNA, 16 bp, R. norvegicus
gtacatttcctgtatg

SEQ ID NO: 512363 - DNA, 16 bp, R. norvegicus
gtaccacagctccctg

SEQ ID NO: 512364 - DNA, 16 bp, R. norvegicus
gtaccaccactgcctg

SEQ ID NO: 512365 - DNA, 16 bp, R. norvegicus
gtaccagagaactggg

SEQ ID NO: 512366 - DNA, 16 bp, R. norvegicus
gtaccagccctcacct

SEQ ID NO: 512367 - DNA, 16 bp, R. norvegicus
gtaccatccctaggca

SEQ ID NO: 512368 - DNA, 16 bp, R. norvegicus
gtaccatgaagtgctg

SEQ ID NO: 512369 - DNA, 16 bp, R. norvegicus
gtaccatgaggggctg

SEQ ID NO: 512370 - DNA, 24 bp, R. norvegicus
gtaccgagaatcgggcgaaagcct

SEQ ID NO: 512371 - DNA, 16 bp, R. norvegicus
gtacctcactgtccac

SEQ ID NO: 512372 - DNA, 16 bp, R. norvegicus
gtacctgacaggggaa

SEQ ID NO: 512373 - DNA, 16 bp, R. norvegicus
gtacctgcaggcacac

SEQ ID NO: 512374 - DNA, 16 bp, R. norvegicus
gtacctgctgaggccc

SEQ ID NO: 512375 - DNA, 16 bp, R. norvegicus
gtacctgtggaagcca

SEQ ID NO: 512376 - DNA, 16 bp, R. norvegicus
gtaccttctgcctctg

SEQ ID NO: 512377 - DNA, 16 bp, R. norvegicus
gtacgggaatgtcagg

SEQ ID NO: 512378 - DNA, 16 bp, R. norvegicus
gtacgtgtgtgcgtgc

SEQ ID NO: 512379 - DNA, 16 bp, R. norvegicus
gtactacctgaggagc

SEQ ID NO: 512380 - DNA, 16 bp, R. norvegicus
gtactatgaggtgctg

SEQ ID NO: 512381 - DNA, 16 bp, R. norvegicus
gtactctgtgtgtgtg

SEQ ID NO: 512382 - DNA, 16 bp, R. norvegicus
gtactcttctgctgtg

SEQ ID NO: 512383 - DNA, 16 bp, R. norvegicus
gtactgagaaccaaac

SEQ ID NO: 512384 - DNA, 16 bp, R. norvegicus
gtactgcacacacaca

SEQ ID NO: 512385 - DNA, 16 bp, R. norvegicus
gtactggcagctgtct

SEQ ID NO: 512386 - DNA, 16 bp, R. norvegicus
gtactgggaactgagc

SEQ ID NO: 512387 - DNA, 16 bp, R. norvegicus
gtactgggagctgaac

SEQ ID NO: 512388 - DNA, 16 bp, R. norvegicus
gtactggggctggaga

SEQ ID NO: 512389 - DNA, 16 bp, R. norvegicus
gtactgttctctttgt

SEQ ID NO: 512390 - DNA, 16 bp, R. norvegicus
gtacttacatttcaaa

SEQ ID NO: 512391 - DNA, 16 bp, R. norvegicus
gtacttagagagtgga

SEQ ID NO: 512392 - DNA, 16 bp, R. norvegicus
gtacttcccctacctg

SEQ ID NO: 512393 - DNA, 16 bp, R. norvegicus
gtacttcctgctgctc

SEQ ID NO: 512394 - DNA, 16 bp, R. norvegicus
gtactttatattattt

SEQ ID NO: 512395 - DNA, 16 bp, R. norvegicus
gtagaaacagaaagaa

SEQ ID NO: 512396 - DNA, 16 bp, R. norvegicus
gtagaagcaataaaga

SEQ ID NO: 512397 - DNA, 16 bp, R. norvegicus
gtagaagcagagaaag

SEQ ID NO: 512398 - DNA, 16 bp, R. norvegicus
gtagaatgcttttggc

SEQ ID NO: 512399 - DNA, 16 bp, R. norvegicus
gtagaattctaccaga

SEQ ID NO: 512400 - DNA, 16 bp, R. norvegicus
gtagaattctgcagta

SEQ ID NO: 512401 - DNA, 16 bp, R. norvegicus
gtagacaaagtgatga

SEQ ID NO: 512402 - DNA, 17 bp, R. norvegicus
gtagacacacacacaca

SEQ ID NO: 512403 - DNA, 16 bp, R. norvegicus
gtagacatctgcccag

SEQ ID NO: 512404 - DNA, 16 bp, R. norvegicus
gtagacctggcctcca

SEQ ID NO: 512405 - DNA, 16 bp, R. norvegicus
gtagacttcatctcag

SEQ ID NO: 512406 - DNA, 16 bp, R. norvegicus
gtagagaaagaggagc

SEQ ID NO: 512407 - DNA, 16 bp, R. norvegicus
gtagagacaggcagat

SEQ ID NO: 512408 - DNA, 16 bp, R. norvegicus
gtagagaccctgccta

SEQ ID NO: 512409 - DNA, 16 bp, R. norvegicus
gtagagagaatgaaca

SEQ ID NO: 512410 - DNA, 16 bp, R. norvegicus
gtagagcacgtgtctt

SEQ ID NO: 512411 - DNA, 16 bp, R. norvegicus
gtagagcaggctgtcc

SEQ ID NO: 512412 - DNA, 21 bp, R. norvegicus
gtagagcgcttgcctagcgag

SEQ ID NO: 512413 - DNA, 16 bp, R. norvegicus
gtagagctgacactgg

SEQ ID NO: 512414 - DNA, 16 bp, R. norvegicus
gtagaggagggcccag

SEQ ID NO: 512415 - DNA, 16 bp, R. norvegicus
gtagaggcagaagaat

SEQ ID NO: 512416 - DNA, 16 bp, R. norvegicus
gtagaggccagaggaa

SEQ ID NO: 512417 - DNA, 16 bp, R. norvegicus
gtagaggctggcaagg

SEQ ID NO: 512418 - DNA, 16 bp, R. norvegicus
gtagaggggctgggga

SEQ ID NO: 512419 - DNA, 16 bp, R. norvegicus
gtagaggtcagatgac

SEQ ID NO: 512420 - DNA, 16 bp, R. norvegicus
gtagatggatggatgg

SEQ ID NO: 512421 - DNA, 16 bp, R. norvegicus
gtagcaaatgtgcagc

SEQ ID NO: 512422 - DNA, 16 bp, R. norvegicus
gtagcactggctgtcc

SEQ ID NO: 512423 - DNA, 16 bp, R. norvegicus
gtagcagcagcaacaa

SEQ ID NO: 512424 - DNA, 16 bp, R. norvegicus
gtagcccaggatggcc

SEQ ID NO: 512425 - DNA, 16 bp, R. norvegicus
gtagccccagctgtcc

SEQ ID NO: 512426 - DNA, 16 bp, R. norvegicus
gtagcctttgttctat

SEQ ID NO: 512427 - DNA, 16 bp, R. norvegicus
gtagctgaggctagcc

SEQ ID NO: 512428 - DNA, 16 bp, R. norvegicus
gtaggattcttgtatg

SEQ ID NO: 512429 - DNA, 16 bp, R. norvegicus
gtaggcaggaactgaa

SEQ ID NO: 512430 - DNA, 16 bp, R. norvegicus
gtaggctgcagaatgc

SEQ ID NO: 512431 - DNA, 16 bp, R. norvegicus
gtaggtctttccatct

SEQ ID NO: 512432 - DNA, 16 bp, R. norvegicus
gtaggtgtgtatgtat

SEQ ID NO: 512433 - DNA, 16 bp, R. norvegicus
gtagtagaagaagaag

SEQ ID NO: 512434 - DNA, 16 bp, R. norvegicus
gtagtagcagcagtag

SEQ ID NO: 512435 - DNA, 16 bp, R. norvegicus
gtagtcattttaatat

SEQ ID NO: 512436 - DNA, 16 bp, R. norvegicus
gtagtgctgtatttgt

SEQ ID NO: 512437 - DNA, 16 bp, R. norvegicus
gtagtgtgtgagtgtg

SEQ ID NO: 512438 - DNA, 16 bp, R. norvegicus
gtagttcagtggtaga

SEQ ID NO: 512439 - DNA, 16 bp, R. norvegicus
gtagttgtagttgtag

SEQ ID NO: 512440 - DNA, 16 bp, R. norvegicus
gtagtttagttcctgg

SEQ ID NO: 512441 - DNA, 16 bp, R. norvegicus
gtataattatatcatt

SEQ ID NO: 512442 - DNA, 16 bp, R. norvegicus
gtatagtttctctcct

SEQ ID NO: 512443 - DNA, 16 bp, R. norvegicus
gtatataagtatgtgt

SEQ ID NO: 512444 - DNA, 16 bp, R. norvegicus
gtatatacatgggctg

SEQ ID NO: 512445 - DNA, 16 bp, R. norvegicus
gtatatataagtatat

SEQ ID NO: 512446 - DNA, 16 bp, R. norvegicus
gtatatatatatatgt

SEQ ID NO: 512447 - DNA, 16 bp, R. norvegicus
gtatatatatgtgtgt

SEQ ID NO: 512448 - DNA, 16 bp, R. norvegicus
gtatatatgcatattt

SEQ ID NO: 512449 - DNA, 16 bp, R. norvegicus
gtatatatgcatgtgt

SEQ ID NO: 512450 - DNA, 16 bp, R. norvegicus
gtatatgcccaagagt

SEQ ID NO: 512451 - DNA, 16 bp, R. norvegicus
gtatatggagacaaag

SEQ ID NO: 512452 - DNA, 16 bp, R. norvegicus
gtatatgggctggatc

SEQ ID NO: 512453 - DNA, 16 bp, R. norvegicus
gtatatgtaatatatg

SEQ ID NO: 512454 - DNA, 16 bp, R. norvegicus
gtatatgtatattcat

SEQ ID NO: 512455 - DNA, 16 bp, R. norvegicus
gtatatgtatgtgtgt

SEQ ID NO: 512456 - DNA, 16 bp, R. norvegicus
gtatattataccatcc

SEQ ID NO: 512457 - DNA, 16 bp, R. norvegicus
gtatcaattcttctgt

SEQ ID NO: 512458 - DNA, 16 bp, R. norvegicus
gtatcagacattgtta

SEQ ID NO: 512459 - DNA, 16 bp, R. norvegicus
gtatccctggctgtct

SEQ ID NO: 512460 - DNA, 16 bp, R. norvegicus
gtatcctgcgcaggag

SEQ ID NO: 512461 - DNA, 16 bp, R. norvegicus
gtatctctatgtgtgt

SEQ ID NO: 512462 - DNA, 16 bp, R. norvegicus
gtatctctctttctct

SEQ ID NO: 512463 - DNA, 16 bp, R. norvegicus
gtatctgagttctttc

SEQ ID NO: 512464 - DNA, 16 bp, R. norvegicus
gtatctgcagaggcca

SEQ ID NO: 512465 - DNA, 16 bp, R. norvegicus
gtatctgcagtcagga

SEQ ID NO: 512466 - DNA, 16 bp, R. norvegicus
gtatctgcatctgtct

SEQ ID NO: 512467 - DNA, 16 bp, R. norvegicus
gtatctgctgaggcct

SEQ ID NO: 512468 - DNA, 16 bp, R. norvegicus
gtatcttcaatgcctg

SEQ ID NO: 512469 - DNA, 16 bp, R. norvegicus
gtatgaaattttcaaa

SEQ ID NO: 512470 - DNA, 16 bp, R. norvegicus
gtatgagaaagagaga

SEQ ID NO: 512471 - DNA, 16 bp, R. norvegicus
gtatgaggccagcctg

SEQ ID NO: 512472 - DNA, 16 bp, R. norvegicus
gtatgagtgtaattgt

SEQ ID NO: 512473 - DNA, 16 bp, R. norvegicus
gtatgatcattttgat

SEQ ID NO: 512474 - DNA, 16 bp, R. norvegicus
gtatgatgtggaggtc

SEQ ID NO: 512475 - DNA, 16 bp, R. norvegicus
gtatgcagtgtgtgtg

SEQ ID NO: 512476 - DNA, 16 bp, R. norvegicus
gtatgcatgaagacag

SEQ ID NO: 512477 - DNA, 16 bp, R. norvegicus
gtatgcatgcatgtct

SEQ ID NO: 512478 - DNA, 16 bp, R. norvegicus
gtatgcatgttcatgt

SEQ ID NO: 512479 - DNA, 16 bp, R. norvegicus
gtatgcctgtgcacca

SEQ ID NO: 512480 - DNA, 17 bp, R. norvegicus
gtatgctctaagatcaa

SEQ ID NO: 512481 - DNA, 16 bp, R. norvegicus
gtatggagaaaaagca

SEQ ID NO: 512482 - DNA, 16 bp, R. norvegicus
gtatggccttgttgga

SEQ ID NO: 512483 - DNA, 16 bp, R. norvegicus
gtatggctgggtcttg

SEQ ID NO: 512484 - DNA, 16 bp, R. norvegicus
gtatgggttccatctc

SEQ ID NO: 512485 - DNA, 16 bp, R. norvegicus
gtatggtgaggtggaa

SEQ ID NO: 512486 - DNA, 16 bp, R. norvegicus
gtatgtatacatgtgt

SEQ ID NO: 512487 - DNA, 16 bp, R. norvegicus
gtatgtatatattata

SEQ ID NO: 512488 - DNA, 16 bp, R. norvegicus
gtatgtatgtatggtg

SEQ ID NO: 512489 - DNA, 16 bp, R. norvegicus
gtatgtatttatgtat

SEQ ID NO: 512490 - DNA, 16 bp, R. norvegicus
gtatgtgaatgtgttt

SEQ ID NO: 512491 - DNA, 16 bp, R. norvegicus
gtatgtgctgtgtgtg

SEQ ID NO: 512492 - DNA, 16 bp, R. norvegicus
gtatgtggctggagcc

SEQ ID NO: 512493 - DNA, 16 bp, R. norvegicus
gtatgtgtatgtgcat

SEQ ID NO: 512494 - DNA, 16 bp, R. norvegicus
gtatgtgtgtgtacat

SEQ ID NO: 512495 - DNA, 16 bp, R. norvegicus
gtatgtgtgtgtaggt

SEQ ID NO: 512496 - DNA, 16 bp, R. norvegicus
gtatgtgtgtgtatag

SEQ ID NO: 512497 - DNA, 16 bp, R. norvegicus
gtatgtgttcatttct

SEQ ID NO: 512498 - DNA, 16 bp, R. norvegicus
gtatgtttgtgtctgt

SEQ ID NO: 512499 - DNA, 16 bp, R. norvegicus
gtattcctgccctgtg

SEQ ID NO: 512500 - DNA, 16 bp, R. norvegicus
gtattccttctgcctc

SEQ ID NO: 512501 - DNA, 16 bp, R. norvegicus
gtattctgtaattttt

SEQ ID NO: 512502 - DNA, 16 bp, R. norvegicus
gtattgaagagatcag

SEQ ID NO: 512503 - DNA, 16 bp, R. norvegicus
gtattgaagtcaacag

SEQ ID NO: 512504 - DNA, 16 bp, R. norvegicus
gtattggacatgctgt

SEQ ID NO: 512505 - DNA, 16 bp, R. norvegicus
gtatttacattatgat

SEQ ID NO: 512506 - DNA, 16 bp, R. norvegicus
gtatttagggcttttt

SEQ ID NO: 512507 - DNA, 16 bp, R. norvegicus
gtatttcataaagtca

SEQ ID NO: 512508 - DNA, 16 bp, R. norvegicus
gtatttctttaagaga

SEQ ID NO: 512509 - DNA, 16 bp, R. norvegicus
gtatttggggcattga

SEQ ID NO: 512510 - DNA, 16 bp, R. norvegicus
gtatttgtaaatatat

SEQ ID NO: 512511 - DNA, 16 bp, R. norvegicus
gtatttgtcatgcact

SEQ ID NO: 512512 - DNA, 16 bp, R. norvegicus
gtattttcatctcagt

SEQ ID NO: 512513 - DNA, 16 bp, R. norvegicus
gtattttcatttacat

SEQ ID NO: 512514 - DNA, 16 bp, R. norvegicus
gtattttctggaacca

SEQ ID NO: 512515 - DNA, 16 bp, R. norvegicus
gtattttgatgggaat

SEQ ID NO: 512516 - DNA, 16 bp, R. norvegicus
gtattttggccatgaa

SEQ ID NO: 512517 - DNA, 16 bp, R. norvegicus
gtattttgggaaagaa

SEQ ID NO: 512518 - DNA, 16 bp, R. norvegicus
gtatttttataatctg

SEQ ID NO: 512519 - DNA, 16 bp, R. norvegicus
gtcaaaaatcaagcga

SEQ ID NO: 512520 - DNA, 16 bp, R. norvegicus
gtcaaaaatcaagtat

SEQ ID NO: 512521 - DNA, 36 bp, R. norvegicus
gtcaaaatatcactatttgcagacgacatgatagta

SEQ ID NO: 512522 - DNA, 16 bp, R. norvegicus
gtcaaaattctgaccc

SEQ ID NO: 512523 - DNA, 16 bp, R. norvegicus
gtcaaagaaaatggaa

SEQ ID NO: 512524 - DNA, 16 bp, R. norvegicus
gtcaaagatcacatga

SEQ ID NO: 512525 - DNA, 16 bp, R. norvegicus
gtcaaagctacacaga

SEQ ID NO: 512526 - DNA, 16 bp, R. norvegicus
gtcaaagtggatcaaa

SEQ ID NO: 512527 - DNA, 16 bp, R. norvegicus
gtcaaatgcttctcag

SEQ ID NO: 512528 - DNA, 16 bp, R. norvegicus
gtcaacaaagatgaaa

SEQ ID NO: 512529 - DNA, 16 bp, R. norvegicus
gtcaacaattgacaaa

SEQ ID NO: 512530 - DNA, 16 bp, R. norvegicus
gtcaacatgttgaaga

SEQ ID NO: 512531 - DNA, 16 bp, R. norvegicus
gtcaacattaaactaa

SEQ ID NO: 512532 - DNA, 16 bp, R. norvegicus
gtcaaccagagctccc

SEQ ID NO: 512533 - DNA, 16 bp, R. norvegicus
gtcaaccttggctaca

SEQ ID NO: 512534 - DNA, 16 bp, R. norvegicus
gtcaagatggctcagt

SEQ ID NO: 512535 - DNA, 16 bp, R. norvegicus
gtcaagctgcaggagc

SEQ ID NO: 512536 - DNA, 16 bp, R. norvegicus
gtcaagctgctggcat

SEQ ID NO: 512537 - DNA, 16 bp, R. norvegicus
gtcaaggaaaaaataa

SEQ ID NO: 512538 - DNA, 16 bp, R. norvegicus
gtcaaggaagaagtaa

SEQ ID NO: 512539 - DNA, 16 bp, R. norvegicus
gtcaaggccatgactg

SEQ ID NO: 512540 - DNA, 16 bp, R. norvegicus
gtcaatctcttctatg

SEQ ID NO: 512541 - DNA, 16 bp, R. norvegicus
gtcaatgccagcagca

SEQ ID NO: 512542 - DNA, 16 bp, R. norvegicus
gtcaatggctgctgtg

SEQ ID NO: 512543 - DNA, 16 bp, R. norvegicus
gtcaattatggagaaa

SEQ ID NO: 512544 - DNA, 16 bp, R. norvegicus
gtcaattctttgttta

SEQ ID NO: 512545 - DNA, 16 bp, R. norvegicus
gtcacaaaagaagaca

SEQ ID NO: 512546 - DNA, 16 bp, R. norvegicus
gtcacaaaataaaaca

SEQ ID NO: 512547 - DNA, 16 bp, R. norvegicus
gtcacaccaaggtgtt

SEQ ID NO: 512548 - DNA, 16 bp, R. norvegicus
gtcacactgcacactg

SEQ ID NO: 512549 - DNA, 16 bp, R. norvegicus
gtcacagaacttacag

SEQ ID NO: 512550 - DNA, 16 bp, R. norvegicus
gtcacaggcacacaca

SEQ ID NO: 512551 - DNA, 16 bp, R. norvegicus
gtcacaggcagctgtg

SEQ ID NO: 512552 - DNA, 16 bp, R. norvegicus
gtcacaggtggctgtg

SEQ ID NO: 512553 - DNA, 16 bp, R. norvegicus
gtcacagttcacagtg

SEQ ID NO: 512554 - DNA, 16 bp, R. norvegicus
gtcacatgatcatctc

SEQ ID NO: 512555 - DNA, 16 bp, R. norvegicus
gtcaccaaaccaagac

SEQ ID NO: 512556 - DNA, 16 bp, R. norvegicus
gtcaccaccaccacca

SEQ ID NO: 512557 - DNA, 16 bp, R. norvegicus
gtcaccctcctcctca

SEQ ID NO: 512558 - DNA, 16 bp, R. norvegicus
gtcaccgtgtgggtgc

SEQ ID NO: 512559 - DNA, 16 bp, R. norvegicus
gtcacctcactcagga

SEQ ID NO: 512560 - DNA, 16 bp, R. norvegicus
gtcacctgggagagct

SEQ ID NO: 512561 - DNA, 16 bp, R. norvegicus
gtcaccttgtacaaag

SEQ ID NO: 512562 - DNA, 16 bp, R. norvegicus
gtcactactcaggaat

SEQ ID NO: 512563 - DNA, 16 bp, R. norvegicus
gtcactattggagatg

SEQ ID NO: 512564 - DNA, 16 bp, R. norvegicus
gtcactctgtccccac

SEQ ID NO: 512565 - DNA, 16 bp, R. norvegicus
gtcactgacacagaaa

SEQ ID NO: 512566 - DNA, 16 bp, R. norvegicus
gtcactggagaaaatt

SEQ ID NO: 512567 - DNA, 16 bp, R. norvegicus
gtcactgtatccagca

SEQ ID NO: 512568 - DNA, 16 bp, R. norvegicus
gtcactgtgggtgtgg

SEQ ID NO: 512569 - DNA, 16 bp, R. norvegicus
gtcacttcctgggcca

SEQ ID NO: 512570 - DNA, 16 bp, R. norvegicus
gtcacttgatttttaa

SEQ ID NO: 512571 - DNA, 16 bp, R. norvegicus
gtcactttgcacaaag

SEQ ID NO: 512572 - DNA, 16 bp, R. norvegicus
gtcagaaaaagcagaa

SEQ ID NO: 512573 - DNA, 16 bp, R. norvegicus
gtcagaaagcagaaag

SEQ ID NO: 512574 - DNA, 16 bp, R. norvegicus
gtcagaaatgaaaagg

SEQ ID NO: 512575 - DNA, 16 bp, R. norvegicus
gtcagaaattgcagaa

SEQ ID NO: 512576 - DNA, 16 bp, R. norvegicus
gtcagaagagagtgtc

SEQ ID NO: 512577 - DNA, 16 bp, R. norvegicus
gtcagaagaggctgtc

SEQ ID NO: 512578 - DNA, 16 bp, R. norvegicus
gtcagaagatgaaaag

SEQ ID NO: 512579 - DNA, 16 bp, R. norvegicus
gtcagaagcagcaagc

SEQ ID NO: 512580 - DNA, 16 bp, R. norvegicus
gtcagaagctgaaaag

SEQ ID NO: 512581 - DNA, 16 bp, R. norvegicus
gtcagagaacaactct

SEQ ID NO: 512582 - DNA, 16 bp, R. norvegicus
gtcagagaacagcttg

SEQ ID NO: 512583 - DNA, 16 bp, R. norvegicus
gtcagagaagatgaac

SEQ ID NO: 512584 - DNA, 16 bp, R. norvegicus
gtcagagagaaagaga

SEQ ID NO: 512585 - DNA, 16 bp, R. norvegicus
gtcagagctacacaga

SEQ ID NO: 512586 - DNA, 16 bp, R. norvegicus
gtcagaggacaacctg

SEQ ID NO: 512587 - DNA, 16 bp, R. norvegicus
gtcagaggacaacttc

SEQ ID NO: 512588 - DNA, 16 bp, R. norvegicus
gtcagaggacaagttt

SEQ ID NO: 512589 - DNA, 16 bp, R. norvegicus
gtcagaggacaccttg

SEQ ID NO: 512590 - DNA, 16 bp, R. norvegicus
gtcagaggacagcatg

SEQ ID NO: 512591 - DNA, 16 bp, R. norvegicus
gtcagaggtcaacttc

SEQ ID NO: 512592 - DNA, 16 bp, R. norvegicus
gtcagatccccctgga

SEQ ID NO: 512593 - DNA, 16 bp, R. norvegicus
gtcagatcttggagtt

SEQ ID NO: 512594 - DNA, 16 bp, R. norvegicus
gtcagcaacttctcct

SEQ ID NO: 512595 - DNA, 16 bp, R. norvegicus
gtcagcactcctggag

SEQ ID NO: 512596 - DNA, 16 bp, R. norvegicus
gtcagcagatgctggc

SEQ ID NO: 512597 - DNA, 16 bp, R. norvegicus
gtcagcagcagcagct

SEQ ID NO: 512598 - DNA, 16 bp, R. norvegicus
gtcagcagcatgacag

SEQ ID NO: 512599 - DNA, 16 bp, R. norvegicus
gtcagcagcttctctt

SEQ ID NO: 512600 - DNA, 16 bp, R. norvegicus
gtcagcatcttctgtc

SEQ ID NO: 512601 - DNA, 16 bp, R. norvegicus
gtcagcatgtacaaga

SEQ ID NO: 512602 - DNA, 16 bp, R. norvegicus
gtcagccaaccacagc

SEQ ID NO: 512603 - DNA, 16 bp, R. norvegicus
gtcagcctgacctaca

SEQ ID NO: 512604 - DNA, 16 bp, R. norvegicus
gtcagcctgctcttct

SEQ ID NO: 512605 - DNA, 16 bp, R. norvegicus
gtcagcctgggttaca

SEQ ID NO: 512606 - DNA, 16 bp, R. norvegicus
gtcagcctggtctaca

SEQ ID NO: 512607 - DNA, 16 bp, R. norvegicus
gtcagctggggctgaa

SEQ ID NO: 512608 - DNA, 16 bp, R. norvegicus
gtcagctgtttgttgg

SEQ ID NO: 512609 - DNA, 16 bp, R. norvegicus
gtcagcttctatggca

SEQ ID NO: 512610 - DNA, 16 bp, R. norvegicus
gtcaggaagcagagaa

SEQ ID NO: 512611 - DNA, 16 bp, R. norvegicus
gtcaggagagctggcc

SEQ ID NO: 512612 - DNA, 16 bp, R. norvegicus
gtcaggaggaggagga

SEQ ID NO: 512613 - DNA, 16 bp, R. norvegicus
gtcaggaggcagaagc

SEQ ID NO: 512614 - DNA, 16 bp, R. norvegicus
gtcaggataccagcag

SEQ ID NO: 512615 - DNA, 16 bp, R. norvegicus
gtcaggcatacctgac

SEQ ID NO: 512616 - DNA, 16 bp, R. norvegicus
gtcaggcatgcctggc

SEQ ID NO: 512617 - DNA, 16 bp, R. norvegicus
gtcaggcatggtggct

SEQ ID NO: 512618 - DNA, 16 bp, R. norvegicus
gtcaggctccagcaga

SEQ ID NO: 512619 - DNA, 16 bp, R. norvegicus
gtcaggctgtgggaag

SEQ ID NO: 512620 - DNA, 16 bp, R. norvegicus
gtcaggcttggccaca

SEQ ID NO: 512621 - DNA, 16 bp, R. norvegicus
gtcagggagcagagag

SEQ ID NO: 512622 - DNA, 16 bp, R. norvegicus
gtcagggcattgaggt

SEQ ID NO: 512623 - DNA, 16 bp, R. norvegicus
gtcagggtggggaggc

SEQ ID NO: 512624 - DNA, 16 bp, R. norvegicus
gtcaggtgactcacaa

SEQ ID NO: 512625 - DNA, 16 bp, R. norvegicus
gtcaggtttttgagaa

SEQ ID NO: 512626 - DNA, 16 bp, R. norvegicus
gtcagtcatgtgacag

SEQ ID NO: 512627 - DNA, 22 bp, R. norvegicus
gtcagtccttggtttatagcta

SEQ ID NO: 512628 - DNA, 16 bp, R. norvegicus
gtcagtgactggcagg

SEQ ID NO: 512629 - DNA, 16 bp, R. norvegicus
gtcagtgatggtgatt

SEQ ID NO: 512630 - DNA, 16 bp, R. norvegicus
gtcagtgcacagcagc

SEQ ID NO: 512631 - DNA, 16 bp, R. norvegicus
gtcagtggacaacttt

SEQ ID NO: 512632 - DNA, 16 bp, R. norvegicus
gtcagtggctagactg

SEQ ID NO: 512633 - DNA, 16 bp, R. norvegicus
gtcagtggttagagca

SEQ ID NO: 512634 - DNA, 17 bp, R. norvegicus
gtcataaaagaacacac

SEQ ID NO: 512635 - DNA, 16 bp, R. norvegicus
gtcatacagctgaagg

SEQ ID NO: 512636 - DNA, 52 bp, R. norvegicus
gtcatagaagacctcataccaatattatccaaactattccacaaaattgaaa

SEQ ID NO: 512637 - DNA, 16 bp, R. norvegicus
gtcataggcatcctga

SEQ ID NO: 512638 - DNA, 16 bp, R. norvegicus
gtcatcaccaccacca

SEQ ID NO: 512639 - DNA, 16 bp, R. norvegicus
gtcatcagacttggtg

SEQ ID NO: 512640 - DNA, 16 bp, R. norvegicus
gtcatcatacttggca

SEQ ID NO: 512641 - DNA, 16 bp, R. norvegicus
gtcatcatcaccacca

SEQ ID NO: 512642 - DNA, 16 bp, R. norvegicus
gtcatcatctgctaca

SEQ ID NO: 512643 - DNA, 16 bp, R. norvegicus
gtcatcatgcctggct

SEQ ID NO: 512644 - DNA, 16 bp, R. norvegicus
gtcatcccagagctga

SEQ ID NO: 512645 - DNA, 16 bp, R. norvegicus
gtcatcccagcactta

SEQ ID NO: 512646 - DNA, 16 bp, R. norvegicus
gtcatccctggctaca

SEQ ID NO: 512647 - DNA, 16 bp, R. norvegicus
gtcatcctcctcctca

SEQ ID NO: 512648 - DNA, 16 bp, R. norvegicus
gtcatcctgcacttct

SEQ ID NO: 512649 - DNA, 16 bp, R. norvegicus
gtcatctccaaagaca

SEQ ID NO: 512650 - DNA, 16 bp, R. norvegicus
gtcatctccatcttga

SEQ ID NO: 512651 - DNA, 16 bp, R. norvegicus
gtcatctttgactaca

SEQ ID NO: 512652 - DNA, 16 bp, R. norvegicus
gtcatgagtcaccatg

SEQ ID NO: 512653 - DNA, 16 bp, R. norvegicus
gtcatggatcttggag

SEQ ID NO: 512654 - DNA, 16 bp, R. norvegicus
gtcatggtttttaata

SEQ ID NO: 512655 - DNA, 16 bp, R. norvegicus
gtcatgtgggtgctga

SEQ ID NO: 512656 - DNA, 16 bp, R. norvegicus
gtcatgttcagaacat

SEQ ID NO: 512657 - DNA, 41 bp, R. norvegicus
gtcattaaaggtctcccaaccaaaaagagtccaggtccaga

SEQ ID NO: 512658 - DNA, 16 bp, R. norvegicus
gtcattatgcagcaag

SEQ ID NO: 512659 - DNA, 16 bp, R. norvegicus
gtcattcagtattcct

SEQ ID NO: 512660 - DNA, 16 bp, R. norvegicus
gtcattctcatccaaa

SEQ ID NO: 512661 - DNA, 16 bp, R. norvegicus
gtcattgaatagagca

SEQ ID NO: 512662 - DNA, 16 bp, R. norvegicus
gtcattggttttaata

SEQ ID NO: 512663 - DNA, 16 bp, R. norvegicus
gtcattttctcaactg

SEQ ID NO: 512664 - DNA, 16 bp, R. norvegicus
gtcattttgcagtctg

SEQ ID NO: 512665 - DNA, 16 bp, R. norvegicus
gtcattttgccaaaag

SEQ ID NO: 512666 - DNA, 16 bp, R. norvegicus
gtccaaaagctcggaa

SEQ ID NO: 512667 - DNA, 16 bp, R. norvegicus
gtccaaaccatacagg

SEQ ID NO: 512668 - DNA, 16 bp, R. norvegicus
gtccaaactaacaaaa

SEQ ID NO: 512669 - DNA, 16 bp, R. norvegicus
gtccaagtccaagaac

SEQ ID NO: 512670 - DNA, 16 bp, R. norvegicus
gtccaagtggataaag

SEQ ID NO: 512671 - DNA, 16 bp, R. norvegicus
gtccaatatttggctg

SEQ ID NO: 512672 - DNA, 16 bp, R. norvegicus
gtccaatctgtttgga

SEQ ID NO: 512673 - DNA, 16 bp, R. norvegicus
gtccacacccacagtg

SEQ ID NO: 512674 - DNA, 16 bp, R. norvegicus
gtccacacttctgaaa

SEQ ID NO: 512675 - DNA, 16 bp, R. norvegicus
gtccacagagcaagtt

SEQ ID NO: 512676 - DNA, 16 bp, R. norvegicus
gtccacagtcaggaag

SEQ ID NO: 512677 - DNA, 16 bp, R. norvegicus
gtccacctgcctcagc

SEQ ID NO: 512678 - DNA, 16 bp, R. norvegicus
gtccacttcctgcaga

SEQ ID NO: 512679 - DNA, 16 bp, R. norvegicus
gtccacttctgcagtg

SEQ ID NO: 512680 - DNA, 16 bp, R. norvegicus
gtccagaagaggatgt

SEQ ID NO: 512681 - DNA, 16 bp, R. norvegicus
gtccagaagagggcat

SEQ ID NO: 512682 - DNA, 16 bp, R. norvegicus
gtccagacaaggcagt

SEQ ID NO: 512683 - DNA, 16 bp, R. norvegicus
gtccagacccaagagg

SEQ ID NO: 512684 - DNA, 16 bp, R. norvegicus
gtccagactgtggaga

SEQ ID NO: 512685 - DNA, 16 bp, R. norvegicus
gtccagagacaggcag

SEQ ID NO: 512686 - DNA, 16 bp, R. norvegicus
gtccagagagctgtgg

SEQ ID NO: 512687 - DNA, 16 bp, R. norvegicus
gtccagagccacagag

SEQ ID NO: 512688 - DNA, 16 bp, R. norvegicus
gtccagcagaggctcc

SEQ ID NO: 512689 - DNA, 16 bp, R. norvegicus
gtccagcagtggctgg

SEQ ID NO: 512690 - DNA, 16 bp, R. norvegicus
gtccagcccactgtgg

SEQ ID NO: 512691 - DNA, 16 bp, R. norvegicus
gtccagcctgtgtgtg

SEQ ID NO: 512692 - DNA, 16 bp, R. norvegicus
gtccaggagaaagaag

SEQ ID NO: 512693 - DNA, 16 bp, R. norvegicus
gtccaggaggagctga

SEQ ID NO: 512694 - DNA, 16 bp, R. norvegicus
gtccaggatgtggaga

SEQ ID NO: 512695 - DNA, 16 bp, R. norvegicus
gtccaggcagccatgg

SEQ ID NO: 512696 - DNA, 16 bp, R. norvegicus
gtccaggcagtgagct

SEQ ID NO: 512697 - DNA, 16 bp, R. norvegicus
gtccaggcagtgtctg

SEQ ID NO: 512698 - DNA, 16 bp, R. norvegicus
gtccaggctcttctgg

SEQ ID NO: 512699 - DNA, 16 bp, R. norvegicus
gtccagtctggccttg

SEQ ID NO: 512700 - DNA, 16 bp, R. norvegicus
gtccagttcagtagtg

SEQ ID NO: 512701 - DNA, 16 bp, R. norvegicus
gtccatcaacagaaga

SEQ ID NO: 512702 - DNA, 16 bp, R. norvegicus
gtccatcaccaaagga

SEQ ID NO: 512703 - DNA, 16 bp, R. norvegicus
gtccatgtgtcctctt

SEQ ID NO: 512704 - DNA, 16 bp, R. norvegicus
gtccattatcatcaag

SEQ ID NO: 512705 - DNA, 16 bp, R. norvegicus
gtccattggtgttaag

SEQ ID NO: 512706 - DNA, 16 bp, R. norvegicus
gtccattgtcatcaca

SEQ ID NO: 512707 - DNA, 16 bp, R. norvegicus
gtccatttggctcacg

SEQ ID NO: 512708 - DNA, 16 bp, R. norvegicus
gtcccaagaggaggag

SEQ ID NO: 512709 - DNA, 16 bp, R. norvegicus
gtcccacaggaagacc

SEQ ID NO: 512710 - DNA, 16 bp, R. norvegicus
gtcccaccaacaatgg

SEQ ID NO: 512711 - DNA, 16 bp, R. norvegicus
gtcccagagatgtccc

SEQ ID NO: 512712 - DNA, 16 bp, R. norvegicus
gtcccagatgtcagga

SEQ ID NO: 512713 - DNA, 16 bp, R. norvegicus
gtcccagcatttgaga

SEQ ID NO: 512714 - DNA, 16 bp, R. norvegicus
gtcccagccccagccc

SEQ ID NO: 512715 - DNA, 16 bp, R. norvegicus
gtcccaggacagccag

SEQ ID NO: 512716 - DNA, 16 bp, R. norvegicus
gtcccagggagtgggg

SEQ ID NO: 512717 - DNA, 16 bp, R. norvegicus
gtcccatagctctctg

SEQ ID NO: 512718 - DNA, 16 bp, R. norvegicus
gtcccatcccccaacc

SEQ ID NO: 512719 - DNA, 16 bp, R. norvegicus
gtcccattttcagttc

SEQ ID NO: 512720 - DNA, 16 bp, R. norvegicus
gtccccaacctccatc

SEQ ID NO: 512721 - DNA, 16 bp, R. norvegicus
gtccccagatggtggc

SEQ ID NO: 512722 - DNA, 16 bp, R. norvegicus
gtcccccacctcctac

SEQ ID NO: 512723 - DNA, 16 bp, R. norvegicus
gtcccctgcaagagca

SEQ ID NO: 512724 - DNA, 16 bp, R. norvegicus
gtcccctggaagagca

SEQ ID NO: 512725 - DNA, 16 bp, R. norvegicus
gtcccgagaaaaaggg

SEQ ID NO: 512726 - DNA, 16 bp, R. norvegicus
gtccctaagagaacac

SEQ ID NO: 512727 - DNA, 23 bp, R. norvegicus
gtccctaggcgcagatcctcttc

SEQ ID NO: 512728 - DNA, 16 bp, R. norvegicus
gtccctcaaccaaaaa

SEQ ID NO: 512729 - DNA, 16 bp, R. norvegicus
gtccctcagagcagaa

SEQ ID NO: 512730 - DNA, 16 bp, R. norvegicus
gtccctctcaccctct

SEQ ID NO: 512731 - DNA, 16 bp, R. norvegicus
gtccctctgcctctct

SEQ ID NO: 512732 - DNA, 16 bp, R. norvegicus
gtccctctgtccttct

SEQ ID NO: 512733 - DNA, 16 bp, R. norvegicus
gtccctgacccagcag

SEQ ID NO: 512734 - DNA, 16 bp, R. norvegicus
gtccctgacctccatc

SEQ ID NO: 512735 - DNA, 16 bp, R. norvegicus
gtccctgagagctttg

SEQ ID NO: 512736 - DNA, 16 bp, R. norvegicus
gtccctgcactcagtc

SEQ ID NO: 512737 - DNA, 16 bp, R. norvegicus
gtccctgcatccccaa

SEQ ID NO: 512738 - DNA, 16 bp, R. norvegicus
gtccctgccctgtgtg

SEQ ID NO: 512739 - DNA, 16 bp, R. norvegicus
gtccctgctgctgctg

SEQ ID NO: 512740 - DNA, 16 bp, R. norvegicus
gtccctgctggtcctg

SEQ ID NO: 512741 - DNA, 16 bp, R. norvegicus
gtccctggaagccctg

SEQ ID NO: 512742 - DNA, 16 bp, R. norvegicus
gtccctggaaggcctg

SEQ ID NO: 512743 - DNA, 16 bp, R. norvegicus
gtccctggactctgac

SEQ ID NO: 512744 - DNA, 16 bp, R. norvegicus
gtccctggagcccggc

SEQ ID NO: 512745 - DNA, 16 bp, R. norvegicus
gtccctgtcagtccct

SEQ ID NO: 512746 - DNA, 16 bp, R. norvegicus
gtccctgtccccagtt

SEQ ID NO: 512747 - DNA, 16 bp, R. norvegicus
gtccctgtctttcctt

SEQ ID NO: 512748 - DNA, 16 bp, R. norvegicus
gtcccttctgccagag

SEQ ID NO: 512749 - DNA, 16 bp, R. norvegicus
gtccgtccgtccgtcc

SEQ ID NO: 512750 - DNA, 16 bp, R. norvegicus
gtcctacagatccaaa

SEQ ID NO: 512751 - DNA, 16 bp, R. norvegicus
gtcctacatcttcatc

SEQ ID NO: 512752 - DNA, 19 bp, R. norvegicus
gtcctagagtgctggctat

SEQ ID NO: 512753 - DNA, 16 bp, R. norvegicus
gtcctagctgtcctag

SEQ ID NO: 512754 - DNA, 16 bp, R. norvegicus
gtcctattcccagttc

SEQ ID NO: 512755 - DNA, 16 bp, R. norvegicus
gtcctattctcagtac

SEQ ID NO: 512756 - DNA, 16 bp, R. norvegicus
gtcctcacagtgctcc

SEQ ID NO: 512757 - DNA, 16 bp, R. norvegicus
gtcctcactctcttct

SEQ ID NO: 512758 - DNA, 16 bp, R. norvegicus
gtcctcatctcagctg

SEQ ID NO: 512759 - DNA, 16 bp, R. norvegicus
gtcctccattccctct

SEQ ID NO: 512760 - DNA, 16 bp, R. norvegicus
gtcctccccagggaag

SEQ ID NO: 512761 - DNA, 16 bp, R. norvegicus
gtcctcctgcctcacc

SEQ ID NO: 512762 - DNA, 16 bp, R. norvegicus
gtcctcctgcctcagc

SEQ ID NO: 512763 - DNA, 16 bp, R. norvegicus
gtcctcctgcctctgc

SEQ ID NO: 512764 - DNA, 16 bp, R. norvegicus
gtcctcctgctcctgg

SEQ ID NO: 512765 - DNA, 16 bp, R. norvegicus
gtcctcctggcccacc

SEQ ID NO: 512766 - DNA, 16 bp, R. norvegicus
gtcctcctttatacaa

SEQ ID NO: 512767 - DNA, 17 bp, R. norvegicus
gtcctcgccagcatctg

SEQ ID NO: 512768 - DNA, 16 bp, R. norvegicus
gtcctctagaggagca

SEQ ID NO: 512769 - DNA, 16 bp, R. norvegicus
gtcctctcccacctca

SEQ ID NO: 512770 - DNA, 17 bp, R. norvegicus
gtcctctccgcggcggc

SEQ ID NO: 512771 - DNA, 16 bp, R. norvegicus
gtcctctccttctacc

SEQ ID NO: 512772 - DNA, 16 bp, R. norvegicus
gtcctctgaaaggaca

SEQ ID NO: 512773 - DNA, 17 bp, R. norvegicus
gtcctctgcacccaaat

SEQ ID NO: 512774 - DNA, 16 bp, R. norvegicus
gtcctctggatgagca

SEQ ID NO: 512775 - DNA, 16 bp, R. norvegicus
gtcctgaaactcaatc

SEQ ID NO: 512776 - DNA, 16 bp, R. norvegicus
gtcctgactttctttg

SEQ ID NO: 512777 - DNA, 16 bp, R. norvegicus
gtcctgcacacacaca

SEQ ID NO: 512778 - DNA, 16 bp, R. norvegicus
gtcctgcagatccaaa

SEQ ID NO: 512779 - DNA, 16 bp, R. norvegicus
gtcctgccaaggctgt

SEQ ID NO: 512780 - DNA, 16 bp, R. norvegicus
gtcctgccatgtctgg

SEQ ID NO: 512781 - DNA, 16 bp, R. norvegicus
gtcctgcccaggctgg

SEQ ID NO: 512782 - DNA, 16 bp, R. norvegicus
gtcctgctcatctccc

SEQ ID NO: 512783 - DNA, 16 bp, R. norvegicus
gtcctgctgctgctgc

SEQ ID NO: 512784 - DNA, 16 bp, R. norvegicus
gtcctggaactcacgc

SEQ ID NO: 512785 - DNA, 16 bp, R. norvegicus
gtcctggaactcagta

SEQ ID NO: 512786 - DNA, 16 bp, R. norvegicus
gtcctggaactctctt

SEQ ID NO: 512787 - DNA, 16 bp, R. norvegicus
gtcctggaacttgccc

SEQ ID NO: 512788 - DNA, 16 bp, R. norvegicus
gtcctggaagcctctt

SEQ ID NO: 512789 - DNA, 16 bp, R. norvegicus
gtcctggaattcctgg

SEQ ID NO: 512790 - DNA, 16 bp, R. norvegicus
gtcctggacagatgtc

SEQ ID NO: 512791 - DNA, 16 bp, R. norvegicus
gtcctggcagtcctgg

SEQ ID NO: 512792 - DNA, 16 bp, R. norvegicus
gtcctggctggcctca

SEQ ID NO: 512793 - DNA, 16 bp, R. norvegicus
gtcctggctggctttg

SEQ ID NO: 512794 - DNA, 16 bp, R. norvegicus
gtcctggctgtctctg

SEQ ID NO: 512795 - DNA, 16 bp, R. norvegicus
gtcctggctttcctgg

SEQ ID NO: 512796 - DNA, 16 bp, R. norvegicus
gtcctgggattaaagg

SEQ ID NO: 512797 - DNA, 16 bp, R. norvegicus
gtcctgggatttgaac

SEQ ID NO: 512798 - DNA, 16 bp, R. norvegicus
gtcctgggctcttttt

SEQ ID NO: 512799 - DNA, 16 bp, R. norvegicus
gtcctgggctttgttt

SEQ ID NO: 512800 - DNA, 16 bp, R. norvegicus
gtcctgggtcctgggt

SEQ ID NO: 512801 - DNA, 16 bp, R. norvegicus
gtcctgtcaggggcag

SEQ ID NO: 512802 - DNA, 16 bp, R. norvegicus
gtcctgtggagatgtg

SEQ ID NO: 512803 - DNA, 16 bp, R. norvegicus
gtcctgtggctggtcc

SEQ ID NO: 512804 - DNA, 16 bp, R. norvegicus
gtcctgtggtcctgtg

SEQ ID NO: 512805 - DNA, 16 bp, R. norvegicus
gtcctgttcccagcag

SEQ ID NO: 512806 - DNA, 16 bp, R. norvegicus
gtcctgttgacagtgt

SEQ ID NO: 512807 - DNA, 16 bp, R. norvegicus
gtccttcaaaataaaa

SEQ ID NO: 512808 - DNA, 16 bp, R. norvegicus
gtccttcagaggctgg

SEQ ID NO: 512809 - DNA, 16 bp, R. norvegicus
gtccttccccatctct

SEQ ID NO: 512810 - DNA, 16 bp, R. norvegicus
gtccttcccccagctc

SEQ ID NO: 512811 - DNA, 16 bp, R. norvegicus
gtccttcctggctaca

SEQ ID NO: 512812 - DNA, 16 bp, R. norvegicus
gtccttcttcacgtct

SEQ ID NO: 512813 - DNA, 16 bp, R. norvegicus
gtccttgatccactag

SEQ ID NO: 512814 - DNA, 16 bp, R. norvegicus
gtccttgcacctacaa

SEQ ID NO: 512815 - DNA, 16 bp, R. norvegicus
gtccttgtctcttcct

SEQ ID NO: 512816 - DNA, 16 bp, R. norvegicus
gtccttgttcctgtga

SEQ ID NO: 512817 - DNA, 16 bp, R. norvegicus
gtcctttccagcttct

SEQ ID NO: 512818 - DNA, 16 bp, R. norvegicus
gtcctttctcagattc

SEQ ID NO: 512819 - DNA, 16 bp, R. norvegicus
gtcctttctgtgattc

SEQ ID NO: 512820 - DNA, 16 bp, R. norvegicus
gtcctttgaggtggga

SEQ ID NO: 512821 - DNA, 16 bp, R. norvegicus
gtcctttgcaagggca

SEQ ID NO: 512822 - DNA, 16 bp, R. norvegicus
gtcctttgccttcaga

SEQ ID NO: 512823 - DNA, 16 bp, R. norvegicus
gtcctttgtcagatgt

SEQ ID NO: 512824 - DNA, 16 bp, R. norvegicus
gtccttttcatttcta

SEQ ID NO: 512825 - DNA, 16 bp, R. norvegicus
gtccttttctcagttc

SEQ ID NO: 512826 - DNA, 16 bp, R. norvegicus
gtcgctggagagggag

SEQ ID NO: 512827 - DNA, 16 bp, R. norvegicus
gtcgtccttctcttcc

SEQ ID NO: 512828 - DNA, 16 bp, R. norvegicus
gtcgttcttgctggcg

SEQ ID NO: 512829 - DNA, 16 bp, R. norvegicus
gtctaattgctctggg

SEQ ID NO: 512830 - DNA, 16 bp, R. norvegicus
gtctacaagaaatgca

SEQ ID NO: 512831 - DNA, 16 bp, R. norvegicus
gtctacacagtaagtt

SEQ ID NO: 512832 - DNA, 16 bp, R. norvegicus
gtctacactgtgagtt

SEQ ID NO: 512833 - DNA, 16 bp, R. norvegicus
gtctacagagcaagct

SEQ ID NO: 512834 - DNA, 16 bp, R. norvegicus
gtctacagagtgggtt

SEQ ID NO: 512835 - DNA, 16 bp, R. norvegicus
gtctatatattaaaga

SEQ ID NO: 512836 - DNA, 16 bp, R. norvegicus
gtctatgtttctgttt

SEQ ID NO: 512837 - DNA, 16 bp, R. norvegicus
gtctcaaaaacaccaa

SEQ ID NO: 512838 - DNA, 16 bp, R. norvegicus
gtctcaaaagacaaaa

SEQ ID NO: 512839 - DNA, 16 bp, R. norvegicus
gtctcaaaatacaaag

SEQ ID NO: 512840 - DNA, 16 bp, R. norvegicus
gtctcaatttggggca

SEQ ID NO: 512841 - DNA, 16 bp, R. norvegicus
gtctcacctgtgctct

SEQ ID NO: 512842 - DNA, 16 bp, R. norvegicus
gtctcactcaggatga

SEQ ID NO: 512843 - DNA, 16 bp, R. norvegicus
gtctcactgtgtagcc

SEQ ID NO: 512844 - DNA, 16 bp, R. norvegicus
gtctcagaaaacaaca

SEQ ID NO: 512845 - DNA, 16 bp, R. norvegicus
gtctcagaaacaaaca

SEQ ID NO: 512846 - DNA, 16 bp, R. norvegicus
gtctcagaaagaaaga

SEQ ID NO: 512847 - DNA, 16 bp, R. norvegicus
gtctcagcctctccac

SEQ ID NO: 512848 - DNA, 16 bp, R. norvegicus
gtctcaggaaaaaaaa

SEQ ID NO: 512849 - DNA, 16 bp, R. norvegicus
gtctcaggatgagatt

SEQ ID NO: 512850 - DNA, 16 bp, R. norvegicus
gtctcagtcagctgcc

SEQ ID NO: 512851 - DNA, 16 bp, R. norvegicus
gtctcatcttcaggaa

SEQ ID NO: 512852 - DNA, 16 bp, R. norvegicus
gtctccaaggaaacca

SEQ ID NO: 512853 - DNA, 16 bp, R. norvegicus
gtctccacctcctgag

SEQ ID NO: 512854 - DNA, 16 bp, R. norvegicus
gtctccaccttcccag

SEQ ID NO: 512855 - DNA, 16 bp, R. norvegicus
gtctccagagtgctgg

SEQ ID NO: 512856 - DNA, 16 bp, R. norvegicus
gtctccagccaccaca

SEQ ID NO: 512857 - DNA, 16 bp, R. norvegicus
gtctccagccgccaca

SEQ ID NO: 512858 - DNA, 16 bp, R. norvegicus
gtctccaggatcctgc

SEQ ID NO: 512859 - DNA, 16 bp, R. norvegicus
gtctccagtgagaagt

SEQ ID NO: 512860 - DNA, 16 bp, R. norvegicus
gtctccagttggtgga

SEQ ID NO: 512861 - DNA, 16 bp, R. norvegicus
gtctccatatcctaaa

SEQ ID NO: 512862 - DNA, 16 bp, R. norvegicus
gtctccatcttcctcc

SEQ ID NO: 512863 - DNA, 16 bp, R. norvegicus
gtctccatttgctgta

SEQ ID NO: 512864 - DNA, 16 bp, R. norvegicus
gtctccattttcattt

SEQ ID NO: 512865 - DNA, 16 bp, R. norvegicus
gtctcccaactaaaaa

SEQ ID NO: 512866 - DNA, 16 bp, R. norvegicus
gtctccctctattatt

SEQ ID NO: 512867 - DNA, 16 bp, R. norvegicus
gtctccctgcagtcca

SEQ ID NO: 512868 - DNA, 16 bp, R. norvegicus
gtctccctgctccagg

SEQ ID NO: 512869 - DNA, 16 bp, R. norvegicus
gtctccctgtgtctct

SEQ ID NO: 512870 - DNA, 16 bp, R. norvegicus
gtctccctttgtgaat

SEQ ID NO: 512871 - DNA, 16 bp, R. norvegicus
gtctcctcagtgctgg

SEQ ID NO: 512872 - DNA, 16 bp, R. norvegicus
gtctcctcccacacct

SEQ ID NO: 512873 - DNA, 16 bp, R. norvegicus
gtctcctcctccccag

SEQ ID NO: 512874 - DNA, 16 bp, R. norvegicus
gtctcctcctggctgc

SEQ ID NO: 512875 - DNA, 16 bp, R. norvegicus
gtctcctctgagctct

SEQ ID NO: 512876 - DNA, 16 bp, R. norvegicus
gtctcctgagagcctc

SEQ ID NO: 512877 - DNA, 16 bp, R. norvegicus
gtctcctgcagaaggc

SEQ ID NO: 512878 - DNA, 16 bp, R. norvegicus
gtctcctgcctcagct

SEQ ID NO: 512879 - DNA, 16 bp, R. norvegicus
gtctcctgctgcctgt

SEQ ID NO: 512880 - DNA, 16 bp, R. norvegicus
gtctcctttgttccag

SEQ ID NO: 512881 - DNA, 16 bp, R. norvegicus
gtctctatgaagaatt

SEQ ID NO: 512882 - DNA, 16 bp, R. norvegicus
gtctctcaagattgct

SEQ ID NO: 512883 - DNA, 16 bp, R. norvegicus
gtctctcagagcagaa

SEQ ID NO: 512884 - DNA, 16 bp, R. norvegicus
gtctctcaggagagaa

SEQ ID NO: 512885 - DNA, 16 bp, R. norvegicus
gtctctcattgacctg

SEQ ID NO: 512886 - DNA, 16 bp, R. norvegicus
gtctctcattggcctg

SEQ ID NO: 512887 - DNA, 16 bp, R. norvegicus
gtctctccatctatgt

SEQ ID NO: 512888 - DNA, 16 bp, R. norvegicus
gtctctcctgagctct

SEQ ID NO: 512889 - DNA, 16 bp, R. norvegicus
gtctctctctgtctct

SEQ ID NO: 512890 - DNA, 16 bp, R. norvegicus
gtctctctgactgtct

SEQ ID NO: 512891 - DNA, 16 bp, R. norvegicus
gtctctctgatgatga

SEQ ID NO: 512892 - DNA, 16 bp, R. norvegicus
gtctctctgcctttta

SEQ ID NO: 512893 - DNA, 16 bp, R. norvegicus
gtctctctgtagacca

SEQ ID NO: 512894 - DNA, 16 bp, R. norvegicus
gtctctgaatgacctt

SEQ ID NO: 512895 - DNA, 16 bp, R. norvegicus
gtctctgaatggccat

SEQ ID NO: 512896 - DNA, 16 bp, R. norvegicus
gtctctgacagtggct

SEQ ID NO: 512897 - DNA, 34 bp, R. norvegicus
gtctctgcacccaaatcccgtgggagggagagct

SEQ ID NO: 512898 - DNA, 16 bp, R. norvegicus
gtctctgcatctgtct

SEQ ID NO: 512899 - DNA, 16 bp, R. norvegicus
gtctctgcctcccagt

SEQ ID NO: 512900 - DNA, 16 bp, R. norvegicus
gtctctgccttcagag

SEQ ID NO: 512901 - DNA, 16 bp, R. norvegicus
gtctctgccttctgaa

SEQ ID NO: 512902 - DNA, 16 bp, R. norvegicus
gtctctggatgaccct

SEQ ID NO: 512903 - DNA, 16 bp, R. norvegicus
gtctctggctctgttg

SEQ ID NO: 512904 - DNA, 17 bp, R. norvegicus
gtctctggcttattggc

SEQ ID NO: 512905 - DNA, 16 bp, R. norvegicus
gtctctggcttctgtg

SEQ ID NO: 512906 - DNA, 16 bp, R. norvegicus
gtctctgggctattca

SEQ ID NO: 512907 - DNA, 16 bp, R. norvegicus
gtctctggtcttacct

SEQ ID NO: 512908 - DNA, 16 bp, R. norvegicus
gtctctgtctcccttt

SEQ ID NO: 512909 - DNA, 16 bp, R. norvegicus
gtctctgtctctccat

SEQ ID NO: 512910 - DNA, 16 bp, R. norvegicus
gtctctgtctctcttg

SEQ ID NO: 512911 - DNA, 16 bp, R. norvegicus
gtctctgtctcttcct

SEQ ID NO: 512912 - DNA, 16 bp, R. norvegicus
gtctctgtctttctgt

SEQ ID NO: 512913 - DNA, 16 bp, R. norvegicus
gtctctgtgagcccca

SEQ ID NO: 512914 - DNA, 16 bp, R. norvegicus
gtctctgtgagtccat

SEQ ID NO: 512915 - DNA, 16 bp, R. norvegicus
gtctctgtgcttcctg

SEQ ID NO: 512916 - DNA, 16 bp, R. norvegicus
gtctctgtgtctgtct

SEQ ID NO: 512917 - DNA, 16 bp, R. norvegicus
gtctctgtgtttctct

SEQ ID NO: 512918 - DNA, 16 bp, R. norvegicus
gtctctgttactttct

SEQ ID NO: 512919 - DNA, 16 bp, R. norvegicus
gtctctgtttaacttc

SEQ ID NO: 512920 - DNA, 16 bp, R. norvegicus
gtctctgtttctctgt

SEQ ID NO: 512921 - DNA, 16 bp, R. norvegicus
gtctcttagttgggac

SEQ ID NO: 512922 - DNA, 16 bp, R. norvegicus
gtctcttcatagcaat

SEQ ID NO: 512923 - DNA, 16 bp, R. norvegicus
gtctcttgagagacac

SEQ ID NO: 512924 - DNA, 16 bp, R. norvegicus
gtctgaaagatctcag

SEQ ID NO: 512925 - DNA, 16 bp, R. norvegicus
gtctgaagacagacag

SEQ ID NO: 512926 - DNA, 16 bp, R. norvegicus
gtctgaagacagtgac

SEQ ID NO: 512927 - DNA, 17 bp, R. norvegicus
gtctgaagacggcgaca

SEQ ID NO: 512928 - DNA, 16 bp, R. norvegicus
gtctgacaccttcttc

SEQ ID NO: 512929 - DNA, 16 bp, R. norvegicus
gtctgagaccagtctg

SEQ ID NO: 512930 - DNA, 16 bp, R. norvegicus
gtctgagagcctgaga

SEQ ID NO: 512931 - DNA, 16 bp, R. norvegicus
gtctgaggaagcagca

SEQ ID NO: 512932 - DNA, 16 bp, R. norvegicus
gtctgaggaggaggag

SEQ ID NO: 512933 - DNA, 16 bp, R. norvegicus
gtctgaggcaggggga

SEQ ID NO: 512934 - DNA, 16 bp, R. norvegicus
gtctgcaagcacaaca

SEQ ID NO: 512935 - DNA, 16 bp, R. norvegicus
gtctgcagagtaagtt

SEQ ID NO: 512936 - DNA, 16 bp, R. norvegicus
gtctgcagcctcagga

SEQ ID NO: 512937 - DNA, 16 bp, R. norvegicus
gtctgcagctccagtg

SEQ ID NO: 512938 - DNA, 16 bp, R. norvegicus
gtctgcagtctgcagc

SEQ ID NO: 512939 - DNA, 16 bp, R. norvegicus
gtctgcctctccgaag

SEQ ID NO: 512940 - DNA, 16 bp, R. norvegicus
gtctgcctgcctatct

SEQ ID NO: 512941 - DNA, 16 bp, R. norvegicus
gtctgctccaccacag

SEQ ID NO: 512942 - DNA, 16 bp, R. norvegicus
gtctgctcttcctgag

SEQ ID NO: 512943 - DNA, 16 bp, R. norvegicus
gtctgctgccaggctc

SEQ ID NO: 512944 - DNA, 16 bp, R. norvegicus
gtctgctggacaagct

SEQ ID NO: 512945 - DNA, 16 bp, R. norvegicus
gtctgctgtgtgtgtg

SEQ ID NO: 512946 - DNA, 16 bp, R. norvegicus
gtctgctttagcaaga

SEQ ID NO: 512947 - DNA, 16 bp, R. norvegicus
gtctggaaggctgtgg

SEQ ID NO: 512948 - DNA, 30 bp, R. norvegicus
gtctggaggttcctcagaaaattggacatt

SEQ ID NO: 512949 - DNA, 16 bp, R. norvegicus
gtctggcatcagtgag

SEQ ID NO: 512950 - DNA, 16 bp, R. norvegicus
gtctggctgtctggct

SEQ ID NO: 512951 - DNA, 16 bp, R. norvegicus
gtctgggaaaccagga

SEQ ID NO: 512952 - DNA, 16 bp, R. norvegicus
gtctgggacctttgat

SEQ ID NO: 512953 - DNA, 16 bp, R. norvegicus
gtctgggagcagaaag

SEQ ID NO: 512954 - DNA, 16 bp, R. norvegicus
gtctgggcagtgtctg

SEQ ID NO: 512955 - DNA, 16 bp, R. norvegicus
gtctgggccaccacag

SEQ ID NO: 512956 - DNA, 16 bp, R. norvegicus
gtctgggtggtgagct

SEQ ID NO: 512957 - DNA, 16 bp, R. norvegicus
gtctgggttctttcca

SEQ ID NO: 512958 - DNA, 16 bp, R. norvegicus
gtctgggtttggtgtc

SEQ ID NO: 512959 - DNA, 16 bp, R. norvegicus
gtctggtcattgagtt

SEQ ID NO: 512960 - DNA, 16 bp, R. norvegicus
gtctggtggggtggag

SEQ ID NO: 512961 - DNA, 16 bp, R. norvegicus
gtctggttcaaggcct

SEQ ID NO: 512962 - DNA, 16 bp, R. norvegicus
gtctgtaatgggatcc

SEQ ID NO: 512963 - DNA, 16 bp, R. norvegicus
gtctgtatgacatcag

SEQ ID NO: 512964 - DNA, 16 bp, R. norvegicus
gtctgtcaggagagat

SEQ ID NO: 512965 - DNA, 16 bp, R. norvegicus
gtctgtcatggagtca

SEQ ID NO: 512966 - DNA, 16 bp, R. norvegicus
gtctgtccatctgtcc

SEQ ID NO: 512967 - DNA, 16 bp, R. norvegicus
gtctgtccatctgtct

SEQ ID NO: 512968 - DNA, 16 bp, R. norvegicus
gtctgtctctgttttg

SEQ ID NO: 512969 - DNA, 16 bp, R. norvegicus
gtctgtctgtctacag

SEQ ID NO: 512970 - DNA, 16 bp, R. norvegicus
gtctgtctgtctccct

SEQ ID NO: 512971 - DNA, 16 bp, R. norvegicus
gtctgtctgtctctgc

SEQ ID NO: 512972 - DNA, 16 bp, R. norvegicus
gtctgtctgtctgtcc

SEQ ID NO: 512973 - DNA, 16 bp, R. norvegicus
gtctgtctgtctttct

SEQ ID NO: 512974 - DNA, 16 bp, R. norvegicus
gtctgtcttctgtgct

SEQ ID NO: 512975 - DNA, 16 bp, R. norvegicus
gtctgtcttgtggaca

SEQ ID NO: 512976 - DNA, 16 bp, R. norvegicus
gtctgtctttctgcct

SEQ ID NO: 512977 - DNA, 16 bp, R. norvegicus
gtctgtctttgccact

SEQ ID NO: 512978 - DNA, 18 bp, R. norvegicus
gtctgtgcagaaaagtgg

SEQ ID NO: 512979 - DNA, 16 bp, R. norvegicus
gtctgtgcatgcatgt

SEQ ID NO: 512980 - DNA, 16 bp, R. norvegicus
gtctgtgcgtgtgtgc

SEQ ID NO: 512981 - DNA, 16 bp, R. norvegicus
gtctgtgctgctgcct

SEQ ID NO: 512982 - DNA, 16 bp, R. norvegicus
gtctgtgctgtgtgtg

SEQ ID NO: 512983 - DNA, 16 bp, R. norvegicus
gtctgtgcttacaaag

SEQ ID NO: 512984 - DNA, 16 bp, R. norvegicus
gtctgtggagtgtatc

SEQ ID NO: 512985 - DNA, 16 bp, R. norvegicus
gtctgtggggtcagat

SEQ ID NO: 512986 - DNA, 16 bp, R. norvegicus
gtctgtgtctatgtgt

SEQ ID NO: 512987 - DNA, 16 bp, R. norvegicus
gtctgtgtctgtgtgg

SEQ ID NO: 512988 - DNA, 18 bp, R. norvegicus
gtctgtgtggtggaaagt

SEQ ID NO: 512989 - DNA, 16 bp, R. norvegicus
gtctgtgtgtcaggag

SEQ ID NO: 512990 - DNA, 16 bp, R. norvegicus
gtctgtgtgtgcacag

SEQ ID NO: 512991 - DNA, 16 bp, R. norvegicus
gtctgtgtgtggtatg

SEQ ID NO: 512992 - DNA, 16 bp, R. norvegicus
gtctgtttccttcagt

SEQ ID NO: 512993 - DNA, 18 bp, R. norvegicus
gtctgtttccttctggtt

SEQ ID NO: 512994 - DNA, 16 bp, R. norvegicus
gtcttaaattctgttc

SEQ ID NO: 512995 - DNA, 16 bp, R. norvegicus
gtcttacctccctctc

SEQ ID NO: 512996 - DNA, 16 bp, R. norvegicus
gtcttagtcaggtttc

SEQ ID NO: 512997 - DNA, 16 bp, R. norvegicus
gtcttatgttttcaaa

SEQ ID NO: 512998 - DNA, 16 bp, R. norvegicus
gtcttcaataacaaaa

SEQ ID NO: 512999 - DNA, 16 bp, R. norvegicus
gtcttcacacacacca

SEQ ID NO: 513000 - DNA, 16 bp, R. norvegicus
gtcttcacagtgagtt

SEQ ID NO: 513001 - DNA, 16 bp, R. norvegicus
gtcttcacctatgtct

SEQ ID NO: 513002 - DNA, 16 bp, R. norvegicus
gtcttcactctgttct

SEQ ID NO: 513003 - DNA, 16 bp, R. norvegicus
gtcttcagaacaagat

SEQ ID NO: 513004 - DNA, 16 bp, R. norvegicus
gtcttcagaagagcag

SEQ ID NO: 513005 - DNA, 16 bp, R. norvegicus
gtcttcagaggagcag

SEQ ID NO: 513006 - DNA, 16 bp, R. norvegicus
gtcttcagcaacagag

SEQ ID NO: 513007 - DNA, 16 bp, R. norvegicus
gtcttcagccacacca

SEQ ID NO: 513008 - DNA, 24 bp, R. norvegicus
gtcttcagctgttcctgtgggccc

SEQ ID NO: 513009 - DNA, 46 bp, R. norvegicus
gtcttcagctgttcttgtgggcctgtgtcttgagttcaccaggcag

SEQ ID NO: 513010 - DNA, 16 bp, R. norvegicus
gtcttcagtcacacca

SEQ ID NO: 513011 - DNA, 16 bp, R. norvegicus
gtcttcagtctatgtt

SEQ ID NO: 513012 - DNA, 16 bp, R. norvegicus
gtcttcatcccaggga

SEQ ID NO: 513013 - DNA, 16 bp, R. norvegicus
gtcttccaaaagaagg

SEQ ID NO: 513014 - DNA, 16 bp, R. norvegicus
gtcttccacattcctc

SEQ ID NO: 513015 - DNA, 16 bp, R. norvegicus
gtcttccccagggaag

SEQ ID NO: 513016 - DNA, 16 bp, R. norvegicus
gtcttcctctctgaag

SEQ ID NO: 513017 - DNA, 16 bp, R. norvegicus
gtcttcctcttagcac

SEQ ID NO: 513018 - DNA, 16 bp, R. norvegicus
gtcttcctgcttcaaa

SEQ ID NO: 513019 - DNA, 16 bp, R. norvegicus
gtcttccttcttccag

SEQ ID NO: 513020 - DNA, 16 bp, R. norvegicus
gtcttccttgctggtc

SEQ ID NO: 513021 - DNA, 74 bp, R. norvegicus
gtcttctatacctattatccttaggtttgatcttctcattgagtcctggatttcctgtatgttttggaccagta

SEQ ID NO: 513022 - DNA, 16 bp, R. norvegicus
gtcttctatattccta

SEQ ID NO: 513023 - DNA, 16 bp, R. norvegicus
gtcttctcactgtgtc

SEQ ID NO: 513024 - DNA, 16 bp, R. norvegicus
gtcttctctcactgag

SEQ ID NO: 513025 - DNA, 16 bp, R. norvegicus
gtcttctctggtttcc

SEQ ID NO: 513026 - DNA, 16 bp, R. norvegicus
gtcttctgcaaaagca

SEQ ID NO: 513027 - DNA, 16 bp, R. norvegicus
gtcttctgccctccac

SEQ ID NO: 513028 - DNA, 16 bp, R. norvegicus
gtcttctgctgcaact

SEQ ID NO: 513029 - DNA, 16 bp, R. norvegicus
gtcttctggacatgac

SEQ ID NO: 513030 - DNA, 16 bp, R. norvegicus
gtcttctgggaatgta

SEQ ID NO: 513031 - DNA, 16 bp, R. norvegicus
gtcttctggtttccca

SEQ ID NO: 513032 - DNA, 16 bp, R. norvegicus
gtcttcttcaatgtct

SEQ ID NO: 513033 - DNA, 16 bp, R. norvegicus
gtcttgaaaaaaaaaa

SEQ ID NO: 513034 - DNA, 16 bp, R. norvegicus
gtcttgaattcagaga

SEQ ID NO: 513035 - DNA, 16 bp, R. norvegicus
gtcttgagaaaacaaa

SEQ ID NO: 513036 - DNA, 16 bp, R. norvegicus
gtcttgagcaccttca

SEQ ID NO: 513037 - DNA, 16 bp, R. norvegicus
gtcttgctgtctctaa

SEQ ID NO: 513038 - DNA, 16 bp, R. norvegicus
gtcttgctgtctgtga

SEQ ID NO: 513039 - DNA, 16 bp, R. norvegicus
gtcttgcttttaacta

SEQ ID NO: 513040 - DNA, 16 bp, R. norvegicus
gtcttggtttccattg

SEQ ID NO: 513041 - DNA, 16 bp, R. norvegicus
gtcttgtctccatttc

SEQ ID NO: 513042 - DNA, 16 bp, R. norvegicus
gtcttgtggaagagct

SEQ ID NO: 513043 - DNA, 16 bp, R. norvegicus
gtcttgtggcagaatg

SEQ ID NO: 513044 - DNA, 16 bp, R. norvegicus
gtcttgttggaggagg

SEQ ID NO: 513045 - DNA, 16 bp, R. norvegicus
gtctttattattatta

SEQ ID NO: 513046 - DNA, 16 bp, R. norvegicus
gtctttattggtaaaa

SEQ ID NO: 513047 - DNA, 16 bp, R. norvegicus
gtctttcagaaggcag

SEQ ID NO: 513048 - DNA, 16 bp, R. norvegicus
gtctttcctgcctact

SEQ ID NO: 513049 - DNA, 16 bp, R. norvegicus
gtctttctgctggtgg

SEQ ID NO: 513050 - DNA, 16 bp, R. norvegicus
gtctttgaagaaagaa

SEQ ID NO: 513051 - DNA, 16 bp, R. norvegicus
gtctttgtcactgaag

SEQ ID NO: 513052 - DNA, 16 bp, R. norvegicus
gtctttgtgtctctgt

SEQ ID NO: 513053 - DNA, 16 bp, R. norvegicus
gtctttgtgtgtctct

SEQ ID NO: 513054 - DNA, 16 bp, R. norvegicus
gtcttttgttttagga

SEQ ID NO: 513055 - DNA, 16 bp, R. norvegicus
gtgaaaacaccaaacg

SEQ ID NO: 513056 - DNA, 16 bp, R. norvegicus
gtgaaaactatattca

SEQ ID NO: 513057 - DNA, 16 bp, R. norvegicus
gtgaaaatggacatct

SEQ ID NO: 513058 - DNA, 16 bp, R. norvegicus
gtgaaagaattgaaaa

SEQ ID NO: 513059 - DNA, 16 bp, R. norvegicus
gtgaaagagctgtatg

SEQ ID NO: 513060 - DNA, 16 bp, R. norvegicus
gtgaaagctgtgctaa

SEQ ID NO: 513061 - DNA, 16 bp, R. norvegicus
gtgaaatcttctggga

SEQ ID NO: 513062 - DNA, 16 bp, R. norvegicus
gtgaacacacacatgc

SEQ ID NO: 513063 - DNA, 16 bp, R. norvegicus
gtgaacacagcctcca

SEQ ID NO: 513064 - DNA, 16 bp, R. norvegicus
gtgaacagtcaccatg

SEQ ID NO: 513065 - DNA, 16 bp, R. norvegicus
gtgaactcgggacaca

SEQ ID NO: 513066 - DNA, 16 bp, R. norvegicus
gtgaagaatccttcat

SEQ ID NO: 513067 - DNA, 16 bp, R. norvegicus
gtgaagaatgtgtctg

SEQ ID NO: 513068 - DNA, 16 bp, R. norvegicus
gtgaagaattgcattg

SEQ ID NO: 513069 - DNA, 16 bp, R. norvegicus
gtgaagaattgtgctg

SEQ ID NO: 513070 - DNA, 16 bp, R. norvegicus
gtgaagatctgcagtt

SEQ ID NO: 513071 - DNA, 16 bp, R. norvegicus
gtgaagatgtagagct

SEQ ID NO: 513072 - DNA, 16 bp, R. norvegicus
gtgaagcatctgcatt

SEQ ID NO: 513073 - DNA, 16 bp, R. norvegicus
gtgaagcctcaggcca

SEQ ID NO: 513074 - DNA, 16 bp, R. norvegicus
gtgaagctaacagaag

SEQ ID NO: 513075 - DNA, 16 bp, R. norvegicus
gtgaagctgttctcca

SEQ ID NO: 513076 - DNA, 16 bp, R. norvegicus
gtgaaggagctgagag

SEQ ID NO: 513077 - DNA, 16 bp, R. norvegicus
gtgaaggccttctctg

SEQ ID NO: 513078 - DNA, 16 bp, R. norvegicus
gtgaaggctgagccca

SEQ ID NO: 513079 - DNA, 16 bp, R. norvegicus
gtgaaggtgcttgctg

SEQ ID NO: 513080 - DNA, 18 bp, R. norvegicus
gtgaagtttccagagcct

SEQ ID NO: 513081 - DNA, 16 bp, R. norvegicus
gtgaatatatatatat

SEQ ID NO: 513082 - DNA, 16 bp, R. norvegicus
gtgaatgacagcagca

SEQ ID NO: 513083 - DNA, 16 bp, R. norvegicus
gtgaatgtgactgttg

SEQ ID NO: 513084 - DNA, 16 bp, R. norvegicus
gtgaattcaaagtcac

SEQ ID NO: 513085 - DNA, 16 bp, R. norvegicus
gtgaattcagcaggtt

SEQ ID NO: 513086 - DNA, 16 bp, R. norvegicus
gtgaattcagttaatt

SEQ ID NO: 513087 - DNA, 16 bp, R. norvegicus
gtgaattccaagacag

SEQ ID NO: 513088 - DNA, 16 bp, R. norvegicus
gtgaattctttgttaa

SEQ ID NO: 513089 - DNA, 16 bp, R. norvegicus
gtgaattttacatcat

SEQ ID NO: 513090 - DNA, 16 bp, R. norvegicus
gtgacaaaaactgtat

SEQ ID NO: 513091 - DNA, 16 bp, R. norvegicus
gtgacaaaggagacag

SEQ ID NO: 513092 - DNA, 16 bp, R. norvegicus
gtgacaaatatgaatc

SEQ ID NO: 513093 - DNA, 16 bp, R. norvegicus
gtgacagaagctctca

SEQ ID NO: 513094 - DNA, 16 bp, R. norvegicus
gtgacagaggtgacag

SEQ ID NO: 513095 - DNA, 16 bp, R. norvegicus
gtgacagcagatggtg

SEQ ID NO: 513096 - DNA, 16 bp, R. norvegicus
gtgacagccagaagct

SEQ ID NO: 513097 - DNA, 16 bp, R. norvegicus
gtgacagtaaatgctg

SEQ ID NO: 513098 - DNA, 16 bp, R. norvegicus
gtgacatacctcctct

SEQ ID NO: 513099 - DNA, 16 bp, R. norvegicus
gtgaccacagaggcca

SEQ ID NO: 513100 - DNA, 16 bp, R. norvegicus
gtgaccatgagggtgg

SEQ ID NO: 513101 - DNA, 16 bp, R. norvegicus
gtgaccccagaagttc

SEQ ID NO: 513102 - DNA, 16 bp, R. norvegicus
gtgacccctgtgaaag

SEQ ID NO: 513103 - DNA, 16 bp, R. norvegicus
gtgacccctgtgaagg

SEQ ID NO: 513104 - DNA, 16 bp, R. norvegicus
gtgaccctgcagcagc

SEQ ID NO: 513105 - DNA, 17 bp, R. norvegicus
gtgacctgctcaccaaa

SEQ ID NO: 513106 - DNA, 16 bp, R. norvegicus
gtgacctgcttggtgg

SEQ ID NO: 513107 - DNA, 16 bp, R. norvegicus
gtgacctgggctggca

SEQ ID NO: 513108 - DNA, 16 bp, R. norvegicus
gtgacctggttggagg

SEQ ID NO: 513109 - DNA, 16 bp, R. norvegicus
gtgacctgtgtgtgtg

SEQ ID NO: 513110 - DNA, 16 bp, R. norvegicus
gtgaccttgggaaagt

SEQ ID NO: 513111 - DNA, 16 bp, R. norvegicus
gtgaccttgggcaagt

SEQ ID NO: 513112 - DNA, 16 bp, R. norvegicus
gtgactcacaaccatg

SEQ ID NO: 513113 - DNA, 16 bp, R. norvegicus
gtgactcagaaagctg

SEQ ID NO: 513114 - DNA, 16 bp, R. norvegicus
gtgactccagttctag

SEQ ID NO: 513115 - DNA, 16 bp, R. norvegicus
gtgactctagccaagc

SEQ ID NO: 513116 - DNA, 16 bp, R. norvegicus
gtgactctgactctga

SEQ ID NO: 513117 - DNA, 18 bp, R. norvegicus
gtgactgcaggccagaag

SEQ ID NO: 513118 - DNA, 16 bp, R. norvegicus
gtgactgtgactgtgg

SEQ ID NO: 513119 - DNA, 16 bp, R. norvegicus
gtgactgtgagtgtgt

SEQ ID NO: 513120 - DNA, 16 bp, R. norvegicus
gtgactgttcacagca

SEQ ID NO: 513121 - DNA, 16 bp, R. norvegicus
gtgacttccaggccag

SEQ ID NO: 513122 - DNA, 16 bp, R. norvegicus
gtgacttccctggcct

SEQ ID NO: 513123 - DNA, 16 bp, R. norvegicus
gtgacttgaatgagaa

SEQ ID NO: 513124 - DNA, 16 bp, R. norvegicus
gtgactttcaccaagc

SEQ ID NO: 513125 - DNA, 16 bp, R. norvegicus
gtgagaaactctcagg

SEQ ID NO: 513126 - DNA, 16 bp, R. norvegicus
gtgagaaaggggacag

SEQ ID NO: 513127 - DNA, 16 bp, R. norvegicus
gtgagaacaaagcaga

SEQ ID NO: 513128 - DNA, 16 bp, R. norvegicus
gtgagaaggctcagca

SEQ ID NO: 513129 - DNA, 16 bp, R. norvegicus
gtgagaagtctgttgt

SEQ ID NO: 513130 - DNA, 16 bp, R. norvegicus
gtgagaatgtagagaa

SEQ ID NO: 513131 - DNA, 16 bp, R. norvegicus
gtgagaatgtggagaa

SEQ ID NO: 513132 - DNA, 16 bp, R. norvegicus
gtgagacaccatgtga

SEQ ID NO: 513133 - DNA, 16 bp, R. norvegicus
gtgagacagagacaga

SEQ ID NO: 513134 - DNA, 16 bp, R. norvegicus
gtgagacagctcagca

SEQ ID NO: 513135 - DNA, 16 bp, R. norvegicus
gtgagacagctcagtg

SEQ ID NO: 513136 - DNA, 16 bp, R. norvegicus
gtgagacagggtttct

SEQ ID NO: 513137 - DNA, 16 bp, R. norvegicus
gtgagacattgtctca

SEQ ID NO: 513138 - DNA, 16 bp, R. norvegicus
gtgagaccctgtctga

SEQ ID NO: 513139 - DNA, 16 bp, R. norvegicus
gtgagagacactgtct

SEQ ID NO: 513140 - DNA, 16 bp, R. norvegicus
gtgagagaccctcagg

SEQ ID NO: 513141 - DNA, 16 bp, R. norvegicus
gtgagagaccttatct

SEQ ID NO: 513142 - DNA, 16 bp, R. norvegicus
gtgagagagagaacca

SEQ ID NO: 513143 - DNA, 16 bp, R. norvegicus
gtgagagagcatgaga

SEQ ID NO: 513144 - DNA, 16 bp, R. norvegicus
gtgagaggttcccagg

SEQ ID NO: 513145 - DNA, 16 bp, R. norvegicus
gtgagagtgggagcat

SEQ ID NO: 513146 - DNA, 16 bp, R. norvegicus
gtgagcaccaggcaca

SEQ ID NO: 513147 - DNA, 16 bp, R. norvegicus
gtgagcagaagtggag

SEQ ID NO: 513148 - DNA, 16 bp, R. norvegicus
gtgagcagcagtgaca

SEQ ID NO: 513149 - DNA, 16 bp, R. norvegicus
gtgagcaggggtgtga

SEQ ID NO: 513150 - DNA, 16 bp, R. norvegicus
gtgagcatcaccacag

SEQ ID NO: 513151 - DNA, 16 bp, R. norvegicus
gtgagccagtaagcag

SEQ ID NO: 513152 - DNA, 16 bp, R. norvegicus
gtgagcctctatgagc

SEQ ID NO: 513153 - DNA, 16 bp, R. norvegicus
gtgagcctgaggccag

SEQ ID NO: 513154 - DNA, 16 bp, R. norvegicus
gtgagcctgggctaca

SEQ ID NO: 513155 - DNA, 18 bp, R. norvegicus
gtgagcgctccttgtagt

SEQ ID NO: 513156 - DNA, 16 bp, R. norvegicus
gtgagctcactcagga

SEQ ID NO: 513157 - DNA, 16 bp, R. norvegicus
gtgagctccaagccag

SEQ ID NO: 513158 - DNA, 16 bp, R. norvegicus
gtgagctgccgtgtgg

SEQ ID NO: 513159 - DNA, 16 bp, R. norvegicus
gtgagctgtgggcagg

SEQ ID NO: 513160 - DNA, 16 bp, R. norvegicus
gtgaggaagaagagtg

SEQ ID NO: 513161 - DNA, 16 bp, R. norvegicus
gtgaggagctggagag

SEQ ID NO: 513162 - DNA, 16 bp, R. norvegicus
gtgaggaggaactggg

SEQ ID NO: 513163 - DNA, 16 bp, R. norvegicus
gtgaggaggacattgt

SEQ ID NO: 513164 - DNA, 16 bp, R. norvegicus
gtgaggagggaggctg

SEQ ID NO: 513165 - DNA, 16 bp, R. norvegicus
gtgaggcagctggtca

SEQ ID NO: 513166 - DNA, 16 bp, R. norvegicus
gtgagggagcaccctc

SEQ ID NO: 513167 - DNA, 16 bp, R. norvegicus
gtgagggatggctgtg

SEQ ID NO: 513168 - DNA, 16 bp, R. norvegicus
gtgaggtagagagaga

SEQ ID NO: 513169 - DNA, 16 bp, R. norvegicus
gtgaggtgtgtgtgaa

SEQ ID NO: 513170 - DNA, 16 bp, R. norvegicus
gtgaggttgtggagaa

SEQ ID NO: 513171 - DNA, 16 bp, R. norvegicus
gtgagtaaggacagtg

SEQ ID NO: 513172 - DNA, 16 bp, R. norvegicus
gtgagtacaaggccag

SEQ ID NO: 513173 - DNA, 16 bp, R. norvegicus
gtgagtcaggctctga

SEQ ID NO: 513174 - DNA, 16 bp, R. norvegicus
gtgagtccgaggccag

SEQ ID NO: 513175 - DNA, 16 bp, R. norvegicus
gtgagtctgaagacag

SEQ ID NO: 513176 - DNA, 16 bp, R. norvegicus
gtgagtgagtgtgtgt

SEQ ID NO: 513177 - DNA, 16 bp, R. norvegicus
gtgagtgctgagaacc

SEQ ID NO: 513178 - DNA, 18 bp, R. norvegicus
gtgagtgtcccatgcatt

SEQ ID NO: 513179 - DNA, 16 bp, R. norvegicus
gtgagttaactcagac

SEQ ID NO: 513180 - DNA, 16 bp, R. norvegicus
gtgagttcaagaccag

SEQ ID NO: 513181 - DNA, 16 bp, R. norvegicus
gtgagttcaaggccag

SEQ ID NO: 513182 - DNA, 16 bp, R. norvegicus
gtgagttcaaggctgg

SEQ ID NO: 513183 - DNA, 16 bp, R. norvegicus
gtgagttcaggccagc

SEQ ID NO: 513184 - DNA, 16 bp, R. norvegicus
gtgagttccagggcaa

SEQ ID NO: 513185 - DNA, 16 bp, R. norvegicus
gtgagttcgaggccag

SEQ ID NO: 513186 - DNA, 16 bp, R. norvegicus
gtgagttctaggccag

SEQ ID NO: 513187 - DNA, 16 bp, R. norvegicus
gtgagtttccttctag

SEQ ID NO: 513188 - DNA, 16 bp, R. norvegicus
gtgagtttgaagtcag

SEQ ID NO: 513189 - DNA, 16 bp, R. norvegicus
gtgagtttgaggccag

SEQ ID NO: 513190 - DNA, 16 bp, R. norvegicus
gtgagtttgaggtcag

SEQ ID NO: 513191 - DNA, 16 bp, R. norvegicus
gtgataaatgccatga

SEQ ID NO: 513192 - DNA, 16 bp, R. norvegicus
gtgatacagaccctaa

SEQ ID NO: 513193 - DNA, 16 bp, R. norvegicus
gtgatagaaactgcat

SEQ ID NO: 513194 - DNA, 16 bp, R. norvegicus
gtgatagagaaagaca

SEQ ID NO: 513195 - DNA, 16 bp, R. norvegicus
gtgatatcattaaaat

SEQ ID NO: 513196 - DNA, 16 bp, R. norvegicus
gtgatatttttacttt

SEQ ID NO: 513197 - DNA, 16 bp, R. norvegicus
gtgatcaagtggggag

SEQ ID NO: 513198 - DNA, 16 bp, R. norvegicus
gtgatcaccaagaaca

SEQ ID NO: 513199 - DNA, 16 bp, R. norvegicus
gtgatcaggatgtaaa

SEQ ID NO: 513200 - DNA, 16 bp, R. norvegicus
gtgatgaggacagtga

SEQ ID NO: 513201 - DNA, 17 bp, R. norvegicus
gtgatgatgatgatgac

SEQ ID NO: 513202 - DNA, 16 bp, R. norvegicus
gtgatgatgatgatgg

SEQ ID NO: 513203 - DNA, 16 bp, R. norvegicus
gtgatgatgatggtga

SEQ ID NO: 513204 - DNA, 19 bp, R. norvegicus
gtgatgatgtacccctggt

SEQ ID NO: 513205 - DNA, 16 bp, R. norvegicus
gtgatggactgggtgt

SEQ ID NO: 513206 - DNA, 16 bp, R. norvegicus
gtgatggagatgatgg

SEQ ID NO: 513207 - DNA, 16 bp, R. norvegicus
gtgatggcagatgctg

SEQ ID NO: 513208 - DNA, 16 bp, R. norvegicus
gtgatggtgacagtga

SEQ ID NO: 513209 - DNA, 16 bp, R. norvegicus
gtgatgtacttcctct

SEQ ID NO: 513210 - DNA, 16 bp, R. norvegicus
gtgatgtatgtggtgt

SEQ ID NO: 513211 - DNA, 16 bp, R. norvegicus
gtgatgtcatcacctg

SEQ ID NO: 513212 - DNA, 16 bp, R. norvegicus
gtgatgtctgtgtgtg

SEQ ID NO: 513213 - DNA, 16 bp, R. norvegicus
gtgattattgctttcc

SEQ ID NO: 513214 - DNA, 37 bp, R. norvegicus
gtgattccccctgaagtccttttattgttgaggatag

SEQ ID NO: 513215 - DNA, 16 bp, R. norvegicus
gtgattcctccagaag

SEQ ID NO: 513216 - DNA, 16 bp, R. norvegicus
gtgattctcttgcctc

SEQ ID NO: 513217 - DNA, 16 bp, R. norvegicus
gtgattctgccagaag

SEQ ID NO: 513218 - DNA, 16 bp, R. norvegicus
gtgattgcccctgaag

SEQ ID NO: 513219 - DNA, 16 bp, R. norvegicus
gtgattgctgggaatt

SEQ ID NO: 513220 - DNA, 16 bp, R. norvegicus
gtgatttccaggacag

SEQ ID NO: 513221 - DNA, 16 bp, R. norvegicus
gtgatttccaggatag

SEQ ID NO: 513222 - DNA, 16 bp, R. norvegicus
gtgatttgaatgagat

SEQ ID NO: 513223 - DNA, 16 bp, R. norvegicus
gtgcaacacttgtggg

SEQ ID NO: 513224 - DNA, 16 bp, R. norvegicus
gtgcaagcagacatgg

SEQ ID NO: 513225 - DNA, 16 bp, R. norvegicus
gtgcaaggagctgttt

SEQ ID NO: 513226 - DNA, 16 bp, R. norvegicus
gtgcaaggccctgtgt

SEQ ID NO: 513227 - DNA, 16 bp, R. norvegicus
gtgcaagggaatgtca

SEQ ID NO: 513228 - DNA, 16 bp, R. norvegicus
gtgcaatgtgtgcctt

SEQ ID NO: 513229 - DNA, 16 bp, R. norvegicus
gtgcacacacacacac

SEQ ID NO: 513230 - DNA, 16 bp, R. norvegicus
gtgcacacatgtgtat

SEQ ID NO: 513231 - DNA, 16 bp, R. norvegicus
gtgcacaccaagtgtg

SEQ ID NO: 513232 - DNA, 16 bp, R. norvegicus
gtgcacagatgtacat

SEQ ID NO: 513233 - DNA, 16 bp, R. norvegicus
gtgcacagggacctga

SEQ ID NO: 513234 - DNA, 16 bp, R. norvegicus
gtgcacatctgcaatc

SEQ ID NO: 513235 - DNA, 16 bp, R. norvegicus
gtgcacatgcacgcac

SEQ ID NO: 513236 - DNA, 16 bp, R. norvegicus
gtgcacattcacacac

SEQ ID NO: 513237 - DNA, 16 bp, R. norvegicus
gtgcaccacatgcata

SEQ ID NO: 513238 - DNA, 16 bp, R. norvegicus
gtgcaccacatgtgtg

SEQ ID NO: 513239 - DNA, 16 bp, R. norvegicus
gtgcaccaccatgtcc

SEQ ID NO: 513240 - DNA, 16 bp, R. norvegicus
gtgcactcaggaggca

SEQ ID NO: 513241 - DNA, 16 bp, R. norvegicus
gtgcagaattatatca

SEQ ID NO: 513242 - DNA, 16 bp, R. norvegicus
gtgcagaattcaatca

SEQ ID NO: 513243 - DNA, 16 bp, R. norvegicus
gtgcagacaggcttgg

SEQ ID NO: 513244 - DNA, 16 bp, R. norvegicus
gtgcagactcactgac

SEQ ID NO: 513245 - DNA, 16 bp, R. norvegicus
gtgcagagacagacag

SEQ ID NO: 513246 - DNA, 16 bp, R. norvegicus
gtgcagagagcagttt

SEQ ID NO: 513247 - DNA, 16 bp, R. norvegicus
gtgcagagccagtgcc

SEQ ID NO: 513248 - DNA, 16 bp, R. norvegicus
gtgcagagggtacctg

SEQ ID NO: 513249 - DNA, 16 bp, R. norvegicus
gtgcagaggtcatgga

SEQ ID NO: 513250 - DNA, 16 bp, R. norvegicus
gtgcaggaagtgagct

SEQ ID NO: 513251 - DNA, 16 bp, R. norvegicus
gtgcaggagacagagg

SEQ ID NO: 513252 - DNA, 16 bp, R. norvegicus
gtgcaggaggagctgg

SEQ ID NO: 513253 - DNA, 16 bp, R. norvegicus
gtgcaggcacacatgc

SEQ ID NO: 513254 - DNA, 16 bp, R. norvegicus
gtgcagggcgagctac

SEQ ID NO: 513255 - DNA, 16 bp, R. norvegicus
gtgcaggggaatatga

SEQ ID NO: 513256 - DNA, 16 bp, R. norvegicus
gtgcaggtgcacacac

SEQ ID NO: 513257 - DNA, 16 bp, R. norvegicus
gtgcaggtgcctgtgg

SEQ ID NO: 513258 - DNA, 16 bp, R. norvegicus
gtgcaggtgtgcaggg

SEQ ID NO: 513259 - DNA, 16 bp, R. norvegicus
gtgcaggtgtgtatgt

SEQ ID NO: 513260 - DNA, 16 bp, R. norvegicus
gtgcagtggaagccag

SEQ ID NO: 513261 - DNA, 16 bp, R. norvegicus
gtgcagttggagccca

SEQ ID NO: 513262 - DNA, 16 bp, R. norvegicus
gtgcatatggtgtgtg

SEQ ID NO: 513263 - DNA, 16 bp, R. norvegicus
gtgcatatgtatgtgg

SEQ ID NO: 513264 - DNA, 16 bp, R. norvegicus
gtgcatgaagacagtg

SEQ ID NO: 513265 - DNA, 16 bp, R. norvegicus
gtgcatgcacacgtgc

SEQ ID NO: 513266 - DNA, 16 bp, R. norvegicus
gtgcatgcatgtgcac

SEQ ID NO: 513267 - DNA, 16 bp, R. norvegicus
gtgcatgctaggcaag

SEQ ID NO: 513268 - DNA, 16 bp, R. norvegicus
gtgcatgctgcctcag

SEQ ID NO: 513269 - DNA, 16 bp, R. norvegicus
gtgcatgtatgtgcgt

SEQ ID NO: 513270 - DNA, 16 bp, R. norvegicus
gtgcatgtggaggcca

SEQ ID NO: 513271 - DNA, 16 bp, R. norvegicus
gtgcatgtgtgtggag

SEQ ID NO: 513272 - DNA, 16 bp, R. norvegicus
gtgcatgtgtgtttgc

SEQ ID NO: 513273 - DNA, 16 bp, R. norvegicus
gtgcatgtgttcctgt

SEQ ID NO: 513274 - DNA, 16 bp, R. norvegicus
gtgcattcccagcctc

SEQ ID NO: 513275 - DNA, 16 bp, R. norvegicus
gtgcattcccagtctc

SEQ ID NO: 513276 - DNA, 16 bp, R. norvegicus
gtgcattgtgtgtgtg

SEQ ID NO: 513277 - DNA, 16 bp, R. norvegicus
gtgcatttggtggttt

SEQ ID NO: 513278 - DNA, 16 bp, R. norvegicus
gtgccaaggaccagcc

SEQ ID NO: 513279 - DNA, 16 bp, R. norvegicus
gtgccacagaggccag

SEQ ID NO: 513280 - DNA, 16 bp, R. norvegicus
gtgccaccaagcccag

SEQ ID NO: 513281 - DNA, 16 bp, R. norvegicus
gtgccaccacatctgg

SEQ ID NO: 513282 - DNA, 16 bp, R. norvegicus
gtgccaccactgccag

SEQ ID NO: 513283 - DNA, 16 bp, R. norvegicus
gtgccaccagctggga

SEQ ID NO: 513284 - DNA, 16 bp, R. norvegicus
gtgccaccatcaccca

SEQ ID NO: 513285 - DNA, 16 bp, R. norvegicus
gtgccaccatgcctga

SEQ ID NO: 513286 - DNA, 16 bp, R. norvegicus
gtgccactccatgggc

SEQ ID NO: 513287 - DNA, 16 bp, R. norvegicus
gtgccactccctgggc

SEQ ID NO: 513288 - DNA, 16 bp, R. norvegicus
gtgccactgtgcctgg

SEQ ID NO: 513289 - DNA, 16 bp, R. norvegicus
gtgccacttcctggac

SEQ ID NO: 513290 - DNA, 16 bp, R. norvegicus
gtgccagcactcctgg

SEQ ID NO: 513291 - DNA, 16 bp, R. norvegicus
gtgccaggattacagg

SEQ ID NO: 513292 - DNA, 16 bp, R. norvegicus
gtgccagggtgggagg

SEQ ID NO: 513293 - DNA, 16 bp, R. norvegicus
gtgccatcccctgggc

SEQ ID NO: 513294 - DNA, 16 bp, R. norvegicus
gtgccatccctgagca

SEQ ID NO: 513295 - DNA, 16 bp, R. norvegicus
gtgccatccctggact

SEQ ID NO: 513296 - DNA, 16 bp, R. norvegicus
gtgccatgcttcctgc

SEQ ID NO: 513297 - DNA, 16 bp, R. norvegicus
gtgccatgtgtgtttt

SEQ ID NO: 513298 - DNA, 16 bp, R. norvegicus
gtgcccacagagacca

SEQ ID NO: 513299 - DNA, 16 bp, R. norvegicus
gtgcccacccctgccc

SEQ ID NO: 513300 - DNA, 16 bp, R. norvegicus
gtgcccagagggcaca

SEQ ID NO: 513301 - DNA, 16 bp, R. norvegicus
gtgcccaggaggcaga

SEQ ID NO: 513302 - DNA, 16 bp, R. norvegicus
gtgccccaagatatct

SEQ ID NO: 513303 - DNA, 16 bp, R. norvegicus
gtgccccaagatgtct

SEQ ID NO: 513304 - DNA, 16 bp, R. norvegicus
gtgccccctgggcaca

SEQ ID NO: 513305 - DNA, 16 bp, R. norvegicus
gtgcccttacccaagg

SEQ ID NO: 513306 - DNA, 16 bp, R. norvegicus
gtgcccttggaggaag

SEQ ID NO: 513307 - DNA, 16 bp, R. norvegicus
gtgcccttggatttgg

SEQ ID NO: 513308 - DNA, 16 bp, R. norvegicus
gtgcctcccacagtgg

SEQ ID NO: 513309 - DNA, 16 bp, R. norvegicus
gtgcctcctcctgcca

SEQ ID NO: 513310 - DNA, 16 bp, R. norvegicus
gtgcctctttcccaga

SEQ ID NO: 513311 - DNA, 16 bp, R. norvegicus
gtgcctgcagtcccag

SEQ ID NO: 513312 - DNA, 16 bp, R. norvegicus
gtgcctggagctgacc

SEQ ID NO: 513313 - DNA, 16 bp, R. norvegicus
gtgcctggatgctgcc

SEQ ID NO: 513314 - DNA, 16 bp, R. norvegicus
gtgcctgtgcctgtgc

SEQ ID NO: 513315 - DNA, 16 bp, R. norvegicus
gtgcctgtggaggtca

SEQ ID NO: 513316 - DNA, 16 bp, R. norvegicus
gtgcctgtggagtcca

SEQ ID NO: 513317 - DNA, 16 bp, R. norvegicus
gtgcctgtgtctgtgc

SEQ ID NO: 513318 - DNA, 16 bp, R. norvegicus
gtgccttcagaggcca

SEQ ID NO: 513319 - DNA, 16 bp, R. norvegicus
gtgccttcaggacctg

SEQ ID NO: 513320 - DNA, 16 bp, R. norvegicus
gtgccttgaagttctt

SEQ ID NO: 513321 - DNA, 16 bp, R. norvegicus
gtgcgcatgcgtgtgt

SEQ ID NO: 513322 - DNA, 16 bp, R. norvegicus
gtgcgccaccaccgcc

SEQ ID NO: 513323 - DNA, 16 bp, R. norvegicus
gtgcgcgcgtgtgcgc

SEQ ID NO: 513324 - DNA, 16 bp, R. norvegicus
gtgcgcgcgtgtgtgc

SEQ ID NO: 513325 - DNA, 16 bp, R. norvegicus
gtgcgcgcgtgtgtgt

SEQ ID NO: 513326 - DNA, 16 bp, R. norvegicus
gtgcggcagctggaga

SEQ ID NO: 513327 - DNA, 16 bp, R. norvegicus
gtgcggctgggctgtg

SEQ ID NO: 513328 - DNA, 16 bp, R. norvegicus
gtgcggtaatgggggg

SEQ ID NO: 513329 - DNA, 16 bp, R. norvegicus
gtgcgtgcatgtgcgt

SEQ ID NO: 513330 - DNA, 16 bp, R. norvegicus
gtgcgtgcatgtgtgt

SEQ ID NO: 513331 - DNA, 16 bp, R. norvegicus
gtgcgtgcatgtgttt

SEQ ID NO: 513332 - DNA, 16 bp, R. norvegicus
gtgcgtgcgtacgtgc

SEQ ID NO: 513333 - DNA, 16 bp, R. norvegicus
gtgcgtgtgtgtgaca

SEQ ID NO: 513334 - DNA, 16 bp, R. norvegicus
gtgctaggaactgaac

SEQ ID NO: 513335 - DNA, 16 bp, R. norvegicus
gtgctagggattgaac

SEQ ID NO: 513336 - DNA, 16 bp, R. norvegicus
gtgctcaagctccacc

SEQ ID NO: 513337 - DNA, 16 bp, R. norvegicus
gtgctcaaggaggcca

SEQ ID NO: 513338 - DNA, 16 bp, R. norvegicus
gtgctcaataaatgtt

SEQ ID NO: 513339 - DNA, 16 bp, R. norvegicus
gtgctcagtctgttcc

SEQ ID NO: 513340 - DNA, 16 bp, R. norvegicus
gtgctcagtgtcctca

SEQ ID NO: 513341 - DNA, 16 bp, R. norvegicus
gtgctcatggaggcca

SEQ ID NO: 513342 - DNA, 16 bp, R. norvegicus
gtgctccaagatatct

SEQ ID NO: 513343 - DNA, 16 bp, R. norvegicus
gtgctccaccctgtgt

SEQ ID NO: 513344 - DNA, 16 bp, R. norvegicus
gtgctcccagccacaa

SEQ ID NO: 513345 - DNA, 16 bp, R. norvegicus
gtgctcccccacccac

SEQ ID NO: 513346 - DNA, 18 bp, R. norvegicus
gtgctctactatgttcat

SEQ ID NO: 513347 - DNA, 16 bp, R. norvegicus
gtgctctcactaggat

SEQ ID NO: 513348 - DNA, 16 bp, R. norvegicus
gtgctctcttctggcc

SEQ ID NO: 513349 - DNA, 16 bp, R. norvegicus
gtgctctgaaccactg

SEQ ID NO: 513350 - DNA, 16 bp, R. norvegicus
gtgctctggagagctg

SEQ ID NO: 513351 - DNA, 16 bp, R. norvegicus
gtgctctgtgtgtgtg

SEQ ID NO: 513352 - DNA, 16 bp, R. norvegicus
gtgctcttaagctctg

SEQ ID NO: 513353 - DNA, 16 bp, R. norvegicus
gtgctcttgcagaaga

SEQ ID NO: 513354 - DNA, 16 bp, R. norvegicus
gtgctcttggctttct

SEQ ID NO: 513355 - DNA, 16 bp, R. norvegicus
gtgctcttgtatttgg

SEQ ID NO: 513356 - DNA, 16 bp, R. norvegicus
gtgctgacccccaacc

SEQ ID NO: 513357 - DNA, 16 bp, R. norvegicus
gtgctgagaaagttca

SEQ ID NO: 513358 - DNA, 16 bp, R. norvegicus
gtgctgagaagaagct

SEQ ID NO: 513359 - DNA, 16 bp, R. norvegicus
gtgctgagaagatggt

SEQ ID NO: 513360 - DNA, 16 bp, R. norvegicus
gtgctgagattacaga

SEQ ID NO: 513361 - DNA, 16 bp, R. norvegicus
gtgctgagattgcagg

SEQ ID NO: 513362 - DNA, 16 bp, R. norvegicus
gtgctgagcctgtgcc

SEQ ID NO: 513363 - DNA, 16 bp, R. norvegicus
gtgctgaggacaaaga

SEQ ID NO: 513364 - DNA, 16 bp, R. norvegicus
gtgctgaggcaagacc

SEQ ID NO: 513365 - DNA, 19 bp, R. norvegicus
gtgctgaggtggctgtgtg

SEQ ID NO: 513366 - DNA, 16 bp, R. norvegicus
gtgctgcagagacaga

SEQ ID NO: 513367 - DNA, 16 bp, R. norvegicus
gtgctgcagccagtga

SEQ ID NO: 513368 - DNA, 16 bp, R. norvegicus
gtgctgcagctggtga

SEQ ID NO: 513369 - DNA, 16 bp, R. norvegicus
gtgctgcagtttcttg

SEQ ID NO: 513370 - DNA, 16 bp, R. norvegicus
gtgctgccacacctgg

SEQ ID NO: 513371 - DNA, 16 bp, R. norvegicus
gtgctgcccaaatatt

SEQ ID NO: 513372 - DNA, 16 bp, R. norvegicus
gtgctgccctgggaga

SEQ ID NO: 513373 - DNA, 16 bp, R. norvegicus
gtgctgctgctggtgg

SEQ ID NO: 513374 - DNA, 16 bp, R. norvegicus
gtgctgctggtgctgc

SEQ ID NO: 513375 - DNA, 16 bp, R. norvegicus
gtgctggaaaacaaac

SEQ ID NO: 513376 - DNA, 16 bp, R. norvegicus
gtgctggagaagaagc

SEQ ID NO: 513377 - DNA, 16 bp, R. norvegicus
gtgctggagaaggaga

SEQ ID NO: 513378 - DNA, 16 bp, R. norvegicus
gtgctggagaaggagc

SEQ ID NO: 513379 - DNA, 16 bp, R. norvegicus
gtgctggagaaggagt

SEQ ID NO: 513380 - DNA, 16 bp, R. norvegicus
gtgctggagacagagc

SEQ ID NO: 513381 - DNA, 16 bp, R. norvegicus
gtgctggagagctcgc

SEQ ID NO: 513382 - DNA, 16 bp, R. norvegicus
gtgctggagagctggc

SEQ ID NO: 513383 - DNA, 16 bp, R. norvegicus
gtgctggagcagtggc

SEQ ID NO: 513384 - DNA, 16 bp, R. norvegicus
gtgctggaggaactga

SEQ ID NO: 513385 - DNA, 16 bp, R. norvegicus
gtgctggaggagctaa

SEQ ID NO: 513386 - DNA, 16 bp, R. norvegicus
gtgctggagtcacagg

SEQ ID NO: 513387 - DNA, 16 bp, R. norvegicus
gtgctggagttaaagg

SEQ ID NO: 513388 - DNA, 16 bp, R. norvegicus
gtgctggcactaaagg

SEQ ID NO: 513389 - DNA, 16 bp, R. norvegicus
gtgctggcattgcagg

SEQ ID NO: 513390 - DNA, 16 bp, R. norvegicus
gtgctggctgtcctgg

SEQ ID NO: 513391 - DNA, 16 bp, R. norvegicus
gtgctgggaacagagc

SEQ ID NO: 513392 - DNA, 16 bp, R. norvegicus
gtgctgggaatcaaac

SEQ ID NO: 513393 - DNA, 16 bp, R. norvegicus
gtgctgggacccaaac

SEQ ID NO: 513394 - DNA, 16 bp, R. norvegicus
gtgctgggactacaag

SEQ ID NO: 513395 - DNA, 16 bp, R. norvegicus
gtgctgggactgcagg

SEQ ID NO: 513396 - DNA, 16 bp, R. norvegicus
gtgctgggattcaagg

SEQ ID NO: 513397 - DNA, 16 bp, R. norvegicus
gtgctgggattgcagg

SEQ ID NO: 513398 - DNA, 16 bp, R. norvegicus
gtgctgggctgtgctg

SEQ ID NO: 513399 - DNA, 16 bp, R. norvegicus
gtgctggggagacaga

SEQ ID NO: 513400 - DNA, 16 bp, R. norvegicus
gtgctgggggttgaac

SEQ ID NO: 513401 - DNA, 16 bp, R. norvegicus
gtgctggggttgggga

SEQ ID NO: 513402 - DNA, 16 bp, R. norvegicus
gtgctgggtttcagct

SEQ ID NO: 513403 - DNA, 16 bp, R. norvegicus
gtgctggtgctgctgc

SEQ ID NO: 513404 - DNA, 16 bp, R. norvegicus
gtgctggtgctggtga

SEQ ID NO: 513405 - DNA, 16 bp, R. norvegicus
gtgctgtatatggctt

SEQ ID NO: 513406 - DNA, 16 bp, R. norvegicus
gtgctgtatgtgtgtg

SEQ ID NO: 513407 - DNA, 16 bp, R. norvegicus
gtgctgtcaggctgct

SEQ ID NO: 513408 - DNA, 16 bp, R. norvegicus
gtgctgtcatctgcag

SEQ ID NO: 513409 - DNA, 19 bp, R. norvegicus
gtgctgtgcggttgatggt

SEQ ID NO: 513410 - DNA, 16 bp, R. norvegicus
gtgctgtgctgctctg

SEQ ID NO: 513411 - DNA, 16 bp, R. norvegicus
gtgctgtggctggact

SEQ ID NO: 513412 - DNA, 16 bp, R. norvegicus
gtgctgtgtgtgagag

SEQ ID NO: 513413 - DNA, 16 bp, R. norvegicus
gtgctgttaaccactg

SEQ ID NO: 513414 - DNA, 16 bp, R. norvegicus
gtgctgttgctgctgc

SEQ ID NO: 513415 - DNA, 16 bp, R. norvegicus
gtgcttcagtgtgtgt

SEQ ID NO: 513416 - DNA, 16 bp, R. norvegicus
gtgcttccaaaaagaa

SEQ ID NO: 513417 - DNA, 16 bp, R. norvegicus
gtgcttcccatccctg

SEQ ID NO: 513418 - DNA, 16 bp, R. norvegicus
gtgcttcctgccttga

SEQ ID NO: 513419 - DNA, 16 bp, R. norvegicus
gtgcttcgtggggaag

SEQ ID NO: 513420 - DNA, 16 bp, R. norvegicus
gtgcttctcagccact

SEQ ID NO: 513421 - DNA, 16 bp, R. norvegicus
gtgcttcttagcatca

SEQ ID NO: 513422 - DNA, 16 bp, R. norvegicus
gtgcttcttgccggcg

SEQ ID NO: 513423 - DNA, 16 bp, R. norvegicus
gtgcttgcagccaagc

SEQ ID NO: 513424 - DNA, 16 bp, R. norvegicus
gtgcttgccctgcaag

SEQ ID NO: 513425 - DNA, 16 bp, R. norvegicus
gtgcttgcctggcatg

SEQ ID NO: 513426 - DNA, 16 bp, R. norvegicus
gtgcttgctgcacaaa

SEQ ID NO: 513427 - DNA, 16 bp, R. norvegicus
gtgcttgctgctcttt

SEQ ID NO: 513428 - DNA, 16 bp, R. norvegicus
gtgcttgctgtctcct

SEQ ID NO: 513429 - DNA, 16 bp, R. norvegicus
gtgcttgctgttcttc

SEQ ID NO: 513430 - DNA, 16 bp, R. norvegicus
gtgcttggaactgaac

SEQ ID NO: 513431 - DNA, 16 bp, R. norvegicus
gtgcttgtgagtgtgt

SEQ ID NO: 513432 - DNA, 16 bp, R. norvegicus
gtgcttgtgtgtgtgc

SEQ ID NO: 513433 - DNA, 16 bp, R. norvegicus
gtgctttgcaggaggc

SEQ ID NO: 513434 - DNA, 16 bp, R. norvegicus
gtgctttgcctgcatg

SEQ ID NO: 513435 - DNA, 16 bp, R. norvegicus
gtgctttgctgctggc

SEQ ID NO: 513436 - DNA, 16 bp, R. norvegicus
gtggaaaaagagaaac

SEQ ID NO: 513437 - DNA, 16 bp, R. norvegicus
gtggaaaccagccaag

SEQ ID NO: 513438 - DNA, 16 bp, R. norvegicus
gtggaaagagatggga

SEQ ID NO: 513439 - DNA, 16 bp, R. norvegicus
gtggaaagagcacatc

SEQ ID NO: 513440 - DNA, 16 bp, R. norvegicus
gtggaaatagaagcaa

SEQ ID NO: 513441 - DNA, 16 bp, R. norvegicus
gtggaaatatgtttgt

SEQ ID NO: 513442 - DNA, 16 bp, R. norvegicus
gtggaaattaaacaat

SEQ ID NO: 513443 - DNA, 16 bp, R. norvegicus
gtggaacacactgtga

SEQ ID NO: 513444 - DNA, 16 bp, R. norvegicus
gtggaacatgtgcctc

SEQ ID NO: 513445 - DNA, 16 bp, R. norvegicus
gtggaaccatgttggc

SEQ ID NO: 513446 - DNA, 16 bp, R. norvegicus
gtggaacgtcttccag

SEQ ID NO: 513447 - DNA, 16 bp, R. norvegicus
gtggaactttggggat

SEQ ID NO: 513448 - DNA, 16 bp, R. norvegicus
gtggaagaagagaaca

SEQ ID NO: 513449 - DNA, 16 bp, R. norvegicus
gtggaagacagcagtg

SEQ ID NO: 513450 - DNA, 16 bp, R. norvegicus
gtggaagacttcaaca

SEQ ID NO: 513451 - DNA, 16 bp, R. norvegicus
gtggaagcaaaggtaa

SEQ ID NO: 513452 - DNA, 16 bp, R. norvegicus
gtggaagccagtgcca

SEQ ID NO: 513453 - DNA, 16 bp, R. norvegicus
gtggaagtgaaagctg

SEQ ID NO: 513454 - DNA, 16 bp, R. norvegicus
gtggaatagtttgagg

SEQ ID NO: 513455 - DNA, 16 bp, R. norvegicus
gtggaatctcaaggtt

SEQ ID NO: 513456 - DNA, 16 bp, R. norvegicus
gtggaatggatcccca

SEQ ID NO: 513457 - DNA, 16 bp, R. norvegicus
gtggaattatttttgt

SEQ ID NO: 513458 - DNA, 16 bp, R. norvegicus
gtggacaatctgaagc

SEQ ID NO: 513459 - DNA, 16 bp, R. norvegicus
gtggaccaaggacctc

SEQ ID NO: 513460 - DNA, 16 bp, R. norvegicus
gtggaccaggaaggga

SEQ ID NO: 513461 - DNA, 16 bp, R. norvegicus
gtggaccatgccacca

SEQ ID NO: 513462 - DNA, 16 bp, R. norvegicus
gtggacctggcctcca

SEQ ID NO: 513463 - DNA, 21 bp, R. norvegicus
gtggaccttggcgtgggctgg

SEQ ID NO: 513464 - DNA, 18 bp, R. norvegicus
gtggaccttggtgtgggc

SEQ ID NO: 513465 - DNA, 16 bp, R. norvegicus
gtggactcagaacaca

SEQ ID NO: 513466 - DNA, 16 bp, R. norvegicus
gtggactctcagggtc

SEQ ID NO: 513467 - DNA, 16 bp, R. norvegicus
gtggacttgttggagt

SEQ ID NO: 513468 - DNA, 17 bp, R. norvegicus
gtggagaacgaggaaca

SEQ ID NO: 513469 - DNA, 16 bp, R. norvegicus
gtggagaatggaactt

SEQ ID NO: 513470 - DNA, 16 bp, R. norvegicus
gtggagaattctatca

SEQ ID NO: 513471 - DNA, 16 bp, R. norvegicus
gtggagaattctcaaa

SEQ ID NO: 513472 - DNA, 16 bp, R. norvegicus
gtggagacagaagaat

SEQ ID NO: 513473 - DNA, 16 bp, R. norvegicus
gtggagaccagaggag

SEQ ID NO: 513474 - DNA, 16 bp, R. norvegicus
gtggagaccagaggtt

SEQ ID NO: 513475 - DNA, 16 bp, R. norvegicus
gtggagagaaccaact

SEQ ID NO: 513476 - DNA, 16 bp, R. norvegicus
gtggagagagaggaac

SEQ ID NO: 513477 - DNA, 16 bp, R. norvegicus
gtggagagatgagaag

SEQ ID NO: 513478 - DNA, 16 bp, R. norvegicus
gtggagaggctgagac

SEQ ID NO: 513479 - DNA, 16 bp, R. norvegicus
gtggagatcctgcagc

SEQ ID NO: 513480 - DNA, 16 bp, R. norvegicus
gtggagcagaaattga

SEQ ID NO: 513481 - DNA, 16 bp, R. norvegicus
gtggagccacccctgg

SEQ ID NO: 513482 - DNA, 16 bp, R. norvegicus
gtggagcccctcagag

SEQ ID NO: 513483 - DNA, 16 bp, R. norvegicus
gtggagcctatatggt

SEQ ID NO: 513484 - DNA, 16 bp, R. norvegicus
gtggagctggccctgg

SEQ ID NO: 513485 - DNA, 16 bp, R. norvegicus
gtggaggaacactctc

SEQ ID NO: 513486 - DNA, 16 bp, R. norvegicus
gtggaggaagctgagg

SEQ ID NO: 513487 - DNA, 16 bp, R. norvegicus
gtggaggaaggctact

SEQ ID NO: 513488 - DNA, 16 bp, R. norvegicus
gtggaggacccagccc

SEQ ID NO: 513489 - DNA, 17 bp, R. norvegicus
gtggaggacttcaagaa

SEQ ID NO: 513490 - DNA, 16 bp, R. norvegicus
gtggaggagctccctc

SEQ ID NO: 513491 - DNA, 16 bp, R. norvegicus
gtggaggaggaggcag

SEQ ID NO: 513492 - DNA, 16 bp, R. norvegicus
gtggaggagggcccag

SEQ ID NO: 513493 - DNA, 17 bp, R. norvegicus
gtggaggatgtggagaa

SEQ ID NO: 513494 - DNA, 16 bp, R. norvegicus
gtggaggcagagaaag

SEQ ID NO: 513495 - DNA, 16 bp, R. norvegicus
gtggaggcaggaactg

SEQ ID NO: 513496 - DNA, 16 bp, R. norvegicus
gtggaggcagtggagg

SEQ ID NO: 513497 - DNA, 16 bp, R. norvegicus
gtggaggcattttctt

SEQ ID NO: 513498 - DNA, 16 bp, R. norvegicus
gtggaggccagaagac

SEQ ID NO: 513499 - DNA, 17 bp, R. norvegicus
gtggaggctgtgctcac

SEQ ID NO: 513500 - DNA, 16 bp, R. norvegicus
gtggagggcccaggag

SEQ ID NO: 513501 - DNA, 16 bp, R. norvegicus
gtggaggggaaacctg

SEQ ID NO: 513502 - DNA, 16 bp, R. norvegicus
gtggaggtagaggcag

SEQ ID NO: 513503 - DNA, 16 bp, R. norvegicus
gtggaggtctgtgatc

SEQ ID NO: 513504 - DNA, 17 bp, R. norvegicus
gtggaggtgccttctgt

SEQ ID NO: 513505 - DNA, 16 bp, R. norvegicus
gtggagtcagttctct

SEQ ID NO: 513506 - DNA, 16 bp, R. norvegicus
gtggagttcctatcct

SEQ ID NO: 513507 - DNA, 16 bp, R. norvegicus
gtggagttcctattcc

SEQ ID NO: 513508 - DNA, 16 bp, R. norvegicus
gtggagttggtaaaaa

SEQ ID NO: 513509 - DNA, 16 bp, R. norvegicus
gtggagttggttttct

SEQ ID NO: 513510 - DNA, 16 bp, R. norvegicus
gtggatatatatatat

SEQ ID NO: 513511 - DNA, 16 bp, R. norvegicus
gtggatcccaatgaaa

SEQ ID NO: 513512 - DNA, 16 bp, R. norvegicus
gtggatccctggggct

SEQ ID NO: 513513 - DNA, 16 bp, R. norvegicus
gtggatctgagggaga

SEQ ID NO: 513514 - DNA, 16 bp, R. norvegicus
gtggatctggatggga

SEQ ID NO: 513515 - DNA, 16 bp, R. norvegicus
gtggatctggggaaga

SEQ ID NO: 513516 - DNA, 16 bp, R. norvegicus
gtggatgaaatggaca

SEQ ID NO: 513517 - DNA, 16 bp, R. norvegicus
gtggatgacagcaaag

SEQ ID NO: 513518 - DNA, 16 bp, R. norvegicus
gtggatgcacacactg

SEQ ID NO: 513519 - DNA, 16 bp, R. norvegicus
gtggatgcttgaaacc

SEQ ID NO: 513520 - DNA, 16 bp, R. norvegicus
gtggatggagaatgga

SEQ ID NO: 513521 - DNA, 16 bp, R. norvegicus
gtggatggcacctgag

SEQ ID NO: 513522 - DNA, 16 bp, R. norvegicus
gtggatgtgcagtcag

SEQ ID NO: 513523 - DNA, 16 bp, R. norvegicus
gtggatgtgtacagtg

SEQ ID NO: 513524 - DNA, 16 bp, R. norvegicus
gtggatgttcacagcc

SEQ ID NO: 513525 - DNA, 16 bp, R. norvegicus
gtggattacatcgatg

SEQ ID NO: 513526 - DNA, 16 bp, R. norvegicus
gtggattagtccctgg

SEQ ID NO: 513527 - DNA, 16 bp, R. norvegicus
gtggattagtgttcat

SEQ ID NO: 513528 - DNA, 16 bp, R. norvegicus
gtggattctgaggatc

SEQ ID NO: 513529 - DNA, 16 bp, R. norvegicus
gtggattgagctgctg

SEQ ID NO: 513530 - DNA, 16 bp, R. norvegicus
gtggattttatcttga

SEQ ID NO: 513531 - DNA, 16 bp, R. norvegicus
gtggcaagcaccttca

SEQ ID NO: 513532 - DNA, 16 bp, R. norvegicus
gtggcaagcaccttta

SEQ ID NO: 513533 - DNA, 16 bp, R. norvegicus
gtggcaagtgctttta

SEQ ID NO: 513534 - DNA, 16 bp, R. norvegicus
gtggcacacacatgta

SEQ ID NO: 513535 - DNA, 16 bp, R. norvegicus
gtggcaccagtggaag

SEQ ID NO: 513536 - DNA, 16 bp, R. norvegicus
gtggcaccatccacag

SEQ ID NO: 513537 - DNA, 16 bp, R. norvegicus
gtggcactctgtctct

SEQ ID NO: 513538 - DNA, 16 bp, R. norvegicus
gtggcactgcccacag

SEQ ID NO: 513539 - DNA, 16 bp, R. norvegicus
gtggcagagctgatca

SEQ ID NO: 513540 - DNA, 16 bp, R. norvegicus
gtggcagaggcagagg

SEQ ID NO: 513541 - DNA, 16 bp, R. norvegicus
gtggcagcagagacac

SEQ ID NO: 513542 - DNA, 16 bp, R. norvegicus
gtggcagcagcagtgg

SEQ ID NO: 513543 - DNA, 16 bp, R. norvegicus
gtggcagcagcatgga

SEQ ID NO: 513544 - DNA, 16 bp, R. norvegicus
gtggcagccaccagga

SEQ ID NO: 513545 - DNA, 16 bp, R. norvegicus
gtggcagctcacagcc

SEQ ID NO: 513546 - DNA, 16 bp, R. norvegicus
gtggcaggagagaacc

SEQ ID NO: 513547 - DNA, 16 bp, R. norvegicus
gtggcagggagccatg

SEQ ID NO: 513548 - DNA, 16 bp, R. norvegicus
gtggcagggcggggct

SEQ ID NO: 513549 - DNA, 16 bp, R. norvegicus
gtggcagtggtggcag

SEQ ID NO: 513550 - DNA, 16 bp, R. norvegicus
gtggcagttgtggctg

SEQ ID NO: 513551 - DNA, 16 bp, R. norvegicus
gtggcatgcaggcagg

SEQ ID NO: 513552 - DNA, 16 bp, R. norvegicus
gtggccaatggctggg

SEQ ID NO: 513553 - DNA, 16 bp, R. norvegicus
gtggccccatccctta

SEQ ID NO: 513554 - DNA, 16 bp, R. norvegicus
gtggccctctacatct

SEQ ID NO: 513555 - DNA, 16 bp, R. norvegicus
gtggccctgatggagt

SEQ ID NO: 513556 - DNA, 16 bp, R. norvegicus
gtggccctggcctctc

SEQ ID NO: 513557 - DNA, 16 bp, R. norvegicus
gtggccttgctggagt

SEQ ID NO: 513558 - DNA, 16 bp, R. norvegicus
gtggccttggaggaaa

SEQ ID NO: 513559 - DNA, 16 bp, R. norvegicus
gtggccttggcccagg

SEQ ID NO: 513560 - DNA, 16 bp, R. norvegicus
gtggcgggaggtgttt

SEQ ID NO: 513561 - DNA, 16 bp, R. norvegicus
gtggctacctccagtt

SEQ ID NO: 513562 - DNA, 16 bp, R. norvegicus
gtggctaggacaaaat

SEQ ID NO: 513563 - DNA, 16 bp, R. norvegicus
gtggctcacaagcacc

SEQ ID NO: 513564 - DNA, 16 bp, R. norvegicus
gtggctcacaagtgtc

SEQ ID NO: 513565 - DNA, 16 bp, R. norvegicus
gtggctcacacccacc

SEQ ID NO: 513566 - DNA, 17 bp, R. norvegicus
gtggctcacagccatct

SEQ ID NO: 513567 - DNA, 16 bp, R. norvegicus
gtggctcacggccatc

SEQ ID NO: 513568 - DNA, 16 bp, R. norvegicus
gtggctcatctgtaat

SEQ ID NO: 513569 - DNA, 16 bp, R. norvegicus
gtggctccacccacaa

SEQ ID NO: 513570 - DNA, 16 bp, R. norvegicus
gtggctccagctgtgg

SEQ ID NO: 513571 - DNA, 16 bp, R. norvegicus
gtggctctccacctag

SEQ ID NO: 513572 - DNA, 16 bp, R. norvegicus
gtggctctggcatctt

SEQ ID NO: 513573 - DNA, 16 bp, R. norvegicus
gtggctctggctgtcc

SEQ ID NO: 513574 - DNA, 16 bp, R. norvegicus
gtggctctgtggtaga

SEQ ID NO: 513575 - DNA, 16 bp, R. norvegicus
gtggctgaagacagtg

SEQ ID NO: 513576 - DNA, 16 bp, R. norvegicus
gtggctgacagccatc

SEQ ID NO: 513577 - DNA, 16 bp, R. norvegicus
gtggctgcagatggga

SEQ ID NO: 513578 - DNA, 16 bp, R. norvegicus
gtggctgcctagccac

SEQ ID NO: 513579 - DNA, 16 bp, R. norvegicus
gtggctggagacattg

SEQ ID NO: 513580 - DNA, 16 bp, R. norvegicus
gtggctggagctatgg

SEQ ID NO: 513581 - DNA, 16 bp, R. norvegicus
gtggctgggagtgcag

SEQ ID NO: 513582 - DNA, 17 bp, R. norvegicus
gtggctgtcccaaagtc

SEQ ID NO: 513583 - DNA, 16 bp, R. norvegicus
gtggctgttacaggaa

SEQ ID NO: 513584 - DNA, 16 bp, R. norvegicus
gtggcttacaaccatc

SEQ ID NO: 513585 - DNA, 16 bp, R. norvegicus
gtggcttctgcttcag

SEQ ID NO: 513586 - DNA, 16 bp, R. norvegicus
gtggcttgaccttcct

SEQ ID NO: 513587 - DNA, 16 bp, R. norvegicus
gtggcttgttggagta

SEQ ID NO: 513588 - DNA, 16 bp, R. norvegicus
gtggctttgtccctgg

SEQ ID NO: 513589 - DNA, 16 bp, R. norvegicus
gtgggaaaattcccac

SEQ ID NO: 513590 - DNA, 16 bp, R. norvegicus
gtgggaaagagcctgg

SEQ ID NO: 513591 - DNA, 16 bp, R. norvegicus
gtgggaaagagtcttg

SEQ ID NO: 513592 - DNA, 16 bp, R. norvegicus
gtgggaaaggaagtgc

SEQ ID NO: 513593 - DNA, 16 bp, R. norvegicus
gtgggaacctggacaa

SEQ ID NO: 513594 - DNA, 16 bp, R. norvegicus
gtgggaagagggaact

SEQ ID NO: 513595 - DNA, 16 bp, R. norvegicus
gtgggaaggggagcag

SEQ ID NO: 513596 - DNA, 16 bp, R. norvegicus
gtgggacagtttctgg

SEQ ID NO: 513597 - DNA, 16 bp, R. norvegicus
gtgggactcccaacag

SEQ ID NO: 513598 - DNA, 16 bp, R. norvegicus
gtgggagaaatagttt

SEQ ID NO: 513599 - DNA, 16 bp, R. norvegicus
gtgggagaagatgagc

SEQ ID NO: 513600 - DNA, 16 bp, R. norvegicus
gtgggagacttcaatg

SEQ ID NO: 513601 - DNA, 16 bp, R. norvegicus
gtgggagagatggctc

SEQ ID NO: 513602 - DNA, 16 bp, R. norvegicus
gtgggagagctggtgg

SEQ ID NO: 513603 - DNA, 16 bp, R. norvegicus
gtgggaggagaagcct

SEQ ID NO: 513604 - DNA, 16 bp, R. norvegicus
gtgggagttgctgttg

SEQ ID NO: 513605 - DNA, 16 bp, R. norvegicus
gtgggatctggttggt

SEQ ID NO: 513606 - DNA, 16 bp, R. norvegicus
gtgggatggtggagca

SEQ ID NO: 513607 - DNA, 16 bp, R. norvegicus
gtgggcaaggtcatcc

SEQ ID NO: 513608 - DNA, 18 bp, R. norvegicus
gtgggcaattatatctta

SEQ ID NO: 513609 - DNA, 16 bp, R. norvegicus
gtgggcaccaccatgc

SEQ ID NO: 513610 - DNA, 16 bp, R. norvegicus
gtgggcagaagtggcg

SEQ ID NO: 513611 - DNA, 16 bp, R. norvegicus
gtgggcagccttgtcc

SEQ ID NO: 513612 - DNA, 16 bp, R. norvegicus
gtgggcagtgggcagc

SEQ ID NO: 513613 - DNA, 16 bp, R. norvegicus
gtgggcagttatatct

SEQ ID NO: 513614 - DNA, 16 bp, R. norvegicus
gtgggccacctccagg

SEQ ID NO: 513615 - DNA, 16 bp, R. norvegicus
gtgggccaggctctga

SEQ ID NO: 513616 - DNA, 16 bp, R. norvegicus
gtgggcctctgtcttg

SEQ ID NO: 513617 - DNA, 16 bp, R. norvegicus
gtgggcctgaggttaa

SEQ ID NO: 513618 - DNA, 16 bp, R. norvegicus
gtgggctagaaggagg

SEQ ID NO: 513619 - DNA, 16 bp, R. norvegicus
gtgggctagaggagag

SEQ ID NO: 513620 - DNA, 16 bp, R. norvegicus
gtggggaaaagccttg

SEQ ID NO: 513621 - DNA, 16 bp, R. norvegicus
gtggggaagcaccctc

SEQ ID NO: 513622 - DNA, 16 bp, R. norvegicus
gtggggacagctacag

SEQ ID NO: 513623 - DNA, 16 bp, R. norvegicus
gtggggacatggaacc

SEQ ID NO: 513624 - DNA, 16 bp, R. norvegicus
gtggggagacagagag

SEQ ID NO: 513625 - DNA, 16 bp, R. norvegicus
gtggggaggcaagaag

SEQ ID NO: 513626 - DNA, 16 bp, R. norvegicus
gtggggaggcaggaag

SEQ ID NO: 513627 - DNA, 16 bp, R. norvegicus
gtggggcaggctctgg

SEQ ID NO: 513628 - DNA, 16 bp, R. norvegicus
gtggggcagtctttga

SEQ ID NO: 513629 - DNA, 16 bp, R. norvegicus
gtgggggaataccctc

SEQ ID NO: 513630 - DNA, 16 bp, R. norvegicus
gtgggggatggggaca

SEQ ID NO: 513631 - DNA, 16 bp, R. norvegicus
gtgggggcatcctctt

SEQ ID NO: 513632 - DNA, 16 bp, R. norvegicus
gtggggtggtaataaa

SEQ ID NO: 513633 - DNA, 16 bp, R. norvegicus
gtggggtgtcagaaga

SEQ ID NO: 513634 - DNA, 16 bp, R. norvegicus
gtgggtcacagccatc

SEQ ID NO: 513635 - DNA, 16 bp, R. norvegicus
gtgggtcaggaacata

SEQ ID NO: 513636 - DNA, 16 bp, R. norvegicus
gtgggtcctgggaact

SEQ ID NO: 513637 - DNA, 16 bp, R. norvegicus
gtgggtctctccatct

SEQ ID NO: 513638 - DNA, 16 bp, R. norvegicus
gtgggtctctgagggg

SEQ ID NO: 513639 - DNA, 16 bp, R. norvegicus
gtgggtctctgtttct

SEQ ID NO: 513640 - DNA, 16 bp, R. norvegicus
gtgggtgacaccatcc

SEQ ID NO: 513641 - DNA, 16 bp, R. norvegicus
gtgggtgctaggaatc

SEQ ID NO: 513642 - DNA, 16 bp, R. norvegicus
gtgggtgctgagagct

SEQ ID NO: 513643 - DNA, 16 bp, R. norvegicus
gtgggtgctgggaatg

SEQ ID NO: 513644 - DNA, 16 bp, R. norvegicus
gtgggtgctggggaac

SEQ ID NO: 513645 - DNA, 16 bp, R. norvegicus
gtgggtgggaccatcc

SEQ ID NO: 513646 - DNA, 16 bp, R. norvegicus
gtgggtggggccactc

SEQ ID NO: 513647 - DNA, 16 bp, R. norvegicus
gtgggtggtgccatcc

SEQ ID NO: 513648 - DNA, 16 bp, R. norvegicus
gtgggtgtgaatgtgt

SEQ ID NO: 513649 - DNA, 16 bp, R. norvegicus
gtgggtgtggccttct

SEQ ID NO: 513650 - DNA, 16 bp, R. norvegicus
gtgggttcatttctgt

SEQ ID NO: 513651 - DNA, 20 bp, R. norvegicus
gtgggttcggtccccagctc

SEQ ID NO: 513652 - DNA, 16 bp, R. norvegicus
gtgggttgtgccatcc

SEQ ID NO: 513653 - DNA, 16 bp, R. norvegicus
gtggtaaagctctgag

SEQ ID NO: 513654 - DNA, 16 bp, R. norvegicus
gtggtaaagctgggtc

SEQ ID NO: 513655 - DNA, 16 bp, R. norvegicus
gtggtaagcagactga

SEQ ID NO: 513656 - DNA, 16 bp, R. norvegicus
gtggtacatgcctgta

SEQ ID NO: 513657 - DNA, 16 bp, R. norvegicus
gtggtacatgtcttta

SEQ ID NO: 513658 - DNA, 16 bp, R. norvegicus
gtggtagagcctttgc

SEQ ID NO: 513659 - DNA, 16 bp, R. norvegicus
gtggtagagctggatc

SEQ ID NO: 513660 - DNA, 16 bp, R. norvegicus
gtggtagagtgcttgc

SEQ ID NO: 513661 - DNA, 16 bp, R. norvegicus
gtggtagcagcagcag

SEQ ID NO: 513662 - DNA, 16 bp, R. norvegicus
gtggtcaagagcactg

SEQ ID NO: 513663 - DNA, 16 bp, R. norvegicus
gtggtcaaggtgggag

SEQ ID NO: 513664 - DNA, 16 bp, R. norvegicus
gtggtcatcaatcaca

SEQ ID NO: 513665 - DNA, 16 bp, R. norvegicus
gtggtcattgctgaca

SEQ ID NO: 513666 - DNA, 16 bp, R. norvegicus
gtggtcccaagaaaca

SEQ ID NO: 513667 - DNA, 16 bp, R. norvegicus
gtggtcctgcccatca

SEQ ID NO: 513668 - DNA, 16 bp, R. norvegicus
gtggtcctggtgactg

SEQ ID NO: 513669 - DNA, 16 bp, R. norvegicus
gtggtgaagcaggcat

SEQ ID NO: 513670 - DNA, 16 bp, R. norvegicus
gtggtgacccctcccc

SEQ ID NO: 513671 - DNA, 16 bp, R. norvegicus
gtggtgaccctcaacc

SEQ ID NO: 513672 - DNA, 16 bp, R. norvegicus
gtggtgatggtagtga

SEQ ID NO: 513673 - DNA, 16 bp, R. norvegicus
gtggtgatggtgataa

SEQ ID NO: 513674 - DNA, 16 bp, R. norvegicus
gtggtgccatccctgg

SEQ ID NO: 513675 - DNA, 16 bp, R. norvegicus
gtggtgcgggggctcc

SEQ ID NO: 513676 - DNA, 16 bp, R. norvegicus
gtggtgctatccctgg

SEQ ID NO: 513677 - DNA, 16 bp, R. norvegicus
gtggtgctgatgctgg

SEQ ID NO: 513678 - DNA, 16 bp, R. norvegicus
gtggtgctgcacacct

SEQ ID NO: 513679 - DNA, 16 bp, R. norvegicus
gtggtgctgctgctgc

SEQ ID NO: 513680 - DNA, 16 bp, R. norvegicus
gtggtgctgtccctgg

SEQ ID NO: 513681 - DNA, 16 bp, R. norvegicus
gtggtggcacacgcct

SEQ ID NO: 513682 - DNA, 16 bp, R. norvegicus
gtggtggcagcggtgg

SEQ ID NO: 513683 - DNA, 16 bp, R. norvegicus
gtggtggcagtggcag

SEQ ID NO: 513684 - DNA, 16 bp, R. norvegicus
gtggtggcccaggcct

SEQ ID NO: 513685 - DNA, 16 bp, R. norvegicus
gtggtggcggcagtgg

SEQ ID NO: 513686 - DNA, 16 bp, R. norvegicus
gtggtggctcacaacc

SEQ ID NO: 513687 - DNA, 16 bp, R. norvegicus
gtggtggctcatgcct

SEQ ID NO: 513688 - DNA, 16 bp, R. norvegicus
gtggtggctgagtgtg

SEQ ID NO: 513689 - DNA, 16 bp, R. norvegicus
gtggtggctgctgctg

SEQ ID NO: 513690 - DNA, 16 bp, R. norvegicus
gtggtgggaaccacca

SEQ ID NO: 513691 - DNA, 16 bp, R. norvegicus
gtggtgggagaactgg

SEQ ID NO: 513692 - DNA, 16 bp, R. norvegicus
gtggtgggatttgaac

SEQ ID NO: 513693 - DNA, 16 bp, R. norvegicus
gtggtggggagcatgg

SEQ ID NO: 513694 - DNA, 16 bp, R. norvegicus
gtggtgggtgtcctca

SEQ ID NO: 513695 - DNA, 16 bp, R. norvegicus
gtggtggtacatgcct

SEQ ID NO: 513696 - DNA, 16 bp, R. norvegicus
gtggtggtcttccctg

SEQ ID NO: 513697 - DNA, 16 bp, R. norvegicus
gtggtggtgatgctgg

SEQ ID NO: 513698 - DNA, 16 bp, R. norvegicus
gtggtggtgcacgtct

SEQ ID NO: 513699 - DNA, 16 bp, R. norvegicus
gtggtggtgctgatgg

SEQ ID NO: 513700 - DNA, 16 bp, R. norvegicus
gtggtggtggcagcag

SEQ ID NO: 513701 - DNA, 16 bp, R. norvegicus
gtggtggtggcagtgg

SEQ ID NO: 513702 - DNA, 16 bp, R. norvegicus
gtggtggtggtgacca

SEQ ID NO: 513703 - DNA, 16 bp, R. norvegicus
gtggtggtggtgcacg

SEQ ID NO: 513704 - DNA, 16 bp, R. norvegicus
gtggtggtggtgtgca

SEQ ID NO: 513705 - DNA, 16 bp, R. norvegicus
gtggtggtgtacacct

SEQ ID NO: 513706 - DNA, 16 bp, R. norvegicus
gtggtgtacacctgta

SEQ ID NO: 513707 - DNA, 16 bp, R. norvegicus
gtggtgtggaagtgta

SEQ ID NO: 513708 - DNA, 16 bp, R. norvegicus
gtggttaagaatgctg

SEQ ID NO: 513709 - DNA, 16 bp, R. norvegicus
gtggttaagagcaatg

SEQ ID NO: 513710 - DNA, 16 bp, R. norvegicus
gtggttaagagtgctt

SEQ ID NO: 513711 - DNA, 16 bp, R. norvegicus
gtggttaagagttctt

SEQ ID NO: 513712 - DNA, 16 bp, R. norvegicus
gtggttcagtctttgg

SEQ ID NO: 513713 - DNA, 16 bp, R. norvegicus
gtggttcctgagaaaa

SEQ ID NO: 513714 - DNA, 16 bp, R. norvegicus
gtggttcctgtgccct

SEQ ID NO: 513715 - DNA, 16 bp, R. norvegicus
gtggttctgatgcttt

SEQ ID NO: 513716 - DNA, 16 bp, R. norvegicus
gtggttgtaccagcta

SEQ ID NO: 513717 - DNA, 16 bp, R. norvegicus
gtggtttcatccctgg

SEQ ID NO: 513718 - DNA, 16 bp, R. norvegicus
gtggtttgaaaaagaa

SEQ ID NO: 513719 - DNA, 16 bp, R. norvegicus
gtggtttgaaggagaa

SEQ ID NO: 513720 - DNA, 16 bp, R. norvegicus
gtggtttggatgagaa

SEQ ID NO: 513721 - DNA, 16 bp, R. norvegicus
gtggttttttctttga

SEQ ID NO: 513722 - DNA, 16 bp, R. norvegicus
gtgtaaaataagaaca

SEQ ID NO: 513723 - DNA, 16 bp, R. norvegicus
gtgtaagagtcaccca

SEQ ID NO: 513724 - DNA, 16 bp, R. norvegicus
gtgtaatatatatata

SEQ ID NO: 513725 - DNA, 16 bp, R. norvegicus
gtgtacacatgtgtgt

SEQ ID NO: 513726 - DNA, 16 bp, R. norvegicus
gtgtacacttgtaatc

SEQ ID NO: 513727 - DNA, 16 bp, R. norvegicus
gtgtactccttggatg

SEQ ID NO: 513728 - DNA, 16 bp, R. norvegicus
gtgtactcttttgttg

SEQ ID NO: 513729 - DNA, 16 bp, R. norvegicus
gtgtacttataaataa

SEQ ID NO: 513730 - DNA, 16 bp, R. norvegicus
gtgtacttgtataaat

SEQ ID NO: 513731 - DNA, 16 bp, R. norvegicus
gtgtacttgtatacat

SEQ ID NO: 513732 - DNA, 16 bp, R. norvegicus
gtgtagaagaaagtga

SEQ ID NO: 513733 - DNA, 16 bp, R. norvegicus
gtgtagatgctgggaa

SEQ ID NO: 513734 - DNA, 16 bp, R. norvegicus
gtgtagcaacaactgg

SEQ ID NO: 513735 - DNA, 16 bp, R. norvegicus
gtgtagccaaggatga

SEQ ID NO: 513736 - DNA, 16 bp, R. norvegicus
gtgtagccctggatgg

SEQ ID NO: 513737 - DNA, 16 bp, R. norvegicus
gtgtaggaggagctga

SEQ ID NO: 513738 - DNA, 16 bp, R. norvegicus
gtgtagggctggatga

SEQ ID NO: 513739 - DNA, 16 bp, R. norvegicus
gtgtagtttccctcct

SEQ ID NO: 513740 - DNA, 16 bp, R. norvegicus
gtgtatagtgtttgtg

SEQ ID NO: 513741 - DNA, 16 bp, R. norvegicus
gtgtatatatatatat

SEQ ID NO: 513742 - DNA, 16 bp, R. norvegicus
gtgtatatgtgtgtgc

SEQ ID NO: 513743 - DNA, 16 bp, R. norvegicus
gtgtatcagaagacag

SEQ ID NO: 513744 - DNA, 16 bp, R. norvegicus
gtgtatcagaggatgg

SEQ ID NO: 513745 - DNA, 16 bp, R. norvegicus
gtgtatctgttcctga

SEQ ID NO: 513746 - DNA, 16 bp, R. norvegicus
gtgtatgaacatgtgt

SEQ ID NO: 513747 - DNA, 16 bp, R. norvegicus
gtgtatgcacatgcac

SEQ ID NO: 513748 - DNA, 16 bp, R. norvegicus
gtgtatgcgtgtgcgt

SEQ ID NO: 513749 - DNA, 16 bp, R. norvegicus
gtgtatgcgtgtgtgt

SEQ ID NO: 513750 - DNA, 17 bp, R. norvegicus
gtgtatgctgggccatt

SEQ ID NO: 513751 - DNA, 16 bp, R. norvegicus
gtgtatggaggtcaga

SEQ ID NO: 513752 - DNA, 16 bp, R. norvegicus
gtgtatgtctgtgtgt

SEQ ID NO: 513753 - DNA, 16 bp, R. norvegicus
gtgtatgtgagtgaat

SEQ ID NO: 513754 - DNA, 16 bp, R. norvegicus
gtgtatgtgatccata

SEQ ID NO: 513755 - DNA, 16 bp, R. norvegicus
gtgtatgtgcacttgt

SEQ ID NO: 513756 - DNA, 16 bp, R. norvegicus
gtgtatgtgcgcatgt

SEQ ID NO: 513757 - DNA, 16 bp, R. norvegicus
gtgtatgtgtacacat

SEQ ID NO: 513758 - DNA, 16 bp, R. norvegicus
gtgtatgtgtacatga

SEQ ID NO: 513759 - DNA, 16 bp, R. norvegicus
gtgtatgtgtatgtat

SEQ ID NO: 513760 - DNA, 16 bp, R. norvegicus
gtgtatgtgtatgtgt

SEQ ID NO: 513761 - DNA, 16 bp, R. norvegicus
gtgtatgtgtgcacac

SEQ ID NO: 513762 - DNA, 16 bp, R. norvegicus
gtgtatgtgtgtgtga

SEQ ID NO: 513763 - DNA, 16 bp, R. norvegicus
gtgtatgtgtgtgtgc

SEQ ID NO: 513764 - DNA, 16 bp, R. norvegicus
gtgtatttgaagacag

SEQ ID NO: 513765 - DNA, 16 bp, R. norvegicus
gtgtattttaaaaata

SEQ ID NO: 513766 - DNA, 16 bp, R. norvegicus
gtgtcaagtagacaca

SEQ ID NO: 513767 - DNA, 16 bp, R. norvegicus
gtgtcaccatacctgg

SEQ ID NO: 513768 - DNA, 16 bp, R. norvegicus
gtgtcactgggggtgg

SEQ ID NO: 513769 - DNA, 16 bp, R. norvegicus
gtgtcagaagccctgg

SEQ ID NO: 513770 - DNA, 16 bp, R. norvegicus
gtgtcagagcctctgg

SEQ ID NO: 513771 - DNA, 16 bp, R. norvegicus
gtgtcagagcttctgg

SEQ ID NO: 513772 - DNA, 16 bp, R. norvegicus
gtgtcagatctcttgg

SEQ ID NO: 513773 - DNA, 16 bp, R. norvegicus
gtgtcagcaaagccca

SEQ ID NO: 513774 - DNA, 16 bp, R. norvegicus
gtgtcagcactcctgt

SEQ ID NO: 513775 - DNA, 16 bp, R. norvegicus
gtgtcaggctctgaat

SEQ ID NO: 513776 - DNA, 16 bp, R. norvegicus
gtgtcagtcctgagtc

SEQ ID NO: 513777 - DNA, 16 bp, R. norvegicus
gtgtcatgctctgtgg

SEQ ID NO: 513778 - DNA, 16 bp, R. norvegicus
gtgtcatggagatcct

SEQ ID NO: 513779 - DNA, 16 bp, R. norvegicus
gtgtcattgtgggggt

SEQ ID NO: 513780 - DNA, 16 bp, R. norvegicus
gtgtccaaccttggca

SEQ ID NO: 513781 - DNA, 19 bp, R. norvegicus
gtgtccaattttctgagga

SEQ ID NO: 513782 - DNA, 16 bp, R. norvegicus
gtgtccacaggtgtgt

SEQ ID NO: 513783 - DNA, 16 bp, R. norvegicus
gtgtccagttttatgt

SEQ ID NO: 513784 - DNA, 16 bp, R. norvegicus
gtgtccatggaagcca

SEQ ID NO: 513785 - DNA, 16 bp, R. norvegicus
gtgtccatgtgtccat

SEQ ID NO: 513786 - DNA, 16 bp, R. norvegicus
gtgtccatgtgtgtgg

SEQ ID NO: 513787 - DNA, 16 bp, R. norvegicus
gtgtcccataagtatg

SEQ ID NO: 513788 - DNA, 16 bp, R. norvegicus
gtgtccctgctgagtg

SEQ ID NO: 513789 - DNA, 16 bp, R. norvegicus
gtgtcctccacatgcc

SEQ ID NO: 513790 - DNA, 16 bp, R. norvegicus
gtgtcctgggcagtgt

SEQ ID NO: 513791 - DNA, 16 bp, R. norvegicus
gtgtcctgttcagaaa

SEQ ID NO: 513792 - DNA, 16 bp, R. norvegicus
gtgtccttctctgtct

SEQ ID NO: 513793 - DNA, 16 bp, R. norvegicus
gtgtccttgctggggt

SEQ ID NO: 513794 - DNA, 16 bp, R. norvegicus
gtgtccttgtgtggtt

SEQ ID NO: 513795 - DNA, 16 bp, R. norvegicus
gtgtcctttgtcatcc

SEQ ID NO: 513796 - DNA, 16 bp, R. norvegicus
gtgtctaaagacagtg

SEQ ID NO: 513797 - DNA, 16 bp, R. norvegicus
gtgtctatgtctgtgc

SEQ ID NO: 513798 - DNA, 22 bp, R. norvegicus
gtgtctcaggcaggggtcctgc

SEQ ID NO: 513799 - DNA, 16 bp, R. norvegicus
gtgtctctcaggacag

SEQ ID NO: 513800 - DNA, 16 bp, R. norvegicus
gtgtctctcctctctc

SEQ ID NO: 513801 - DNA, 16 bp, R. norvegicus
gtgtctctggacacag

SEQ ID NO: 513802 - DNA, 23 bp, R. norvegicus
gtgtctcttttatatgttggggc

SEQ ID NO: 513803 - DNA, 16 bp, R. norvegicus
gtgtctgaacacagtg

SEQ ID NO: 513804 - DNA, 16 bp, R. norvegicus
gtgtctgaagacaact

SEQ ID NO: 513805 - DNA, 16 bp, R. norvegicus
gtgtctgaagagagcg

SEQ ID NO: 513806 - DNA, 16 bp, R. norvegicus
gtgtctgactctctga

SEQ ID NO: 513807 - DNA, 16 bp, R. norvegicus
gtgtctgaggacagtg

SEQ ID NO: 513808 - DNA, 16 bp, R. norvegicus
gtgtctgagggctgtg

SEQ ID NO: 513809 - DNA, 16 bp, R. norvegicus
gtgtctgcagtggttg

SEQ ID NO: 513810 - DNA, 16 bp, R. norvegicus
gtgtctgctgctgctg

SEQ ID NO: 513811 - DNA, 16 bp, R. norvegicus
gtgtctggagtgctgt

SEQ ID NO: 513812 - DNA, 16 bp, R. norvegicus
gtgtctggggacagct

SEQ ID NO: 513813 - DNA, 16 bp, R. norvegicus
gtgtctgggttacctt

SEQ ID NO: 513814 - DNA, 16 bp, R. norvegicus
gtgtctgtctctctgc

SEQ ID NO: 513815 - DNA, 16 bp, R. norvegicus
gtgtctgtctgtctgt

SEQ ID NO: 513816 - DNA, 16 bp, R. norvegicus
gtgtctgtctgtgtac

SEQ ID NO: 513817 - DNA, 16 bp, R. norvegicus
gtgtctgtctttctct

SEQ ID NO: 513818 - DNA, 16 bp, R. norvegicus
gtgtctgtgactgtga

SEQ ID NO: 513819 - DNA, 16 bp, R. norvegicus
gtgtctgtgagagtgt

SEQ ID NO: 513820 - DNA, 16 bp, R. norvegicus
gtgtctgtgcatgtgc

SEQ ID NO: 513821 - DNA, 16 bp, R. norvegicus
gtgtctgtgtatctgt

SEQ ID NO: 513822 - DNA, 16 bp, R. norvegicus
gtgtctgtgtctatat

SEQ ID NO: 513823 - DNA, 16 bp, R. norvegicus
gtgtctgttcccagca

SEQ ID NO: 513824 - DNA, 16 bp, R. norvegicus
gtgtctgttttaatgt

SEQ ID NO: 513825 - DNA, 16 bp, R. norvegicus
gtgtctgttttcagca

SEQ ID NO: 513826 - DNA, 16 bp, R. norvegicus
gtgtcttccttgccgg

SEQ ID NO: 513827 - DNA, 16 bp, R. norvegicus
gtgtctttcttgtatg

SEQ ID NO: 513828 - DNA, 16 bp, R. norvegicus
gtgtctttctttgtca

SEQ ID NO: 513829 - DNA, 16 bp, R. norvegicus
gtgtcttttgcctcac

SEQ ID NO: 513830 - DNA, 16 bp, R. norvegicus
gtgtgaaagtatgtgt

SEQ ID NO: 513831 - DNA, 16 bp, R. norvegicus
gtgtgaacacagagag

SEQ ID NO: 513832 - DNA, 16 bp, R. norvegicus
gtgtgaagagcagaca

SEQ ID NO: 513833 - DNA, 16 bp, R. norvegicus
gtgtgaagagtgtgtg

SEQ ID NO: 513834 - DNA, 16 bp, R. norvegicus
gtgtgaaggtgtcaga

SEQ ID NO: 513835 - DNA, 16 bp, R. norvegicus
gtgtgaatgtgtgtgt

SEQ ID NO: 513836 - DNA, 43 bp, R. norvegicus
gtgtgactttaaccaagcaagtaaaagatttgtacaataagaa

SEQ ID NO: 513837 - DNA, 16 bp, R. norvegicus
gtgtgagacagacaga

SEQ ID NO: 513838 - DNA, 16 bp, R. norvegicus
gtgtgagaccttgtct

SEQ ID NO: 513839 - DNA, 16 bp, R. norvegicus
gtgtgagccaccatac

SEQ ID NO: 513840 - DNA, 16 bp, R. norvegicus
gtgtgaggccaacctg

SEQ ID NO: 513841 - DNA, 16 bp, R. norvegicus
gtgtgagtgagtatgt

SEQ ID NO: 513842 - DNA, 16 bp, R. norvegicus
gtgtgagtgcatgtgc

SEQ ID NO: 513843 - DNA, 17 bp, R. norvegicus
gtgtgatgggagcactg

SEQ ID NO: 513844 - DNA, 16 bp, R. norvegicus
gtgtgatggtgcacac

SEQ ID NO: 513845 - DNA, 16 bp, R. norvegicus
gtgtgatggtttgtat

SEQ ID NO: 513846 - DNA, 16 bp, R. norvegicus
gtgtgatgtgtgtgat

SEQ ID NO: 513847 - DNA, 16 bp, R. norvegicus
gtgtgatttttttcat

SEQ ID NO: 513848 - DNA, 16 bp, R. norvegicus
gtgtgcaaagaatgtg

SEQ ID NO: 513849 - DNA, 16 bp, R. norvegicus
gtgtgcaaagtgcagt

SEQ ID NO: 513850 - DNA, 16 bp, R. norvegicus
gtgtgcacacaggtgt

SEQ ID NO: 513851 - DNA, 16 bp, R. norvegicus
gtgtgcacacatgtgc

SEQ ID NO: 513852 - DNA, 16 bp, R. norvegicus
gtgtgcaccgtgtgtg

SEQ ID NO: 513853 - DNA, 16 bp, R. norvegicus
gtgtgcacggatgctg

SEQ ID NO: 513854 - DNA, 16 bp, R. norvegicus
gtgtgcactgccacca

SEQ ID NO: 513855 - DNA, 16 bp, R. norvegicus
gtgtgcaggagaggtg

SEQ ID NO: 513856 - DNA, 16 bp, R. norvegicus
gtgtgcaggtgccctc

SEQ ID NO: 513857 - DNA, 16 bp, R. norvegicus
gtgtgcagtgcctgca

SEQ ID NO: 513858 - DNA, 16 bp, R. norvegicus
gtgtgcagtgctgggg

SEQ ID NO: 513859 - DNA, 16 bp, R. norvegicus
gtgtgcagtgtgtgca

SEQ ID NO: 513860 - DNA, 16 bp, R. norvegicus
gtgtgcatgaacacac

SEQ ID NO: 513861 - DNA, 16 bp, R. norvegicus
gtgtgcatgcacacac

SEQ ID NO: 513862 - DNA, 16 bp, R. norvegicus
gtgtgcatgcacatac

SEQ ID NO: 513863 - DNA, 16 bp, R. norvegicus
gtgtgcatgcatctgt

SEQ ID NO: 513864 - DNA, 16 bp, R. norvegicus
gtgtgcatgcatttgt

SEQ ID NO: 513865 - DNA, 16 bp, R. norvegicus
gtgtgcatgcttcagt

SEQ ID NO: 513866 - DNA, 16 bp, R. norvegicus
gtgtgcatggtgtgtg

SEQ ID NO: 513867 - DNA, 16 bp, R. norvegicus
gtgtgcatgtgaatgc

SEQ ID NO: 513868 - DNA, 16 bp, R. norvegicus
gtgtgcatgtgagtgc

SEQ ID NO: 513869 - DNA, 16 bp, R. norvegicus
gtgtgcatgtgcatga

SEQ ID NO: 513870 - DNA, 16 bp, R. norvegicus
gtgtgcatgtgcttgt

SEQ ID NO: 513871 - DNA, 16 bp, R. norvegicus
gtgtgcatgtgtagtg

SEQ ID NO: 513872 - DNA, 16 bp, R. norvegicus
gtgtgcatgtgtgtga

SEQ ID NO: 513873 - DNA, 16 bp, R. norvegicus
gtgtgcatgtgtgtgc

SEQ ID NO: 513874 - DNA, 16 bp, R. norvegicus
gtgtgcatgtttgttt

SEQ ID NO: 513875 - DNA, 16 bp, R. norvegicus
gtgtgcccactgtctg

SEQ ID NO: 513876 - DNA, 16 bp, R. norvegicus
gtgtgccctccatttc

SEQ ID NO: 513877 - DNA, 16 bp, R. norvegicus
gtgtgcctactgtgtg

SEQ ID NO: 513878 - DNA, 16 bp, R. norvegicus
gtgtgcctctctgaag

SEQ ID NO: 513879 - DNA, 16 bp, R. norvegicus
gtgtgcctgcctgcct

SEQ ID NO: 513880 - DNA, 16 bp, R. norvegicus
gtgtgcctgcgtgtgc

SEQ ID NO: 513881 - DNA, 16 bp, R. norvegicus
gtgtgcctggttcctg

SEQ ID NO: 513882 - DNA, 16 bp, R. norvegicus
gtgtgccttgtgcctg

SEQ ID NO: 513883 - DNA, 16 bp, R. norvegicus
gtgtgccttgtgtgtg

SEQ ID NO: 513884 - DNA, 16 bp, R. norvegicus
gtgtgcgccaccactg

SEQ ID NO: 513885 - DNA, 16 bp, R. norvegicus
gtgtgcgcgcgtgcgc

SEQ ID NO: 513886 - DNA, 16 bp, R. norvegicus
gtgtgcggcagctgga

SEQ ID NO: 513887 - DNA, 16 bp, R. norvegicus
gtgtgcgtgcacacac

SEQ ID NO: 513888 - DNA, 16 bp, R. norvegicus
gtgtgcgtgtgtgtgc

SEQ ID NO: 513889 - DNA, 16 bp, R. norvegicus
gtgtgctcagtgtgtg

SEQ ID NO: 513890 - DNA, 16 bp, R. norvegicus
gtgtgctcatatatat

SEQ ID NO: 513891 - DNA, 16 bp, R. norvegicus
gtgtgctgcagagaca

SEQ ID NO: 513892 - DNA, 16 bp, R. norvegicus
gtgtgctgcagtttct

SEQ ID NO: 513893 - DNA, 16 bp, R. norvegicus
gtgtgctttgaatttt

SEQ ID NO: 513894 - DNA, 16 bp, R. norvegicus
gtgtggagaaagagga

SEQ ID NO: 513895 - DNA, 16 bp, R. norvegicus
gtgtggagatcaaagg

SEQ ID NO: 513896 - DNA, 16 bp, R. norvegicus
gtgtggagcagagaca

SEQ ID NO: 513897 - DNA, 16 bp, R. norvegicus
gtgtggaggtcagatg

SEQ ID NO: 513898 - DNA, 16 bp, R. norvegicus
gtgtggatgcttcaat

SEQ ID NO: 513899 - DNA, 16 bp, R. norvegicus
gtgtggatgtggagaa

SEQ ID NO: 513900 - DNA, 16 bp, R. norvegicus
gtgtggatgtggatgt

SEQ ID NO: 513901 - DNA, 16 bp, R. norvegicus
gtgtggcaagtgtttt

SEQ ID NO: 513902 - DNA, 16 bp, R. norvegicus
gtgtggcaccatcatg

SEQ ID NO: 513903 - DNA, 16 bp, R. norvegicus
gtgtggcagcagtccc

SEQ ID NO: 513904 - DNA, 16 bp, R. norvegicus
gtgtggcagtcatggg

SEQ ID NO: 513905 - DNA, 16 bp, R. norvegicus
gtgtggcagtctctgg

SEQ ID NO: 513906 - DNA, 16 bp, R. norvegicus
gtgtggccatattgga

SEQ ID NO: 513907 - DNA, 16 bp, R. norvegicus
gtgtggccctgttgga

SEQ ID NO: 513908 - DNA, 16 bp, R. norvegicus
gtgtggcctggctgga

SEQ ID NO: 513909 - DNA, 16 bp, R. norvegicus
gtgtggccttgtaaga

SEQ ID NO: 513910 - DNA, 16 bp, R. norvegicus
gtgtggccttgttgga

SEQ ID NO: 513911 - DNA, 16 bp, R. norvegicus
gtgtggcctttttgga

SEQ ID NO: 513912 - DNA, 16 bp, R. norvegicus
gtgtggctctggctgt

SEQ ID NO: 513913 - DNA, 16 bp, R. norvegicus
gtgtggctgctggaga

SEQ ID NO: 513914 - DNA, 16 bp, R. norvegicus
gtgtgggaggagacag

SEQ ID NO: 513915 - DNA, 16 bp, R. norvegicus
gtgtgggatatggggc

SEQ ID NO: 513916 - DNA, 16 bp, R. norvegicus
gtgtgggcactgggaa

SEQ ID NO: 513917 - DNA, 16 bp, R. norvegicus
gtgtgggcatcctcct

SEQ ID NO: 513918 - DNA, 16 bp, R. norvegicus
gtgtgggctgggagca

SEQ ID NO: 513919 - DNA, 16 bp, R. norvegicus
gtgtggggaactgaac

SEQ ID NO: 513920 - DNA, 16 bp, R. norvegicus
gtgtggggcatgcaga

SEQ ID NO: 513921 - DNA, 16 bp, R. norvegicus
gtgtgggtgctaggaa

SEQ ID NO: 513922 - DNA, 16 bp, R. norvegicus
gtgtggtaaagccttt

SEQ ID NO: 513923 - DNA, 16 bp, R. norvegicus
gtgtggtcctgcttct

SEQ ID NO: 513924 - DNA, 16 bp, R. norvegicus
gtgtggtggcacacct

SEQ ID NO: 513925 - DNA, 16 bp, R. norvegicus
gtgtggtggcacaggc

SEQ ID NO: 513926 - DNA, 16 bp, R. norvegicus
gtgtgtacacacacac

SEQ ID NO: 513927 - DNA, 16 bp, R. norvegicus
gtgtgtacatatacat

SEQ ID NO: 513928 - DNA, 16 bp, R. norvegicus
gtgtgtacatgaatgc

SEQ ID NO: 513929 - DNA, 16 bp, R. norvegicus
gtgtgtacatgtgtgt

SEQ ID NO: 513930 - DNA, 16 bp, R. norvegicus
gtgtgtacgtatgtgc

SEQ ID NO: 513931 - DNA, 16 bp, R. norvegicus
gtgtgtacgtgtacgt

SEQ ID NO: 513932 - DNA, 16 bp, R. norvegicus
gtgtgtactctgtgtg

SEQ ID NO: 513933 - DNA, 16 bp, R. norvegicus
gtgtgtactgggtctg

SEQ ID NO: 513934 - DNA, 16 bp, R. norvegicus
gtgtgtactgtgtgtg

SEQ ID NO: 513935 - DNA, 16 bp, R. norvegicus
gtgtgtatctgtgttt

SEQ ID NO: 513936 - DNA, 16 bp, R. norvegicus
gtgtgtatgagtgagt

SEQ ID NO: 513937 - DNA, 16 bp, R. norvegicus
gtgtgtatgtatacat

SEQ ID NO: 513938 - DNA, 16 bp, R. norvegicus
gtgtgtatttgtatat

SEQ ID NO: 513939 - DNA, 16 bp, R. norvegicus
gtgtgtcaccactgcc

SEQ ID NO: 513940 - DNA, 16 bp, R. norvegicus
gtgtgtccagccacca

SEQ ID NO: 513941 - DNA, 16 bp, R. norvegicus
gtgtgtccctggctgt

SEQ ID NO: 513942 - DNA, 16 bp, R. norvegicus
gtgtgtccctgtgtct

SEQ ID NO: 513943 - DNA, 16 bp, R. norvegicus
gtgtgtccttgttgaa

SEQ ID NO: 513944 - DNA, 16 bp, R. norvegicus
gtgtgtcgctgtgggt

SEQ ID NO: 513945 - DNA, 16 bp, R. norvegicus
gtgtgtctctgtgtgg

SEQ ID NO: 513946 - DNA, 16 bp, R. norvegicus
gtgtgtctgaagataa

SEQ ID NO: 513947 - DNA, 16 bp, R. norvegicus
gtgtgtctgcacacat

SEQ ID NO: 513948 - DNA, 16 bp, R. norvegicus
gtgtgtctgctgtgtg

SEQ ID NO: 513949 - DNA, 16 bp, R. norvegicus
gtgtgtctggggacag

SEQ ID NO: 513950 - DNA, 16 bp, R. norvegicus
gtgtgtctgtatctgt

SEQ ID NO: 513951 - DNA, 16 bp, R. norvegicus
gtgtgtctgtctctct

SEQ ID NO: 513952 - DNA, 16 bp, R. norvegicus
gtgtgtctgtgtccct

SEQ ID NO: 513953 - DNA, 16 bp, R. norvegicus
gtgtgtctgtgtctcc

SEQ ID NO: 513954 - DNA, 16 bp, R. norvegicus
gtgtgtctgtgtttgc

SEQ ID NO: 513955 - DNA, 16 bp, R. norvegicus
gtgtgtcttgttttat

SEQ ID NO: 513956 - DNA, 16 bp, R. norvegicus
gtgtgtgaaagaaatg

SEQ ID NO: 513957 - DNA, 16 bp, R. norvegicus
gtgtgtgaactcatca

SEQ ID NO: 513958 - DNA, 16 bp, R. norvegicus
gtgtgtgagacagaga

SEQ ID NO: 513959 - DNA, 16 bp, R. norvegicus
gtgtgtgagagagaat

SEQ ID NO: 513960 - DNA, 16 bp, R. norvegicus
gtgtgtgagagggaga

SEQ ID NO: 513961 - DNA, 16 bp, R. norvegicus
gtgtgtgagtgtgtgc

SEQ ID NO: 513962 - DNA, 16 bp, R. norvegicus
gtgtgtgagtgtttct

SEQ ID NO: 513963 - DNA, 16 bp, R. norvegicus
gtgtgtgcacacatgc

SEQ ID NO: 513964 - DNA, 16 bp, R. norvegicus
gtgtgtgcacacatgt

SEQ ID NO: 513965 - DNA, 16 bp, R. norvegicus
gtgtgtgcacagtgtg

SEQ ID NO: 513966 - DNA, 16 bp, R. norvegicus
gtgtgtgcacctgtgt

SEQ ID NO: 513967 - DNA, 16 bp, R. norvegicus
gtgtgtgcaggtacat

SEQ ID NO: 513968 - DNA, 16 bp, R. norvegicus
gtgtgtgcatctgtgc

SEQ ID NO: 513969 - DNA, 16 bp, R. norvegicus
gtgtgtgcatgactgt

SEQ ID NO: 513970 - DNA, 16 bp, R. norvegicus
gtgtgtgcatgcaaac

SEQ ID NO: 513971 - DNA, 16 bp, R. norvegicus
gtgtgtgcatgccaca

SEQ ID NO: 513972 - DNA, 16 bp, R. norvegicus
gtgtgtgccaccatgc

SEQ ID NO: 513973 - DNA, 16 bp, R. norvegicus
gtgtgtgcctgcttgt

SEQ ID NO: 513974 - DNA, 16 bp, R. norvegicus
gtgtgtgcgcacgtgc

SEQ ID NO: 513975 - DNA, 16 bp, R. norvegicus
gtgtgtgcgcctgtgc

SEQ ID NO: 513976 - DNA, 16 bp, R. norvegicus
gtgtgtgcgtgcgtgt

SEQ ID NO: 513977 - DNA, 16 bp, R. norvegicus
gtgtgtgcgtgtgtat

SEQ ID NO: 513978 - DNA, 16 bp, R. norvegicus
gtgtgtgctgcatgtg

SEQ ID NO: 513979 - DNA, 16 bp, R. norvegicus
gtgtgtgctgggaacc

SEQ ID NO: 513980 - DNA, 16 bp, R. norvegicus
gtgtgtggaggccagg

SEQ ID NO: 513981 - DNA, 16 bp, R. norvegicus
gtgtgtggcacatgtg

SEQ ID NO: 513982 - DNA, 16 bp, R. norvegicus
gtgtgtggtctgtctg

SEQ ID NO: 513983 - DNA, 16 bp, R. norvegicus
gtgtgtggttcttcct

SEQ ID NO: 513984 - DNA, 16 bp, R. norvegicus
gtgtgtgtacacactc

SEQ ID NO: 513985 - DNA, 16 bp, R. norvegicus
gtgtgtgtacatgaca

SEQ ID NO: 513986 - DNA, 16 bp, R. norvegicus
gtgtgtgtacatgcat

SEQ ID NO: 513987 - DNA, 16 bp, R. norvegicus
gtgtgtgtacatgcct

SEQ ID NO: 513988 - DNA, 16 bp, R. norvegicus
gtgtgtgtacctgtgg

SEQ ID NO: 513989 - DNA, 16 bp, R. norvegicus
gtgtgtgtacttgtgt

SEQ ID NO: 513990 - DNA, 16 bp, R. norvegicus
gtgtgtgtaggggggc

SEQ ID NO: 513991 - DNA, 16 bp, R. norvegicus
gtgtgtgtataatatt

SEQ ID NO: 513992 - DNA, 16 bp, R. norvegicus
gtgtgtgtatacgcac

SEQ ID NO: 513993 - DNA, 16 bp, R. norvegicus
gtgtgtgtatattata

SEQ ID NO: 513994 - DNA, 16 bp, R. norvegicus
gtgtgtgtatgtagtg

SEQ ID NO: 513995 - DNA, 16 bp, R. norvegicus
gtgtgtgtatgtatgt

SEQ ID NO: 513996 - DNA, 16 bp, R. norvegicus
gtgtgtgtatgtctgt

SEQ ID NO: 513997 - DNA, 16 bp, R. norvegicus
gtgtgtgtatgtgtgc

SEQ ID NO: 513998 - DNA, 16 bp, R. norvegicus
gtgtgtgtctatacac

SEQ ID NO: 513999 - DNA, 16 bp, R. norvegicus
gtgtgtgtctctgtgt

SEQ ID NO: 514000 - DNA, 16 bp, R. norvegicus
gtgtgtgtctgagaga

SEQ ID NO: 514001 - DNA, 16 bp, R. norvegicus
gtgtgtgtctgtctct

SEQ ID NO: 514002 - DNA, 16 bp, R. norvegicus
gtgtgtgtctgtgcac

SEQ ID NO: 514003 - DNA, 16 bp, R. norvegicus
gtgtgtgtctgtgctg

SEQ ID NO: 514004 - DNA, 16 bp, R. norvegicus
gtgtgtgtctgtgctt

SEQ ID NO: 514005 - DNA, 16 bp, R. norvegicus
gtgtgtgtgaagggaa

SEQ ID NO: 514006 - DNA, 16 bp, R. norvegicus
gtgtgtgtgaaggttt

SEQ ID NO: 514007 - DNA, 16 bp, R. norvegicus
gtgtgtgtgaatgtgc

SEQ ID NO: 514008 - DNA, 16 bp, R. norvegicus
gtgtgtgtgaatttta

SEQ ID NO: 514009 - DNA, 16 bp, R. norvegicus
gtgtgtgtgagagagt

SEQ ID NO: 514010 - DNA, 16 bp, R. norvegicus
gtgtgtgtgagcacag

SEQ ID NO: 514011 - DNA, 16 bp, R. norvegicus
gtgtgtgtgcacacat

SEQ ID NO: 514012 - DNA, 16 bp, R. norvegicus
gtgtgtgtgcacagac

SEQ ID NO: 514013 - DNA, 16 bp, R. norvegicus
gtgtgtgtgcacatgt

SEQ ID NO: 514014 - DNA, 16 bp, R. norvegicus
gtgtgtgtgcacgagc

SEQ ID NO: 514015 - DNA, 16 bp, R. norvegicus
gtgtgtgtgcatgtgc

SEQ ID NO: 514016 - DNA, 16 bp, R. norvegicus
gtgtgtgtgcctgtct

SEQ ID NO: 514017 - DNA, 16 bp, R. norvegicus
gtgtgtgtgcctgttg

SEQ ID NO: 514018 - DNA, 16 bp, R. norvegicus
gtgtgtgtgcgagcac

SEQ ID NO: 514019 - DNA, 16 bp, R. norvegicus
gtgtgtgtgcgctcat

SEQ ID NO: 514020 - DNA, 16 bp, R. norvegicus
gtgtgtgtgcgtgagc

SEQ ID NO: 514021 - DNA, 16 bp, R. norvegicus
gtgtgtgtgctgggga

SEQ ID NO: 514022 - DNA, 16 bp, R. norvegicus
gtgtgtgtggccttgt

SEQ ID NO: 514023 - DNA, 16 bp, R. norvegicus
gtgtgtgtggtgggca

SEQ ID NO: 514024 - DNA, 16 bp, R. norvegicus
gtgtgtgtggtgtact

SEQ ID NO: 514025 - DNA, 16 bp, R. norvegicus
gtgtgtgtgtaacata

SEQ ID NO: 514026 - DNA, 16 bp, R. norvegicus
gtgtgtgtgtaaggga

SEQ ID NO: 514027 - DNA, 16 bp, R. norvegicus
gtgtgtgtgtaatata

SEQ ID NO: 514028 - DNA, 16 bp, R. norvegicus
gtgtgtgtgtacacac

SEQ ID NO: 514029 - DNA, 16 bp, R. norvegicus
gtgtgtgtgtacatca

SEQ ID NO: 514030 - DNA, 16 bp, R. norvegicus
gtgtgtgtgtagaggc

SEQ ID NO: 514031 - DNA, 16 bp, R. norvegicus
gtgtgtgtgtagtgct

SEQ ID NO: 514032 - DNA, 16 bp, R. norvegicus
gtgtgtgtgtataccc

SEQ ID NO: 514033 - DNA, 16 bp, R. norvegicus
gtgtgtgtgtccctct

SEQ ID NO: 514034 - DNA, 16 bp, R. norvegicus
gtgtgtgtgtccgtgt

SEQ ID NO: 514035 - DNA, 16 bp, R. norvegicus
gtgtgtgtgtctggct

SEQ ID NO: 514036 - DNA, 16 bp, R. norvegicus
gtgtgtgtgtcttccc

SEQ ID NO: 514037 - DNA, 16 bp, R. norvegicus
gtgtgtgtgtgaagcc

SEQ ID NO: 514038 - DNA, 16 bp, R. norvegicus
gtgtgtgtgtgagtga

SEQ ID NO: 514039 - DNA, 16 bp, R. norvegicus
gtgtgtgtgtgatctt

SEQ ID NO: 514040 - DNA, 16 bp, R. norvegicus
gtgtgtgtgtgcagga

SEQ ID NO: 514041 - DNA, 16 bp, R. norvegicus
gtgtgtgtgtgcaggc

SEQ ID NO: 514042 - DNA, 17 bp, R. norvegicus
gtgtgtgtgtgcgcgcg

SEQ ID NO: 514043 - DNA, 16 bp, R. norvegicus
gtgtgtgtgtgcgtgc

SEQ ID NO: 514044 - DNA, 16 bp, R. norvegicus
gtgtgtgtgtgtaaaa

SEQ ID NO: 514045 - DNA, 16 bp, R. norvegicus
gtgtgtgtgtgtaatg

SEQ ID NO: 514046 - DNA, 16 bp, R. norvegicus
gtgtgtgtgtgtatat

SEQ ID NO: 514047 - DNA, 16 bp, R. norvegicus
gtgtgtgtgtgtatga

SEQ ID NO: 514048 - DNA, 16 bp, R. norvegicus
gtgtgtgtgtgtcata

SEQ ID NO: 514049 - DNA, 16 bp, R. norvegicus
gtgtgtgtgtgtgcac

SEQ ID NO: 514050 - DNA, 18 bp, R. norvegicus
gtgtgtgtgtgtgtaatc

SEQ ID NO: 514051 - DNA, 16 bp, R. norvegicus
gtgtgtgtgtgttaac

SEQ ID NO: 514052 - DNA, 16 bp, R. norvegicus
gtgtgtgtgtgttaag

SEQ ID NO: 514053 - DNA, 16 bp, R. norvegicus
gtgtgtgtgttactgc

SEQ ID NO: 514054 - DNA, 16 bp, R. norvegicus
gtgtgtgtgttctcta

SEQ ID NO: 514055 - DNA, 16 bp, R. norvegicus
gtgtgtgtgttctgcc

SEQ ID NO: 514056 - DNA, 16 bp, R. norvegicus
gtgtgtgtgttgcaca

SEQ ID NO: 514057 - DNA, 16 bp, R. norvegicus
gtgtgtgtgttggaga

SEQ ID NO: 514058 - DNA, 16 bp, R. norvegicus
gtgtgtgtgttttacc

SEQ ID NO: 514059 - DNA, 16 bp, R. norvegicus
gtgtgtgttgtgtgca

SEQ ID NO: 514060 - DNA, 16 bp, R. norvegicus
gtgtgtgtttatatat

SEQ ID NO: 514061 - DNA, 16 bp, R. norvegicus
gtgtgtgtttatttca

SEQ ID NO: 514062 - DNA, 16 bp, R. norvegicus
gtgtgtgtttcatatg

SEQ ID NO: 514063 - DNA, 16 bp, R. norvegicus
gtgtgtgtttgcgcgc

SEQ ID NO: 514064 - DNA, 16 bp, R. norvegicus
gtgtgtgttttattca

SEQ ID NO: 514065 - DNA, 16 bp, R. norvegicus
gtgtgttactgggggt

SEQ ID NO: 514066 - DNA, 16 bp, R. norvegicus
gtgtgttctttgtgac

SEQ ID NO: 514067 - DNA, 16 bp, R. norvegicus
gtgtgtttatgtacat

SEQ ID NO: 514068 - DNA, 16 bp, R. norvegicus
gtgtgtttctgtatgt

SEQ ID NO: 514069 - DNA, 17 bp, R. norvegicus
gtgttacaaagagaact

SEQ ID NO: 514070 - DNA, 16 bp, R. norvegicus
gtgttcaagatgctgc

SEQ ID NO: 514071 - DNA, 16 bp, R. norvegicus
gtgttcatcttggtgg

SEQ ID NO: 514072 - DNA, 16 bp, R. norvegicus
gtgttcattgtgctgt

SEQ ID NO: 514073 - DNA, 16 bp, R. norvegicus
gtgttccaagcttttg

SEQ ID NO: 514074 - DNA, 16 bp, R. norvegicus
gtgttccagatgcttc

SEQ ID NO: 514075 - DNA, 16 bp, R. norvegicus
gtgttccagcatcttg

SEQ ID NO: 514076 - DNA, 16 bp, R. norvegicus
gtgttccattatgttc

SEQ ID NO: 514077 - DNA, 16 bp, R. norvegicus
gtgttcccccatgcat

SEQ ID NO: 514078 - DNA, 16 bp, R. norvegicus
gtgttccccctcccta

SEQ ID NO: 514079 - DNA, 16 bp, R. norvegicus
gtgttcctcttcccat

SEQ ID NO: 514080 - DNA, 16 bp, R. norvegicus
gtgttcctggatttgg

SEQ ID NO: 514081 - DNA, 16 bp, R. norvegicus
gtgttcctgtgtgtgt

SEQ ID NO: 514082 - DNA, 16 bp, R. norvegicus
gtgttccttctgcttc

SEQ ID NO: 514083 - DNA, 16 bp, R. norvegicus
gtgttcttggattcat

SEQ ID NO: 514084 - DNA, 16 bp, R. norvegicus
gtgttctttcatgtga

SEQ ID NO: 514085 - DNA, 16 bp, R. norvegicus
gtgttctttgagcttt

SEQ ID NO: 514086 - DNA, 16 bp, R. norvegicus
gtgttcttttatgtgt

SEQ ID NO: 514087 - DNA, 16 bp, R. norvegicus
gtgttcttttcagctt

SEQ ID NO: 514088 - DNA, 16 bp, R. norvegicus
gtgttgaaatttgtca

SEQ ID NO: 514089 - DNA, 16 bp, R. norvegicus
gtgttgctgctgctgt

SEQ ID NO: 514090 - DNA, 16 bp, R. norvegicus
gtgttgggaattgaac

SEQ ID NO: 514091 - DNA, 16 bp, R. norvegicus
gtgttgggagcctcat

SEQ ID NO: 514092 - DNA, 16 bp, R. norvegicus
gtgttgtggtgacctc

SEQ ID NO: 514093 - DNA, 16 bp, R. norvegicus
gtgttgttttgagaca

SEQ ID NO: 514094 - DNA, 16 bp, R. norvegicus
gtgtttacattttaaa

SEQ ID NO: 514095 - DNA, 16 bp, R. norvegicus
gtgtttatggatggga

SEQ ID NO: 514096 - DNA, 16 bp, R. norvegicus
gtgtttcactgtgggc

SEQ ID NO: 514097 - DNA, 16 bp, R. norvegicus
gtgtttcccttgctcc

SEQ ID NO: 514098 - DNA, 16 bp, R. norvegicus
gtgtttcctcagggtc

SEQ ID NO: 514099 - DNA, 16 bp, R. norvegicus
gtgtttcctgtatgtg

SEQ ID NO: 514100 - DNA, 16 bp, R. norvegicus
gtgtttccttgttctg

SEQ ID NO: 514101 - DNA, 31 bp, R. norvegicus
gtgtttctcagccatttggcattcctcagct

SEQ ID NO: 514102 - DNA, 16 bp, R. norvegicus
gtgtttctgcatgtgt

SEQ ID NO: 514103 - DNA, 16 bp, R. norvegicus
gtgtttcttctgtgtc

SEQ ID NO: 514104 - DNA, 16 bp, R. norvegicus
gtgtttctttgtgatt

SEQ ID NO: 514105 - DNA, 16 bp, R. norvegicus
gtgtttgaagacagcg

SEQ ID NO: 514106 - DNA, 16 bp, R. norvegicus
gtgtttgaagacagct

SEQ ID NO: 514107 - DNA, 16 bp, R. norvegicus
gtgtttgtagacacct

SEQ ID NO: 514108 - DNA, 16 bp, R. norvegicus
gtgtttgtagcatttt

SEQ ID NO: 514109 - DNA, 16 bp, R. norvegicus
gtgtttgtatgtatgc

SEQ ID NO: 514110 - DNA, 16 bp, R. norvegicus
gtgtttgtgtctgtat

SEQ ID NO: 514111 - DNA, 16 bp, R. norvegicus
gtgtttgtgtgtattc

SEQ ID NO: 514112 - DNA, 16 bp, R. norvegicus
gtgttttctcacagca

SEQ ID NO: 514113 - DNA, 16 bp, R. norvegicus
gtgttttgccttctgt

SEQ ID NO: 514114 - DNA, 16 bp, R. norvegicus
gtgttttgttgccaag

SEQ ID NO: 514115 - DNA, 16 bp, R. norvegicus
gtgtttttcctgcatg

SEQ ID NO: 514116 - DNA, 16 bp, R. norvegicus
gttaaaaatgctttct

SEQ ID NO: 514117 - DNA, 18 bp, R. norvegicus
gttaaagctttcagattc

SEQ ID NO: 514118 - DNA, 16 bp, R. norvegicus
gttaaatcaggaagaa

SEQ ID NO: 514119 - DNA, 17 bp, R. norvegicus
gttaagaaaaaggatct

SEQ ID NO: 514120 - DNA, 17 bp, R. norvegicus
gttaagagcacccaact

SEQ ID NO: 514121 - DNA, 16 bp, R. norvegicus
gttaagagcactgacc

SEQ ID NO: 514122 - DNA, 16 bp, R. norvegicus
gttaagagcactgact

SEQ ID NO: 514123 - DNA, 16 bp, R. norvegicus
gttaagagcattgact

SEQ ID NO: 514124 - DNA, 16 bp, R. norvegicus
gttaagtgttttcctc

SEQ ID NO: 514125 - DNA, 16 bp, R. norvegicus
gttaataaaggtgaaa

SEQ ID NO: 514126 - DNA, 16 bp, R. norvegicus
gttaattttggagaag

SEQ ID NO: 514127 - DNA, 16 bp, R. norvegicus
gttaattttttatcca

SEQ ID NO: 514128 - DNA, 16 bp, R. norvegicus
gttacagacaattgtg

SEQ ID NO: 514129 - DNA, 16 bp, R. norvegicus
gttacagacacactgg

SEQ ID NO: 514130 - DNA, 16 bp, R. norvegicus
gttacctccagtgttc

SEQ ID NO: 514131 - DNA, 16 bp, R. norvegicus
gttacttatagggaga

SEQ ID NO: 514132 - DNA, 16 bp, R. norvegicus
gttactttgttttgct

SEQ ID NO: 514133 - DNA, 19 bp, R. norvegicus
gttagaattaagtatgact

SEQ ID NO: 514134 - DNA, 16 bp, R. norvegicus
gttagagatgtcagag

SEQ ID NO: 514135 - DNA, 16 bp, R. norvegicus
gttagaggttgaatta

SEQ ID NO: 514136 - DNA, 16 bp, R. norvegicus
gttagcctagaactca

SEQ ID NO: 514137 - DNA, 16 bp, R. norvegicus
gttaggaatttggcag

SEQ ID NO: 514138 - DNA, 16 bp, R. norvegicus
gttagggttttaccgc

SEQ ID NO: 514139 - DNA, 16 bp, R. norvegicus
gttaggtggaatttta

SEQ ID NO: 514140 - DNA, 16 bp, R. norvegicus
gttagtgtcacaccaa

SEQ ID NO: 514141 - DNA, 16 bp, R. norvegicus
gttatagtttaaactt

SEQ ID NO: 514142 - DNA, 16 bp, R. norvegicus
gttatatatacatata

SEQ ID NO: 514143 - DNA, 16 bp, R. norvegicus
gttatcaaaaaaaata

SEQ ID NO: 514144 - DNA, 16 bp, R. norvegicus
gttatcagttcagtgg

SEQ ID NO: 514145 - DNA, 16 bp, R. norvegicus
gttatcctctgacctc

SEQ ID NO: 514146 - DNA, 16 bp, R. norvegicus
gttatgaaacataatg

SEQ ID NO: 514147 - DNA, 16 bp, R. norvegicus
gttattcttcctatgg

SEQ ID NO: 514148 - DNA, 16 bp, R. norvegicus
gttattgaagaccatc

SEQ ID NO: 514149 - DNA, 16 bp, R. norvegicus
gttatttactggaaaa

SEQ ID NO: 514150 - DNA, 16 bp, R. norvegicus
gttatttccagtttct

SEQ ID NO: 514151 - DNA, 16 bp, R. norvegicus
gttatttgtctcactg

SEQ ID NO: 514152 - DNA, 16 bp, R. norvegicus
gttcaaagaaacaagc

SEQ ID NO: 514153 - DNA, 16 bp, R. norvegicus
gttcaaagcacacatt

SEQ ID NO: 514154 - DNA, 16 bp, R. norvegicus
gttcaaagccaatctg

SEQ ID NO: 514155 - DNA, 16 bp, R. norvegicus
gttcaaatctcagcac

SEQ ID NO: 514156 - DNA, 16 bp, R. norvegicus
gttcaacatcttcagt

SEQ ID NO: 514157 - DNA, 16 bp, R. norvegicus
gttcaaccaaaagtca

SEQ ID NO: 514158 - DNA, 16 bp, R. norvegicus
gttcaacttccaagta

SEQ ID NO: 514159 - DNA, 16 bp, R. norvegicus
gttcaagaaattttcc

SEQ ID NO: 514160 - DNA, 16 bp, R. norvegicus
gttcaagaccaaccta

SEQ ID NO: 514161 - DNA, 16 bp, R. norvegicus
gttcaagagcagcctg

SEQ ID NO: 514162 - DNA, 16 bp, R. norvegicus
gttcaagatcaacctg

SEQ ID NO: 514163 - DNA, 16 bp, R. norvegicus
gttcaagatcattctt

SEQ ID NO: 514164 - DNA, 16 bp, R. norvegicus
gttcaaggacaaccag

SEQ ID NO: 514165 - DNA, 16 bp, R. norvegicus
gttcaaggctagtctg

SEQ ID NO: 514166 - DNA, 16 bp, R. norvegicus
gttcaaggctatcctg

SEQ ID NO: 514167 - DNA, 16 bp, R. norvegicus
gttcaaggtcacccta

SEQ ID NO: 514168 - DNA, 16 bp, R. norvegicus
gttcaaggtcaccctt

SEQ ID NO: 514169 - DNA, 16 bp, R. norvegicus
gttcaaggtcagtctt

SEQ ID NO: 514170 - DNA, 16 bp, R. norvegicus
gttcaagtccaagtga

SEQ ID NO: 514171 - DNA, 16 bp, R. norvegicus
gttcaataaatgaaaa

SEQ ID NO: 514172 - DNA, 16 bp, R. norvegicus
gttcaatggcttgctg

SEQ ID NO: 514173 - DNA, 16 bp, R. norvegicus
gttcaattcccaacac

SEQ ID NO: 514174 - DNA, 17 bp, R. norvegicus
gttcaattcccagcaat

SEQ ID NO: 514175 - DNA, 16 bp, R. norvegicus
gttcacaccttgattt

SEQ ID NO: 514176 - DNA, 16 bp, R. norvegicus
gttcacagaagagctg

SEQ ID NO: 514177 - DNA, 16 bp, R. norvegicus
gttcacagcttttctt

SEQ ID NO: 514178 - DNA, 16 bp, R. norvegicus
gttcacaggttcacag

SEQ ID NO: 514179 - DNA, 16 bp, R. norvegicus
gttcacagtatatata

SEQ ID NO: 514180 - DNA, 20 bp, R. norvegicus
gttcacttgtgttcttctac

SEQ ID NO: 514181 - DNA, 26 bp, R. norvegicus
gttcacttgtgttcttctacctacag

SEQ ID NO: 514182 - DNA, 16 bp, R. norvegicus
gttcactttaagaaca

SEQ ID NO: 514183 - DNA, 16 bp, R. norvegicus
gttcagaatacccaag

SEQ ID NO: 514184 - DNA, 16 bp, R. norvegicus
gttcagaccccagcac

SEQ ID NO: 514185 - DNA, 16 bp, R. norvegicus
gttcagagccccagca

SEQ ID NO: 514186 - DNA, 16 bp, R. norvegicus
gttcagatcccagcaa

SEQ ID NO: 514187 - DNA, 16 bp, R. norvegicus
gttcaggaaacttttt

SEQ ID NO: 514188 - DNA, 16 bp, R. norvegicus
gttcaggaccctcagc

SEQ ID NO: 514189 - DNA, 16 bp, R. norvegicus
gttcaggcacccagat

SEQ ID NO: 514190 - DNA, 16 bp, R. norvegicus
gttcagggacagcctg

SEQ ID NO: 514191 - DNA, 16 bp, R. norvegicus
gttcagtacccagctc

SEQ ID NO: 514192 - DNA, 16 bp, R. norvegicus
gttcagtagttaagag

SEQ ID NO: 514193 - DNA, 16 bp, R. norvegicus
gttcagtccattatca

SEQ ID NO: 514194 - DNA, 16 bp, R. norvegicus
gttcagtcccagcacc

SEQ ID NO: 514195 - DNA, 16 bp, R. norvegicus
gttcagtctctgtggg

SEQ ID NO: 514196 - DNA, 16 bp, R. norvegicus
gttcagtctgttcctg

SEQ ID NO: 514197 - DNA, 16 bp, R. norvegicus
gttcagtgaagaattc

SEQ ID NO: 514198 - DNA, 16 bp, R. norvegicus
gttcagtggctaaaag

SEQ ID NO: 514199 - DNA, 16 bp, R. norvegicus
gttcagtggtatgctg

SEQ ID NO: 514200 - DNA, 16 bp, R. norvegicus
gttcagttcccagcac

SEQ ID NO: 514201 - DNA, 16 bp, R. norvegicus
gttcagttccccacac

SEQ ID NO: 514202 - DNA, 16 bp, R. norvegicus
gttcagttctcaacac

SEQ ID NO: 514203 - DNA, 16 bp, R. norvegicus
gttcagttctcagcac

SEQ ID NO: 514204 - DNA, 16 bp, R. norvegicus
gttcatcagcaaagga

SEQ ID NO: 514205 - DNA, 16 bp, R. norvegicus
gttcatcttccatgta

SEQ ID NO: 514206 - DNA, 16 bp, R. norvegicus
gttcatcttgatggat

SEQ ID NO: 514207 - DNA, 19 bp, R. norvegicus
gttcatggaaaatccccag

SEQ ID NO: 514208 - DNA, 16 bp, R. norvegicus
gttcattattgaagga

SEQ ID NO: 514209 - DNA, 16 bp, R. norvegicus
gttcatttgtgtgtga

SEQ ID NO: 514210 - DNA, 16 bp, R. norvegicus
gttccaacagagaact

SEQ ID NO: 514211 - DNA, 16 bp, R. norvegicus
gttccaagaaacaagc

SEQ ID NO: 514212 - DNA, 16 bp, R. norvegicus
gttccacctgagaact

SEQ ID NO: 514213 - DNA, 16 bp, R. norvegicus
gttccagaaaagcctt

SEQ ID NO: 514214 - DNA, 16 bp, R. norvegicus
gttccagaacaaccag

SEQ ID NO: 514215 - DNA, 16 bp, R. norvegicus
gttccagaacagccag

SEQ ID NO: 514216 - DNA, 16 bp, R. norvegicus
gttccagagggagaag

SEQ ID NO: 514217 - DNA, 16 bp, R. norvegicus
gttccagatgatgttt

SEQ ID NO: 514218 - DNA, 16 bp, R. norvegicus
gttccagcacagccag

SEQ ID NO: 514219 - DNA, 16 bp, R. norvegicus
gttccaggaaggtggc

SEQ ID NO: 514220 - DNA, 16 bp, R. norvegicus
gttccaggacagacag

SEQ ID NO: 514221 - DNA, 16 bp, R. norvegicus
gttccaggacagcaag

SEQ ID NO: 514222 - DNA, 16 bp, R. norvegicus
gttccaggacagcagg

SEQ ID NO: 514223 - DNA, 16 bp, R. norvegicus
gttccaggatacccag

SEQ ID NO: 514224 - DNA, 16 bp, R. norvegicus
gttccaggccagactg

SEQ ID NO: 514225 - DNA, 16 bp, R. norvegicus
gttccaggccagccag

SEQ ID NO: 514226 - DNA, 16 bp, R. norvegicus
gttccaggggatctga

SEQ ID NO: 514227 - DNA, 16 bp, R. norvegicus
gttccaggtcatccag

SEQ ID NO: 514228 - DNA, 16 bp, R. norvegicus
gttccaggttcagaga

SEQ ID NO: 514229 - DNA, 16 bp, R. norvegicus
gttccattcattttcc

SEQ ID NO: 514230 - DNA, 16 bp, R. norvegicus
gttccatttccagcac

SEQ ID NO: 514231 - DNA, 16 bp, R. norvegicus
gttcccaacacctaca

SEQ ID NO: 514232 - DNA, 16 bp, R. norvegicus
gttcccaaggcaggct

SEQ ID NO: 514233 - DNA, 16 bp, R. norvegicus
gttcccagaaataaga

SEQ ID NO: 514234 - DNA, 16 bp, R. norvegicus
gttcccagaattccaa

SEQ ID NO: 514235 - DNA, 16 bp, R. norvegicus
gttcccagctggtgtg

SEQ ID NO: 514236 - DNA, 16 bp, R. norvegicus
gttcccagtacctaca

SEQ ID NO: 514237 - DNA, 16 bp, R. norvegicus
gttcccatggcaggtc

SEQ ID NO: 514238 - DNA, 16 bp, R. norvegicus
gttcccctatcctggg

SEQ ID NO: 514239 - DNA, 16 bp, R. norvegicus
gttcccctcccaaacc

SEQ ID NO: 514240 - DNA, 16 bp, R. norvegicus
gttccctcacccaccc

SEQ ID NO: 514241 - DNA, 16 bp, R. norvegicus
gttccctcctctcaaa

SEQ ID NO: 514242 - DNA, 16 bp, R. norvegicus
gttccctgagccctgg

SEQ ID NO: 514243 - DNA, 18 bp, R. norvegicus
gttccggtggtgtctcag

SEQ ID NO: 514244 - DNA, 73 bp, R. norvegicus
gttcctcagaaaattggacattgaactgcctgatgatccagctatacctctcttgggcatatacccaaaagat

SEQ ID NO: 514245 - DNA, 16 bp, R. norvegicus
gttcctcaggagctgt

SEQ ID NO: 514246 - DNA, 16 bp, R. norvegicus
gttcctcaggttgtgg

SEQ ID NO: 514247 - DNA, 16 bp, R. norvegicus
gttcctctagagaacc

SEQ ID NO: 514248 - DNA, 16 bp, R. norvegicus
gttcctctcccaaccc

SEQ ID NO: 514249 - DNA, 16 bp, R. norvegicus
gttcctctccccattc

SEQ ID NO: 514250 - DNA, 16 bp, R. norvegicus
gttcctctttctccag

SEQ ID NO: 514251 - DNA, 16 bp, R. norvegicus
gttcctgagagaaggg

SEQ ID NO: 514252 - DNA, 16 bp, R. norvegicus
gttcctgcagcagctt

SEQ ID NO: 514253 - DNA, 16 bp, R. norvegicus
gttcctgccatgactt

SEQ ID NO: 514254 - DNA, 16 bp, R. norvegicus
gttcctgccttgaggt

SEQ ID NO: 514255 - DNA, 16 bp, R. norvegicus
gttcctgctgctgctg

SEQ ID NO: 514256 - DNA, 16 bp, R. norvegicus
gttcctggaagctctg

SEQ ID NO: 514257 - DNA, 16 bp, R. norvegicus
gttcctgtcaacctgc

SEQ ID NO: 514258 - DNA, 16 bp, R. norvegicus
gttcctgtctacaagc

SEQ ID NO: 514259 - DNA, 16 bp, R. norvegicus
gttcctgtctctgcct

SEQ ID NO: 514260 - DNA, 16 bp, R. norvegicus
gttcctgtcttaaaga

SEQ ID NO: 514261 - DNA, 16 bp, R. norvegicus
gttcctgtcttgactt

SEQ ID NO: 514262 - DNA, 16 bp, R. norvegicus
gttcctgtgccctgtg

SEQ ID NO: 514263 - DNA, 16 bp, R. norvegicus
gttcctgtggggctgt

SEQ ID NO: 514264 - DNA, 16 bp, R. norvegicus
gttccttcattctctg

SEQ ID NO: 514265 - DNA, 16 bp, R. norvegicus
gttccttcggcctctg

SEQ ID NO: 514266 - DNA, 16 bp, R. norvegicus
gttccttctcattctc

SEQ ID NO: 514267 - DNA, 16 bp, R. norvegicus
gttccttctgtttata

SEQ ID NO: 514268 - DNA, 16 bp, R. norvegicus
gttccttggggcaagt

SEQ ID NO: 514269 - DNA, 16 bp, R. norvegicus
gttcctttcccagcac

SEQ ID NO: 514270 - DNA, 16 bp, R. norvegicus
gttcgagatgctgccc

SEQ ID NO: 514271 - DNA, 16 bp, R. norvegicus
gttcgaggccagactg

SEQ ID NO: 514272 - DNA, 16 bp, R. norvegicus
gttcgaggccagtgtg

SEQ ID NO: 514273 - DNA, 16 bp, R. norvegicus
gttcgagtggagacgc

SEQ ID NO: 514274 - DNA, 23 bp, R. norvegicus
gttcgctcgtggggtgctgccca

SEQ ID NO: 514275 - DNA, 16 bp, R. norvegicus
gttcggtgcccagctc

SEQ ID NO: 514276 - DNA, 16 bp, R. norvegicus
gttctacaacttcatc

SEQ ID NO: 514277 - DNA, 16 bp, R. norvegicus
gttctacatcttaatc

SEQ ID NO: 514278 - DNA, 16 bp, R. norvegicus
gttctaccagcacctg

SEQ ID NO: 514279 - DNA, 16 bp, R. norvegicus
gttctaggacagcctg

SEQ ID NO: 514280 - DNA, 16 bp, R. norvegicus
gttctaggtgctgtga

SEQ ID NO: 514281 - DNA, 16 bp, R. norvegicus
gttctcaacctgtggt

SEQ ID NO: 514282 - DNA, 16 bp, R. norvegicus
gttctcacagagaaag

SEQ ID NO: 514283 - DNA, 16 bp, R. norvegicus
gttctcagctctggaa

SEQ ID NO: 514284 - DNA, 16 bp, R. norvegicus
gttctcagctgtgcct

SEQ ID NO: 514285 - DNA, 16 bp, R. norvegicus
gttctcagttcagtgg

SEQ ID NO: 514286 - DNA, 16 bp, R. norvegicus
gttctcatccaaactc

SEQ ID NO: 514287 - DNA, 16 bp, R. norvegicus
gttctccaagcagttc

SEQ ID NO: 514288 - DNA, 16 bp, R. norvegicus
gttctcctcttccacc

SEQ ID NO: 514289 - DNA, 16 bp, R. norvegicus
gttctctcagctgctt

SEQ ID NO: 514290 - DNA, 16 bp, R. norvegicus
gttctctccagtttct

SEQ ID NO: 514291 - DNA, 16 bp, R. norvegicus
gttctctccttccacc

SEQ ID NO: 514292 - DNA, 16 bp, R. norvegicus
gttctctccttttatc

SEQ ID NO: 514293 - DNA, 16 bp, R. norvegicus
gttctctgcatccaaa

SEQ ID NO: 514294 - DNA, 16 bp, R. norvegicus
gttctctgctcttaca

SEQ ID NO: 514295 - DNA, 16 bp, R. norvegicus
gttctctggaggaaca

SEQ ID NO: 514296 - DNA, 16 bp, R. norvegicus
gttctctggtggactt

SEQ ID NO: 514297 - DNA, 16 bp, R. norvegicus
gttctcttctaccatg

SEQ ID NO: 514298 - DNA, 16 bp, R. norvegicus
gttctcttcttccacc

SEQ ID NO: 514299 - DNA, 16 bp, R. norvegicus
gttctgagtacttgac

SEQ ID NO: 514300 - DNA, 48 bp, R. norvegicus
gttctgcagtcatctgaacaaaactgtagagacatccagcacactcca

SEQ ID NO: 514301 - DNA, 16 bp, R. norvegicus
gttctgcatcttcatc

SEQ ID NO: 514302 - DNA, 16 bp, R. norvegicus
gttctgcatcttgatc

SEQ ID NO: 514303 - DNA, 16 bp, R. norvegicus
gttctgcatcttgttc

SEQ ID NO: 514304 - DNA, 16 bp, R. norvegicus
gttctgccagcacctg

SEQ ID NO: 514305 - DNA, 16 bp, R. norvegicus
gttctgccccacagtt

SEQ ID NO: 514306 - DNA, 16 bp, R. norvegicus
gttctgcctgcctctg

SEQ ID NO: 514307 - DNA, 16 bp, R. norvegicus
gttctgcctgggctgc

SEQ ID NO: 514308 - DNA, 16 bp, R. norvegicus
gttctggaagttctag

SEQ ID NO: 514309 - DNA, 16 bp, R. norvegicus
gttctggctgtcctgg

SEQ ID NO: 514310 - DNA, 16 bp, R. norvegicus
gttctgggaaagggct

SEQ ID NO: 514311 - DNA, 16 bp, R. norvegicus
gttctggggaatctga

SEQ ID NO: 514312 - DNA, 16 bp, R. norvegicus
gttctgggggtcaaac

SEQ ID NO: 514313 - DNA, 16 bp, R. norvegicus
gttctgggtcccttag

SEQ ID NO: 514314 - DNA, 16 bp, R. norvegicus
gttctggttattataa

SEQ ID NO: 514315 - DNA, 16 bp, R. norvegicus
gttctgtctctgtgag

SEQ ID NO: 514316 - DNA, 16 bp, R. norvegicus
gttctgtgaaggctct

SEQ ID NO: 514317 - DNA, 16 bp, R. norvegicus
gttctgtgactccaga

SEQ ID NO: 514318 - DNA, 16 bp, R. norvegicus
gttctgtgcaagagca

SEQ ID NO: 514319 - DNA, 16 bp, R. norvegicus
gttctgtggatctagg

SEQ ID NO: 514320 - DNA, 16 bp, R. norvegicus
gttctgtggattgtgt

SEQ ID NO: 514321 - DNA, 16 bp, R. norvegicus
gttctgttctgttctc

SEQ ID NO: 514322 - DNA, 16 bp, R. norvegicus
gttcttaacttctgag

SEQ ID NO: 514323 - DNA, 16 bp, R. norvegicus
gttcttcaacagaaga

SEQ ID NO: 514324 - DNA, 16 bp, R. norvegicus
gttcttcagacaggtt

SEQ ID NO: 514325 - DNA, 16 bp, R. norvegicus
gttcttccagaggaca

SEQ ID NO: 514326 - DNA, 16 bp, R. norvegicus
gttcttccagaggacc

SEQ ID NO: 514327 - DNA, 16 bp, R. norvegicus
gttcttccaggggacc

SEQ ID NO: 514328 - DNA, 16 bp, R. norvegicus
gttcttccagttcttt

SEQ ID NO: 514329 - DNA, 16 bp, R. norvegicus
gttcttcgggtagtcc

SEQ ID NO: 514330 - DNA, 16 bp, R. norvegicus
gttcttctacatgctg

SEQ ID NO: 514331 - DNA, 16 bp, R. norvegicus
gttcttctgccagctc

SEQ ID NO: 514332 - DNA, 16 bp, R. norvegicus
gttcttctttctccac

SEQ ID NO: 514333 - DNA, 16 bp, R. norvegicus
gttcttctttctccat

SEQ ID NO: 514334 - DNA, 16 bp, R. norvegicus
gttcttgaagaccagc

SEQ ID NO: 514335 - DNA, 16 bp, R. norvegicus
gttcttgctgttcttg

SEQ ID NO: 514336 - DNA, 16 bp, R. norvegicus
gttcttggacttggcc

SEQ ID NO: 514337 - DNA, 16 bp, R. norvegicus
gttcttggtggtcatt

SEQ ID NO: 514338 - DNA, 16 bp, R. norvegicus
gttcttgtcggcctgc

SEQ ID NO: 514339 - DNA, 16 bp, R. norvegicus
gttctttatacatttt

SEQ ID NO: 514340 - DNA, 16 bp, R. norvegicus
gttctttatgtatttc

SEQ ID NO: 514341 - DNA, 16 bp, R. norvegicus
gttctttccattttct

SEQ ID NO: 514342 - DNA, 16 bp, R. norvegicus
gttctttcttcattgc

SEQ ID NO: 514343 - DNA, 16 bp, R. norvegicus
gttctttgagaaaata

SEQ ID NO: 514344 - DNA, 16 bp, R. norvegicus
gttctttgctgcttct

SEQ ID NO: 514345 - DNA, 16 bp, R. norvegicus
gttctttgtgtttcta

SEQ ID NO: 514346 - DNA, 16 bp, R. norvegicus
gttcttttgctgtgaa

SEQ ID NO: 514347 - DNA, 16 bp, R. norvegicus
gttcttttgggactgg

SEQ ID NO: 514348 - DNA, 16 bp, R. norvegicus
gttgaaaatgttttct

SEQ ID NO: 514349 - DNA, 16 bp, R. norvegicus
gttgaaagagctgaag

SEQ ID NO: 514350 - DNA, 16 bp, R. norvegicus
gttgaaccagccagag

SEQ ID NO: 514351 - DNA, 16 bp, R. norvegicus
gttgaaccagtgccat

SEQ ID NO: 514352 - DNA, 16 bp, R. norvegicus
gttgaagaagaagaag

SEQ ID NO: 514353 - DNA, 16 bp, R. norvegicus
gttgaagatgctttct

SEQ ID NO: 514354 - DNA, 16 bp, R. norvegicus
gttgaaggaaacagag

SEQ ID NO: 514355 - DNA, 16 bp, R. norvegicus
gttgaaggaggtgtgg

SEQ ID NO: 514356 - DNA, 16 bp, R. norvegicus
gttgaaggagtcagag

SEQ ID NO: 514357 - DNA, 16 bp, R. norvegicus
gttgaaggccatctgg

SEQ ID NO: 514358 - DNA, 16 bp, R. norvegicus
gttgaagtccagcctt

SEQ ID NO: 514359 - DNA, 16 bp, R. norvegicus
gttgaagtgtggttca

SEQ ID NO: 514360 - DNA, 16 bp, R. norvegicus
gttgaattagggaaga

SEQ ID NO: 514361 - DNA, 16 bp, R. norvegicus
gttgacctgttttcct

SEQ ID NO: 514362 - DNA, 21 bp, R. norvegicus
gttgagaaaatcaacaagata

SEQ ID NO: 514363 - DNA, 16 bp, R. norvegicus
gttgagaaccactgtt

SEQ ID NO: 514364 - DNA, 16 bp, R. norvegicus
gttgagaactgctact

SEQ ID NO: 514365 - DNA, 16 bp, R. norvegicus
gttgagagtaagcaaa

SEQ ID NO: 514366 - DNA, 16 bp, R. norvegicus
gttgaggaaagtttta

SEQ ID NO: 514367 - DNA, 16 bp, R. norvegicus
gttgaggcagggggat

SEQ ID NO: 514368 - DNA, 16 bp, R. norvegicus
gttgatattcataaag

SEQ ID NO: 514369 - DNA, 16 bp, R. norvegicus
gttgatggacaggaaa

SEQ ID NO: 514370 - DNA, 16 bp, R. norvegicus
gttgattctttgtgtg

SEQ ID NO: 514371 - DNA, 16 bp, R. norvegicus
gttgattttggctctg

SEQ ID NO: 514372 - DNA, 16 bp, R. norvegicus
gttgcaaagagaaatt

SEQ ID NO: 514373 - DNA, 16 bp, R. norvegicus
gttgcagaggatctga

SEQ ID NO: 514374 - DNA, 16 bp, R. norvegicus
gttgcagatggctgtg

SEQ ID NO: 514375 - DNA, 16 bp, R. norvegicus
gttgccatggcaactg

SEQ ID NO: 514376 - DNA, 16 bp, R. norvegicus
gttgccatggcaatgg

SEQ ID NO: 514377 - DNA, 16 bp, R. norvegicus
gttgcctccccagtgg

SEQ ID NO: 514378 - DNA, 16 bp, R. norvegicus
gttgcctctccctgca

SEQ ID NO: 514379 - DNA, 17 bp, R. norvegicus
gttgctacctatgaggt

SEQ ID NO: 514380 - DNA, 16 bp, R. norvegicus
gttgctcagtcccatg

SEQ ID NO: 514381 - DNA, 19 bp, R. norvegicus
gttgctgccgccgcggaga

SEQ ID NO: 514382 - DNA, 16 bp, R. norvegicus
gttgctgccgctgctg

SEQ ID NO: 514383 - DNA, 16 bp, R. norvegicus
gttgctgcctccacgg

SEQ ID NO: 514384 - DNA, 16 bp, R. norvegicus
gttgctgctgccgctg

SEQ ID NO: 514385 - DNA, 16 bp, R. norvegicus
gttgctgctgctgcag

SEQ ID NO: 514386 - DNA, 16 bp, R. norvegicus
gttgctgctgctgctg

SEQ ID NO: 514387 - DNA, 16 bp, R. norvegicus
gttgctgctgctgctt

SEQ ID NO: 514388 - DNA, 16 bp, R. norvegicus
gttgctgctgctggtg

SEQ ID NO: 514389 - DNA, 16 bp, R. norvegicus
gttgctgctggtggtg

SEQ ID NO: 514390 - DNA, 16 bp, R. norvegicus
gttgctggatgaagtc

SEQ ID NO: 514391 - DNA, 16 bp, R. norvegicus
gttgctgggaacagaa

SEQ ID NO: 514392 - DNA, 16 bp, R. norvegicus
gttgctgggattttaa

SEQ ID NO: 514393 - DNA, 16 bp, R. norvegicus
gttgctgtgagaaaat

SEQ ID NO: 514394 - DNA, 16 bp, R. norvegicus
gttgctgtgatcatgg

SEQ ID NO: 514395 - DNA, 16 bp, R. norvegicus
gttgcttggcattgat

SEQ ID NO: 514396 - DNA, 16 bp, R. norvegicus
gttgctttctgttgct

SEQ ID NO: 514397 - DNA, 16 bp, R. norvegicus
gttgcttttgtcaggt

SEQ ID NO: 514398 - DNA, 16 bp, R. norvegicus
gttggaaaagaagaag

SEQ ID NO: 514399 - DNA, 16 bp, R. norvegicus
gttggaaaggaagaaa

SEQ ID NO: 514400 - DNA, 16 bp, R. norvegicus
gttggaactggaaatt

SEQ ID NO: 514401 - DNA, 16 bp, R. norvegicus
gttggaactggagaat

SEQ ID NO: 514402 - DNA, 16 bp, R. norvegicus
gttggaagaagctgag

SEQ ID NO: 514403 - DNA, 16 bp, R. norvegicus
gttggaagtctatttt

SEQ ID NO: 514404 - DNA, 16 bp, R. norvegicus
gttggacccacagtgt

SEQ ID NO: 514405 - DNA, 16 bp, R. norvegicus
gttggaccttcatttt

SEQ ID NO: 514406 - DNA, 16 bp, R. norvegicus
gttggacttgaactca

SEQ ID NO: 514407 - DNA, 16 bp, R. norvegicus
gttggagaaggtgtgt

SEQ ID NO: 514408 - DNA, 16 bp, R. norvegicus
gttggagcaagtgtgt

SEQ ID NO: 514409 - DNA, 16 bp, R. norvegicus
gttggagccatggatc

SEQ ID NO: 514410 - DNA, 16 bp, R. norvegicus
gttggagccctgggcc

SEQ ID NO: 514411 - DNA, 16 bp, R. norvegicus
gttggaggaagtgtca

SEQ ID NO: 514412 - DNA, 16 bp, R. norvegicus
gttggaggccagtctg

SEQ ID NO: 514413 - DNA, 16 bp, R. norvegicus
gttggcagacctttaa

SEQ ID NO: 514414 - DNA, 16 bp, R. norvegicus
gttggcagagagtagt

SEQ ID NO: 514415 - DNA, 16 bp, R. norvegicus
gttggcattgttcata

SEQ ID NO: 514416 - DNA, 16 bp, R. norvegicus
gttggccttgaactca

SEQ ID NO: 514417 - DNA, 16 bp, R. norvegicus
gttggctgagagcatc

SEQ ID NO: 514418 - DNA, 16 bp, R. norvegicus
gttggctggtcttgct

SEQ ID NO: 514419 - DNA, 16 bp, R. norvegicus
gttggctgtgggcttg

SEQ ID NO: 514420 - DNA, 16 bp, R. norvegicus
gttggcttggtcatgg

SEQ ID NO: 514421 - DNA, 16 bp, R. norvegicus
gttgggaaggaaaagg

SEQ ID NO: 514422 - DNA, 16 bp, R. norvegicus
gttgggagagttttaa

SEQ ID NO: 514423 - DNA, 16 bp, R. norvegicus
gttgggcatcttttgg

SEQ ID NO: 514424 - DNA, 16 bp, R. norvegicus
gttgggcttttcatta

SEQ ID NO: 514425 - DNA, 16 bp, R. norvegicus
gttggggtttctattg

SEQ ID NO: 514426 - DNA, 16 bp, R. norvegicus
gttgggtcctcagctc

SEQ ID NO: 514427 - DNA, 16 bp, R. norvegicus
gttgggtctcagtggg

SEQ ID NO: 514428 - DNA, 16 bp, R. norvegicus
gttggtaccagggatt

SEQ ID NO: 514429 - DNA, 16 bp, R. norvegicus
gttggtgaagcctgta

SEQ ID NO: 514430 - DNA, 16 bp, R. norvegicus
gttggtgactcagtgt

SEQ ID NO: 514431 - DNA, 16 bp, R. norvegicus
gttggtgatgcttctg

SEQ ID NO: 514432 - DNA, 24 bp, R. norvegicus
gttggtgggattgcatactggtac

SEQ ID NO: 514433 - DNA, 16 bp, R. norvegicus
gttggtggttcagact

SEQ ID NO: 514434 - DNA, 16 bp, R. norvegicus
gttggtgtccaggttt

SEQ ID NO: 514435 - DNA, 16 bp, R. norvegicus
gttggttcttgatctt

SEQ ID NO: 514436 - DNA, 16 bp, R. norvegicus
gttggttggcatggtt

SEQ ID NO: 514437 - DNA, 16 bp, R. norvegicus
gttgtaagatcaagaa

SEQ ID NO: 514438 - DNA, 16 bp, R. norvegicus
gttgtacatatgggat

SEQ ID NO: 514439 - DNA, 16 bp, R. norvegicus
gttgtagatatttact

SEQ ID NO: 514440 - DNA, 16 bp, R. norvegicus
gttgtatattggagca

SEQ ID NO: 514441 - DNA, 16 bp, R. norvegicus
gttgtcaggcttgaca

SEQ ID NO: 514442 - DNA, 16 bp, R. norvegicus
gttgtcatagcaacag

SEQ ID NO: 514443 - DNA, 16 bp, R. norvegicus
gttgtcatggaaacag

SEQ ID NO: 514444 - DNA, 16 bp, R. norvegicus
gttgtcatggcaacag

SEQ ID NO: 514445 - DNA, 16 bp, R. norvegicus
gttgtcatggtcctct

SEQ ID NO: 514446 - DNA, 16 bp, R. norvegicus
gttgtcctctgacacc

SEQ ID NO: 514447 - DNA, 16 bp, R. norvegicus
gttgtcctgtatttca

SEQ ID NO: 514448 - DNA, 16 bp, R. norvegicus
gttgtcctttataaaa

SEQ ID NO: 514449 - DNA, 16 bp, R. norvegicus
gttgtctcattgctct

SEQ ID NO: 514450 - DNA, 16 bp, R. norvegicus
gttgtctccatcttga

SEQ ID NO: 514451 - DNA, 16 bp, R. norvegicus
gttgtctcccttccca

SEQ ID NO: 514452 - DNA, 16 bp, R. norvegicus
gttgtctcttctgctc

SEQ ID NO: 514453 - DNA, 16 bp, R. norvegicus
gttgtcttctgacctc

SEQ ID NO: 514454 - DNA, 16 bp, R. norvegicus
gttgtcttctggcctc

SEQ ID NO: 514455 - DNA, 16 bp, R. norvegicus
gttgtgagccacaatg

SEQ ID NO: 514456 - DNA, 20 bp, R. norvegicus
gttgtgagcctagcctttaa

SEQ ID NO: 514457 - DNA, 16 bp, R. norvegicus
gttgtgagctgctgta

SEQ ID NO: 514458 - DNA, 16 bp, R. norvegicus
gttgtggcttgccctg

SEQ ID NO: 514459 - DNA, 16 bp, R. norvegicus
gttgtgggaacagagt

SEQ ID NO: 514460 - DNA, 16 bp, R. norvegicus
gttgtgggcaggggtg

SEQ ID NO: 514461 - DNA, 16 bp, R. norvegicus
gttgtgttaatacaaa

SEQ ID NO: 514462 - DNA, 16 bp, R. norvegicus
gttgttaaagaaacca

SEQ ID NO: 514463 - DNA, 16 bp, R. norvegicus
gttgttagtgaagaat

SEQ ID NO: 514464 - DNA, 16 bp, R. norvegicus
gttgttccaggaacta

SEQ ID NO: 514465 - DNA, 16 bp, R. norvegicus
gttgttctctggcctc

SEQ ID NO: 514466 - DNA, 16 bp, R. norvegicus
gttgttcttcctctgg

SEQ ID NO: 514467 - DNA, 16 bp, R. norvegicus
gttgttgctgttttta

SEQ ID NO: 514468 - DNA, 16 bp, R. norvegicus
gttgttgttgctgctg

SEQ ID NO: 514469 - DNA, 16 bp, R. norvegicus
gttgttgttttaataa

SEQ ID NO: 514470 - DNA, 16 bp, R. norvegicus
gtttaaagaaaagcct

SEQ ID NO: 514471 - DNA, 16 bp, R. norvegicus
gtttaaagcacacatt

SEQ ID NO: 514472 - DNA, 16 bp, R. norvegicus
gtttaaattctgtttc

SEQ ID NO: 514473 - DNA, 16 bp, R. norvegicus
gtttaactctgaaccc

SEQ ID NO: 514474 - DNA, 16 bp, R. norvegicus
gtttaagaagaaggaa

SEQ ID NO: 514475 - DNA, 16 bp, R. norvegicus
gtttaagaagatgaaa

SEQ ID NO: 514476 - DNA, 16 bp, R. norvegicus
gtttacagagttccag

SEQ ID NO: 514477 - DNA, 47 bp, R. norvegicus
gtttaccaggctatgaccaccattaaaaagggtgcttctcccaacat

SEQ ID NO: 514478 - DNA, 16 bp, R. norvegicus
gtttactgctgtgaac

SEQ ID NO: 514479 - DNA, 16 bp, R. norvegicus
gtttagatggcttatc

SEQ ID NO: 514480 - DNA, 16 bp, R. norvegicus
gtttagctcctttgtc

SEQ ID NO: 514481 - DNA, 16 bp, R. norvegicus
gtttagctctgtactt

SEQ ID NO: 514482 - DNA, 16 bp, R. norvegicus
gtttataagggaaatt

SEQ ID NO: 514483 - DNA, 17 bp, R. norvegicus
gtttatgcaccaggtgt

SEQ ID NO: 514484 - DNA, 16 bp, R. norvegicus
gtttattatgtggatg

SEQ ID NO: 514485 - DNA, 16 bp, R. norvegicus
gtttatttatgtttac

SEQ ID NO: 514486 - DNA, 16 bp, R. norvegicus
gtttatttggtgctgg

SEQ ID NO: 514487 - DNA, 16 bp, R. norvegicus
gtttattttctcaaag

SEQ ID NO: 514488 - DNA, 16 bp, R. norvegicus
gtttattttgtcctat

SEQ ID NO: 514489 - DNA, 16 bp, R. norvegicus
gtttcaaaaaagaaaa

SEQ ID NO: 514490 - DNA, 16 bp, R. norvegicus
gtttcaaatgcagatg

SEQ ID NO: 514491 - DNA, 16 bp, R. norvegicus
gtttcactgtgcagcc

SEQ ID NO: 514492 - DNA, 16 bp, R. norvegicus
gtttcagacatttttt

SEQ ID NO: 514493 - DNA, 16 bp, R. norvegicus
gtttcagaggagaata

SEQ ID NO: 514494 - DNA, 16 bp, R. norvegicus
gtttcagtggagaaga

SEQ ID NO: 514495 - DNA, 16 bp, R. norvegicus
gtttcatcctaaaaca

SEQ ID NO: 514496 - DNA, 16 bp, R. norvegicus
gtttccaaagaagaaa

SEQ ID NO: 514497 - DNA, 16 bp, R. norvegicus
gtttccaagaactggg

SEQ ID NO: 514498 - DNA, 16 bp, R. norvegicus
gtttccaagaggatgt

SEQ ID NO: 514499 - DNA, 16 bp, R. norvegicus
gtttccactccagaaa

SEQ ID NO: 514500 - DNA, 16 bp, R. norvegicus
gtttccagagaggaaa

SEQ ID NO: 514501 - DNA, 16 bp, R. norvegicus
gtttccagcaccaaca

SEQ ID NO: 514502 - DNA, 16 bp, R. norvegicus
gtttccagcatctggc

SEQ ID NO: 514503 - DNA, 16 bp, R. norvegicus
gtttccagcttctgga

SEQ ID NO: 514504 - DNA, 16 bp, R. norvegicus
gtttccatggcaacca

SEQ ID NO: 514505 - DNA, 16 bp, R. norvegicus
gtttccatggtcatgg

SEQ ID NO: 514506 - DNA, 16 bp, R. norvegicus
gtttcccaggcttgtc

SEQ ID NO: 514507 - DNA, 16 bp, R. norvegicus
gtttccccagtgtagg

SEQ ID NO: 514508 - DNA, 16 bp, R. norvegicus
gtttcccctccaggaa

SEQ ID NO: 514509 - DNA, 16 bp, R. norvegicus
gtttcctcaagggagg

SEQ ID NO: 514510 - DNA, 16 bp, R. norvegicus
gtttcctcacagcaat

SEQ ID NO: 514511 - DNA, 16 bp, R. norvegicus
gtttcctcagaaagtt

SEQ ID NO: 514512 - DNA, 16 bp, R. norvegicus
gtttcctcagagtcag

SEQ ID NO: 514513 - DNA, 16 bp, R. norvegicus
gtttcctcctttagag

SEQ ID NO: 514514 - DNA, 16 bp, R. norvegicus
gtttcctgcttggtgg

SEQ ID NO: 514515 - DNA, 16 bp, R. norvegicus
gtttcctgtgtttgag

SEQ ID NO: 514516 - DNA, 16 bp, R. norvegicus
gtttctacttgtttat

SEQ ID NO: 514517 - DNA, 16 bp, R. norvegicus
gtttctagagggaaaa

SEQ ID NO: 514518 - DNA, 16 bp, R. norvegicus
gtttctattgcttatg

SEQ ID NO: 514519 - DNA, 16 bp, R. norvegicus
gtttctcactgaattg

SEQ ID NO: 514520 - DNA, 16 bp, R. norvegicus
gtttctcagaaaaaaa

SEQ ID NO: 514521 - DNA, 16 bp, R. norvegicus
gtttctcaggagagat

SEQ ID NO: 514522 - DNA, 16 bp, R. norvegicus
gtttctcatccatttg

SEQ ID NO: 514523 - DNA, 16 bp, R. norvegicus
gtttctccatctattt

SEQ ID NO: 514524 - DNA, 16 bp, R. norvegicus
gtttctcctccacaaa

SEQ ID NO: 514525 - DNA, 16 bp, R. norvegicus
gtttctccttctctga

SEQ ID NO: 514526 - DNA, 16 bp, R. norvegicus
gtttctctccagtatg

SEQ ID NO: 514527 - DNA, 16 bp, R. norvegicus
gtttctctgtgcagca

SEQ ID NO: 514528 - DNA, 16 bp, R. norvegicus
gtttctctgtgtaact

SEQ ID NO: 514529 - DNA, 16 bp, R. norvegicus
gtttctcttttctata

SEQ ID NO: 514530 - DNA, 16 bp, R. norvegicus
gtttctgaagaaaaaa

SEQ ID NO: 514531 - DNA, 16 bp, R. norvegicus
gtttctgaagacagct

SEQ ID NO: 514532 - DNA, 16 bp, R. norvegicus
gtttctgacatgctgt

SEQ ID NO: 514533 - DNA, 16 bp, R. norvegicus
gtttctgcttcaagct

SEQ ID NO: 514534 - DNA, 17 bp, R. norvegicus
gtttctggcaagaagtc

SEQ ID NO: 514535 - DNA, 16 bp, R. norvegicus
gtttctgtctgtgtct

SEQ ID NO: 514536 - DNA, 16 bp, R. norvegicus
gtttctgtgtctctgt

SEQ ID NO: 514537 - DNA, 16 bp, R. norvegicus
gtttctgtttccctgt

SEQ ID NO: 514538 - DNA, 16 bp, R. norvegicus
gtttcttcaggttcca

SEQ ID NO: 514539 - DNA, 16 bp, R. norvegicus
gtttcttcatgtagcc

SEQ ID NO: 514540 - DNA, 16 bp, R. norvegicus
gtttcttcttgcagta

SEQ ID NO: 514541 - DNA, 16 bp, R. norvegicus
gtttctttcagggtcc

SEQ ID NO: 514542 - DNA, 16 bp, R. norvegicus
gtttctttggaaactc

SEQ ID NO: 514543 - DNA, 16 bp, R. norvegicus
gtttctttgggccatt

SEQ ID NO: 514544 - DNA, 16 bp, R. norvegicus
gtttcttttacgtgtg

SEQ ID NO: 514545 - DNA, 16 bp, R. norvegicus
gtttgaaactcttccc

SEQ ID NO: 514546 - DNA, 16 bp, R. norvegicus
gtttgaaaggaggaaa

SEQ ID NO: 514547 - DNA, 16 bp, R. norvegicus
gtttgaacatgaaatg

SEQ ID NO: 514548 - DNA, 16 bp, R. norvegicus
gtttgaaggaagggga

SEQ ID NO: 514549 - DNA, 16 bp, R. norvegicus
gtttgaatatgctggg

SEQ ID NO: 514550 - DNA, 16 bp, R. norvegicus
gtttgaatgtgaagtg

SEQ ID NO: 514551 - DNA, 16 bp, R. norvegicus
gtttgagaccagactg

SEQ ID NO: 514552 - DNA, 16 bp, R. norvegicus
gtttgaggacagcttg

SEQ ID NO: 514553 - DNA, 16 bp, R. norvegicus
gtttgaggagaaaagg

SEQ ID NO: 514554 - DNA, 16 bp, R. norvegicus
gtttgaggcagaacag

SEQ ID NO: 514555 - DNA, 16 bp, R. norvegicus
gtttgaggccacccta

SEQ ID NO: 514556 - DNA, 16 bp, R. norvegicus
gtttgaggctcttcct

SEQ ID NO: 514557 - DNA, 16 bp, R. norvegicus
gtttgagtgtgtgtgc

SEQ ID NO: 514558 - DNA, 16 bp, R. norvegicus
gtttgagttcctgtct

SEQ ID NO: 514559 - DNA, 16 bp, R. norvegicus
gtttgatctctgggac

SEQ ID NO: 514560 - DNA, 18 bp, R. norvegicus
gtttgatcttcaaggttc

SEQ ID NO: 514561 - DNA, 16 bp, R. norvegicus
gtttgatgtggaggtt

SEQ ID NO: 514562 - DNA, 16 bp, R. norvegicus
gtttgatgtggtggtc

SEQ ID NO: 514563 - DNA, 16 bp, R. norvegicus
gtttgattctcaggac

SEQ ID NO: 514564 - DNA, 16 bp, R. norvegicus
gtttgcacagcaaaca

SEQ ID NO: 514565 - DNA, 17 bp, R. norvegicus
gtttgcagtatatggct

SEQ ID NO: 514566 - DNA, 16 bp, R. norvegicus
gtttgcccagatggtt

SEQ ID NO: 514567 - DNA, 16 bp, R. norvegicus
gtttgcccagctggtt

SEQ ID NO: 514568 - DNA, 16 bp, R. norvegicus
gtttgctaggcaagcg

SEQ ID NO: 514569 - DNA, 16 bp, R. norvegicus
gtttgctgctgggatt

SEQ ID NO: 514570 - DNA, 16 bp, R. norvegicus
gtttgctgctgtcatt

SEQ ID NO: 514571 - DNA, 16 bp, R. norvegicus
gtttgctgtatattgg

SEQ ID NO: 514572 - DNA, 16 bp, R. norvegicus
gtttgctgtgcaagca

SEQ ID NO: 514573 - DNA, 16 bp, R. norvegicus
gtttggaggccagagg

SEQ ID NO: 514574 - DNA, 16 bp, R. norvegicus
gtttggatcccagcat

SEQ ID NO: 514575 - DNA, 16 bp, R. norvegicus
gtttggctgtggatgt

SEQ ID NO: 514576 - DNA, 16 bp, R. norvegicus
gtttgggattaaaggt

SEQ ID NO: 514577 - DNA, 17 bp, R. norvegicus
gtttgggtatatgccca

SEQ ID NO: 514578 - DNA, 16 bp, R. norvegicus
gtttgggtatgttctg

SEQ ID NO: 514579 - DNA, 16 bp, R. norvegicus
gtttgggtatgttgta

SEQ ID NO: 514580 - DNA, 16 bp, R. norvegicus
gtttggtcccagcacc

SEQ ID NO: 514581 - DNA, 16 bp, R. norvegicus
gtttggtctggtctgg

SEQ ID NO: 514582 - DNA, 16 bp, R. norvegicus
gtttggtgcctgcaga

SEQ ID NO: 514583 - DNA, 16 bp, R. norvegicus
gtttggttcccagaac

SEQ ID NO: 514584 - DNA, 16 bp, R. norvegicus
gtttggttttctgaga

SEQ ID NO: 514585 - DNA, 16 bp, R. norvegicus
gtttggtttttcaaga

SEQ ID NO: 514586 - DNA, 18 bp, R. norvegicus
gtttgttccatgaggcaa

SEQ ID NO: 514587 - DNA, 16 bp, R. norvegicus
gtttgttgtctgcaga

SEQ ID NO: 514588 - DNA, 16 bp, R. norvegicus
gtttgtttacatcctg

SEQ ID NO: 514589 - DNA, 16 bp, R. norvegicus
gtttgtttgttttgca

SEQ ID NO: 514590 - DNA, 16 bp, R. norvegicus
gtttgttttggagaca

SEQ ID NO: 514591 - DNA, 16 bp, R. norvegicus
gttttaaaagaagaaa

SEQ ID NO: 514592 - DNA, 16 bp, R. norvegicus
gttttaaagaaacaaa

SEQ ID NO: 514593 - DNA, 16 bp, R. norvegicus
gttttaaatatgctga

SEQ ID NO: 514594 - DNA, 16 bp, R. norvegicus
gttttaagctgccagg

SEQ ID NO: 514595 - DNA, 16 bp, R. norvegicus
gttttaagtcctttca

SEQ ID NO: 514596 - DNA, 16 bp, R. norvegicus
gttttaattaattcca

SEQ ID NO: 514597 - DNA, 16 bp, R. norvegicus
gttttaggacatccag

SEQ ID NO: 514598 - DNA, 16 bp, R. norvegicus
gttttataggaaatgg

SEQ ID NO: 514599 - DNA, 16 bp, R. norvegicus
gttttatgtatgtagg

SEQ ID NO: 514600 - DNA, 16 bp, R. norvegicus
gttttatttaaagaaa

SEQ ID NO: 514601 - DNA, 16 bp, R. norvegicus
gttttatttcctcaga

SEQ ID NO: 514602 - DNA, 16 bp, R. norvegicus
gttttatttgtttaca

SEQ ID NO: 514603 - DNA, 16 bp, R. norvegicus
gttttcaaatatttct

SEQ ID NO: 514604 - DNA, 16 bp, R. norvegicus
gttttcaattctttag

SEQ ID NO: 514605 - DNA, 16 bp, R. norvegicus
gttttcacccccttct

SEQ ID NO: 514606 - DNA, 33 bp, R. norvegicus
gttttcagcaaatggtgctggttcaactggagg

SEQ ID NO: 514607 - DNA, 16 bp, R. norvegicus
gttttccctctgcaaa

SEQ ID NO: 514608 - DNA, 16 bp, R. norvegicus
gttttcctgaagcaga

SEQ ID NO: 514609 - DNA, 16 bp, R. norvegicus
gttttccttccagaaa

SEQ ID NO: 514610 - DNA, 16 bp, R. norvegicus
gttttccttttttaaa

SEQ ID NO: 514611 - DNA, 16 bp, R. norvegicus
gttttctatctccagt

SEQ ID NO: 514612 - DNA, 16 bp, R. norvegicus
gttttctgaaggtgga

SEQ ID NO: 514613 - DNA, 16 bp, R. norvegicus
gttttctgagacaagg

SEQ ID NO: 514614 - DNA, 16 bp, R. norvegicus
gttttctgcatgcagc

SEQ ID NO: 514615 - DNA, 21 bp, R. norvegicus
gttttctggaacaaaggagac

SEQ ID NO: 514616 - DNA, 16 bp, R. norvegicus
gttttctgtatattgt

SEQ ID NO: 514617 - DNA, 16 bp, R. norvegicus
gttttctgtcaacttg

SEQ ID NO: 514618 - DNA, 16 bp, R. norvegicus
gttttctgtcagcttg

SEQ ID NO: 514619 - DNA, 16 bp, R. norvegicus
gttttcttcatttcct

SEQ ID NO: 514620 - DNA, 16 bp, R. norvegicus
gttttctttcagaaaa

SEQ ID NO: 514621 - DNA, 18 bp, R. norvegicus
gttttgaattactagtgt

SEQ ID NO: 514622 - DNA, 16 bp, R. norvegicus
gttttgactattattt

SEQ ID NO: 514623 - DNA, 16 bp, R. norvegicus
gttttgatcatggtgt

SEQ ID NO: 514624 - DNA, 16 bp, R. norvegicus
gttttgcagcctttca

SEQ ID NO: 514625 - DNA, 16 bp, R. norvegicus
gttttgcaggcaaatt

SEQ ID NO: 514626 - DNA, 16 bp, R. norvegicus
gttttgcctgtgtatg

SEQ ID NO: 514627 - DNA, 16 bp, R. norvegicus
gttttgcctttgaata

SEQ ID NO: 514628 - DNA, 16 bp, R. norvegicus
gttttgctgctggcat

SEQ ID NO: 514629 - DNA, 16 bp, R. norvegicus
gttttgctgggcatag

SEQ ID NO: 514630 - DNA, 16 bp, R. norvegicus
gttttggaaggattag

SEQ ID NO: 514631 - DNA, 16 bp, R. norvegicus
gttttggctatcctgg

SEQ ID NO: 514632 - DNA, 16 bp, R. norvegicus
gttttggtcaacttga

SEQ ID NO: 514633 - DNA, 16 bp, R. norvegicus
gttttggttttctgag

SEQ ID NO: 514634 - DNA, 16 bp, R. norvegicus
gttttgtaaataaagt

SEQ ID NO: 514635 - DNA, 16 bp, R. norvegicus
gttttgtagattcttt

SEQ ID NO: 514636 - DNA, 16 bp, R. norvegicus
gttttgtcataatgac

SEQ ID NO: 514637 - DNA, 16 bp, R. norvegicus
gttttgtccagtggct

SEQ ID NO: 514638 - DNA, 16 bp, R. norvegicus
gttttgtgactgattt

SEQ ID NO: 514639 - DNA, 16 bp, R. norvegicus
gttttgtgtgtcgact

SEQ ID NO: 514640 - DNA, 16 bp, R. norvegicus
gttttgttaaaaaaaa

SEQ ID NO: 514641 - DNA, 16 bp, R. norvegicus
gttttgtttaatatag

SEQ ID NO: 514642 - DNA, 16 bp, R. norvegicus
gttttgtttgagacag

SEQ ID NO: 514643 - DNA, 16 bp, R. norvegicus
gttttgttttaagaca

SEQ ID NO: 514644 - DNA, 16 bp, R. norvegicus
gttttgttttctgaat

SEQ ID NO: 514645 - DNA, 16 bp, R. norvegicus
gttttgtttttagaaa

SEQ ID NO: 514646 - DNA, 16 bp, R. norvegicus
gtttttaaagtgtgtg

SEQ ID NO: 514647 - DNA, 16 bp, R. norvegicus
gtttttaatctttcag

SEQ ID NO: 514648 - DNA, 16 bp, R. norvegicus
gtttttaattacattt

SEQ ID NO: 514649 - DNA, 16 bp, R. norvegicus
gtttttatacatttta

SEQ ID NO: 514650 - DNA, 16 bp, R. norvegicus
gtttttcattaaataa

SEQ ID NO: 514651 - DNA, 16 bp, R. norvegicus
gtttttcgagacaagg

SEQ ID NO: 514652 - DNA, 16 bp, R. norvegicus
gtttttctgtgactgt

SEQ ID NO: 514653 - DNA, 16 bp, R. norvegicus
gtttttgcattttaca

SEQ ID NO: 514654 - DNA, 16 bp, R. norvegicus
gtttttgcctttaaaa

SEQ ID NO: 514655 - DNA, 16 bp, R. norvegicus
gttttttcagaaaggt

SEQ ID NO: 514656 - DNA, 16 bp, R. norvegicus
gttttttgagacaaga

SEQ ID NO: 514657 - DNA, 16 bp, R. norvegicus
gttttttgagacagga

SEQ ID NO: 514658 - DNA, 16 bp, R. norvegicus
taaaaaaaaatggtgc

SEQ ID NO: 514659 - DNA, 16 bp, R. norvegicus
taaaaaaaattctgaa

SEQ ID NO: 514660 - DNA, 16 bp, R. norvegicus
taaaaaagcctttgac

SEQ ID NO: 514661 - DNA, 16 bp, R. norvegicus
taaaaaatagggctgg

SEQ ID NO: 514662 - DNA, 16 bp, R. norvegicus
taaaaacaaaatggag

SEQ ID NO: 514663 - DNA, 16 bp, R. norvegicus
taaaaacaactctgag

SEQ ID NO: 514664 - DNA, 16 bp, R. norvegicus
taaaaacaatgacctc

SEQ ID NO: 514665 - DNA, 16 bp, R. norvegicus
taaaaacaattctttt

SEQ ID NO: 514666 - DNA, 16 bp, R. norvegicus
taaaaacagtgacttt

SEQ ID NO: 514667 - DNA, 16 bp, R. norvegicus
taaaaacatttttctt

SEQ ID NO: 514668 - DNA, 16 bp, R. norvegicus
taaaaactattttctt

SEQ ID NO: 514669 - DNA, 16 bp, R. norvegicus
taaaaactgcaaagct

SEQ ID NO: 514670 - DNA, 16 bp, R. norvegicus
taaaaactggaaacaa

SEQ ID NO: 514671 - DNA, 16 bp, R. norvegicus
taaaaacttcttagaa

SEQ ID NO: 514672 - DNA, 16 bp, R. norvegicus
taaaaagaggtcaaag

SEQ ID NO: 514673 - DNA, 16 bp, R. norvegicus
taaaaagccaaacaac

SEQ ID NO: 514674 - DNA, 16 bp, R. norvegicus
taaaaagggaaacttt

SEQ ID NO: 514675 - DNA, 16 bp, R. norvegicus
taaaaagggaactaac

SEQ ID NO: 514676 - DNA, 16 bp, R. norvegicus
taaaaataaaagctga

SEQ ID NO: 514677 - DNA, 16 bp, R. norvegicus
taaaaataaagctttt

SEQ ID NO: 514678 - DNA, 16 bp, R. norvegicus
taaaaataagtctttt

SEQ ID NO: 514679 - DNA, 16 bp, R. norvegicus
taaaaatagcaaaatt

SEQ ID NO: 514680 - DNA, 16 bp, R. norvegicus
taaaaatattttcaca

SEQ ID NO: 514681 - DNA, 16 bp, R. norvegicus
taaaaatccaaatgaa

SEQ ID NO: 514682 - DNA, 16 bp, R. norvegicus
taaaaatcctttccca

SEQ ID NO: 514683 - DNA, 16 bp, R. norvegicus
taaaaatcctttctgc

SEQ ID NO: 514684 - DNA, 16 bp, R. norvegicus
taaaaatgaaatttca

SEQ ID NO: 514685 - DNA, 16 bp, R. norvegicus
taaaaatgaacaaatg

SEQ ID NO: 514686 - DNA, 16 bp, R. norvegicus
taaaaatgaaggcaaa

SEQ ID NO: 514687 - DNA, 16 bp, R. norvegicus
taaaaatgaatcttaa

SEQ ID NO: 514688 - DNA, 16 bp, R. norvegicus
taaaaatgagtatttt

SEQ ID NO: 514689 - DNA, 16 bp, R. norvegicus
taaaaatggcaatttt

SEQ ID NO: 514690 - DNA, 16 bp, R. norvegicus
taaaaatggtaataga

SEQ ID NO: 514691 - DNA, 16 bp, R. norvegicus
taaaaatgtatttgtt

SEQ ID NO: 514692 - DNA, 16 bp, R. norvegicus
taaaaatgtattttct

SEQ ID NO: 514693 - DNA, 16 bp, R. norvegicus
taaaaatgtttgtgtg

SEQ ID NO: 514694 - DNA, 16 bp, R. norvegicus
taaaaattgccttggt

SEQ ID NO: 514695 - DNA, 16 bp, R. norvegicus
taaaaattggttattt

SEQ ID NO: 514696 - DNA, 16 bp, R. norvegicus
taaaaatttagagatg

SEQ ID NO: 514697 - DNA, 16 bp, R. norvegicus
taaaacaaaatttgaa

SEQ ID NO: 514698 - DNA, 16 bp, R. norvegicus
taaaacaaagcattta

SEQ ID NO: 514699 - DNA, 16 bp, R. norvegicus
taaaacagacagacag

SEQ ID NO: 514700 - DNA, 16 bp, R. norvegicus
taaaacagagaaggga

SEQ ID NO: 514701 - DNA, 16 bp, R. norvegicus
taaaacataaaaatgt

SEQ ID NO: 514702 - DNA, 16 bp, R. norvegicus
taaaactaaaatgttt

SEQ ID NO: 514703 - DNA, 16 bp, R. norvegicus
taaaactatagaacaa

SEQ ID NO: 514704 - DNA, 16 bp, R. norvegicus
taaaactgcaaagttt

SEQ ID NO: 514705 - DNA, 16 bp, R. norvegicus
taaaactgctatgaat

SEQ ID NO: 514706 - DNA, 16 bp, R. norvegicus
taaaactgcttgaaga

SEQ ID NO: 514707 - DNA, 16 bp, R. norvegicus
taaaactgttttaaaa

SEQ ID NO: 514708 - DNA, 16 bp, R. norvegicus
taaaagaaactttaat

SEQ ID NO: 514709 - DNA, 16 bp, R. norvegicus
taaaagaacctctgga

SEQ ID NO: 514710 - DNA, 16 bp, R. norvegicus
taaaagaactttaaaa

SEQ ID NO: 514711 - DNA, 16 bp, R. norvegicus
taaaagaagttatgaa

SEQ ID NO: 514712 - DNA, 16 bp, R. norvegicus
taaaagaattacagga

SEQ ID NO: 514713 - DNA, 16 bp, R. norvegicus
taaaagacattttgaa

SEQ ID NO: 514714 - DNA, 16 bp, R. norvegicus
taaaagacttttattt

SEQ ID NO: 514715 - DNA, 16 bp, R. norvegicus
taaaagagcttaataa

SEQ ID NO: 514716 - DNA, 16 bp, R. norvegicus
taaaagagtatcatta

SEQ ID NO: 514717 - DNA, 16 bp, R. norvegicus
taaaagatgtgtatga

SEQ ID NO: 514718 - DNA, 16 bp, R. norvegicus
taaaagatttatttct

SEQ ID NO: 514719 - DNA, 16 bp, R. norvegicus
taaaagcagaaaagga

SEQ ID NO: 514720 - DNA, 16 bp, R. norvegicus
taaaagccttggaaag

SEQ ID NO: 514721 - DNA, 16 bp, R. norvegicus
taaaaggaaaaattca

SEQ ID NO: 514722 - DNA, 16 bp, R. norvegicus
taaaaggaaacatttt

SEQ ID NO: 514723 - DNA, 16 bp, R. norvegicus
taaaagtaaatctttt

SEQ ID NO: 514724 - DNA, 16 bp, R. norvegicus
taaaagtacacatact

SEQ ID NO: 514725 - DNA, 16 bp, R. norvegicus
taaaagtaggatttga

SEQ ID NO: 514726 - DNA, 16 bp, R. norvegicus
taaaagtattggaaag

SEQ ID NO: 514727 - DNA, 16 bp, R. norvegicus
taaaagtcttcaaaaa

SEQ ID NO: 514728 - DNA, 16 bp, R. norvegicus
taaaagtcttgtaaag

SEQ ID NO: 514729 - DNA, 16 bp, R. norvegicus
taaaagtggaacaaga

SEQ ID NO: 514730 - DNA, 16 bp, R. norvegicus
taaaagtgtgtgccac

SEQ ID NO: 514731 - DNA, 16 bp, R. norvegicus
taaaagttctagaaca

SEQ ID NO: 514732 - DNA, 16 bp, R. norvegicus
taaaataaatgttttg

SEQ ID NO: 514733 - DNA, 16 bp, R. norvegicus
taaaataattttctgt

SEQ ID NO: 514734 - DNA, 16 bp, R. norvegicus
taaaatacttgaaaac

SEQ ID NO: 514735 - DNA, 16 bp, R. norvegicus
taaaatatacaatgaa

SEQ ID NO: 514736 - DNA, 16 bp, R. norvegicus
taaaatattttgacaa

SEQ ID NO: 514737 - DNA, 16 bp, R. norvegicus
taaaatcaaggacaag

SEQ ID NO: 514738 - DNA, 16 bp, R. norvegicus
taaaatcacactgagg

SEQ ID NO: 514739 - DNA, 16 bp, R. norvegicus
taaaatcacatcccat

SEQ ID NO: 514740 - DNA, 22 bp, R. norvegicus
taaaatcagggactagacaaga

SEQ ID NO: 514741 - DNA, 16 bp, R. norvegicus
taaaatccactttcaa

SEQ ID NO: 514742 - DNA, 16 bp, R. norvegicus
taaaatcccagcaacc

SEQ ID NO: 514743 - DNA, 16 bp, R. norvegicus
taaaatctggagtgtg

SEQ ID NO: 514744 - DNA, 16 bp, R. norvegicus
taaaatcttcaggaaa

SEQ ID NO: 514745 - DNA, 16 bp, R. norvegicus
taaaatgaattccctt

SEQ ID NO: 514746 - DNA, 16 bp, R. norvegicus
taaaatgacatatttt

SEQ ID NO: 514747 - DNA, 16 bp, R. norvegicus
taaaatgctggaaaac

SEQ ID NO: 514748 - DNA, 16 bp, R. norvegicus
taaaatgcttattttt

SEQ ID NO: 514749 - DNA, 16 bp, R. norvegicus
taaaatggaaatttta

SEQ ID NO: 514750 - DNA, 16 bp, R. norvegicus
taaaatggattatttt

SEQ ID NO: 514751 - DNA, 16 bp, R. norvegicus
taaaatggcctttttt

SEQ ID NO: 514752 - DNA, 16 bp, R. norvegicus
taaaatgtaccagaga

SEQ ID NO: 514753 - DNA, 16 bp, R. norvegicus
taaaatgtatcatttt

SEQ ID NO: 514754 - DNA, 16 bp, R. norvegicus
taaaatgtcataataa

SEQ ID NO: 514755 - DNA, 16 bp, R. norvegicus
taaaatgttttcaaaa

SEQ ID NO: 514756 - DNA, 16 bp, R. norvegicus
taaaattacacatatt

SEQ ID NO: 514757 - DNA, 16 bp, R. norvegicus
taaaattacttttgtt

SEQ ID NO: 514758 - DNA, 16 bp, R. norvegicus
taaaattcccacaaac

SEQ ID NO: 514759 - DNA, 16 bp, R. norvegicus
taaaattcttaaaaag

SEQ ID NO: 514760 - DNA, 16 bp, R. norvegicus
taaaattcttccaaac

SEQ ID NO: 514761 - DNA, 16 bp, R. norvegicus
taaaattctttcaaac

SEQ ID NO: 514762 - DNA, 16 bp, R. norvegicus
taaaattggtcaaaaa

SEQ ID NO: 514763 - DNA, 16 bp, R. norvegicus
taaaattggtcacaaa

SEQ ID NO: 514764 - DNA, 16 bp, R. norvegicus
taaaattttgaattcc

SEQ ID NO: 514765 - DNA, 16 bp, R. norvegicus
taaacaaaacattctc

SEQ ID NO: 514766 - DNA, 16 bp, R. norvegicus
taaacaaactccaaga

SEQ ID NO: 514767 - DNA, 28 bp, R. norvegicus
taaacaaagaattcacagctgaggaata

SEQ ID NO: 514768 - DNA, 16 bp, R. norvegicus
taaacaaagagatgcc

SEQ ID NO: 514769 - DNA, 16 bp, R. norvegicus
taaacaaagtaaaagc

SEQ ID NO: 514770 - DNA, 16 bp, R. norvegicus
taaacaaatagaagcc

SEQ ID NO: 514771 - DNA, 16 bp, R. norvegicus
taaacaaatcagtagc

SEQ ID NO: 514772 - DNA, 16 bp, R. norvegicus
taaacaaatggaaaga

SEQ ID NO: 514773 - DNA, 22 bp, R. norvegicus
taaacaacccgataactcctaa

SEQ ID NO: 514774 - DNA, 16 bp, R. norvegicus
taaacaagcaagttaa

SEQ ID NO: 514775 - DNA, 32 bp, R. norvegicus
taaacaagtagaagcccatagagaggagtcac

SEQ ID NO: 514776 - DNA, 16 bp, R. norvegicus
taaacaagtgaaggaa

SEQ ID NO: 514777 - DNA, 16 bp, R. norvegicus
taaacacatatacata

SEQ ID NO: 514778 - DNA, 16 bp, R. norvegicus
taaacagagaattatc

SEQ ID NO: 514779 - DNA, 16 bp, R. norvegicus
taaacagatacacaca

SEQ ID NO: 514780 - DNA, 16 bp, R. norvegicus
taaacatagcataatg

SEQ ID NO: 514781 - DNA, 16 bp, R. norvegicus
taaacattcatcatct

SEQ ID NO: 514782 - DNA, 16 bp, R. norvegicus
taaacatttgttgaat

SEQ ID NO: 514783 - DNA, 17 bp, R. norvegicus
taaaccaacatgtcata

SEQ ID NO: 514784 - DNA, 16 bp, R. norvegicus
taaaccacgaaccaaa

SEQ ID NO: 514785 - DNA, 16 bp, R. norvegicus
taaaccatctaaagag

SEQ ID NO: 514786 - DNA, 16 bp, R. norvegicus
taaacccctgcctgaa

SEQ ID NO: 514787 - DNA, 16 bp, R. norvegicus
taaacccttagtcaga

SEQ ID NO: 514788 - DNA, 16 bp, R. norvegicus
taaacctacacacaca

SEQ ID NO: 514789 - DNA, 16 bp, R. norvegicus
taaacctcttgctgat

SEQ ID NO: 514790 - DNA, 16 bp, R. norvegicus
taaacctgataaagaa

SEQ ID NO: 514791 - DNA, 16 bp, R. norvegicus
taaacctgatgacctg

SEQ ID NO: 514792 - DNA, 16 bp, R. norvegicus
taaacctttctggaaa

SEQ ID NO: 514793 - DNA, 16 bp, R. norvegicus
taaactacacaaagac

SEQ ID NO: 514794 - DNA, 16 bp, R. norvegicus
taaactgaggcaggca

SEQ ID NO: 514795 - DNA, 17 bp, R. norvegicus
taaacttatgggacaca

SEQ ID NO: 514796 - DNA, 16 bp, R. norvegicus
taaacttcctggggcc

SEQ ID NO: 514797 - DNA, 16 bp, R. norvegicus
taaactttccctccct

SEQ ID NO: 514798 - DNA, 16 bp, R. norvegicus
taaactttttagaatt

SEQ ID NO: 514799 - DNA, 16 bp, R. norvegicus
taaagaaaaaatcagg

SEQ ID NO: 514800 - DNA, 16 bp, R. norvegicus
taaagaaaaacatttc

SEQ ID NO: 514801 - DNA, 16 bp, R. norvegicus
taaagaaaaagaggct

SEQ ID NO: 514802 - DNA, 16 bp, R. norvegicus
taaagaaaacttccct

SEQ ID NO: 514803 - DNA, 16 bp, R. norvegicus
taaagaaaagacattt

SEQ ID NO: 514804 - DNA, 16 bp, R. norvegicus
taaagaaaatattcaa

SEQ ID NO: 514805 - DNA, 16 bp, R. norvegicus
taaagaaaattgactc

SEQ ID NO: 514806 - DNA, 16 bp, R. norvegicus
taaagaaacacacaca

SEQ ID NO: 514807 - DNA, 16 bp, R. norvegicus
taaagaaacaccatga

SEQ ID NO: 514808 - DNA, 16 bp, R. norvegicus
taaagaaacatttatt

SEQ ID NO: 514809 - DNA, 16 bp, R. norvegicus
taaagaaagaatattg

SEQ ID NO: 514810 - DNA, 16 bp, R. norvegicus
taaagaaatattcaac

SEQ ID NO: 514811 - DNA, 16 bp, R. norvegicus
taaagaaatgacagaa

SEQ ID NO: 514812 - DNA, 16 bp, R. norvegicus
taaagaaatgcagaaa

SEQ ID NO: 514813 - DNA, 16 bp, R. norvegicus
taaagaaatgcaggag

SEQ ID NO: 514814 - DNA, 16 bp, R. norvegicus
taaagaaattcaggaa

SEQ ID NO: 514815 - DNA, 16 bp, R. norvegicus
taaagaaattgaagca

SEQ ID NO: 514816 - DNA, 16 bp, R. norvegicus
taaagaactcaaggag

SEQ ID NO: 514817 - DNA, 16 bp, R. norvegicus
taaagaactccaaata

SEQ ID NO: 514818 - DNA, 16 bp, R. norvegicus
taaagaactttatttt

SEQ ID NO: 514819 - DNA, 16 bp, R. norvegicus
taaagaagaaaaagct

SEQ ID NO: 514820 - DNA, 16 bp, R. norvegicus
taaagaagaagtcaaa

SEQ ID NO: 514821 - DNA, 16 bp, R. norvegicus
taaagaagacccagca

SEQ ID NO: 514822 - DNA, 16 bp, R. norvegicus
taaagaagctgaaaag

SEQ ID NO: 514823 - DNA, 16 bp, R. norvegicus
taaagaatataccttc

SEQ ID NO: 514824 - DNA, 16 bp, R. norvegicus
taaagacaaagctgtt

SEQ ID NO: 514825 - DNA, 16 bp, R. norvegicus
taaagacagagaaagg

SEQ ID NO: 514826 - DNA, 16 bp, R. norvegicus
taaagacatgcatcac

SEQ ID NO: 514827 - DNA, 16 bp, R. norvegicus
taaagaccttttccca

SEQ ID NO: 514828 - DNA, 16 bp, R. norvegicus
taaagactacttagaa

SEQ ID NO: 514829 - DNA, 16 bp, R. norvegicus
taaagactgctgagag

SEQ ID NO: 514830 - DNA, 16 bp, R. norvegicus
taaagacttttgttcc

SEQ ID NO: 514831 - DNA, 16 bp, R. norvegicus
taaagactttttaaaa

SEQ ID NO: 514832 - DNA, 16 bp, R. norvegicus
taaagacttttttttt

SEQ ID NO: 514833 - DNA, 16 bp, R. norvegicus
taaagagaaaacacat

SEQ ID NO: 514834 - DNA, 16 bp, R. norvegicus
taaagagcaagttcca

SEQ ID NO: 514835 - DNA, 16 bp, R. norvegicus
taaagaggaaacagat

SEQ ID NO: 514836 - DNA, 16 bp, R. norvegicus
taaagatctattttat

SEQ ID NO: 514837 - DNA, 16 bp, R. norvegicus
taaagatctcttccca

SEQ ID NO: 514838 - DNA, 16 bp, R. norvegicus
taaagatgactttgaa

SEQ ID NO: 514839 - DNA, 16 bp, R. norvegicus
taaagatgatttaaat

SEQ ID NO: 514840 - DNA, 16 bp, R. norvegicus
taaagatgccagagcc

SEQ ID NO: 514841 - DNA, 16 bp, R. norvegicus
taaagatggaaaaaca

SEQ ID NO: 514842 - DNA, 16 bp, R. norvegicus
taaagatggagaaata

SEQ ID NO: 514843 - DNA, 17 bp, R. norvegicus
taaagatggcgccgaca

SEQ ID NO: 514844 - DNA, 16 bp, R. norvegicus
taaagatgtattttat

SEQ ID NO: 514845 - DNA, 16 bp, R. norvegicus
taaagatgtggaacat

SEQ ID NO: 514846 - DNA, 16 bp, R. norvegicus
taaagatgttttagaa

SEQ ID NO: 514847 - DNA, 16 bp, R. norvegicus
taaagatttatttcta

SEQ ID NO: 514848 - DNA, 16 bp, R. norvegicus
taaagcacactcctca

SEQ ID NO: 514849 - DNA, 16 bp, R. norvegicus
taaagcacccaggaaa

SEQ ID NO: 514850 - DNA, 16 bp, R. norvegicus
taaagcactggctgct

SEQ ID NO: 514851 - DNA, 16 bp, R. norvegicus
taaagcagcagcagca

SEQ ID NO: 514852 - DNA, 16 bp, R. norvegicus
taaagcattaatgcaa

SEQ ID NO: 514853 - DNA, 16 bp, R. norvegicus
taaagcatttgccaca

SEQ ID NO: 514854 - DNA, 16 bp, R. norvegicus
taaagcattttaaatt

SEQ ID NO: 514855 - DNA, 16 bp, R. norvegicus
taaagccatctgggac

SEQ ID NO: 514856 - DNA, 16 bp, R. norvegicus
taaagccctgggttca

SEQ ID NO: 514857 - DNA, 37 bp, R. norvegicus
taaagctacagtggactggggaactctgtcctggtta

SEQ ID NO: 514858 - DNA, 16 bp, R. norvegicus
taaagctcatttcctg

SEQ ID NO: 514859 - DNA, 16 bp, R. norvegicus
taaagctgctatggac

SEQ ID NO: 514860 - DNA, 16 bp, R. norvegicus
taaagctggatttcaa

SEQ ID NO: 514861 - DNA, 16 bp, R. norvegicus
taaagctggtaaacaa

SEQ ID NO: 514862 - DNA, 16 bp, R. norvegicus
taaaggaagaaattga

SEQ ID NO: 514863 - DNA, 16 bp, R. norvegicus
taaaggacaacattca

SEQ ID NO: 514864 - DNA, 16 bp, R. norvegicus
taaaggagaaattaat

SEQ ID NO: 514865 - DNA, 16 bp, R. norvegicus
taaaggaggaacagag

SEQ ID NO: 514866 - DNA, 17 bp, R. norvegicus
taaaggagttcttcatg

SEQ ID NO: 514867 - DNA, 16 bp, R. norvegicus
taaaggattgcagcat

SEQ ID NO: 514868 - DNA, 16 bp, R. norvegicus
taaaggcaagcaccac

SEQ ID NO: 514869 - DNA, 16 bp, R. norvegicus
taaaggcagacctttc

SEQ ID NO: 514870 - DNA, 16 bp, R. norvegicus
taaaggcatgtgccac

SEQ ID NO: 514871 - DNA, 16 bp, R. norvegicus
taaagggacaaagagt

SEQ ID NO: 514872 - DNA, 16 bp, R. norvegicus
taaagggagacctata

SEQ ID NO: 514873 - DNA, 16 bp, R. norvegicus
taaaggtcctggaaag

SEQ ID NO: 514874 - DNA, 16 bp, R. norvegicus
taaaggtgattgctgc

SEQ ID NO: 514875 - DNA, 16 bp, R. norvegicus
taaaggtgtttgctgt

SEQ ID NO: 514876 - DNA, 16 bp, R. norvegicus
taaagtaaaatgcaaa

SEQ ID NO: 514877 - DNA, 16 bp, R. norvegicus
taaagtcagaaatgtg

SEQ ID NO: 514878 - DNA, 16 bp, R. norvegicus
taaagtcattgttctt

SEQ ID NO: 514879 - DNA, 16 bp, R. norvegicus
taaagtgtgtgtgtgt

SEQ ID NO: 514880 - DNA, 16 bp, R. norvegicus
taaagttaaatcaaga

SEQ ID NO: 514881 - DNA, 16 bp, R. norvegicus
taaagttgtgtgtgtg

SEQ ID NO: 514882 - DNA, 16 bp, R. norvegicus
taaagtttaaaacaaa

SEQ ID NO: 514883 - DNA, 16 bp, R. norvegicus
taaataaacatgttta

SEQ ID NO: 514884 - DNA, 16 bp, R. norvegicus
taaataaagcaaatat

SEQ ID NO: 514885 - DNA, 16 bp, R. norvegicus
taaataaagcttttaa

SEQ ID NO: 514886 - DNA, 16 bp, R. norvegicus
taaataaagttgctat

SEQ ID NO: 514887 - DNA, 16 bp, R. norvegicus
taaataaatacataga

SEQ ID NO: 514888 - DNA, 16 bp, R. norvegicus
taaataaatacatgaa

SEQ ID NO: 514889 - DNA, 16 bp, R. norvegicus
taaataaatcctttct

SEQ ID NO: 514890 - DNA, 16 bp, R. norvegicus
taaataaatctgtttt

SEQ ID NO: 514891 - DNA, 16 bp, R. norvegicus
taaataacaaatactc

SEQ ID NO: 514892 - DNA, 16 bp, R. norvegicus
taaataacttccttaa

SEQ ID NO: 514893 - DNA, 16 bp, R. norvegicus
taaatacacaaactat

SEQ ID NO: 514894 - DNA, 16 bp, R. norvegicus
taaatacagttttttg

SEQ ID NO: 514895 - DNA, 16 bp, R. norvegicus
taaatagtaaagccca

SEQ ID NO: 514896 - DNA, 16 bp, R. norvegicus
taaatatacatatatg

SEQ ID NO: 514897 - DNA, 16 bp, R. norvegicus
taaatatatgtatgta

SEQ ID NO: 514898 - DNA, 16 bp, R. norvegicus
taaatatcagttaagt

SEQ ID NO: 514899 - DNA, 16 bp, R. norvegicus
taaatatctgttaaga

SEQ ID NO: 514900 - DNA, 16 bp, R. norvegicus
taaatatcttcaaaat

SEQ ID NO: 514901 - DNA, 16 bp, R. norvegicus
taaatatgtatataca

SEQ ID NO: 514902 - DNA, 16 bp, R. norvegicus
taaatatgtatttgtg

SEQ ID NO: 514903 - DNA, 16 bp, R. norvegicus
taaatattcaaaagaa

SEQ ID NO: 514904 - DNA, 16 bp, R. norvegicus
taaatatttcagtttt

SEQ ID NO: 514905 - DNA, 16 bp, R. norvegicus
taaatatttctaaaag

SEQ ID NO: 514906 - DNA, 16 bp, R. norvegicus
taaatatttctgaaaa

SEQ ID NO: 514907 - DNA, 16 bp, R. norvegicus
taaatatttgttgagt

SEQ ID NO: 514908 - DNA, 16 bp, R. norvegicus
taaatattttctgaaa

SEQ ID NO: 514909 - DNA, 16 bp, R. norvegicus
taaatcaataaatgta

SEQ ID NO: 514910 - DNA, 16 bp, R. norvegicus
taaatcatatatacat

SEQ ID NO: 514911 - DNA, 16 bp, R. norvegicus
taaatccaggcttggt

SEQ ID NO: 514912 - DNA, 16 bp, R. norvegicus
taaatccccaacccta

SEQ ID NO: 514913 - DNA, 16 bp, R. norvegicus
taaatcctcagaatgc

SEQ ID NO: 514914 - DNA, 16 bp, R. norvegicus
taaatcctttgaaaaa

SEQ ID NO: 514915 - DNA, 16 bp, R. norvegicus
taaatctgagagagag

SEQ ID NO: 514916 - DNA, 16 bp, R. norvegicus
taaatctgtggttttt

SEQ ID NO: 514917 - DNA, 16 bp, R. norvegicus
taaatcttggctgaat

SEQ ID NO: 514918 - DNA, 16 bp, R. norvegicus
taaatctttagaagtt

SEQ ID NO: 514919 - DNA, 16 bp, R. norvegicus
taaatgaaagaagcca

SEQ ID NO: 514920 - DNA, 16 bp, R. norvegicus
taaatgaactatattt

SEQ ID NO: 514921 - DNA, 16 bp, R. norvegicus
taaatgcaaacattta

SEQ ID NO: 514922 - DNA, 16 bp, R. norvegicus
taaatgcatattttat

SEQ ID NO: 514923 - DNA, 16 bp, R. norvegicus
taaatgctatgtaaat

SEQ ID NO: 514924 - DNA, 16 bp, R. norvegicus
taaatggaaagaaact

SEQ ID NO: 514925 - DNA, 16 bp, R. norvegicus
taaatggacagatcat

SEQ ID NO: 514926 - DNA, 17 bp, R. norvegicus
taaatggttggaactgg

SEQ ID NO: 514927 - DNA, 16 bp, R. norvegicus
taaatgtaacaaaaat

SEQ ID NO: 514928 - DNA, 16 bp, R. norvegicus
taaatgtaatacaaat

SEQ ID NO: 514929 - DNA, 16 bp, R. norvegicus
taaatgtaattttgct

SEQ ID NO: 514930 - DNA, 16 bp, R. norvegicus
taaatgtatacattta

SEQ ID NO: 514931 - DNA, 16 bp, R. norvegicus
taaatgtgtgtatgtg

SEQ ID NO: 514932 - DNA, 16 bp, R. norvegicus
taaatgtgtgtgccac

SEQ ID NO: 514933 - DNA, 16 bp, R. norvegicus
taaatgttcttaatct

SEQ ID NO: 514934 - DNA, 16 bp, R. norvegicus
taaatgtttgttaaat

SEQ ID NO: 514935 - DNA, 16 bp, R. norvegicus
taaattattttctttg

SEQ ID NO: 514936 - DNA, 16 bp, R. norvegicus
taaattctctctctct

SEQ ID NO: 514937 - DNA, 16 bp, R. norvegicus
taaattgaattaaggg

SEQ ID NO: 514938 - DNA, 16 bp, R. norvegicus
taaattgcttttgata

SEQ ID NO: 514939 - DNA, 16 bp, R. norvegicus
taaattggctcatttc

SEQ ID NO: 514940 - DNA, 16 bp, R. norvegicus
taaattgtttcttggg

SEQ ID NO: 514941 - DNA, 16 bp, R. norvegicus
taaatttaactcaaat

SEQ ID NO: 514942 - DNA, 16 bp, R. norvegicus
taaatttacacttcaa

SEQ ID NO: 514943 - DNA, 16 bp, R. norvegicus
taaatttcaaaaagtt

SEQ ID NO: 514944 - DNA, 16 bp, R. norvegicus
taaatttgaaaaacaa

SEQ ID NO: 514945 - DNA, 16 bp, R. norvegicus
taaattttcaaagaaa

SEQ ID NO: 514946 - DNA, 16 bp, R. norvegicus
taaattttcctgagaa

SEQ ID NO: 514947 - DNA, 16 bp, R. norvegicus
taaattttgtttcatt

SEQ ID NO: 514948 - DNA, 27 bp, R. norvegicus
taacaaaagcaattaacctgtttgtca

SEQ ID NO: 514949 - DNA, 16 bp, R. norvegicus
taacaaactggatgca

SEQ ID NO: 514950 - DNA, 16 bp, R. norvegicus
taacaacagcagcagc

SEQ ID NO: 514951 - DNA, 16 bp, R. norvegicus
taacaagaacttcaaa

SEQ ID NO: 514952 - DNA, 16 bp, R. norvegicus
taacaagctgaaggac

SEQ ID NO: 514953 - DNA, 16 bp, R. norvegicus
taacaagttacaataa

SEQ ID NO: 514954 - DNA, 16 bp, R. norvegicus
taacaataatgacaga

SEQ ID NO: 514955 - DNA, 16 bp, R. norvegicus
taacaatgaaataatt

SEQ ID NO: 514956 - DNA, 16 bp, R. norvegicus
taacaatgtttttgtt

SEQ ID NO: 514957 - DNA, 16 bp, R. norvegicus
taacacagcttccaga

SEQ ID NO: 514958 - DNA, 16 bp, R. norvegicus
taacactcctccattg

SEQ ID NO: 514959 - DNA, 16 bp, R. norvegicus
taacagaacttatgaa

SEQ ID NO: 514960 - DNA, 16 bp, R. norvegicus
taacaggaaacaagaa

SEQ ID NO: 514961 - DNA, 16 bp, R. norvegicus
taacaggaaacaataa

SEQ ID NO: 514962 - DNA, 16 bp, R. norvegicus
taacaggaaacagcaa

SEQ ID NO: 514963 - DNA, 16 bp, R. norvegicus
taacagtgcctctgga

SEQ ID NO: 514964 - DNA, 16 bp, R. norvegicus
taacatcaaggcagga

SEQ ID NO: 514965 - DNA, 16 bp, R. norvegicus
taacatcagagataat

SEQ ID NO: 514966 - DNA, 16 bp, R. norvegicus
taacatccttatttat

SEQ ID NO: 514967 - DNA, 17 bp, R. norvegicus
taacattcaagggatgc

SEQ ID NO: 514968 - DNA, 16 bp, R. norvegicus
taacattgcaaatgaa

SEQ ID NO: 514969 - DNA, 16 bp, R. norvegicus
taacatttctgaaaaa

SEQ ID NO: 514970 - DNA, 16 bp, R. norvegicus
taacatttgaaaatgt

SEQ ID NO: 514971 - DNA, 16 bp, R. norvegicus
taacatttttaaaaga

SEQ ID NO: 514972 - DNA, 16 bp, R. norvegicus
taaccaaaacaatcct

SEQ ID NO: 514973 - DNA, 16 bp, R. norvegicus
taaccaaaagaaagag

SEQ ID NO: 514974 - DNA, 16 bp, R. norvegicus
taaccaaacaagggaa

SEQ ID NO: 514975 - DNA, 16 bp, R. norvegicus
taaccaacaactttct

SEQ ID NO: 514976 - DNA, 16 bp, R. norvegicus
taaccaagaaactatt

SEQ ID NO: 514977 - DNA, 20 bp, R. norvegicus
taaccacatggtggctcaca

SEQ ID NO: 514978 - DNA, 16 bp, R. norvegicus
taaccactaagacatc

SEQ ID NO: 514979 - DNA, 16 bp, R. norvegicus
taaccactgaaccagc

SEQ ID NO: 514980 - DNA, 16 bp, R. norvegicus
taaccagatggctaga

SEQ ID NO: 514981 - DNA, 16 bp, R. norvegicus
taaccaggcaagactt

SEQ ID NO: 514982 - DNA, 16 bp, R. norvegicus
taaccattgatccatc

SEQ ID NO: 514983 - DNA, 16 bp, R. norvegicus
taacccaaaccatcca

SEQ ID NO: 514984 - DNA, 16 bp, R. norvegicus
taacccagcctggcct

SEQ ID NO: 514985 - DNA, 16 bp, R. norvegicus
taacccaggctggcct

SEQ ID NO: 514986 - DNA, 16 bp, R. norvegicus
taaccccagcactggg

SEQ ID NO: 514987 - DNA, 16 bp, R. norvegicus
taaccccagctctggg

SEQ ID NO: 514988 - DNA, 16 bp, R. norvegicus
taaccctagctggcct

SEQ ID NO: 514989 - DNA, 16 bp, R. norvegicus
taacctggagtccttc

SEQ ID NO: 514990 - DNA, 16 bp, R. norvegicus
taacctgggagaccaa

SEQ ID NO: 514991 - DNA, 16 bp, R. norvegicus
taacctgggctcacag

SEQ ID NO: 514992 - DNA, 16 bp, R. norvegicus
taacgaagcaagtaaa

SEQ ID NO: 514993 - DNA, 16 bp, R. norvegicus
taactagcaaaattac

SEQ ID NO: 514994 - DNA, 16 bp, R. norvegicus
taactatggttacaaa

SEQ ID NO: 514995 - DNA, 16 bp, R. norvegicus
taactcaggaacagat

SEQ ID NO: 514996 - DNA, 16 bp, R. norvegicus
taactcagtggtagag

SEQ ID NO: 514997 - DNA, 16 bp, R. norvegicus
taactccaatcccagg

SEQ ID NO: 514998 - DNA, 16 bp, R. norvegicus
taactccaattagcca

SEQ ID NO: 514999 - DNA, 16 bp, R. norvegicus
taactccagttccagg

SEQ ID NO: 515000 - DNA, 16 bp, R. norvegicus
taactctatgaggaat

SEQ ID NO: 515001 - DNA, 16 bp, R. norvegicus
taactctggttctagg

SEQ ID NO: 515002 - DNA, 16 bp, R. norvegicus
taactgaagtatgtca

SEQ ID NO: 515003 - DNA, 16 bp, R. norvegicus
taactgaggatgacct

SEQ ID NO: 515004 - DNA, 16 bp, R. norvegicus
taactgcaactttgct

SEQ ID NO: 515005 - DNA, 16 bp, R. norvegicus
taactgccatcactct

SEQ ID NO: 515006 - DNA, 16 bp, R. norvegicus
taactgcctgtaactc

SEQ ID NO: 515007 - DNA, 16 bp, R. norvegicus
taactgcttgtctact

SEQ ID NO: 515008 - DNA, 16 bp, R. norvegicus
taactgggtcctcaga

SEQ ID NO: 515009 - DNA, 16 bp, R. norvegicus
taactggtgtgtgtgt

SEQ ID NO: 515010 - DNA, 16 bp, R. norvegicus
taactgtaattttgct

SEQ ID NO: 515011 - DNA, 16 bp, R. norvegicus
taactgttttatctgt

SEQ ID NO: 515012 - DNA, 16 bp, R. norvegicus
taacttaaaagactca

SEQ ID NO: 515013 - DNA, 16 bp, R. norvegicus
taacttgtatcaagtt

SEQ ID NO: 515014 - DNA, 16 bp, R. norvegicus
taactttcagttattg

SEQ ID NO: 515015 - DNA, 16 bp, R. norvegicus
taactttctgaagaat

SEQ ID NO: 515016 - DNA, 16 bp, R. norvegicus
taactttttaaagttt

SEQ ID NO: 515017 - DNA, 16 bp, R. norvegicus
taactttttgaaattt

SEQ ID NO: 515018 - DNA, 16 bp, R. norvegicus
taagaaaaaggatcct

SEQ ID NO: 515019 - DNA, 16 bp, R. norvegicus
taagaaaatagaagtc

SEQ ID NO: 515020 - DNA, 16 bp, R. norvegicus
taagaaactgaaaacc

SEQ ID NO: 515021 - DNA, 16 bp, R. norvegicus
taagaaagatttattt

SEQ ID NO: 515022 - DNA, 16 bp, R. norvegicus
taagaaagcagactga

SEQ ID NO: 515023 - DNA, 16 bp, R. norvegicus
taagaaagcaggctga

SEQ ID NO: 515024 - DNA, 16 bp, R. norvegicus
taagaacaaggatatc

SEQ ID NO: 515025 - DNA, 16 bp, R. norvegicus
taagaacatttgctgc

SEQ ID NO: 515026 - DNA, 16 bp, R. norvegicus
taagaagaaagtatat

SEQ ID NO: 515027 - DNA, 16 bp, R. norvegicus
taagaagaaatatttc

SEQ ID NO: 515028 - DNA, 16 bp, R. norvegicus
taagaagctgagagaa

SEQ ID NO: 515029 - DNA, 16 bp, R. norvegicus
taagaaggagtgggaa

SEQ ID NO: 515030 - DNA, 16 bp, R. norvegicus
taagaagttgtttatg

SEQ ID NO: 515031 - DNA, 21 bp, R. norvegicus
taagaataacaaagtgtctct

SEQ ID NO: 515032 - DNA, 16 bp, R. norvegicus
taagaatatgtttttg

SEQ ID NO: 515033 - DNA, 16 bp, R. norvegicus
taagaatttcatgaag

SEQ ID NO: 515034 - DNA, 16 bp, R. norvegicus
taagacaaacttttct

SEQ ID NO: 515035 - DNA, 16 bp, R. norvegicus
taagacaaagtctcac

SEQ ID NO: 515036 - DNA, 16 bp, R. norvegicus
taagacaaagtcttac

SEQ ID NO: 515037 - DNA, 16 bp, R. norvegicus
taagacacggggcctg

SEQ ID NO: 515038 - DNA, 16 bp, R. norvegicus
taagaccaccatttct

SEQ ID NO: 515039 - DNA, 16 bp, R. norvegicus
taagactgctatgaac

SEQ ID NO: 515040 - DNA, 16 bp, R. norvegicus
taagagaaaaatgagc

SEQ ID NO: 515041 - DNA, 16 bp, R. norvegicus
taagagaaaggactga

SEQ ID NO: 515042 - DNA, 16 bp, R. norvegicus
taagagaacaaaatgc

SEQ ID NO: 515043 - DNA, 25 bp, R. norvegicus
taagagaacacaaatgccagcccac

SEQ ID NO: 515044 - DNA, 16 bp, R. norvegicus
taagagagaaagctga

SEQ ID NO: 515045 - DNA, 16 bp, R. norvegicus
taagagagcaagctga

SEQ ID NO: 515046 - DNA, 16 bp, R. norvegicus
taagagcaatggctgc

SEQ ID NO: 515047 - DNA, 16 bp, R. norvegicus
taagagccagaggaca

SEQ ID NO: 515048 - DNA, 16 bp, R. norvegicus
taagaggagtttcaag

SEQ ID NO: 515049 - DNA, 16 bp, R. norvegicus
taagaggtggagccta

SEQ ID NO: 515050 - DNA, 16 bp, R. norvegicus
taagagtacacaaatg

SEQ ID NO: 515051 - DNA, 16 bp, R. norvegicus
taagagtctttcacag

SEQ ID NO: 515052 - DNA, 16 bp, R. norvegicus
taagatatttaaacat

SEQ ID NO: 515053 - DNA, 22 bp, R. norvegicus
taagatcaagaatcgacaaata

SEQ ID NO: 515054 - DNA, 16 bp, R. norvegicus
taagatcattttaaaa

SEQ ID NO: 515055 - DNA, 16 bp, R. norvegicus
taagatctgatgtttt

SEQ ID NO: 515056 - DNA, 16 bp, R. norvegicus
taagatgaagcaaaaa

SEQ ID NO: 515057 - DNA, 16 bp, R. norvegicus
taagattgaggaagct

SEQ ID NO: 515058 - DNA, 16 bp, R. norvegicus
taagattttcatgaag

SEQ ID NO: 515059 - DNA, 16 bp, R. norvegicus
taagcagagggcacag

SEQ ID NO: 515060 - DNA, 16 bp, R. norvegicus
taagcagcacctttct

SEQ ID NO: 515061 - DNA, 18 bp, R. norvegicus
taagcagcagcagcagca

SEQ ID NO: 515062 - DNA, 16 bp, R. norvegicus
taagcaggaagcagag

SEQ ID NO: 515063 - DNA, 16 bp, R. norvegicus
taagcatttttaaaaa

SEQ ID NO: 515064 - DNA, 16 bp, R. norvegicus
taagccaggtgtggtg

SEQ ID NO: 515065 - DNA, 16 bp, R. norvegicus
taagcccacacaccta

SEQ ID NO: 515066 - DNA, 16 bp, R. norvegicus
taagccctcaggaaca

SEQ ID NO: 515067 - DNA, 16 bp, R. norvegicus
taagcctcagagacaa

SEQ ID NO: 515068 - DNA, 16 bp, R. norvegicus
taagctctaccataaa

SEQ ID NO: 515069 - DNA, 16 bp, R. norvegicus
taaggaaatgtcaggg

SEQ ID NO: 515070 - DNA, 16 bp, R. norvegicus
taaggaagaaatattt

SEQ ID NO: 515071 - DNA, 16 bp, R. norvegicus
taaggaagcagaaagg

SEQ ID NO: 515072 - DNA, 16 bp, R. norvegicus
taaggaaggacagttc

SEQ ID NO: 515073 - DNA, 16 bp, R. norvegicus
taaggacaaatattta

SEQ ID NO: 515074 - DNA, 16 bp, R. norvegicus
taaggagctgaagaga

SEQ ID NO: 515075 - DNA, 16 bp, R. norvegicus
taaggaggagcactgt

SEQ ID NO: 515076 - DNA, 16 bp, R. norvegicus
taaggaggatatcttg

SEQ ID NO: 515077 - DNA, 16 bp, R. norvegicus
taaggcaaagggcact

SEQ ID NO: 515078 - DNA, 16 bp, R. norvegicus
taaggcaagcacagtg

SEQ ID NO: 515079 - DNA, 16 bp, R. norvegicus
taaggcagcagctaat

SEQ ID NO: 515080 - DNA, 17 bp, R. norvegicus
taaggccagcctggtct

SEQ ID NO: 515081 - DNA, 16 bp, R. norvegicus
taaggctggatgaggc

SEQ ID NO: 515082 - DNA, 16 bp, R. norvegicus
taaggctgttcttcaa

SEQ ID NO: 515083 - DNA, 16 bp, R. norvegicus
taagggaaccagtgga

SEQ ID NO: 515084 - DNA, 16 bp, R. norvegicus
taaggtcaaaaattca

SEQ ID NO: 515085 - DNA, 16 bp, R. norvegicus
taaggtccctcccttt

SEQ ID NO: 515086 - DNA, 16 bp, R. norvegicus
taaggtgaagagattt

SEQ ID NO: 515087 - DNA, 17 bp, R. norvegicus
taaggttaggagaaatg

SEQ ID NO: 515088 - DNA, 16 bp, R. norvegicus
taaggttccctcctct

SEQ ID NO: 515089 - DNA, 16 bp, R. norvegicus
taagtcacctctcttt

SEQ ID NO: 515090 - DNA, 16 bp, R. norvegicus
taagtccattttgctc

SEQ ID NO: 515091 - DNA, 16 bp, R. norvegicus
taagtccctgaagaaa

SEQ ID NO: 515092 - DNA, 16 bp, R. norvegicus
taagtccctggaagct

SEQ ID NO: 515093 - DNA, 16 bp, R. norvegicus
taagtctcctgcagaa

SEQ ID NO: 515094 - DNA, 16 bp, R. norvegicus
taagtctggaggttcc

SEQ ID NO: 515095 - DNA, 16 bp, R. norvegicus
taagtgaccccaataa

SEQ ID NO: 515096 - DNA, 16 bp, R. norvegicus
taagtggtcccaaaag

SEQ ID NO: 515097 - DNA, 16 bp, R. norvegicus
taagtgtatctggttt

SEQ ID NO: 515098 - DNA, 16 bp, R. norvegicus
taagtgtgaccttgtt

SEQ ID NO: 515099 - DNA, 16 bp, R. norvegicus
taagtgtgggaaaggc

SEQ ID NO: 515100 - DNA, 16 bp, R. norvegicus
taagtgtggtggcaca

SEQ ID NO: 515101 - DNA, 16 bp, R. norvegicus
taagtgtgtatatgta

SEQ ID NO: 515102 - DNA, 16 bp, R. norvegicus
taagtttaaattactg

SEQ ID NO: 515103 - DNA, 16 bp, R. norvegicus
taagtttctttaaaaa

SEQ ID NO: 515104 - DNA, 16 bp, R. norvegicus
taataaaagcagcatg

SEQ ID NO: 515105 - DNA, 16 bp, R. norvegicus
taataaaattttgaac

SEQ ID NO: 515106 - DNA, 16 bp, R. norvegicus
taataaagatataaac

SEQ ID NO: 515107 - DNA, 16 bp, R. norvegicus
taataaagtgttttca

SEQ ID NO: 515108 - DNA, 16 bp, R. norvegicus
taataaagtttaaact

SEQ ID NO: 515109 - DNA, 16 bp, R. norvegicus
taataaccaaaagctg

SEQ ID NO: 515110 - DNA, 16 bp, R. norvegicus
taataatcaaagcact

SEQ ID NO: 515111 - DNA, 16 bp, R. norvegicus
taataatcctggagaa

SEQ ID NO: 515112 - DNA, 16 bp, R. norvegicus
taatacaggttaattc

SEQ ID NO: 515113 - DNA, 16 bp, R. norvegicus
taatagaagaagaagt

SEQ ID NO: 515114 - DNA, 16 bp, R. norvegicus
taatagaagagaaact

SEQ ID NO: 515115 - DNA, 16 bp, R. norvegicus
taatagaagagaaagt

SEQ ID NO: 515116 - DNA, 16 bp, R. norvegicus
taatagaattgaagac

SEQ ID NO: 515117 - DNA, 16 bp, R. norvegicus
taatagagatggagaa

SEQ ID NO: 515118 - DNA, 16 bp, R. norvegicus
taatagaggaaaaagt

SEQ ID NO: 515119 - DNA, 16 bp, R. norvegicus
taatagccagcagctg

SEQ ID NO: 515120 - DNA, 16 bp, R. norvegicus
taatagggttatttgt

SEQ ID NO: 515121 - DNA, 16 bp, R. norvegicus
taatagtaataatgat

SEQ ID NO: 515122 - DNA, 16 bp, R. norvegicus
taatatacaaaatgta

SEQ ID NO: 515123 - DNA, 26 bp, R. norvegicus
taatatatctcagtatcttacaggaa

SEQ ID NO: 515124 - DNA, 16 bp, R. norvegicus
taatatatgtcttttt

SEQ ID NO: 515125 - DNA, 16 bp, R. norvegicus
taatatctttaccctc

SEQ ID NO: 515126 - DNA, 20 bp, R. norvegicus
taatattccattgtgtagat

SEQ ID NO: 515127 - DNA, 16 bp, R. norvegicus
taatcaaactcagaga

SEQ ID NO: 515128 - DNA, 16 bp, R. norvegicus
taatcaaggaagaaat

SEQ ID NO: 515129 - DNA, 16 bp, R. norvegicus
taatcacttaactgta

SEQ ID NO: 515130 - DNA, 16 bp, R. norvegicus
taatcattcacaaaac

SEQ ID NO: 515131 - DNA, 16 bp, R. norvegicus
taatccaaccattttg

SEQ ID NO: 515132 - DNA, 16 bp, R. norvegicus
taatccacttgaactt

SEQ ID NO: 515133 - DNA, 16 bp, R. norvegicus
taatcccaacccttgg

SEQ ID NO: 515134 - DNA, 16 bp, R. norvegicus
taatcccaggtgtggg

SEQ ID NO: 515135 - DNA, 16 bp, R. norvegicus
taatccccaaagcaag

SEQ ID NO: 515136 - DNA, 16 bp, R. norvegicus
taatccccgcacttgg

SEQ ID NO: 515137 - DNA, 16 bp, R. norvegicus
taatccctggaagctc

SEQ ID NO: 515138 - DNA, 16 bp, R. norvegicus
taatcctagcacttgg

SEQ ID NO: 515139 - DNA, 16 bp, R. norvegicus
taatctatatatctat

SEQ ID NO: 515140 - DNA, 16 bp, R. norvegicus
taatctcagcactgga

SEQ ID NO: 515141 - DNA, 16 bp, R. norvegicus
taatcttctgtctcct

SEQ ID NO: 515142 - DNA, 16 bp, R. norvegicus
taatctttgctttctt

SEQ ID NO: 515143 - DNA, 16 bp, R. norvegicus
taatgaaaatggaggt

SEQ ID NO: 515144 - DNA, 16 bp, R. norvegicus
taatgaaaatgtggta

SEQ ID NO: 515145 - DNA, 16 bp, R. norvegicus
taatgaaagacagaaa

SEQ ID NO: 515146 - DNA, 16 bp, R. norvegicus
taatgaagatggaaaa

SEQ ID NO: 515147 - DNA, 16 bp, R. norvegicus
taatgaagtcattgtt

SEQ ID NO: 515148 - DNA, 16 bp, R. norvegicus
taatgacagtgtcatt

SEQ ID NO: 515149 - DNA, 18 bp, R. norvegicus
taatgactttatgaaatt

SEQ ID NO: 515150 - DNA, 16 bp, R. norvegicus
taatgagactgtctca

SEQ ID NO: 515151 - DNA, 16 bp, R. norvegicus
taatgagagaagagga

SEQ ID NO: 515152 - DNA, 17 bp, R. norvegicus
taatgagatctgatgcc

SEQ ID NO: 515153 - DNA, 16 bp, R. norvegicus
taatgagatgatgatg

SEQ ID NO: 515154 - DNA, 16 bp, R. norvegicus
taatgaggacctgagg

SEQ ID NO: 515155 - DNA, 16 bp, R. norvegicus
taatgatggaggactt

SEQ ID NO: 515156 - DNA, 16 bp, R. norvegicus
taatggaactagaaaa

SEQ ID NO: 515157 - DNA, 16 bp, R. norvegicus
taatggagatctgatg

SEQ ID NO: 515158 - DNA, 16 bp, R. norvegicus
taatggagtactattc

SEQ ID NO: 515159 - DNA, 16 bp, R. norvegicus
taatggatggatagat

SEQ ID NO: 515160 - DNA, 16 bp, R. norvegicus
taatgggatccaattc

SEQ ID NO: 515161 - DNA, 21 bp, R. norvegicus
taatgtccaattttctgagga

SEQ ID NO: 515162 - DNA, 16 bp, R. norvegicus
taatgtctggaatttt

SEQ ID NO: 515163 - DNA, 16 bp, R. norvegicus
taatgttgagagatat

SEQ ID NO: 515164 - DNA, 16 bp, R. norvegicus
taattaattaactaac

SEQ ID NO: 515165 - DNA, 16 bp, R. norvegicus
taattacatcattccc

SEQ ID NO: 515166 - DNA, 16 bp, R. norvegicus
taattatattgtaatc

SEQ ID NO: 515167 - DNA, 16 bp, R. norvegicus
taattcaagatttctt

SEQ ID NO: 515168 - DNA, 16 bp, R. norvegicus
taattcaagcttttga

SEQ ID NO: 515169 - DNA, 16 bp, R. norvegicus
taattcagctcccaaa

SEQ ID NO: 515170 - DNA, 16 bp, R. norvegicus
taattccaactccagg

SEQ ID NO: 515171 - DNA, 16 bp, R. norvegicus
taattccacatctaac

SEQ ID NO: 515172 - DNA, 16 bp, R. norvegicus
taattccagcacatgg

SEQ ID NO: 515173 - DNA, 16 bp, R. norvegicus
taattcctaaagaaat

SEQ ID NO: 515174 - DNA, 16 bp, R. norvegicus
taattccttcatctgt

SEQ ID NO: 515175 - DNA, 16 bp, R. norvegicus
taattctagcacttgg

SEQ ID NO: 515176 - DNA, 16 bp, R. norvegicus
taattgtgtcctggat

SEQ ID NO: 515177 - DNA, 16 bp, R. norvegicus
taattgttgcttcctg

SEQ ID NO: 515178 - DNA, 16 bp, R. norvegicus
taatttaaaaagcaaa

SEQ ID NO: 515179 - DNA, 16 bp, R. norvegicus
taatttcatttctgtt

SEQ ID NO: 515180 - DNA, 16 bp, R. norvegicus
taatttctgtctttgt

SEQ ID NO: 515181 - DNA, 16 bp, R. norvegicus
taatttctttctcagc

SEQ ID NO: 515182 - DNA, 16 bp, R. norvegicus
taattttagtggaatt

SEQ ID NO: 515183 - DNA, 16 bp, R. norvegicus
taattttcaaaatgtg

SEQ ID NO: 515184 - DNA, 16 bp, R. norvegicus
taattttcaaatgaaa

SEQ ID NO: 515185 - DNA, 16 bp, R. norvegicus
taattttcatttgaaa

SEQ ID NO: 515186 - DNA, 16 bp, R. norvegicus
taattttctagacaga

SEQ ID NO: 515187 - DNA, 16 bp, R. norvegicus
taattttgagacagga

SEQ ID NO: 515188 - DNA, 16 bp, R. norvegicus
taattttgccactgtt

SEQ ID NO: 515189 - DNA, 16 bp, R. norvegicus
taattttgctactgtt

SEQ ID NO: 515190 - DNA, 16 bp, R. norvegicus
taatttttgaaagtca

SEQ ID NO: 515191 - DNA, 16 bp, R. norvegicus
tacaaaaagcaattta

SEQ ID NO: 515192 - DNA, 16 bp, R. norvegicus
tacaaaaatccattaa

SEQ ID NO: 515193 - DNA, 16 bp, R. norvegicus
tacaaaagagaaacca

SEQ ID NO: 515194 - DNA, 16 bp, R. norvegicus
tacaaaagctcaaagc

SEQ ID NO: 515195 - DNA, 16 bp, R. norvegicus
tacaaaagttttgcag

SEQ ID NO: 515196 - DNA, 16 bp, R. norvegicus
tacaaaatatctttct

SEQ ID NO: 515197 - DNA, 16 bp, R. norvegicus
tacaaaatgaaatact

SEQ ID NO: 515198 - DNA, 16 bp, R. norvegicus
tacaaaatgtacagtt

SEQ ID NO: 515199 - DNA, 16 bp, R. norvegicus
tacaaacagcatcagg

SEQ ID NO: 515200 - DNA, 16 bp, R. norvegicus
tacaaacatctgtaac

SEQ ID NO: 515201 - DNA, 16 bp, R. norvegicus
tacaaacctcaagtcc

SEQ ID NO: 515202 - DNA, 16 bp, R. norvegicus
tacaaactgtcctctg

SEQ ID NO: 515203 - DNA, 16 bp, R. norvegicus
tacaaagaaaaatatt

SEQ ID NO: 515204 - DNA, 16 bp, R. norvegicus
tacaaagaataaacag

SEQ ID NO: 515205 - DNA, 16 bp, R. norvegicus
tacaaagaatcaagaa

SEQ ID NO: 515206 - DNA, 16 bp, R. norvegicus
tacaaagacaaagttt

SEQ ID NO: 515207 - DNA, 16 bp, R. norvegicus
tacaaagagaaacagc

SEQ ID NO: 515208 - DNA, 16 bp, R. norvegicus
tacaaagagattgaaa

SEQ ID NO: 515209 - DNA, 16 bp, R. norvegicus
tacaaagagttccagg

SEQ ID NO: 515210 - DNA, 16 bp, R. norvegicus
tacaaagctgaagtcc

SEQ ID NO: 515211 - DNA, 22 bp, R. norvegicus
tacaaagcttctgtaaggcaaa

SEQ ID NO: 515212 - DNA, 16 bp, R. norvegicus
tacaaaggataaatgg

SEQ ID NO: 515213 - DNA, 16 bp, R. norvegicus
tacaaaggttaataaa

SEQ ID NO: 515214 - DNA, 16 bp, R. norvegicus
tacaaagtcaaggaaa

SEQ ID NO: 515215 - DNA, 16 bp, R. norvegicus
tacaaagtgagactct

SEQ ID NO: 515216 - DNA, 16 bp, R. norvegicus
tacaaagtgataagaa

SEQ ID NO: 515217 - DNA, 16 bp, R. norvegicus
tacaaagtttacaaag

SEQ ID NO: 515218 - DNA, 16 bp, R. norvegicus
tacaaatacacagaca

SEQ ID NO: 515219 - DNA, 16 bp, R. norvegicus
tacaaatacatgcaca

SEQ ID NO: 515220 - DNA, 16 bp, R. norvegicus
tacaaatatgtatata

SEQ ID NO: 515221 - DNA, 16 bp, R. norvegicus
tacaaatcctacaaca

SEQ ID NO: 515222 - DNA, 16 bp, R. norvegicus
tacaaatgataaatgg

SEQ ID NO: 515223 - DNA, 16 bp, R. norvegicus
tacaaattggaaaaga

SEQ ID NO: 515224 - DNA, 16 bp, R. norvegicus
tacaaattgtcctctg

SEQ ID NO: 515225 - DNA, 16 bp, R. norvegicus
tacaaatttttcagac

SEQ ID NO: 515226 - DNA, 16 bp, R. norvegicus
tacaacaaggaggact

SEQ ID NO: 515227 - DNA, 16 bp, R. norvegicus
tacaacagaagctgtt

SEQ ID NO: 515228 - DNA, 16 bp, R. norvegicus
tacaacagacagaggc

SEQ ID NO: 515229 - DNA, 16 bp, R. norvegicus
tacaacagagagaggc

SEQ ID NO: 515230 - DNA, 38 bp, R. norvegicus
tacaacatacccaaacttatgggacacaatgaaagcta

SEQ ID NO: 515231 - DNA, 16 bp, R. norvegicus
tacaacatacgcaaac

SEQ ID NO: 515232 - DNA, 16 bp, R. norvegicus
tacaacattttggtgc

SEQ ID NO: 515233 - DNA, 16 bp, R. norvegicus
tacaaccactttagaa

SEQ ID NO: 515234 - DNA, 16 bp, R. norvegicus
tacaaccttctgactc

SEQ ID NO: 515235 - DNA, 17 bp, R. norvegicus
tacaacctttctggaaa

SEQ ID NO: 515236 - DNA, 16 bp, R. norvegicus
tacaactccagttcca

SEQ ID NO: 515237 - DNA, 16 bp, R. norvegicus
tacaactgatagaggc

SEQ ID NO: 515238 - DNA, 16 bp, R. norvegicus
tacaagaagaagaaga

SEQ ID NO: 515239 - DNA, 16 bp, R. norvegicus
tacaagacatagaaga

SEQ ID NO: 515240 - DNA, 16 bp, R. norvegicus
tacaagacttgagaga

SEQ ID NO: 515241 - DNA, 16 bp, R. norvegicus
tacaagatatggaaga

SEQ ID NO: 515242 - DNA, 16 bp, R. norvegicus
tacaagatggatgaag

SEQ ID NO: 515243 - DNA, 16 bp, R. norvegicus
tacaagatttacaaag

SEQ ID NO: 515244 - DNA, 16 bp, R. norvegicus
tacaaggagctactgg

SEQ ID NO: 515245 - DNA, 16 bp, R. norvegicus
tacaaggtgataaaaa

SEQ ID NO: 515246 - DNA, 16 bp, R. norvegicus
tacaagtaacattgta

SEQ ID NO: 515247 - DNA, 16 bp, R. norvegicus
tacaagtcccttcagc

SEQ ID NO: 515248 - DNA, 16 bp, R. norvegicus
tacaagtgtgcacaca

SEQ ID NO: 515249 - DNA, 16 bp, R. norvegicus
tacaagttgacctcca

SEQ ID NO: 515250 - DNA, 16 bp, R. norvegicus
tacaatgaaactaata

SEQ ID NO: 515251 - DNA, 16 bp, R. norvegicus
tacaatgtgtgctttg

SEQ ID NO: 515252 - DNA, 16 bp, R. norvegicus
tacaattaaacaggtg

SEQ ID NO: 515253 - DNA, 16 bp, R. norvegicus
tacaattcagaacagt

SEQ ID NO: 515254 - DNA, 18 bp, R. norvegicus
tacaattcttttgtcagc

SEQ ID NO: 515255 - DNA, 16 bp, R. norvegicus
tacacaaagaaaacct

SEQ ID NO: 515256 - DNA, 16 bp, R. norvegicus
tacacaatggaacatt

SEQ ID NO: 515257 - DNA, 16 bp, R. norvegicus
tacacacacacataca

SEQ ID NO: 515258 - DNA, 16 bp, R. norvegicus
tacacacacacatatg

SEQ ID NO: 515259 - DNA, 16 bp, R. norvegicus
tacacacacatacaca

SEQ ID NO: 515260 - DNA, 16 bp, R. norvegicus
tacacacacatacata

SEQ ID NO: 515261 - DNA, 16 bp, R. norvegicus
tacacacacattcaca

SEQ ID NO: 515262 - DNA, 16 bp, R. norvegicus
tacacacacccctaca

SEQ ID NO: 515263 - DNA, 16 bp, R. norvegicus
tacacacagagaaaaa

SEQ ID NO: 515264 - DNA, 16 bp, R. norvegicus
tacacacatacatgca

SEQ ID NO: 515265 - DNA, 16 bp, R. norvegicus
tacacacatgcataca

SEQ ID NO: 515266 - DNA, 16 bp, R. norvegicus
tacacacatgtactta

SEQ ID NO: 515267 - DNA, 16 bp, R. norvegicus
tacacactggagaaaa

SEQ ID NO: 515268 - DNA, 16 bp, R. norvegicus
tacacactggagtact

SEQ ID NO: 515269 - DNA, 16 bp, R. norvegicus
tacacactgtgtgtgt

SEQ ID NO: 515270 - DNA, 16 bp, R. norvegicus
tacacagacacacaca

SEQ ID NO: 515271 - DNA, 16 bp, R. norvegicus
tacacagacatacgtg

SEQ ID NO: 515272 - DNA, 16 bp, R. norvegicus
tacacagagaaacaca

SEQ ID NO: 515273 - DNA, 16 bp, R. norvegicus
tacacagagaaaccaa

SEQ ID NO: 515274 - DNA, 16 bp, R. norvegicus
tacacagagaaaccac

SEQ ID NO: 515275 - DNA, 16 bp, R. norvegicus
tacacagagaaatcct

SEQ ID NO: 515276 - DNA, 16 bp, R. norvegicus
tacacagagaagccct

SEQ ID NO: 515277 - DNA, 16 bp, R. norvegicus
tacacagcaaagtcct

SEQ ID NO: 515278 - DNA, 16 bp, R. norvegicus
tacacagcaagtttca

SEQ ID NO: 515279 - DNA, 16 bp, R. norvegicus
tacacagccaccaaac

SEQ ID NO: 515280 - DNA, 16 bp, R. norvegicus
tacacagggatggatc

SEQ ID NO: 515281 - DNA, 16 bp, R. norvegicus
tacacagtgagaccct

SEQ ID NO: 515282 - DNA, 16 bp, R. norvegicus
tacacagtgagactgt

SEQ ID NO: 515283 - DNA, 16 bp, R. norvegicus
tacacataatatacat

SEQ ID NO: 515284 - DNA, 16 bp, R. norvegicus
tacacatacacaagca

SEQ ID NO: 515285 - DNA, 16 bp, R. norvegicus
tacacatacacataca

SEQ ID NO: 515286 - DNA, 16 bp, R. norvegicus
tacacatatatatttt

SEQ ID NO: 515287 - DNA, 16 bp, R. norvegicus
tacacatgcaaaaaaa

SEQ ID NO: 515288 - DNA, 16 bp, R. norvegicus
tacacatgggcagacc

SEQ ID NO: 515289 - DNA, 16 bp, R. norvegicus
tacacatggtgcacag

SEQ ID NO: 515290 - DNA, 16 bp, R. norvegicus
tacacatgtgtatgtg

SEQ ID NO: 515291 - DNA, 16 bp, R. norvegicus
tacacattcaggaata

SEQ ID NO: 515292 - DNA, 16 bp, R. norvegicus
tacaccaaagaaaaca

SEQ ID NO: 515293 - DNA, 16 bp, R. norvegicus
tacaccaccatgcctg

SEQ ID NO: 515294 - DNA, 16 bp, R. norvegicus
tacaccagaagagaga

SEQ ID NO: 515295 - DNA, 16 bp, R. norvegicus
tacaccagacttctga

SEQ ID NO: 515296 - DNA, 16 bp, R. norvegicus
tacaccaggttggcct

SEQ ID NO: 515297 - DNA, 16 bp, R. norvegicus
tacacccaagaggagc

SEQ ID NO: 515298 - DNA, 16 bp, R. norvegicus
tacacccagtaggagt

SEQ ID NO: 515299 - DNA, 16 bp, R. norvegicus
tacaccccacagaccc

SEQ ID NO: 515300 - DNA, 16 bp, R. norvegicus
tacaccctaggaaaag

SEQ ID NO: 515301 - DNA, 16 bp, R. norvegicus
tacaccctggaggagt

SEQ ID NO: 515302 - DNA, 16 bp, R. norvegicus
tacaccgtagctgtct

SEQ ID NO: 515303 - DNA, 16 bp, R. norvegicus
tacacgagacttctca

SEQ ID NO: 515304 - DNA, 16 bp, R. norvegicus
tacacgcatatacaca

SEQ ID NO: 515305 - DNA, 16 bp, R. norvegicus
tacactaggctggcct

SEQ ID NO: 515306 - DNA, 16 bp, R. norvegicus
tacactcacatgcaca

SEQ ID NO: 515307 - DNA, 16 bp, R. norvegicus
tacactctctctctct

SEQ ID NO: 515308 - DNA, 16 bp, R. norvegicus
tacactgatggatttc

SEQ ID NO: 515309 - DNA, 16 bp, R. norvegicus
tacactggggaaacaa

SEQ ID NO: 515310 - DNA, 16 bp, R. norvegicus
tacactggggtatcca

SEQ ID NO: 515311 - DNA, 16 bp, R. norvegicus
tacactgtggctgtct

SEQ ID NO: 515312 - DNA, 16 bp, R. norvegicus
tacactgtgggacaca

SEQ ID NO: 515313 - DNA, 16 bp, R. norvegicus
tacacttcagacacac

SEQ ID NO: 515314 - DNA, 16 bp, R. norvegicus
tacagaaaaccaaaag

SEQ ID NO: 515315 - DNA, 22 bp, R. norvegicus
tacagaaaacttaagtgtacat

SEQ ID NO: 515316 - DNA, 16 bp, R. norvegicus
tacagaaaacttcagg

SEQ ID NO: 515317 - DNA, 16 bp, R. norvegicus
tacagaaaagatacat

SEQ ID NO: 515318 - DNA, 16 bp, R. norvegicus
tacagaaaatgtggtt

SEQ ID NO: 515319 - DNA, 16 bp, R. norvegicus
tacagaaagagaaaag

SEQ ID NO: 515320 - DNA, 16 bp, R. norvegicus
tacagaaagagaagaa

SEQ ID NO: 515321 - DNA, 16 bp, R. norvegicus
tacagaaagatggaaa

SEQ ID NO: 515322 - DNA, 16 bp, R. norvegicus
tacagaaatagaaacc

SEQ ID NO: 515323 - DNA, 16 bp, R. norvegicus
tacagaacaccaaata

SEQ ID NO: 515324 - DNA, 16 bp, R. norvegicus
tacagaagctcttcag

SEQ ID NO: 515325 - DNA, 16 bp, R. norvegicus
tacagaagctttccaa

SEQ ID NO: 515326 - DNA, 16 bp, R. norvegicus
tacagaatatccagga

SEQ ID NO: 515327 - DNA, 16 bp, R. norvegicus
tacagaatctgaagaa

SEQ ID NO: 515328 - DNA, 16 bp, R. norvegicus
tacagaatgaattcca

SEQ ID NO: 515329 - DNA, 16 bp, R. norvegicus
tacagaatgagaccct

SEQ ID NO: 515330 - DNA, 16 bp, R. norvegicus
tacagacaacaaaccc

SEQ ID NO: 515331 - DNA, 16 bp, R. norvegicus
tacagacacagataca

SEQ ID NO: 515332 - DNA, 16 bp, R. norvegicus
tacagacacaggcagg

SEQ ID NO: 515333 - DNA, 16 bp, R. norvegicus
tacagacactgtcata

SEQ ID NO: 515334 - DNA, 16 bp, R. norvegicus
tacagacagctgtgag

SEQ ID NO: 515335 - DNA, 16 bp, R. norvegicus
tacagacagttatgaa

SEQ ID NO: 515336 - DNA, 16 bp, R. norvegicus
tacagactgagttcca

SEQ ID NO: 515337 - DNA, 16 bp, R. norvegicus
tacagagaaaccctat

SEQ ID NO: 515338 - DNA, 16 bp, R. norvegicus
tacagagaatgagaga

SEQ ID NO: 515339 - DNA, 16 bp, R. norvegicus
tacagagacacacaga

SEQ ID NO: 515340 - DNA, 16 bp, R. norvegicus
tacagagacacacagg

SEQ ID NO: 515341 - DNA, 16 bp, R. norvegicus
tacagagacagagaga

SEQ ID NO: 515342 - DNA, 16 bp, R. norvegicus
tacagagacaggaaga

SEQ ID NO: 515343 - DNA, 16 bp, R. norvegicus
tacagagacagtcaga

SEQ ID NO: 515344 - DNA, 16 bp, R. norvegicus
tacagagacctgtggg

SEQ ID NO: 515345 - DNA, 16 bp, R. norvegicus
tacagagaccttgtct

SEQ ID NO: 515346 - DNA, 18 bp, R. norvegicus
tacagagcaatagtgatt

SEQ ID NO: 515347 - DNA, 16 bp, R. norvegicus
tacagagctaaaggaa

SEQ ID NO: 515348 - DNA, 16 bp, R. norvegicus
tacagagctgccatct

SEQ ID NO: 515349 - DNA, 16 bp, R. norvegicus
tacagaggcggatgcc

SEQ ID NO: 515350 - DNA, 16 bp, R. norvegicus
tacagagggcagagct

SEQ ID NO: 515351 - DNA, 16 bp, R. norvegicus
tacagaggggaaacca

SEQ ID NO: 515352 - DNA, 16 bp, R. norvegicus
tacagagtccagaaga

SEQ ID NO: 515353 - DNA, 16 bp, R. norvegicus
tacagagtctgatcag

SEQ ID NO: 515354 - DNA, 16 bp, R. norvegicus
tacagagtgaatccca

SEQ ID NO: 515355 - DNA, 16 bp, R. norvegicus
tacagatacagatgag

SEQ ID NO: 515356 - DNA, 16 bp, R. norvegicus
tacagatccagatgta

SEQ ID NO: 515357 - DNA, 26 bp, R. norvegicus
tacagatctcagaaatggttccattg

SEQ ID NO: 515358 - DNA, 16 bp, R. norvegicus
tacagatgcaaatact

SEQ ID NO: 515359 - DNA, 16 bp, R. norvegicus
tacagatgcatgccac

SEQ ID NO: 515360 - DNA, 16 bp, R. norvegicus
tacagatgcgaatgct

SEQ ID NO: 515361 - DNA, 16 bp, R. norvegicus
tacagatggctgtaag

SEQ ID NO: 515362 - DNA, 16 bp, R. norvegicus
tacagattcactgcaa

SEQ ID NO: 515363 - DNA, 16 bp, R. norvegicus
tacagcaaacacagag

SEQ ID NO: 515364 - DNA, 16 bp, R. norvegicus
tacagcaaagcagttg

SEQ ID NO: 515365 - DNA, 16 bp, R. norvegicus
tacagcaaatggagac

SEQ ID NO: 515366 - DNA, 16 bp, R. norvegicus
tacagcacccaggacc

SEQ ID NO: 515367 - DNA, 16 bp, R. norvegicus
tacagcactcctgaaa

SEQ ID NO: 515368 - DNA, 17 bp, R. norvegicus
tacagcacttctgacac

SEQ ID NO: 515369 - DNA, 16 bp, R. norvegicus
tacagcagcagcagca

SEQ ID NO: 515370 - DNA, 16 bp, R. norvegicus
tacagcagctgagatg

SEQ ID NO: 515371 - DNA, 16 bp, R. norvegicus
tacagccagagcatgt

SEQ ID NO: 515372 - DNA, 16 bp, R. norvegicus
tacagccagtttgctt

SEQ ID NO: 515373 - DNA, 16 bp, R. norvegicus
tacagcccagagtcat

SEQ ID NO: 515374 - DNA, 16 bp, R. norvegicus
tacagctactctggaa

SEQ ID NO: 515375 - DNA, 16 bp, R. norvegicus
tacagctatgctgggg

SEQ ID NO: 515376 - DNA, 16 bp, R. norvegicus
tacagctgaggaatat

SEQ ID NO: 515377 - DNA, 16 bp, R. norvegicus
tacagctgcagcacaa

SEQ ID NO: 515378 - DNA, 16 bp, R. norvegicus
tacagctttggtgagt

SEQ ID NO: 515379 - DNA, 16 bp, R. norvegicus
tacaggaaaacaaaag

SEQ ID NO: 515380 - DNA, 16 bp, R. norvegicus
tacaggaaaacacaat

SEQ ID NO: 515381 - DNA, 16 bp, R. norvegicus
tacaggaaaacacatc

SEQ ID NO: 515382 - DNA, 16 bp, R. norvegicus
tacaggaaaacagaac

SEQ ID NO: 515383 - DNA, 16 bp, R. norvegicus
tacaggaaacatacct

SEQ ID NO: 515384 - DNA, 16 bp, R. norvegicus
tacaggaactggatgt

SEQ ID NO: 515385 - DNA, 16 bp, R. norvegicus
tacaggaaggtcaagc

SEQ ID NO: 515386 - DNA, 16 bp, R. norvegicus
tacaggaatttggttt

SEQ ID NO: 515387 - DNA, 16 bp, R. norvegicus
tacaggacagccaagg

SEQ ID NO: 515388 - DNA, 16 bp, R. norvegicus
tacaggagagaaggag

SEQ ID NO: 515389 - DNA, 16 bp, R. norvegicus
tacaggagcagaaatg

SEQ ID NO: 515390 - DNA, 16 bp, R. norvegicus
tacaggcataaaagag

SEQ ID NO: 515391 - DNA, 16 bp, R. norvegicus
tacaggcatttgcagc

SEQ ID NO: 515392 - DNA, 16 bp, R. norvegicus
tacaggccctacagat

SEQ ID NO: 515393 - DNA, 16 bp, R. norvegicus
tacaggctgacaggaa

SEQ ID NO: 515394 - DNA, 16 bp, R. norvegicus
tacagggaaacacaac

SEQ ID NO: 515395 - DNA, 16 bp, R. norvegicus
tacaggtgtacatgca

SEQ ID NO: 515396 - DNA, 16 bp, R. norvegicus
tacaggttcagagttc

SEQ ID NO: 515397 - DNA, 16 bp, R. norvegicus
tacagtaacctggtct

SEQ ID NO: 515398 - DNA, 16 bp, R. norvegicus
tacagtattttaaaaa

SEQ ID NO: 515399 - DNA, 16 bp, R. norvegicus
tacagtccacagaatt

SEQ ID NO: 515400 - DNA, 16 bp, R. norvegicus
tacagtctttctgctc

SEQ ID NO: 515401 - DNA, 16 bp, R. norvegicus
tacagtgacctgggct

SEQ ID NO: 515402 - DNA, 16 bp, R. norvegicus
tacagtgagactctgt

SEQ ID NO: 515403 - DNA, 16 bp, R. norvegicus
tacagtggcagatgca

SEQ ID NO: 515404 - DNA, 16 bp, R. norvegicus
tacagtggttcttctg

SEQ ID NO: 515405 - DNA, 16 bp, R. norvegicus
tacagtgtacttatgt

SEQ ID NO: 515406 - DNA, 16 bp, R. norvegicus
tacagtgtgtgtatgt

SEQ ID NO: 515407 - DNA, 16 bp, R. norvegicus
tacagttcttcatgtt

SEQ ID NO: 515408 - DNA, 16 bp, R. norvegicus
tacagttgctcatgtt

SEQ ID NO: 515409 - DNA, 16 bp, R. norvegicus
tacagtttcaaaggct

SEQ ID NO: 515410 - DNA, 16 bp, R. norvegicus
tacagtttcagaggaa

SEQ ID NO: 515411 - DNA, 16 bp, R. norvegicus
tacagtttcctctccc

SEQ ID NO: 515412 - DNA, 16 bp, R. norvegicus
tacagtttgagaggtt

SEQ ID NO: 515413 - DNA, 16 bp, R. norvegicus
tacagtttttttaaat

SEQ ID NO: 515414 - DNA, 18 bp, R. norvegicus
tacataaaagaacacaca

SEQ ID NO: 515415 - DNA, 16 bp, R. norvegicus
tacataaatacacaca

SEQ ID NO: 515416 - DNA, 16 bp, R. norvegicus
tacataaatatacatg

SEQ ID NO: 515417 - DNA, 16 bp, R. norvegicus
tacataagctttgcaa

SEQ ID NO: 515418 - DNA, 16 bp, R. norvegicus
tacatacaaagacaca

SEQ ID NO: 515419 - DNA, 16 bp, R. norvegicus
tacatacaagtacaca

SEQ ID NO: 515420 - DNA, 16 bp, R. norvegicus
tacatacaatgcatgt

SEQ ID NO: 515421 - DNA, 16 bp, R. norvegicus
tacatacacacacata

SEQ ID NO: 515422 - DNA, 16 bp, R. norvegicus
tacatacacacatgca

SEQ ID NO: 515423 - DNA, 16 bp, R. norvegicus
tacatacaccacacac

SEQ ID NO: 515424 - DNA, 16 bp, R. norvegicus
tacatacaggagagaa

SEQ ID NO: 515425 - DNA, 16 bp, R. norvegicus
tacatacatgcagata

SEQ ID NO: 515426 - DNA, 16 bp, R. norvegicus
tacatacatgtacata

SEQ ID NO: 515427 - DNA, 16 bp, R. norvegicus
tacatactcacacaca

SEQ ID NO: 515428 - DNA, 16 bp, R. norvegicus
tacatagaaatccttg

SEQ ID NO: 515429 - DNA, 16 bp, R. norvegicus
tacatagacaaataga

SEQ ID NO: 515430 - DNA, 16 bp, R. norvegicus
tacatagagaaattct

SEQ ID NO: 515431 - DNA, 16 bp, R. norvegicus
tacatagagagaccct

SEQ ID NO: 515432 - DNA, 16 bp, R. norvegicus
tacataggcaaatgct

SEQ ID NO: 515433 - DNA, 16 bp, R. norvegicus
tacataggcagctgga

SEQ ID NO: 515434 - DNA, 16 bp, R. norvegicus
tacatagtaaaagcaa

SEQ ID NO: 515435 - DNA, 16 bp, R. norvegicus
tacatagtaagctcca

SEQ ID NO: 515436 - DNA, 16 bp, R. norvegicus
tacatatatatatatg

SEQ ID NO: 515437 - DNA, 16 bp, R. norvegicus
tacatatgaatatatt

SEQ ID NO: 515438 - DNA, 16 bp, R. norvegicus
tacatatgcagccatc

SEQ ID NO: 515439 - DNA, 16 bp, R. norvegicus
tacatatgtaaataaa

SEQ ID NO: 515440 - DNA, 16 bp, R. norvegicus
tacatattatatacat

SEQ ID NO: 515441 - DNA, 16 bp, R. norvegicus
tacatatttcaaaata

SEQ ID NO: 515442 - DNA, 16 bp, R. norvegicus
tacatatttttgtttg

SEQ ID NO: 515443 - DNA, 16 bp, R. norvegicus
tacatcaagactgagt

SEQ ID NO: 515444 - DNA, 16 bp, R. norvegicus
tacatcatgagtttaa

SEQ ID NO: 515445 - DNA, 16 bp, R. norvegicus
tacatccaggaggagt

SEQ ID NO: 515446 - DNA, 16 bp, R. norvegicus
tacatcctcaccagca

SEQ ID NO: 515447 - DNA, 16 bp, R. norvegicus
tacatcctgattacag

SEQ ID NO: 515448 - DNA, 16 bp, R. norvegicus
tacatcctgctcattg

SEQ ID NO: 515449 - DNA, 16 bp, R. norvegicus
tacatcgaagaagcaa

SEQ ID NO: 515450 - DNA, 16 bp, R. norvegicus
tacatcgatggatttc

SEQ ID NO: 515451 - DNA, 18 bp, R. norvegicus
tacatctacacaatggag

SEQ ID NO: 515452 - DNA, 16 bp, R. norvegicus
tacatctatataatgg

SEQ ID NO: 515453 - DNA, 16 bp, R. norvegicus
tacatctcccttattg

SEQ ID NO: 515454 - DNA, 16 bp, R. norvegicus
tacatctctcctgaga

SEQ ID NO: 515455 - DNA, 16 bp, R. norvegicus
tacatctgatacaggg

SEQ ID NO: 515456 - DNA, 16 bp, R. norvegicus
tacatgaaaataaaat

SEQ ID NO: 515457 - DNA, 16 bp, R. norvegicus
tacatgaaagaacaca

SEQ ID NO: 515458 - DNA, 16 bp, R. norvegicus
tacatgagcctgtggg

SEQ ID NO: 515459 - DNA, 16 bp, R. norvegicus
tacatgagtatgtgtg

SEQ ID NO: 515460 - DNA, 16 bp, R. norvegicus
tacatgatgtgaaact

SEQ ID NO: 515461 - DNA, 16 bp, R. norvegicus
tacatgcacatatgta

SEQ ID NO: 515462 - DNA, 16 bp, R. norvegicus
tacatgcaggcaaaca

SEQ ID NO: 515463 - DNA, 16 bp, R. norvegicus
tacatgctgactacca

SEQ ID NO: 515464 - DNA, 16 bp, R. norvegicus
tacatgcttgcatgca

SEQ ID NO: 515465 - DNA, 16 bp, R. norvegicus
tacatgtatgaaaatg

SEQ ID NO: 515466 - DNA, 16 bp, R. norvegicus
tacatgtatgcaaaca

SEQ ID NO: 515467 - DNA, 16 bp, R. norvegicus
tacatgtgtatatgtg

SEQ ID NO: 515468 - DNA, 16 bp, R. norvegicus
tacatgtgtgtgtgtg

SEQ ID NO: 515469 - DNA, 16 bp, R. norvegicus
tacattcaagcaaaac

SEQ ID NO: 515470 - DNA, 16 bp, R. norvegicus
tacattctctgtgccc

SEQ ID NO: 515471 - DNA, 16 bp, R. norvegicus
tacattgatgattttc

SEQ ID NO: 515472 - DNA, 16 bp, R. norvegicus
tacattgtacattgta

SEQ ID NO: 515473 - DNA, 19 bp, R. norvegicus
tacattgtcactgtcttca

SEQ ID NO: 515474 - DNA, 16 bp, R. norvegicus
tacattgtgtatatgt

SEQ ID NO: 515475 - DNA, 16 bp, R. norvegicus
tacatttaaaatgata

SEQ ID NO: 515476 - DNA, 16 bp, R. norvegicus
tacatttcaaaatgtt

SEQ ID NO: 515477 - DNA, 16 bp, R. norvegicus
tacatttcaaaggtta

SEQ ID NO: 515478 - DNA, 16 bp, R. norvegicus
tacatttcacatatta

SEQ ID NO: 515479 - DNA, 16 bp, R. norvegicus
tacatttctgattttg

SEQ ID NO: 515480 - DNA, 16 bp, R. norvegicus
tacatttgatagaggg

SEQ ID NO: 515481 - DNA, 16 bp, R. norvegicus
tacatttggaattctg

SEQ ID NO: 515482 - DNA, 16 bp, R. norvegicus
tacattttaaatgtca

SEQ ID NO: 515483 - DNA, 16 bp, R. norvegicus
tacattttagaaaata

SEQ ID NO: 515484 - DNA, 16 bp, R. norvegicus
tacattttcatctgaa

SEQ ID NO: 515485 - DNA, 16 bp, R. norvegicus
tacatttttattttga

SEQ ID NO: 515486 - DNA, 16 bp, R. norvegicus
tacatttttctcagca

SEQ ID NO: 515487 - DNA, 16 bp, R. norvegicus
tacattttttaaagtt

SEQ ID NO: 515488 - DNA, 16 bp, R. norvegicus
taccaaaagcaatcca

SEQ ID NO: 515489 - DNA, 16 bp, R. norvegicus
taccaaagaaaacaat

SEQ ID NO: 515490 - DNA, 16 bp, R. norvegicus
taccaaagactataca

SEQ ID NO: 515491 - DNA, 16 bp, R. norvegicus
taccaaagataaacaa

SEQ ID NO: 515492 - DNA, 16 bp, R. norvegicus
taccaaaggagaaaca

SEQ ID NO: 515493 - DNA, 16 bp, R. norvegicus
taccaaattccttcta

SEQ ID NO: 515494 - DNA, 16 bp, R. norvegicus
taccaacaatggagga

SEQ ID NO: 515495 - DNA, 17 bp, R. norvegicus
taccaagggcttcccct

SEQ ID NO: 515496 - DNA, 16 bp, R. norvegicus
taccaagtatgggtgg

SEQ ID NO: 515497 - DNA, 16 bp, R. norvegicus
taccaagtgtgttctt

SEQ ID NO: 515498 - DNA, 66 bp, R. norvegicus
taccaatattatccaaactattccacaaaattgaaacagatggatcactaccgaataccttctacg

SEQ ID NO: 515499 - DNA, 16 bp, R. norvegicus
taccacagcaacagga

SEQ ID NO: 515500 - DNA, 16 bp, R. norvegicus
taccacatgggtccca

SEQ ID NO: 515501 - DNA, 16 bp, R. norvegicus
taccacatttttaaat

SEQ ID NO: 515502 - DNA, 16 bp, R. norvegicus
taccaccaagcctgga

SEQ ID NO: 515503 - DNA, 16 bp, R. norvegicus
taccactccctgggcc

SEQ ID NO: 515504 - DNA, 16 bp, R. norvegicus
taccactcctgggtat

SEQ ID NO: 515505 - DNA, 16 bp, R. norvegicus
taccactctccacctc

SEQ ID NO: 515506 - DNA, 16 bp, R. norvegicus
taccactctttggcat

SEQ ID NO: 515507 - DNA, 16 bp, R. norvegicus
taccagaagcctacag

SEQ ID NO: 515508 - DNA, 16 bp, R. norvegicus
taccagcacaaacagc

SEQ ID NO: 515509 - DNA, 16 bp, R. norvegicus
taccagccctcacctg

SEQ ID NO: 515510 - DNA, 16 bp, R. norvegicus
taccagctttagtagt

SEQ ID NO: 515511 - DNA, 16 bp, R. norvegicus
taccagctttatgtca

SEQ ID NO: 515512 - DNA, 16 bp, R. norvegicus
taccaggcatgagttt

SEQ ID NO: 515513 - DNA, 16 bp, R. norvegicus
taccagggaggcagag

SEQ ID NO: 515514 - DNA, 16 bp, R. norvegicus
taccaggtgtgttctt

SEQ ID NO: 515515 - DNA, 21 bp, R. norvegicus
taccagtttgcaaccccacca

SEQ ID NO: 515516 - DNA, 16 bp, R. norvegicus
taccatgagatgctga

SEQ ID NO: 515517 - DNA, 16 bp, R. norvegicus
taccatgagcagctga

SEQ ID NO: 515518 - DNA, 16 bp, R. norvegicus
taccatgcggagctga

SEQ ID NO: 515519 - DNA, 16 bp, R. norvegicus
taccatgtgtgctctt

SEQ ID NO: 515520 - DNA, 16 bp, R. norvegicus
taccatgtgtgttttc

SEQ ID NO: 515521 - DNA, 16 bp, R. norvegicus
taccatgttgtcaaat

SEQ ID NO: 515522 - DNA, 16 bp, R. norvegicus
taccatgttttctgta

SEQ ID NO: 515523 - DNA, 16 bp, R. norvegicus
taccattcacctctgt

SEQ ID NO: 515524 - DNA, 16 bp, R. norvegicus
tacccaacaaaggggg

SEQ ID NO: 515525 - DNA, 16 bp, R. norvegicus
tacccaagaagaagca

SEQ ID NO: 515526 - DNA, 16 bp, R. norvegicus
tacccacagaagccag

SEQ ID NO: 515527 - DNA, 16 bp, R. norvegicus
tacccactgagctctc

SEQ ID NO: 515528 - DNA, 81 bp, R. norvegicus
tacccagatgcccttcaacagaggaatggatacagaaaatgtggtacatctacacaatggaatattactcagctatcaaaa

SEQ ID NO: 515529 - DNA, 16 bp, R. norvegicus
tacccagcactcacat

SEQ ID NO: 515530 - DNA, 16 bp, R. norvegicus
tacccagccagtttgc

SEQ ID NO: 515531 - DNA, 17 bp, R. norvegicus
tacccagccagtttgct

SEQ ID NO: 515532 - DNA, 16 bp, R. norvegicus
tacccaggatacaacc

SEQ ID NO: 515533 - DNA, 27 bp, R. norvegicus
tacccagtatcctgggtccctttatag

SEQ ID NO: 515534 - DNA, 16 bp, R. norvegicus
tacccagtgctgggat

SEQ ID NO: 515535 - DNA, 16 bp, R. norvegicus
taccccaaaaatgctc

SEQ ID NO: 515536 - DNA, 16 bp, R. norvegicus
taccccaggctggcct

SEQ ID NO: 515537 - DNA, 16 bp, R. norvegicus
taccctctgacttcca

SEQ ID NO: 515538 - DNA, 16 bp, R. norvegicus
taccctttctcccagc

SEQ ID NO: 515539 - DNA, 16 bp, R. norvegicus
tacccttttgtccaca

SEQ ID NO: 515540 - DNA, 16 bp, R. norvegicus
taccgaagagggcaaa

SEQ ID NO: 515541 - DNA, 16 bp, R. norvegicus
tacctaaaagaaacaa

SEQ ID NO: 515542 - DNA, 18 bp, R. norvegicus
tacctaaagaaatgttca

SEQ ID NO: 515543 - DNA, 16 bp, R. norvegicus
tacctacagaagccag

SEQ ID NO: 515544 - DNA, 16 bp, R. norvegicus
tacctcaagatccagc

SEQ ID NO: 515545 - DNA, 16 bp, R. norvegicus
tacctcaagtcccagc

SEQ ID NO: 515546 - DNA, 16 bp, R. norvegicus
tacctcactaaggatg

SEQ ID NO: 515547 - DNA, 16 bp, R. norvegicus
tacctcactgccctgg

SEQ ID NO: 515548 - DNA, 16 bp, R. norvegicus
tacctcagagtaaata

SEQ ID NO: 515549 - DNA, 19 bp, R. norvegicus
tacctcagtgtgactttaa

SEQ ID NO: 515550 - DNA, 16 bp, R. norvegicus
tacctcatggaacctt

SEQ ID NO: 515551 - DNA, 16 bp, R. norvegicus
tacctcattcagaata

SEQ ID NO: 515552 - DNA, 16 bp, R. norvegicus
tacctcatttttaata

SEQ ID NO: 515553 - DNA, 16 bp, R. norvegicus
tacctccctagtgctg

SEQ ID NO: 515554 - DNA, 16 bp, R. norvegicus
tacctccctgccctgg

SEQ ID NO: 515555 - DNA, 16 bp, R. norvegicus
tacctctcctctcagg

SEQ ID NO: 515556 - DNA, 16 bp, R. norvegicus
tacctcttctcccagc

SEQ ID NO: 515557 - DNA, 16 bp, R. norvegicus
tacctgaagactcagc

SEQ ID NO: 515558 - DNA, 16 bp, R. norvegicus
tacctgaggcaaaagc

SEQ ID NO: 515559 - DNA, 16 bp, R. norvegicus
tacctgcactcacaca

SEQ ID NO: 515560 - DNA, 16 bp, R. norvegicus
tacctgcagaagccag

SEQ ID NO: 515561 - DNA, 16 bp, R. norvegicus
tacctgcaggccagaa

SEQ ID NO: 515562 - DNA, 16 bp, R. norvegicus
tacctgcctctcacct

SEQ ID NO: 515563 - DNA, 16 bp, R. norvegicus
tacctgcttctatgag

SEQ ID NO: 515564 - DNA, 16 bp, R. norvegicus
tacctgcttctgcctt

SEQ ID NO: 515565 - DNA, 16 bp, R. norvegicus
tacctggaagagaatg

SEQ ID NO: 515566 - DNA, 16 bp, R. norvegicus
tacctggcccacgcca

SEQ ID NO: 515567 - DNA, 16 bp, R. norvegicus
tacctgggaacagcca

SEQ ID NO: 515568 - DNA, 16 bp, R. norvegicus
tacctgggattcctgg

SEQ ID NO: 515569 - DNA, 16 bp, R. norvegicus
tacctgggctggagag

SEQ ID NO: 515570 - DNA, 29 bp, R. norvegicus
tacctggtgctgctgaccaccctgacagc

SEQ ID NO: 515571 - DNA, 16 bp, R. norvegicus
tacctgtctcctgaga

SEQ ID NO: 515572 - DNA, 16 bp, R. norvegicus
tacctgtctgtttctg

SEQ ID NO: 515573 - DNA, 16 bp, R. norvegicus
tacctgtggaggtcag

SEQ ID NO: 515574 - DNA, 16 bp, R. norvegicus
tacctgtgggcacaca

SEQ ID NO: 515575 - DNA, 16 bp, R. norvegicus
tacctgtgtgtgtgtg

SEQ ID NO: 515576 - DNA, 16 bp, R. norvegicus
taccttcctctcagct

SEQ ID NO: 515577 - DNA, 16 bp, R. norvegicus
tacctttaacaacaaa

SEQ ID NO: 515578 - DNA, 16 bp, R. norvegicus
tacgcaagttaataaa

SEQ ID NO: 515579 - DNA, 16 bp, R. norvegicus
tacggagaaagaggaa

SEQ ID NO: 515580 - DNA, 16 bp, R. norvegicus
tacggccctcccccca

SEQ ID NO: 515581 - DNA, 16 bp, R. norvegicus
tactaaggaaatagaa

SEQ ID NO: 515582 - DNA, 16 bp, R. norvegicus
tactaagtgtgggaaa

SEQ ID NO: 515583 - DNA, 16 bp, R. norvegicus
tactactactactact

SEQ ID NO: 515584 - DNA, 19 bp, R. norvegicus
tactactcagctatcaaaa

SEQ ID NO: 515585 - DNA, 16 bp, R. norvegicus
tactactccactatca

SEQ ID NO: 515586 - DNA, 16 bp, R. norvegicus
tactactgctgctgct

SEQ ID NO: 515587 - DNA, 16 bp, R. norvegicus
tactagctgggctgcc

SEQ ID NO: 515588 - DNA, 36 bp, R. norvegicus
tactaggcaagcgctctaccactgagctaaatcccc

SEQ ID NO: 515589 - DNA, 16 bp, R. norvegicus
tactataaccagcaaa

SEQ ID NO: 515590 - DNA, 16 bp, R. norvegicus
tactatctctctctct

SEQ ID NO: 515591 - DNA, 16 bp, R. norvegicus
tactatgttgaattct

SEQ ID NO: 515592 - DNA, 16 bp, R. norvegicus
tactattttttaaaga

SEQ ID NO: 515593 - DNA, 16 bp, R. norvegicus
tactcaataaatattt

SEQ ID NO: 515594 - DNA, 16 bp, R. norvegicus
tactcaatgatcacct

SEQ ID NO: 515595 - DNA, 16 bp, R. norvegicus
tactcacagagatcca

SEQ ID NO: 515596 - DNA, 16 bp, R. norvegicus
tactcacaggagaaaa

SEQ ID NO: 515597 - DNA, 16 bp, R. norvegicus
tactcacatgcataaa

SEQ ID NO: 515598 - DNA, 16 bp, R. norvegicus
tactcagagatcagtg

SEQ ID NO: 515599 - DNA, 16 bp, R. norvegicus
tactcagccatcaaaa

SEQ ID NO: 515600 - DNA, 21 bp, R. norvegicus
tactcagctatcaaaaacaag

SEQ ID NO: 515601 - DNA, 24 bp, R. norvegicus
tactcagctatcaaaaacaatgat

SEQ ID NO: 515602 - DNA, 16 bp, R. norvegicus
tactcagctattaaaa

SEQ ID NO: 515603 - DNA, 20 bp, R. norvegicus
tactcagctgtcaaaaacaa

SEQ ID NO: 515604 - DNA, 16 bp, R. norvegicus
tactcagttatcaaaa

SEQ ID NO: 515605 - DNA, 16 bp, R. norvegicus
tactcataaaataaac

SEQ ID NO: 515606 - DNA, 16 bp, R. norvegicus
tactcatacacagaca

SEQ ID NO: 515607 - DNA, 16 bp, R. norvegicus
tactcatcctgggtgt

SEQ ID NO: 515608 - DNA, 16 bp, R. norvegicus
tactcatgtgtgtgtg

SEQ ID NO: 515609 - DNA, 16 bp, R. norvegicus
tactccaccaaggcca

SEQ ID NO: 515610 - DNA, 16 bp, R. norvegicus
tactccatggcctctg

SEQ ID NO: 515611 - DNA, 16 bp, R. norvegicus
tactccattgtgcaaa

SEQ ID NO: 515612 - DNA, 16 bp, R. norvegicus
tactccattgtgtaaa

SEQ ID NO: 515613 - DNA, 16 bp, R. norvegicus
tactcctcctggctgt

SEQ ID NO: 515614 - DNA, 16 bp, R. norvegicus
tactcctcttggatat

SEQ ID NO: 515615 - DNA, 16 bp, R. norvegicus
tactcctgtgtgctga

SEQ ID NO: 515616 - DNA, 16 bp, R. norvegicus
tactctgaaaatcagt

SEQ ID NO: 515617 - DNA, 16 bp, R. norvegicus
tactctgacaaaagca

SEQ ID NO: 515618 - DNA, 16 bp, R. norvegicus
tactctggactgcagg

SEQ ID NO: 515619 - DNA, 16 bp, R. norvegicus
tactctggggcatcaa

SEQ ID NO: 515620 - DNA, 16 bp, R. norvegicus
tactctgtggaccagg

SEQ ID NO: 515621 - DNA, 16 bp, R. norvegicus
tactcttataccaaaa

SEQ ID NO: 515622 - DNA, 16 bp, R. norvegicus
tactcttccacaagac

SEQ ID NO: 515623 - DNA, 16 bp, R. norvegicus
tactcttccagaggtc

SEQ ID NO: 515624 - DNA, 16 bp, R. norvegicus
tactcttctgttgctg

SEQ ID NO: 515625 - DNA, 16 bp, R. norvegicus
tactctttgagaattt

SEQ ID NO: 515626 - DNA, 16 bp, R. norvegicus
tactcttttggttccc

SEQ ID NO: 515627 - DNA, 16 bp, R. norvegicus
tactcttttgttttag

SEQ ID NO: 515628 - DNA, 16 bp, R. norvegicus
tactgaaaaccatcaa

SEQ ID NO: 515629 - DNA, 16 bp, R. norvegicus
tactgaaaatgaaggt

SEQ ID NO: 515630 - DNA, 16 bp, R. norvegicus
tactgaaagaaatctt

SEQ ID NO: 515631 - DNA, 16 bp, R. norvegicus
tactgaatgcagctgt

SEQ ID NO: 515632 - DNA, 16 bp, R. norvegicus
tactgacatgtgtgac

SEQ ID NO: 515633 - DNA, 16 bp, R. norvegicus
tactgacctccagttg

SEQ ID NO: 515634 - DNA, 16 bp, R. norvegicus
tactgacttccagaca

SEQ ID NO: 515635 - DNA, 16 bp, R. norvegicus
tactgaggaaagaaat

SEQ ID NO: 515636 - DNA, 16 bp, R. norvegicus
tactgaggattgaacc

SEQ ID NO: 515637 - DNA, 16 bp, R. norvegicus
tactgatgctgagctg

SEQ ID NO: 515638 - DNA, 16 bp, R. norvegicus
tactgcaacaaggcca

SEQ ID NO: 515639 - DNA, 16 bp, R. norvegicus
tactgcactcaggatg

SEQ ID NO: 515640 - DNA, 16 bp, R. norvegicus
tactgcctgagttcag

SEQ ID NO: 515641 - DNA, 16 bp, R. norvegicus
tactgcctgttccagg

SEQ ID NO: 515642 - DNA, 16 bp, R. norvegicus
tactgctgatgccaag

SEQ ID NO: 515643 - DNA, 16 bp, R. norvegicus
tactgctgctgctact

SEQ ID NO: 515644 - DNA, 16 bp, R. norvegicus
tactgctgtgagcaga

SEQ ID NO: 515645 - DNA, 16 bp, R. norvegicus
tactgcttagatacta

SEQ ID NO: 515646 - DNA, 16 bp, R. norvegicus
tactgcttttaatatt

SEQ ID NO: 515647 - DNA, 16 bp, R. norvegicus
tactggaaaagcaaga

SEQ ID NO: 515648 - DNA, 16 bp, R. norvegicus
tactggaacctcactg

SEQ ID NO: 515649 - DNA, 16 bp, R. norvegicus
tactggacagatgtca

SEQ ID NO: 515650 - DNA, 16 bp, R. norvegicus
tactggactgatgtca

SEQ ID NO: 515651 - DNA, 17 bp, R. norvegicus
tactggagactacacca

SEQ ID NO: 515652 - DNA, 16 bp, R. norvegicus
tactggagatggactc

SEQ ID NO: 515653 - DNA, 16 bp, R. norvegicus
tactggagcatcaagc

SEQ ID NO: 515654 - DNA, 16 bp, R. norvegicus
tactggcatcttcaat

SEQ ID NO: 515655 - DNA, 16 bp, R. norvegicus
tactgggaaaattgat

SEQ ID NO: 515656 - DNA, 16 bp, R. norvegicus
tactgggaactgaatc

SEQ ID NO: 515657 - DNA, 16 bp, R. norvegicus
tactgggaatggtaat

SEQ ID NO: 515658 - DNA, 16 bp, R. norvegicus
tactgggatttttttt

SEQ ID NO: 515659 - DNA, 16 bp, R. norvegicus
tactggggagttgagg

SEQ ID NO: 515660 - DNA, 16 bp, R. norvegicus
tactggggttacaggt

SEQ ID NO: 515661 - DNA, 16 bp, R. norvegicus
tactgggttttttgtt

SEQ ID NO: 515662 - DNA, 16 bp, R. norvegicus
tactggttttgaaggt

SEQ ID NO: 515663 - DNA, 16 bp, R. norvegicus
tactgtccaatcacag

SEQ ID NO: 515664 - DNA, 16 bp, R. norvegicus
tactgtcttgtctcca

SEQ ID NO: 515665 - DNA, 16 bp, R. norvegicus
tactgtgataaaataa

SEQ ID NO: 515666 - DNA, 16 bp, R. norvegicus
tactgtgcctggcttt

SEQ ID NO: 515667 - DNA, 16 bp, R. norvegicus
tactgtggatgccaag

SEQ ID NO: 515668 - DNA, 16 bp, R. norvegicus
tactgtgtactgtgta

SEQ ID NO: 515669 - DNA, 16 bp, R. norvegicus
tactgtgtgaggtaca

SEQ ID NO: 515670 - DNA, 16 bp, R. norvegicus
tacttaacaataaaag

SEQ ID NO: 515671 - DNA, 16 bp, R. norvegicus
tacttaccatgcatgt

SEQ ID NO: 515672 - DNA, 16 bp, R. norvegicus
tacttcaacaagacca

SEQ ID NO: 515673 - DNA, 16 bp, R. norvegicus
tacttcatattcatca

SEQ ID NO: 515674 - DNA, 16 bp, R. norvegicus
tacttgaattacccta

SEQ ID NO: 515675 - DNA, 16 bp, R. norvegicus
tacttgagaaggatta

SEQ ID NO: 515676 - DNA, 16 bp, R. norvegicus
tacttgatcatagtga

SEQ ID NO: 515677 - DNA, 16 bp, R. norvegicus
tacttgatcgtggtga

SEQ ID NO: 515678 - DNA, 17 bp, R. norvegicus
tacttggcatcatcaga

SEQ ID NO: 515679 - DNA, 16 bp, R. norvegicus
tacttgggaggaagaa

SEQ ID NO: 515680 - DNA, 16 bp, R. norvegicus
tacttgggcagctgca

SEQ ID NO: 515681 - DNA, 16 bp, R. norvegicus
tacttgtgcatgtgtg

SEQ ID NO: 515682 - DNA, 16 bp, R. norvegicus
tacttgtgttgtcctt

SEQ ID NO: 515683 - DNA, 16 bp, R. norvegicus
tacttgtgttttcctg

SEQ ID NO: 515684 - DNA, 16 bp, R. norvegicus
tactttaaaaaaagaa

SEQ ID NO: 515685 - DNA, 16 bp, R. norvegicus
tactttaaaaacctat

SEQ ID NO: 515686 - DNA, 16 bp, R. norvegicus
tactttagaaaataaa

SEQ ID NO: 515687 - DNA, 16 bp, R. norvegicus
tactttatgaaattcg

SEQ ID NO: 515688 - DNA, 16 bp, R. norvegicus
tactttcttatttcaa

SEQ ID NO: 515689 - DNA, 16 bp, R. norvegicus
tactttgaattttaaa

SEQ ID NO: 515690 - DNA, 16 bp, R. norvegicus
tactttgagaaaatca

SEQ ID NO: 515691 - DNA, 16 bp, R. norvegicus
tactttgagcttcagt

SEQ ID NO: 515692 - DNA, 16 bp, R. norvegicus
tactttttaagataaa

SEQ ID NO: 515693 - DNA, 16 bp, R. norvegicus
tacttttttacttgtg

SEQ ID NO: 515694 - DNA, 16 bp, R. norvegicus
tagaaaaaaaattcca

SEQ ID NO: 515695 - DNA, 16 bp, R. norvegicus
tagaaaaatgactgaa

SEQ ID NO: 515696 - DNA, 16 bp, R. norvegicus
tagaaaacatcctgag

SEQ ID NO: 515697 - DNA, 16 bp, R. norvegicus
tagaaaacattgacaa

SEQ ID NO: 515698 - DNA, 16 bp, R. norvegicus
tagaaaaccaagggaa

SEQ ID NO: 515699 - DNA, 16 bp, R. norvegicus
tagaaaacttgaaaaa

SEQ ID NO: 515700 - DNA, 16 bp, R. norvegicus
tagaaaaggctcctgc

SEQ ID NO: 515701 - DNA, 16 bp, R. norvegicus
tagaaaatattttgtt

SEQ ID NO: 515702 - DNA, 16 bp, R. norvegicus
tagaaaatgcaagaaa

SEQ ID NO: 515703 - DNA, 16 bp, R. norvegicus
tagaaacaaaaaggat

SEQ ID NO: 515704 - DNA, 16 bp, R. norvegicus
tagaaacagaaacaat

SEQ ID NO: 515705 - DNA, 16 bp, R. norvegicus
tagaaaccaaacccag

SEQ ID NO: 515706 - DNA, 16 bp, R. norvegicus
tagaaagatactgttt

SEQ ID NO: 515707 - DNA, 16 bp, R. norvegicus
tagaaataaaaaggac

SEQ ID NO: 515708 - DNA, 16 bp, R. norvegicus
tagaaatatttttctt

SEQ ID NO: 515709 - DNA, 16 bp, R. norvegicus
tagaaatcaagaaaat

SEQ ID NO: 515710 - DNA, 16 bp, R. norvegicus
tagaaatcattgacta

SEQ ID NO: 515711 - DNA, 16 bp, R. norvegicus
tagaaatccagcccta

SEQ ID NO: 515712 - DNA, 16 bp, R. norvegicus
tagaaatgacagatga

SEQ ID NO: 515713 - DNA, 16 bp, R. norvegicus
tagaaatgctacagaa

SEQ ID NO: 515714 - DNA, 16 bp, R. norvegicus
tagaaatggagttaca

SEQ ID NO: 515715 - DNA, 16 bp, R. norvegicus
tagaaatgtgggcaga

SEQ ID NO: 515716 - DNA, 16 bp, R. norvegicus
tagaaattaaaaagct

SEQ ID NO: 515717 - DNA, 16 bp, R. norvegicus
tagaaattcaaggccc

SEQ ID NO: 515718 - DNA, 16 bp, R. norvegicus
tagaacaagaagaagc

SEQ ID NO: 515719 - DNA, 16 bp, R. norvegicus
tagaacagaaagaaga

SEQ ID NO: 515720 - DNA, 16 bp, R. norvegicus
tagaacagagaaggaa

SEQ ID NO: 515721 - DNA, 16 bp, R. norvegicus
tagaacctgaaaagac

SEQ ID NO: 515722 - DNA, 16 bp, R. norvegicus
tagaactctcagctac

SEQ ID NO: 515723 - DNA, 16 bp, R. norvegicus
tagaactgaagatcca

SEQ ID NO: 515724 - DNA, 16 bp, R. norvegicus
tagaactggagttaga

SEQ ID NO: 515725 - DNA, 17 bp, R. norvegicus
tagaacttcaagaagta

SEQ ID NO: 515726 - DNA, 17 bp, R. norvegicus
tagaacttgaagaacta

SEQ ID NO: 515727 - DNA, 16 bp, R. norvegicus
tagaagaaaaactcca

SEQ ID NO: 515728 - DNA, 16 bp, R. norvegicus
tagaagaaaaacttca

SEQ ID NO: 515729 - DNA, 16 bp, R. norvegicus
tagaagaaaacatggg

SEQ ID NO: 515730 - DNA, 16 bp, R. norvegicus
tagaagaaaatatttt

SEQ ID NO: 515731 - DNA, 16 bp, R. norvegicus
tagaagaaaattttcc

SEQ ID NO: 515732 - DNA, 16 bp, R. norvegicus
tagaagaaagcaaaga

SEQ ID NO: 515733 - DNA, 18 bp, R. norvegicus
tagaagaagatgcagaga

SEQ ID NO: 515734 - DNA, 16 bp, R. norvegicus
tagaagaatgtaaatc

SEQ ID NO: 515735 - DNA, 16 bp, R. norvegicus
tagaagacagagaaga

SEQ ID NO: 515736 - DNA, 16 bp, R. norvegicus
tagaagacagcaaaga

SEQ ID NO: 515737 - DNA, 16 bp, R. norvegicus
tagaagacagtgaaga

SEQ ID NO: 515738 - DNA, 16 bp, R. norvegicus
tagaagactgcagatc

SEQ ID NO: 515739 - DNA, 16 bp, R. norvegicus
tagaagactttaagaa

SEQ ID NO: 515740 - DNA, 16 bp, R. norvegicus
tagaagagaaagttgg

SEQ ID NO: 515741 - DNA, 16 bp, R. norvegicus
tagaagagaacaaaga

SEQ ID NO: 515742 - DNA, 16 bp, R. norvegicus
tagaagagagtgatga

SEQ ID NO: 515743 - DNA, 16 bp, R. norvegicus
tagaagagattgaaga

SEQ ID NO: 515744 - DNA, 16 bp, R. norvegicus
tagaagaggaagcaga

SEQ ID NO: 515745 - DNA, 16 bp, R. norvegicus
tagaagaggaagtggg

SEQ ID NO: 515746 - DNA, 16 bp, R. norvegicus
tagaagagttggggga

SEQ ID NO: 515747 - DNA, 16 bp, R. norvegicus
tagaagagttggtctt

SEQ ID NO: 515748 - DNA, 16 bp, R. norvegicus
tagaagcaaagagaac

SEQ ID NO: 515749 - DNA, 16 bp, R. norvegicus
tagaagcagagagagg

SEQ ID NO: 515750 - DNA, 16 bp, R. norvegicus
tagaagcagggaaagg

SEQ ID NO: 515751 - DNA, 16 bp, R. norvegicus
tagaagcccttgaaga

SEQ ID NO: 515752 - DNA, 16 bp, R. norvegicus
tagaagcctttaaaaa

SEQ ID NO: 515753 - DNA, 16 bp, R. norvegicus
tagaaggaaagaactg

SEQ ID NO: 515754 - DNA, 16 bp, R. norvegicus
tagaaggaaatgaata

SEQ ID NO: 515755 - DNA, 16 bp, R. norvegicus
tagaaggagagaacca

SEQ ID NO: 515756 - DNA, 16 bp, R. norvegicus
tagaaggagagaatgg

SEQ ID NO: 515757 - DNA, 16 bp, R. norvegicus
tagaaggaggcctatc

SEQ ID NO: 515758 - DNA, 16 bp, R. norvegicus
tagaagggaaaacaaa

SEQ ID NO: 515759 - DNA, 16 bp, R. norvegicus
tagaagggaaaacttt

SEQ ID NO: 515760 - DNA, 16 bp, R. norvegicus
tagaagtcttatttat

SEQ ID NO: 515761 - DNA, 16 bp, R. norvegicus
tagaagtgagtgaaga

SEQ ID NO: 515762 - DNA, 16 bp, R. norvegicus
tagaatagtttggata

SEQ ID NO: 515763 - DNA, 16 bp, R. norvegicus
tagaatcagaggaaat

SEQ ID NO: 515764 - DNA, 16 bp, R. norvegicus
tagaatccagagaacc

SEQ ID NO: 515765 - DNA, 16 bp, R. norvegicus
tagaattcattgaaaa

SEQ ID NO: 515766 - DNA, 16 bp, R. norvegicus
tagacaagaaggatga

SEQ ID NO: 515767 - DNA, 16 bp, R. norvegicus
tagacaagataaaaat

SEQ ID NO: 515768 - DNA, 16 bp, R. norvegicus
tagacaagatgcatga

SEQ ID NO: 515769 - DNA, 16 bp, R. norvegicus
tagacaccagagaatc

SEQ ID NO: 515770 - DNA, 16 bp, R. norvegicus
tagacagagagacaga

SEQ ID NO: 515771 - DNA, 16 bp, R. norvegicus
tagacagatggtagat

SEQ ID NO: 515772 - DNA, 16 bp, R. norvegicus
tagacagcagctctgt

SEQ ID NO: 515773 - DNA, 16 bp, R. norvegicus
tagacagcctcactgc

SEQ ID NO: 515774 - DNA, 16 bp, R. norvegicus
tagacagctgtccttg

SEQ ID NO: 515775 - DNA, 16 bp, R. norvegicus
tagaccagctggccag

SEQ ID NO: 515776 - DNA, 16 bp, R. norvegicus
tagaccaggaggggaa

SEQ ID NO: 515777 - DNA, 16 bp, R. norvegicus
tagaccaggctagcct

SEQ ID NO: 515778 - DNA, 16 bp, R. norvegicus
tagaccaggctggcct

SEQ ID NO: 515779 - DNA, 16 bp, R. norvegicus
tagaccaggttggcct

SEQ ID NO: 515780 - DNA, 16 bp, R. norvegicus
tagactcaaataatat

SEQ ID NO: 515781 - DNA, 16 bp, R. norvegicus
tagactggctgaccag

SEQ ID NO: 515782 - DNA, 18 bp, R. norvegicus
tagactgggtgatctctt

SEQ ID NO: 515783 - DNA, 16 bp, R. norvegicus
tagagaaaagcctgaa

SEQ ID NO: 515784 - DNA, 16 bp, R. norvegicus
tagagaaaaggctgaa

SEQ ID NO: 515785 - DNA, 16 bp, R. norvegicus
tagagaaagaactgaa

SEQ ID NO: 515786 - DNA, 16 bp, R. norvegicus
tagagaaagaagaaca

SEQ ID NO: 515787 - DNA, 16 bp, R. norvegicus
tagagaaagcaagaaa

SEQ ID NO: 515788 - DNA, 16 bp, R. norvegicus
tagagaagagcctgag

SEQ ID NO: 515789 - DNA, 16 bp, R. norvegicus
tagagaagtaaattaa

SEQ ID NO: 515790 - DNA, 16 bp, R. norvegicus
tagagacagggggatc

SEQ ID NO: 515791 - DNA, 16 bp, R. norvegicus
tagagacattttctca

SEQ ID NO: 515792 - DNA, 16 bp, R. norvegicus
tagagacctcctccag

SEQ ID NO: 515793 - DNA, 16 bp, R. norvegicus
tagagaccttatccag

SEQ ID NO: 515794 - DNA, 16 bp, R. norvegicus
tagagactggagagat

SEQ ID NO: 515795 - DNA, 16 bp, R. norvegicus
tagagagaaaccctgt

SEQ ID NO: 515796 - DNA, 16 bp, R. norvegicus
tagagagaccttatct

SEQ ID NO: 515797 - DNA, 16 bp, R. norvegicus
tagagagagagctcag

SEQ ID NO: 515798 - DNA, 16 bp, R. norvegicus
tagagagagttctagg

SEQ ID NO: 515799 - DNA, 16 bp, R. norvegicus
tagagagatggctcag

SEQ ID NO: 515800 - DNA, 20 bp, R. norvegicus
tagagagcggcgcggcgaaa

SEQ ID NO: 515801 - DNA, 33 bp, R. norvegicus
tagagaggaatcacaaaaatccctgaaagaatt

SEQ ID NO: 515802 - DNA, 16 bp, R. norvegicus
tagagaggctgaggca

SEQ ID NO: 515803 - DNA, 23 bp, R. norvegicus
tagagatacaagaagaatttaat

SEQ ID NO: 515804 - DNA, 16 bp, R. norvegicus
tagagatatagctcag

SEQ ID NO: 515805 - DNA, 16 bp, R. norvegicus
tagagatggagcaaga

SEQ ID NO: 515806 - DNA, 16 bp, R. norvegicus
tagagcagtggctctc

SEQ ID NO: 515807 - DNA, 16 bp, R. norvegicus
tagagccaccaaaact

SEQ ID NO: 515808 - DNA, 16 bp, R. norvegicus
tagagccctgccctga

SEQ ID NO: 515809 - DNA, 16 bp, R. norvegicus
tagagctgtctcctga

SEQ ID NO: 515810 - DNA, 16 bp, R. norvegicus
tagaggaaggcaagtg

SEQ ID NO: 515811 - DNA, 16 bp, R. norvegicus
tagaggacattaagaa

SEQ ID NO: 515812 - DNA, 16 bp, R. norvegicus
tagaggaccagggttt

SEQ ID NO: 515813 - DNA, 16 bp, R. norvegicus
tagaggactttaagaa

SEQ ID NO: 515814 - DNA, 16 bp, R. norvegicus
tagaggcaggaggatg

SEQ ID NO: 515815 - DNA, 16 bp, R. norvegicus
tagaggccagagatca

SEQ ID NO: 515816 - DNA, 16 bp, R. norvegicus
tagagggcaaatatct

SEQ ID NO: 515817 - DNA, 16 bp, R. norvegicus
tagaggtcagaggaca

SEQ ID NO: 515818 - DNA, 17 bp, R. norvegicus
tagaggtgtgtgtgtgt

SEQ ID NO: 515819 - DNA, 16 bp, R. norvegicus
tagagtctctcaggag

SEQ ID NO: 515820 - DNA, 16 bp, R. norvegicus
tagagtggctactcca

SEQ ID NO: 515821 - DNA, 16 bp, R. norvegicus
tagagttatctgaaaa

SEQ ID NO: 515822 - DNA, 21 bp, R. norvegicus
tagagtttcgggtagtacatt

SEQ ID NO: 515823 - DNA, 16 bp, R. norvegicus
tagataaacaagtaga

SEQ ID NO: 515824 - DNA, 17 bp, R. norvegicus
tagataaacccttagct

SEQ ID NO: 515825 - DNA, 17 bp, R. norvegicus
tagataacatggatgaa

SEQ ID NO: 515826 - DNA, 16 bp, R. norvegicus
tagataagatacagtt

SEQ ID NO: 515827 - DNA, 16 bp, R. norvegicus
tagatacttctcagtc

SEQ ID NO: 515828 - DNA, 16 bp, R. norvegicus
tagatagagagacaga

SEQ ID NO: 515829 - DNA, 16 bp, R. norvegicus
tagatagatagataaa

SEQ ID NO: 515830 - DNA, 22 bp, R. norvegicus
tagatagatagatagatagatg

SEQ ID NO: 515831 - DNA, 16 bp, R. norvegicus
tagatatatgatatat

SEQ ID NO: 515832 - DNA, 16 bp, R. norvegicus
tagatatatttcctta

SEQ ID NO: 515833 - DNA, 16 bp, R. norvegicus
tagatatggagagagt

SEQ ID NO: 515834 - DNA, 16 bp, R. norvegicus
tagatattggatatta

SEQ ID NO: 515835 - DNA, 16 bp, R. norvegicus
tagatatttatgattg

SEQ ID NO: 515836 - DNA, 16 bp, R. norvegicus
tagatcaagatgtaga

SEQ ID NO: 515837 - DNA, 16 bp, R. norvegicus
tagatcaagctgacct

SEQ ID NO: 515838 - DNA, 16 bp, R. norvegicus
tagatctctccttaga

SEQ ID NO: 515839 - DNA, 16 bp, R. norvegicus
tagatgaacttgccag

SEQ ID NO: 515840 - DNA, 16 bp, R. norvegicus
tagatggagaagccaa

SEQ ID NO: 515841 - DNA, 16 bp, R. norvegicus
tagatggcactggctt

SEQ ID NO: 515842 - DNA, 16 bp, R. norvegicus
tagatgggctggagag

SEQ ID NO: 515843 - DNA, 16 bp, R. norvegicus
tagatggtgaaaccaa

SEQ ID NO: 515844 - DNA, 16 bp, R. norvegicus
tagattctatctttca

SEQ ID NO: 515845 - DNA, 16 bp, R. norvegicus
tagattctgagaaagc

SEQ ID NO: 515846 - DNA, 16 bp, R. norvegicus
tagattggacaaatgt

SEQ ID NO: 515847 - DNA, 16 bp, R. norvegicus
tagatttgaaatcaca

SEQ ID NO: 515848 - DNA, 16 bp, R. norvegicus
tagatttggttttgtc

SEQ ID NO: 515849 - DNA, 16 bp, R. norvegicus
tagcaaaaaatatcct

SEQ ID NO: 515850 - DNA, 16 bp, R. norvegicus
tagcaaacaccaaaca

SEQ ID NO: 515851 - DNA, 16 bp, R. norvegicus
tagcaaagcatccttt

SEQ ID NO: 515852 - DNA, 16 bp, R. norvegicus
tagcaaagtcatggct

SEQ ID NO: 515853 - DNA, 16 bp, R. norvegicus
tagcaacaaaatattt

SEQ ID NO: 515854 - DNA, 16 bp, R. norvegicus
tagcaactttattcat

SEQ ID NO: 515855 - DNA, 16 bp, R. norvegicus
tagcaagacactgtct

SEQ ID NO: 515856 - DNA, 16 bp, R. norvegicus
tagcaagagagaactg

SEQ ID NO: 515857 - DNA, 16 bp, R. norvegicus
tagcaagcacaaggtc

SEQ ID NO: 515858 - DNA, 16 bp, R. norvegicus
tagcaaggccctgtct

SEQ ID NO: 515859 - DNA, 35 bp, R. norvegicus
tagcaatgcatagcctagtaagagcaccagtggaa

SEQ ID NO: 515860 - DNA, 16 bp, R. norvegicus
tagcacagctttcagt

SEQ ID NO: 515861 - DNA, 16 bp, R. norvegicus
tagcacatgcctgtaa

SEQ ID NO: 515862 - DNA, 16 bp, R. norvegicus
tagcacccaggtccta

SEQ ID NO: 515863 - DNA, 16 bp, R. norvegicus
tagcagaagccagaag

SEQ ID NO: 515864 - DNA, 20 bp, R. norvegicus
tagcagagaatagccttgtt

SEQ ID NO: 515865 - DNA, 16 bp, R. norvegicus
tagcagagaatagctt

SEQ ID NO: 515866 - DNA, 16 bp, R. norvegicus
tagcagagactctcag

SEQ ID NO: 515867 - DNA, 16 bp, R. norvegicus
tagcagatgctggaga

SEQ ID NO: 515868 - DNA, 16 bp, R. norvegicus
tagcagatgctggtga

SEQ ID NO: 515869 - DNA, 16 bp, R. norvegicus
tagcagatgtgcacct

SEQ ID NO: 515870 - DNA, 16 bp, R. norvegicus
tagcagcagcaacagc

SEQ ID NO: 515871 - DNA, 16 bp, R. norvegicus
tagcagcagcagcaac

SEQ ID NO: 515872 - DNA, 16 bp, R. norvegicus
tagcagcagcagcagt

SEQ ID NO: 515873 - DNA, 16 bp, R. norvegicus
tagcagcaggggatta

SEQ ID NO: 515874 - DNA, 17 bp, R. norvegicus
tagcaggacctagggct

SEQ ID NO: 515875 - DNA, 16 bp, R. norvegicus
tagcaggctcctgtca

SEQ ID NO: 515876 - DNA, 16 bp, R. norvegicus
tagcaggtttctgaag

SEQ ID NO: 515877 - DNA, 17 bp, R. norvegicus
tagcagtagcagcagca

SEQ ID NO: 515878 - DNA, 18 bp, R. norvegicus
tagcagtctgcaatccca

SEQ ID NO: 515879 - DNA, 16 bp, R. norvegicus
tagcagtcttcagata

SEQ ID NO: 515880 - DNA, 16 bp, R. norvegicus
tagcatcacatttcat

SEQ ID NO: 515881 - DNA, 16 bp, R. norvegicus
tagcattgccttttcc

SEQ ID NO: 515882 - DNA, 16 bp, R. norvegicus
tagcattggtttctgt

SEQ ID NO: 515883 - DNA, 16 bp, R. norvegicus
tagccaattttattta

SEQ ID NO: 515884 - DNA, 16 bp, R. norvegicus
tagccacaaacaatat

SEQ ID NO: 515885 - DNA, 16 bp, R. norvegicus
tagccagaagctgcaa

SEQ ID NO: 515886 - DNA, 16 bp, R. norvegicus
tagccagaagctggag

SEQ ID NO: 515887 - DNA, 16 bp, R. norvegicus
tagccaggctggcctt

SEQ ID NO: 515888 - DNA, 19 bp, R. norvegicus
tagccagggctacacagag

SEQ ID NO: 515889 - DNA, 16 bp, R. norvegicus
tagccatcaagaaaat

SEQ ID NO: 515890 - DNA, 16 bp, R. norvegicus
tagccatcaaggaaat

SEQ ID NO: 515891 - DNA, 16 bp, R. norvegicus
tagccatttctttttt

SEQ ID NO: 515892 - DNA, 16 bp, R. norvegicus
tagccatttttactgt

SEQ ID NO: 515893 - DNA, 16 bp, R. norvegicus
tagcccagcccagccc

SEQ ID NO: 515894 - DNA, 16 bp, R. norvegicus
tagcccagcctgacct

SEQ ID NO: 515895 - DNA, 16 bp, R. norvegicus
tagcccaggctagcct

SEQ ID NO: 515896 - DNA, 16 bp, R. norvegicus
tagcccaggctcacct

SEQ ID NO: 515897 - DNA, 16 bp, R. norvegicus
tagcccaggctgacct

SEQ ID NO: 515898 - DNA, 16 bp, R. norvegicus
tagcccaggctggccc

SEQ ID NO: 515899 - DNA, 16 bp, R. norvegicus
tagcccaggctggcct

SEQ ID NO: 515900 - DNA, 16 bp, R. norvegicus
tagccctgcctggcct

SEQ ID NO: 515901 - DNA, 16 bp, R. norvegicus
tagccctggctgccct

SEQ ID NO: 515902 - DNA, 16 bp, R. norvegicus
tagccctggctggcat

SEQ ID NO: 515903 - DNA, 16 bp, R. norvegicus
tagccctggctggcct

SEQ ID NO: 515904 - DNA, 16 bp, R. norvegicus
tagccctggctttcct

SEQ ID NO: 515905 - DNA, 16 bp, R. norvegicus
tagccctgggtatcct

SEQ ID NO: 515906 - DNA, 16 bp, R. norvegicus
tagcctaattggcaag

SEQ ID NO: 515907 - DNA, 16 bp, R. norvegicus
tagcctcaaacttgca

SEQ ID NO: 515908 - DNA, 16 bp, R. norvegicus
tagcctctcagagact

SEQ ID NO: 515909 - DNA, 16 bp, R. norvegicus
tagcctgatcttatgg

SEQ ID NO: 515910 - DNA, 16 bp, R. norvegicus
tagcctgggctacaca

SEQ ID NO: 515911 - DNA, 16 bp, R. norvegicus
tagcctgtgctcttca

SEQ ID NO: 515912 - DNA, 16 bp, R. norvegicus
tagccttggctgtcct

SEQ ID NO: 515913 - DNA, 16 bp, R. norvegicus
tagccttggtttctat

SEQ ID NO: 515914 - DNA, 16 bp, R. norvegicus
tagccttttctgcttt

SEQ ID NO: 515915 - DNA, 16 bp, R. norvegicus
tagctagacagacaga

SEQ ID NO: 515916 - DNA, 16 bp, R. norvegicus
tagctcagactggcct

SEQ ID NO: 515917 - DNA, 16 bp, R. norvegicus
tagctcaggctggcct

SEQ ID NO: 515918 - DNA, 16 bp, R. norvegicus
tagctcagtgataaag

SEQ ID NO: 515919 - DNA, 17 bp, R. norvegicus
tagctcagtggtagagt

SEQ ID NO: 515920 - DNA, 16 bp, R. norvegicus
tagctcctccagcacc

SEQ ID NO: 515921 - DNA, 16 bp, R. norvegicus
tagctctgaacaccat

SEQ ID NO: 515922 - DNA, 17 bp, R. norvegicus
tagctctgaaccccttt

SEQ ID NO: 515923 - DNA, 16 bp, R. norvegicus
tagctcttagtgcctg

SEQ ID NO: 515924 - DNA, 17 bp, R. norvegicus
tagctgaccttgaggag

SEQ ID NO: 515925 - DNA, 16 bp, R. norvegicus
tagctgagactctctg

SEQ ID NO: 515926 - DNA, 16 bp, R. norvegicus
tagctgcctggggatg

SEQ ID NO: 515927 - DNA, 16 bp, R. norvegicus
tagctgctacaaagaa

SEQ ID NO: 515928 - DNA, 16 bp, R. norvegicus
tagctgctgttaacag

SEQ ID NO: 515929 - DNA, 16 bp, R. norvegicus
tagctggagccatggg

SEQ ID NO: 515930 - DNA, 16 bp, R. norvegicus
tagctgggctgcctgg

SEQ ID NO: 515931 - DNA, 16 bp, R. norvegicus
tagctgtaattttaag

SEQ ID NO: 515932 - DNA, 16 bp, R. norvegicus
tagctgtagaggaaga

SEQ ID NO: 515933 - DNA, 16 bp, R. norvegicus
tagctgtgaactctct

SEQ ID NO: 515934 - DNA, 16 bp, R. norvegicus
tagctgtggctgtcct

SEQ ID NO: 515935 - DNA, 16 bp, R. norvegicus
tagctgtttctctgtt

SEQ ID NO: 515936 - DNA, 16 bp, R. norvegicus
tagcttaaccctttaa

SEQ ID NO: 515937 - DNA, 19 bp, R. norvegicus
tagcttcacaggaatgcca

SEQ ID NO: 515938 - DNA, 16 bp, R. norvegicus
tagcttcagcaccatc

SEQ ID NO: 515939 - DNA, 16 bp, R. norvegicus
tagcttcagtaatagt

SEQ ID NO: 515940 - DNA, 16 bp, R. norvegicus
tagcttcctgctgact

SEQ ID NO: 515941 - DNA, 16 bp, R. norvegicus
tagctttgaactcaca

SEQ ID NO: 515942 - DNA, 16 bp, R. norvegicus
tagctttggctggcct

SEQ ID NO: 515943 - DNA, 16 bp, R. norvegicus
tagcttttctatctcc

SEQ ID NO: 515944 - DNA, 16 bp, R. norvegicus
tagctttttcagcaaa

SEQ ID NO: 515945 - DNA, 16 bp, R. norvegicus
taggaaaaaacagcaa

SEQ ID NO: 515946 - DNA, 16 bp, R. norvegicus
taggaaaacacacaca

SEQ ID NO: 515947 - DNA, 16 bp, R. norvegicus
taggaaacatggagtt

SEQ ID NO: 515948 - DNA, 16 bp, R. norvegicus
taggaaagagagcagg

SEQ ID NO: 515949 - DNA, 16 bp, R. norvegicus
taggaaccaaactctg

SEQ ID NO: 515950 - DNA, 16 bp, R. norvegicus
taggaagcagaggcag

SEQ ID NO: 515951 - DNA, 24 bp, R. norvegicus
taggaagcgcaaggccctgggttc

SEQ ID NO: 515952 - DNA, 16 bp, R. norvegicus
taggaagtctaacatg

SEQ ID NO: 515953 - DNA, 16 bp, R. norvegicus
taggaagtttccactg

SEQ ID NO: 515954 - DNA, 16 bp, R. norvegicus
taggaattttaatggg

SEQ ID NO: 515955 - DNA, 16 bp, R. norvegicus
taggacaaaatgtcaa

SEQ ID NO: 515956 - DNA, 16 bp, R. norvegicus
taggacaagctaataa

SEQ ID NO: 515957 - DNA, 16 bp, R. norvegicus
taggacatctgtccag

SEQ ID NO: 515958 - DNA, 16 bp, R. norvegicus
taggagctgtggcctt

SEQ ID NO: 515959 - DNA, 16 bp, R. norvegicus
taggaggtgtggtctt

SEQ ID NO: 515960 - DNA, 16 bp, R. norvegicus
taggagtcaagaaaac

SEQ ID NO: 515961 - DNA, 16 bp, R. norvegicus
taggatattcattact

SEQ ID NO: 515962 - DNA, 16 bp, R. norvegicus
taggattaataaagat

SEQ ID NO: 515963 - DNA, 16 bp, R. norvegicus
taggattacaggcttg

SEQ ID NO: 515964 - DNA, 16 bp, R. norvegicus
taggattttgtagtag

SEQ ID NO: 515965 - DNA, 98 bp, R. norvegicus
taggcaaatggttggaactggaaaacatcatcctgagtgagctaacccaatcacagaaagacatacatggtatgcactcattgataagtggctattag

SEQ ID NO: 515966 - DNA, 16 bp, R. norvegicus
taggcaagcgctcaac

SEQ ID NO: 515967 - DNA, 16 bp, R. norvegicus
taggcagaagttggaa

SEQ ID NO: 515968 - DNA, 16 bp, R. norvegicus
taggcagaggcagagg

SEQ ID NO: 515969 - DNA, 16 bp, R. norvegicus
taggcatagaagaagc

SEQ ID NO: 515970 - DNA, 16 bp, R. norvegicus
taggcatatacccaca

SEQ ID NO: 515971 - DNA, 16 bp, R. norvegicus
taggcatcctgaccac

SEQ ID NO: 515972 - DNA, 16 bp, R. norvegicus
taggcatgtgccacca

SEQ ID NO: 515973 - DNA, 16 bp, R. norvegicus
taggccagattggcct

SEQ ID NO: 515974 - DNA, 16 bp, R. norvegicus
taggctcctatatttg

SEQ ID NO: 515975 - DNA, 16 bp, R. norvegicus
taggctcctctctgta

SEQ ID NO: 515976 - DNA, 16 bp, R. norvegicus
taggctctcttcatgg

SEQ ID NO: 515977 - DNA, 16 bp, R. norvegicus
taggctgacctcaaac

SEQ ID NO: 515978 - DNA, 16 bp, R. norvegicus
taggctgccagcagaa

SEQ ID NO: 515979 - DNA, 16 bp, R. norvegicus
taggctgttttgaaat

SEQ ID NO: 515980 - DNA, 16 bp, R. norvegicus
taggcttcaccaataa

SEQ ID NO: 515981 - DNA, 16 bp, R. norvegicus
tagggaaacaagcctt

SEQ ID NO: 515982 - DNA, 16 bp, R. norvegicus
tagggaattccaggaa

SEQ ID NO: 515983 - DNA, 16 bp, R. norvegicus
tagggactggagagat

SEQ ID NO: 515984 - DNA, 16 bp, R. norvegicus
tagggagagaagggac

SEQ ID NO: 515985 - DNA, 17 bp, R. norvegicus
tagggagcgccaggtct

SEQ ID NO: 515986 - DNA, 16 bp, R. norvegicus
tagggagcggcgcggt

SEQ ID NO: 515987 - DNA, 16 bp, R. norvegicus
tagggagctgcgacgt

SEQ ID NO: 515988 - DNA, 17 bp, R. norvegicus
tagggcagcatctcaaa

SEQ ID NO: 515989 - DNA, 16 bp, R. norvegicus
tagggctggtttacag

SEQ ID NO: 515990 - DNA, 16 bp, R. norvegicus
taggggaatgttggga

SEQ ID NO: 515991 - DNA, 16 bp, R. norvegicus
taggggctggagagat

SEQ ID NO: 515992 - DNA, 16 bp, R. norvegicus
tagggggatgttggcc

SEQ ID NO: 515993 - DNA, 16 bp, R. norvegicus
taggggttaagagcac

SEQ ID NO: 515994 - DNA, 16 bp, R. norvegicus
taggtctgtctttaca

SEQ ID NO: 515995 - DNA, 16 bp, R. norvegicus
taggtgatcccaaaag

SEQ ID NO: 515996 - DNA, 16 bp, R. norvegicus
taggtgctcaataaat

SEQ ID NO: 515997 - DNA, 16 bp, R. norvegicus
taggtgctgggagctg

SEQ ID NO: 515998 - DNA, 16 bp, R. norvegicus
taggtgtgtcactgtg

SEQ ID NO: 515999 - DNA, 16 bp, R. norvegicus
taggttatggggaccc

SEQ ID NO: 516000 - DNA, 16 bp, R. norvegicus
tagtaaatgctcttaa

SEQ ID NO: 516001 - DNA, 16 bp, R. norvegicus
tagtaagacacaaaaa

SEQ ID NO: 516002 - DNA, 16 bp, R. norvegicus
tagtaagatcaccaat

SEQ ID NO: 516003 - DNA, 16 bp, R. norvegicus
tagtaagatcaccagt

SEQ ID NO: 516004 - DNA, 16 bp, R. norvegicus
tagtaaggatattatt

SEQ ID NO: 516005 - DNA, 16 bp, R. norvegicus
tagtacatacttttaa

SEQ ID NO: 516006 - DNA, 17 bp, R. norvegicus
tagtagtagtagtagta

SEQ ID NO: 516007 - DNA, 16 bp, R. norvegicus
tagtagtagtggtggt

SEQ ID NO: 516008 - DNA, 16 bp, R. norvegicus
tagtattccttttgtt

SEQ ID NO: 516009 - DNA, 16 bp, R. norvegicus
tagtattttctttggt

SEQ ID NO: 516010 - DNA, 16 bp, R. norvegicus
tagtcaaaaattgctt

SEQ ID NO: 516011 - DNA, 16 bp, R. norvegicus
tagtcaaaataccaaa

SEQ ID NO: 516012 - DNA, 16 bp, R. norvegicus
tagtcagaacctggaa

SEQ ID NO: 516013 - DNA, 16 bp, R. norvegicus
tagtccattgatctac

SEQ ID NO: 516014 - DNA, 17 bp, R. norvegicus
tagtcccaggaagctct

SEQ ID NO: 516015 - DNA, 16 bp, R. norvegicus
tagtcctggctgtcct

SEQ ID NO: 516016 - DNA, 16 bp, R. norvegicus
tagtcctgtagtgact

SEQ ID NO: 516017 - DNA, 16 bp, R. norvegicus
tagtctctggcgagaa

SEQ ID NO: 516018 - DNA, 16 bp, R. norvegicus
tagtcttagctatcct

SEQ ID NO: 516019 - DNA, 16 bp, R. norvegicus
tagtcttggggtagtg

SEQ ID NO: 516020 - DNA, 16 bp, R. norvegicus
tagtgaaaggaaaatt

SEQ ID NO: 516021 - DNA, 16 bp, R. norvegicus
tagtgaaaggttgcaa

SEQ ID NO: 516022 - DNA, 16 bp, R. norvegicus
tagtgagaccctgtct

SEQ ID NO: 516023 - DNA, 16 bp, R. norvegicus
tagtgagagacagaaa

SEQ ID NO: 516024 - DNA, 16 bp, R. norvegicus
tagtgatttttgactt

SEQ ID NO: 516025 - DNA, 18 bp, R. norvegicus
tagtgcccacctgaccag

SEQ ID NO: 516026 - DNA, 16 bp, R. norvegicus
tagtgctggatatgta

SEQ ID NO: 516027 - DNA, 16 bp, R. norvegicus
tagtggaaaagaaagg

SEQ ID NO: 516028 - DNA, 16 bp, R. norvegicus
tagtgtctgtctttga

SEQ ID NO: 516029 - DNA, 16 bp, R. norvegicus
tagtgtcttttgcctt

SEQ ID NO: 516030 - DNA, 16 bp, R. norvegicus
tagtgttcctcctgtt

SEQ ID NO: 516031 - DNA, 26 bp, R. norvegicus
tagttcaatgtccaattttctgagga

SEQ ID NO: 516032 - DNA, 16 bp, R. norvegicus
tagttctggctgtcct

SEQ ID NO: 516033 - DNA, 16 bp, R. norvegicus
tagttgatactgttgg

SEQ ID NO: 516034 - DNA, 16 bp, R. norvegicus
tagttgattctgttgg

SEQ ID NO: 516035 - DNA, 16 bp, R. norvegicus
tagtttcacagtgtct

SEQ ID NO: 516036 - DNA, 16 bp, R. norvegicus
tagtttctgtttccac

SEQ ID NO: 516037 - DNA, 16 bp, R. norvegicus
tagtttctttgggtct

SEQ ID NO: 516038 - DNA, 16 bp, R. norvegicus
tagtttggatagtttt

SEQ ID NO: 516039 - DNA, 16 bp, R. norvegicus
tagttttagctttcct

SEQ ID NO: 516040 - DNA, 23 bp, R. norvegicus
tagttttatgagatcccatttgt

SEQ ID NO: 516041 - DNA, 16 bp, R. norvegicus
tagttttcagtggttc

SEQ ID NO: 516042 - DNA, 16 bp, R. norvegicus
tagttttcattatcct

SEQ ID NO: 516043 - DNA, 16 bp, R. norvegicus
tagttttccctatctt

SEQ ID NO: 516044 - DNA, 16 bp, R. norvegicus
tagttttctgtatatt

SEQ ID NO: 516045 - DNA, 16 bp, R. norvegicus
tagttttggtttctgt

SEQ ID NO: 516046 - DNA, 16 bp, R. norvegicus
tataaaaactgcttgt

SEQ ID NO: 516047 - DNA, 16 bp, R. norvegicus
tataaaagacagcatt

SEQ ID NO: 516048 - DNA, 16 bp, R. norvegicus
tataaaagcaagaaga

SEQ ID NO: 516049 - DNA, 16 bp, R. norvegicus
tataaaatcaactcaa

SEQ ID NO: 516050 - DNA, 16 bp, R. norvegicus
tataaaatggaatatt

SEQ ID NO: 516051 - DNA, 16 bp, R. norvegicus
tataaaattgtcaaag

SEQ ID NO: 516052 - DNA, 16 bp, R. norvegicus
tataaacaaactcaag

SEQ ID NO: 516053 - DNA, 16 bp, R. norvegicus
tataaacaaactgaag

SEQ ID NO: 516054 - DNA, 16 bp, R. norvegicus
tataaaccaaccagac

SEQ ID NO: 516055 - DNA, 16 bp, R. norvegicus
tataaacccagcactt

SEQ ID NO: 516056 - DNA, 16 bp, R. norvegicus
tataaactgtccacct

SEQ ID NO: 516057 - DNA, 16 bp, R. norvegicus
tataaagaaaaacatt

SEQ ID NO: 516058 - DNA, 16 bp, R. norvegicus
tataaagaaaaattca

SEQ ID NO: 516059 - DNA, 16 bp, R. norvegicus
tataaagaaattggag

SEQ ID NO: 516060 - DNA, 16 bp, R. norvegicus
tataaagaattcaaaa

SEQ ID NO: 516061 - DNA, 16 bp, R. norvegicus
tataaagacaagcaag

SEQ ID NO: 516062 - DNA, 16 bp, R. norvegicus
tataaaggacatcatt

SEQ ID NO: 516063 - DNA, 16 bp, R. norvegicus
tataaataaggctgct

SEQ ID NO: 516064 - DNA, 16 bp, R. norvegicus
tataaatgtgtgtgtg

SEQ ID NO: 516065 - DNA, 16 bp, R. norvegicus
tataacagcaatagaa

SEQ ID NO: 516066 - DNA, 16 bp, R. norvegicus
tataacatgactccag

SEQ ID NO: 516067 - DNA, 16 bp, R. norvegicus
tataagagatagaaga

SEQ ID NO: 516068 - DNA, 16 bp, R. norvegicus
tataagcaaactgaaa

SEQ ID NO: 516069 - DNA, 16 bp, R. norvegicus
tataagccagccccaa

SEQ ID NO: 516070 - DNA, 16 bp, R. norvegicus
tataagtgagcttcgc

SEQ ID NO: 516071 - DNA, 16 bp, R. norvegicus
tataagttcacagtga

SEQ ID NO: 516072 - DNA, 16 bp, R. norvegicus
tataataaagtgtttt

SEQ ID NO: 516073 - DNA, 16 bp, R. norvegicus
tataataacctcttgg

SEQ ID NO: 516074 - DNA, 16 bp, R. norvegicus
tataataccagaacag

SEQ ID NO: 516075 - DNA, 16 bp, R. norvegicus
tataatatttctatgt

SEQ ID NO: 516076 - DNA, 16 bp, R. norvegicus
tataatgaaaatgaag

SEQ ID NO: 516077 - DNA, 25 bp, R. norvegicus
tataatgaggaaatggcaacttatt

SEQ ID NO: 516078 - DNA, 16 bp, R. norvegicus
tataattgtatataca

SEQ ID NO: 516079 - DNA, 16 bp, R. norvegicus
tataatttcagaggtt

SEQ ID NO: 516080 - DNA, 16 bp, R. norvegicus
tatacaaagaactcac

SEQ ID NO: 516081 - DNA, 16 bp, R. norvegicus
tatacaaagaatcatc

SEQ ID NO: 516082 - DNA, 16 bp, R. norvegicus
tatacaaagatttata

SEQ ID NO: 516083 - DNA, 16 bp, R. norvegicus
tatacaacattttctg

SEQ ID NO: 516084 - DNA, 16 bp, R. norvegicus
tatacaatggggaaaa

SEQ ID NO: 516085 - DNA, 16 bp, R. norvegicus
tatacacacacacaca

SEQ ID NO: 516086 - DNA, 16 bp, R. norvegicus
tatacacacacatata

SEQ ID NO: 516087 - DNA, 16 bp, R. norvegicus
tatacacacatacata

SEQ ID NO: 516088 - DNA, 16 bp, R. norvegicus
tatacacatacacaaa

SEQ ID NO: 516089 - DNA, 16 bp, R. norvegicus
tatacacatacacatg

SEQ ID NO: 516090 - DNA, 16 bp, R. norvegicus
tatacactcatacaca

SEQ ID NO: 516091 - DNA, 16 bp, R. norvegicus
tatacagagaaatcct

SEQ ID NO: 516092 - DNA, 16 bp, R. norvegicus
tatacagagacataga

SEQ ID NO: 516093 - DNA, 16 bp, R. norvegicus
tatacagtgagatctt

SEQ ID NO: 516094 - DNA, 16 bp, R. norvegicus
tatacatacacatcat

SEQ ID NO: 516095 - DNA, 16 bp, R. norvegicus
tatacatacatacata

SEQ ID NO: 516096 - DNA, 16 bp, R. norvegicus
tatacatatacataga

SEQ ID NO: 516097 - DNA, 16 bp, R. norvegicus
tatacatatacatata

SEQ ID NO: 516098 - DNA, 16 bp, R. norvegicus
tatacatgaactgact

SEQ ID NO: 516099 - DNA, 16 bp, R. norvegicus
tatacatgcatattta

SEQ ID NO: 516100 - DNA, 16 bp, R. norvegicus
tatacatgtaaatgta

SEQ ID NO: 516101 - DNA, 16 bp, R. norvegicus
tatacatgtataaatt

SEQ ID NO: 516102 - DNA, 16 bp, R. norvegicus
tatacattatgtatat

SEQ ID NO: 516103 - DNA, 16 bp, R. norvegicus
tatacattgtatatat

SEQ ID NO: 516104 - DNA, 16 bp, R. norvegicus
tatacatttccagtgt

SEQ ID NO: 516105 - DNA, 16 bp, R. norvegicus
tatacatttcgagtgt

SEQ ID NO: 516106 - DNA, 16 bp, R. norvegicus
tatacctcccctgggc

SEQ ID NO: 516107 - DNA, 17 bp, R. norvegicus
tatacctgtcctgggca

SEQ ID NO: 516108 - DNA, 16 bp, R. norvegicus
tataccttcctctcag

SEQ ID NO: 516109 - DNA, 16 bp, R. norvegicus
tataccttgaaaacta

SEQ ID NO: 516110 - DNA, 16 bp, R. norvegicus
tatactctggttggtg

SEQ ID NO: 516111 - DNA, 16 bp, R. norvegicus
tatactgagaaaccct

SEQ ID NO: 516112 - DNA, 21 bp, R. norvegicus
tatactggccacagtagttag

SEQ ID NO: 516113 - DNA, 16 bp, R. norvegicus
tatagaagaaaatttt

SEQ ID NO: 516114 - DNA, 16 bp, R. norvegicus
tatagaagctttgaaa

SEQ ID NO: 516115 - DNA, 16 bp, R. norvegicus
tatagaccaggctgac

SEQ ID NO: 516116 - DNA, 16 bp, R. norvegicus
tatagactatggggac

SEQ ID NO: 516117 - DNA, 16 bp, R. norvegicus
tatagagggtcaggaa

SEQ ID NO: 516118 - DNA, 16 bp, R. norvegicus
tatagagtgaattcca

SEQ ID NO: 516119 - DNA, 16 bp, R. norvegicus
tatagatatatgtgta

SEQ ID NO: 516120 - DNA, 38 bp, R. norvegicus
tatagatctggtccgagagcaattagacattctatggc

SEQ ID NO: 516121 - DNA, 16 bp, R. norvegicus
tatagccttaggaata

SEQ ID NO: 516122 - DNA, 16 bp, R. norvegicus
tatagctgggtcctca

SEQ ID NO: 516123 - DNA, 16 bp, R. norvegicus
tatagctgggtcctcg

SEQ ID NO: 516124 - DNA, 16 bp, R. norvegicus
tataggacctctggga

SEQ ID NO: 516125 - DNA, 17 bp, R. norvegicus
tataggagtaattgtgg

SEQ ID NO: 516126 - DNA, 16 bp, R. norvegicus
tataggcacaggggaa

SEQ ID NO: 516127 - DNA, 16 bp, R. norvegicus
tataggggtgtgtgtg

SEQ ID NO: 516128 - DNA, 16 bp, R. norvegicus
tatagggtcgccctcc

SEQ ID NO: 516129 - DNA, 16 bp, R. norvegicus
tataggtgcttctcag

SEQ ID NO: 516130 - DNA, 16 bp, R. norvegicus
tataggtgtgtatgtg

SEQ ID NO: 516131 - DNA, 16 bp, R. norvegicus
tatagtaatcctgcca

SEQ ID NO: 516132 - DNA, 16 bp, R. norvegicus
tatagtattgatacag

SEQ ID NO: 516133 - DNA, 16 bp, R. norvegicus
tatagtctttggggag

SEQ ID NO: 516134 - DNA, 16 bp, R. norvegicus
tatataaaatatgcaa

SEQ ID NO: 516135 - DNA, 16 bp, R. norvegicus
tatataaacaatctga

SEQ ID NO: 516136 - DNA, 16 bp, R. norvegicus
tatataaataaactga

SEQ ID NO: 516137 - DNA, 16 bp, R. norvegicus
tatataacatatatac

SEQ ID NO: 516138 - DNA, 16 bp, R. norvegicus
tatataataaatgagt

SEQ ID NO: 516139 - DNA, 16 bp, R. norvegicus
tatataattggtcaaa

SEQ ID NO: 516140 - DNA, 16 bp, R. norvegicus
tatatacaaagaattc

SEQ ID NO: 516141 - DNA, 16 bp, R. norvegicus
tatatacaggttgtta

SEQ ID NO: 516142 - DNA, 16 bp, R. norvegicus
tatatacataatatgt

SEQ ID NO: 516143 - DNA, 16 bp, R. norvegicus
tatatacatacaatat

SEQ ID NO: 516144 - DNA, 16 bp, R. norvegicus
tatatacatctatata

SEQ ID NO: 516145 - DNA, 16 bp, R. norvegicus
tatatacatgaataaa

SEQ ID NO: 516146 - DNA, 16 bp, R. norvegicus
tatatactacatatat

SEQ ID NO: 516147 - DNA, 16 bp, R. norvegicus
tatatactatatatca

SEQ ID NO: 516148 - DNA, 16 bp, R. norvegicus
tatatagccttaggaa

SEQ ID NO: 516149 - DNA, 16 bp, R. norvegicus
tatatagtggattata

SEQ ID NO: 516150 - DNA, 16 bp, R. norvegicus
tatatatacatataca

SEQ ID NO: 516151 - DNA, 16 bp, R. norvegicus
tatatatacccaaaag

SEQ ID NO: 516152 - DNA, 16 bp, R. norvegicus
tatatataggtatata

SEQ ID NO: 516153 - DNA, 16 bp, R. norvegicus
tatatatatacataca

SEQ ID NO: 516154 - DNA, 16 bp, R. norvegicus
tatatatatatacaca

SEQ ID NO: 516155 - DNA, 16 bp, R. norvegicus
tatatatatataccca

SEQ ID NO: 516156 - DNA, 16 bp, R. norvegicus
tatatatatatagtga

SEQ ID NO: 516157 - DNA, 16 bp, R. norvegicus
tatatatatatgtgtg

SEQ ID NO: 516158 - DNA, 16 bp, R. norvegicus
tatatatatattcatg

SEQ ID NO: 516159 - DNA, 16 bp, R. norvegicus
tatatatatgttttct

SEQ ID NO: 516160 - DNA, 16 bp, R. norvegicus
tatatatattctgtat

SEQ ID NO: 516161 - DNA, 16 bp, R. norvegicus
tatatatatttacaca

SEQ ID NO: 516162 - DNA, 16 bp, R. norvegicus
tatatatccaatatat

SEQ ID NO: 516163 - DNA, 16 bp, R. norvegicus
tatatatgtatataca

SEQ ID NO: 516164 - DNA, 16 bp, R. norvegicus
tatatatgtatatgaa

SEQ ID NO: 516165 - DNA, 16 bp, R. norvegicus
tatatatgtatgaatg

SEQ ID NO: 516166 - DNA, 16 bp, R. norvegicus
tatatatgtattacat

SEQ ID NO: 516167 - DNA, 16 bp, R. norvegicus
tatatatgtggctgga

SEQ ID NO: 516168 - DNA, 16 bp, R. norvegicus
tatatattcatcaaag

SEQ ID NO: 516169 - DNA, 16 bp, R. norvegicus
tatatattggctatta

SEQ ID NO: 516170 - DNA, 17 bp, R. norvegicus
tatatatttgctgtatt

SEQ ID NO: 516171 - DNA, 16 bp, R. norvegicus
tatatatttggaaaat

SEQ ID NO: 516172 - DNA, 16 bp, R. norvegicus
tatatattttaggaaa

SEQ ID NO: 516173 - DNA, 16 bp, R. norvegicus
tatatcacattttctt

SEQ ID NO: 516174 - DNA, 16 bp, R. norvegicus
tatatcatacacacat

SEQ ID NO: 516175 - DNA, 16 bp, R. norvegicus
tatatccagccacttc

SEQ ID NO: 516176 - DNA, 16 bp, R. norvegicus
tatatccagtcacttt

SEQ ID NO: 516177 - DNA, 16 bp, R. norvegicus
tatatccattcctttg

SEQ ID NO: 516178 - DNA, 16 bp, R. norvegicus
tatatctatatctcta

SEQ ID NO: 516179 - DNA, 16 bp, R. norvegicus
tatatctgtatatgta

SEQ ID NO: 516180 - DNA, 16 bp, R. norvegicus
tatatgaaaatgtcat

SEQ ID NO: 516181 - DNA, 16 bp, R. norvegicus
tatatgaaatgtatat

SEQ ID NO: 516182 - DNA, 16 bp, R. norvegicus
tatatgaacatacaca

SEQ ID NO: 516183 - DNA, 16 bp, R. norvegicus
tatatgaagaattgaa

SEQ ID NO: 516184 - DNA, 16 bp, R. norvegicus
tatatgaagaattgag

SEQ ID NO: 516185 - DNA, 16 bp, R. norvegicus
tatatgagtatgtgtg

SEQ ID NO: 516186 - DNA, 16 bp, R. norvegicus
tatatgatctgctttt

SEQ ID NO: 516187 - DNA, 16 bp, R. norvegicus
tatatgcacatgcatg

SEQ ID NO: 516188 - DNA, 16 bp, R. norvegicus
tatatgcatatatatg

SEQ ID NO: 516189 - DNA, 16 bp, R. norvegicus
tatatgcatatattaa

SEQ ID NO: 516190 - DNA, 16 bp, R. norvegicus
tatatgcccaagagta

SEQ ID NO: 516191 - DNA, 16 bp, R. norvegicus
tatatgtacacacaca

SEQ ID NO: 516192 - DNA, 16 bp, R. norvegicus
tatatgtacatgtata

SEQ ID NO: 516193 - DNA, 16 bp, R. norvegicus
tatatgtatacacata

SEQ ID NO: 516194 - DNA, 16 bp, R. norvegicus
tatatgtatatagtat

SEQ ID NO: 516195 - DNA, 16 bp, R. norvegicus
tatatgtatatatatg

SEQ ID NO: 516196 - DNA, 16 bp, R. norvegicus
tatatgtatatgtata

SEQ ID NO: 516197 - DNA, 16 bp, R. norvegicus
tatatgtatgtacatg

SEQ ID NO: 516198 - DNA, 16 bp, R. norvegicus
tatatgtgggcgtttt

SEQ ID NO: 516199 - DNA, 16 bp, R. norvegicus
tatatgtgtgactgtg

SEQ ID NO: 516200 - DNA, 16 bp, R. norvegicus
tatatgtgtgcataca

SEQ ID NO: 516201 - DNA, 16 bp, R. norvegicus
tatatgtttgtatgtg

SEQ ID NO: 516202 - DNA, 16 bp, R. norvegicus
tatattaaaaattcac

SEQ ID NO: 516203 - DNA, 16 bp, R. norvegicus
tatattatgtacatat

SEQ ID NO: 516204 - DNA, 16 bp, R. norvegicus
tatattcaacaacact

SEQ ID NO: 516205 - DNA, 16 bp, R. norvegicus
tatattcctaaatata

SEQ ID NO: 516206 - DNA, 16 bp, R. norvegicus
tatattgaatattgaa

SEQ ID NO: 516207 - DNA, 16 bp, R. norvegicus
tatattgatttcttct

SEQ ID NO: 516208 - DNA, 16 bp, R. norvegicus
tatatttatatacaca

SEQ ID NO: 516209 - DNA, 16 bp, R. norvegicus
tatatttatatagaga

SEQ ID NO: 516210 - DNA, 16 bp, R. norvegicus
tatatttatttacatg

SEQ ID NO: 516211 - DNA, 16 bp, R. norvegicus
tatatttgaatacttg

SEQ ID NO: 516212 - DNA, 16 bp, R. norvegicus
tatatttgtcatgctc

SEQ ID NO: 516213 - DNA, 16 bp, R. norvegicus
tatattttgcatattt

SEQ ID NO: 516214 - DNA, 16 bp, R. norvegicus
tatcaaaaacaaagac

SEQ ID NO: 516215 - DNA, 16 bp, R. norvegicus
tatcaaaattggttct

SEQ ID NO: 516216 - DNA, 16 bp, R. norvegicus
tatcaaagaagataag

SEQ ID NO: 516217 - DNA, 16 bp, R. norvegicus
tatcaaagtaaatgga

SEQ ID NO: 516218 - DNA, 16 bp, R. norvegicus
tatcaacagaaacatg

SEQ ID NO: 516219 - DNA, 16 bp, R. norvegicus
tatcaagttgcagtaa

SEQ ID NO: 516220 - DNA, 16 bp, R. norvegicus
tatcaatcaagaaaat

SEQ ID NO: 516221 - DNA, 16 bp, R. norvegicus
tatcacaccacacaca

SEQ ID NO: 516222 - DNA, 16 bp, R. norvegicus
tatcacagagaaatga

SEQ ID NO: 516223 - DNA, 16 bp, R. norvegicus
tatcacagagaaggga

SEQ ID NO: 516224 - DNA, 16 bp, R. norvegicus
tatcacagcaatagaa

SEQ ID NO: 516225 - DNA, 16 bp, R. norvegicus
tatcacagtttttaaa

SEQ ID NO: 516226 - DNA, 16 bp, R. norvegicus
tatcaccaacagaata

SEQ ID NO: 516227 - DNA, 17 bp, R. norvegicus
tatcaccatcaccacca

SEQ ID NO: 516228 - DNA, 16 bp, R. norvegicus
tatcaccattgctctg

SEQ ID NO: 516229 - DNA, 16 bp, R. norvegicus
tatcactatttgcagg

SEQ ID NO: 516230 - DNA, 16 bp, R. norvegicus
tatcagaacaccacag

SEQ ID NO: 516231 - DNA, 16 bp, R. norvegicus
tatcagaagatggaaa

SEQ ID NO: 516232 - DNA, 16 bp, R. norvegicus
tatcagacaaccatgg

SEQ ID NO: 516233 - DNA, 16 bp, R. norvegicus
tatcagactcctgtca

SEQ ID NO: 516234 - DNA, 16 bp, R. norvegicus
tatcagatgtacgatt

SEQ ID NO: 516235 - DNA, 16 bp, R. norvegicus
tatcagatgtatgatt

SEQ ID NO: 516236 - DNA, 16 bp, R. norvegicus
tatcagcatcttgaca

SEQ ID NO: 516237 - DNA, 16 bp, R. norvegicus
tatcaggaattcactg

SEQ ID NO: 516238 - DNA, 16 bp, R. norvegicus
tatcaggctcctctca

SEQ ID NO: 516239 - DNA, 16 bp, R. norvegicus
tatcagggaccctaag

SEQ ID NO: 516240 - DNA, 16 bp, R. norvegicus
tatcaggtgtcttcct

SEQ ID NO: 516241 - DNA, 16 bp, R. norvegicus
tatcagtgggaggaga

SEQ ID NO: 516242 - DNA, 16 bp, R. norvegicus
tatcatacaaatattt

SEQ ID NO: 516243 - DNA, 22 bp, R. norvegicus
tatcatatgacacagctgtcct

SEQ ID NO: 516244 - DNA, 31 bp, R. norvegicus
tatcatatgacgcagctgtcctgcgtttcct

SEQ ID NO: 516245 - DNA, 16 bp, R. norvegicus
tatcatatttaagttt

SEQ ID NO: 516246 - DNA, 16 bp, R. norvegicus
tatcatcaaagtggga

SEQ ID NO: 516247 - DNA, 16 bp, R. norvegicus
tatcatcctgagcgag

SEQ ID NO: 516248 - DNA, 16 bp, R. norvegicus
tatcatcttgagtgag

SEQ ID NO: 516249 - DNA, 16 bp, R. norvegicus
tatcatggaaacagaa

SEQ ID NO: 516250 - DNA, 16 bp, R. norvegicus
tatcattaaggctctg

SEQ ID NO: 516251 - DNA, 16 bp, R. norvegicus
tatcattatcatcatc

SEQ ID NO: 516252 - DNA, 16 bp, R. norvegicus
tatccaaaatagacaa

SEQ ID NO: 516253 - DNA, 16 bp, R. norvegicus
tatccaaactatttca

SEQ ID NO: 516254 - DNA, 18 bp, R. norvegicus
tatccaaagaccttgagt

SEQ ID NO: 516255 - DNA, 25 bp, R. norvegicus
tatccaaagaccttgggtacagggg

SEQ ID NO: 516256 - DNA, 16 bp, R. norvegicus
tatccaaagactgtac

SEQ ID NO: 516257 - DNA, 16 bp, R. norvegicus
tatccacactgagtat

SEQ ID NO: 516258 - DNA, 16 bp, R. norvegicus
tatccacatttctgag

SEQ ID NO: 516259 - DNA, 16 bp, R. norvegicus
tatccactgggactgg

SEQ ID NO: 516260 - DNA, 16 bp, R. norvegicus
tatccacttatgagtg

SEQ ID NO: 516261 - DNA, 16 bp, R. norvegicus
tatccagaatgccttc

SEQ ID NO: 516262 - DNA, 16 bp, R. norvegicus
tatccagatcttttcc

SEQ ID NO: 516263 - DNA, 16 bp, R. norvegicus
tatccagcctgttagt

SEQ ID NO: 516264 - DNA, 16 bp, R. norvegicus
tatccagtttgttaat

SEQ ID NO: 516265 - DNA, 16 bp, R. norvegicus
tatccatggcttgctg

SEQ ID NO: 516266 - DNA, 16 bp, R. norvegicus
tatccattcacccacc

SEQ ID NO: 516267 - DNA, 16 bp, R. norvegicus
tatccattcttctgat

SEQ ID NO: 516268 - DNA, 16 bp, R. norvegicus
tatcccagaatcctct

SEQ ID NO: 516269 - DNA, 16 bp, R. norvegicus
tatcccctttccaagt

SEQ ID NO: 516270 - DNA, 21 bp, R. norvegicus
tatcccgcgcaggagacagag

SEQ ID NO: 516271 - DNA, 16 bp, R. norvegicus
tatccctcttcctggt

SEQ ID NO: 516272 - DNA, 16 bp, R. norvegicus
tatccctgaactgaag

SEQ ID NO: 516273 - DNA, 16 bp, R. norvegicus
tatcccttcttctcag

SEQ ID NO: 516274 - DNA, 16 bp, R. norvegicus
tatcctaggtctttgg

SEQ ID NO: 516275 - DNA, 16 bp, R. norvegicus
tatcctatcatctgca

SEQ ID NO: 516276 - DNA, 16 bp, R. norvegicus
tatcctcaaaaattag

SEQ ID NO: 516277 - DNA, 16 bp, R. norvegicus
tatcctcagacacacc

SEQ ID NO: 516278 - DNA, 16 bp, R. norvegicus
tatcctctgacctcca

SEQ ID NO: 516279 - DNA, 17 bp, R. norvegicus
tatcctgagtgaggtaa

SEQ ID NO: 516280 - DNA, 16 bp, R. norvegicus
tatcctgatggtgaag

SEQ ID NO: 516281 - DNA, 16 bp, R. norvegicus
tatcctggacccgcct

SEQ ID NO: 516282 - DNA, 16 bp, R. norvegicus
tatcctgggctttttt

SEQ ID NO: 516283 - DNA, 16 bp, R. norvegicus
tatccttttaaaaaaa

SEQ ID NO: 516284 - DNA, 19 bp, R. norvegicus
tatcgagacaattgctgat

SEQ ID NO: 516285 - DNA, 16 bp, R. norvegicus
tatctacaagtcttca

SEQ ID NO: 516286 - DNA, 16 bp, R. norvegicus
tatctacagctacttg

SEQ ID NO: 516287 - DNA, 16 bp, R. norvegicus
tatctatagaaaattt

SEQ ID NO: 516288 - DNA, 16 bp, R. norvegicus
tatctatatatacata

SEQ ID NO: 516289 - DNA, 27 bp, R. norvegicus
tatctatctatctatctatctatctac

SEQ ID NO: 516290 - DNA, 16 bp, R. norvegicus
tatctatctatgtctc

SEQ ID NO: 516291 - DNA, 16 bp, R. norvegicus
tatctatctgtttgtc

SEQ ID NO: 516292 - DNA, 16 bp, R. norvegicus
tatctatctttctgtc

SEQ ID NO: 516293 - DNA, 16 bp, R. norvegicus
tatctatgtgtgtata

SEQ ID NO: 516294 - DNA, 26 bp, R. norvegicus
tatctcactatggccagaatgctcat

SEQ ID NO: 516295 - DNA, 16 bp, R. norvegicus
tatctcccctttgctg

SEQ ID NO: 516296 - DNA, 16 bp, R. norvegicus
tatctccttttgttgt

SEQ ID NO: 516297 - DNA, 29 bp, R. norvegicus
tatctcggtgtgactttaaccaagcaagt

SEQ ID NO: 516298 - DNA, 16 bp, R. norvegicus
tatctctgcttcctga

SEQ ID NO: 516299 - DNA, 16 bp, R. norvegicus
tatctctggcctgctg

SEQ ID NO: 516300 - DNA, 16 bp, R. norvegicus
tatctctgtgtgcatg

SEQ ID NO: 516301 - DNA, 16 bp, R. norvegicus
tatctgaatagtattc

SEQ ID NO: 516302 - DNA, 16 bp, R. norvegicus
tatctgcagactgtgt

SEQ ID NO: 516303 - DNA, 16 bp, R. norvegicus
tatctgccatcaatgg

SEQ ID NO: 516304 - DNA, 16 bp, R. norvegicus
tatctgctagatatct

SEQ ID NO: 516305 - DNA, 16 bp, R. norvegicus
tatctggaaggcacat

SEQ ID NO: 516306 - DNA, 16 bp, R. norvegicus
tatctggagctaagaa

SEQ ID NO: 516307 - DNA, 16 bp, R. norvegicus
tatctgggcatgcctg

SEQ ID NO: 516308 - DNA, 16 bp, R. norvegicus
tatctggtctgatgtg

SEQ ID NO: 516309 - DNA, 16 bp, R. norvegicus
tatctgtagtgggatc

SEQ ID NO: 516310 - DNA, 16 bp, R. norvegicus
tatctgtggattcaag

SEQ ID NO: 516311 - DNA, 16 bp, R. norvegicus
tatctgtgtaccatat

SEQ ID NO: 516312 - DNA, 16 bp, R. norvegicus
tatctgtgtgaatgta

SEQ ID NO: 516313 - DNA, 16 bp, R. norvegicus
tatctgtgtgtttgtg

SEQ ID NO: 516314 - DNA, 26 bp, R. norvegicus
tatcttacaggaatttggtttcaaca

SEQ ID NO: 516315 - DNA, 16 bp, R. norvegicus
tatcttacccattctg

SEQ ID NO: 516316 - DNA, 18 bp, R. norvegicus
tatcttggcggaaacaca

SEQ ID NO: 516317 - DNA, 16 bp, R. norvegicus
tatcttgtgcctgcct

SEQ ID NO: 516318 - DNA, 16 bp, R. norvegicus
tatctttatctgtaga

SEQ ID NO: 516319 - DNA, 16 bp, R. norvegicus
tatctttatgggcatc

SEQ ID NO: 516320 - DNA, 16 bp, R. norvegicus
tatctttctgcaaatc

SEQ ID NO: 516321 - DNA, 16 bp, R. norvegicus
tatctttgtctctgag

SEQ ID NO: 516322 - DNA, 16 bp, R. norvegicus
tatcttttggcccttg

SEQ ID NO: 516323 - DNA, 16 bp, R. norvegicus
tatcttttgggtatat

SEQ ID NO: 516324 - DNA, 16 bp, R. norvegicus
tatcttttttgataaa

SEQ ID NO: 516325 - DNA, 16 bp, R. norvegicus
tatgaaaaccagaaga

SEQ ID NO: 516326 - DNA, 16 bp, R. norvegicus
tatgaaaataaactac

SEQ ID NO: 516327 - DNA, 16 bp, R. norvegicus
tatgaaaatgctaatt

SEQ ID NO: 516328 - DNA, 16 bp, R. norvegicus
tatgaaaatgtcataa

SEQ ID NO: 516329 - DNA, 16 bp, R. norvegicus
tatgaaaattcatcaa

SEQ ID NO: 516330 - DNA, 16 bp, R. norvegicus
tatgaaactgaggaga

SEQ ID NO: 516331 - DNA, 16 bp, R. norvegicus
tatgaaagaaagcatt

SEQ ID NO: 516332 - DNA, 16 bp, R. norvegicus
tatgaaagatcccacg

SEQ ID NO: 516333 - DNA, 16 bp, R. norvegicus
tatgaaagcgagaaga

SEQ ID NO: 516334 - DNA, 109 bp, R. norvegicus
tatgaaattcgtaggcaaatggttggaactggaaaatatcatcctgagtgagctaacccaatcacagaaagacatacatggtatgcactcattgataagtggctattag

SEQ ID NO: 516335 - DNA, 16 bp, R. norvegicus
tatgaacaaactcaaa

SEQ ID NO: 516336 - DNA, 16 bp, R. norvegicus
tatgaacagagcagca

SEQ ID NO: 516337 - DNA, 16 bp, R. norvegicus
tatgaacaggaaactg

SEQ ID NO: 516338 - DNA, 16 bp, R. norvegicus
tatgaagaagagcttc

SEQ ID NO: 516339 - DNA, 16 bp, R. norvegicus
tatgaagaatttgatt

SEQ ID NO: 516340 - DNA, 16 bp, R. norvegicus
tatgaagcccccaaca

SEQ ID NO: 516341 - DNA, 16 bp, R. norvegicus
tatgaagtagcaatga

SEQ ID NO: 516342 - DNA, 16 bp, R. norvegicus
tatgaagtgcatgctg

SEQ ID NO: 516343 - DNA, 16 bp, R. norvegicus
tatgaatatatatgca

SEQ ID NO: 516344 - DNA, 16 bp, R. norvegicus
tatgaatatttttaag

SEQ ID NO: 516345 - DNA, 16 bp, R. norvegicus
tatgaatgtgaatgtg

SEQ ID NO: 516346 - DNA, 16 bp, R. norvegicus
tatgaatgttggtgcc

SEQ ID NO: 516347 - DNA, 16 bp, R. norvegicus
tatgaatttgatgaag

SEQ ID NO: 516348 - DNA, 16 bp, R. norvegicus
tatgacaaagataaat

SEQ ID NO: 516349 - DNA, 16 bp, R. norvegicus
tatgacaagatcttca

SEQ ID NO: 516350 - DNA, 16 bp, R. norvegicus
tatgacaagcacttta

SEQ ID NO: 516351 - DNA, 16 bp, R. norvegicus
tatgacaccttcagag

SEQ ID NO: 516352 - DNA, 16 bp, R. norvegicus
tatgactacactgtca

SEQ ID NO: 516353 - DNA, 16 bp, R. norvegicus
tatgacttttcctctt

SEQ ID NO: 516354 - DNA, 16 bp, R. norvegicus
tatgagacatttaatt

SEQ ID NO: 516355 - DNA, 16 bp, R. norvegicus
tatgagagagggagag

SEQ ID NO: 516356 - DNA, 16 bp, R. norvegicus
tatgagatatttacat

SEQ ID NO: 516357 - DNA, 16 bp, R. norvegicus
tatgagcctatgagga

SEQ ID NO: 516358 - DNA, 16 bp, R. norvegicus
tatgaggccccagaca

SEQ ID NO: 516359 - DNA, 16 bp, R. norvegicus
tatgaggctggagaga

SEQ ID NO: 516360 - DNA, 16 bp, R. norvegicus
tatgagggtgtttcct

SEQ ID NO: 516361 - DNA, 17 bp, R. norvegicus
tatgaggtctcaagccc

SEQ ID NO: 516362 - DNA, 16 bp, R. norvegicus
tatgaggtgctgaaaa

SEQ ID NO: 516363 - DNA, 16 bp, R. norvegicus
tatgaggtgctgggga

SEQ ID NO: 516364 - DNA, 16 bp, R. norvegicus
tatgagtgctctgtct

SEQ ID NO: 516365 - DNA, 16 bp, R. norvegicus
tatgagtgctttgctt

SEQ ID NO: 516366 - DNA, 16 bp, R. norvegicus
tatgagtggtgtgtgt

SEQ ID NO: 516367 - DNA, 16 bp, R. norvegicus
tatgagtgtgtgtgtg

SEQ ID NO: 516368 - DNA, 16 bp, R. norvegicus
tatgagttgccatggt

SEQ ID NO: 516369 - DNA, 16 bp, R. norvegicus
tatgagtttgaagcca

SEQ ID NO: 516370 - DNA, 16 bp, R. norvegicus
tatgatcataaggcta

SEQ ID NO: 516371 - DNA, 16 bp, R. norvegicus
tatgatgataatgaac

SEQ ID NO: 516372 - DNA, 16 bp, R. norvegicus
tatgatgataatggac

SEQ ID NO: 516373 - DNA, 16 bp, R. norvegicus
tatgatgatgatgaag

SEQ ID NO: 516374 - DNA, 27 bp, R. norvegicus
tatgatgctggaggacttcaagaaaga

SEQ ID NO: 516375 - DNA, 16 bp, R. norvegicus
tatgatggtatattta

SEQ ID NO: 516376 - DNA, 16 bp, R. norvegicus
tatgattggggtcacc

SEQ ID NO: 516377 - DNA, 16 bp, R. norvegicus
tatgattttaattgaa

SEQ ID NO: 516378 - DNA, 16 bp, R. norvegicus
tatgattttgtagaag

SEQ ID NO: 516379 - DNA, 16 bp, R. norvegicus
tatgcacacacacaca

SEQ ID NO: 516380 - DNA, 21 bp, R. norvegicus
tatgcactcattgataagtga

SEQ ID NO: 516381 - DNA, 17 bp, R. norvegicus
tatgcactcattgatat

SEQ ID NO: 516382 - DNA, 16 bp, R. norvegicus
tatgcagaggacccag

SEQ ID NO: 516383 - DNA, 16 bp, R. norvegicus
tatgcagctgctgggg

SEQ ID NO: 516384 - DNA, 16 bp, R. norvegicus
tatgcaggccctgtgc

SEQ ID NO: 516385 - DNA, 16 bp, R. norvegicus
tatgcatatatttgta

SEQ ID NO: 516386 - DNA, 16 bp, R. norvegicus
tatgcatgcatgcaca

SEQ ID NO: 516387 - DNA, 16 bp, R. norvegicus
tatgcatgtaaacatt

SEQ ID NO: 516388 - DNA, 16 bp, R. norvegicus
tatgcatgtatgcatt

SEQ ID NO: 516389 - DNA, 16 bp, R. norvegicus
tatgcatgtctgtata

SEQ ID NO: 516390 - DNA, 16 bp, R. norvegicus
tatgcatgtttgtatg

SEQ ID NO: 516391 - DNA, 16 bp, R. norvegicus
tatgcattgctccaaa

SEQ ID NO: 516392 - DNA, 16 bp, R. norvegicus
tatgcattggtgtttt

SEQ ID NO: 516393 - DNA, 16 bp, R. norvegicus
tatgcattttaatttt

SEQ ID NO: 516394 - DNA, 16 bp, R. norvegicus
tatgcccaagacaggt

SEQ ID NO: 516395 - DNA, 16 bp, R. norvegicus
tatgcccaagagaggg

SEQ ID NO: 516396 - DNA, 16 bp, R. norvegicus
tatgcccaggacaggt

SEQ ID NO: 516397 - DNA, 16 bp, R. norvegicus
tatgcccaggtgtggt

SEQ ID NO: 516398 - DNA, 16 bp, R. norvegicus
tatgccctaaatgcaa

SEQ ID NO: 516399 - DNA, 16 bp, R. norvegicus
tatgccctagagaggt

SEQ ID NO: 516400 - DNA, 16 bp, R. norvegicus
tatgcctcttgcttgt

SEQ ID NO: 516401 - DNA, 16 bp, R. norvegicus
tatgcctgggagtggt

SEQ ID NO: 516402 - DNA, 16 bp, R. norvegicus
tatgccttccttttca

SEQ ID NO: 516403 - DNA, 17 bp, R. norvegicus
tatgctccaaatacaag

SEQ ID NO: 516404 - DNA, 16 bp, R. norvegicus
tatgctgcctggtttg

SEQ ID NO: 516405 - DNA, 30 bp, R. norvegicus
tatgctggagtggcagttccagaagagact

SEQ ID NO: 516406 - DNA, 16 bp, R. norvegicus
tatgctggctggtttt

SEQ ID NO: 516407 - DNA, 16 bp, R. norvegicus
tatgctgtgccttcat

SEQ ID NO: 516408 - DNA, 16 bp, R. norvegicus
tatgctgtgttcagtt

SEQ ID NO: 516409 - DNA, 16 bp, R. norvegicus
tatggaaaacaaaaca

SEQ ID NO: 516410 - DNA, 16 bp, R. norvegicus
tatggaaattttcttc

SEQ ID NO: 516411 - DNA, 16 bp, R. norvegicus
tatggaacctgaaaag

SEQ ID NO: 516412 - DNA, 16 bp, R. norvegicus
tatggaagaattagag

SEQ ID NO: 516413 - DNA, 16 bp, R. norvegicus
tatggaagagctgggg

SEQ ID NO: 516414 - DNA, 16 bp, R. norvegicus
tatggaagtgaaacac

SEQ ID NO: 516415 - DNA, 16 bp, R. norvegicus
tatggacatgtgtgtg

SEQ ID NO: 516416 - DNA, 16 bp, R. norvegicus
tatggactggaaaccg

SEQ ID NO: 516417 - DNA, 16 bp, R. norvegicus
tatggagaaaggggaa

SEQ ID NO: 516418 - DNA, 16 bp, R. norvegicus
tatggagacaaagttt

SEQ ID NO: 516419 - DNA, 16 bp, R. norvegicus
tatggagacagacaga

SEQ ID NO: 516420 - DNA, 16 bp, R. norvegicus
tatggagatcagaaga

SEQ ID NO: 516421 - DNA, 16 bp, R. norvegicus
tatggagattataata

SEQ ID NO: 516422 - DNA, 16 bp, R. norvegicus
tatggagtgttcacaa

SEQ ID NO: 516423 - DNA, 16 bp, R. norvegicus
tatggatatgtgtgtg

SEQ ID NO: 516424 - DNA, 16 bp, R. norvegicus
tatggatgagaaactg

SEQ ID NO: 516425 - DNA, 16 bp, R. norvegicus
tatggcatcttctgcc

SEQ ID NO: 516426 - DNA, 18 bp, R. norvegicus
tatggctatgatggtggg

SEQ ID NO: 516427 - DNA, 16 bp, R. norvegicus
tatggctatggctatg

SEQ ID NO: 516428 - DNA, 16 bp, R. norvegicus
tatggctggatttgtg

SEQ ID NO: 516429 - DNA, 16 bp, R. norvegicus
tatggctgtcttcaga

SEQ ID NO: 516430 - DNA, 16 bp, R. norvegicus
tatggcttgttgatgc

SEQ ID NO: 516431 - DNA, 16 bp, R. norvegicus
tatgggagccattttt

SEQ ID NO: 516432 - DNA, 16 bp, R. norvegicus
tatgggatgtggagca

SEQ ID NO: 516433 - DNA, 16 bp, R. norvegicus
tatgggtctgtccatg

SEQ ID NO: 516434 - DNA, 16 bp, R. norvegicus
tatgggtgtatgtgtg

SEQ ID NO: 516435 - DNA, 30 bp, R. norvegicus
tatggtagtgggaaagctcccatttgattc

SEQ ID NO: 516436 - DNA, 22 bp, R. norvegicus
tatggtataaattcagccttgg

SEQ ID NO: 516437 - DNA, 16 bp, R. norvegicus
tatggtatgtgtgtgg

SEQ ID NO: 516438 - DNA, 16 bp, R. norvegicus
tatggtcattcagaag

SEQ ID NO: 516439 - DNA, 16 bp, R. norvegicus
tatggtctctacaagt

SEQ ID NO: 516440 - DNA, 16 bp, R. norvegicus
tatggtgcctttgatg

SEQ ID NO: 516441 - DNA, 16 bp, R. norvegicus
tatggtgtatatgtat

SEQ ID NO: 516442 - DNA, 16 bp, R. norvegicus
tatggttttactcatc

SEQ ID NO: 516443 - DNA, 16 bp, R. norvegicus
tatgtaaaaattgttt

SEQ ID NO: 516444 - DNA, 16 bp, R. norvegicus
tatgtaaacaaggatg

SEQ ID NO: 516445 - DNA, 16 bp, R. norvegicus
tatgtaaaccagtctg

SEQ ID NO: 516446 - DNA, 16 bp, R. norvegicus
tatgtaaatcaggctg

SEQ ID NO: 516447 - DNA, 16 bp, R. norvegicus
tatgtacaggtgtgtg

SEQ ID NO: 516448 - DNA, 16 bp, R. norvegicus
tatgtacattatatat

SEQ ID NO: 516449 - DNA, 16 bp, R. norvegicus
tatgtactatgtatgt

SEQ ID NO: 516450 - DNA, 16 bp, R. norvegicus
tatgtactcactgaga

SEQ ID NO: 516451 - DNA, 16 bp, R. norvegicus
tatgtagaccaggctg

SEQ ID NO: 516452 - DNA, 16 bp, R. norvegicus
tatgtagctgaaaatg

SEQ ID NO: 516453 - DNA, 16 bp, R. norvegicus
tatgtagctgaggata

SEQ ID NO: 516454 - DNA, 16 bp, R. norvegicus
tatgtagctgagggtg

SEQ ID NO: 516455 - DNA, 16 bp, R. norvegicus
tatgtagtcaaagatg

SEQ ID NO: 516456 - DNA, 16 bp, R. norvegicus
tatgtagtcctggctg

SEQ ID NO: 516457 - DNA, 16 bp, R. norvegicus
tatgtatatacaaata

SEQ ID NO: 516458 - DNA, 16 bp, R. norvegicus
tatgtatatagtgtat

SEQ ID NO: 516459 - DNA, 16 bp, R. norvegicus
tatgtatatatttgaa

SEQ ID NO: 516460 - DNA, 16 bp, R. norvegicus
tatgtatatttgcata

SEQ ID NO: 516461 - DNA, 16 bp, R. norvegicus
tatgtatcaattaaaa

SEQ ID NO: 516462 - DNA, 16 bp, R. norvegicus
tatgtatgcataaata

SEQ ID NO: 516463 - DNA, 16 bp, R. norvegicus
tatgtatgtaacatat

SEQ ID NO: 516464 - DNA, 16 bp, R. norvegicus
tatgtatgtacatata

SEQ ID NO: 516465 - DNA, 16 bp, R. norvegicus
tatgtatgtactgtgt

SEQ ID NO: 516466 - DNA, 16 bp, R. norvegicus
tatgtatgtataaata

SEQ ID NO: 516467 - DNA, 16 bp, R. norvegicus
tatgtatgtatgtgtg

SEQ ID NO: 516468 - DNA, 16 bp, R. norvegicus
tatgtatgtgcatgtg

SEQ ID NO: 516469 - DNA, 16 bp, R. norvegicus
tatgtatgtgggtatg

SEQ ID NO: 516470 - DNA, 16 bp, R. norvegicus
tatgtatgtgtacatg

SEQ ID NO: 516471 - DNA, 16 bp, R. norvegicus
tatgtatgtttatgtg

SEQ ID NO: 516472 - DNA, 16 bp, R. norvegicus
tatgtattgtgtatat

SEQ ID NO: 516473 - DNA, 16 bp, R. norvegicus
tatgtcagcagcttaa

SEQ ID NO: 516474 - DNA, 17 bp, R. norvegicus
tatgtccaattttctga

SEQ ID NO: 516475 - DNA, 16 bp, R. norvegicus
tatgtcctccttaaag

SEQ ID NO: 516476 - DNA, 16 bp, R. norvegicus
tatgtccttatgattc

SEQ ID NO: 516477 - DNA, 16 bp, R. norvegicus
tatgtctctgtgtgtg

SEQ ID NO: 516478 - DNA, 16 bp, R. norvegicus
tatgtctgaagacagc

SEQ ID NO: 516479 - DNA, 16 bp, R. norvegicus
tatgtctgcatgtatg

SEQ ID NO: 516480 - DNA, 16 bp, R. norvegicus
tatgtctgcccctctg

SEQ ID NO: 516481 - DNA, 16 bp, R. norvegicus
tatgtctggaaaactg

SEQ ID NO: 516482 - DNA, 16 bp, R. norvegicus
tatgtctggtttgatg

SEQ ID NO: 516483 - DNA, 16 bp, R. norvegicus
tatgtctgtctctgtc

SEQ ID NO: 516484 - DNA, 16 bp, R. norvegicus
tatgtctgtgaaggtg

SEQ ID NO: 516485 - DNA, 16 bp, R. norvegicus
tatgtctgtgtatgtg

SEQ ID NO: 516486 - DNA, 16 bp, R. norvegicus
tatgtctttcctaaag

SEQ ID NO: 516487 - DNA, 16 bp, R. norvegicus
tatgtcttttttaaag

SEQ ID NO: 516488 - DNA, 16 bp, R. norvegicus
tatgtgaacatgcatg

SEQ ID NO: 516489 - DNA, 16 bp, R. norvegicus
tatgtgagcacactgt

SEQ ID NO: 516490 - DNA, 16 bp, R. norvegicus
tatgtgatacaggaag

SEQ ID NO: 516491 - DNA, 16 bp, R. norvegicus
tatgtgatcagttttg

SEQ ID NO: 516492 - DNA, 16 bp, R. norvegicus
tatgtgcacacacact

SEQ ID NO: 516493 - DNA, 16 bp, R. norvegicus
tatgtgcatgtgaatg

SEQ ID NO: 516494 - DNA, 16 bp, R. norvegicus
tatgtgccaggcactg

SEQ ID NO: 516495 - DNA, 16 bp, R. norvegicus
tatgtgcccctgtggc

SEQ ID NO: 516496 - DNA, 16 bp, R. norvegicus
tatgtgcctgtgtctg

SEQ ID NO: 516497 - DNA, 16 bp, R. norvegicus
tatgtgcctgtgtttg

SEQ ID NO: 516498 - DNA, 16 bp, R. norvegicus
tatgtgcttatgtgtg

SEQ ID NO: 516499 - DNA, 16 bp, R. norvegicus
tatgtggagattcttg

SEQ ID NO: 516500 - DNA, 16 bp, R. norvegicus
tatgtggagtgtgtgt

SEQ ID NO: 516501 - DNA, 16 bp, R. norvegicus
tatgtggcccaggctg

SEQ ID NO: 516502 - DNA, 16 bp, R. norvegicus
tatgtggctattagcc

SEQ ID NO: 516503 - DNA, 16 bp, R. norvegicus
tatgtggctgctggga

SEQ ID NO: 516504 - DNA, 16 bp, R. norvegicus
tatgtgggcatgtgtg

SEQ ID NO: 516505 - DNA, 16 bp, R. norvegicus
tatgtggttgctggga

SEQ ID NO: 516506 - DNA, 16 bp, R. norvegicus
tatgtggtttatgtat

SEQ ID NO: 516507 - DNA, 16 bp, R. norvegicus
tatgtgtacctatgtg

SEQ ID NO: 516508 - DNA, 16 bp, R. norvegicus
tatgtgtatatagtat

SEQ ID NO: 516509 - DNA, 16 bp, R. norvegicus
tatgtgtatgaataca

SEQ ID NO: 516510 - DNA, 16 bp, R. norvegicus
tatgtgtatgtgcgtg

SEQ ID NO: 516511 - DNA, 16 bp, R. norvegicus
tatgtgtatgtggata

SEQ ID NO: 516512 - DNA, 16 bp, R. norvegicus
tatgtgtctctgtctc

SEQ ID NO: 516513 - DNA, 16 bp, R. norvegicus
tatgtgtctgtatgtg

SEQ ID NO: 516514 - DNA, 16 bp, R. norvegicus
tatgtgtctgtgcatg

SEQ ID NO: 516515 - DNA, 16 bp, R. norvegicus
tatgtgtgcaagtgtg

SEQ ID NO: 516516 - DNA, 16 bp, R. norvegicus
tatgtgtgcatgcatg

SEQ ID NO: 516517 - DNA, 16 bp, R. norvegicus
tatgtgtgctgtatgt

SEQ ID NO: 516518 - DNA, 16 bp, R. norvegicus
tatgtgtggtgtgtgc

SEQ ID NO: 516519 - DNA, 16 bp, R. norvegicus
tatgtgtgtaaatata

SEQ ID NO: 516520 - DNA, 16 bp, R. norvegicus
tatgtgtgtatatgca

SEQ ID NO: 516521 - DNA, 16 bp, R. norvegicus
tatgtgtgtctgtgtg

SEQ ID NO: 516522 - DNA, 16 bp, R. norvegicus
tatgtgtgtgatgtat

SEQ ID NO: 516523 - DNA, 16 bp, R. norvegicus
tatgtgtgtgcagtgt

SEQ ID NO: 516524 - DNA, 16 bp, R. norvegicus
tatgtgtgtgcatgtg

SEQ ID NO: 516525 - DNA, 16 bp, R. norvegicus
tatgtgtgtgtatata

SEQ ID NO: 516526 - DNA, 16 bp, R. norvegicus
tatgtgtgtgtgactg

SEQ ID NO: 516527 - DNA, 16 bp, R. norvegicus
tatgtgtgtgtgagtg

SEQ ID NO: 516528 - DNA, 16 bp, R. norvegicus
tatgtgtgtgtgcaca

SEQ ID NO: 516529 - DNA, 16 bp, R. norvegicus
tatgttcaaggatatt

SEQ ID NO: 516530 - DNA, 16 bp, R. norvegicus
tatgttcaatgagttg

SEQ ID NO: 516531 - DNA, 16 bp, R. norvegicus
tatgttcatagcctta

SEQ ID NO: 516532 - DNA, 16 bp, R. norvegicus
tatgttccccctttta

SEQ ID NO: 516533 - DNA, 16 bp, R. norvegicus
tatgttcttctacctg

SEQ ID NO: 516534 - DNA, 16 bp, R. norvegicus
tatgttgaagtctttg

SEQ ID NO: 516535 - DNA, 16 bp, R. norvegicus
tatgttgggaatcttt

SEQ ID NO: 516536 - DNA, 16 bp, R. norvegicus
tatgtttcctttttaa

SEQ ID NO: 516537 - DNA, 16 bp, R. norvegicus
tatgtttgcatgtgta

SEQ ID NO: 516538 - DNA, 16 bp, R. norvegicus
tatgtttgcctgtgtg

SEQ ID NO: 516539 - DNA, 16 bp, R. norvegicus
tatgtttggtggaggt

SEQ ID NO: 516540 - DNA, 16 bp, R. norvegicus
tatgttttgtgccagt

SEQ ID NO: 516541 - DNA, 16 bp, R. norvegicus
tattaaaaataaagct

SEQ ID NO: 516542 - DNA, 16 bp, R. norvegicus
tattaaaaatgtggtt

SEQ ID NO: 516543 - DNA, 16 bp, R. norvegicus
tattaaaagcaggaag

SEQ ID NO: 516544 - DNA, 16 bp, R. norvegicus
tattaaaagctgtaaa

SEQ ID NO: 516545 - DNA, 16 bp, R. norvegicus
tattaaaagtcttgga

SEQ ID NO: 516546 - DNA, 16 bp, R. norvegicus
tattaagaaaaaaatc

SEQ ID NO: 516547 - DNA, 16 bp, R. norvegicus
tattaataacaatgac

SEQ ID NO: 516548 - DNA, 16 bp, R. norvegicus
tattaatcaagaaaat

SEQ ID NO: 516549 - DNA, 16 bp, R. norvegicus
tattaatgatactgtt

SEQ ID NO: 516550 - DNA, 16 bp, R. norvegicus
tattaatgatatcctt

SEQ ID NO: 516551 - DNA, 17 bp, R. norvegicus
tattacagagcaatagc

SEQ ID NO: 516552 - DNA, 16 bp, R. norvegicus
tattacagagcaatgg

SEQ ID NO: 516553 - DNA, 16 bp, R. norvegicus
tattacagatgaattt

SEQ ID NO: 516554 - DNA, 16 bp, R. norvegicus
tattacagctgggcgg

SEQ ID NO: 516555 - DNA, 30 bp, R. norvegicus
tattactcagctatcaaaaacaatgacttc

SEQ ID NO: 516556 - DNA, 16 bp, R. norvegicus
tattactgtgaagaga

SEQ ID NO: 516557 - DNA, 16 bp, R. norvegicus
tattacttagctatta

SEQ ID NO: 516558 - DNA, 16 bp, R. norvegicus
tattagccatctattg

SEQ ID NO: 516559 - DNA, 26 bp, R. norvegicus
tattagctaatcaaaggatagattta

SEQ ID NO: 516560 - DNA, 16 bp, R. norvegicus
tattagtagtagtagt

SEQ ID NO: 516561 - DNA, 16 bp, R. norvegicus
tattagttttcaaaat

SEQ ID NO: 516562 - DNA, 16 bp, R. norvegicus
tattataaataaggtt

SEQ ID NO: 516563 - DNA, 16 bp, R. norvegicus
tattatatatatacac

SEQ ID NO: 516564 - DNA, 16 bp, R. norvegicus
tattatatgagaaaat

SEQ ID NO: 516565 - DNA, 16 bp, R. norvegicus
tattatcaaggtagga

SEQ ID NO: 516566 - DNA, 16 bp, R. norvegicus
tattatgtgaagagag

SEQ ID NO: 516567 - DNA, 16 bp, R. norvegicus
tattcaaagaaataaa

SEQ ID NO: 516568 - DNA, 16 bp, R. norvegicus
tattcaataaagtact

SEQ ID NO: 516569 - DNA, 16 bp, R. norvegicus
tattcactattagaat

SEQ ID NO: 516570 - DNA, 16 bp, R. norvegicus
tattcactggagcatg

SEQ ID NO: 516571 - DNA, 16 bp, R. norvegicus
tattcactttataccc

SEQ ID NO: 516572 - DNA, 16 bp, R. norvegicus
tattcagaattgtttt

SEQ ID NO: 516573 - DNA, 16 bp, R. norvegicus
tattcagctatcaaaa

SEQ ID NO: 516574 - DNA, 16 bp, R. norvegicus
tattcaggacttgctg

SEQ ID NO: 516575 - DNA, 16 bp, R. norvegicus
tattcagtattttctt

SEQ ID NO: 516576 - DNA, 16 bp, R. norvegicus
tattcagtttcctctt

SEQ ID NO: 516577 - DNA, 16 bp, R. norvegicus
tattcataagggaaat

SEQ ID NO: 516578 - DNA, 16 bp, R. norvegicus
tattcatcaaagaaaa

SEQ ID NO: 516579 - DNA, 16 bp, R. norvegicus
tattcatgaaggaaat

SEQ ID NO: 516580 - DNA, 16 bp, R. norvegicus
tattcatgagggaatt

SEQ ID NO: 516581 - DNA, 16 bp, R. norvegicus
tattcatgtgtctgtg

SEQ ID NO: 516582 - DNA, 18 bp, R. norvegicus
tattcattgctaactatg

SEQ ID NO: 516583 - DNA, 27 bp, R. norvegicus
tattcattgctacctatgaggttggag

SEQ ID NO: 516584 - DNA, 16 bp, R. norvegicus
tattcattgtgtttct

SEQ ID NO: 516585 - DNA, 16 bp, R. norvegicus
tattccaaatatattt

SEQ ID NO: 516586 - DNA, 16 bp, R. norvegicus
tattccactgctctat

SEQ ID NO: 516587 - DNA, 16 bp, R. norvegicus
tattccagatgaattt

SEQ ID NO: 516588 - DNA, 16 bp, R. norvegicus
tattcctcagttcaga

SEQ ID NO: 516589 - DNA, 16 bp, R. norvegicus
tattcctgcaggccag

SEQ ID NO: 516590 - DNA, 16 bp, R. norvegicus
tattccttctgtttct

SEQ ID NO: 516591 - DNA, 16 bp, R. norvegicus
tattcgatatagtact

SEQ ID NO: 516592 - DNA, 16 bp, R. norvegicus
tattctcaaagttaaa

SEQ ID NO: 516593 - DNA, 16 bp, R. norvegicus
tattctccctttgaaa

SEQ ID NO: 516594 - DNA, 16 bp, R. norvegicus
tattctgagtgaggta

SEQ ID NO: 516595 - DNA, 16 bp, R. norvegicus
tattctgggctggcat

SEQ ID NO: 516596 - DNA, 16 bp, R. norvegicus
tattctgtccccaggg

SEQ ID NO: 516597 - DNA, 16 bp, R. norvegicus
tattctgtggatttct

SEQ ID NO: 516598 - DNA, 16 bp, R. norvegicus
tattctgtttctgtgt

SEQ ID NO: 516599 - DNA, 16 bp, R. norvegicus
tattcttagttcagtg

SEQ ID NO: 516600 - DNA, 16 bp, R. norvegicus
tattcttcaaaggaaa

SEQ ID NO: 516601 - DNA, 16 bp, R. norvegicus
tattcttcccttattg

SEQ ID NO: 516602 - DNA, 16 bp, R. norvegicus
tattcttgtacccctt

SEQ ID NO: 516603 - DNA, 16 bp, R. norvegicus
tattcttgtgcttgcc

SEQ ID NO: 516604 - DNA, 16 bp, R. norvegicus
tattcttgttcctcat

SEQ ID NO: 516605 - DNA, 16 bp, R. norvegicus
tattctttaaaaagaa

SEQ ID NO: 516606 - DNA, 16 bp, R. norvegicus
tattcttttattggat

SEQ ID NO: 516607 - DNA, 16 bp, R. norvegicus
tattgaaccagaaaag

SEQ ID NO: 516608 - DNA, 16 bp, R. norvegicus
tattgaccaatcagaa

SEQ ID NO: 516609 - DNA, 16 bp, R. norvegicus
tattgacccaaaaata

SEQ ID NO: 516610 - DNA, 16 bp, R. norvegicus
tattgataaagccaag

SEQ ID NO: 516611 - DNA, 16 bp, R. norvegicus
tattgatcaaaggaaa

SEQ ID NO: 516612 - DNA, 16 bp, R. norvegicus
tattgatgatgatgat

SEQ ID NO: 516613 - DNA, 16 bp, R. norvegicus
tattgatgatgtcaca

SEQ ID NO: 516614 - DNA, 16 bp, R. norvegicus
tattgattgtcaactt

SEQ ID NO: 516615 - DNA, 16 bp, R. norvegicus
tattgccttgtacaaa

SEQ ID NO: 516616 - DNA, 16 bp, R. norvegicus
tattgctctgaagaga

SEQ ID NO: 516617 - DNA, 16 bp, R. norvegicus
tattgctgagaagaga

SEQ ID NO: 516618 - DNA, 16 bp, R. norvegicus
tattgctgcaaagaaa

SEQ ID NO: 516619 - DNA, 16 bp, R. norvegicus
tattgctgctgctgct

SEQ ID NO: 516620 - DNA, 16 bp, R. norvegicus
tattgctgtaataaaa

SEQ ID NO: 516621 - DNA, 16 bp, R. norvegicus
tattgctgtggtaaaa

SEQ ID NO: 516622 - DNA, 16 bp, R. norvegicus
tattgctgttcttctt

SEQ ID NO: 516623 - DNA, 16 bp, R. norvegicus
tattgctttttactat

SEQ ID NO: 516624 - DNA, 16 bp, R. norvegicus
tattgcttttttaaaa

SEQ ID NO: 516625 - DNA, 16 bp, R. norvegicus
tattggaattttcctt

SEQ ID NO: 516626 - DNA, 16 bp, R. norvegicus
tattggagttttctat

SEQ ID NO: 516627 - DNA, 16 bp, R. norvegicus
tattggatgtgggatt

SEQ ID NO: 516628 - DNA, 16 bp, R. norvegicus
tattggcagatgatat

SEQ ID NO: 516629 - DNA, 17 bp, R. norvegicus
tattgggaaaagatctt

SEQ ID NO: 516630 - DNA, 18 bp, R. norvegicus
tattgggaacctgctgaa

SEQ ID NO: 516631 - DNA, 16 bp, R. norvegicus
tattgggggaagggag

SEQ ID NO: 516632 - DNA, 16 bp, R. norvegicus
tattggtatgaggcct

SEQ ID NO: 516633 - DNA, 16 bp, R. norvegicus
tattgtacattgagca

SEQ ID NO: 516634 - DNA, 16 bp, R. norvegicus
tattgtcaaatgcttt

SEQ ID NO: 516635 - DNA, 16 bp, R. norvegicus
tattgtcaacaataaa

SEQ ID NO: 516636 - DNA, 16 bp, R. norvegicus
tattgtgaacagacac

SEQ ID NO: 516637 - DNA, 16 bp, R. norvegicus
tattgtggatgtcaag

SEQ ID NO: 516638 - DNA, 16 bp, R. norvegicus
tattgtgtaaatatgg

SEQ ID NO: 516639 - DNA, 16 bp, R. norvegicus
tattgttatagaagac

SEQ ID NO: 516640 - DNA, 16 bp, R. norvegicus
tattgttgctgctgct

SEQ ID NO: 516641 - DNA, 16 bp, R. norvegicus
tattgtttttcaggaa

SEQ ID NO: 516642 - DNA, 16 bp, R. norvegicus
tattgtttttgaagac

SEQ ID NO: 516643 - DNA, 16 bp, R. norvegicus
tatttaaaatggaaat

SEQ ID NO: 516644 - DNA, 16 bp, R. norvegicus
tatttaaactgtattt

SEQ ID NO: 516645 - DNA, 16 bp, R. norvegicus
tatttaaagaaaaaca

SEQ ID NO: 516646 - DNA, 16 bp, R. norvegicus
tatttaataaaacttg

SEQ ID NO: 516647 - DNA, 16 bp, R. norvegicus
tatttaatgaaaatga

SEQ ID NO: 516648 - DNA, 16 bp, R. norvegicus
tatttacataacattt

SEQ ID NO: 516649 - DNA, 16 bp, R. norvegicus
tatttacatatcgatt

SEQ ID NO: 516650 - DNA, 16 bp, R. norvegicus
tatttacattatgatt

SEQ ID NO: 516651 - DNA, 16 bp, R. norvegicus
tatttagaccaggctg

SEQ ID NO: 516652 - DNA, 16 bp, R. norvegicus
tatttataaatgtgtg

SEQ ID NO: 516653 - DNA, 40 bp, R. norvegicus
tatttataatagccagaagctggaaagaacccagatgcct

SEQ ID NO: 516654 - DNA, 18 bp, R. norvegicus
tatttataatagtcagaa

SEQ ID NO: 516655 - DNA, 16 bp, R. norvegicus
tatttataccaatgaa

SEQ ID NO: 516656 - DNA, 16 bp, R. norvegicus
tatttatagaacattt

SEQ ID NO: 516657 - DNA, 16 bp, R. norvegicus
tatttatatatacaca

SEQ ID NO: 516658 - DNA, 16 bp, R. norvegicus
tatttatattacgatt

SEQ ID NO: 516659 - DNA, 16 bp, R. norvegicus
tatttatcatgctctg

SEQ ID NO: 516660 - DNA, 16 bp, R. norvegicus
tatttatccatctatc

SEQ ID NO: 516661 - DNA, 16 bp, R. norvegicus
tatttatctatcttgt

SEQ ID NO: 516662 - DNA, 16 bp, R. norvegicus
tatttatgtatatgca

SEQ ID NO: 516663 - DNA, 16 bp, R. norvegicus
tatttatgtatgtaca

SEQ ID NO: 516664 - DNA, 16 bp, R. norvegicus
tatttatgtatgtgca

SEQ ID NO: 516665 - DNA, 16 bp, R. norvegicus
tatttatgtgtatgta

SEQ ID NO: 516666 - DNA, 16 bp, R. norvegicus
tatttatgttttcctg

SEQ ID NO: 516667 - DNA, 16 bp, R. norvegicus
tatttattacatgtat

SEQ ID NO: 516668 - DNA, 16 bp, R. norvegicus
tatttattcacacaca

SEQ ID NO: 516669 - DNA, 16 bp, R. norvegicus
tatttatttatgcata

SEQ ID NO: 516670 - DNA, 16 bp, R. norvegicus
tatttatttcatgtat

SEQ ID NO: 516671 - DNA, 16 bp, R. norvegicus
tatttatttggcattc

SEQ ID NO: 516672 - DNA, 16 bp, R. norvegicus
tatttattttatgtac

SEQ ID NO: 516673 - DNA, 16 bp, R. norvegicus
tatttcaaagaagaaa

SEQ ID NO: 516674 - DNA, 16 bp, R. norvegicus
tatttcaaatgtcatt

SEQ ID NO: 516675 - DNA, 16 bp, R. norvegicus
tatttcatgccttcta

SEQ ID NO: 516676 - DNA, 16 bp, R. norvegicus
tatttcatgtatgtgg

SEQ ID NO: 516677 - DNA, 16 bp, R. norvegicus
tatttccagtgcccat

SEQ ID NO: 516678 - DNA, 16 bp, R. norvegicus
tatttcccagaatcct

SEQ ID NO: 516679 - DNA, 16 bp, R. norvegicus
tatttccccaccaagg

SEQ ID NO: 516680 - DNA, 16 bp, R. norvegicus
tatttccctcttccca

SEQ ID NO: 516681 - DNA, 16 bp, R. norvegicus
tatttcctcagaggaa

SEQ ID NO: 516682 - DNA, 16 bp, R. norvegicus
tatttcctcctgtgtg

SEQ ID NO: 516683 - DNA, 17 bp, R. norvegicus
tatttcctgccttctac

SEQ ID NO: 516684 - DNA, 16 bp, R. norvegicus
tatttcctggatattt

SEQ ID NO: 516685 - DNA, 16 bp, R. norvegicus
tatttcctgtaacagc

SEQ ID NO: 516686 - DNA, 16 bp, R. norvegicus
tatttccttctacaaa

SEQ ID NO: 516687 - DNA, 16 bp, R. norvegicus
tatttctaagactttt

SEQ ID NO: 516688 - DNA, 16 bp, R. norvegicus
tatttctattttatgg

SEQ ID NO: 516689 - DNA, 16 bp, R. norvegicus
tatttctatttttaga

SEQ ID NO: 516690 - DNA, 16 bp, R. norvegicus
tatttctgaaatattt

SEQ ID NO: 516691 - DNA, 16 bp, R. norvegicus
tatttctgctcctgta

SEQ ID NO: 516692 - DNA, 16 bp, R. norvegicus
tatttctgggtcttca

SEQ ID NO: 516693 - DNA, 16 bp, R. norvegicus
tatttctgtgatgaaa

SEQ ID NO: 516694 - DNA, 16 bp, R. norvegicus
tatttcttaaagattt

SEQ ID NO: 516695 - DNA, 16 bp, R. norvegicus
tatttcttcccttgag

SEQ ID NO: 516696 - DNA, 16 bp, R. norvegicus
tatttctttctgaact

SEQ ID NO: 516697 - DNA, 16 bp, R. norvegicus
tatttctttgaaaaat

SEQ ID NO: 516698 - DNA, 16 bp, R. norvegicus
tatttctttgaaattt

SEQ ID NO: 516699 - DNA, 16 bp, R. norvegicus
tatttgaaaatacttt

SEQ ID NO: 516700 - DNA, 27 bp, R. norvegicus
tatttgaaaggaaactggtccatggaa

SEQ ID NO: 516701 - DNA, 16 bp, R. norvegicus
tatttgaacaaaatat

SEQ ID NO: 516702 - DNA, 16 bp, R. norvegicus
tatttgagaaaaatca

SEQ ID NO: 516703 - DNA, 16 bp, R. norvegicus
tatttgatcacactgt

SEQ ID NO: 516704 - DNA, 16 bp, R. norvegicus
tatttgctgtattatg

SEQ ID NO: 516705 - DNA, 16 bp, R. norvegicus
tatttgcttcttttca

SEQ ID NO: 516706 - DNA, 16 bp, R. norvegicus
tatttggaaaagcaaa

SEQ ID NO: 516707 - DNA, 16 bp, R. norvegicus
tatttggcattcctca

SEQ ID NO: 516708 - DNA, 16 bp, R. norvegicus
tatttgggggcatggt

SEQ ID NO: 516709 - DNA, 16 bp, R. norvegicus
tatttggtaatttcat

SEQ ID NO: 516710 - DNA, 16 bp, R. norvegicus
tatttggtgttctcta

SEQ ID NO: 516711 - DNA, 16 bp, R. norvegicus
tatttggttccctgga

SEQ ID NO: 516712 - DNA, 16 bp, R. norvegicus
tatttgtcagactctg

SEQ ID NO: 516713 - DNA, 16 bp, R. norvegicus
tatttgtcatcctctg

SEQ ID NO: 516714 - DNA, 16 bp, R. norvegicus
tatttgtctataaaat

SEQ ID NO: 516715 - DNA, 16 bp, R. norvegicus
tatttgtgtatataaa

SEQ ID NO: 516716 - DNA, 16 bp, R. norvegicus
tatttgtgtatctgtg

SEQ ID NO: 516717 - DNA, 16 bp, R. norvegicus
tatttgtgtctgtgtg

SEQ ID NO: 516718 - DNA, 16 bp, R. norvegicus
tatttgttttctaaag

SEQ ID NO: 516719 - DNA, 16 bp, R. norvegicus
tattttaaaaggcaaa

SEQ ID NO: 516720 - DNA, 16 bp, R. norvegicus
tattttaatgtacatt

SEQ ID NO: 516721 - DNA, 16 bp, R. norvegicus
tattttaatgttttca

SEQ ID NO: 516722 - DNA, 16 bp, R. norvegicus
tattttactggatatt

SEQ ID NO: 516723 - DNA, 16 bp, R. norvegicus
tattttagaaaacaaa

SEQ ID NO: 516724 - DNA, 16 bp, R. norvegicus
tattttaggttacaat

SEQ ID NO: 516725 - DNA, 16 bp, R. norvegicus
tattttatagaatagt

SEQ ID NO: 516726 - DNA, 16 bp, R. norvegicus
tattttatgcatttgg

SEQ ID NO: 516727 - DNA, 16 bp, R. norvegicus
tattttatgtctatga

SEQ ID NO: 516728 - DNA, 16 bp, R. norvegicus
tattttattgatttca

SEQ ID NO: 516729 - DNA, 16 bp, R. norvegicus
tattttcaaagaaata

SEQ ID NO: 516730 - DNA, 16 bp, R. norvegicus
tattttcaaatataca

SEQ ID NO: 516731 - DNA, 16 bp, R. norvegicus
tattttcaacaaaact

SEQ ID NO: 516732 - DNA, 16 bp, R. norvegicus
tattttcacattcctc

SEQ ID NO: 516733 - DNA, 16 bp, R. norvegicus
tattttcagatgatat

SEQ ID NO: 516734 - DNA, 16 bp, R. norvegicus
tattttcagcttctgg

SEQ ID NO: 516735 - DNA, 16 bp, R. norvegicus
tattttcatgtatata

SEQ ID NO: 516736 - DNA, 16 bp, R. norvegicus
tattttcattaaaatc

SEQ ID NO: 516737 - DNA, 16 bp, R. norvegicus
tattttcattccaaat

SEQ ID NO: 516738 - DNA, 16 bp, R. norvegicus
tattttcattttctga

SEQ ID NO: 516739 - DNA, 16 bp, R. norvegicus
tattttccaaaataaa

SEQ ID NO: 516740 - DNA, 16 bp, R. norvegicus
tattttctgaatccat

SEQ ID NO: 516741 - DNA, 16 bp, R. norvegicus
tattttctgtgtttgg

SEQ ID NO: 516742 - DNA, 16 bp, R. norvegicus
tattttctgttgctgt

SEQ ID NO: 516743 - DNA, 16 bp, R. norvegicus
tattttctttcccagt

SEQ ID NO: 516744 - DNA, 16 bp, R. norvegicus
tattttcttttagaaa

SEQ ID NO: 516745 - DNA, 16 bp, R. norvegicus
tattttgaagcatttt

SEQ ID NO: 516746 - DNA, 16 bp, R. norvegicus
tattttgaatttttcc

SEQ ID NO: 516747 - DNA, 16 bp, R. norvegicus
tattttgacttctctt

SEQ ID NO: 516748 - DNA, 16 bp, R. norvegicus
tattttgatggagatt

SEQ ID NO: 516749 - DNA, 16 bp, R. norvegicus
tattttgctgaagttg

SEQ ID NO: 516750 - DNA, 16 bp, R. norvegicus
tattttgcttgtgtgt

SEQ ID NO: 516751 - DNA, 16 bp, R. norvegicus
tattttggaaagaaaa

SEQ ID NO: 516752 - DNA, 16 bp, R. norvegicus
tattttggctattagc

SEQ ID NO: 516753 - DNA, 16 bp, R. norvegicus
tattttgggaatttca

SEQ ID NO: 516754 - DNA, 16 bp, R. norvegicus
tattttggttgtgagc

SEQ ID NO: 516755 - DNA, 16 bp, R. norvegicus
tattttgtcacaacaa

SEQ ID NO: 516756 - DNA, 16 bp, R. norvegicus
tattttgtcatggaat

SEQ ID NO: 516757 - DNA, 16 bp, R. norvegicus
tattttgtggaaaaat

SEQ ID NO: 516758 - DNA, 16 bp, R. norvegicus
tattttgtggatttct

SEQ ID NO: 516759 - DNA, 16 bp, R. norvegicus
tattttgttttctgaa

SEQ ID NO: 516760 - DNA, 16 bp, R. norvegicus
tatttttaaaacacaa

SEQ ID NO: 516761 - DNA, 16 bp, R. norvegicus
tatttttaaacagttt

SEQ ID NO: 516762 - DNA, 16 bp, R. norvegicus
tatttttatatgtaca

SEQ ID NO: 516763 - DNA, 16 bp, R. norvegicus
tatttttcagatattt

SEQ ID NO: 516764 - DNA, 16 bp, R. norvegicus
tatttttcaggattgt

SEQ ID NO: 516765 - DNA, 16 bp, R. norvegicus
tatttttcagttccaa

SEQ ID NO: 516766 - DNA, 16 bp, R. norvegicus
tatttttccattctgt

SEQ ID NO: 516767 - DNA, 16 bp, R. norvegicus
tatttttccttgctca

SEQ ID NO: 516768 - DNA, 16 bp, R. norvegicus
tatttttcctttccaa

SEQ ID NO: 516769 - DNA, 16 bp, R. norvegicus
tatttttgcgtcagta

SEQ ID NO: 516770 - DNA, 16 bp, R. norvegicus
tatttttgtagacttt

SEQ ID NO: 516771 - DNA, 16 bp, R. norvegicus
tattttttaaagaaag

SEQ ID NO: 516772 - DNA, 16 bp, R. norvegicus
tattttttaaagactt

SEQ ID NO: 516773 - DNA, 16 bp, R. norvegicus
tattttttaaagcaaa

SEQ ID NO: 516774 - DNA, 16 bp, R. norvegicus
tattttttgcatttgg

SEQ ID NO: 516775 - DNA, 16 bp, R. norvegicus
tatttttttctcagcc

SEQ ID NO: 516776 - DNA, 16 bp, R. norvegicus
tattttttttctaaga

SEQ ID NO: 516777 - DNA, 16 bp, R. norvegicus
tcaaaaaagaagagga

SEQ ID NO: 516778 - DNA, 16 bp, R. norvegicus
tcaaaaaagcatcaga

SEQ ID NO: 516779 - DNA, 16 bp, R. norvegicus
tcaaaaaaggggcctc

SEQ ID NO: 516780 - DNA, 16 bp, R. norvegicus
tcaaaaaagtcaacaa

SEQ ID NO: 516781 - DNA, 16 bp, R. norvegicus
tcaaaaacaaagagtt

SEQ ID NO: 516782 - DNA, 16 bp, R. norvegicus
tcaaaaacatcatcta

SEQ ID NO: 516783 - DNA, 16 bp, R. norvegicus
tcaaaaacctcaacat

SEQ ID NO: 516784 - DNA, 16 bp, R. norvegicus
tcaaaaagaaattgga

SEQ ID NO: 516785 - DNA, 16 bp, R. norvegicus
tcaaaaagagagagag

SEQ ID NO: 516786 - DNA, 16 bp, R. norvegicus
tcaaaaaggataagga

SEQ ID NO: 516787 - DNA, 16 bp, R. norvegicus
tcaaaaatatataaag

SEQ ID NO: 516788 - DNA, 16 bp, R. norvegicus
tcaaaaatcaagagac

SEQ ID NO: 516789 - DNA, 16 bp, R. norvegicus
tcaaaaatgttttaaa

SEQ ID NO: 516790 - DNA, 16 bp, R. norvegicus
tcaaaaattcagatga

SEQ ID NO: 516791 - DNA, 16 bp, R. norvegicus
tcaaaacaatcttgag

SEQ ID NO: 516792 - DNA, 16 bp, R. norvegicus
tcaaaacaatgacttt

SEQ ID NO: 516793 - DNA, 16 bp, R. norvegicus
tcaaaacacaaggtgg

SEQ ID NO: 516794 - DNA, 16 bp, R. norvegicus
tcaaaacaccaactgc

SEQ ID NO: 516795 - DNA, 16 bp, R. norvegicus
tcaaaacacgaaatgc

SEQ ID NO: 516796 - DNA, 16 bp, R. norvegicus
tcaaaacagaagcaaa

SEQ ID NO: 516797 - DNA, 16 bp, R. norvegicus
tcaaaaccagcaccac

SEQ ID NO: 516798 - DNA, 16 bp, R. norvegicus
tcaaaactaaacaaag

SEQ ID NO: 516799 - DNA, 16 bp, R. norvegicus
tcaaaactcaggtgac

SEQ ID NO: 516800 - DNA, 16 bp, R. norvegicus
tcaaaagatggaaaga

SEQ ID NO: 516801 - DNA, 16 bp, R. norvegicus
tcaaaagcaaaacaag

SEQ ID NO: 516802 - DNA, 16 bp, R. norvegicus
tcaaaagcaacacccc

SEQ ID NO: 516803 - DNA, 16 bp, R. norvegicus
tcaaaaggagaaagaa

SEQ ID NO: 516804 - DNA, 16 bp, R. norvegicus
tcaaaaggatcatcca

SEQ ID NO: 516805 - DNA, 16 bp, R. norvegicus
tcaaaagtcagcagtg

SEQ ID NO: 516806 - DNA, 16 bp, R. norvegicus
tcaaaataacaggaaa

SEQ ID NO: 516807 - DNA, 25 bp, R. norvegicus
tcaaaatatcactatttgcagatga

SEQ ID NO: 516808 - DNA, 16 bp, R. norvegicus
tcaaaatatttttcat

SEQ ID NO: 516809 - DNA, 16 bp, R. norvegicus
tcaaaatcaaatttga

SEQ ID NO: 516810 - DNA, 16 bp, R. norvegicus
tcaaaatctactttaa

SEQ ID NO: 516811 - DNA, 16 bp, R. norvegicus
tcaaaatgccaacaca

SEQ ID NO: 516812 - DNA, 16 bp, R. norvegicus
tcaaaattgctctcca

SEQ ID NO: 516813 - DNA, 16 bp, R. norvegicus
tcaaacaaagcaaaac

SEQ ID NO: 516814 - DNA, 16 bp, R. norvegicus
tcaaacaaatgaacaa

SEQ ID NO: 516815 - DNA, 16 bp, R. norvegicus
tcaaacaagaagaaac

SEQ ID NO: 516816 - DNA, 16 bp, R. norvegicus
tcaaacacacattgca

SEQ ID NO: 516817 - DNA, 16 bp, R. norvegicus
tcaaacagatggagca

SEQ ID NO: 516818 - DNA, 16 bp, R. norvegicus
tcaaacagctgaagga

SEQ ID NO: 516819 - DNA, 16 bp, R. norvegicus
tcaaaccagaccaatg

SEQ ID NO: 516820 - DNA, 16 bp, R. norvegicus
tcaaacctcctcaact

SEQ ID NO: 516821 - DNA, 16 bp, R. norvegicus
tcaaactcaagagacc

SEQ ID NO: 516822 - DNA, 16 bp, R. norvegicus
tcaaactcacagagat

SEQ ID NO: 516823 - DNA, 16 bp, R. norvegicus
tcaaactcagagaccc

SEQ ID NO: 516824 - DNA, 16 bp, R. norvegicus
tcaaactcagatctga

SEQ ID NO: 516825 - DNA, 16 bp, R. norvegicus
tcaaactcctgaccct

SEQ ID NO: 516826 - DNA, 16 bp, R. norvegicus
tcaaactctgggctga

SEQ ID NO: 516827 - DNA, 16 bp, R. norvegicus
tcaaactctttgaaga

SEQ ID NO: 516828 - DNA, 16 bp, R. norvegicus
tcaaactgaaaccaaa

SEQ ID NO: 516829 - DNA, 16 bp, R. norvegicus
tcaaacttggagatct

SEQ ID NO: 516830 - DNA, 16 bp, R. norvegicus
tcaaagaaaaagtgac

SEQ ID NO: 516831 - DNA, 16 bp, R. norvegicus
tcaaagaaaatattaa

SEQ ID NO: 516832 - DNA, 16 bp, R. norvegicus
tcaaagaaaatctcag

SEQ ID NO: 516833 - DNA, 16 bp, R. norvegicus
tcaaagaaaatgaaga

SEQ ID NO: 516834 - DNA, 16 bp, R. norvegicus
tcaaagaaaattcaaa

SEQ ID NO: 516835 - DNA, 16 bp, R. norvegicus
tcaaagaaccaaattt

SEQ ID NO: 516836 - DNA, 16 bp, R. norvegicus
tcaaagaaccagaaaa

SEQ ID NO: 516837 - DNA, 16 bp, R. norvegicus
tcaaagaactcaagaa

SEQ ID NO: 516838 - DNA, 16 bp, R. norvegicus
tcaaagaagcagcttt

SEQ ID NO: 516839 - DNA, 16 bp, R. norvegicus
tcaaagaataaacagg

SEQ ID NO: 516840 - DNA, 16 bp, R. norvegicus
tcaaagaattaataaa

SEQ ID NO: 516841 - DNA, 16 bp, R. norvegicus
tcaaagacaaagaaag

SEQ ID NO: 516842 - DNA, 16 bp, R. norvegicus
tcaaagacaatgactt

SEQ ID NO: 516843 - DNA, 16 bp, R. norvegicus
tcaaagacaatgtaaa

SEQ ID NO: 516844 - DNA, 16 bp, R. norvegicus
tcaaagacccagaaat

SEQ ID NO: 516845 - DNA, 16 bp, R. norvegicus
tcaaagagaaaggagc

SEQ ID NO: 516846 - DNA, 17 bp, R. norvegicus
tcaaagagaagatcaaa

SEQ ID NO: 516847 - DNA, 16 bp, R. norvegicus
tcaaagagcacatcaa

SEQ ID NO: 516848 - DNA, 16 bp, R. norvegicus
tcaaagagctgggtct

SEQ ID NO: 516849 - DNA, 16 bp, R. norvegicus
tcaaagataaaaagga

SEQ ID NO: 516850 - DNA, 16 bp, R. norvegicus
tcaaagataagaacca

SEQ ID NO: 516851 - DNA, 16 bp, R. norvegicus
tcaaagataatgaaaa

SEQ ID NO: 516852 - DNA, 17 bp, R. norvegicus
tcaaagataatgtaaaa

SEQ ID NO: 516853 - DNA, 16 bp, R. norvegicus
tcaaagatattaaatt

SEQ ID NO: 516854 - DNA, 16 bp, R. norvegicus
tcaaagcactcaaaga

SEQ ID NO: 516855 - DNA, 16 bp, R. norvegicus
tcaaagcagttttcag

SEQ ID NO: 516856 - DNA, 16 bp, R. norvegicus
tcaaagccagccaggt

SEQ ID NO: 516857 - DNA, 16 bp, R. norvegicus
tcaaagccagcctggg

SEQ ID NO: 516858 - DNA, 16 bp, R. norvegicus
tcaaagccagcctgtg

SEQ ID NO: 516859 - DNA, 16 bp, R. norvegicus
tcaaagcccatgctgg

SEQ ID NO: 516860 - DNA, 16 bp, R. norvegicus
tcaaagcctgtcccca

SEQ ID NO: 516861 - DNA, 16 bp, R. norvegicus
tcaaagctcatatgaa

SEQ ID NO: 516862 - DNA, 16 bp, R. norvegicus
tcaaaggaagaaagaa

SEQ ID NO: 516863 - DNA, 16 bp, R. norvegicus
tcaaaggaccaatatt

SEQ ID NO: 516864 - DNA, 16 bp, R. norvegicus
tcaaaggagaagggga

SEQ ID NO: 516865 - DNA, 16 bp, R. norvegicus
tcaaaggaggctcctt

SEQ ID NO: 516866 - DNA, 16 bp, R. norvegicus
tcaaaggcaaagggga

SEQ ID NO: 516867 - DNA, 16 bp, R. norvegicus
tcaaaggccttttcta

SEQ ID NO: 516868 - DNA, 16 bp, R. norvegicus
tcaaagggatacaaat

SEQ ID NO: 516869 - DNA, 16 bp, R. norvegicus
tcaaaggtacctaagt

SEQ ID NO: 516870 - DNA, 16 bp, R. norvegicus
tcaaagtaatagaaaa

SEQ ID NO: 516871 - DNA, 16 bp, R. norvegicus
tcaaagtcagggctga

SEQ ID NO: 516872 - DNA, 16 bp, R. norvegicus
tcaaagtctttagtga

SEQ ID NO: 516873 - DNA, 16 bp, R. norvegicus
tcaaagtgaaatggtt

SEQ ID NO: 516874 - DNA, 16 bp, R. norvegicus
tcaaagtgcagagaac

SEQ ID NO: 516875 - DNA, 16 bp, R. norvegicus
tcaaagtggttttgat

SEQ ID NO: 516876 - DNA, 17 bp, R. norvegicus
tcaaagttctccgaaag

SEQ ID NO: 516877 - DNA, 16 bp, R. norvegicus
tcaaagttttctttgc

SEQ ID NO: 516878 - DNA, 16 bp, R. norvegicus
tcaaatacagaagcga

SEQ ID NO: 516879 - DNA, 16 bp, R. norvegicus
tcaaatacatgagcct

SEQ ID NO: 516880 - DNA, 16 bp, R. norvegicus
tcaaataggtttcatc

SEQ ID NO: 516881 - DNA, 16 bp, R. norvegicus
tcaaatattattccat

SEQ ID NO: 516882 - DNA, 16 bp, R. norvegicus
tcaaatcaccacagaa

SEQ ID NO: 516883 - DNA, 16 bp, R. norvegicus
tcaaatccagcctggg

SEQ ID NO: 516884 - DNA, 16 bp, R. norvegicus
tcaaatcctgtaaaca

SEQ ID NO: 516885 - DNA, 16 bp, R. norvegicus
tcaaatctttttctga

SEQ ID NO: 516886 - DNA, 16 bp, R. norvegicus
tcaaatgatttctcag

SEQ ID NO: 516887 - DNA, 16 bp, R. norvegicus
tcaaatgcagggctga

SEQ ID NO: 516888 - DNA, 16 bp, R. norvegicus
tcaaatgcccaagact

SEQ ID NO: 516889 - DNA, 16 bp, R. norvegicus
tcaaatgcgttctcag

SEQ ID NO: 516890 - DNA, 16 bp, R. norvegicus
tcaaatgcttcctcag

SEQ ID NO: 516891 - DNA, 16 bp, R. norvegicus
tcaaatgctttttcag

SEQ ID NO: 516892 - DNA, 16 bp, R. norvegicus
tcaaatggagggatgg

SEQ ID NO: 516893 - DNA, 25 bp, R. norvegicus
tcaaatggtcagaagaagcaagctg

SEQ ID NO: 516894 - DNA, 16 bp, R. norvegicus
tcaaatgtctttcctt

SEQ ID NO: 516895 - DNA, 16 bp, R. norvegicus
tcaaatgtgattttca

SEQ ID NO: 516896 - DNA, 16 bp, R. norvegicus
tcaaatgttatactct

SEQ ID NO: 516897 - DNA, 16 bp, R. norvegicus
tcaaatgttctgagtg

SEQ ID NO: 516898 - DNA, 16 bp, R. norvegicus
tcaaattattccacaa

SEQ ID NO: 516899 - DNA, 16 bp, R. norvegicus
tcaaattcaggttgtc

SEQ ID NO: 516900 - DNA, 16 bp, R. norvegicus
tcaaattcctgccaaa

SEQ ID NO: 516901 - DNA, 16 bp, R. norvegicus
tcaaattgacaataaa

SEQ ID NO: 516902 - DNA, 16 bp, R. norvegicus
tcaacaaaacaaggag

SEQ ID NO: 516903 - DNA, 16 bp, R. norvegicus
tcaacaaagaaatgga

SEQ ID NO: 516904 - DNA, 16 bp, R. norvegicus
tcaacaaagctgaaaa

SEQ ID NO: 516905 - DNA, 16 bp, R. norvegicus
tcaacaaagtggctga

SEQ ID NO: 516906 - DNA, 16 bp, R. norvegicus
tcaacaaatacaggaa

SEQ ID NO: 516907 - DNA, 16 bp, R. norvegicus
tcaacaacaacagcaa

SEQ ID NO: 516908 - DNA, 16 bp, R. norvegicus
tcaacaacaatggcct

SEQ ID NO: 516909 - DNA, 16 bp, R. norvegicus
tcaacaacacagactc

SEQ ID NO: 516910 - DNA, 16 bp, R. norvegicus
tcaacaagaaggaaga

SEQ ID NO: 516911 - DNA, 16 bp, R. norvegicus
tcaacaagataaacaa

SEQ ID NO: 516912 - DNA, 17 bp, R. norvegicus
tcaacaagatcgataaa

SEQ ID NO: 516913 - DNA, 16 bp, R. norvegicus
tcaacaagcccaaaag

SEQ ID NO: 516914 - DNA, 16 bp, R. norvegicus
tcaacaagttcaaggc

SEQ ID NO: 516915 - DNA, 16 bp, R. norvegicus
tcaacactaaaaggac

SEQ ID NO: 516916 - DNA, 16 bp, R. norvegicus
tcaacagaaactatga

SEQ ID NO: 516917 - DNA, 43 bp, R. norvegicus
tcaacagaggaatggatacagaaaatgtggtacatctacacac

SEQ ID NO: 516918 - DNA, 16 bp, R. norvegicus
tcaacagaggaatttc

SEQ ID NO: 516919 - DNA, 16 bp, R. norvegicus
tcaacagatccaaaag

SEQ ID NO: 516920 - DNA, 16 bp, R. norvegicus
tcaacagcaccctcag

SEQ ID NO: 516921 - DNA, 16 bp, R. norvegicus
tcaacaggaacagaaa

SEQ ID NO: 516922 - DNA, 16 bp, R. norvegicus
tcaacagttctctgca

SEQ ID NO: 516923 - DNA, 16 bp, R. norvegicus
tcaacatagtggagca

SEQ ID NO: 516924 - DNA, 16 bp, R. norvegicus
tcaacatcaatggtct

SEQ ID NO: 516925 - DNA, 16 bp, R. norvegicus
tcaacatcacactctc

SEQ ID NO: 516926 - DNA, 16 bp, R. norvegicus
tcaacatcatcatcac

SEQ ID NO: 516927 - DNA, 16 bp, R. norvegicus
tcaacatcctggttat

SEQ ID NO: 516928 - DNA, 16 bp, R. norvegicus
tcaacatgaagaagaa

SEQ ID NO: 516929 - DNA, 16 bp, R. norvegicus
tcaacatgtagaagat

SEQ ID NO: 516930 - DNA, 16 bp, R. norvegicus
tcaaccaatcagacac

SEQ ID NO: 516931 - DNA, 16 bp, R. norvegicus
tcaaccactgagccat

SEQ ID NO: 516932 - DNA, 16 bp, R. norvegicus
tcaaccattctttgaa

SEQ ID NO: 516933 - DNA, 16 bp, R. norvegicus
tcaacccccaagtgct

SEQ ID NO: 516934 - DNA, 16 bp, R. norvegicus
tcaaccctcctgcctc

SEQ ID NO: 516935 - DNA, 16 bp, R. norvegicus
tcaaccctgcccacat

SEQ ID NO: 516936 - DNA, 16 bp, R. norvegicus
tcaacctctgacctct

SEQ ID NO: 516937 - DNA, 16 bp, R. norvegicus
tcaacctgactggatt

SEQ ID NO: 516938 - DNA, 16 bp, R. norvegicus
tcaacctgagcttaga

SEQ ID NO: 516939 - DNA, 16 bp, R. norvegicus
tcaacctgcctgtctc

SEQ ID NO: 516940 - DNA, 16 bp, R. norvegicus
tcaacctgtgggtggt

SEQ ID NO: 516941 - DNA, 16 bp, R. norvegicus
tcaaccttcctaatgc

SEQ ID NO: 516942 - DNA, 16 bp, R. norvegicus
tcaactcagcttttct

SEQ ID NO: 516943 - DNA, 16 bp, R. norvegicus
tcaactccttcacctg

SEQ ID NO: 516944 - DNA, 17 bp, R. norvegicus
tcaactgaggaatggat

SEQ ID NO: 516945 - DNA, 16 bp, R. norvegicus
tcaactgaggctcctt

SEQ ID NO: 516946 - DNA, 16 bp, R. norvegicus
tcaactgcaactgaag

SEQ ID NO: 516947 - DNA, 16 bp, R. norvegicus
tcaactgctgcaccca

SEQ ID NO: 516948 - DNA, 16 bp, R. norvegicus
tcaacttcacagcttc

SEQ ID NO: 516949 - DNA, 16 bp, R. norvegicus
tcaacttctctgtgtt

SEQ ID NO: 516950 - DNA, 16 bp, R. norvegicus
tcaacttgacacaggt

SEQ ID NO: 516951 - DNA, 16 bp, R. norvegicus
tcaacttgactatatt

SEQ ID NO: 516952 - DNA, 16 bp, R. norvegicus
tcaacttgagacaagc

SEQ ID NO: 516953 - DNA, 16 bp, R. norvegicus
tcaactttggaaaaaa

SEQ ID NO: 516954 - DNA, 16 bp, R. norvegicus
tcaagaaaaacatgaa

SEQ ID NO: 516955 - DNA, 16 bp, R. norvegicus
tcaagaaaactcagca

SEQ ID NO: 516956 - DNA, 16 bp, R. norvegicus
tcaagaaaatgccctc

SEQ ID NO: 516957 - DNA, 16 bp, R. norvegicus
tcaagaaaattcccca

SEQ ID NO: 516958 - DNA, 16 bp, R. norvegicus
tcaagaaagaagacat

SEQ ID NO: 516959 - DNA, 16 bp, R. norvegicus
tcaagaaagagcacat

SEQ ID NO: 516960 - DNA, 16 bp, R. norvegicus
tcaagaaagatgtgga

SEQ ID NO: 516961 - DNA, 16 bp, R. norvegicus
tcaagaagaaagacca

SEQ ID NO: 516962 - DNA, 16 bp, R. norvegicus
tcaagaagaaagatga

SEQ ID NO: 516963 - DNA, 16 bp, R. norvegicus
tcaagaagaagaacaa

SEQ ID NO: 516964 - DNA, 16 bp, R. norvegicus
tcaagaagaagaccaa

SEQ ID NO: 516965 - DNA, 16 bp, R. norvegicus
tcaagaagaaggacaa

SEQ ID NO: 516966 - DNA, 16 bp, R. norvegicus
tcaagaagaagtatga

SEQ ID NO: 516967 - DNA, 16 bp, R. norvegicus
tcaagaagaatgaaga

SEQ ID NO: 516968 - DNA, 17 bp, R. norvegicus
tcaagaagatactggaa

SEQ ID NO: 516969 - DNA, 16 bp, R. norvegicus
tcaagaagatggaaga

SEQ ID NO: 516970 - DNA, 16 bp, R. norvegicus
tcaagaagcagaagca

SEQ ID NO: 516971 - DNA, 16 bp, R. norvegicus
tcaagaaggacaacca

SEQ ID NO: 516972 - DNA, 16 bp, R. norvegicus
tcaagaaggaggaaga

SEQ ID NO: 516973 - DNA, 16 bp, R. norvegicus
tcaagaagtacatgca

SEQ ID NO: 516974 - DNA, 16 bp, R. norvegicus
tcaagaagttggactc

SEQ ID NO: 516975 - DNA, 17 bp, R. norvegicus
tcaagaagtttgaccgc

SEQ ID NO: 516976 - DNA, 16 bp, R. norvegicus
tcaagaatgaccaaaa

SEQ ID NO: 516977 - DNA, 16 bp, R. norvegicus
tcaagaatgaggtgtt

SEQ ID NO: 516978 - DNA, 16 bp, R. norvegicus
tcaagaatgtggagaa

SEQ ID NO: 516979 - DNA, 16 bp, R. norvegicus
tcaagaattacatgaa

SEQ ID NO: 516980 - DNA, 16 bp, R. norvegicus
tcaagacaccgaagaa

SEQ ID NO: 516981 - DNA, 17 bp, R. norvegicus
tcaagacactgaagaaa

SEQ ID NO: 516982 - DNA, 17 bp, R. norvegicus
tcaagacactgaggaaa

SEQ ID NO: 516983 - DNA, 16 bp, R. norvegicus
tcaagaccaacctgag

SEQ ID NO: 516984 - DNA, 16 bp, R. norvegicus
tcaagaccagcatggg

SEQ ID NO: 516985 - DNA, 16 bp, R. norvegicus
tcaagaccagccaggg

SEQ ID NO: 516986 - DNA, 16 bp, R. norvegicus
tcaagaccagcctaag

SEQ ID NO: 516987 - DNA, 16 bp, R. norvegicus
tcaagacctctggaaa

SEQ ID NO: 516988 - DNA, 16 bp, R. norvegicus
tcaagagaaaggtaga

SEQ ID NO: 516989 - DNA, 16 bp, R. norvegicus
tcaagagacaggaggc

SEQ ID NO: 516990 - DNA, 16 bp, R. norvegicus
tcaagagagaaagaaa

SEQ ID NO: 516991 - DNA, 16 bp, R. norvegicus
tcaagagagcatgtca

SEQ ID NO: 516992 - DNA, 16 bp, R. norvegicus
tcaagagcaaatcaaa

SEQ ID NO: 516993 - DNA, 16 bp, R. norvegicus
tcaagagcagagaaaa

SEQ ID NO: 516994 - DNA, 16 bp, R. norvegicus
tcaagagctgctggtc

SEQ ID NO: 516995 - DNA, 16 bp, R. norvegicus
tcaagaggaccctggc

SEQ ID NO: 516996 - DNA, 16 bp, R. norvegicus
tcaagaggaggctcca

SEQ ID NO: 516997 - DNA, 16 bp, R. norvegicus
tcaagaggcagaggca

SEQ ID NO: 516998 - DNA, 16 bp, R. norvegicus
tcaagagtctgaagaa

SEQ ID NO: 516999 - DNA, 16 bp, R. norvegicus
tcaagatacagcaaca

SEQ ID NO: 517000 - DNA, 16 bp, R. norvegicus
tcaagatattgagtca

SEQ ID NO: 517001 - DNA, 16 bp, R. norvegicus
tcaagatcatccttga

SEQ ID NO: 517002 - DNA, 16 bp, R. norvegicus
tcaagatccagctaca

SEQ ID NO: 517003 - DNA, 16 bp, R. norvegicus
tcaagatccaggtcag

SEQ ID NO: 517004 - DNA, 16 bp, R. norvegicus
tcaagatcccttctaa

SEQ ID NO: 517005 - DNA, 16 bp, R. norvegicus
tcaagatgaaggatga

SEQ ID NO: 517006 - DNA, 16 bp, R. norvegicus
tcaagatgatgataga

SEQ ID NO: 517007 - DNA, 16 bp, R. norvegicus
tcaagatgatgttttc

SEQ ID NO: 517008 - DNA, 16 bp, R. norvegicus
tcaagatgctggagga

SEQ ID NO: 517009 - DNA, 16 bp, R. norvegicus
tcaagattcctctgct

SEQ ID NO: 517010 - DNA, 16 bp, R. norvegicus
tcaagattgtcagcaa

SEQ ID NO: 517011 - DNA, 16 bp, R. norvegicus
tcaagcaaatgaaaga

SEQ ID NO: 517012 - DNA, 16 bp, R. norvegicus
tcaagcaacagaaacc

SEQ ID NO: 517013 - DNA, 16 bp, R. norvegicus
tcaagcagaacacagg

SEQ ID NO: 517014 - DNA, 16 bp, R. norvegicus
tcaagcaggaacctgg

SEQ ID NO: 517015 - DNA, 16 bp, R. norvegicus
tcaagcagttttacag

SEQ ID NO: 517016 - DNA, 16 bp, R. norvegicus
tcaagcatcctctctt

SEQ ID NO: 517017 - DNA, 16 bp, R. norvegicus
tcaagccaaattaaag

SEQ ID NO: 517018 - DNA, 16 bp, R. norvegicus
tcaagcccctgaagaa

SEQ ID NO: 517019 - DNA, 16 bp, R. norvegicus
tcaagcctccacaaga

SEQ ID NO: 517020 - DNA, 16 bp, R. norvegicus
tcaagcctccagagga

SEQ ID NO: 517021 - DNA, 16 bp, R. norvegicus
tcaagcctctgtcaga

SEQ ID NO: 517022 - DNA, 16 bp, R. norvegicus
tcaagcctgacaacct

SEQ ID NO: 517023 - DNA, 16 bp, R. norvegicus
tcaagccttcacagaa

SEQ ID NO: 517024 - DNA, 16 bp, R. norvegicus
tcaagctctcaaactt

SEQ ID NO: 517025 - DNA, 16 bp, R. norvegicus
tcaagctctgcccaat

SEQ ID NO: 517026 - DNA, 16 bp, R. norvegicus
tcaagctcttcaagtc

SEQ ID NO: 517027 - DNA, 16 bp, R. norvegicus
tcaagctgcaggagtc

SEQ ID NO: 517028 - DNA, 16 bp, R. norvegicus
tcaagctggcctggaa

SEQ ID NO: 517029 - DNA, 16 bp, R. norvegicus
tcaagctggcttcaaa

SEQ ID NO: 517030 - DNA, 16 bp, R. norvegicus
tcaagctgttcctgta

SEQ ID NO: 517031 - DNA, 16 bp, R. norvegicus
tcaagctgttgatata

SEQ ID NO: 517032 - DNA, 16 bp, R. norvegicus
tcaaggaaaaatccac

SEQ ID NO: 517033 - DNA, 16 bp, R. norvegicus
tcaaggaaaaggaaaa

SEQ ID NO: 517034 - DNA, 16 bp, R. norvegicus
tcaaggaataaagaaa

SEQ ID NO: 517035 - DNA, 16 bp, R. norvegicus
tcaaggacaaaggctg

SEQ ID NO: 517036 - DNA, 16 bp, R. norvegicus
tcaaggacacaagaaa

SEQ ID NO: 517037 - DNA, 16 bp, R. norvegicus
tcaaggacacagaaaa

SEQ ID NO: 517038 - DNA, 16 bp, R. norvegicus
tcaaggacagtctggg

SEQ ID NO: 517039 - DNA, 16 bp, R. norvegicus
tcaaggaccccagtgc

SEQ ID NO: 517040 - DNA, 16 bp, R. norvegicus
tcaaggacttgaaaga

SEQ ID NO: 517041 - DNA, 16 bp, R. norvegicus
tcaaggagataaaaag

SEQ ID NO: 517042 - DNA, 16 bp, R. norvegicus
tcaaggaggagttgca

SEQ ID NO: 517043 - DNA, 16 bp, R. norvegicus
tcaaggatagacatta

SEQ ID NO: 517044 - DNA, 16 bp, R. norvegicus
tcaaggcagaagcatg

SEQ ID NO: 517045 - DNA, 16 bp, R. norvegicus
tcaaggccaacctgaa

SEQ ID NO: 517046 - DNA, 16 bp, R. norvegicus
tcaaggccaacctgtt

SEQ ID NO: 517047 - DNA, 16 bp, R. norvegicus
tcaaggccaccctgag

SEQ ID NO: 517048 - DNA, 16 bp, R. norvegicus
tcaaggccaccctggt

SEQ ID NO: 517049 - DNA, 16 bp, R. norvegicus
tcaaggccagcctcag

SEQ ID NO: 517050 - DNA, 16 bp, R. norvegicus
tcaaggccagctgggt

SEQ ID NO: 517051 - DNA, 16 bp, R. norvegicus
tcaaggccaggctggt

SEQ ID NO: 517052 - DNA, 16 bp, R. norvegicus
tcaaggctattcccca

SEQ ID NO: 517053 - DNA, 16 bp, R. norvegicus
tcaagggcagcctgag

SEQ ID NO: 517054 - DNA, 16 bp, R. norvegicus
tcaagggcagcctggg

SEQ ID NO: 517055 - DNA, 16 bp, R. norvegicus
tcaagggggaaggacc

SEQ ID NO: 517056 - DNA, 16 bp, R. norvegicus
tcaaggtcatcctgga

SEQ ID NO: 517057 - DNA, 16 bp, R. norvegicus
tcaaggtcatctggga

SEQ ID NO: 517058 - DNA, 16 bp, R. norvegicus
tcaaggtcatcttcag

SEQ ID NO: 517059 - DNA, 16 bp, R. norvegicus
tcaaggtcttcctcag

SEQ ID NO: 517060 - DNA, 16 bp, R. norvegicus
tcaaggtcttttccag

SEQ ID NO: 517061 - DNA, 16 bp, R. norvegicus
tcaaggttaaaaaaaa

SEQ ID NO: 517062 - DNA, 16 bp, R. norvegicus
tcaaggttagcctggg

SEQ ID NO: 517063 - DNA, 16 bp, R. norvegicus
tcaaggttctctagag

SEQ ID NO: 517064 - DNA, 16 bp, R. norvegicus
tcaagtaacatataaa

SEQ ID NO: 517065 - DNA, 16 bp, R. norvegicus
tcaagtaacatatcaa

SEQ ID NO: 517066 - DNA, 19 bp, R. norvegicus
tcaagtaaggactggtgac

SEQ ID NO: 517067 - DNA, 16 bp, R. norvegicus
tcaagtagaaataaaa

SEQ ID NO: 517068 - DNA, 16 bp, R. norvegicus
tcaagtcaataaagat

SEQ ID NO: 517069 - DNA, 16 bp, R. norvegicus
tcaagtcatcaagctt

SEQ ID NO: 517070 - DNA, 16 bp, R. norvegicus
tcaagtcatcagactt

SEQ ID NO: 517071 - DNA, 16 bp, R. norvegicus
tcaagtcattgcagga

SEQ ID NO: 517072 - DNA, 16 bp, R. norvegicus
tcaagtccaagtggat

SEQ ID NO: 517073 - DNA, 16 bp, R. norvegicus
tcaagtcccagcagcc

SEQ ID NO: 517074 - DNA, 17 bp, R. norvegicus
tcaagtctccgaagaaa

SEQ ID NO: 517075 - DNA, 16 bp, R. norvegicus
tcaagtctctaaagga

SEQ ID NO: 517076 - DNA, 16 bp, R. norvegicus
tcaagtctctgaagaa

SEQ ID NO: 517077 - DNA, 16 bp, R. norvegicus
tcaagtctctggagaa

SEQ ID NO: 517078 - DNA, 16 bp, R. norvegicus
tcaagtctcttcaggg

SEQ ID NO: 517079 - DNA, 16 bp, R. norvegicus
tcaagtctgtgaagaa

SEQ ID NO: 517080 - DNA, 16 bp, R. norvegicus
tcaagtctttctctga

SEQ ID NO: 517081 - DNA, 17 bp, R. norvegicus
tcaagtgaccataggtt

SEQ ID NO: 517082 - DNA, 16 bp, R. norvegicus
tcaagtgatggagagg

SEQ ID NO: 517083 - DNA, 16 bp, R. norvegicus
tcaagtggatcaagaa

SEQ ID NO: 517084 - DNA, 16 bp, R. norvegicus
tcaagtgtctttggtg

SEQ ID NO: 517085 - DNA, 16 bp, R. norvegicus
tcaagttaaaaagcaa

SEQ ID NO: 517086 - DNA, 16 bp, R. norvegicus
tcaagttatcttttag

SEQ ID NO: 517087 - DNA, 16 bp, R. norvegicus
tcaagttcaagtagat

SEQ ID NO: 517088 - DNA, 16 bp, R. norvegicus
tcaagttgacagtgaa

SEQ ID NO: 517089 - DNA, 16 bp, R. norvegicus
tcaagtttttcccaga

SEQ ID NO: 517090 - DNA, 16 bp, R. norvegicus
tcaataaaaagtttaa

SEQ ID NO: 517091 - DNA, 16 bp, R. norvegicus
tcaataaaattataga

SEQ ID NO: 517092 - DNA, 16 bp, R. norvegicus
tcaataaaattctcaa

SEQ ID NO: 517093 - DNA, 16 bp, R. norvegicus
tcaataaacaaatgaa

SEQ ID NO: 517094 - DNA, 16 bp, R. norvegicus
tcaataaatgtttatt

SEQ ID NO: 517095 - DNA, 17 bp, R. norvegicus
tcaataaatttcttgca

SEQ ID NO: 517096 - DNA, 16 bp, R. norvegicus
tcaataagaacttcaa

SEQ ID NO: 517097 - DNA, 16 bp, R. norvegicus
tcaataagaagatcaa

SEQ ID NO: 517098 - DNA, 16 bp, R. norvegicus
tcaatattcctcagat

SEQ ID NO: 517099 - DNA, 16 bp, R. norvegicus
tcaatattgttcttga

SEQ ID NO: 517100 - DNA, 16 bp, R. norvegicus
tcaatattttctatgg

SEQ ID NO: 517101 - DNA, 16 bp, R. norvegicus
tcaatcccaccaaaaa

SEQ ID NO: 517102 - DNA, 16 bp, R. norvegicus
tcaatccccaacactg

SEQ ID NO: 517103 - DNA, 16 bp, R. norvegicus
tcaatccccagtaccc

SEQ ID NO: 517104 - DNA, 16 bp, R. norvegicus
tcaatccctagaacct

SEQ ID NO: 517105 - DNA, 16 bp, R. norvegicus
tcaatccctggcacca

SEQ ID NO: 517106 - DNA, 16 bp, R. norvegicus
tcaatccctgggactc

SEQ ID NO: 517107 - DNA, 16 bp, R. norvegicus
tcaatcctcagcaccc

SEQ ID NO: 517108 - DNA, 16 bp, R. norvegicus
tcaatcctttctttaa

SEQ ID NO: 517109 - DNA, 16 bp, R. norvegicus
tcaatcctttttaaat

SEQ ID NO: 517110 - DNA, 16 bp, R. norvegicus
tcaatctcacagagat

SEQ ID NO: 517111 - DNA, 16 bp, R. norvegicus
tcaatgaagaaaatgc

SEQ ID NO: 517112 - DNA, 74 bp, R. norvegicus
tcaatgaatatcctagtaagagcaccagtggaaggggaagccctgggtcctgctaagactgaacccccagtgaa

SEQ ID NO: 517113 - DNA, 16 bp, R. norvegicus
tcaatgacaactttgt

SEQ ID NO: 517114 - DNA, 16 bp, R. norvegicus
tcaatgagaacttggt

SEQ ID NO: 517115 - DNA, 16 bp, R. norvegicus
tcaatgagtgcataca

SEQ ID NO: 517116 - DNA, 16 bp, R. norvegicus
tcaatgataacttgat

SEQ ID NO: 517117 - DNA, 16 bp, R. norvegicus
tcaatgatgtctatgg

SEQ ID NO: 517118 - DNA, 16 bp, R. norvegicus
tcaatgatttctatga

SEQ ID NO: 517119 - DNA, 16 bp, R. norvegicus
tcaatgattttgttga

SEQ ID NO: 517120 - DNA, 16 bp, R. norvegicus
tcaatgctagcagcaa

SEQ ID NO: 517121 - DNA, 16 bp, R. norvegicus
tcaatgcttttaacca

SEQ ID NO: 517122 - DNA, 16 bp, R. norvegicus
tcaatggaaaaatact

SEQ ID NO: 517123 - DNA, 16 bp, R. norvegicus
tcaatggaaggggaag

SEQ ID NO: 517124 - DNA, 16 bp, R. norvegicus
tcaatggaatcaaact

SEQ ID NO: 517125 - DNA, 16 bp, R. norvegicus
tcaatggacagaacat

SEQ ID NO: 517126 - DNA, 18 bp, R. norvegicus
tcaatggacagcagtctg

SEQ ID NO: 517127 - DNA, 16 bp, R. norvegicus
tcaatggacagctcat

SEQ ID NO: 517128 - DNA, 16 bp, R. norvegicus
tcaatggatggatgga

SEQ ID NO: 517129 - DNA, 16 bp, R. norvegicus
tcaatgtgggaaaaca

SEQ ID NO: 517130 - DNA, 16 bp, R. norvegicus
tcaatgtgtgtatgtg

SEQ ID NO: 517131 - DNA, 16 bp, R. norvegicus
tcaattactatattga

SEQ ID NO: 517132 - DNA, 16 bp, R. norvegicus
tcaattcagtcattta

SEQ ID NO: 517133 - DNA, 16 bp, R. norvegicus
tcaattcattctatga

SEQ ID NO: 517134 - DNA, 16 bp, R. norvegicus
tcaattcccagctacc

SEQ ID NO: 517135 - DNA, 16 bp, R. norvegicus
tcaattcccaggactc

SEQ ID NO: 517136 - DNA, 16 bp, R. norvegicus
tcaattcctgatctta

SEQ ID NO: 517137 - DNA, 16 bp, R. norvegicus
tcaattctccacaaga

SEQ ID NO: 517138 - DNA, 16 bp, R. norvegicus
tcaattcttcaagaaa

SEQ ID NO: 517139 - DNA, 16 bp, R. norvegicus
tcaattgctttcttca

SEQ ID NO: 517140 - DNA, 16 bp, R. norvegicus
tcaatttccagcaatc

SEQ ID NO: 517141 - DNA, 16 bp, R. norvegicus
tcaatttgtatctctt

SEQ ID NO: 517142 - DNA, 16 bp, R. norvegicus
tcaattttctgagaaa

SEQ ID NO: 517143 - DNA, 18 bp, R. norvegicus
tcaattttgggacccctt

SEQ ID NO: 517144 - DNA, 16 bp, R. norvegicus
tcaattttttgaggaa

SEQ ID NO: 517145 - DNA, 24 bp, R. norvegicus
tcacaaaaatccctgaaagaatta

SEQ ID NO: 517146 - DNA, 16 bp, R. norvegicus
tcacaaaacaggcctg

SEQ ID NO: 517147 - DNA, 16 bp, R. norvegicus
tcacaaacatacacat

SEQ ID NO: 517148 - DNA, 16 bp, R. norvegicus
tcacaaagaatcaaca

SEQ ID NO: 517149 - DNA, 16 bp, R. norvegicus
tcacaaagacccacct

SEQ ID NO: 517150 - DNA, 16 bp, R. norvegicus
tcacaaagcaagacaa

SEQ ID NO: 517151 - DNA, 16 bp, R. norvegicus
tcacaaagcaggcctc

SEQ ID NO: 517152 - DNA, 16 bp, R. norvegicus
tcacaacaaagccaaa

SEQ ID NO: 517153 - DNA, 16 bp, R. norvegicus
tcacaacatgagaaac

SEQ ID NO: 517154 - DNA, 16 bp, R. norvegicus
tcacaaccaaaatttt

SEQ ID NO: 517155 - DNA, 16 bp, R. norvegicus
tcacaaccaagaagca

SEQ ID NO: 517156 - DNA, 16 bp, R. norvegicus
tcacaactgcctgtaa

SEQ ID NO: 517157 - DNA, 16 bp, R. norvegicus
tcacaactgtctatga

SEQ ID NO: 517158 - DNA, 16 bp, R. norvegicus
tcacaactgtctgtaa

SEQ ID NO: 517159 - DNA, 17 bp, R. norvegicus
tcacaagaatgccatct

SEQ ID NO: 517160 - DNA, 16 bp, R. norvegicus
tcacaaggagaaactc

SEQ ID NO: 517161 - DNA, 16 bp, R. norvegicus
tcacaagttcgaggcc

SEQ ID NO: 517162 - DNA, 16 bp, R. norvegicus
tcacaataggcacaaa

SEQ ID NO: 517163 - DNA, 16 bp, R. norvegicus
tcacaatcacctttaa

SEQ ID NO: 517164 - DNA, 16 bp, R. norvegicus
tcacaattccatccca

SEQ ID NO: 517165 - DNA, 16 bp, R. norvegicus
tcacacaaagatattt

SEQ ID NO: 517166 - DNA, 16 bp, R. norvegicus
tcacacaatgtatttt

SEQ ID NO: 517167 - DNA, 16 bp, R. norvegicus
tcacacacacacactc

SEQ ID NO: 517168 - DNA, 16 bp, R. norvegicus
tcacacacactcacac

SEQ ID NO: 517169 - DNA, 16 bp, R. norvegicus
tcacacagctccctgc

SEQ ID NO: 517170 - DNA, 16 bp, R. norvegicus
tcacaccagtcagaat

SEQ ID NO: 517171 - DNA, 16 bp, R. norvegicus
tcacactgaggtactt

SEQ ID NO: 517172 - DNA, 16 bp, R. norvegicus
tcacactgaggtattt

SEQ ID NO: 517173 - DNA, 16 bp, R. norvegicus
tcacactgccgatggc

SEQ ID NO: 517174 - DNA, 16 bp, R. norvegicus
tcacagaaaccagaga

SEQ ID NO: 517175 - DNA, 16 bp, R. norvegicus
tcacagaaataaaaac

SEQ ID NO: 517176 - DNA, 16 bp, R. norvegicus
tcacagaaatggaaaa

SEQ ID NO: 517177 - DNA, 16 bp, R. norvegicus
tcacagaaatggaaac

SEQ ID NO: 517178 - DNA, 16 bp, R. norvegicus
tcacagaaattgaaaa

SEQ ID NO: 517179 - DNA, 16 bp, R. norvegicus
tcacagaacacacaca

SEQ ID NO: 517180 - DNA, 16 bp, R. norvegicus
tcacagaacagacctg

SEQ ID NO: 517181 - DNA, 16 bp, R. norvegicus
tcacagaaccaagagc

SEQ ID NO: 517182 - DNA, 16 bp, R. norvegicus
tcacagaactagaaaa

SEQ ID NO: 517183 - DNA, 16 bp, R. norvegicus
tcacagaagaggaggc

SEQ ID NO: 517184 - DNA, 16 bp, R. norvegicus
tcacagaagccagaga

SEQ ID NO: 517185 - DNA, 16 bp, R. norvegicus
tcacagaaggaaatac

SEQ ID NO: 517186 - DNA, 16 bp, R. norvegicus
tcacagaaggcagagg

SEQ ID NO: 517187 - DNA, 16 bp, R. norvegicus
tcacagaatttatgga

SEQ ID NO: 517188 - DNA, 16 bp, R. norvegicus
tcacagacacttgaag

SEQ ID NO: 517189 - DNA, 16 bp, R. norvegicus
tcacagaccacaggaa

SEQ ID NO: 517190 - DNA, 16 bp, R. norvegicus
tcacagaccacatgaa

SEQ ID NO: 517191 - DNA, 16 bp, R. norvegicus
tcacagactctagcct

SEQ ID NO: 517192 - DNA, 16 bp, R. norvegicus
tcacagagatccacca

SEQ ID NO: 517193 - DNA, 16 bp, R. norvegicus
tcacagagatccaccc

SEQ ID NO: 517194 - DNA, 16 bp, R. norvegicus
tcacagagatcctccc

SEQ ID NO: 517195 - DNA, 16 bp, R. norvegicus
tcacagagatttgcct

SEQ ID NO: 517196 - DNA, 16 bp, R. norvegicus
tcacagagctccacct

SEQ ID NO: 517197 - DNA, 16 bp, R. norvegicus
tcacagagctcttcct

SEQ ID NO: 517198 - DNA, 16 bp, R. norvegicus
tcacagaggaaggaag

SEQ ID NO: 517199 - DNA, 16 bp, R. norvegicus
tcacagaggccagaaa

SEQ ID NO: 517200 - DNA, 16 bp, R. norvegicus
tcacagaggtcagagg

SEQ ID NO: 517201 - DNA, 16 bp, R. norvegicus
tcacagagttctacct

SEQ ID NO: 517202 - DNA, 16 bp, R. norvegicus
tcacagatgaagaaat

SEQ ID NO: 517203 - DNA, 16 bp, R. norvegicus
tcacagatggctgtga

SEQ ID NO: 517204 - DNA, 16 bp, R. norvegicus
tcacagcaaagagaaa

SEQ ID NO: 517205 - DNA, 16 bp, R. norvegicus
tcacagcaacaggaaa

SEQ ID NO: 517206 - DNA, 16 bp, R. norvegicus
tcacagcacccacatg

SEQ ID NO: 517207 - DNA, 16 bp, R. norvegicus
tcacagcagagagaaa

SEQ ID NO: 517208 - DNA, 16 bp, R. norvegicus
tcacagcagcagaaac

SEQ ID NO: 517209 - DNA, 16 bp, R. norvegicus
tcacagcagcagcagc

SEQ ID NO: 517210 - DNA, 16 bp, R. norvegicus
tcacagcagtggaaac

SEQ ID NO: 517211 - DNA, 16 bp, R. norvegicus
tcacagcagtggaaat

SEQ ID NO: 517212 - DNA, 16 bp, R. norvegicus
tcacagccagagaagt

SEQ ID NO: 517213 - DNA, 16 bp, R. norvegicus
tcacagccatcctcct

SEQ ID NO: 517214 - DNA, 16 bp, R. norvegicus
tcacagccctcctccc

SEQ ID NO: 517215 - DNA, 16 bp, R. norvegicus
tcacagcctgctgccc

SEQ ID NO: 517216 - DNA, 16 bp, R. norvegicus
tcacagctagcagaga

SEQ ID NO: 517217 - DNA, 16 bp, R. norvegicus
tcacagctcaggaatg

SEQ ID NO: 517218 - DNA, 16 bp, R. norvegicus
tcacagctgaggagtg

SEQ ID NO: 517219 - DNA, 16 bp, R. norvegicus
tcacagctgcccactg

SEQ ID NO: 517220 - DNA, 16 bp, R. norvegicus
tcacagctgtctgtaa

SEQ ID NO: 517221 - DNA, 16 bp, R. norvegicus
tcacaggaagacatac

SEQ ID NO: 517222 - DNA, 16 bp, R. norvegicus
tcacaggaatagaaaa

SEQ ID NO: 517223 - DNA, 16 bp, R. norvegicus
tcacaggaccaaggcc

SEQ ID NO: 517224 - DNA, 16 bp, R. norvegicus
tcacaggaccaaggct

SEQ ID NO: 517225 - DNA, 16 bp, R. norvegicus
tcacaggagcaagggc

SEQ ID NO: 517226 - DNA, 16 bp, R. norvegicus
tcacaggaggaaatat

SEQ ID NO: 517227 - DNA, 16 bp, R. norvegicus
tcacaggagggacagg

SEQ ID NO: 517228 - DNA, 16 bp, R. norvegicus
tcacaggccacatgaa

SEQ ID NO: 517229 - DNA, 16 bp, R. norvegicus
tcacaggctttagcct

SEQ ID NO: 517230 - DNA, 16 bp, R. norvegicus
tcacaggtcttgcctt

SEQ ID NO: 517231 - DNA, 16 bp, R. norvegicus
tcacaggtgtgtcctc

SEQ ID NO: 517232 - DNA, 16 bp, R. norvegicus
tcacagtaataaaacc

SEQ ID NO: 517233 - DNA, 16 bp, R. norvegicus
tcacagtaatgaaacc

SEQ ID NO: 517234 - DNA, 16 bp, R. norvegicus
tcacagtcaaccactg

SEQ ID NO: 517235 - DNA, 16 bp, R. norvegicus
tcacagtcatctgtaa

SEQ ID NO: 517236 - DNA, 16 bp, R. norvegicus
tcacagtgacaagaaa

SEQ ID NO: 517237 - DNA, 16 bp, R. norvegicus
tcacagtgatgagaaa

SEQ ID NO: 517238 - DNA, 16 bp, R. norvegicus
tcacagtgatgctcaa

SEQ ID NO: 517239 - DNA, 16 bp, R. norvegicus
tcacagtggtaaaacc

SEQ ID NO: 517240 - DNA, 16 bp, R. norvegicus
tcacagtgtgtctcac

SEQ ID NO: 517241 - DNA, 16 bp, R. norvegicus
tcacagtgtgtgactg

SEQ ID NO: 517242 - DNA, 16 bp, R. norvegicus
tcacagtgttcccagc

SEQ ID NO: 517243 - DNA, 16 bp, R. norvegicus
tcacagtttaaaaaaa

SEQ ID NO: 517244 - DNA, 16 bp, R. norvegicus
tcacagtttcagaggg

SEQ ID NO: 517245 - DNA, 16 bp, R. norvegicus
tcacataatagtaaaa

SEQ ID NO: 517246 - DNA, 16 bp, R. norvegicus
tcacatacacacacac

SEQ ID NO: 517247 - DNA, 16 bp, R. norvegicus
tcacatacacagtcac

SEQ ID NO: 517248 - DNA, 16 bp, R. norvegicus
tcacatacagaaaata

SEQ ID NO: 517249 - DNA, 16 bp, R. norvegicus
tcacatacatagggct

SEQ ID NO: 517250 - DNA, 16 bp, R. norvegicus
tcacatactagtcaaa

SEQ ID NO: 517251 - DNA, 16 bp, R. norvegicus
tcacatcaaggctgga

SEQ ID NO: 517252 - DNA, 16 bp, R. norvegicus
tcacatcatatccaca

SEQ ID NO: 517253 - DNA, 16 bp, R. norvegicus
tcacatccccacttgg

SEQ ID NO: 517254 - DNA, 16 bp, R. norvegicus
tcacatccctggccca

SEQ ID NO: 517255 - DNA, 16 bp, R. norvegicus
tcacatccttaaagaa

SEQ ID NO: 517256 - DNA, 16 bp, R. norvegicus
tcacatctcctgatga

SEQ ID NO: 517257 - DNA, 16 bp, R. norvegicus
tcacatgctccagcag

SEQ ID NO: 517258 - DNA, 17 bp, R. norvegicus
tcacatggtggctcaca

SEQ ID NO: 517259 - DNA, 16 bp, R. norvegicus
tcacatgtttgcccca

SEQ ID NO: 517260 - DNA, 16 bp, R. norvegicus
tcacattgtccttggt

SEQ ID NO: 517261 - DNA, 16 bp, R. norvegicus
tcacatttgataatga

SEQ ID NO: 517262 - DNA, 16 bp, R. norvegicus
tcacatttggtcatga

SEQ ID NO: 517263 - DNA, 16 bp, R. norvegicus
tcacatttgtcaattc

SEQ ID NO: 517264 - DNA, 16 bp, R. norvegicus
tcaccaaagaagcttc

SEQ ID NO: 517265 - DNA, 16 bp, R. norvegicus
tcaccaaagcccaccc

SEQ ID NO: 517266 - DNA, 17 bp, R. norvegicus
tcaccaacaatggagga

SEQ ID NO: 517267 - DNA, 16 bp, R. norvegicus
tcaccaacatgactac

SEQ ID NO: 517268 - DNA, 16 bp, R. norvegicus
tcaccaacatgtgctg

SEQ ID NO: 517269 - DNA, 16 bp, R. norvegicus
tcaccaactggggacc

SEQ ID NO: 517270 - DNA, 16 bp, R. norvegicus
tcaccaactgtcttct

SEQ ID NO: 517271 - DNA, 16 bp, R. norvegicus
tcaccaagaaaataca

SEQ ID NO: 517272 - DNA, 16 bp, R. norvegicus
tcaccaagcaggtcac

SEQ ID NO: 517273 - DNA, 16 bp, R. norvegicus
tcaccaaggcccaccc

SEQ ID NO: 517274 - DNA, 16 bp, R. norvegicus
tcaccaattcagctag

SEQ ID NO: 517275 - DNA, 16 bp, R. norvegicus
tcaccacaacataaga

SEQ ID NO: 517276 - DNA, 16 bp, R. norvegicus
tcaccacagaatccat

SEQ ID NO: 517277 - DNA, 16 bp, R. norvegicus
tcaccaccgccaccac

SEQ ID NO: 517278 - DNA, 16 bp, R. norvegicus
tcaccagaaggaagcc

SEQ ID NO: 517279 - DNA, 16 bp, R. norvegicus
tcaccagacctcccca

SEQ ID NO: 517280 - DNA, 16 bp, R. norvegicus
tcaccagagaccatga

SEQ ID NO: 517281 - DNA, 16 bp, R. norvegicus
tcaccagattctcctc

SEQ ID NO: 517282 - DNA, 17 bp, R. norvegicus
tcaccagcatctactgt

SEQ ID NO: 517283 - DNA, 16 bp, R. norvegicus
tcaccagcatcttctg

SEQ ID NO: 517284 - DNA, 16 bp, R. norvegicus
tcaccaggacccagca

SEQ ID NO: 517285 - DNA, 16 bp, R. norvegicus
tcaccaggcagccttc

SEQ ID NO: 517286 - DNA, 16 bp, R. norvegicus
tcaccaggcagctttt

SEQ ID NO: 517287 - DNA, 16 bp, R. norvegicus
tcaccatcaccctggt

SEQ ID NO: 517288 - DNA, 16 bp, R. norvegicus
tcaccatcactgtcct

SEQ ID NO: 517289 - DNA, 16 bp, R. norvegicus
tcaccatcatcatcaa

SEQ ID NO: 517290 - DNA, 16 bp, R. norvegicus
tcaccatcatcatcct

SEQ ID NO: 517291 - DNA, 16 bp, R. norvegicus
tcaccatcatcgtcat

SEQ ID NO: 517292 - DNA, 16 bp, R. norvegicus
tcaccatccatgactt

SEQ ID NO: 517293 - DNA, 16 bp, R. norvegicus
tcaccatcccagacct

SEQ ID NO: 517294 - DNA, 16 bp, R. norvegicus
tcaccatctccagaga

SEQ ID NO: 517295 - DNA, 16 bp, R. norvegicus
tcaccatcttccagga

SEQ ID NO: 517296 - DNA, 16 bp, R. norvegicus
tcaccatggatctaca

SEQ ID NO: 517297 - DNA, 16 bp, R. norvegicus
tcaccatgtggtttct

SEQ ID NO: 517298 - DNA, 16 bp, R. norvegicus
tcacccacactcctgt

SEQ ID NO: 517299 - DNA, 16 bp, R. norvegicus
tcacccactgagctgt

SEQ ID NO: 517300 - DNA, 16 bp, R. norvegicus
tcacccaggctggcct

SEQ ID NO: 517301 - DNA, 16 bp, R. norvegicus
tcacccatgctcctgt

SEQ ID NO: 517302 - DNA, 16 bp, R. norvegicus
tcaccccaaataaagt

SEQ ID NO: 517303 - DNA, 16 bp, R. norvegicus
tcaccccaccctggca

SEQ ID NO: 517304 - DNA, 16 bp, R. norvegicus
tcaccccactctcatc

SEQ ID NO: 517305 - DNA, 16 bp, R. norvegicus
tcacccccaaagaact

SEQ ID NO: 517306 - DNA, 16 bp, R. norvegicus
tcaccctcttctatac

SEQ ID NO: 517307 - DNA, 16 bp, R. norvegicus
tcaccctgatacccaa

SEQ ID NO: 517308 - DNA, 16 bp, R. norvegicus
tcaccctggactctga

SEQ ID NO: 517309 - DNA, 16 bp, R. norvegicus
tcacccttcacagtac

SEQ ID NO: 517310 - DNA, 16 bp, R. norvegicus
tcaccgagagctcaaa

SEQ ID NO: 517311 - DNA, 16 bp, R. norvegicus
tcaccgtgaacaccat

SEQ ID NO: 517312 - DNA, 16 bp, R. norvegicus
tcacctccaccaccat

SEQ ID NO: 517313 - DNA, 16 bp, R. norvegicus
tcacctcccagatctc

SEQ ID NO: 517314 - DNA, 16 bp, R. norvegicus
tcacctcccaggcctc

SEQ ID NO: 517315 - DNA, 16 bp, R. norvegicus
tcacctcctcccacaa

SEQ ID NO: 517316 - DNA, 16 bp, R. norvegicus
tcacctcctcctgcac

SEQ ID NO: 517317 - DNA, 16 bp, R. norvegicus
tcacctctgtgtttga

SEQ ID NO: 517318 - DNA, 16 bp, R. norvegicus
tcacctgaggacatca

SEQ ID NO: 517319 - DNA, 16 bp, R. norvegicus
tcacctgagttttgat

SEQ ID NO: 517320 - DNA, 16 bp, R. norvegicus
tcacctgctaagctcc

SEQ ID NO: 517321 - DNA, 16 bp, R. norvegicus
tcacctgctcacctgc

SEQ ID NO: 517322 - DNA, 16 bp, R. norvegicus
tcacctgcttctgcct

SEQ ID NO: 517323 - DNA, 16 bp, R. norvegicus
tcacctggacagcaca

SEQ ID NO: 517324 - DNA, 16 bp, R. norvegicus
tcacctgtcaataaaa

SEQ ID NO: 517325 - DNA, 16 bp, R. norvegicus
tcaccttaaaacaaaa

SEQ ID NO: 517326 - DNA, 16 bp, R. norvegicus
tcaccttcctccctgt

SEQ ID NO: 517327 - DNA, 16 bp, R. norvegicus
tcaccttcctgaagaa

SEQ ID NO: 517328 - DNA, 16 bp, R. norvegicus
tcaccttctgattggt

SEQ ID NO: 517329 - DNA, 16 bp, R. norvegicus
tcaccttgcacaaaac

SEQ ID NO: 517330 - DNA, 16 bp, R. norvegicus
tcacgaccaagaagca

SEQ ID NO: 517331 - DNA, 16 bp, R. norvegicus
tcacgaccatctgcaa

SEQ ID NO: 517332 - DNA, 16 bp, R. norvegicus
tcacgcgcgcgcgcgc

SEQ ID NO: 517333 - DNA, 16 bp, R. norvegicus
tcacgctgaggtagtg

SEQ ID NO: 517334 - DNA, 16 bp, R. norvegicus
tcacgtgtttgcttta

SEQ ID NO: 517335 - DNA, 16 bp, R. norvegicus
tcactaacctggagtt

SEQ ID NO: 517336 - DNA, 16 bp, R. norvegicus
tcactacctccaagta

SEQ ID NO: 517337 - DNA, 16 bp, R. norvegicus
tcactaggctcctccc

SEQ ID NO: 517338 - DNA, 16 bp, R. norvegicus
tcactatgcaaaccag

SEQ ID NO: 517339 - DNA, 16 bp, R. norvegicus
tcactatggagctctg

SEQ ID NO: 517340 - DNA, 16 bp, R. norvegicus
tcactatgtagagcag

SEQ ID NO: 517341 - DNA, 16 bp, R. norvegicus
tcactatgtagccaag

SEQ ID NO: 517342 - DNA, 16 bp, R. norvegicus
tcactatgtagccctg

SEQ ID NO: 517343 - DNA, 16 bp, R. norvegicus
tcactattgctaatgc

SEQ ID NO: 517344 - DNA, 16 bp, R. norvegicus
tcactcacacacacac

SEQ ID NO: 517345 - DNA, 16 bp, R. norvegicus
tcactcacagctccct

SEQ ID NO: 517346 - DNA, 16 bp, R. norvegicus
tcactcagaaaggcaa

SEQ ID NO: 517347 - DNA, 16 bp, R. norvegicus
tcactcagagcagaag

SEQ ID NO: 517348 - DNA, 51 bp, R. norvegicus
tcactcaggatgatattttccagttccaaccatttgcctacgaatttcata

SEQ ID NO: 517349 - DNA, 16 bp, R. norvegicus
tcactcaggatttttt

SEQ ID NO: 517350 - DNA, 16 bp, R. norvegicus
tcactcattcacttat

SEQ ID NO: 517351 - DNA, 16 bp, R. norvegicus
tcactcattctctctc

SEQ ID NO: 517352 - DNA, 16 bp, R. norvegicus
tcactcccaacatctc

SEQ ID NO: 517353 - DNA, 16 bp, R. norvegicus
tcactcccacccctgt

SEQ ID NO: 517354 - DNA, 16 bp, R. norvegicus
tcactcctgctgctgc

SEQ ID NO: 517355 - DNA, 16 bp, R. norvegicus
tcactcctttaaaaga

SEQ ID NO: 517356 - DNA, 16 bp, R. norvegicus
tcactcctttaaaagg

SEQ ID NO: 517357 - DNA, 16 bp, R. norvegicus
tcactctcagtaacaa

SEQ ID NO: 517358 - DNA, 16 bp, R. norvegicus
tcactctccttcctgt

SEQ ID NO: 517359 - DNA, 16 bp, R. norvegicus
tcactctctcctatac

SEQ ID NO: 517360 - DNA, 16 bp, R. norvegicus
tcactctctctttctg

SEQ ID NO: 517361 - DNA, 16 bp, R. norvegicus
tcactctgtagaccag

SEQ ID NO: 517362 - DNA, 16 bp, R. norvegicus
tcactctgtagatcag

SEQ ID NO: 517363 - DNA, 16 bp, R. norvegicus
tcactgaacatggaga

SEQ ID NO: 517364 - DNA, 16 bp, R. norvegicus
tcactgaagaaagaaa

SEQ ID NO: 517365 - DNA, 16 bp, R. norvegicus
tcactgacagaaagga

SEQ ID NO: 517366 - DNA, 16 bp, R. norvegicus
tcactgagaccagaca

SEQ ID NO: 517367 - DNA, 16 bp, R. norvegicus
tcactgagatctgcct

SEQ ID NO: 517368 - DNA, 20 bp, R. norvegicus
tcactgagcaaaaggccttg

SEQ ID NO: 517369 - DNA, 16 bp, R. norvegicus
tcactgaggcatctct

SEQ ID NO: 517370 - DNA, 16 bp, R. norvegicus
tcactgagggaaatca

SEQ ID NO: 517371 - DNA, 16 bp, R. norvegicus
tcactgatataatttt

SEQ ID NO: 517372 - DNA, 16 bp, R. norvegicus
tcactgcagccttatt

SEQ ID NO: 517373 - DNA, 16 bp, R. norvegicus
tcactgccaccaccct

SEQ ID NO: 517374 - DNA, 16 bp, R. norvegicus
tcactgccatgtttga

SEQ ID NO: 517375 - DNA, 16 bp, R. norvegicus
tcactgctggaggtga

SEQ ID NO: 517376 - DNA, 16 bp, R. norvegicus
tcactggaactcctct

SEQ ID NO: 517377 - DNA, 16 bp, R. norvegicus
tcactggagatgggct

SEQ ID NO: 517378 - DNA, 16 bp, R. norvegicus
tcactggaggattcta

SEQ ID NO: 517379 - DNA, 16 bp, R. norvegicus
tcactggatagtttta

SEQ ID NO: 517380 - DNA, 17 bp, R. norvegicus
tcactggcatggccttc

SEQ ID NO: 517381 - DNA, 16 bp, R. norvegicus
tcactggcctggaatt

SEQ ID NO: 517382 - DNA, 16 bp, R. norvegicus
tcactggcctggagct

SEQ ID NO: 517383 - DNA, 16 bp, R. norvegicus
tcactggctgcagcac

SEQ ID NO: 517384 - DNA, 16 bp, R. norvegicus
tcactgggagtccagc

SEQ ID NO: 517385 - DNA, 16 bp, R. norvegicus
tcactgggcatcatga

SEQ ID NO: 517386 - DNA, 16 bp, R. norvegicus
tcactgggtcagggaa

SEQ ID NO: 517387 - DNA, 16 bp, R. norvegicus
tcactgtcactgtcac

SEQ ID NO: 517388 - DNA, 16 bp, R. norvegicus
tcactgtccacaggac

SEQ ID NO: 517389 - DNA, 16 bp, R. norvegicus
tcactgtccctgaact

SEQ ID NO: 517390 - DNA, 16 bp, R. norvegicus
tcactgtcctggcatt

SEQ ID NO: 517391 - DNA, 16 bp, R. norvegicus
tcactgtctgcagaca

SEQ ID NO: 517392 - DNA, 16 bp, R. norvegicus
tcactgtcttcaggca

SEQ ID NO: 517393 - DNA, 16 bp, R. norvegicus
tcactgtgaaggtggg

SEQ ID NO: 517394 - DNA, 16 bp, R. norvegicus
tcactgtgacaaaata

SEQ ID NO: 517395 - DNA, 16 bp, R. norvegicus
tcactgtggaggaggg

SEQ ID NO: 517396 - DNA, 16 bp, R. norvegicus
tcactgtgggcctggg

SEQ ID NO: 517397 - DNA, 16 bp, R. norvegicus
tcactgtgggcgtgga

SEQ ID NO: 517398 - DNA, 16 bp, R. norvegicus
tcactgtggggacagg

SEQ ID NO: 517399 - DNA, 16 bp, R. norvegicus
tcactgtgggtgagtg

SEQ ID NO: 517400 - DNA, 16 bp, R. norvegicus
tcactgtgggtgggct

SEQ ID NO: 517401 - DNA, 16 bp, R. norvegicus
tcactgtgggtgtgag

SEQ ID NO: 517402 - DNA, 16 bp, R. norvegicus
tcactgtgggtttggg

SEQ ID NO: 517403 - DNA, 16 bp, R. norvegicus
tcactgtgtctctctt

SEQ ID NO: 517404 - DNA, 16 bp, R. norvegicus
tcactgtgtgctcagg

SEQ ID NO: 517405 - DNA, 16 bp, R. norvegicus
tcacttcccatgggcc

SEQ ID NO: 517406 - DNA, 16 bp, R. norvegicus
tcacttcctgcttcct

SEQ ID NO: 517407 - DNA, 16 bp, R. norvegicus
tcacttctgctgcctg

SEQ ID NO: 517408 - DNA, 16 bp, R. norvegicus
tcacttgagattttta

SEQ ID NO: 517409 - DNA, 16 bp, R. norvegicus
tcacttgccttcctct

SEQ ID NO: 517410 - DNA, 16 bp, R. norvegicus
tcacttgctgtgcctg

SEQ ID NO: 517411 - DNA, 16 bp, R. norvegicus
tcacttgttctaggca

SEQ ID NO: 517412 - DNA, 16 bp, R. norvegicus
tcactttgtagccaag

SEQ ID NO: 517413 - DNA, 16 bp, R. norvegicus
tcacttttaaaataaa

SEQ ID NO: 517414 - DNA, 16 bp, R. norvegicus
tcactttttaaaaatt

SEQ ID NO: 517415 - DNA, 16 bp, R. norvegicus
tcagaaaaaaaatcat

SEQ ID NO: 517416 - DNA, 16 bp, R. norvegicus
tcagaaaaagaaagga

SEQ ID NO: 517417 - DNA, 16 bp, R. norvegicus
tcagaaaaagaaatgt

SEQ ID NO: 517418 - DNA, 16 bp, R. norvegicus
tcagaaaaatgtaaat

SEQ ID NO: 517419 - DNA, 16 bp, R. norvegicus
tcagaaaacactttcc

SEQ ID NO: 517420 - DNA, 16 bp, R. norvegicus
tcagaaaacccatgag

SEQ ID NO: 517421 - DNA, 16 bp, R. norvegicus
tcagaaaagctgctat

SEQ ID NO: 517422 - DNA, 16 bp, R. norvegicus
tcagaaaatgaaagaa

SEQ ID NO: 517423 - DNA, 16 bp, R. norvegicus
tcagaaaatggagaaa

SEQ ID NO: 517424 - DNA, 17 bp, R. norvegicus
tcagaaaattggacata

SEQ ID NO: 517425 - DNA, 20 bp, R. norvegicus
tcagaaaattggacattgca

SEQ ID NO: 517426 - DNA, 16 bp, R. norvegicus
tcagaaaattggtaat

SEQ ID NO: 517427 - DNA, 16 bp, R. norvegicus
tcagaaacacacacac

SEQ ID NO: 517428 - DNA, 16 bp, R. norvegicus
tcagaaacacccatca

SEQ ID NO: 517429 - DNA, 16 bp, R. norvegicus
tcagaaacagaggata

SEQ ID NO: 517430 - DNA, 16 bp, R. norvegicus
tcagaaacaggaagtg

SEQ ID NO: 517431 - DNA, 16 bp, R. norvegicus
tcagaaactagaaaca

SEQ ID NO: 517432 - DNA, 16 bp, R. norvegicus
tcagaaagaaccagaa

SEQ ID NO: 517433 - DNA, 16 bp, R. norvegicus
tcagaaagaactggaa

SEQ ID NO: 517434 - DNA, 16 bp, R. norvegicus
tcagaaagatactaag

SEQ ID NO: 517435 - DNA, 16 bp, R. norvegicus
tcagaaagcaaaataa

SEQ ID NO: 517436 - DNA, 16 bp, R. norvegicus
tcagaaagcagagaga

SEQ ID NO: 517437 - DNA, 16 bp, R. norvegicus
tcagaaaggaaaagaa

SEQ ID NO: 517438 - DNA, 16 bp, R. norvegicus
tcagaaaggcaaagaa

SEQ ID NO: 517439 - DNA, 16 bp, R. norvegicus
tcagaaaggcagacaa

SEQ ID NO: 517440 - DNA, 16 bp, R. norvegicus
tcagaaaggcagagaa

SEQ ID NO: 517441 - DNA, 16 bp, R. norvegicus
tcagaaaggtcacagg

SEQ ID NO: 517442 - DNA, 16 bp, R. norvegicus
tcagaaatagtgactg

SEQ ID NO: 517443 - DNA, 16 bp, R. norvegicus
tcagaaatgctgtcag

SEQ ID NO: 517444 - DNA, 16 bp, R. norvegicus
tcagaaattcaaggct

SEQ ID NO: 517445 - DNA, 16 bp, R. norvegicus
tcagaaattcacaaaa

SEQ ID NO: 517446 - DNA, 16 bp, R. norvegicus
tcagaacaaacaaaca

SEQ ID NO: 517447 - DNA, 16 bp, R. norvegicus
tcagaacaccacgggc

SEQ ID NO: 517448 - DNA, 16 bp, R. norvegicus
tcagaacagaaactca

SEQ ID NO: 517449 - DNA, 16 bp, R. norvegicus
tcagaacatggaaaga

SEQ ID NO: 517450 - DNA, 16 bp, R. norvegicus
tcagaacccacatggc

SEQ ID NO: 517451 - DNA, 16 bp, R. norvegicus
tcagaacccagctctc

SEQ ID NO: 517452 - DNA, 16 bp, R. norvegicus
tcagaacctggaaaga

SEQ ID NO: 517453 - DNA, 16 bp, R. norvegicus
tcagaactgaaacttc

SEQ ID NO: 517454 - DNA, 16 bp, R. norvegicus
tcagaactgagaggtt

SEQ ID NO: 517455 - DNA, 16 bp, R. norvegicus
tcagaactgtgagaaa

SEQ ID NO: 517456 - DNA, 16 bp, R. norvegicus
tcagaagaagcaagat

SEQ ID NO: 517457 - DNA, 16 bp, R. norvegicus
tcagaagaagcaagcc

SEQ ID NO: 517458 - DNA, 16 bp, R. norvegicus
tcagaagacaaccttg

SEQ ID NO: 517459 - DNA, 16 bp, R. norvegicus
tcagaagacaacttga

SEQ ID NO: 517460 - DNA, 16 bp, R. norvegicus
tcagaagacagccatg

SEQ ID NO: 517461 - DNA, 16 bp, R. norvegicus
tcagaagacagcttgc

SEQ ID NO: 517462 - DNA, 16 bp, R. norvegicus
tcagaagagctgagtt

SEQ ID NO: 517463 - DNA, 16 bp, R. norvegicus
tcagaagagggcaaca

SEQ ID NO: 517464 - DNA, 16 bp, R. norvegicus
tcagaagagggcttca

SEQ ID NO: 517465 - DNA, 16 bp, R. norvegicus
tcagaagatcctggac

SEQ ID NO: 517466 - DNA, 19 bp, R. norvegicus
tcagaagatggaaagatca

SEQ ID NO: 517467 - DNA, 16 bp, R. norvegicus
tcagaagatggaaagc

SEQ ID NO: 517468 - DNA, 16 bp, R. norvegicus
tcagaagatggaaagg

SEQ ID NO: 517469 - DNA, 16 bp, R. norvegicus
tcagaagatggcatca

SEQ ID NO: 517470 - DNA, 16 bp, R. norvegicus
tcagaagccacaccca

SEQ ID NO: 517471 - DNA, 16 bp, R. norvegicus
tcagaagcccaagcca

SEQ ID NO: 517472 - DNA, 16 bp, R. norvegicus
tcagaagctgaaaaca

SEQ ID NO: 517473 - DNA, 16 bp, R. norvegicus
tcagaagctgagaaaa

SEQ ID NO: 517474 - DNA, 16 bp, R. norvegicus
tcagaagctgccccac

SEQ ID NO: 517475 - DNA, 16 bp, R. norvegicus
tcagaaggcagagaca

SEQ ID NO: 517476 - DNA, 16 bp, R. norvegicus
tcagaaggcagccatg

SEQ ID NO: 517477 - DNA, 16 bp, R. norvegicus
tcagaagggggcatca

SEQ ID NO: 517478 - DNA, 16 bp, R. norvegicus
tcagaagttatgaacc

SEQ ID NO: 517479 - DNA, 16 bp, R. norvegicus
tcagaagttcatggtc

SEQ ID NO: 517480 - DNA, 16 bp, R. norvegicus
tcagaattacacaaga

SEQ ID NO: 517481 - DNA, 16 bp, R. norvegicus
tcagaattcaaggcca

SEQ ID NO: 517482 - DNA, 16 bp, R. norvegicus
tcagaattccaaagta

SEQ ID NO: 517483 - DNA, 16 bp, R. norvegicus
tcagaattccataaaa

SEQ ID NO: 517484 - DNA, 16 bp, R. norvegicus
tcagaatttcagtcca

SEQ ID NO: 517485 - DNA, 16 bp, R. norvegicus
tcagacaaagcagcag

SEQ ID NO: 517486 - DNA, 16 bp, R. norvegicus
tcagacaacaaaatga

SEQ ID NO: 517487 - DNA, 16 bp, R. norvegicus
tcagacaaggtttctc

SEQ ID NO: 517488 - DNA, 16 bp, R. norvegicus
tcagacaataaaagga

SEQ ID NO: 517489 - DNA, 16 bp, R. norvegicus
tcagacacacaagaag

SEQ ID NO: 517490 - DNA, 16 bp, R. norvegicus
tcagacacaccagaag

SEQ ID NO: 517491 - DNA, 17 bp, R. norvegicus
tcagacacaccagaaga

SEQ ID NO: 517492 - DNA, 16 bp, R. norvegicus
tcagacacacctgaag

SEQ ID NO: 517493 - DNA, 16 bp, R. norvegicus
tcagacacatgagtct

SEQ ID NO: 517494 - DNA, 16 bp, R. norvegicus
tcagacacatggccaa

SEQ ID NO: 517495 - DNA, 16 bp, R. norvegicus
tcagacaccagaggag

SEQ ID NO: 517496 - DNA, 16 bp, R. norvegicus
tcagacactgagtcac

SEQ ID NO: 517497 - DNA, 16 bp, R. norvegicus
tcagacactggaccac

SEQ ID NO: 517498 - DNA, 16 bp, R. norvegicus
tcagacactgggccac

SEQ ID NO: 517499 - DNA, 17 bp, R. norvegicus
tcagacagaccagaaga

SEQ ID NO: 517500 - DNA, 17 bp, R. norvegicus
tcagacagagctcagac

SEQ ID NO: 517501 - DNA, 16 bp, R. norvegicus
tcagacagcagctgca

SEQ ID NO: 517502 - DNA, 16 bp, R. norvegicus
tcagacagggtcactc

SEQ ID NO: 517503 - DNA, 16 bp, R. norvegicus
tcagacatcaacatgg

SEQ ID NO: 517504 - DNA, 16 bp, R. norvegicus
tcagacattgctggag

SEQ ID NO: 517505 - DNA, 16 bp, R. norvegicus
tcagacattttgtcac

SEQ ID NO: 517506 - DNA, 17 bp, R. norvegicus
tcagaccaatctcactt

SEQ ID NO: 517507 - DNA, 16 bp, R. norvegicus
tcagaccagaagaggg

SEQ ID NO: 517508 - DNA, 16 bp, R. norvegicus
tcagaccagcccatgt

SEQ ID NO: 517509 - DNA, 16 bp, R. norvegicus
tcagaccccagcctct

SEQ ID NO: 517510 - DNA, 16 bp, R. norvegicus
tcagacctagaccctg

SEQ ID NO: 517511 - DNA, 16 bp, R. norvegicus
tcagacctgagtttga

SEQ ID NO: 517512 - DNA, 16 bp, R. norvegicus
tcagactccagaagtt

SEQ ID NO: 517513 - DNA, 16 bp, R. norvegicus
tcagactccctggagc

SEQ ID NO: 517514 - DNA, 16 bp, R. norvegicus
tcagactctgagagcc

SEQ ID NO: 517515 - DNA, 16 bp, R. norvegicus
tcagactctggcagag

SEQ ID NO: 517516 - DNA, 16 bp, R. norvegicus
tcagactggcctcaaa

SEQ ID NO: 517517 - DNA, 16 bp, R. norvegicus
tcagactgtggtgtca

SEQ ID NO: 517518 - DNA, 16 bp, R. norvegicus
tcagacttggtggcaa

SEQ ID NO: 517519 - DNA, 16 bp, R. norvegicus
tcagagaaacagaaat

SEQ ID NO: 517520 - DNA, 17 bp, R. norvegicus
tcagagaaagaactgaa

SEQ ID NO: 517521 - DNA, 16 bp, R. norvegicus
tcagagaaagactgaa

SEQ ID NO: 517522 - DNA, 16 bp, R. norvegicus
tcagagaaaggactgg

SEQ ID NO: 517523 - DNA, 16 bp, R. norvegicus
tcagagaaagggctga

SEQ ID NO: 517524 - DNA, 16 bp, R. norvegicus
tcagagaaatgcagat

SEQ ID NO: 517525 - DNA, 16 bp, R. norvegicus
tcagagaaatggaaaa

SEQ ID NO: 517526 - DNA, 16 bp, R. norvegicus
tcagagaacaactgtg

SEQ ID NO: 517527 - DNA, 16 bp, R. norvegicus
tcagagaacaactttt

SEQ ID NO: 517528 - DNA, 16 bp, R. norvegicus
tcagagaagaaattaa

SEQ ID NO: 517529 - DNA, 16 bp, R. norvegicus
tcagagaagcagagaa

SEQ ID NO: 517530 - DNA, 16 bp, R. norvegicus
tcagagaagccttctc

SEQ ID NO: 517531 - DNA, 16 bp, R. norvegicus
tcagagaaggggaagc

SEQ ID NO: 517532 - DNA, 16 bp, R. norvegicus
tcagagaaggggaagt

SEQ ID NO: 517533 - DNA, 16 bp, R. norvegicus
tcagagacaaatacag

SEQ ID NO: 517534 - DNA, 16 bp, R. norvegicus
tcagagacaacaagac

SEQ ID NO: 517535 - DNA, 16 bp, R. norvegicus
tcagagacagacagag

SEQ ID NO: 517536 - DNA, 16 bp, R. norvegicus
tcagagacagcccctg

SEQ ID NO: 517537 - DNA, 16 bp, R. norvegicus
tcagagaccctcctgc

SEQ ID NO: 517538 - DNA, 16 bp, R. norvegicus
tcagagacttcaagtt

SEQ ID NO: 517539 - DNA, 16 bp, R. norvegicus
tcagagacttcctgaa

SEQ ID NO: 517540 - DNA, 16 bp, R. norvegicus
tcagagagaaagagag

SEQ ID NO: 517541 - DNA, 16 bp, R. norvegicus
tcagagagaggccatc

SEQ ID NO: 517542 - DNA, 16 bp, R. norvegicus
tcagagagcagcctgt

SEQ ID NO: 517543 - DNA, 16 bp, R. norvegicus
tcagagaggaaggaga

SEQ ID NO: 517544 - DNA, 17 bp, R. norvegicus
tcagagaggaatcacaa

SEQ ID NO: 517545 - DNA, 16 bp, R. norvegicus
tcagagaggcagacag

SEQ ID NO: 517546 - DNA, 16 bp, R. norvegicus
tcagagaggcagctct

SEQ ID NO: 517547 - DNA, 16 bp, R. norvegicus
tcagagagtttgctgt

SEQ ID NO: 517548 - DNA, 16 bp, R. norvegicus
tcagagatctcagggg

SEQ ID NO: 517549 - DNA, 16 bp, R. norvegicus
tcagagatgtgaagtt

SEQ ID NO: 517550 - DNA, 16 bp, R. norvegicus
tcagagcaatagaaac

SEQ ID NO: 517551 - DNA, 16 bp, R. norvegicus
tcagagcaatggaaac

SEQ ID NO: 517552 - DNA, 16 bp, R. norvegicus
tcagagcagaagtgtt

SEQ ID NO: 517553 - DNA, 25 bp, R. norvegicus
tcagagcagccatgaagcaaaatta

SEQ ID NO: 517554 - DNA, 16 bp, R. norvegicus
tcagagccaaaatcaa

SEQ ID NO: 517555 - DNA, 16 bp, R. norvegicus
tcagagcccagttccc

SEQ ID NO: 517556 - DNA, 16 bp, R. norvegicus
tcagagcctcctgggt

SEQ ID NO: 517557 - DNA, 16 bp, R. norvegicus
tcagagcctgcttcac

SEQ ID NO: 517558 - DNA, 16 bp, R. norvegicus
tcagagcctttgctcc

SEQ ID NO: 517559 - DNA, 16 bp, R. norvegicus
tcagagctccacctgc

SEQ ID NO: 517560 - DNA, 16 bp, R. norvegicus
tcagagctccagtgct

SEQ ID NO: 517561 - DNA, 20 bp, R. norvegicus
tcagagctggggaccgaacc

SEQ ID NO: 517562 - DNA, 16 bp, R. norvegicus
tcagagcttagtgagg

SEQ ID NO: 517563 - DNA, 24 bp, R. norvegicus
tcagagctttaaatgctgtacatt

SEQ ID NO: 517564 - DNA, 16 bp, R. norvegicus
tcagaggaaacaacta

SEQ ID NO: 517565 - DNA, 16 bp, R. norvegicus
tcagaggaaattgaaa

SEQ ID NO: 517566 - DNA, 16 bp, R. norvegicus
tcagaggacaacatgg

SEQ ID NO: 517567 - DNA, 16 bp, R. norvegicus
tcagaggacaacctct

SEQ ID NO: 517568 - DNA, 16 bp, R. norvegicus
tcagaggacaacttgt

SEQ ID NO: 517569 - DNA, 16 bp, R. norvegicus
tcagaggacagctgtg

SEQ ID NO: 517570 - DNA, 16 bp, R. norvegicus
tcagaggacagcttta

SEQ ID NO: 517571 - DNA, 16 bp, R. norvegicus
tcagaggacagctttg

SEQ ID NO: 517572 - DNA, 16 bp, R. norvegicus
tcagaggacagtgatg

SEQ ID NO: 517573 - DNA, 16 bp, R. norvegicus
tcagaggacagtttgt

SEQ ID NO: 517574 - DNA, 16 bp, R. norvegicus
tcagaggagaaaggaa

SEQ ID NO: 517575 - DNA, 16 bp, R. norvegicus
tcagaggatagatgcc

SEQ ID NO: 517576 - DNA, 16 bp, R. norvegicus
tcagaggcaagaggga

SEQ ID NO: 517577 - DNA, 16 bp, R. norvegicus
tcagaggcaaggggga

SEQ ID NO: 517578 - DNA, 16 bp, R. norvegicus
tcagaggcaggaactg

SEQ ID NO: 517579 - DNA, 16 bp, R. norvegicus
tcagaggcaggcagat

SEQ ID NO: 517580 - DNA, 16 bp, R. norvegicus
tcagagggaaaagaaa

SEQ ID NO: 517581 - DNA, 16 bp, R. norvegicus
tcagagggaaaggatg

SEQ ID NO: 517582 - DNA, 16 bp, R. norvegicus
tcagagggaacaagaa

SEQ ID NO: 517583 - DNA, 16 bp, R. norvegicus
tcagagggaatggagg

SEQ ID NO: 517584 - DNA, 16 bp, R. norvegicus
tcagagggagaggcag

SEQ ID NO: 517585 - DNA, 16 bp, R. norvegicus
tcagaggggcagagaa

SEQ ID NO: 517586 - DNA, 16 bp, R. norvegicus
tcagaggggctgggga

SEQ ID NO: 517587 - DNA, 16 bp, R. norvegicus
tcagagggtggactgg

SEQ ID NO: 517588 - DNA, 16 bp, R. norvegicus
tcagaggtcacagaga

SEQ ID NO: 517589 - DNA, 16 bp, R. norvegicus
tcagaggtcccgagtt

SEQ ID NO: 517590 - DNA, 16 bp, R. norvegicus
tcagaggtcctgagtt

SEQ ID NO: 517591 - DNA, 16 bp, R. norvegicus
tcagaggtggatggag

SEQ ID NO: 517592 - DNA, 16 bp, R. norvegicus
tcagaggttaaaaaca

SEQ ID NO: 517593 - DNA, 16 bp, R. norvegicus
tcagaggttctgagtt

SEQ ID NO: 517594 - DNA, 16 bp, R. norvegicus
tcagaggtttagtcca

SEQ ID NO: 517595 - DNA, 16 bp, R. norvegicus
tcagagtagagcctag

SEQ ID NO: 517596 - DNA, 16 bp, R. norvegicus
tcagagtcagctctct

SEQ ID NO: 517597 - DNA, 16 bp, R. norvegicus
tcagagtctctcagga

SEQ ID NO: 517598 - DNA, 16 bp, R. norvegicus
tcagagtctgccctac

SEQ ID NO: 517599 - DNA, 16 bp, R. norvegicus
tcagagtgaagggctg

SEQ ID NO: 517600 - DNA, 16 bp, R. norvegicus
tcagagtgactaagat

SEQ ID NO: 517601 - DNA, 16 bp, R. norvegicus
tcagagtgtctcctca

SEQ ID NO: 517602 - DNA, 16 bp, R. norvegicus
tcagagttagaaagag

SEQ ID NO: 517603 - DNA, 16 bp, R. norvegicus
tcagagttattttgat

SEQ ID NO: 517604 - DNA, 21 bp, R. norvegicus
tcagagtttagtgatagtgac

SEQ ID NO: 517605 - DNA, 16 bp, R. norvegicus
tcagagttttaactgt

SEQ ID NO: 517606 - DNA, 16 bp, R. norvegicus
tcagatagctcacaac

SEQ ID NO: 517607 - DNA, 16 bp, R. norvegicus
tcagatatggatgtct

SEQ ID NO: 517608 - DNA, 16 bp, R. norvegicus
tcagatatttacattg

SEQ ID NO: 517609 - DNA, 16 bp, R. norvegicus
tcagatcatcagactt

SEQ ID NO: 517610 - DNA, 16 bp, R. norvegicus
tcagatcccagcatcc

SEQ ID NO: 517611 - DNA, 16 bp, R. norvegicus
tcagatcccatcacag

SEQ ID NO: 517612 - DNA, 20 bp, R. norvegicus
tcagatcccattacagatgg

SEQ ID NO: 517613 - DNA, 16 bp, R. norvegicus
tcagatccccaacacc

SEQ ID NO: 517614 - DNA, 16 bp, R. norvegicus
tcagatcctcaagctt

SEQ ID NO: 517615 - DNA, 16 bp, R. norvegicus
tcagatctccagcact

SEQ ID NO: 517616 - DNA, 16 bp, R. norvegicus
tcagatctgggcacag

SEQ ID NO: 517617 - DNA, 16 bp, R. norvegicus
tcagatctttattaca

SEQ ID NO: 517618 - DNA, 16 bp, R. norvegicus
tcagatgaaattcaaa

SEQ ID NO: 517619 - DNA, 16 bp, R. norvegicus
tcagatgatggaaaga

SEQ ID NO: 517620 - DNA, 16 bp, R. norvegicus
tcagatgatggaggag

SEQ ID NO: 517621 - DNA, 16 bp, R. norvegicus
tcagatgccagtgaag

SEQ ID NO: 517622 - DNA, 16 bp, R. norvegicus
tcagatgccctctcct

SEQ ID NO: 517623 - DNA, 16 bp, R. norvegicus
tcagatgccctggagc

SEQ ID NO: 517624 - DNA, 16 bp, R. norvegicus
tcagatgctggtgagg

SEQ ID NO: 517625 - DNA, 16 bp, R. norvegicus
tcagatggagctcagg

SEQ ID NO: 517626 - DNA, 16 bp, R. norvegicus
tcagatggtgccatgc

SEQ ID NO: 517627 - DNA, 16 bp, R. norvegicus
tcagattccctggaac

SEQ ID NO: 517628 - DNA, 17 bp, R. norvegicus
tcagattctgttgttat

SEQ ID NO: 517629 - DNA, 16 bp, R. norvegicus
tcagcaaagacagatg

SEQ ID NO: 517630 - DNA, 16 bp, R. norvegicus
tcagcaaaggcatcag

SEQ ID NO: 517631 - DNA, 16 bp, R. norvegicus
tcagcaaagtctctca

SEQ ID NO: 517632 - DNA, 16 bp, R. norvegicus
tcagcaacagtgcctc

SEQ ID NO: 517633 - DNA, 16 bp, R. norvegicus
tcagcaagcacctctt

SEQ ID NO: 517634 - DNA, 16 bp, R. norvegicus
tcagcaagcacttctt

SEQ ID NO: 517635 - DNA, 16 bp, R. norvegicus
tcagcaaggctctggc

SEQ ID NO: 517636 - DNA, 18 bp, R. norvegicus
tcagcaagtggtgctggt

SEQ ID NO: 517637 - DNA, 16 bp, R. norvegicus
tcagcaataaggtctt

SEQ ID NO: 517638 - DNA, 17 bp, R. norvegicus
tcagcaatcaaaaacaa

SEQ ID NO: 517639 - DNA, 16 bp, R. norvegicus
tcagcaatcccaccaa

SEQ ID NO: 517640 - DNA, 17 bp, R. norvegicus
tcagcaatgcaatgtaa

SEQ ID NO: 517641 - DNA, 16 bp, R. norvegicus
tcagcaatggacagat

SEQ ID NO: 517642 - DNA, 16 bp, R. norvegicus
tcagcacacaggagca

SEQ ID NO: 517643 - DNA, 16 bp, R. norvegicus
tcagcacacaggagta

SEQ ID NO: 517644 - DNA, 16 bp, R. norvegicus
tcagcacaggctcagg

SEQ ID NO: 517645 - DNA, 16 bp, R. norvegicus
tcagcaccaaggacag

SEQ ID NO: 517646 - DNA, 16 bp, R. norvegicus
tcagcaccacggacag

SEQ ID NO: 517647 - DNA, 16 bp, R. norvegicus
tcagcacccacacagc

SEQ ID NO: 517648 - DNA, 16 bp, R. norvegicus
tcagcacccaggaggc

SEQ ID NO: 517649 - DNA, 16 bp, R. norvegicus
tcagcaccgcggacag

SEQ ID NO: 517650 - DNA, 16 bp, R. norvegicus
tcagcactcctgcaga

SEQ ID NO: 517651 - DNA, 16 bp, R. norvegicus
tcagcactgaggaggc

SEQ ID NO: 517652 - DNA, 16 bp, R. norvegicus
tcagcactgcacagac

SEQ ID NO: 517653 - DNA, 16 bp, R. norvegicus
tcagcacttcatggaa

SEQ ID NO: 517654 - DNA, 16 bp, R. norvegicus
tcagcagacaccacac

SEQ ID NO: 517655 - DNA, 16 bp, R. norvegicus
tcagcagatgaatgga

SEQ ID NO: 517656 - DNA, 16 bp, R. norvegicus
tcagcagattgacagc

SEQ ID NO: 517657 - DNA, 16 bp, R. norvegicus
tcagcagcagcagcag

SEQ ID NO: 517658 - DNA, 17 bp, R. norvegicus
tcagcagcagcagcagt

SEQ ID NO: 517659 - DNA, 16 bp, R. norvegicus
tcagcagcagcagctg

SEQ ID NO: 517660 - DNA, 16 bp, R. norvegicus
tcagcagcaggtacct

SEQ ID NO: 517661 - DNA, 16 bp, R. norvegicus
tcagcaggaaaacaga

SEQ ID NO: 517662 - DNA, 16 bp, R. norvegicus
tcagcaggcccatgct

SEQ ID NO: 517663 - DNA, 16 bp, R. norvegicus
tcagcaggtacttctt

SEQ ID NO: 517664 - DNA, 16 bp, R. norvegicus
tcagcagtccagtcca

SEQ ID NO: 517665 - DNA, 16 bp, R. norvegicus
tcagcagtgagaagca

SEQ ID NO: 517666 - DNA, 16 bp, R. norvegicus
tcagcagtggcagctc

SEQ ID NO: 517667 - DNA, 16 bp, R. norvegicus
tcagcatgaagaagaa

SEQ ID NO: 517668 - DNA, 16 bp, R. norvegicus
tcagcatgtagaagaa

SEQ ID NO: 517669 - DNA, 16 bp, R. norvegicus
tcagcatttctcagct

SEQ ID NO: 517670 - DNA, 16 bp, R. norvegicus
tcagccaaccagaccc

SEQ ID NO: 517671 - DNA, 16 bp, R. norvegicus
tcagccaatgactgag

SEQ ID NO: 517672 - DNA, 16 bp, R. norvegicus
tcagccaatgagcttc

SEQ ID NO: 517673 - DNA, 16 bp, R. norvegicus
tcagccaatggtgctg

SEQ ID NO: 517674 - DNA, 16 bp, R. norvegicus
tcagccacctcagcca

SEQ ID NO: 517675 - DNA, 16 bp, R. norvegicus
tcagccaggtggtggt

SEQ ID NO: 517676 - DNA, 16 bp, R. norvegicus
tcagccatcttgctgg

SEQ ID NO: 517677 - DNA, 16 bp, R. norvegicus
tcagcccctgcttcct

SEQ ID NO: 517678 - DNA, 16 bp, R. norvegicus
tcagccctcatcaaag

SEQ ID NO: 517679 - DNA, 16 bp, R. norvegicus
tcagcccttggagccc

SEQ ID NO: 517680 - DNA, 16 bp, R. norvegicus
tcagcctcagcctctg

SEQ ID NO: 517681 - DNA, 16 bp, R. norvegicus
tcagcctcaggaggaa

SEQ ID NO: 517682 - DNA, 16 bp, R. norvegicus
tcagcctcaggaggag

SEQ ID NO: 517683 - DNA, 16 bp, R. norvegicus
tcagcctcaggagtgc

SEQ ID NO: 517684 - DNA, 16 bp, R. norvegicus
tcagcctcccaagtag

SEQ ID NO: 517685 - DNA, 16 bp, R. norvegicus
tcagcctccccagtgc

SEQ ID NO: 517686 - DNA, 16 bp, R. norvegicus
tcagcctcctcagtgc

SEQ ID NO: 517687 - DNA, 16 bp, R. norvegicus
tcagcctcctgctcct

SEQ ID NO: 517688 - DNA, 16 bp, R. norvegicus
tcagcctctttatcct

SEQ ID NO: 517689 - DNA, 16 bp, R. norvegicus
tcagcctgaactacat

SEQ ID NO: 517690 - DNA, 16 bp, R. norvegicus
tcagcctgcctctgct

SEQ ID NO: 517691 - DNA, 16 bp, R. norvegicus
tcagcctggtctgcag

SEQ ID NO: 517692 - DNA, 16 bp, R. norvegicus
tcagcctggtttacag

SEQ ID NO: 517693 - DNA, 16 bp, R. norvegicus
tcagcctgtttaccct

SEQ ID NO: 517694 - DNA, 16 bp, R. norvegicus
tcagcctgtttatccc

SEQ ID NO: 517695 - DNA, 16 bp, R. norvegicus
tcagccttctggccca

SEQ ID NO: 517696 - DNA, 16 bp, R. norvegicus
tcagcggtgaagagca

SEQ ID NO: 517697 - DNA, 16 bp, R. norvegicus
tcagctactgggtaga

SEQ ID NO: 517698 - DNA, 24 bp, R. norvegicus
tcagctatcaaaaacaatgacttg

SEQ ID NO: 517699 - DNA, 16 bp, R. norvegicus
tcagctatctctccag

SEQ ID NO: 517700 - DNA, 16 bp, R. norvegicus
tcagctcagggcacag

SEQ ID NO: 517701 - DNA, 16 bp, R. norvegicus
tcagctccaaactttg

SEQ ID NO: 517702 - DNA, 16 bp, R. norvegicus
tcagctccagctccag

SEQ ID NO: 517703 - DNA, 16 bp, R. norvegicus
tcagctccaggagcag

SEQ ID NO: 517704 - DNA, 16 bp, R. norvegicus
tcagctcccagcacct

SEQ ID NO: 517705 - DNA, 16 bp, R. norvegicus
tcagctcccctggagc

SEQ ID NO: 517706 - DNA, 16 bp, R. norvegicus
tcagctcccttagcag

SEQ ID NO: 517707 - DNA, 17 bp, R. norvegicus
tcagctcccttagcaga

SEQ ID NO: 517708 - DNA, 16 bp, R. norvegicus
tcagctcctcctccag

SEQ ID NO: 517709 - DNA, 17 bp, R. norvegicus
tcagctcctcctgcacc

SEQ ID NO: 517710 - DNA, 16 bp, R. norvegicus
tcagctcctgcctcca

SEQ ID NO: 517711 - DNA, 16 bp, R. norvegicus
tcagctcctgtcccca

SEQ ID NO: 517712 - DNA, 16 bp, R. norvegicus
tcagctccttctccag

SEQ ID NO: 517713 - DNA, 16 bp, R. norvegicus
tcagctccttctctga

SEQ ID NO: 517714 - DNA, 16 bp, R. norvegicus
tcagctccttcttcag

SEQ ID NO: 517715 - DNA, 16 bp, R. norvegicus
tcagctccttgtctct

SEQ ID NO: 517716 - DNA, 16 bp, R. norvegicus
tcagctctccctccct

SEQ ID NO: 517717 - DNA, 16 bp, R. norvegicus
tcagctctcctgctct

SEQ ID NO: 517718 - DNA, 16 bp, R. norvegicus
tcagctctcctggttc

SEQ ID NO: 517719 - DNA, 16 bp, R. norvegicus
tcagctctgaaaaaca

SEQ ID NO: 517720 - DNA, 16 bp, R. norvegicus
tcagctctgactttga

SEQ ID NO: 517721 - DNA, 16 bp, R. norvegicus
tcagctctgagtttgg

SEQ ID NO: 517722 - DNA, 16 bp, R. norvegicus
tcagctctgcctccag

SEQ ID NO: 517723 - DNA, 16 bp, R. norvegicus
tcagctctgcgtttga

SEQ ID NO: 517724 - DNA, 16 bp, R. norvegicus
tcagctctgggatgac

SEQ ID NO: 517725 - DNA, 16 bp, R. norvegicus
tcagctcttccagtcc

SEQ ID NO: 517726 - DNA, 16 bp, R. norvegicus
tcagctcttcctgcat

SEQ ID NO: 517727 - DNA, 16 bp, R. norvegicus
tcagctgaagaatatt

SEQ ID NO: 517728 - DNA, 16 bp, R. norvegicus
tcagctgccctgactc

SEQ ID NO: 517729 - DNA, 16 bp, R. norvegicus
tcagctgctgcctcca

SEQ ID NO: 517730 - DNA, 16 bp, R. norvegicus
tcagctgctgggtggg

SEQ ID NO: 517731 - DNA, 16 bp, R. norvegicus
tcagctgcttgttgag

SEQ ID NO: 517732 - DNA, 16 bp, R. norvegicus
tcagctggagctgaag

SEQ ID NO: 517733 - DNA, 16 bp, R. norvegicus
tcagctggagctgaga

SEQ ID NO: 517734 - DNA, 16 bp, R. norvegicus
tcagctggccttgaac

SEQ ID NO: 517735 - DNA, 16 bp, R. norvegicus
tcagctgggctctgtg

SEQ ID NO: 517736 - DNA, 16 bp, R. norvegicus
tcagctggtaaaggca

SEQ ID NO: 517737 - DNA, 16 bp, R. norvegicus
tcagctgtcctggctc

SEQ ID NO: 517738 - DNA, 16 bp, R. norvegicus
tcagctgtgattaaga

SEQ ID NO: 517739 - DNA, 16 bp, R. norvegicus
tcagctgtggaaagga

SEQ ID NO: 517740 - DNA, 16 bp, R. norvegicus
tcagctgtggtggtgc

SEQ ID NO: 517741 - DNA, 16 bp, R. norvegicus
tcagctgttcttggtg

SEQ ID NO: 517742 - DNA, 16 bp, R. norvegicus
tcagcttacacttcca

SEQ ID NO: 517743 - DNA, 16 bp, R. norvegicus
tcagcttcaggaggag

SEQ ID NO: 517744 - DNA, 16 bp, R. norvegicus
tcagcttgaagaggag

SEQ ID NO: 517745 - DNA, 16 bp, R. norvegicus
tcaggaaaattttccc

SEQ ID NO: 517746 - DNA, 16 bp, R. norvegicus
tcaggaaagagaataa

SEQ ID NO: 517747 - DNA, 17 bp, R. norvegicus
tcaggaaagatctacat

SEQ ID NO: 517748 - DNA, 16 bp, R. norvegicus
tcaggaaagctgcagg

SEQ ID NO: 517749 - DNA, 16 bp, R. norvegicus
tcaggaaataatcaaa

SEQ ID NO: 517750 - DNA, 16 bp, R. norvegicus
tcaggaacacacacac

SEQ ID NO: 517751 - DNA, 16 bp, R. norvegicus
tcaggaacagagaaac

SEQ ID NO: 517752 - DNA, 24 bp, R. norvegicus
tcaggaaccttgatacaatcttct

SEQ ID NO: 517753 - DNA, 16 bp, R. norvegicus
tcaggaacttcctgaa

SEQ ID NO: 517754 - DNA, 16 bp, R. norvegicus
tcaggaagaaagaaga

SEQ ID NO: 517755 - DNA, 16 bp, R. norvegicus
tcaggaagaacagcca

SEQ ID NO: 517756 - DNA, 16 bp, R. norvegicus
tcaggaagaagagaga

SEQ ID NO: 517757 - DNA, 16 bp, R. norvegicus
tcaggaagacagattg

SEQ ID NO: 517758 - DNA, 18 bp, R. norvegicus
tcaggaagagataaacca

SEQ ID NO: 517759 - DNA, 16 bp, R. norvegicus
tcaggaagcaaagaaa

SEQ ID NO: 517760 - DNA, 16 bp, R. norvegicus
tcaggaagcagagcca

SEQ ID NO: 517761 - DNA, 16 bp, R. norvegicus
tcaggaagcaggagcc

SEQ ID NO: 517762 - DNA, 16 bp, R. norvegicus
tcaggaagcaggagga

SEQ ID NO: 517763 - DNA, 16 bp, R. norvegicus
tcaggaagctgagaca

SEQ ID NO: 517764 - DNA, 16 bp, R. norvegicus
tcaggaagctgtctcc

SEQ ID NO: 517765 - DNA, 16 bp, R. norvegicus
tcaggaaggagaggtg

SEQ ID NO: 517766 - DNA, 16 bp, R. norvegicus
tcaggaagtggagagg

SEQ ID NO: 517767 - DNA, 16 bp, R. norvegicus
tcaggaagttcctgaa

SEQ ID NO: 517768 - DNA, 16 bp, R. norvegicus
tcaggaatatgagcag

SEQ ID NO: 517769 - DNA, 16 bp, R. norvegicus
tcaggaatggtgattc

SEQ ID NO: 517770 - DNA, 16 bp, R. norvegicus
tcaggaattcaaggaa

SEQ ID NO: 517771 - DNA, 16 bp, R. norvegicus
tcaggacacaaaaagg

SEQ ID NO: 517772 - DNA, 16 bp, R. norvegicus
tcaggacacccagggc

SEQ ID NO: 517773 - DNA, 16 bp, R. norvegicus
tcaggacagccagggc

SEQ ID NO: 517774 - DNA, 16 bp, R. norvegicus
tcaggacagccagtgc

SEQ ID NO: 517775 - DNA, 16 bp, R. norvegicus
tcaggacctctggatg

SEQ ID NO: 517776 - DNA, 16 bp, R. norvegicus
tcaggacctgagttca

SEQ ID NO: 517777 - DNA, 16 bp, R. norvegicus
tcaggacgtctggaag

SEQ ID NO: 517778 - DNA, 16 bp, R. norvegicus
tcaggactgaccattt

SEQ ID NO: 517779 - DNA, 16 bp, R. norvegicus
tcaggacttctggaaa

SEQ ID NO: 517780 - DNA, 16 bp, R. norvegicus
tcaggagaagcaggag

SEQ ID NO: 517781 - DNA, 16 bp, R. norvegicus
tcaggagacaaagaca

SEQ ID NO: 517782 - DNA, 16 bp, R. norvegicus
tcaggagacacccaca

SEQ ID NO: 517783 - DNA, 16 bp, R. norvegicus
tcaggagacagagaag

SEQ ID NO: 517784 - DNA, 16 bp, R. norvegicus
tcaggagacatagatg

SEQ ID NO: 517785 - DNA, 16 bp, R. norvegicus
tcaggagacatctaca

SEQ ID NO: 517786 - DNA, 16 bp, R. norvegicus
tcaggagcagaggatt

SEQ ID NO: 517787 - DNA, 16 bp, R. norvegicus
tcaggagcagaggcag

SEQ ID NO: 517788 - DNA, 16 bp, R. norvegicus
tcaggagcctcagccc

SEQ ID NO: 517789 - DNA, 16 bp, R. norvegicus
tcaggagctggagaga

SEQ ID NO: 517790 - DNA, 16 bp, R. norvegicus
tcaggaggaagaagca

SEQ ID NO: 517791 - DNA, 16 bp, R. norvegicus
tcaggaggagctcagg

SEQ ID NO: 517792 - DNA, 16 bp, R. norvegicus
tcaggaggaggaagag

SEQ ID NO: 517793 - DNA, 16 bp, R. norvegicus
tcaggaggatcaggag

SEQ ID NO: 517794 - DNA, 16 bp, R. norvegicus
tcaggaggcagagaca

SEQ ID NO: 517795 - DNA, 16 bp, R. norvegicus
tcaggaggcagaggaa

SEQ ID NO: 517796 - DNA, 16 bp, R. norvegicus
tcaggaggctgagaca

SEQ ID NO: 517797 - DNA, 16 bp, R. norvegicus
tcaggaggctgaggca

SEQ ID NO: 517798 - DNA, 17 bp, R. norvegicus
tcaggagtgcccatctg

SEQ ID NO: 517799 - DNA, 16 bp, R. norvegicus
tcaggagtgccctcct

SEQ ID NO: 517800 - DNA, 16 bp, R. norvegicus
tcaggagtgctgcaga

SEQ ID NO: 517801 - DNA, 16 bp, R. norvegicus
tcaggagttcaaggtt

SEQ ID NO: 517802 - DNA, 16 bp, R. norvegicus
tcaggagttcagggtc

SEQ ID NO: 517803 - DNA, 16 bp, R. norvegicus
tcaggatatatgcttg

SEQ ID NO: 517804 - DNA, 16 bp, R. norvegicus
tcaggatcagataaac

SEQ ID NO: 517805 - DNA, 16 bp, R. norvegicus
tcaggatcagatgaac

SEQ ID NO: 517806 - DNA, 16 bp, R. norvegicus
tcaggatgacatcttg

SEQ ID NO: 517807 - DNA, 16 bp, R. norvegicus
tcaggatgtgaagtga

SEQ ID NO: 517808 - DNA, 16 bp, R. norvegicus
tcaggcagaaacctga

SEQ ID NO: 517809 - DNA, 16 bp, R. norvegicus
tcaggcagagctctgg

SEQ ID NO: 517810 - DNA, 16 bp, R. norvegicus
tcaggccaccaggctt

SEQ ID NO: 517811 - DNA, 16 bp, R. norvegicus
tcaggccttggggcct

SEQ ID NO: 517812 - DNA, 16 bp, R. norvegicus
tcaggccttggggtct

SEQ ID NO: 517813 - DNA, 16 bp, R. norvegicus
tcaggctcctctgtgg

SEQ ID NO: 517814 - DNA, 16 bp, R. norvegicus
tcaggctctggcaggg

SEQ ID NO: 517815 - DNA, 16 bp, R. norvegicus
tcaggctctgtgagcc

SEQ ID NO: 517816 - DNA, 16 bp, R. norvegicus
tcaggctgacctcaaa

SEQ ID NO: 517817 - DNA, 24 bp, R. norvegicus
tcaggctgcagaggcactgaaggg

SEQ ID NO: 517818 - DNA, 16 bp, R. norvegicus
tcaggctggcctcaaa

SEQ ID NO: 517819 - DNA, 16 bp, R. norvegicus
tcaggctgtggcagag

SEQ ID NO: 517820 - DNA, 16 bp, R. norvegicus
tcaggctgttctcaaa

SEQ ID NO: 517821 - DNA, 16 bp, R. norvegicus
tcaggcttagcagcaa

SEQ ID NO: 517822 - DNA, 16 bp, R. norvegicus
tcaggcttggcagaaa

SEQ ID NO: 517823 - DNA, 16 bp, R. norvegicus
tcagggaaaaagaaaa

SEQ ID NO: 517824 - DNA, 16 bp, R. norvegicus
tcagggaaaggcaaat

SEQ ID NO: 517825 - DNA, 16 bp, R. norvegicus
tcagggaaatacaagt

SEQ ID NO: 517826 - DNA, 16 bp, R. norvegicus
tcagggaacatcatgg

SEQ ID NO: 517827 - DNA, 16 bp, R. norvegicus
tcagggaagatgcacc

SEQ ID NO: 517828 - DNA, 16 bp, R. norvegicus
tcagggaatattccag

SEQ ID NO: 517829 - DNA, 16 bp, R. norvegicus
tcagggacagctcctg

SEQ ID NO: 517830 - DNA, 16 bp, R. norvegicus
tcagggacttcctgag

SEQ ID NO: 517831 - DNA, 16 bp, R. norvegicus
tcagggagaagacaag

SEQ ID NO: 517832 - DNA, 16 bp, R. norvegicus
tcagggagcagaggca

SEQ ID NO: 517833 - DNA, 16 bp, R. norvegicus
tcagggattggtggag

SEQ ID NO: 517834 - DNA, 16 bp, R. norvegicus
tcagggattggtgggg

SEQ ID NO: 517835 - DNA, 16 bp, R. norvegicus
tcagggatttcctgaa

SEQ ID NO: 517836 - DNA, 16 bp, R. norvegicus
tcagggatttttttga

SEQ ID NO: 517837 - DNA, 16 bp, R. norvegicus
tcagggcaatgcaaat

SEQ ID NO: 517838 - DNA, 16 bp, R. norvegicus
tcagggcaggaacaca

SEQ ID NO: 517839 - DNA, 16 bp, R. norvegicus
tcagggcaggaactga

SEQ ID NO: 517840 - DNA, 16 bp, R. norvegicus
tcagggcagggtccca

SEQ ID NO: 517841 - DNA, 17 bp, R. norvegicus
tcagggctacacagaga

SEQ ID NO: 517842 - DNA, 16 bp, R. norvegicus
tcagggctggtgagat

SEQ ID NO: 517843 - DNA, 16 bp, R. norvegicus
tcagggcttctctcct

SEQ ID NO: 517844 - DNA, 16 bp, R. norvegicus
tcaggggctgaggcag

SEQ ID NO: 517845 - DNA, 16 bp, R. norvegicus
tcaggggtcaagagca

SEQ ID NO: 517846 - DNA, 16 bp, R. norvegicus
tcaggggtcaggggtc

SEQ ID NO: 517847 - DNA, 16 bp, R. norvegicus
tcaggggtccccaggc

SEQ ID NO: 517848 - DNA, 16 bp, R. norvegicus
tcaggggtgggcagtg

SEQ ID NO: 517849 - DNA, 16 bp, R. norvegicus
tcagggtaatattttc

SEQ ID NO: 517850 - DNA, 16 bp, R. norvegicus
tcagggtcctgaagag

SEQ ID NO: 517851 - DNA, 16 bp, R. norvegicus
tcagggtgattttttt

SEQ ID NO: 517852 - DNA, 16 bp, R. norvegicus
tcagggtggaccagag

SEQ ID NO: 517853 - DNA, 16 bp, R. norvegicus
tcaggtcatcaagctt

SEQ ID NO: 517854 - DNA, 16 bp, R. norvegicus
tcaggtcatcaggcct

SEQ ID NO: 517855 - DNA, 16 bp, R. norvegicus
tcaggtccaagtggat

SEQ ID NO: 517856 - DNA, 16 bp, R. norvegicus
tcaggtccaggcagtg

SEQ ID NO: 517857 - DNA, 16 bp, R. norvegicus
tcaggtccccagcacc

SEQ ID NO: 517858 - DNA, 16 bp, R. norvegicus
tcaggtcctcaagctt

SEQ ID NO: 517859 - DNA, 16 bp, R. norvegicus
tcaggtctctgaagaa

SEQ ID NO: 517860 - DNA, 16 bp, R. norvegicus
tcaggtcttcaggcct

SEQ ID NO: 517861 - DNA, 16 bp, R. norvegicus
tcaggtcttcatgctt

SEQ ID NO: 517862 - DNA, 16 bp, R. norvegicus
tcaggtgacagaaaat

SEQ ID NO: 517863 - DNA, 16 bp, R. norvegicus
tcaggtgacagaagat

SEQ ID NO: 517864 - DNA, 19 bp, R. norvegicus
tcaggtgacttcaccagaa

SEQ ID NO: 517865 - DNA, 16 bp, R. norvegicus
tcaggtgctggtagaa

SEQ ID NO: 517866 - DNA, 16 bp, R. norvegicus
tcaggtggagctcagg

SEQ ID NO: 517867 - DNA, 16 bp, R. norvegicus
tcaggtggcagtgcag

SEQ ID NO: 517868 - DNA, 28 bp, R. norvegicus
tcaggtgggcactcctgaggctgcagag

SEQ ID NO: 517869 - DNA, 16 bp, R. norvegicus
tcaggtgtgtgaggaa

SEQ ID NO: 517870 - DNA, 16 bp, R. norvegicus
tcaggttatcaagctt

SEQ ID NO: 517871 - DNA, 16 bp, R. norvegicus
tcaggttcagtgagaa

SEQ ID NO: 517872 - DNA, 16 bp, R. norvegicus
tcaggttccagaggtg

SEQ ID NO: 517873 - DNA, 16 bp, R. norvegicus
tcaggttctggcagaa

SEQ ID NO: 517874 - DNA, 16 bp, R. norvegicus
tcaggttcttctccat

SEQ ID NO: 517875 - DNA, 16 bp, R. norvegicus
tcaggttgtcagactt

SEQ ID NO: 517876 - DNA, 16 bp, R. norvegicus
tcaggttgtcaggctt

SEQ ID NO: 517877 - DNA, 16 bp, R. norvegicus
tcaggttttgtgtgtg

SEQ ID NO: 517878 - DNA, 16 bp, R. norvegicus
tcagtaaagctctggc

SEQ ID NO: 517879 - DNA, 16 bp, R. norvegicus
tcagtaaagtgtgtgt

SEQ ID NO: 517880 - DNA, 16 bp, R. norvegicus
tcagtaacaacaaaaa

SEQ ID NO: 517881 - DNA, 20 bp, R. norvegicus
tcagtaactgtcagtcaccc

SEQ ID NO: 517882 - DNA, 16 bp, R. norvegicus
tcagtacctgtggctc

SEQ ID NO: 517883 - DNA, 16 bp, R. norvegicus
tcagtagccttgctct

SEQ ID NO: 517884 - DNA, 16 bp, R. norvegicus
tcagtaggtggcagag

SEQ ID NO: 517885 - DNA, 16 bp, R. norvegicus
tcagtataacagaggc

SEQ ID NO: 517886 - DNA, 16 bp, R. norvegicus
tcagtatatagaagaa

SEQ ID NO: 517887 - DNA, 16 bp, R. norvegicus
tcagtatctgctgtca

SEQ ID NO: 517888 - DNA, 16 bp, R. norvegicus
tcagtatttcttagaa

SEQ ID NO: 517889 - DNA, 16 bp, R. norvegicus
tcagtcaaagaagatg

SEQ ID NO: 517890 - DNA, 16 bp, R. norvegicus
tcagtcagctgctgct

SEQ ID NO: 517891 - DNA, 16 bp, R. norvegicus
tcagtcagggaagatg

SEQ ID NO: 517892 - DNA, 16 bp, R. norvegicus
tcagtcatagcaggac

SEQ ID NO: 517893 - DNA, 16 bp, R. norvegicus
tcagtcattcagcatt

SEQ ID NO: 517894 - DNA, 16 bp, R. norvegicus
tcagtccaaattcaaa

SEQ ID NO: 517895 - DNA, 24 bp, R. norvegicus
tcagtccaagatttcaaacacagt

SEQ ID NO: 517896 - DNA, 16 bp, R. norvegicus
tcagtccaatggttgg

SEQ ID NO: 517897 - DNA, 16 bp, R. norvegicus
tcagtccccaacactg

SEQ ID NO: 517898 - DNA, 16 bp, R. norvegicus
tcagtccccaggaccc

SEQ ID NO: 517899 - DNA, 16 bp, R. norvegicus
tcagtccccagttctg

SEQ ID NO: 517900 - DNA, 16 bp, R. norvegicus
tcagtccctgcctggc

SEQ ID NO: 517901 - DNA, 16 bp, R. norvegicus
tcagtccctgggaccc

SEQ ID NO: 517902 - DNA, 16 bp, R. norvegicus
tcagtcctgggcacag

SEQ ID NO: 517903 - DNA, 16 bp, R. norvegicus
tcagtccttgctccac

SEQ ID NO: 517904 - DNA, 16 bp, R. norvegicus
tcagtcctttccccca

SEQ ID NO: 517905 - DNA, 16 bp, R. norvegicus
tcagtcctttctaaga

SEQ ID NO: 517906 - DNA, 16 bp, R. norvegicus
tcagtctcacttggga

SEQ ID NO: 517907 - DNA, 16 bp, R. norvegicus
tcagtctcagctccaa

SEQ ID NO: 517908 - DNA, 16 bp, R. norvegicus
tcagtctcaggaggag

SEQ ID NO: 517909 - DNA, 16 bp, R. norvegicus
tcagtctctgctctag

SEQ ID NO: 517910 - DNA, 16 bp, R. norvegicus
tcagtctctgcttcct

SEQ ID NO: 517911 - DNA, 16 bp, R. norvegicus
tcagtctctgttccct

SEQ ID NO: 517912 - DNA, 18 bp, R. norvegicus
tcagtctcttctggtttc

SEQ ID NO: 517913 - DNA, 16 bp, R. norvegicus
tcagtctggaagatcc

SEQ ID NO: 517914 - DNA, 18 bp, R. norvegicus
tcagtctggaggctcctc

SEQ ID NO: 517915 - DNA, 16 bp, R. norvegicus
tcagtgaagaaagcaa

SEQ ID NO: 517916 - DNA, 16 bp, R. norvegicus
tcagtgaataaagcta

SEQ ID NO: 517917 - DNA, 16 bp, R. norvegicus
tcagtgacagagacag

SEQ ID NO: 517918 - DNA, 16 bp, R. norvegicus
tcagtgagagaacctg

SEQ ID NO: 517919 - DNA, 16 bp, R. norvegicus
tcagtgagagatgctg

SEQ ID NO: 517920 - DNA, 16 bp, R. norvegicus
tcagtgagcagcaccc

SEQ ID NO: 517921 - DNA, 16 bp, R. norvegicus
tcagtgagctccaagt

SEQ ID NO: 517922 - DNA, 16 bp, R. norvegicus
tcagtgagtaaagaca

SEQ ID NO: 517923 - DNA, 16 bp, R. norvegicus
tcagtgcccacagagg

SEQ ID NO: 517924 - DNA, 17 bp, R. norvegicus
tcagtgcctctgcagcc

SEQ ID NO: 517925 - DNA, 16 bp, R. norvegicus
tcagtgctcttaagca

SEQ ID NO: 517926 - DNA, 16 bp, R. norvegicus
tcagtgctcttagcca

SEQ ID NO: 517927 - DNA, 16 bp, R. norvegicus
tcagtgctcttgactg

SEQ ID NO: 517928 - DNA, 16 bp, R. norvegicus
tcagtggagagaaagt

SEQ ID NO: 517929 - DNA, 16 bp, R. norvegicus
tcagtggcagtgggtc

SEQ ID NO: 517930 - DNA, 16 bp, R. norvegicus
tcagtgggaggaaagg

SEQ ID NO: 517931 - DNA, 16 bp, R. norvegicus
tcagtgggctagaagg

SEQ ID NO: 517932 - DNA, 16 bp, R. norvegicus
tcagtgggtgaagatg

SEQ ID NO: 517933 - DNA, 16 bp, R. norvegicus
tcagtggttaaagtgc

SEQ ID NO: 517934 - DNA, 18 bp, R. norvegicus
tcagtggttaagagcact

SEQ ID NO: 517935 - DNA, 17 bp, R. norvegicus
tcagtggttaagagcat

SEQ ID NO: 517936 - DNA, 16 bp, R. norvegicus
tcagtgtctgagaaat

SEQ ID NO: 517937 - DNA, 16 bp, R. norvegicus
tcagtgtcttctccat

SEQ ID NO: 517938 - DNA, 16 bp, R. norvegicus
tcagtgtctttaagtt

SEQ ID NO: 517939 - DNA, 16 bp, R. norvegicus
tcagtgtgtaaaggtg

SEQ ID NO: 517940 - DNA, 16 bp, R. norvegicus
tcagtgtgtgtgtgtg

SEQ ID NO: 517941 - DNA, 16 bp, R. norvegicus
tcagtgtgtgtttgtg

SEQ ID NO: 517942 - DNA, 22 bp, R. norvegicus
tcagtgttaccgctgcgtgtgt

SEQ ID NO: 517943 - DNA, 16 bp, R. norvegicus
tcagtgttcttaaccc

SEQ ID NO: 517944 - DNA, 16 bp, R. norvegicus
tcagtgtttaagagtg

SEQ ID NO: 517945 - DNA, 16 bp, R. norvegicus
tcagttaaaaataaaa

SEQ ID NO: 517946 - DNA, 48 bp, R. norvegicus
tcagttactactgtactttattgtgttcaaccaaatcaccatgttaca

SEQ ID NO: 517947 - DNA, 16 bp, R. norvegicus
tcagttattaagaaca

SEQ ID NO: 517948 - DNA, 16 bp, R. norvegicus
tcagttcacagcagta

SEQ ID NO: 517949 - DNA, 16 bp, R. norvegicus
tcagttccagctcagg

SEQ ID NO: 517950 - DNA, 16 bp, R. norvegicus
tcagttcccagctctg

SEQ ID NO: 517951 - DNA, 16 bp, R. norvegicus
tcagttcctgccctgt

SEQ ID NO: 517952 - DNA, 16 bp, R. norvegicus
tcagttccttcctcca

SEQ ID NO: 517953 - DNA, 16 bp, R. norvegicus
tcagttctcagcatcc

SEQ ID NO: 517954 - DNA, 16 bp, R. norvegicus
tcagttctcccactac

SEQ ID NO: 517955 - DNA, 16 bp, R. norvegicus
tcagttctgggcacag

SEQ ID NO: 517956 - DNA, 16 bp, R. norvegicus
tcagttctgtcctggg

SEQ ID NO: 517957 - DNA, 16 bp, R. norvegicus
tcagttctgttcttct

SEQ ID NO: 517958 - DNA, 16 bp, R. norvegicus
tcagttgaaccagcac

SEQ ID NO: 517959 - DNA, 16 bp, R. norvegicus
tcagttgtggagagct

SEQ ID NO: 517960 - DNA, 16 bp, R. norvegicus
tcagtttccccatctg

SEQ ID NO: 517961 - DNA, 16 bp, R. norvegicus
tcagtttccccatctt

SEQ ID NO: 517962 - DNA, 16 bp, R. norvegicus
tcagtttccttctctg

SEQ ID NO: 517963 - DNA, 16 bp, R. norvegicus
tcagtttcttcagaga

SEQ ID NO: 517964 - DNA, 16 bp, R. norvegicus
tcagtttgcagagagc

SEQ ID NO: 517965 - DNA, 16 bp, R. norvegicus
tcagtttgtctctgat

SEQ ID NO: 517966 - DNA, 16 bp, R. norvegicus
tcagtttgtgagaatt

SEQ ID NO: 517967 - DNA, 16 bp, R. norvegicus
tcagtttgtgtgtgtg

SEQ ID NO: 517968 - DNA, 16 bp, R. norvegicus
tcagttttctcttttc

SEQ ID NO: 517969 - DNA, 16 bp, R. norvegicus
tcagttttctgtggct

SEQ ID NO: 517970 - DNA, 16 bp, R. norvegicus
tcagtttttcaagaca

SEQ ID NO: 517971 - DNA, 16 bp, R. norvegicus
tcataaaaattgtatg

SEQ ID NO: 517972 - DNA, 16 bp, R. norvegicus
tcataaaagaaaatat

SEQ ID NO: 517973 - DNA, 16 bp, R. norvegicus
tcataaaagaaacgtt

SEQ ID NO: 517974 - DNA, 16 bp, R. norvegicus
tcataaaagaagcttt

SEQ ID NO: 517975 - DNA, 16 bp, R. norvegicus
tcataaaatatttgaa

SEQ ID NO: 517976 - DNA, 16 bp, R. norvegicus
tcataaagaaatagaa

SEQ ID NO: 517977 - DNA, 16 bp, R. norvegicus
tcataaagatgataga

SEQ ID NO: 517978 - DNA, 16 bp, R. norvegicus
tcataaagatttttca

SEQ ID NO: 517979 - DNA, 16 bp, R. norvegicus
tcataaaggcatttcc

SEQ ID NO: 517980 - DNA, 16 bp, R. norvegicus
tcataacagaagcaaa

SEQ ID NO: 517981 - DNA, 16 bp, R. norvegicus
tcataatgatgataga

SEQ ID NO: 517982 - DNA, 16 bp, R. norvegicus
tcatacaactgcaaag

SEQ ID NO: 517983 - DNA, 16 bp, R. norvegicus
tcatacacactcacac

SEQ ID NO: 517984 - DNA, 16 bp, R. norvegicus
tcatacacatatacac

SEQ ID NO: 517985 - DNA, 16 bp, R. norvegicus
tcatacaggagagaaa

SEQ ID NO: 517986 - DNA, 16 bp, R. norvegicus
tcatactaaatggaga

SEQ ID NO: 517987 - DNA, 16 bp, R. norvegicus
tcatactggagagaaa

SEQ ID NO: 517988 - DNA, 16 bp, R. norvegicus
tcatagaaatagaaat

SEQ ID NO: 517989 - DNA, 16 bp, R. norvegicus
tcatagaagaaaaatt

SEQ ID NO: 517990 - DNA, 16 bp, R. norvegicus
tcatagaagaaattgg

SEQ ID NO: 517991 - DNA, 16 bp, R. norvegicus
tcatagaagcaggagg

SEQ ID NO: 517992 - DNA, 17 bp, R. norvegicus
tcatagacatcttgcag

SEQ ID NO: 517993 - DNA, 16 bp, R. norvegicus
tcatagatgcaaatat

SEQ ID NO: 517994 - DNA, 16 bp, R. norvegicus
tcatagcaacagaaac

SEQ ID NO: 517995 - DNA, 16 bp, R. norvegicus
tcatatacatatacac

SEQ ID NO: 517996 - DNA, 16 bp, R. norvegicus
tcatatatttacatta

SEQ ID NO: 517997 - DNA, 16 bp, R. norvegicus
tcatatctatcaccct

SEQ ID NO: 517998 - DNA, 16 bp, R. norvegicus
tcatatctggctcctg

SEQ ID NO: 517999 - DNA, 16 bp, R. norvegicus
tcatcaaaacagaaac

SEQ ID NO: 518000 - DNA, 16 bp, R. norvegicus
tcatcaaaatgtgaaa

SEQ ID NO: 518001 - DNA, 16 bp, R. norvegicus
tcatcaaagaagaaat

SEQ ID NO: 518002 - DNA, 16 bp, R. norvegicus
tcatcaaagaagcttc

SEQ ID NO: 518003 - DNA, 16 bp, R. norvegicus
tcatcaaaggaaaaaa

SEQ ID NO: 518004 - DNA, 16 bp, R. norvegicus
tcatcaaaggacagat

SEQ ID NO: 518005 - DNA, 16 bp, R. norvegicus
tcatcaacatcatcat

SEQ ID NO: 518006 - DNA, 16 bp, R. norvegicus
tcatcaagaaaacaaa

SEQ ID NO: 518007 - DNA, 16 bp, R. norvegicus
tcatcaaggaaaaaaa

SEQ ID NO: 518008 - DNA, 16 bp, R. norvegicus
tcatcaaggaccaact

SEQ ID NO: 518009 - DNA, 16 bp, R. norvegicus
tcatcaaggcaggagc

SEQ ID NO: 518010 - DNA, 16 bp, R. norvegicus
tcatcaatctcatcta

SEQ ID NO: 518011 - DNA, 16 bp, R. norvegicus
tcatcaatgcgctgca

SEQ ID NO: 518012 - DNA, 16 bp, R. norvegicus
tcatcacaggaaaaat

SEQ ID NO: 518013 - DNA, 16 bp, R. norvegicus
tcatcacagtgacaga

SEQ ID NO: 518014 - DNA, 16 bp, R. norvegicus
tcatcacagtgctcca

SEQ ID NO: 518015 - DNA, 16 bp, R. norvegicus
tcatcaccaccatcat

SEQ ID NO: 518016 - DNA, 16 bp, R. norvegicus
tcatcaccatcacctc

SEQ ID NO: 518017 - DNA, 16 bp, R. norvegicus
tcatcaccatcactat

SEQ ID NO: 518018 - DNA, 16 bp, R. norvegicus
tcatcaccatcatccc

SEQ ID NO: 518019 - DNA, 16 bp, R. norvegicus
tcatcaccatcatcct

SEQ ID NO: 518020 - DNA, 16 bp, R. norvegicus
tcatcaccatcatctt

SEQ ID NO: 518021 - DNA, 16 bp, R. norvegicus
tcatcaccctgtacaa

SEQ ID NO: 518022 - DNA, 16 bp, R. norvegicus
tcatcacttcccaggg

SEQ ID NO: 518023 - DNA, 16 bp, R. norvegicus
tcatcagatcctccta

SEQ ID NO: 518024 - DNA, 16 bp, R. norvegicus
tcatcagcaaagacca

SEQ ID NO: 518025 - DNA, 16 bp, R. norvegicus
tcatcaggagatgtga

SEQ ID NO: 518026 - DNA, 16 bp, R. norvegicus
tcatcagtgaccttcc

SEQ ID NO: 518027 - DNA, 16 bp, R. norvegicus
tcatcagtttgtctct

SEQ ID NO: 518028 - DNA, 16 bp, R. norvegicus
tcatcatcaacatcat

SEQ ID NO: 518029 - DNA, 16 bp, R. norvegicus
tcatcatcaccaccat

SEQ ID NO: 518030 - DNA, 16 bp, R. norvegicus
tcatcatcaccatcaa

SEQ ID NO: 518031 - DNA, 16 bp, R. norvegicus
tcatcatcatcacttt

SEQ ID NO: 518032 - DNA, 16 bp, R. norvegicus
tcatcatcatcatatt

SEQ ID NO: 518033 - DNA, 16 bp, R. norvegicus
tcatcatcatcatcct

SEQ ID NO: 518034 - DNA, 16 bp, R. norvegicus
tcatcatcatcatcgt

SEQ ID NO: 518035 - DNA, 16 bp, R. norvegicus
tcatcatcatcatgac

SEQ ID NO: 518036 - DNA, 16 bp, R. norvegicus
tcatcatcatcatgat

SEQ ID NO: 518037 - DNA, 16 bp, R. norvegicus
tcatcatcatccttct

SEQ ID NO: 518038 - DNA, 16 bp, R. norvegicus
tcatcatcatcgccat

SEQ ID NO: 518039 - DNA, 16 bp, R. norvegicus
tcatcatcctcatcat

SEQ ID NO: 518040 - DNA, 16 bp, R. norvegicus
tcatcatcctcttcct

SEQ ID NO: 518041 - DNA, 16 bp, R. norvegicus
tcatcatcttcctctt

SEQ ID NO: 518042 - DNA, 16 bp, R. norvegicus
tcatcatgatcatcat

SEQ ID NO: 518043 - DNA, 16 bp, R. norvegicus
tcatcatggtcatcat

SEQ ID NO: 518044 - DNA, 16 bp, R. norvegicus
tcatcatggtggagaa

SEQ ID NO: 518045 - DNA, 16 bp, R. norvegicus
tcatcattgtcatcat

SEQ ID NO: 518046 - DNA, 16 bp, R. norvegicus
tcatccaagtgttcat

SEQ ID NO: 518047 - DNA, 16 bp, R. norvegicus
tcatccagacaaaaac

SEQ ID NO: 518048 - DNA, 16 bp, R. norvegicus
tcatccagagactgca

SEQ ID NO: 518049 - DNA, 19 bp, R. norvegicus
tcatccagctcttattcat

SEQ ID NO: 518050 - DNA, 16 bp, R. norvegicus
tcatccaggcaggcat

SEQ ID NO: 518051 - DNA, 16 bp, R. norvegicus
tcatccagttatggga

SEQ ID NO: 518052 - DNA, 16 bp, R. norvegicus
tcatccatctgtccat

SEQ ID NO: 518053 - DNA, 16 bp, R. norvegicus
tcatccatcttgtcaa

SEQ ID NO: 518054 - DNA, 16 bp, R. norvegicus
tcatccattcatctat

SEQ ID NO: 518055 - DNA, 16 bp, R. norvegicus
tcatcccagagatgaa

SEQ ID NO: 518056 - DNA, 16 bp, R. norvegicus
tcatcccagagatgga

SEQ ID NO: 518057 - DNA, 16 bp, R. norvegicus
tcatcccaggaatgca

SEQ ID NO: 518058 - DNA, 16 bp, R. norvegicus
tcatcccagggatgct

SEQ ID NO: 518059 - DNA, 16 bp, R. norvegicus
tcatcccatctgcaga

SEQ ID NO: 518060 - DNA, 16 bp, R. norvegicus
tcatcccattcttcct

SEQ ID NO: 518061 - DNA, 16 bp, R. norvegicus
tcatccccacagacac

SEQ ID NO: 518062 - DNA, 16 bp, R. norvegicus
tcatccccactgagtc

SEQ ID NO: 518063 - DNA, 16 bp, R. norvegicus
tcatcctaaaacagaa

SEQ ID NO: 518064 - DNA, 16 bp, R. norvegicus
tcatcctcatcaccat

SEQ ID NO: 518065 - DNA, 16 bp, R. norvegicus
tcatcctcctgcctcc

SEQ ID NO: 518066 - DNA, 16 bp, R. norvegicus
tcatcctcgccagcat

SEQ ID NO: 518067 - DNA, 16 bp, R. norvegicus
tcatcctctgctacat

SEQ ID NO: 518068 - DNA, 16 bp, R. norvegicus
tcatcctgctgggggt

SEQ ID NO: 518069 - DNA, 16 bp, R. norvegicus
tcatcctgggctacag

SEQ ID NO: 518070 - DNA, 16 bp, R. norvegicus
tcatcctggtctacag

SEQ ID NO: 518071 - DNA, 16 bp, R. norvegicus
tcatccttcttatcta

SEQ ID NO: 518072 - DNA, 16 bp, R. norvegicus
tcatccttcttcagct

SEQ ID NO: 518073 - DNA, 16 bp, R. norvegicus
tcatccttgccagcat

SEQ ID NO: 518074 - DNA, 16 bp, R. norvegicus
tcatcgccagcatctg

SEQ ID NO: 518075 - DNA, 16 bp, R. norvegicus
tcatctacacaatgga

SEQ ID NO: 518076 - DNA, 16 bp, R. norvegicus
tcatctacctgtctgt

SEQ ID NO: 518077 - DNA, 16 bp, R. norvegicus
tcatctcactcagcag

SEQ ID NO: 518078 - DNA, 16 bp, R. norvegicus
tcatctcagctgctgt

SEQ ID NO: 518079 - DNA, 16 bp, R. norvegicus
tcatctcagttggtgt

SEQ ID NO: 518080 - DNA, 16 bp, R. norvegicus
tcatctcatgagatgc

SEQ ID NO: 518081 - DNA, 16 bp, R. norvegicus
tcatctccagttccag

SEQ ID NO: 518082 - DNA, 16 bp, R. norvegicus
tcatctccatcttgat

SEQ ID NO: 518083 - DNA, 16 bp, R. norvegicus
tcatctccctagcccc

SEQ ID NO: 518084 - DNA, 16 bp, R. norvegicus
tcatctccctctgctt

SEQ ID NO: 518085 - DNA, 16 bp, R. norvegicus
tcatctccttctccag

SEQ ID NO: 518086 - DNA, 16 bp, R. norvegicus
tcatctctctgtccct

SEQ ID NO: 518087 - DNA, 16 bp, R. norvegicus
tcatctctgccttctc

SEQ ID NO: 518088 - DNA, 16 bp, R. norvegicus
tcatctgaagaatgga

SEQ ID NO: 518089 - DNA, 16 bp, R. norvegicus
tcatctgaaggctgct

SEQ ID NO: 518090 - DNA, 16 bp, R. norvegicus
tcatctgagaggaaag

SEQ ID NO: 518091 - DNA, 16 bp, R. norvegicus
tcatctgagattttga

SEQ ID NO: 518092 - DNA, 16 bp, R. norvegicus
tcatctgagtcctgag

SEQ ID NO: 518093 - DNA, 23 bp, R. norvegicus
tcatctgcaaatagtgatatttt

SEQ ID NO: 518094 - DNA, 16 bp, R. norvegicus
tcatctgcccctcaga

SEQ ID NO: 518095 - DNA, 16 bp, R. norvegicus
tcatctgcctttgcct

SEQ ID NO: 518096 - DNA, 39 bp, R. norvegicus
tcatctggaaccctggtgcacggaggctcccggaaagag

SEQ ID NO: 518097 - DNA, 16 bp, R. norvegicus
tcatctgtaaatagtg

SEQ ID NO: 518098 - DNA, 16 bp, R. norvegicus
tcatcttcatcatctt

SEQ ID NO: 518099 - DNA, 16 bp, R. norvegicus
tcatcttcatcttcct

SEQ ID NO: 518100 - DNA, 16 bp, R. norvegicus
tcatcttcctcatcct

SEQ ID NO: 518101 - DNA, 16 bp, R. norvegicus
tcatcttcctgaggaa

SEQ ID NO: 518102 - DNA, 16 bp, R. norvegicus
tcatcttctgctacat

SEQ ID NO: 518103 - DNA, 16 bp, R. norvegicus
tcatcttgatttgcat

SEQ ID NO: 518104 - DNA, 17 bp, R. norvegicus
tcatcttggaggatttt

SEQ ID NO: 518105 - DNA, 17 bp, R. norvegicus
tcatcttggtggacttt

SEQ ID NO: 518106 - DNA, 16 bp, R. norvegicus
tcatcttggtgggttt

SEQ ID NO: 518107 - DNA, 16 bp, R. norvegicus
tcatctttcagtttgt

SEQ ID NO: 518108 - DNA, 16 bp, R. norvegicus
tcatctttgtcttcct

SEQ ID NO: 518109 - DNA, 16 bp, R. norvegicus
tcatgaaaatggcatc

SEQ ID NO: 518110 - DNA, 16 bp, R. norvegicus
tcatgaaaccaaaaag

SEQ ID NO: 518111 - DNA, 16 bp, R. norvegicus
tcatgaagagaactgt

SEQ ID NO: 518112 - DNA, 16 bp, R. norvegicus
tcatgaagttgttttt

SEQ ID NO: 518113 - DNA, 16 bp, R. norvegicus
tcatgaattcaaagcc

SEQ ID NO: 518114 - DNA, 16 bp, R. norvegicus
tcatgacaaaactaaa

SEQ ID NO: 518115 - DNA, 16 bp, R. norvegicus
tcatgacaggaaacat

SEQ ID NO: 518116 - DNA, 16 bp, R. norvegicus
tcatgacctcatcagg

SEQ ID NO: 518117 - DNA, 16 bp, R. norvegicus
tcatgactcaacaaac

SEQ ID NO: 518118 - DNA, 16 bp, R. norvegicus
tcatgactgctctcca

SEQ ID NO: 518119 - DNA, 16 bp, R. norvegicus
tcatgactgtaatttt

SEQ ID NO: 518120 - DNA, 16 bp, R. norvegicus
tcatgagatccagctg

SEQ ID NO: 518121 - DNA, 16 bp, R. norvegicus
tcatgagcatgtggag

SEQ ID NO: 518122 - DNA, 16 bp, R. norvegicus
tcatgatgacaatgga

SEQ ID NO: 518123 - DNA, 16 bp, R. norvegicus
tcatgatgatgattga

SEQ ID NO: 518124 - DNA, 16 bp, R. norvegicus
tcatgatgcaggagga

SEQ ID NO: 518125 - DNA, 16 bp, R. norvegicus
tcatgatgggaagcat

SEQ ID NO: 518126 - DNA, 16 bp, R. norvegicus
tcatgatgtcattgtt

SEQ ID NO: 518127 - DNA, 16 bp, R. norvegicus
tcatgatgttcattgg

SEQ ID NO: 518128 - DNA, 16 bp, R. norvegicus
tcatgatgtttaccct

SEQ ID NO: 518129 - DNA, 16 bp, R. norvegicus
tcatgatgtttgttca

SEQ ID NO: 518130 - DNA, 16 bp, R. norvegicus
tcatgatgttttatca

SEQ ID NO: 518131 - DNA, 16 bp, R. norvegicus
tcatgattaatgattg

SEQ ID NO: 518132 - DNA, 16 bp, R. norvegicus
tcatgcatgctaggca

SEQ ID NO: 518133 - DNA, 16 bp, R. norvegicus
tcatgcccctgcctca

SEQ ID NO: 518134 - DNA, 16 bp, R. norvegicus
tcatgctctggcaaag

SEQ ID NO: 518135 - DNA, 16 bp, R. norvegicus
tcatgctgcagctgga

SEQ ID NO: 518136 - DNA, 16 bp, R. norvegicus
tcatgctgctgctgct

SEQ ID NO: 518137 - DNA, 16 bp, R. norvegicus
tcatggaactgaaaag

SEQ ID NO: 518138 - DNA, 16 bp, R. norvegicus
tcatggacagaaaatg

SEQ ID NO: 518139 - DNA, 16 bp, R. norvegicus
tcatggagagcagctg

SEQ ID NO: 518140 - DNA, 16 bp, R. norvegicus
tcatggagagctgaaa

SEQ ID NO: 518141 - DNA, 16 bp, R. norvegicus
tcatggagctggagag

SEQ ID NO: 518142 - DNA, 16 bp, R. norvegicus
tcatggagggaagtca

SEQ ID NO: 518143 - DNA, 16 bp, R. norvegicus
tcatggagtcatttcc

SEQ ID NO: 518144 - DNA, 16 bp, R. norvegicus
tcatggattggaaaga

SEQ ID NO: 518145 - DNA, 16 bp, R. norvegicus
tcatggcagcaggcag

SEQ ID NO: 518146 - DNA, 16 bp, R. norvegicus
tcatggccaacatccc

SEQ ID NO: 518147 - DNA, 16 bp, R. norvegicus
tcatggccaacctgtc

SEQ ID NO: 518148 - DNA, 16 bp, R. norvegicus
tcatggctgacctcta

SEQ ID NO: 518149 - DNA, 16 bp, R. norvegicus
tcatggctgccctctg

SEQ ID NO: 518150 - DNA, 16 bp, R. norvegicus
tcatggctttctcagc

SEQ ID NO: 518151 - DNA, 16 bp, R. norvegicus
tcatgggactttgttt

SEQ ID NO: 518152 - DNA, 16 bp, R. norvegicus
tcatgggattgcttca

SEQ ID NO: 518153 - DNA, 16 bp, R. norvegicus
tcatgggcatctcttc

SEQ ID NO: 518154 - DNA, 16 bp, R. norvegicus
tcatgggttgctccat

SEQ ID NO: 518155 - DNA, 16 bp, R. norvegicus
tcatggtacgttctcc

SEQ ID NO: 518156 - DNA, 16 bp, R. norvegicus
tcatggtcatggtcat

SEQ ID NO: 518157 - DNA, 16 bp, R. norvegicus
tcatggtgattctcct

SEQ ID NO: 518158 - DNA, 16 bp, R. norvegicus
tcatggtgatttcagt

SEQ ID NO: 518159 - DNA, 16 bp, R. norvegicus
tcatggtggacaggaa

SEQ ID NO: 518160 - DNA, 16 bp, R. norvegicus
tcatggtggatgatct

SEQ ID NO: 518161 - DNA, 16 bp, R. norvegicus
tcatggtgtctctgca

SEQ ID NO: 518162 - DNA, 16 bp, R. norvegicus
tcatggtttctgcttc

SEQ ID NO: 518163 - DNA, 16 bp, R. norvegicus
tcatgtagatctttca

SEQ ID NO: 518164 - DNA, 16 bp, R. norvegicus
tcatgtatgctaggca

SEQ ID NO: 518165 - DNA, 16 bp, R. norvegicus
tcatgtatgtacacat

SEQ ID NO: 518166 - DNA, 16 bp, R. norvegicus
tcatgtctctgaagaa

SEQ ID NO: 518167 - DNA, 16 bp, R. norvegicus
tcatgtctgtgaagaa

SEQ ID NO: 518168 - DNA, 16 bp, R. norvegicus
tcatgtgcacacacac

SEQ ID NO: 518169 - DNA, 16 bp, R. norvegicus
tcatgtggaatgtgga

SEQ ID NO: 518170 - DNA, 16 bp, R. norvegicus
tcatgtgggaccccta

SEQ ID NO: 518171 - DNA, 16 bp, R. norvegicus
tcatgtggtctgggaa

SEQ ID NO: 518172 - DNA, 16 bp, R. norvegicus
tcatgtggtgctggga

SEQ ID NO: 518173 - DNA, 16 bp, R. norvegicus
tcatgtggtttttctt

SEQ ID NO: 518174 - DNA, 16 bp, R. norvegicus
tcatgtgtgtgtgtgt

SEQ ID NO: 518175 - DNA, 16 bp, R. norvegicus
tcatgtgttccagatg

SEQ ID NO: 518176 - DNA, 16 bp, R. norvegicus
tcatgtgtttgagatt

SEQ ID NO: 518177 - DNA, 16 bp, R. norvegicus
tcatgttctttctctt

SEQ ID NO: 518178 - DNA, 16 bp, R. norvegicus
tcatgttgcagtgacc

SEQ ID NO: 518179 - DNA, 16 bp, R. norvegicus
tcatgttggagttttc

SEQ ID NO: 518180 - DNA, 16 bp, R. norvegicus
tcatgttgtggtgacc

SEQ ID NO: 518181 - DNA, 16 bp, R. norvegicus
tcatgtttgtgtgctt

SEQ ID NO: 518182 - DNA, 16 bp, R. norvegicus
tcatgttttcctgtgt

SEQ ID NO: 518183 - DNA, 16 bp, R. norvegicus
tcattaaaaacaatga

SEQ ID NO: 518184 - DNA, 16 bp, R. norvegicus
tcattaaaaagataag

SEQ ID NO: 518185 - DNA, 16 bp, R. norvegicus
tcattaataaagaaaa

SEQ ID NO: 518186 - DNA, 28 bp, R. norvegicus
tcattacagatggttgtgagccaccatg

SEQ ID NO: 518187 - DNA, 16 bp, R. norvegicus
tcattacagatggttt

SEQ ID NO: 518188 - DNA, 16 bp, R. norvegicus
tcattagaggctgaga

SEQ ID NO: 518189 - DNA, 16 bp, R. norvegicus
tcattattattattgt

SEQ ID NO: 518190 - DNA, 16 bp, R. norvegicus
tcattcaacccaccac

SEQ ID NO: 518191 - DNA, 16 bp, R. norvegicus
tcattcactcttcaca

SEQ ID NO: 518192 - DNA, 16 bp, R. norvegicus
tcattcagaacctgcc

SEQ ID NO: 518193 - DNA, 16 bp, R. norvegicus
tcattcaggaggactt

SEQ ID NO: 518194 - DNA, 16 bp, R. norvegicus
tcattcagtccttccc

SEQ ID NO: 518195 - DNA, 16 bp, R. norvegicus
tcattcagttcctgga

SEQ ID NO: 518196 - DNA, 16 bp, R. norvegicus
tcattcattcatttaa

SEQ ID NO: 518197 - DNA, 16 bp, R. norvegicus
tcattccaaggatgca

SEQ ID NO: 518198 - DNA, 16 bp, R. norvegicus
tcattccaagttctta

SEQ ID NO: 518199 - DNA, 16 bp, R. norvegicus
tcattccagggatgaa

SEQ ID NO: 518200 - DNA, 16 bp, R. norvegicus
tcattccatccatcca

SEQ ID NO: 518201 - DNA, 16 bp, R. norvegicus
tcattccatggatgca

SEQ ID NO: 518202 - DNA, 16 bp, R. norvegicus
tcattccattcctcct

SEQ ID NO: 518203 - DNA, 16 bp, R. norvegicus
tcattccatttgccaa

SEQ ID NO: 518204 - DNA, 16 bp, R. norvegicus
tcattcctgtctactg

SEQ ID NO: 518205 - DNA, 16 bp, R. norvegicus
tcattctcctggccat

SEQ ID NO: 518206 - DNA, 16 bp, R. norvegicus
tcattctctgctccac

SEQ ID NO: 518207 - DNA, 16 bp, R. norvegicus
tcattctctggcttca

SEQ ID NO: 518208 - DNA, 16 bp, R. norvegicus
tcattctcttcagaca

SEQ ID NO: 518209 - DNA, 16 bp, R. norvegicus
tcattctcttgctcat

SEQ ID NO: 518210 - DNA, 16 bp, R. norvegicus
tcattctgtttctatt

SEQ ID NO: 518211 - DNA, 16 bp, R. norvegicus
tcattcttatggggtt

SEQ ID NO: 518212 - DNA, 16 bp, R. norvegicus
tcattcttcacagaaa

SEQ ID NO: 518213 - DNA, 16 bp, R. norvegicus
tcattcttggatttct

SEQ ID NO: 518214 - DNA, 16 bp, R. norvegicus
tcattcttttaaaaat

SEQ ID NO: 518215 - DNA, 16 bp, R. norvegicus
tcattgaaaacaaaac

SEQ ID NO: 518216 - DNA, 16 bp, R. norvegicus
tcattgatttttttaa

SEQ ID NO: 518217 - DNA, 16 bp, R. norvegicus
tcattgatttttttca

SEQ ID NO: 518218 - DNA, 16 bp, R. norvegicus
tcattgctacctttga

SEQ ID NO: 518219 - DNA, 16 bp, R. norvegicus
tcattgctacttccta

SEQ ID NO: 518220 - DNA, 16 bp, R. norvegicus
tcattgctgctctttt

SEQ ID NO: 518221 - DNA, 16 bp, R. norvegicus
tcattggaggagaaga

SEQ ID NO: 518222 - DNA, 16 bp, R. norvegicus
tcattggtacaggaga

SEQ ID NO: 518223 - DNA, 16 bp, R. norvegicus
tcattggtttaccaag

SEQ ID NO: 518224 - DNA, 16 bp, R. norvegicus
tcattgtattccataa

SEQ ID NO: 518225 - DNA, 16 bp, R. norvegicus
tcattgtcaccatcat

SEQ ID NO: 518226 - DNA, 16 bp, R. norvegicus
tcattgtcatcatcat

SEQ ID NO: 518227 - DNA, 16 bp, R. norvegicus
tcattgtctttgatag

SEQ ID NO: 518228 - DNA, 16 bp, R. norvegicus
tcattgtgactttaac

SEQ ID NO: 518229 - DNA, 16 bp, R. norvegicus
tcattgtgggaagcat

SEQ ID NO: 518230 - DNA, 16 bp, R. norvegicus
tcattgtgggtgtggg

SEQ ID NO: 518231 - DNA, 16 bp, R. norvegicus
tcatttatcaagaaaa

SEQ ID NO: 518232 - DNA, 16 bp, R. norvegicus
tcatttatggggacag

SEQ ID NO: 518233 - DNA, 16 bp, R. norvegicus
tcatttattacatgct

SEQ ID NO: 518234 - DNA, 16 bp, R. norvegicus
tcatttatttgaaaat

SEQ ID NO: 518235 - DNA, 16 bp, R. norvegicus
tcatttcaaaaaggaa

SEQ ID NO: 518236 - DNA, 16 bp, R. norvegicus
tcatttcctgcctcca

SEQ ID NO: 518237 - DNA, 16 bp, R. norvegicus
tcatttctctaatttc

SEQ ID NO: 518238 - DNA, 16 bp, R. norvegicus
tcatttctgcatcttc

SEQ ID NO: 518239 - DNA, 16 bp, R. norvegicus
tcatttctggttcttt

SEQ ID NO: 518240 - DNA, 16 bp, R. norvegicus
tcatttctgtctttat

SEQ ID NO: 518241 - DNA, 16 bp, R. norvegicus
tcatttctgttccttt

SEQ ID NO: 518242 - DNA, 16 bp, R. norvegicus
tcatttgaaaagaaaa

SEQ ID NO: 518243 - DNA, 16 bp, R. norvegicus
tcatttgaagtaggaa

SEQ ID NO: 518244 - DNA, 16 bp, R. norvegicus
tcatttgcatttccct

SEQ ID NO: 518245 - DNA, 16 bp, R. norvegicus
tcatttggaacaacaa

SEQ ID NO: 518246 - DNA, 16 bp, R. norvegicus
tcatttgggaagaggg

SEQ ID NO: 518247 - DNA, 16 bp, R. norvegicus
tcatttggtgatgaga

SEQ ID NO: 518248 - DNA, 16 bp, R. norvegicus
tcatttgttctgtgca

SEQ ID NO: 518249 - DNA, 16 bp, R. norvegicus
tcatttgtttgcttgt

SEQ ID NO: 518250 - DNA, 16 bp, R. norvegicus
tcattttaaaacaata

SEQ ID NO: 518251 - DNA, 16 bp, R. norvegicus
tcattttaaaatgttt

SEQ ID NO: 518252 - DNA, 16 bp, R. norvegicus
tcattttaaagattta

SEQ ID NO: 518253 - DNA, 16 bp, R. norvegicus
tcattttatgtttatg

SEQ ID NO: 518254 - DNA, 16 bp, R. norvegicus
tcattttattgacttt

SEQ ID NO: 518255 - DNA, 16 bp, R. norvegicus
tcattttcattaagtt

SEQ ID NO: 518256 - DNA, 16 bp, R. norvegicus
tcattttctgtttcct

SEQ ID NO: 518257 - DNA, 16 bp, R. norvegicus
tcattttcttcatctg

SEQ ID NO: 518258 - DNA, 16 bp, R. norvegicus
tcattttgataaacag

SEQ ID NO: 518259 - DNA, 16 bp, R. norvegicus
tcattttgcaacaaaa

SEQ ID NO: 518260 - DNA, 16 bp, R. norvegicus
tcattttgggtctggg

SEQ ID NO: 518261 - DNA, 16 bp, R. norvegicus
tcattttgtgagaatt

SEQ ID NO: 518262 - DNA, 16 bp, R. norvegicus
tcattttgttctctct

SEQ ID NO: 518263 - DNA, 16 bp, R. norvegicus
tcatttttaaagaaat

SEQ ID NO: 518264 - DNA, 16 bp, R. norvegicus
tcatttttaaatgaaa

SEQ ID NO: 518265 - DNA, 16 bp, R. norvegicus
tcatttttaatagggt

SEQ ID NO: 518266 - DNA, 16 bp, R. norvegicus
tcatttttctttatgg

SEQ ID NO: 518267 - DNA, 16 bp, R. norvegicus
tcatttttgatgactt

SEQ ID NO: 518268 - DNA, 16 bp, R. norvegicus
tcatttttggagaagg

SEQ ID NO: 518269 - DNA, 16 bp, R. norvegicus
tcattttttaaaaatg

SEQ ID NO: 518270 - DNA, 16 bp, R. norvegicus
tccaaaacactgagtc

SEQ ID NO: 518271 - DNA, 16 bp, R. norvegicus
tccaaaaccatccaat

SEQ ID NO: 518272 - DNA, 16 bp, R. norvegicus
tccaaaagattctcca

SEQ ID NO: 518273 - DNA, 16 bp, R. norvegicus
tccaaaagcaaaagga

SEQ ID NO: 518274 - DNA, 16 bp, R. norvegicus
tccaaaagggaaatga

SEQ ID NO: 518275 - DNA, 16 bp, R. norvegicus
tccaaaattggccata

SEQ ID NO: 518276 - DNA, 16 bp, R. norvegicus
tccaaacacaatggaa

SEQ ID NO: 518277 - DNA, 29 bp, R. norvegicus
tccaaactattccacaaaattgaaacagg

SEQ ID NO: 518278 - DNA, 16 bp, R. norvegicus
tccaaagaaacaaact

SEQ ID NO: 518279 - DNA, 16 bp, R. norvegicus
tccaaagaaaccaaaa

SEQ ID NO: 518280 - DNA, 16 bp, R. norvegicus
tccaaagcatggcaga

SEQ ID NO: 518281 - DNA, 16 bp, R. norvegicus
tccaaagcctgggaca

SEQ ID NO: 518282 - DNA, 16 bp, R. norvegicus
tccaaaggaccagagt

SEQ ID NO: 518283 - DNA, 16 bp, R. norvegicus
tccaaaggatctgatg

SEQ ID NO: 518284 - DNA, 16 bp, R. norvegicus
tccaaagggcctgagt

SEQ ID NO: 518285 - DNA, 16 bp, R. norvegicus
tccaaagtccttccac

SEQ ID NO: 518286 - DNA, 16 bp, R. norvegicus
tccaaatgcatttgca

SEQ ID NO: 518287 - DNA, 16 bp, R. norvegicus
tccaaatggatcaaag

SEQ ID NO: 518288 - DNA, 16 bp, R. norvegicus
tccaacaaaaccagaa

SEQ ID NO: 518289 - DNA, 16 bp, R. norvegicus
tccaacaaagccacac

SEQ ID NO: 518290 - DNA, 16 bp, R. norvegicus
tccaacaatgccatcc

SEQ ID NO: 518291 - DNA, 16 bp, R. norvegicus
tccaacatcctcttct

SEQ ID NO: 518292 - DNA, 16 bp, R. norvegicus
tccaacatcttcttct

SEQ ID NO: 518293 - DNA, 16 bp, R. norvegicus
tccaacgggggtcctg

SEQ ID NO: 518294 - DNA, 16 bp, R. norvegicus
tccaactattccacaa

SEQ ID NO: 518295 - DNA, 16 bp, R. norvegicus
tccaactcttcccaga

SEQ ID NO: 518296 - DNA, 16 bp, R. norvegicus
tccaactgtgagccaa

SEQ ID NO: 518297 - DNA, 16 bp, R. norvegicus
tccaagaactacaact

SEQ ID NO: 518298 - DNA, 16 bp, R. norvegicus
tccaagaatgcatcaa

SEQ ID NO: 518299 - DNA, 16 bp, R. norvegicus
tccaagacagccagga

SEQ ID NO: 518300 - DNA, 16 bp, R. norvegicus
tccaagagaacacagg

SEQ ID NO: 518301 - DNA, 16 bp, R. norvegicus
tccaagaggatcaagg

SEQ ID NO: 518302 - DNA, 16 bp, R. norvegicus
tccaagagtacatcaa

SEQ ID NO: 518303 - DNA, 16 bp, R. norvegicus
tccaagcagccttcag

SEQ ID NO: 518304 - DNA, 16 bp, R. norvegicus
tccaagcccacaccca

SEQ ID NO: 518305 - DNA, 16 bp, R. norvegicus
tccaaggaccagaaaa

SEQ ID NO: 518306 - DNA, 16 bp, R. norvegicus
tccaaggagtaagaaa

SEQ ID NO: 518307 - DNA, 16 bp, R. norvegicus
tccaaggctggccttg

SEQ ID NO: 518308 - DNA, 16 bp, R. norvegicus
tccaagggatccaatg

SEQ ID NO: 518309 - DNA, 16 bp, R. norvegicus
tccaagggccaaaaga

SEQ ID NO: 518310 - DNA, 16 bp, R. norvegicus
tccaagggctggtgga

SEQ ID NO: 518311 - DNA, 16 bp, R. norvegicus
tccaagtaaatggtca

SEQ ID NO: 518312 - DNA, 16 bp, R. norvegicus
tccaagtctctgaaga

SEQ ID NO: 518313 - DNA, 16 bp, R. norvegicus
tccaagtgacctgcct

SEQ ID NO: 518314 - DNA, 16 bp, R. norvegicus
tccaagtgctgggatt

SEQ ID NO: 518315 - DNA, 16 bp, R. norvegicus
tccaagtggcctgcct

SEQ ID NO: 518316 - DNA, 16 bp, R. norvegicus
tccaagtgtgtgtgtg

SEQ ID NO: 518317 - DNA, 16 bp, R. norvegicus
tccaagttcaaagcca

SEQ ID NO: 518318 - DNA, 16 bp, R. norvegicus
tccaagttcaagacca

SEQ ID NO: 518319 - DNA, 16 bp, R. norvegicus
tccaagttgcctttgg

SEQ ID NO: 518320 - DNA, 16 bp, R. norvegicus
tccaataaaaaatgag

SEQ ID NO: 518321 - DNA, 16 bp, R. norvegicus
tccaataaaactacat

SEQ ID NO: 518322 - DNA, 16 bp, R. norvegicus
tccaataaaatattta

SEQ ID NO: 518323 - DNA, 16 bp, R. norvegicus
tccaataagaccacac

SEQ ID NO: 518324 - DNA, 16 bp, R. norvegicus
tccaataccttcttct

SEQ ID NO: 518325 - DNA, 16 bp, R. norvegicus
tccaatatgctggggt

SEQ ID NO: 518326 - DNA, 16 bp, R. norvegicus
tccaatcccccagtct

SEQ ID NO: 518327 - DNA, 16 bp, R. norvegicus
tccaatgccctcttcc

SEQ ID NO: 518328 - DNA, 16 bp, R. norvegicus
tccaatgtggaccctg

SEQ ID NO: 518329 - DNA, 16 bp, R. norvegicus
tccaattcccagcacc

SEQ ID NO: 518330 - DNA, 16 bp, R. norvegicus
tccaattgatgccaga

SEQ ID NO: 518331 - DNA, 16 bp, R. norvegicus
tccaatttctttatgt

SEQ ID NO: 518332 - DNA, 16 bp, R. norvegicus
tccaatttctttggct

SEQ ID NO: 518333 - DNA, 16 bp, R. norvegicus
tccaattttcagagga

SEQ ID NO: 518334 - DNA, 17 bp, R. norvegicus
tccaattttctaaggaa

SEQ ID NO: 518335 - DNA, 16 bp, R. norvegicus
tccaatttttgaggaa

SEQ ID NO: 518336 - DNA, 16 bp, R. norvegicus
tccacaaaccacatga

SEQ ID NO: 518337 - DNA, 16 bp, R. norvegicus
tccacaaattgaaaca

SEQ ID NO: 518338 - DNA, 16 bp, R. norvegicus
tccacaagactcccag

SEQ ID NO: 518339 - DNA, 16 bp, R. norvegicus
tccacaagcaggaggc

SEQ ID NO: 518340 - DNA, 16 bp, R. norvegicus
tccacaatgttcatag

SEQ ID NO: 518341 - DNA, 16 bp, R. norvegicus
tccacacacacctgca

SEQ ID NO: 518342 - DNA, 16 bp, R. norvegicus
tccacacatgcaccat

SEQ ID NO: 518343 - DNA, 16 bp, R. norvegicus
tccacaccctggtctt

SEQ ID NO: 518344 - DNA, 16 bp, R. norvegicus
tccacacctgattggt

SEQ ID NO: 518345 - DNA, 16 bp, R. norvegicus
tccacactgatttcca

SEQ ID NO: 518346 - DNA, 16 bp, R. norvegicus
tccacacttactgctg

SEQ ID NO: 518347 - DNA, 16 bp, R. norvegicus
tccacacttctttgct

SEQ ID NO: 518348 - DNA, 16 bp, R. norvegicus
tccacagaagacctaa

SEQ ID NO: 518349 - DNA, 16 bp, R. norvegicus
tccacagacacttgct

SEQ ID NO: 518350 - DNA, 16 bp, R. norvegicus
tccacagaccacagaa

SEQ ID NO: 518351 - DNA, 16 bp, R. norvegicus
tccacagaggtcagaa

SEQ ID NO: 518352 - DNA, 16 bp, R. norvegicus
tccacagatgctttgg

SEQ ID NO: 518353 - DNA, 16 bp, R. norvegicus
tccacagcactcaccc

SEQ ID NO: 518354 - DNA, 16 bp, R. norvegicus
tccacaggaagaccaa

SEQ ID NO: 518355 - DNA, 16 bp, R. norvegicus
tccacaggcagcaaga

SEQ ID NO: 518356 - DNA, 16 bp, R. norvegicus
tccacagtcagttttc

SEQ ID NO: 518357 - DNA, 16 bp, R. norvegicus
tccacagttcaaatca

SEQ ID NO: 518358 - DNA, 16 bp, R. norvegicus
tccacagttcctcatc

SEQ ID NO: 518359 - DNA, 16 bp, R. norvegicus
tccacatcctcagcag

SEQ ID NO: 518360 - DNA, 16 bp, R. norvegicus
tccacatggcggctca

SEQ ID NO: 518361 - DNA, 16 bp, R. norvegicus
tccacatgtgtgtaca

SEQ ID NO: 518362 - DNA, 16 bp, R. norvegicus
tccacattcttgtcag

SEQ ID NO: 518363 - DNA, 16 bp, R. norvegicus
tccaccaaaagttatc

SEQ ID NO: 518364 - DNA, 16 bp, R. norvegicus
tccaccaagatggact

SEQ ID NO: 518365 - DNA, 16 bp, R. norvegicus
tccaccactgagctgc

SEQ ID NO: 518366 - DNA, 16 bp, R. norvegicus
tccaccagagaagact

SEQ ID NO: 518367 - DNA, 16 bp, R. norvegicus
tccaccaggaaactcc

SEQ ID NO: 518368 - DNA, 16 bp, R. norvegicus
tccaccagttcctggg

SEQ ID NO: 518369 - DNA, 16 bp, R. norvegicus
tccacccagactgacc

SEQ ID NO: 518370 - DNA, 16 bp, R. norvegicus
tccacccataaaatct

SEQ ID NO: 518371 - DNA, 16 bp, R. norvegicus
tccacccatctgtcca

SEQ ID NO: 518372 - DNA, 16 bp, R. norvegicus
tccaccccctggtccc

SEQ ID NO: 518373 - DNA, 16 bp, R. norvegicus
tccaccccttaaaacc

SEQ ID NO: 518374 - DNA, 16 bp, R. norvegicus
tccacctcaacaccct

SEQ ID NO: 518375 - DNA, 17 bp, R. norvegicus
tccacctcacaccagtg

SEQ ID NO: 518376 - DNA, 16 bp, R. norvegicus
tccacctcacagttac

SEQ ID NO: 518377 - DNA, 16 bp, R. norvegicus
tccacctccaacaaca

SEQ ID NO: 518378 - DNA, 16 bp, R. norvegicus
tccacctccagcagaa

SEQ ID NO: 518379 - DNA, 16 bp, R. norvegicus
tccacctctgcctccc

SEQ ID NO: 518380 - DNA, 16 bp, R. norvegicus
tccacctgcctcagct

SEQ ID NO: 518381 - DNA, 16 bp, R. norvegicus
tccacctggctctgct

SEQ ID NO: 518382 - DNA, 16 bp, R. norvegicus
tccaccttacttttga

SEQ ID NO: 518383 - DNA, 17 bp, R. norvegicus
tccacgaagatgaactc

SEQ ID NO: 518384 - DNA, 17 bp, R. norvegicus
tccacgggaacccagag

SEQ ID NO: 518385 - DNA, 16 bp, R. norvegicus
tccacggtggcagcaa

SEQ ID NO: 518386 - DNA, 16 bp, R. norvegicus
tccacgtggaaaaaaa

SEQ ID NO: 518387 - DNA, 16 bp, R. norvegicus
tccactataaaaacaa

SEQ ID NO: 518388 - DNA, 16 bp, R. norvegicus
tccactatgttcacag

SEQ ID NO: 518389 - DNA, 16 bp, R. norvegicus
tccactccactgccac

SEQ ID NO: 518390 - DNA, 16 bp, R. norvegicus
tccactccactgctgc

SEQ ID NO: 518391 - DNA, 16 bp, R. norvegicus
tccactccctgtcagc

SEQ ID NO: 518392 - DNA, 16 bp, R. norvegicus
tccactgaagaaaact

SEQ ID NO: 518393 - DNA, 16 bp, R. norvegicus
tccactgcacaccctc

SEQ ID NO: 518394 - DNA, 16 bp, R. norvegicus
tccactgccctcttct

SEQ ID NO: 518395 - DNA, 16 bp, R. norvegicus
tccactgggaatcctg

SEQ ID NO: 518396 - DNA, 16 bp, R. norvegicus
tccactgggggccatg

SEQ ID NO: 518397 - DNA, 16 bp, R. norvegicus
tccactggtgccacaa

SEQ ID NO: 518398 - DNA, 16 bp, R. norvegicus
tccactggtgccatta

SEQ ID NO: 518399 - DNA, 26 bp, R. norvegicus
tccactgtggctggtcgtctcaggcc

SEQ ID NO: 518400 - DNA, 16 bp, R. norvegicus
tccacttcaggaaaac

SEQ ID NO: 518401 - DNA, 16 bp, R. norvegicus
tccagaaaaacaccat

SEQ ID NO: 518402 - DNA, 16 bp, R. norvegicus
tccagaaaaacatcat

SEQ ID NO: 518403 - DNA, 16 bp, R. norvegicus
tccagaaaaccaaata

SEQ ID NO: 518404 - DNA, 16 bp, R. norvegicus
tccagaaaagattcaa

SEQ ID NO: 518405 - DNA, 16 bp, R. norvegicus
tccagaaaaggacaaa

SEQ ID NO: 518406 - DNA, 16 bp, R. norvegicus
tccagaaactaaacca

SEQ ID NO: 518407 - DNA, 16 bp, R. norvegicus
tccagaaactcactat

SEQ ID NO: 518408 - DNA, 16 bp, R. norvegicus
tccagaaagtaccaga

SEQ ID NO: 518409 - DNA, 16 bp, R. norvegicus
tccagaacaaaaagaa

SEQ ID NO: 518410 - DNA, 16 bp, R. norvegicus
tccagaacagtcaagg

SEQ ID NO: 518411 - DNA, 16 bp, R. norvegicus
tccagaacatccagga

SEQ ID NO: 518412 - DNA, 16 bp, R. norvegicus
tccagaacggttttac

SEQ ID NO: 518413 - DNA, 16 bp, R. norvegicus
tccagaagaatctcct

SEQ ID NO: 518414 - DNA, 16 bp, R. norvegicus
tccagaagaccagggt

SEQ ID NO: 518415 - DNA, 16 bp, R. norvegicus
tccagaaggctccaga

SEQ ID NO: 518416 - DNA, 16 bp, R. norvegicus
tccagaagggaaactg

SEQ ID NO: 518417 - DNA, 16 bp, R. norvegicus
tccagaagtcctgagc

SEQ ID NO: 518418 - DNA, 16 bp, R. norvegicus
tccagaatcttctggc

SEQ ID NO: 518419 - DNA, 16 bp, R. norvegicus
tccagaatgcaccaga

SEQ ID NO: 518420 - DNA, 16 bp, R. norvegicus
tccagacacagatgga

SEQ ID NO: 518421 - DNA, 16 bp, R. norvegicus
tccagacaccagagga

SEQ ID NO: 518422 - DNA, 16 bp, R. norvegicus
tccagacagagacacc

SEQ ID NO: 518423 - DNA, 16 bp, R. norvegicus
tccagacagataccag

SEQ ID NO: 518424 - DNA, 17 bp, R. norvegicus
tccagacaggtttagtg

SEQ ID NO: 518425 - DNA, 16 bp, R. norvegicus
tccagaccagcctgag

SEQ ID NO: 518426 - DNA, 16 bp, R. norvegicus
tccagacttccccagc

SEQ ID NO: 518427 - DNA, 16 bp, R. norvegicus
tccagactttgtctcc

SEQ ID NO: 518428 - DNA, 16 bp, R. norvegicus
tccagagaacctggat

SEQ ID NO: 518429 - DNA, 16 bp, R. norvegicus
tccagagaactaaata

SEQ ID NO: 518430 - DNA, 16 bp, R. norvegicus
tccagagaagcctgag

SEQ ID NO: 518431 - DNA, 16 bp, R. norvegicus
tccagagaagtcaggg

SEQ ID NO: 518432 - DNA, 16 bp, R. norvegicus
tccagagacagctgca

SEQ ID NO: 518433 - DNA, 16 bp, R. norvegicus
tccagagactccccca

SEQ ID NO: 518434 - DNA, 16 bp, R. norvegicus
tccagagactgcccac

SEQ ID NO: 518435 - DNA, 16 bp, R. norvegicus
tccagagactgctaca

SEQ ID NO: 518436 - DNA, 16 bp, R. norvegicus
tccagagactgtgcca

SEQ ID NO: 518437 - DNA, 16 bp, R. norvegicus
tccagagaggaaacag

SEQ ID NO: 518438 - DNA, 16 bp, R. norvegicus
tccagagaggtttaac

SEQ ID NO: 518439 - DNA, 16 bp, R. norvegicus
tccagagatagtcaag

SEQ ID NO: 518440 - DNA, 16 bp, R. norvegicus
tccagagcagccaaga

SEQ ID NO: 518441 - DNA, 16 bp, R. norvegicus
tccagagcgctgggat

SEQ ID NO: 518442 - DNA, 16 bp, R. norvegicus
tccagagcttccaggg

SEQ ID NO: 518443 - DNA, 16 bp, R. norvegicus
tccagaggaaaaaaaa

SEQ ID NO: 518444 - DNA, 16 bp, R. norvegicus
tccagaggaatttgca

SEQ ID NO: 518445 - DNA, 16 bp, R. norvegicus
tccagaggaccaggag

SEQ ID NO: 518446 - DNA, 16 bp, R. norvegicus
tccagaggacccaggc

SEQ ID NO: 518447 - DNA, 16 bp, R. norvegicus
tccagaggacctgagc

SEQ ID NO: 518448 - DNA, 16 bp, R. norvegicus
tccagaggacctggat

SEQ ID NO: 518449 - DNA, 16 bp, R. norvegicus
tccagaggctctgagt

SEQ ID NO: 518450 - DNA, 16 bp, R. norvegicus
tccagagggaaaactg

SEQ ID NO: 518451 - DNA, 16 bp, R. norvegicus
tccagaggtcttgagt

SEQ ID NO: 518452 - DNA, 16 bp, R. norvegicus
tccagagtgctgggat

SEQ ID NO: 518453 - DNA, 16 bp, R. norvegicus
tccagagttatatgga

SEQ ID NO: 518454 - DNA, 43 bp, R. norvegicus
tccagatcaagatgtgcctgcttcacaagtgcaggatgtggca

SEQ ID NO: 518455 - DNA, 16 bp, R. norvegicus
tccagatcagcctggg

SEQ ID NO: 518456 - DNA, 16 bp, R. norvegicus
tccagatcccctggaa

SEQ ID NO: 518457 - DNA, 18 bp, R. norvegicus
tccagatgaatttacaaa

SEQ ID NO: 518458 - DNA, 16 bp, R. norvegicus
tccagatgaatttgaa

SEQ ID NO: 518459 - DNA, 16 bp, R. norvegicus
tccagatgccaggaaa

SEQ ID NO: 518460 - DNA, 16 bp, R. norvegicus
tccagattgacttcca

SEQ ID NO: 518461 - DNA, 16 bp, R. norvegicus
tccagattttattacc

SEQ ID NO: 518462 - DNA, 16 bp, R. norvegicus
tccagcaaggccacac

SEQ ID NO: 518463 - DNA, 16 bp, R. norvegicus
tccagcaaggctccac

SEQ ID NO: 518464 - DNA, 16 bp, R. norvegicus
tccagcaccagggagg

SEQ ID NO: 518465 - DNA, 16 bp, R. norvegicus
tccagcaccatgactg

SEQ ID NO: 518466 - DNA, 16 bp, R. norvegicus
tccagcacccacataa

SEQ ID NO: 518467 - DNA, 16 bp, R. norvegicus
tccagcaccctcttct

SEQ ID NO: 518468 - DNA, 16 bp, R. norvegicus
tccagcacctacatgg

SEQ ID NO: 518469 - DNA, 16 bp, R. norvegicus
tccagcactcaggagg

SEQ ID NO: 518470 - DNA, 16 bp, R. norvegicus
tccagcactggggaag

SEQ ID NO: 518471 - DNA, 16 bp, R. norvegicus
tccagcactgtagtgc

SEQ ID NO: 518472 - DNA, 16 bp, R. norvegicus
tccagcacttggggag

SEQ ID NO: 518473 - DNA, 16 bp, R. norvegicus
tccagcagaaagtcag

SEQ ID NO: 518474 - DNA, 16 bp, R. norvegicus
tccagcagcacctgga

SEQ ID NO: 518475 - DNA, 16 bp, R. norvegicus
tccagcagcagatgga

SEQ ID NO: 518476 - DNA, 16 bp, R. norvegicus
tccagcagccacatgg

SEQ ID NO: 518477 - DNA, 16 bp, R. norvegicus
tccagcaggatctggg

SEQ ID NO: 518478 - DNA, 16 bp, R. norvegicus
tccagcatcaggatca

SEQ ID NO: 518479 - DNA, 16 bp, R. norvegicus
tccagcatccacatca

SEQ ID NO: 518480 - DNA, 16 bp, R. norvegicus
tccagcatgttggggt

SEQ ID NO: 518481 - DNA, 16 bp, R. norvegicus
tccagccactgtcaga

SEQ ID NO: 518482 - DNA, 16 bp, R. norvegicus
tccagccagaggaatt

SEQ ID NO: 518483 - DNA, 16 bp, R. norvegicus
tccagccaggccacac

SEQ ID NO: 518484 - DNA, 16 bp, R. norvegicus
tccagccccagaaagc

SEQ ID NO: 518485 - DNA, 16 bp, R. norvegicus
tccagccccctcttct

SEQ ID NO: 518486 - DNA, 16 bp, R. norvegicus
tccagccccctctttt

SEQ ID NO: 518487 - DNA, 16 bp, R. norvegicus
tccagccctccagccc

SEQ ID NO: 518488 - DNA, 16 bp, R. norvegicus
tccagcctcagcctcc

SEQ ID NO: 518489 - DNA, 16 bp, R. norvegicus
tccagcctcagctccc

SEQ ID NO: 518490 - DNA, 16 bp, R. norvegicus
tccagcctcagcttcc

SEQ ID NO: 518491 - DNA, 16 bp, R. norvegicus
tccagcctcagtctcc

SEQ ID NO: 518492 - DNA, 16 bp, R. norvegicus
tccagcctcctcctcc

SEQ ID NO: 518493 - DNA, 16 bp, R. norvegicus
tccagcctgccctgta

SEQ ID NO: 518494 - DNA, 16 bp, R. norvegicus
tccagccttggcagga

SEQ ID NO: 518495 - DNA, 16 bp, R. norvegicus
tccagctaaggcccag

SEQ ID NO: 518496 - DNA, 16 bp, R. norvegicus
tccagctccaggagaa

SEQ ID NO: 518497 - DNA, 16 bp, R. norvegicus
tccagctccaggagac

SEQ ID NO: 518498 - DNA, 16 bp, R. norvegicus
tccagctccaggcaat

SEQ ID NO: 518499 - DNA, 16 bp, R. norvegicus
tccagctcctgtcagt

SEQ ID NO: 518500 - DNA, 16 bp, R. norvegicus
tccagctcctttttca

SEQ ID NO: 518501 - DNA, 16 bp, R. norvegicus
tccagctctctccacc

SEQ ID NO: 518502 - DNA, 16 bp, R. norvegicus
tccagctgctgcaggg

SEQ ID NO: 518503 - DNA, 16 bp, R. norvegicus
tccagctgctggctat

SEQ ID NO: 518504 - DNA, 16 bp, R. norvegicus
tccagctggagagatg

SEQ ID NO: 518505 - DNA, 16 bp, R. norvegicus
tccagctgtaagtcat

SEQ ID NO: 518506 - DNA, 16 bp, R. norvegicus
tccagcttgaggactc

SEQ ID NO: 518507 - DNA, 16 bp, R. norvegicus
tccagcttgtattttg

SEQ ID NO: 518508 - DNA, 16 bp, R. norvegicus
tccagcttgtgccaag

SEQ ID NO: 518509 - DNA, 16 bp, R. norvegicus
tccaggaaacccagga

SEQ ID NO: 518510 - DNA, 16 bp, R. norvegicus
tccaggaaatccagaa

SEQ ID NO: 518511 - DNA, 16 bp, R. norvegicus
tccaggaaatccaggg

SEQ ID NO: 518512 - DNA, 16 bp, R. norvegicus
tccaggaaatgcagga

SEQ ID NO: 518513 - DNA, 16 bp, R. norvegicus
tccaggaaattcaaga

SEQ ID NO: 518514 - DNA, 16 bp, R. norvegicus
tccaggaaattcagaa

SEQ ID NO: 518515 - DNA, 16 bp, R. norvegicus
tccaggaaattgtcca

SEQ ID NO: 518516 - DNA, 16 bp, R. norvegicus
tccaggaacaagcaga

SEQ ID NO: 518517 - DNA, 16 bp, R. norvegicus
tccaggacaaccagag

SEQ ID NO: 518518 - DNA, 16 bp, R. norvegicus
tccaggacagacagac

SEQ ID NO: 518519 - DNA, 16 bp, R. norvegicus
tccaggacagacagga

SEQ ID NO: 518520 - DNA, 16 bp, R. norvegicus
tccaggacagcctgga

SEQ ID NO: 518521 - DNA, 16 bp, R. norvegicus
tccaggacagctgaga

SEQ ID NO: 518522 - DNA, 16 bp, R. norvegicus
tccaggacagctggag

SEQ ID NO: 518523 - DNA, 16 bp, R. norvegicus
tccaggacatccagga

SEQ ID NO: 518524 - DNA, 16 bp, R. norvegicus
tccaggaccaccaggg

SEQ ID NO: 518525 - DNA, 16 bp, R. norvegicus
tccaggacttttataa

SEQ ID NO: 518526 - DNA, 16 bp, R. norvegicus
tccaggagacactaga

SEQ ID NO: 518527 - DNA, 16 bp, R. norvegicus
tccaggagatccaatg

SEQ ID NO: 518528 - DNA, 16 bp, R. norvegicus
tccaggagatccagga

SEQ ID NO: 518529 - DNA, 16 bp, R. norvegicus
tccaggagcagcagga

SEQ ID NO: 518530 - DNA, 16 bp, R. norvegicus
tccaggagcagctgga

SEQ ID NO: 518531 - DNA, 16 bp, R. norvegicus
tccaggagctggagag

SEQ ID NO: 518532 - DNA, 16 bp, R. norvegicus
tccaggagtcagttct

SEQ ID NO: 518533 - DNA, 16 bp, R. norvegicus
tccaggagtttgggag

SEQ ID NO: 518534 - DNA, 16 bp, R. norvegicus
tccaggatagccaggc

SEQ ID NO: 518535 - DNA, 16 bp, R. norvegicus
tccaggatcttctgac

SEQ ID NO: 518536 - DNA, 31 bp, R. norvegicus
tccaggatcttctggccttcatagtttctgg

SEQ ID NO: 518537 - DNA, 16 bp, R. norvegicus
tccaggatggccagga

SEQ ID NO: 518538 - DNA, 16 bp, R. norvegicus
tccaggatgggcaaag

SEQ ID NO: 518539 - DNA, 16 bp, R. norvegicus
tccaggattttaaaat

SEQ ID NO: 518540 - DNA, 16 bp, R. norvegicus
tccaggcaagcccagg

SEQ ID NO: 518541 - DNA, 16 bp, R. norvegicus
tccaggcacagatgga

SEQ ID NO: 518542 - DNA, 18 bp, R. norvegicus
tccaggcagaacaggact

SEQ ID NO: 518543 - DNA, 16 bp, R. norvegicus
tccaggcagagaggga

SEQ ID NO: 518544 - DNA, 16 bp, R. norvegicus
tccaggcaggactgac

SEQ ID NO: 518545 - DNA, 16 bp, R. norvegicus
tccaggcaggcatgga

SEQ ID NO: 518546 - DNA, 16 bp, R. norvegicus
tccaggcaggcctggc

SEQ ID NO: 518547 - DNA, 16 bp, R. norvegicus
tccaggcaggttgctt

SEQ ID NO: 518548 - DNA, 16 bp, R. norvegicus
tccaggcagtcagctg

SEQ ID NO: 518549 - DNA, 16 bp, R. norvegicus
tccaggccaacacccc

SEQ ID NO: 518550 - DNA, 16 bp, R. norvegicus
tccaggccagacagag

SEQ ID NO: 518551 - DNA, 16 bp, R. norvegicus
tccaggccagccaagg

SEQ ID NO: 518552 - DNA, 16 bp, R. norvegicus
tccaggccagcccagg

SEQ ID NO: 518553 - DNA, 16 bp, R. norvegicus
tccaggccagcctggt

SEQ ID NO: 518554 - DNA, 16 bp, R. norvegicus
tccaggcccaagagga

SEQ ID NO: 518555 - DNA, 16 bp, R. norvegicus
tccaggcccagatcca

SEQ ID NO: 518556 - DNA, 16 bp, R. norvegicus
tccaggcctttgggta

SEQ ID NO: 518557 - DNA, 16 bp, R. norvegicus
tccaggctatcctgga

SEQ ID NO: 518558 - DNA, 16 bp, R. norvegicus
tccaggctccaggctg

SEQ ID NO: 518559 - DNA, 16 bp, R. norvegicus
tccaggctggcctgga

SEQ ID NO: 518560 - DNA, 16 bp, R. norvegicus
tccaggctggtctgga

SEQ ID NO: 518561 - DNA, 16 bp, R. norvegicus
tccagggaagccaggg

SEQ ID NO: 518562 - DNA, 16 bp, R. norvegicus
tccagggaatctggtg

SEQ ID NO: 518563 - DNA, 16 bp, R. norvegicus
tccagggcagccaggg

SEQ ID NO: 518564 - DNA, 16 bp, R. norvegicus
tccagggctgcggggc

SEQ ID NO: 518565 - DNA, 16 bp, R. norvegicus
tccaggggatctgaca

SEQ ID NO: 518566 - DNA, 29 bp, R. norvegicus
tccaggtcacaaggtagcagcatgccctc

SEQ ID NO: 518567 - DNA, 16 bp, R. norvegicus
tccaggtcaccatcac

SEQ ID NO: 518568 - DNA, 16 bp, R. norvegicus
tccaggtcccaggagg

SEQ ID NO: 518569 - DNA, 16 bp, R. norvegicus
tccaggtccctgccct

SEQ ID NO: 518570 - DNA, 16 bp, R. norvegicus
tccaggtctcccagcc

SEQ ID NO: 518571 - DNA, 16 bp, R. norvegicus
tccaggtgactggctt

SEQ ID NO: 518572 - DNA, 16 bp, R. norvegicus
tccaggttagttgaaa

SEQ ID NO: 518573 - DNA, 16 bp, R. norvegicus
tccaggttcagtgaga

SEQ ID NO: 518574 - DNA, 16 bp, R. norvegicus
tccaggttcagtggga

SEQ ID NO: 518575 - DNA, 16 bp, R. norvegicus
tccaggttcccttttg

SEQ ID NO: 518576 - DNA, 16 bp, R. norvegicus
tccagtatttcctttg

SEQ ID NO: 518577 - DNA, 16 bp, R. norvegicus
tccagtcacatatgtg

SEQ ID NO: 518578 - DNA, 16 bp, R. norvegicus
tccagtcactgccttc

SEQ ID NO: 518579 - DNA, 16 bp, R. norvegicus
tccagtccaggagaat

SEQ ID NO: 518580 - DNA, 16 bp, R. norvegicus
tccagtcccagcagga

SEQ ID NO: 518581 - DNA, 16 bp, R. norvegicus
tccagtcccaggagac

SEQ ID NO: 518582 - DNA, 16 bp, R. norvegicus
tccagtcccagggaac

SEQ ID NO: 518583 - DNA, 16 bp, R. norvegicus
tccagtccctgtcctg

SEQ ID NO: 518584 - DNA, 16 bp, R. norvegicus
tccagtccctttccgc

SEQ ID NO: 518585 - DNA, 16 bp, R. norvegicus
tccagtctccaagaca

SEQ ID NO: 518586 - DNA, 16 bp, R. norvegicus
tccagtctctgcttcc

SEQ ID NO: 518587 - DNA, 16 bp, R. norvegicus
tccagtcttccccagc

SEQ ID NO: 518588 - DNA, 16 bp, R. norvegicus
tccagtcttctccagc

SEQ ID NO: 518589 - DNA, 16 bp, R. norvegicus
tccagtcttctccagg

SEQ ID NO: 518590 - DNA, 16 bp, R. norvegicus
tccagtcttttctcta

SEQ ID NO: 518591 - DNA, 16 bp, R. norvegicus
tccagtgaggggctgg

SEQ ID NO: 518592 - DNA, 16 bp, R. norvegicus
tccagtgccatcttct

SEQ ID NO: 518593 - DNA, 16 bp, R. norvegicus
tccagtgccatgtctg

SEQ ID NO: 518594 - DNA, 16 bp, R. norvegicus
tccagtgcccatgggt

SEQ ID NO: 518595 - DNA, 16 bp, R. norvegicus
tccagtgcccatgttt

SEQ ID NO: 518596 - DNA, 16 bp, R. norvegicus
tccagtggctcacaac

SEQ ID NO: 518597 - DNA, 16 bp, R. norvegicus
tccagtgtctgaggga

SEQ ID NO: 518598 - DNA, 16 bp, R. norvegicus
tccagtgtgggtgctg

SEQ ID NO: 518599 - DNA, 16 bp, R. norvegicus
tccagttagtgctgcc

SEQ ID NO: 518600 - DNA, 16 bp, R. norvegicus
tccagttccagaggat

SEQ ID NO: 518601 - DNA, 16 bp, R. norvegicus
tccagttccaggggct

SEQ ID NO: 518602 - DNA, 16 bp, R. norvegicus
tccagttccagttcca

SEQ ID NO: 518603 - DNA, 16 bp, R. norvegicus
tccagttcctggagat

SEQ ID NO: 518604 - DNA, 16 bp, R. norvegicus
tccagttcctggctat

SEQ ID NO: 518605 - DNA, 16 bp, R. norvegicus
tccagtttcagaggtt

SEQ ID NO: 518606 - DNA, 16 bp, R. norvegicus
tccagtttgtcaatct

SEQ ID NO: 518607 - DNA, 16 bp, R. norvegicus
tccagttttatgaggt

SEQ ID NO: 518608 - DNA, 16 bp, R. norvegicus
tccagttttctgaaga

SEQ ID NO: 518609 - DNA, 16 bp, R. norvegicus
tccataagatcaagct

SEQ ID NO: 518610 - DNA, 16 bp, R. norvegicus
tccatagaaagaccaa

SEQ ID NO: 518611 - DNA, 16 bp, R. norvegicus
tccatagcaattgtgg

SEQ ID NO: 518612 - DNA, 16 bp, R. norvegicus
tccatagcccctccta

SEQ ID NO: 518613 - DNA, 16 bp, R. norvegicus
tccataggaagaacaa

SEQ ID NO: 518614 - DNA, 16 bp, R. norvegicus
tccatagtgctgggat

SEQ ID NO: 518615 - DNA, 16 bp, R. norvegicus
tccatatcaactccac

SEQ ID NO: 518616 - DNA, 16 bp, R. norvegicus
tccatatcctcaacag

SEQ ID NO: 518617 - DNA, 16 bp, R. norvegicus
tccatcaaatccttcc

SEQ ID NO: 518618 - DNA, 16 bp, R. norvegicus
tccatcaacacaatcc

SEQ ID NO: 518619 - DNA, 16 bp, R. norvegicus
tccatcaattttgttc

SEQ ID NO: 518620 - DNA, 16 bp, R. norvegicus
tccatcaccaaaggaa

SEQ ID NO: 518621 - DNA, 16 bp, R. norvegicus
tccatcacccatccat

SEQ ID NO: 518622 - DNA, 16 bp, R. norvegicus
tccatcacctcctcca

SEQ ID NO: 518623 - DNA, 16 bp, R. norvegicus
tccatcactgtgaaga

SEQ ID NO: 518624 - DNA, 16 bp, R. norvegicus
tccatcagtctgtcct

SEQ ID NO: 518625 - DNA, 16 bp, R. norvegicus
tccatcatggagtcag

SEQ ID NO: 518626 - DNA, 16 bp, R. norvegicus
tccatcattttgctgc

SEQ ID NO: 518627 - DNA, 16 bp, R. norvegicus
tccatccatccacccg

SEQ ID NO: 518628 - DNA, 16 bp, R. norvegicus
tccatcccagcctact

SEQ ID NO: 518629 - DNA, 16 bp, R. norvegicus
tccatcccaggcatgc

SEQ ID NO: 518630 - DNA, 16 bp, R. norvegicus
tccatccccagaacca

SEQ ID NO: 518631 - DNA, 16 bp, R. norvegicus
tccatccccagtgctg

SEQ ID NO: 518632 - DNA, 16 bp, R. norvegicus
tccatccccatctcca

SEQ ID NO: 518633 - DNA, 16 bp, R. norvegicus
tccatccctctggctc

SEQ ID NO: 518634 - DNA, 16 bp, R. norvegicus
tccatccctcttgccc

SEQ ID NO: 518635 - DNA, 16 bp, R. norvegicus
tccatcctctctggct

SEQ ID NO: 518636 - DNA, 16 bp, R. norvegicus
tccatccttatctcct

SEQ ID NO: 518637 - DNA, 16 bp, R. norvegicus
tccatctacctctgcc

SEQ ID NO: 518638 - DNA, 16 bp, R. norvegicus
tccatctccccactgt

SEQ ID NO: 518639 - DNA, 16 bp, R. norvegicus
tccatctctgcagttc

SEQ ID NO: 518640 - DNA, 16 bp, R. norvegicus
tccatctctgccctct

SEQ ID NO: 518641 - DNA, 16 bp, R. norvegicus
tccatctgcccctgcc

SEQ ID NO: 518642 - DNA, 16 bp, R. norvegicus
tccatctgcctctgac

SEQ ID NO: 518643 - DNA, 16 bp, R. norvegicus
tccatctgcctctgtt

SEQ ID NO: 518644 - DNA, 16 bp, R. norvegicus
tccatctgtccttcct

SEQ ID NO: 518645 - DNA, 16 bp, R. norvegicus
tccatctgtgtgtgtg

SEQ ID NO: 518646 - DNA, 16 bp, R. norvegicus
tccatcttctgaggta

SEQ ID NO: 518647 - DNA, 16 bp, R. norvegicus
tccatcttctgggatc

SEQ ID NO: 518648 - DNA, 16 bp, R. norvegicus
tccatctttgctaccc

SEQ ID NO: 518649 - DNA, 16 bp, R. norvegicus
tccatgaactcagtca

SEQ ID NO: 518650 - DNA, 16 bp, R. norvegicus
tccatgaagatgtccc

SEQ ID NO: 518651 - DNA, 16 bp, R. norvegicus
tccatgaagtgtttgc

SEQ ID NO: 518652 - DNA, 16 bp, R. norvegicus
tccatgagatccagat

SEQ ID NO: 518653 - DNA, 16 bp, R. norvegicus
tccatgaggtgcagag

SEQ ID NO: 518654 - DNA, 16 bp, R. norvegicus
tccatgaggtggtgag

SEQ ID NO: 518655 - DNA, 16 bp, R. norvegicus
tccatgaggttctgag

SEQ ID NO: 518656 - DNA, 16 bp, R. norvegicus
tccatgatgagagtgg

SEQ ID NO: 518657 - DNA, 16 bp, R. norvegicus
tccatgattttagtgg

SEQ ID NO: 518658 - DNA, 16 bp, R. norvegicus
tccatgattttgttga

SEQ ID NO: 518659 - DNA, 16 bp, R. norvegicus
tccatgcctgcatttc

SEQ ID NO: 518660 - DNA, 16 bp, R. norvegicus
tccatgctcatggatt

SEQ ID NO: 518661 - DNA, 16 bp, R. norvegicus
tccatggaagctctgg

SEQ ID NO: 518662 - DNA, 16 bp, R. norvegicus
tccatggattgcatct

SEQ ID NO: 518663 - DNA, 16 bp, R. norvegicus
tccatggcacccttcc

SEQ ID NO: 518664 - DNA, 16 bp, R. norvegicus
tccatggcatctgcat

SEQ ID NO: 518665 - DNA, 16 bp, R. norvegicus
tccatggcctctgcct

SEQ ID NO: 518666 - DNA, 16 bp, R. norvegicus
tccatggctactgtgg

SEQ ID NO: 518667 - DNA, 16 bp, R. norvegicus
tccatggcttcttcct

SEQ ID NO: 518668 - DNA, 16 bp, R. norvegicus
tccatgggcaccagac

SEQ ID NO: 518669 - DNA, 16 bp, R. norvegicus
tccatgtatatttttt

SEQ ID NO: 518670 - DNA, 16 bp, R. norvegicus
tccatgtgtacacatt

SEQ ID NO: 518671 - DNA, 16 bp, R. norvegicus
tccatgtgtactcttt

SEQ ID NO: 518672 - DNA, 16 bp, R. norvegicus
tccatgttttgaagaa

SEQ ID NO: 518673 - DNA, 16 bp, R. norvegicus
tccattacagatggtt

SEQ ID NO: 518674 - DNA, 16 bp, R. norvegicus
tccattatggcattct

SEQ ID NO: 518675 - DNA, 16 bp, R. norvegicus
tccattcattcattct

SEQ ID NO: 518676 - DNA, 16 bp, R. norvegicus
tccattctccatccac

SEQ ID NO: 518677 - DNA, 16 bp, R. norvegicus
tccattctgttcatag

SEQ ID NO: 518678 - DNA, 16 bp, R. norvegicus
tccattcttctgctgt

SEQ ID NO: 518679 - DNA, 16 bp, R. norvegicus
tccattcttcttttga

SEQ ID NO: 518680 - DNA, 16 bp, R. norvegicus
tccattctttgtttga

SEQ ID NO: 518681 - DNA, 16 bp, R. norvegicus
tccattgaggaaatgc

SEQ ID NO: 518682 - DNA, 16 bp, R. norvegicus
tccattggggactgtg

SEQ ID NO: 518683 - DNA, 16 bp, R. norvegicus
tccattgttgatagga

SEQ ID NO: 518684 - DNA, 19 bp, R. norvegicus
tccattgttggtgggatta

SEQ ID NO: 518685 - DNA, 16 bp, R. norvegicus
tccatttatcagtgaa

SEQ ID NO: 518686 - DNA, 16 bp, R. norvegicus
tccatttccatccctg

SEQ ID NO: 518687 - DNA, 16 bp, R. norvegicus
tccatttccattttca

SEQ ID NO: 518688 - DNA, 16 bp, R. norvegicus
tccatttcccttttca

SEQ ID NO: 518689 - DNA, 16 bp, R. norvegicus
tccatttcctgtcagc

SEQ ID NO: 518690 - DNA, 16 bp, R. norvegicus
tccatttctctaccac

SEQ ID NO: 518691 - DNA, 16 bp, R. norvegicus
tccatttcttctacct

SEQ ID NO: 518692 - DNA, 16 bp, R. norvegicus
tccatttgcctatgga

SEQ ID NO: 518693 - DNA, 16 bp, R. norvegicus
tccatttgccttcaaa

SEQ ID NO: 518694 - DNA, 16 bp, R. norvegicus
tccatttgcttatgaa

SEQ ID NO: 518695 - DNA, 16 bp, R. norvegicus
tccatttgcttgtgaa

SEQ ID NO: 518696 - DNA, 16 bp, R. norvegicus
tccatttggaaaaaaa

SEQ ID NO: 518697 - DNA, 16 bp, R. norvegicus
tccatttttaaaatta

SEQ ID NO: 518698 - DNA, 16 bp, R. norvegicus
tccatttttatcacca

SEQ ID NO: 518699 - DNA, 16 bp, R. norvegicus
tccatttttatccctg

SEQ ID NO: 518700 - DNA, 16 bp, R. norvegicus
tccatttttgtccctg

SEQ ID NO: 518701 - DNA, 16 bp, R. norvegicus
tcccaaaacaaaagaa

SEQ ID NO: 518702 - DNA, 16 bp, R. norvegicus
tcccaaaacagttcca

SEQ ID NO: 518703 - DNA, 16 bp, R. norvegicus
tcccaaaagctgctgc

SEQ ID NO: 518704 - DNA, 21 bp, R. norvegicus
tcccaaaatcccctctggggc

SEQ ID NO: 518705 - DNA, 16 bp, R. norvegicus
tcccaaagaaccagct

SEQ ID NO: 518706 - DNA, 16 bp, R. norvegicus
tcccaaatgctgggat

SEQ ID NO: 518707 - DNA, 16 bp, R. norvegicus
tcccaaatggctgttt

SEQ ID NO: 518708 - DNA, 16 bp, R. norvegicus
tcccaacaaaaatgga

SEQ ID NO: 518709 - DNA, 16 bp, R. norvegicus
tcccaacacagccact

SEQ ID NO: 518710 - DNA, 16 bp, R. norvegicus
tcccaacactcacatg

SEQ ID NO: 518711 - DNA, 16 bp, R. norvegicus
tcccaacactccagag

SEQ ID NO: 518712 - DNA, 19 bp, R. norvegicus
tcccaacagagttatcatc

SEQ ID NO: 518713 - DNA, 16 bp, R. norvegicus
tcccaacatctgcccc

SEQ ID NO: 518714 - DNA, 16 bp, R. norvegicus
tcccaaccaaaaagaa

SEQ ID NO: 518715 - DNA, 16 bp, R. norvegicus
tcccaaccagaaaaag

SEQ ID NO: 518716 - DNA, 17 bp, R. norvegicus
tcccaaccataaagagc

SEQ ID NO: 518717 - DNA, 16 bp, R. norvegicus
tcccaaccatctgtaa

SEQ ID NO: 518718 - DNA, 16 bp, R. norvegicus
tcccaaccctcaggag

SEQ ID NO: 518719 - DNA, 26 bp, R. norvegicus
tcccaaccctccacgacacctgttga

SEQ ID NO: 518720 - DNA, 18 bp, R. norvegicus
tcccaactcagcccccaa

SEQ ID NO: 518721 - DNA, 16 bp, R. norvegicus
tcccaagaaaccagct

SEQ ID NO: 518722 - DNA, 16 bp, R. norvegicus
tcccaagaacccacat

SEQ ID NO: 518723 - DNA, 16 bp, R. norvegicus
tcccaagacagccagg

SEQ ID NO: 518724 - DNA, 16 bp, R. norvegicus
tcccaagagcagacaa

SEQ ID NO: 518725 - DNA, 16 bp, R. norvegicus
tcccaagagtccaggt

SEQ ID NO: 518726 - DNA, 16 bp, R. norvegicus
tcccaaggaagaaata

SEQ ID NO: 518727 - DNA, 16 bp, R. norvegicus
tcccaagtcccttcca

SEQ ID NO: 518728 - DNA, 16 bp, R. norvegicus
tcccaagtgcagagat

SEQ ID NO: 518729 - DNA, 16 bp, R. norvegicus
tcccaagtgctgcagc

SEQ ID NO: 518730 - DNA, 16 bp, R. norvegicus
tcccaagtgctggact

SEQ ID NO: 518731 - DNA, 16 bp, R. norvegicus
tcccaagtgctgggat

SEQ ID NO: 518732 - DNA, 16 bp, R. norvegicus
tcccaagtgctggggt

SEQ ID NO: 518733 - DNA, 16 bp, R. norvegicus
tcccaagtgctgtgat

SEQ ID NO: 518734 - DNA, 16 bp, R. norvegicus
tcccaatatgaatata

SEQ ID NO: 518735 - DNA, 16 bp, R. norvegicus
tcccaattaaatgttt

SEQ ID NO: 518736 - DNA, 16 bp, R. norvegicus
tcccacaatcatcctg

SEQ ID NO: 518737 - DNA, 16 bp, R. norvegicus
tcccacaatgacacac

SEQ ID NO: 518738 - DNA, 16 bp, R. norvegicus
tcccacacaaagaaaa

SEQ ID NO: 518739 - DNA, 16 bp, R. norvegicus
tcccacacacaggcaa

SEQ ID NO: 518740 - DNA, 16 bp, R. norvegicus
tcccacagctcctccc

SEQ ID NO: 518741 - DNA, 16 bp, R. norvegicus
tcccacagctctctgt

SEQ ID NO: 518742 - DNA, 16 bp, R. norvegicus
tcccaccacagcaagc

SEQ ID NO: 518743 - DNA, 16 bp, R. norvegicus
tcccaccaccaatgga

SEQ ID NO: 518744 - DNA, 16 bp, R. norvegicus
tcccaccagcaaagga

SEQ ID NO: 518745 - DNA, 16 bp, R. norvegicus
tcccaccagcactgga

SEQ ID NO: 518746 - DNA, 16 bp, R. norvegicus
tcccaccatcaatgga

SEQ ID NO: 518747 - DNA, 16 bp, R. norvegicus
tcccacccccagtgac

SEQ ID NO: 518748 - DNA, 16 bp, R. norvegicus
tcccacctcagcctcc

SEQ ID NO: 518749 - DNA, 16 bp, R. norvegicus
tcccacctcagctccc

SEQ ID NO: 518750 - DNA, 16 bp, R. norvegicus
tcccacctctgtctct

SEQ ID NO: 518751 - DNA, 16 bp, R. norvegicus
tcccacctgctcagag

SEQ ID NO: 518752 - DNA, 16 bp, R. norvegicus
tcccaccttgatgata

SEQ ID NO: 518753 - DNA, 16 bp, R. norvegicus
tcccactaaggccaga

SEQ ID NO: 518754 - DNA, 16 bp, R. norvegicus
tcccactataatcagg

SEQ ID NO: 518755 - DNA, 16 bp, R. norvegicus
tcccactctcatgacc

SEQ ID NO: 518756 - DNA, 16 bp, R. norvegicus
tcccactgaggccaca

SEQ ID NO: 518757 - DNA, 16 bp, R. norvegicus
tcccactgtggcctgc

SEQ ID NO: 518758 - DNA, 16 bp, R. norvegicus
tcccacttgttccttg

SEQ ID NO: 518759 - DNA, 16 bp, R. norvegicus
tcccagaagacttctg

SEQ ID NO: 518760 - DNA, 16 bp, R. norvegicus
tcccagaagcctttgc

SEQ ID NO: 518761 - DNA, 16 bp, R. norvegicus
tcccagaaggaaaaag

SEQ ID NO: 518762 - DNA, 16 bp, R. norvegicus
tcccagaattccaaag

SEQ ID NO: 518763 - DNA, 16 bp, R. norvegicus
tcccagaatttgagag

SEQ ID NO: 518764 - DNA, 16 bp, R. norvegicus
tcccagacaccagaga

SEQ ID NO: 518765 - DNA, 16 bp, R. norvegicus
tcccagacccagaaag

SEQ ID NO: 518766 - DNA, 16 bp, R. norvegicus
tcccagaccccttgag

SEQ ID NO: 518767 - DNA, 16 bp, R. norvegicus
tcccagactgctcctg

SEQ ID NO: 518768 - DNA, 16 bp, R. norvegicus
tcccagacttctcctg

SEQ ID NO: 518769 - DNA, 16 bp, R. norvegicus
tcccagagactaagtc

SEQ ID NO: 518770 - DNA, 16 bp, R. norvegicus
tcccagagactgagct

SEQ ID NO: 518771 - DNA, 16 bp, R. norvegicus
tcccagagcaaaggca

SEQ ID NO: 518772 - DNA, 16 bp, R. norvegicus
tcccagaggaattttg

SEQ ID NO: 518773 - DNA, 16 bp, R. norvegicus
tcccagaggaccagag

SEQ ID NO: 518774 - DNA, 16 bp, R. norvegicus
tcccagaggacccaag

SEQ ID NO: 518775 - DNA, 16 bp, R. norvegicus
tcccagaggatccagg

SEQ ID NO: 518776 - DNA, 16 bp, R. norvegicus
tcccagaggcagaggc

SEQ ID NO: 518777 - DNA, 21 bp, R. norvegicus
tcccagaggtcctgagttcaa

SEQ ID NO: 518778 - DNA, 16 bp, R. norvegicus
tcccagagttcctctc

SEQ ID NO: 518779 - DNA, 29 bp, R. norvegicus
tcccagatgcccttcaacagaggaatgga

SEQ ID NO: 518780 - DNA, 16 bp, R. norvegicus
tcccagatgtccttca

SEQ ID NO: 518781 - DNA, 18 bp, R. norvegicus
tcccagcaaataggagag

SEQ ID NO: 518782 - DNA, 33 bp, R. norvegicus
tcccagcaaccacatggtggctcacaaccatct

SEQ ID NO: 518783 - DNA, 24 bp, R. norvegicus
tcccagcaaccacatggtggctcg

SEQ ID NO: 518784 - DNA, 16 bp, R. norvegicus
tcccagcaaccactgg

SEQ ID NO: 518785 - DNA, 16 bp, R. norvegicus
tcccagcaaccagatg

SEQ ID NO: 518786 - DNA, 16 bp, R. norvegicus
tcccagcaccacacag

SEQ ID NO: 518787 - DNA, 16 bp, R. norvegicus
tcccagcaccagccag

SEQ ID NO: 518788 - DNA, 16 bp, R. norvegicus
tcccagcaccaggagg

SEQ ID NO: 518789 - DNA, 16 bp, R. norvegicus
tcccagcacccacacg

SEQ ID NO: 518790 - DNA, 16 bp, R. norvegicus
tcccagcacccaggag

SEQ ID NO: 518791 - DNA, 16 bp, R. norvegicus
tcccagcacccaggga

SEQ ID NO: 518792 - DNA, 16 bp, R. norvegicus
tcccagcacccaggta

SEQ ID NO: 518793 - DNA, 16 bp, R. norvegicus
tcccagcactcaggaa

SEQ ID NO: 518794 - DNA, 16 bp, R. norvegicus
tcccagcactgcagaa

SEQ ID NO: 518795 - DNA, 16 bp, R. norvegicus
tcccagcactgtggag

SEQ ID NO: 518796 - DNA, 16 bp, R. norvegicus
tcccagcacttggaaa

SEQ ID NO: 518797 - DNA, 16 bp, R. norvegicus
tcccagcacttggggt

SEQ ID NO: 518798 - DNA, 16 bp, R. norvegicus
tcccagcagccacatg

SEQ ID NO: 518799 - DNA, 16 bp, R. norvegicus
tcccagcagccttcag

SEQ ID NO: 518800 - DNA, 16 bp, R. norvegicus
tcccagcagctctctg

SEQ ID NO: 518801 - DNA, 16 bp, R. norvegicus
tcccagcatcccagca

SEQ ID NO: 518802 - DNA, 16 bp, R. norvegicus
tcccagcatcctctgc

SEQ ID NO: 518803 - DNA, 16 bp, R. norvegicus
tcccagcatctacatc

SEQ ID NO: 518804 - DNA, 16 bp, R. norvegicus
tcccagcatgcagtgc

SEQ ID NO: 518805 - DNA, 16 bp, R. norvegicus
tcccagcatgccctgc

SEQ ID NO: 518806 - DNA, 16 bp, R. norvegicus
tcccagcatggagagg

SEQ ID NO: 518807 - DNA, 16 bp, R. norvegicus
tcccagcattacagga

SEQ ID NO: 518808 - DNA, 16 bp, R. norvegicus
tcccagccagcagcag

SEQ ID NO: 518809 - DNA, 16 bp, R. norvegicus
tcccagccagctgcag

SEQ ID NO: 518810 - DNA, 16 bp, R. norvegicus
tcccagccagtctcca

SEQ ID NO: 518811 - DNA, 16 bp, R. norvegicus
tcccagcccctcactg

SEQ ID NO: 518812 - DNA, 16 bp, R. norvegicus
tcccagcctcccagat

SEQ ID NO: 518813 - DNA, 16 bp, R. norvegicus
tcccagctccagaaaa

SEQ ID NO: 518814 - DNA, 16 bp, R. norvegicus
tcccagctcccagctc

SEQ ID NO: 518815 - DNA, 16 bp, R. norvegicus
tcccagctctccacag

SEQ ID NO: 518816 - DNA, 16 bp, R. norvegicus
tcccagcttcaccctg

SEQ ID NO: 518817 - DNA, 16 bp, R. norvegicus
tcccagcttcccttgc

SEQ ID NO: 518818 - DNA, 16 bp, R. norvegicus
tcccaggaaaacacaa

SEQ ID NO: 518819 - DNA, 16 bp, R. norvegicus
tcccaggaaccaacag

SEQ ID NO: 518820 - DNA, 16 bp, R. norvegicus
tcccaggacccaaagg

SEQ ID NO: 518821 - DNA, 16 bp, R. norvegicus
tcccaggacccacata

SEQ ID NO: 518822 - DNA, 16 bp, R. norvegicus
tcccaggactcagcag

SEQ ID NO: 518823 - DNA, 16 bp, R. norvegicus
tcccaggagacagagc

SEQ ID NO: 518824 - DNA, 16 bp, R. norvegicus
tcccaggagactgagg

SEQ ID NO: 518825 - DNA, 16 bp, R. norvegicus
tcccaggagagccctg

SEQ ID NO: 518826 - DNA, 16 bp, R. norvegicus
tcccaggagagctctg

SEQ ID NO: 518827 - DNA, 16 bp, R. norvegicus
tcccaggagcaggctc

SEQ ID NO: 518828 - DNA, 16 bp, R. norvegicus
tcccaggaggaggagg

SEQ ID NO: 518829 - DNA, 16 bp, R. norvegicus
tcccaggaggcaaagg

SEQ ID NO: 518830 - DNA, 16 bp, R. norvegicus
tcccaggccaacatcc

SEQ ID NO: 518831 - DNA, 16 bp, R. norvegicus
tcccaggccagccaag

SEQ ID NO: 518832 - DNA, 16 bp, R. norvegicus
tcccaggccagcctgg

SEQ ID NO: 518833 - DNA, 16 bp, R. norvegicus
tcccaggcctgcaggg

SEQ ID NO: 518834 - DNA, 16 bp, R. norvegicus
tcccaggtgctggaat

SEQ ID NO: 518835 - DNA, 16 bp, R. norvegicus
tcccagtactgggatt

SEQ ID NO: 518836 - DNA, 16 bp, R. norvegicus
tcccagtcacctcctc

SEQ ID NO: 518837 - DNA, 16 bp, R. norvegicus
tcccagtcctgacttc

SEQ ID NO: 518838 - DNA, 16 bp, R. norvegicus
tcccagtctcccagga

SEQ ID NO: 518839 - DNA, 16 bp, R. norvegicus
tcccagtgactgatga

SEQ ID NO: 518840 - DNA, 16 bp, R. norvegicus
tcccagtgccagggag

SEQ ID NO: 518841 - DNA, 16 bp, R. norvegicus
tcccagtgcccacaca

SEQ ID NO: 518842 - DNA, 16 bp, R. norvegicus
tcccagtgctgagaag

SEQ ID NO: 518843 - DNA, 16 bp, R. norvegicus
tcccagtgctgggagg

SEQ ID NO: 518844 - DNA, 16 bp, R. norvegicus
tcccagtggtgcctgg

SEQ ID NO: 518845 - DNA, 16 bp, R. norvegicus
tcccagttgggtcctg

SEQ ID NO: 518846 - DNA, 16 bp, R. norvegicus
tcccagtttccctttc

SEQ ID NO: 518847 - DNA, 16 bp, R. norvegicus
tcccataatccttccc

SEQ ID NO: 518848 - DNA, 16 bp, R. norvegicus
tcccatcatcatcatc

SEQ ID NO: 518849 - DNA, 16 bp, R. norvegicus
tcccatccaggtccct

SEQ ID NO: 518850 - DNA, 16 bp, R. norvegicus
tcccatcccatccatc

SEQ ID NO: 518851 - DNA, 16 bp, R. norvegicus
tcccatcccattgatg

SEQ ID NO: 518852 - DNA, 16 bp, R. norvegicus
tcccatctacccactc

SEQ ID NO: 518853 - DNA, 17 bp, R. norvegicus
tcccatctatgaaccag

SEQ ID NO: 518854 - DNA, 16 bp, R. norvegicus
tcccatctcagcctcc

SEQ ID NO: 518855 - DNA, 16 bp, R. norvegicus
tcccatctctgcctcc

SEQ ID NO: 518856 - DNA, 16 bp, R. norvegicus
tcccatgcccatgtgt

SEQ ID NO: 518857 - DNA, 16 bp, R. norvegicus
tcccatgctcagtctg

SEQ ID NO: 518858 - DNA, 16 bp, R. norvegicus
tcccatgctcccagaa

SEQ ID NO: 518859 - DNA, 16 bp, R. norvegicus
tcccatgctctcttct

SEQ ID NO: 518860 - DNA, 17 bp, R. norvegicus
tcccattaccagaatag

SEQ ID NO: 518861 - DNA, 16 bp, R. norvegicus
tcccattcagagcctg

SEQ ID NO: 518862 - DNA, 16 bp, R. norvegicus
tcccattccagtctcc

SEQ ID NO: 518863 - DNA, 16 bp, R. norvegicus
tcccattgctgtgaca

SEQ ID NO: 518864 - DNA, 16 bp, R. norvegicus
tcccattggtacccaa

SEQ ID NO: 518865 - DNA, 16 bp, R. norvegicus
tcccatttatggctga

SEQ ID NO: 518866 - DNA, 16 bp, R. norvegicus
tcccatttttaaatag

SEQ ID NO: 518867 - DNA, 16 bp, R. norvegicus
tccccaaacagtgtca

SEQ ID NO: 518868 - DNA, 16 bp, R. norvegicus
tccccaacaagaccag

SEQ ID NO: 518869 - DNA, 16 bp, R. norvegicus
tccccaaccccaaggc

SEQ ID NO: 518870 - DNA, 16 bp, R. norvegicus
tccccaaccccagatg

SEQ ID NO: 518871 - DNA, 16 bp, R. norvegicus
tccccaaccccagcaa

SEQ ID NO: 518872 - DNA, 17 bp, R. norvegicus
tccccaaccccagcaat

SEQ ID NO: 518873 - DNA, 16 bp, R. norvegicus
tccccaaccccaggaa

SEQ ID NO: 518874 - DNA, 16 bp, R. norvegicus
tccccaaccccatgat

SEQ ID NO: 518875 - DNA, 16 bp, R. norvegicus
tccccaaccccatttt

SEQ ID NO: 518876 - DNA, 16 bp, R. norvegicus
tccccaacccccagac

SEQ ID NO: 518877 - DNA, 16 bp, R. norvegicus
tccccaacccccagct

SEQ ID NO: 518878 - DNA, 16 bp, R. norvegicus
tccccaacccccagtt

SEQ ID NO: 518879 - DNA, 16 bp, R. norvegicus
tccccaaccccctgaa

SEQ ID NO: 518880 - DNA, 16 bp, R. norvegicus
tccccaaccccctgtc

SEQ ID NO: 518881 - DNA, 16 bp, R. norvegicus
tccccaacccccttgc

SEQ ID NO: 518882 - DNA, 16 bp, R. norvegicus
tccccaacccccttta

SEQ ID NO: 518883 - DNA, 16 bp, R. norvegicus
tccccaaccccgaagg

SEQ ID NO: 518884 - DNA, 16 bp, R. norvegicus
tccccaaccccgagtg

SEQ ID NO: 518885 - DNA, 16 bp, R. norvegicus
tccccaaccccgctgt

SEQ ID NO: 518886 - DNA, 16 bp, R. norvegicus
tccccaacccctgcat

SEQ ID NO: 518887 - DNA, 16 bp, R. norvegicus
tccccaaccccttgga

SEQ ID NO: 518888 - DNA, 16 bp, R. norvegicus
tccccaaccccttggc

SEQ ID NO: 518889 - DNA, 16 bp, R. norvegicus
tccccaacccctttgg

SEQ ID NO: 518890 - DNA, 16 bp, R. norvegicus
tccccaaccctgtttt

SEQ ID NO: 518891 - DNA, 16 bp, R. norvegicus
tccccaagcccaatga

SEQ ID NO: 518892 - DNA, 16 bp, R. norvegicus
tccccaataaaaacat

SEQ ID NO: 518893 - DNA, 16 bp, R. norvegicus
tccccacaaaagaaaa

SEQ ID NO: 518894 - DNA, 16 bp, R. norvegicus
tccccacacctgatcc

SEQ ID NO: 518895 - DNA, 16 bp, R. norvegicus
tccccaccatgacatt

SEQ ID NO: 518896 - DNA, 16 bp, R. norvegicus
tccccactgagtcctg

SEQ ID NO: 518897 - DNA, 16 bp, R. norvegicus
tccccagaactggctg

SEQ ID NO: 518898 - DNA, 16 bp, R. norvegicus
tccccagagagtcctc

SEQ ID NO: 518899 - DNA, 16 bp, R. norvegicus
tccccagagcaagctg

SEQ ID NO: 518900 - DNA, 16 bp, R. norvegicus
tccccagagcccacag

SEQ ID NO: 518901 - DNA, 16 bp, R. norvegicus
tccccagagctcactg

SEQ ID NO: 518902 - DNA, 16 bp, R. norvegicus
tccccagagctctcag

SEQ ID NO: 518903 - DNA, 16 bp, R. norvegicus
tccccagcaacagttt

SEQ ID NO: 518904 - DNA, 16 bp, R. norvegicus
tccccagcaccaaata

SEQ ID NO: 518905 - DNA, 16 bp, R. norvegicus
tccccagcacccactt

SEQ ID NO: 518906 - DNA, 16 bp, R. norvegicus
tccccagcacccaggt

SEQ ID NO: 518907 - DNA, 16 bp, R. norvegicus
tccccagcactgcaga

SEQ ID NO: 518908 - DNA, 16 bp, R. norvegicus
tccccagccccaagca

SEQ ID NO: 518909 - DNA, 16 bp, R. norvegicus
tccccagccccacaga

SEQ ID NO: 518910 - DNA, 16 bp, R. norvegicus
tccccagccccacctt

SEQ ID NO: 518911 - DNA, 16 bp, R. norvegicus
tccccagccccagaag

SEQ ID NO: 518912 - DNA, 16 bp, R. norvegicus
tccccagccccagcag

SEQ ID NO: 518913 - DNA, 16 bp, R. norvegicus
tccccagccccagctc

SEQ ID NO: 518914 - DNA, 16 bp, R. norvegicus
tccccagccccagctg

SEQ ID NO: 518915 - DNA, 16 bp, R. norvegicus
tccccagccccagctt

SEQ ID NO: 518916 - DNA, 16 bp, R. norvegicus
tccccagccccatctc

SEQ ID NO: 518917 - DNA, 16 bp, R. norvegicus
tccccagcccccacat

SEQ ID NO: 518918 - DNA, 16 bp, R. norvegicus
tccccagcccccagca

SEQ ID NO: 518919 - DNA, 16 bp, R. norvegicus
tccccagcccccaggg

SEQ ID NO: 518920 - DNA, 16 bp, R. norvegicus
tccccagccccccaga

SEQ ID NO: 518921 - DNA, 16 bp, R. norvegicus
tccccagccccccagg

SEQ ID NO: 518922 - DNA, 16 bp, R. norvegicus
tccccagccccccttt

SEQ ID NO: 518923 - DNA, 16 bp, R. norvegicus
tccccagccccctgct

SEQ ID NO: 518924 - DNA, 16 bp, R. norvegicus
tccccagccccctgtg

SEQ ID NO: 518925 - DNA, 16 bp, R. norvegicus
tccccagcccccttca

SEQ ID NO: 518926 - DNA, 16 bp, R. norvegicus
tccccagccccgagca

SEQ ID NO: 518927 - DNA, 16 bp, R. norvegicus
tccccagccccgagga

SEQ ID NO: 518928 - DNA, 16 bp, R. norvegicus
tccccagccccgcaac

SEQ ID NO: 518929 - DNA, 16 bp, R. norvegicus
tccccagccccgcagc

SEQ ID NO: 518930 - DNA, 16 bp, R. norvegicus
tccccagccccgtgtg

SEQ ID NO: 518931 - DNA, 16 bp, R. norvegicus
tccccagcccctaaat

SEQ ID NO: 518932 - DNA, 16 bp, R. norvegicus
tccccagcccctcagt

SEQ ID NO: 518933 - DNA, 16 bp, R. norvegicus
tccccagcccctccag

SEQ ID NO: 518934 - DNA, 16 bp, R. norvegicus
tccccagcccctctaa

SEQ ID NO: 518935 - DNA, 16 bp, R. norvegicus
tccccagcccctgaca

SEQ ID NO: 518936 - DNA, 16 bp, R. norvegicus
tccccagcccctgctc

SEQ ID NO: 518937 - DNA, 16 bp, R. norvegicus
tccccagcccctgctg

SEQ ID NO: 518938 - DNA, 16 bp, R. norvegicus
tccccagcccctgtga

SEQ ID NO: 518939 - DNA, 16 bp, R. norvegicus
tccccagccccttctc

SEQ ID NO: 518940 - DNA, 16 bp, R. norvegicus
tccccagccctgctcc

SEQ ID NO: 518941 - DNA, 16 bp, R. norvegicus
tccccagccctggaaa

SEQ ID NO: 518942 - DNA, 16 bp, R. norvegicus
tccccagcccttcctc

SEQ ID NO: 518943 - DNA, 16 bp, R. norvegicus
tccccagcccttgttt

SEQ ID NO: 518944 - DNA, 16 bp, R. norvegicus
tccccagcctcagcct

SEQ ID NO: 518945 - DNA, 16 bp, R. norvegicus
tccccagcctgtgctg

SEQ ID NO: 518946 - DNA, 16 bp, R. norvegicus
tccccagctccagaaa

SEQ ID NO: 518947 - DNA, 16 bp, R. norvegicus
tccccagctccagctc

SEQ ID NO: 518948 - DNA, 16 bp, R. norvegicus
tccccagctccaggaa

SEQ ID NO: 518949 - DNA, 20 bp, R. norvegicus
tccccagctccgaaaaaaaa

SEQ ID NO: 518950 - DNA, 16 bp, R. norvegicus
tccccagctcgggaaa

SEQ ID NO: 518951 - DNA, 16 bp, R. norvegicus
tccccagctctgccct

SEQ ID NO: 518952 - DNA, 16 bp, R. norvegicus
tccccaggagctggag

SEQ ID NO: 518953 - DNA, 16 bp, R. norvegicus
tccccagggaagagca

SEQ ID NO: 518954 - DNA, 16 bp, R. norvegicus
tccccaggggctggct

SEQ ID NO: 518955 - DNA, 16 bp, R. norvegicus
tccccagtactgcaaa

SEQ ID NO: 518956 - DNA, 16 bp, R. norvegicus
tccccagtctcctccc

SEQ ID NO: 518957 - DNA, 16 bp, R. norvegicus
tccccagtgcccgtgt

SEQ ID NO: 518958 - DNA, 16 bp, R. norvegicus
tccccatattttcttc

SEQ ID NO: 518959 - DNA, 16 bp, R. norvegicus
tccccatcaaaatcac

SEQ ID NO: 518960 - DNA, 17 bp, R. norvegicus
tccccatcaaaatgcca

SEQ ID NO: 518961 - DNA, 16 bp, R. norvegicus
tccccatcctgtctct

SEQ ID NO: 518962 - DNA, 18 bp, R. norvegicus
tccccatggcttaccacc

SEQ ID NO: 518963 - DNA, 16 bp, R. norvegicus
tccccatgttgtggtg

SEQ ID NO: 518964 - DNA, 16 bp, R. norvegicus
tccccattgccaccct

SEQ ID NO: 518965 - DNA, 16 bp, R. norvegicus
tcccccaaagctccca

SEQ ID NO: 518966 - DNA, 16 bp, R. norvegicus
tcccccaacctggggc

SEQ ID NO: 518967 - DNA, 16 bp, R. norvegicus
tcccccaactctttca

SEQ ID NO: 518968 - DNA, 16 bp, R. norvegicus
tcccccagatccactg

SEQ ID NO: 518969 - DNA, 16 bp, R. norvegicus
tcccccagtctctgcc

SEQ ID NO: 518970 - DNA, 16 bp, R. norvegicus
tcccccagtgaggagc

SEQ ID NO: 518971 - DNA, 16 bp, R. norvegicus
tcccccagtgatggac

SEQ ID NO: 518972 - DNA, 16 bp, R. norvegicus
tccccccggagctggg

SEQ ID NO: 518973 - DNA, 16 bp, R. norvegicus
tcccccctcccacagt

SEQ ID NO: 518974 - DNA, 16 bp, R. norvegicus
tcccccggaagtcctt

SEQ ID NO: 518975 - DNA, 23 bp, R. norvegicus
tcccccggtgcgctttctaaaaa

SEQ ID NO: 518976 - DNA, 16 bp, R. norvegicus
tccccctcccactgct

SEQ ID NO: 518977 - DNA, 16 bp, R. norvegicus
tccccctcttccacaa

SEQ ID NO: 518978 - DNA, 16 bp, R. norvegicus
tccccctcttcctgga

SEQ ID NO: 518979 - DNA, 16 bp, R. norvegicus
tccccctgcctccact

SEQ ID NO: 518980 - DNA, 16 bp, R. norvegicus
tcccccttgcctctga

SEQ ID NO: 518981 - DNA, 16 bp, R. norvegicus
tccccctttcccagtt

SEQ ID NO: 518982 - DNA, 18 bp, R. norvegicus
tccccgtacgggccacca

SEQ ID NO: 518983 - DNA, 16 bp, R. norvegicus
tcccctaatcctctta

SEQ ID NO: 518984 - DNA, 16 bp, R. norvegicus
tcccctacactggggt

SEQ ID NO: 518985 - DNA, 16 bp, R. norvegicus
tcccctacccaatacc

SEQ ID NO: 518986 - DNA, 16 bp, R. norvegicus
tcccctatctcttcca

SEQ ID NO: 518987 - DNA, 16 bp, R. norvegicus
tcccctcagggctcag

SEQ ID NO: 518988 - DNA, 16 bp, R. norvegicus
tcccctccagatccac

SEQ ID NO: 518989 - DNA, 16 bp, R. norvegicus
tcccctccagtacctg

SEQ ID NO: 518990 - DNA, 16 bp, R. norvegicus
tcccctctacacacac

SEQ ID NO: 518991 - DNA, 16 bp, R. norvegicus
tcccctctccagctct

SEQ ID NO: 518992 - DNA, 16 bp, R. norvegicus
tcccctctcctccaga

SEQ ID NO: 518993 - DNA, 16 bp, R. norvegicus
tcccctctgcaaatcc

SEQ ID NO: 518994 - DNA, 16 bp, R. norvegicus
tcccctgcaagaacaa

SEQ ID NO: 518995 - DNA, 16 bp, R. norvegicus
tcccctgctgtgaaaa

SEQ ID NO: 518996 - DNA, 16 bp, R. norvegicus
tcccctggaactggag

SEQ ID NO: 518997 - DNA, 16 bp, R. norvegicus
tcccctggagatggag

SEQ ID NO: 518998 - DNA, 16 bp, R. norvegicus
tcccctggagcttgag

SEQ ID NO: 518999 - DNA, 16 bp, R. norvegicus
tcccctgtgtctgaga

SEQ ID NO: 519000 - DNA, 16 bp, R. norvegicus
tccccttccaccaggt

SEQ ID NO: 519001 - DNA, 16 bp, R. norvegicus
tccccttcctcatggg

SEQ ID NO: 519002 - DNA, 16 bp, R. norvegicus
tccccttctacatggg

SEQ ID NO: 519003 - DNA, 16 bp, R. norvegicus
tccccttctcctgtga

SEQ ID NO: 519004 - DNA, 16 bp, R. norvegicus
tccccttctgctgcct

SEQ ID NO: 519005 - DNA, 16 bp, R. norvegicus
tccccttctttatggt

SEQ ID NO: 519006 - DNA, 16 bp, R. norvegicus
tccccttggaactgga

SEQ ID NO: 519007 - DNA, 16 bp, R. norvegicus
tcccctttcctagttc

SEQ ID NO: 519008 - DNA, 16 bp, R. norvegicus
tccccttttcatcatg

SEQ ID NO: 519009 - DNA, 16 bp, R. norvegicus
tcccgactgctgggat

SEQ ID NO: 519010 - DNA, 16 bp, R. norvegicus
tcccgaggctcaggtt

SEQ ID NO: 519011 - DNA, 16 bp, R. norvegicus
tcccgagtgctggaat

SEQ ID NO: 519012 - DNA, 16 bp, R. norvegicus
tcccgagtgctgggat

SEQ ID NO: 519013 - DNA, 16 bp, R. norvegicus
tcccgcagcacacagc

SEQ ID NO: 519014 - DNA, 25 bp, R. norvegicus
tcccgcatccgagtgtggtttcaga

SEQ ID NO: 519015 - DNA, 16 bp, R. norvegicus
tcccgcctttcactct

SEQ ID NO: 519016 - DNA, 16 bp, R. norvegicus
tcccgggtgccatctt

SEQ ID NO: 519017 - DNA, 18 bp, R. norvegicus
tcccgtcccactgtggcc

SEQ ID NO: 519018 - DNA, 16 bp, R. norvegicus
tccctaaagaaatgtt

SEQ ID NO: 519019 - DNA, 17 bp, R. norvegicus
tccctaacctaaagaaa

SEQ ID NO: 519020 - DNA, 16 bp, R. norvegicus
tccctaatttccttct

SEQ ID NO: 519021 - DNA, 18 bp, R. norvegicus
tccctaccaagggtattc

SEQ ID NO: 519022 - DNA, 16 bp, R. norvegicus
tccctaccttcagggg

SEQ ID NO: 519023 - DNA, 16 bp, R. norvegicus
tccctagcaccacata

SEQ ID NO: 519024 - DNA, 16 bp, R. norvegicus
tccctagcctgagtca

SEQ ID NO: 519025 - DNA, 17 bp, R. norvegicus
tccctatagccctaaac

SEQ ID NO: 519026 - DNA, 16 bp, R. norvegicus
tccctatctctgtctc

SEQ ID NO: 519027 - DNA, 16 bp, R. norvegicus
tccctatgaagaaatg

SEQ ID NO: 519028 - DNA, 16 bp, R. norvegicus
tccctatgtagctctg

SEQ ID NO: 519029 - DNA, 16 bp, R. norvegicus
tccctatgtggggcag

SEQ ID NO: 519030 - DNA, 16 bp, R. norvegicus
tccctcacctgaagaa

SEQ ID NO: 519031 - DNA, 16 bp, R. norvegicus
tccctcagacactgga

SEQ ID NO: 519032 - DNA, 16 bp, R. norvegicus
tccctcagaggagaag

SEQ ID NO: 519033 - DNA, 16 bp, R. norvegicus
tccctcagcagaagaa

SEQ ID NO: 519034 - DNA, 16 bp, R. norvegicus
tccctcagcagccatc

SEQ ID NO: 519035 - DNA, 16 bp, R. norvegicus
tccctcagcctcctga

SEQ ID NO: 519036 - DNA, 16 bp, R. norvegicus
tccctcagctcctcca

SEQ ID NO: 519037 - DNA, 16 bp, R. norvegicus
tccctcagctccttca

SEQ ID NO: 519038 - DNA, 16 bp, R. norvegicus
tccctccagtccctcc

SEQ ID NO: 519039 - DNA, 16 bp, R. norvegicus
tccctcccccagcagc

SEQ ID NO: 519040 - DNA, 16 bp, R. norvegicus
tccctccctacctctg

SEQ ID NO: 519041 - DNA, 16 bp, R. norvegicus
tccctccctccagtcc

SEQ ID NO: 519042 - DNA, 16 bp, R. norvegicus
tccctcctcccagcct

SEQ ID NO: 519043 - DNA, 16 bp, R. norvegicus
tccctcctgtgagcct

SEQ ID NO: 519044 - DNA, 16 bp, R. norvegicus
tccctctacctcctgt

SEQ ID NO: 519045 - DNA, 16 bp, R. norvegicus
tccctctcactgcccc

SEQ ID NO: 519046 - DNA, 16 bp, R. norvegicus
tccctctccatgtgct

SEQ ID NO: 519047 - DNA, 16 bp, R. norvegicus
tccctctcctggtcca

SEQ ID NO: 519048 - DNA, 16 bp, R. norvegicus
tccctctgagcctggc

SEQ ID NO: 519049 - DNA, 16 bp, R. norvegicus
tccctctgcctcctgt

SEQ ID NO: 519050 - DNA, 16 bp, R. norvegicus
tccctctgccttccat

SEQ ID NO: 519051 - DNA, 16 bp, R. norvegicus
tccctctgctcttgac

SEQ ID NO: 519052 - DNA, 16 bp, R. norvegicus
tccctctggagctgga

SEQ ID NO: 519053 - DNA, 16 bp, R. norvegicus
tccctctggggaagaa

SEQ ID NO: 519054 - DNA, 16 bp, R. norvegicus
tccctctgtccctctg

SEQ ID NO: 519055 - DNA, 16 bp, R. norvegicus
tccctctgtctggaat

SEQ ID NO: 519056 - DNA, 16 bp, R. norvegicus
tccctcttgctgcctc

SEQ ID NO: 519057 - DNA, 16 bp, R. norvegicus
tccctgaaactgacca

SEQ ID NO: 519058 - DNA, 16 bp, R. norvegicus
tccctgacccagcagc

SEQ ID NO: 519059 - DNA, 16 bp, R. norvegicus
tccctgaccctgaaga

SEQ ID NO: 519060 - DNA, 16 bp, R. norvegicus
tccctgacttccctca

SEQ ID NO: 519061 - DNA, 16 bp, R. norvegicus
tccctgagcctgaggt

SEQ ID NO: 519062 - DNA, 16 bp, R. norvegicus
tccctgagcctgttgc

SEQ ID NO: 519063 - DNA, 16 bp, R. norvegicus
tccctgagctgaccaa

SEQ ID NO: 519064 - DNA, 16 bp, R. norvegicus
tccctgaggtgctctc

SEQ ID NO: 519065 - DNA, 17 bp, R. norvegicus
tccctgatgtgcttctc

SEQ ID NO: 519066 - DNA, 16 bp, R. norvegicus
tccctgcacttcttgt

SEQ ID NO: 519067 - DNA, 16 bp, R. norvegicus
tccctgcaggatggaa

SEQ ID NO: 519068 - DNA, 16 bp, R. norvegicus
tccctgcagttctttc

SEQ ID NO: 519069 - DNA, 16 bp, R. norvegicus
tccctgcatccctgaa

SEQ ID NO: 519070 - DNA, 16 bp, R. norvegicus
tccctgcatccctggt

SEQ ID NO: 519071 - DNA, 16 bp, R. norvegicus
tccctgcatccctgtg

SEQ ID NO: 519072 - DNA, 16 bp, R. norvegicus
tccctgcatgcctgtg

SEQ ID NO: 519073 - DNA, 16 bp, R. norvegicus
tccctgcattttcttt

SEQ ID NO: 519074 - DNA, 16 bp, R. norvegicus
tccctgccacccctgt

SEQ ID NO: 519075 - DNA, 16 bp, R. norvegicus
tccctgcccccagttg

SEQ ID NO: 519076 - DNA, 16 bp, R. norvegicus
tccctgccctgacatt

SEQ ID NO: 519077 - DNA, 16 bp, R. norvegicus
tccctgcctctctctg

SEQ ID NO: 519078 - DNA, 16 bp, R. norvegicus
tccctgcctgcctctg

SEQ ID NO: 519079 - DNA, 16 bp, R. norvegicus
tccctgccttctactc

SEQ ID NO: 519080 - DNA, 16 bp, R. norvegicus
tccctgcgagctctgg

SEQ ID NO: 519081 - DNA, 18 bp, R. norvegicus
tccctgcgcctgagacac

SEQ ID NO: 519082 - DNA, 16 bp, R. norvegicus
tccctgctccactctg

SEQ ID NO: 519083 - DNA, 16 bp, R. norvegicus
tccctgctcccaaacc

SEQ ID NO: 519084 - DNA, 16 bp, R. norvegicus
tccctgctcctgcacc

SEQ ID NO: 519085 - DNA, 16 bp, R. norvegicus
tccctgctgcctgcca

SEQ ID NO: 519086 - DNA, 16 bp, R. norvegicus
tccctgcttccctgct

SEQ ID NO: 519087 - DNA, 16 bp, R. norvegicus
tccctggaactggggt

SEQ ID NO: 519088 - DNA, 16 bp, R. norvegicus
tccctggaagctctgg

SEQ ID NO: 519089 - DNA, 16 bp, R. norvegicus
tccctggaaggcatgt

SEQ ID NO: 519090 - DNA, 16 bp, R. norvegicus
tccctggaagtctggt

SEQ ID NO: 519091 - DNA, 16 bp, R. norvegicus
tccctggaagtggagt

SEQ ID NO: 519092 - DNA, 16 bp, R. norvegicus
tccctggaatccacat

SEQ ID NO: 519093 - DNA, 16 bp, R. norvegicus
tccctggagatgacta

SEQ ID NO: 519094 - DNA, 16 bp, R. norvegicus
tccctggagctcactg

SEQ ID NO: 519095 - DNA, 16 bp, R. norvegicus
tccctggagctgcagt

SEQ ID NO: 519096 - DNA, 16 bp, R. norvegicus
tccctggaggctctgg

SEQ ID NO: 519097 - DNA, 16 bp, R. norvegicus
tccctggatcagcatg

SEQ ID NO: 519098 - DNA, 16 bp, R. norvegicus
tccctggatgatggac

SEQ ID NO: 519099 - DNA, 16 bp, R. norvegicus
tccctggcatgaagcc

SEQ ID NO: 519100 - DNA, 16 bp, R. norvegicus
tccctggcccaatagg

SEQ ID NO: 519101 - DNA, 16 bp, R. norvegicus
tccctggccctcatag

SEQ ID NO: 519102 - DNA, 16 bp, R. norvegicus
tccctggcctcagtcc

SEQ ID NO: 519103 - DNA, 16 bp, R. norvegicus
tccctggccttggtcc

SEQ ID NO: 519104 - DNA, 16 bp, R. norvegicus
tccctggctggccttg

SEQ ID NO: 519105 - DNA, 16 bp, R. norvegicus
tccctgggaagaagcc

SEQ ID NO: 519106 - DNA, 16 bp, R. norvegicus
tccctgggaatcacca

SEQ ID NO: 519107 - DNA, 16 bp, R. norvegicus
tccctgggacaagcat

SEQ ID NO: 519108 - DNA, 16 bp, R. norvegicus
tccctgggactcactg

SEQ ID NO: 519109 - DNA, 16 bp, R. norvegicus
tccctgggagctccag

SEQ ID NO: 519110 - DNA, 16 bp, R. norvegicus
tccctgggagctttgg

SEQ ID NO: 519111 - DNA, 16 bp, R. norvegicus
tccctgggctggaggt

SEQ ID NO: 519112 - DNA, 16 bp, R. norvegicus
tccctggggctggaga

SEQ ID NO: 519113 - DNA, 16 bp, R. norvegicus
tccctggtgctgggat

SEQ ID NO: 519114 - DNA, 16 bp, R. norvegicus
tccctggtgtttgctg

SEQ ID NO: 519115 - DNA, 16 bp, R. norvegicus
tccctgtccctccata

SEQ ID NO: 519116 - DNA, 16 bp, R. norvegicus
tccctgtctccaagag

SEQ ID NO: 519117 - DNA, 16 bp, R. norvegicus
tccctgtctccctgtg

SEQ ID NO: 519118 - DNA, 16 bp, R. norvegicus
tccctgtctgtcctgg

SEQ ID NO: 519119 - DNA, 16 bp, R. norvegicus
tccctgtctgtccttc

SEQ ID NO: 519120 - DNA, 16 bp, R. norvegicus
tccctgtgaggatcca

SEQ ID NO: 519121 - DNA, 16 bp, R. norvegicus
tccctgtgctggtggt

SEQ ID NO: 519122 - DNA, 16 bp, R. norvegicus
tccctgtgggcctgtg

SEQ ID NO: 519123 - DNA, 16 bp, R. norvegicus
tccctgtggtggtttg

SEQ ID NO: 519124 - DNA, 16 bp, R. norvegicus
tccctgtgtggccctg

SEQ ID NO: 519125 - DNA, 16 bp, R. norvegicus
tccctgtgtgtatgtg

SEQ ID NO: 519126 - DNA, 18 bp, R. norvegicus
tccctgtttccgggccaa

SEQ ID NO: 519127 - DNA, 16 bp, R. norvegicus
tccctgtttcctgtct

SEQ ID NO: 519128 - DNA, 16 bp, R. norvegicus
tccctgtttttagtgg

SEQ ID NO: 519129 - DNA, 16 bp, R. norvegicus
tcccttaaaagaaaac

SEQ ID NO: 519130 - DNA, 16 bp, R. norvegicus
tcccttaagaaatatt

SEQ ID NO: 519131 - DNA, 16 bp, R. norvegicus
tcccttataaaatatt

SEQ ID NO: 519132 - DNA, 16 bp, R. norvegicus
tcccttcagaaaacag

SEQ ID NO: 519133 - DNA, 16 bp, R. norvegicus
tcccttcagctcctca

SEQ ID NO: 519134 - DNA, 16 bp, R. norvegicus
tcccttcaggttctgg

SEQ ID NO: 519135 - DNA, 16 bp, R. norvegicus
tcccttccaagtgctg

SEQ ID NO: 519136 - DNA, 16 bp, R. norvegicus
tcccttccagccaggc

SEQ ID NO: 519137 - DNA, 16 bp, R. norvegicus
tcccttcccaataagg

SEQ ID NO: 519138 - DNA, 16 bp, R. norvegicus
tcccttctaccatgtg

SEQ ID NO: 519139 - DNA, 16 bp, R. norvegicus
tcccttctgcccagca

SEQ ID NO: 519140 - DNA, 16 bp, R. norvegicus
tcccttctgcctctgt

SEQ ID NO: 519141 - DNA, 16 bp, R. norvegicus
tcccttctgtctctgt

SEQ ID NO: 519142 - DNA, 16 bp, R. norvegicus
tcccttgccagaacag

SEQ ID NO: 519143 - DNA, 16 bp, R. norvegicus
tcccttggaacttgag

SEQ ID NO: 519144 - DNA, 16 bp, R. norvegicus
tcccttggccaagcat

SEQ ID NO: 519145 - DNA, 16 bp, R. norvegicus
tccctttaaataccct

SEQ ID NO: 519146 - DNA, 16 bp, R. norvegicus
tccctttccccagtgt

SEQ ID NO: 519147 - DNA, 16 bp, R. norvegicus
tccctttcccctgagg

SEQ ID NO: 519148 - DNA, 16 bp, R. norvegicus
tccctttgaaaaacag

SEQ ID NO: 519149 - DNA, 16 bp, R. norvegicus
tccctttgacctcatt

SEQ ID NO: 519150 - DNA, 16 bp, R. norvegicus
tccctttgacctcttt

SEQ ID NO: 519151 - DNA, 16 bp, R. norvegicus
tccctttgaccttttt

SEQ ID NO: 519152 - DNA, 16 bp, R. norvegicus
tccctttgatctcttt

SEQ ID NO: 519153 - DNA, 16 bp, R. norvegicus
tccctttgcctctgag

SEQ ID NO: 519154 - DNA, 16 bp, R. norvegicus
tcccttttctgaggag

SEQ ID NO: 519155 - DNA, 16 bp, R. norvegicus
tccgaggcagaggcag

SEQ ID NO: 519156 - DNA, 16 bp, R. norvegicus
tccgcatcaaaccaga

SEQ ID NO: 519157 - DNA, 16 bp, R. norvegicus
tccgcctgtctgaagg

SEQ ID NO: 519158 - DNA, 16 bp, R. norvegicus
tccggaacctgaagga

SEQ ID NO: 519159 - DNA, 16 bp, R. norvegicus
tccggaagaacagcca

SEQ ID NO: 519160 - DNA, 16 bp, R. norvegicus
tccgggaaaacatccc

SEQ ID NO: 519161 - DNA, 19 bp, R. norvegicus
tccgggcaaacatccccct

SEQ ID NO: 519162 - DNA, 16 bp, R. norvegicus
tccgggttcctgcctt

SEQ ID NO: 519163 - DNA, 16 bp, R. norvegicus
tccgtaacctaaagaa

SEQ ID NO: 519164 - DNA, 16 bp, R. norvegicus
tccgtgaagtgtttgc

SEQ ID NO: 519165 - DNA, 16 bp, R. norvegicus
tccgtttgccagaatt

SEQ ID NO: 519166 - DNA, 16 bp, R. norvegicus
tcctaaaacagataga

SEQ ID NO: 519167 - DNA, 16 bp, R. norvegicus
tcctaaagaaaaggat

SEQ ID NO: 519168 - DNA, 16 bp, R. norvegicus
tcctaaagcaaaggga

SEQ ID NO: 519169 - DNA, 16 bp, R. norvegicus
tcctaaataactatgc

SEQ ID NO: 519170 - DNA, 16 bp, R. norvegicus
tcctaaccatagtgtc

SEQ ID NO: 519171 - DNA, 16 bp, R. norvegicus
tcctaagagactctgc

SEQ ID NO: 519172 - DNA, 16 bp, R. norvegicus
tcctaagaggctctgc

SEQ ID NO: 519173 - DNA, 16 bp, R. norvegicus
tcctaatagtgccact

SEQ ID NO: 519174 - DNA, 16 bp, R. norvegicus
tcctaatccaaaatat

SEQ ID NO: 519175 - DNA, 16 bp, R. norvegicus
tcctaatgacattctg

SEQ ID NO: 519176 - DNA, 16 bp, R. norvegicus
tcctacagcagttgca

SEQ ID NO: 519177 - DNA, 16 bp, R. norvegicus
tcctacaggaacactc

SEQ ID NO: 519178 - DNA, 16 bp, R. norvegicus
tcctacaggaattctg

SEQ ID NO: 519179 - DNA, 16 bp, R. norvegicus
tcctacagggtcgccc

SEQ ID NO: 519180 - DNA, 16 bp, R. norvegicus
tcctacctcagcctcc

SEQ ID NO: 519181 - DNA, 16 bp, R. norvegicus
tcctaccttcctacct

SEQ ID NO: 519182 - DNA, 16 bp, R. norvegicus
tcctactatgaagcca

SEQ ID NO: 519183 - DNA, 16 bp, R. norvegicus
tcctactgtgagcaaa

SEQ ID NO: 519184 - DNA, 16 bp, R. norvegicus
tcctagaaggaaaact

SEQ ID NO: 519185 - DNA, 16 bp, R. norvegicus
tcctagaattgaatga

SEQ ID NO: 519186 - DNA, 16 bp, R. norvegicus
tcctagagctcccagg

SEQ ID NO: 519187 - DNA, 19 bp, R. norvegicus
tcctagatcacaactctgc

SEQ ID NO: 519188 - DNA, 16 bp, R. norvegicus
tcctagcacttgagag

SEQ ID NO: 519189 - DNA, 16 bp, R. norvegicus
tcctagcattcaagag

SEQ ID NO: 519190 - DNA, 16 bp, R. norvegicus
tcctagcatttggaag

SEQ ID NO: 519191 - DNA, 16 bp, R. norvegicus
tcctagctaccttcct

SEQ ID NO: 519192 - DNA, 16 bp, R. norvegicus
tcctagctgcctttgg

SEQ ID NO: 519193 - DNA, 16 bp, R. norvegicus
tcctatcagatcaaca

SEQ ID NO: 519194 - DNA, 23 bp, R. norvegicus
tcctatcccctcagcagccagtt

SEQ ID NO: 519195 - DNA, 16 bp, R. norvegicus
tcctatctacaagaaa

SEQ ID NO: 519196 - DNA, 16 bp, R. norvegicus
tcctatctagtgatag

SEQ ID NO: 519197 - DNA, 16 bp, R. norvegicus
tcctatctctacttcc

SEQ ID NO: 519198 - DNA, 16 bp, R. norvegicus
tcctatctttaaaaaa

SEQ ID NO: 519199 - DNA, 16 bp, R. norvegicus
tcctatgaatatttct

SEQ ID NO: 519200 - DNA, 16 bp, R. norvegicus
tcctatgcatattttt

SEQ ID NO: 519201 - DNA, 16 bp, R. norvegicus
tcctatggatactttt

SEQ ID NO: 519202 - DNA, 16 bp, R. norvegicus
tcctcaaactgttcca

SEQ ID NO: 519203 - DNA, 16 bp, R. norvegicus
tcctcaacaataaagg

SEQ ID NO: 519204 - DNA, 16 bp, R. norvegicus
tcctcaaggccaagga

SEQ ID NO: 519205 - DNA, 16 bp, R. norvegicus
tcctcacagagatgtg

SEQ ID NO: 519206 - DNA, 16 bp, R. norvegicus
tcctcacagcaatgaa

SEQ ID NO: 519207 - DNA, 19 bp, R. norvegicus
tcctcacagtctgtgatca

SEQ ID NO: 519208 - DNA, 16 bp, R. norvegicus
tcctcaccaagttgct

SEQ ID NO: 519209 - DNA, 16 bp, R. norvegicus
tcctcacttctgagag

SEQ ID NO: 519210 - DNA, 71 bp, R. norvegicus
tcctcagaaaattggacattgaactgcctgaggatccagccatacctctcttgggcatatacccaaaagat

SEQ ID NO: 519211 - DNA, 71 bp, R. norvegicus
tcctcagaaaattggacattgaactgcctgaggatccagctatacctctcttgggcatatacccaaaagat

SEQ ID NO: 519212 - DNA, 50 bp, R. norvegicus
tcctcagaaaattggacattgaactgcctgaggatccagctatacctctt

SEQ ID NO: 519213 - DNA, 16 bp, R. norvegicus
tcctcagaatcctgaa

SEQ ID NO: 519214 - DNA, 16 bp, R. norvegicus
tcctcagaccacatga

SEQ ID NO: 519215 - DNA, 16 bp, R. norvegicus
tcctcagagaagcagg

SEQ ID NO: 519216 - DNA, 16 bp, R. norvegicus
tcctcagagaagcttc

SEQ ID NO: 519217 - DNA, 16 bp, R. norvegicus
tcctcagaggagaagg

SEQ ID NO: 519218 - DNA, 16 bp, R. norvegicus
tcctcagatggttcca

SEQ ID NO: 519219 - DNA, 16 bp, R. norvegicus
tcctcagattcttcca

SEQ ID NO: 519220 - DNA, 16 bp, R. norvegicus
tcctcagcctcagcct

SEQ ID NO: 519221 - DNA, 16 bp, R. norvegicus
tcctcagcctcccctc

SEQ ID NO: 519222 - DNA, 16 bp, R. norvegicus
tcctcagcctcctcag

SEQ ID NO: 519223 - DNA, 16 bp, R. norvegicus
tcctcagctccaggaa

SEQ ID NO: 519224 - DNA, 16 bp, R. norvegicus
tcctcagctccagggg

SEQ ID NO: 519225 - DNA, 16 bp, R. norvegicus
tcctcagctccggggg

SEQ ID NO: 519226 - DNA, 16 bp, R. norvegicus
tcctcagctccttcca

SEQ ID NO: 519227 - DNA, 16 bp, R. norvegicus
tcctcagctgaggttc

SEQ ID NO: 519228 - DNA, 16 bp, R. norvegicus
tcctcagctgtcaatt

SEQ ID NO: 519229 - DNA, 16 bp, R. norvegicus
tcctcaggagctgtct

SEQ ID NO: 519230 - DNA, 16 bp, R. norvegicus
tcctcaggcttcccca

SEQ ID NO: 519231 - DNA, 16 bp, R. norvegicus
tcctcagggacagggc

SEQ ID NO: 519232 - DNA, 16 bp, R. norvegicus
tcctcagttcctgtgt

SEQ ID NO: 519233 - DNA, 16 bp, R. norvegicus
tcctcagttgagagtt

SEQ ID NO: 519234 - DNA, 16 bp, R. norvegicus
tcctcagttgggaatt

SEQ ID NO: 519235 - DNA, 16 bp, R. norvegicus
tcctcatcatcatcac

SEQ ID NO: 519236 - DNA, 16 bp, R. norvegicus
tcctcatcatcttcct

SEQ ID NO: 519237 - DNA, 16 bp, R. norvegicus
tcctcatcctcatcat

SEQ ID NO: 519238 - DNA, 16 bp, R. norvegicus
tcctcatcctcatcct

SEQ ID NO: 519239 - DNA, 16 bp, R. norvegicus
tcctcatcctcctgcc

SEQ ID NO: 519240 - DNA, 16 bp, R. norvegicus
tcctcatctatatcag

SEQ ID NO: 519241 - DNA, 16 bp, R. norvegicus
tcctcatctggcctct

SEQ ID NO: 519242 - DNA, 16 bp, R. norvegicus
tcctcatgctcagtcc

SEQ ID NO: 519243 - DNA, 16 bp, R. norvegicus
tcctcatggcttcctc

SEQ ID NO: 519244 - DNA, 16 bp, R. norvegicus
tcctcattgggtcctg

SEQ ID NO: 519245 - DNA, 16 bp, R. norvegicus
tcctcattgtatatcc

SEQ ID NO: 519246 - DNA, 16 bp, R. norvegicus
tcctcatttgtatcag

SEQ ID NO: 519247 - DNA, 16 bp, R. norvegicus
tcctccaacaagaaca

SEQ ID NO: 519248 - DNA, 16 bp, R. norvegicus
tcctccaacaagggca

SEQ ID NO: 519249 - DNA, 16 bp, R. norvegicus
tcctccaaccaggtca

SEQ ID NO: 519250 - DNA, 16 bp, R. norvegicus
tcctccaacctccaca

SEQ ID NO: 519251 - DNA, 16 bp, R. norvegicus
tcctccaagaagacca

SEQ ID NO: 519252 - DNA, 16 bp, R. norvegicus
tcctccacacctcaca

SEQ ID NO: 519253 - DNA, 16 bp, R. norvegicus
tcctccacaggggtcc

SEQ ID NO: 519254 - DNA, 17 bp, R. norvegicus
tcctccacgggagccca

SEQ ID NO: 519255 - DNA, 16 bp, R. norvegicus
tcctccagaatcatga

SEQ ID NO: 519256 - DNA, 16 bp, R. norvegicus
tcctccagatattcca

SEQ ID NO: 519257 - DNA, 16 bp, R. norvegicus
tcctccagcaagactc

SEQ ID NO: 519258 - DNA, 16 bp, R. norvegicus
tcctccagcaaggaca

SEQ ID NO: 519259 - DNA, 16 bp, R. norvegicus
tcctccagcagcagat

SEQ ID NO: 519260 - DNA, 16 bp, R. norvegicus
tcctccagcctccaca

SEQ ID NO: 519261 - DNA, 16 bp, R. norvegicus
tcctccagctccatgc

SEQ ID NO: 519262 - DNA, 16 bp, R. norvegicus
tcctccagctccccca

SEQ ID NO: 519263 - DNA, 16 bp, R. norvegicus
tcctccagctcctcca

SEQ ID NO: 519264 - DNA, 16 bp, R. norvegicus
tcctccagctcttcca

SEQ ID NO: 519265 - DNA, 16 bp, R. norvegicus
tcctccagctttttcc

SEQ ID NO: 519266 - DNA, 16 bp, R. norvegicus
tcctccatcacctgag

SEQ ID NO: 519267 - DNA, 16 bp, R. norvegicus
tcctccatcccctctg

SEQ ID NO: 519268 - DNA, 16 bp, R. norvegicus
tcctccatcccttctg

SEQ ID NO: 519269 - DNA, 16 bp, R. norvegicus
tcctccatggcctcag

SEQ ID NO: 519270 - DNA, 16 bp, R. norvegicus
tcctccatggcctctg

SEQ ID NO: 519271 - DNA, 16 bp, R. norvegicus
tcctccatggcctgtg

SEQ ID NO: 519272 - DNA, 16 bp, R. norvegicus
tcctccatgggctctg

SEQ ID NO: 519273 - DNA, 16 bp, R. norvegicus
tcctcccactgatgcc

SEQ ID NO: 519274 - DNA, 16 bp, R. norvegicus
tcctcccagtacccct

SEQ ID NO: 519275 - DNA, 16 bp, R. norvegicus
tcctcccagtgcaatg

SEQ ID NO: 519276 - DNA, 16 bp, R. norvegicus
tcctcccatcacccag

SEQ ID NO: 519277 - DNA, 16 bp, R. norvegicus
tcctccccaaactgct

SEQ ID NO: 519278 - DNA, 16 bp, R. norvegicus
tcctccccaagatgct

SEQ ID NO: 519279 - DNA, 16 bp, R. norvegicus
tcctccccagtctcca

SEQ ID NO: 519280 - DNA, 16 bp, R. norvegicus
tcctcccccactgagc

SEQ ID NO: 519281 - DNA, 16 bp, R. norvegicus
tcctccctcaactctg

SEQ ID NO: 519282 - DNA, 16 bp, R. norvegicus
tcctccctggggaaga

SEQ ID NO: 519283 - DNA, 16 bp, R. norvegicus
tcctcccttgggccct

SEQ ID NO: 519284 - DNA, 16 bp, R. norvegicus
tcctccctttcagtca

SEQ ID NO: 519285 - DNA, 16 bp, R. norvegicus
tcctcctagccatgtg

SEQ ID NO: 519286 - DNA, 16 bp, R. norvegicus
tcctcctcagcctctt

SEQ ID NO: 519287 - DNA, 16 bp, R. norvegicus
tcctcctcagcttctt

SEQ ID NO: 519288 - DNA, 16 bp, R. norvegicus
tcctcctcctcactgt

SEQ ID NO: 519289 - DNA, 16 bp, R. norvegicus
tcctcctcctcagcct

SEQ ID NO: 519290 - DNA, 16 bp, R. norvegicus
tcctcctcctcccagc

SEQ ID NO: 519291 - DNA, 16 bp, R. norvegicus
tcctcctcctctgact

SEQ ID NO: 519292 - DNA, 16 bp, R. norvegicus
tcctcctcctggtctg

SEQ ID NO: 519293 - DNA, 16 bp, R. norvegicus
tcctcctcctgtgtct

SEQ ID NO: 519294 - DNA, 16 bp, R. norvegicus
tcctcctctggcctct

SEQ ID NO: 519295 - DNA, 16 bp, R. norvegicus
tcctcctcttgggact

SEQ ID NO: 519296 - DNA, 16 bp, R. norvegicus
tcctcctgaagcagat

SEQ ID NO: 519297 - DNA, 16 bp, R. norvegicus
tcctcctgaggctgac

SEQ ID NO: 519298 - DNA, 16 bp, R. norvegicus
tcctcctgagggaaag

SEQ ID NO: 519299 - DNA, 16 bp, R. norvegicus
tcctcctgcctcaccc

SEQ ID NO: 519300 - DNA, 16 bp, R. norvegicus
tcctcctgcctcagac

SEQ ID NO: 519301 - DNA, 16 bp, R. norvegicus
tcctcctgcctccact

SEQ ID NO: 519302 - DNA, 16 bp, R. norvegicus
tcctcctgctccagtc

SEQ ID NO: 519303 - DNA, 16 bp, R. norvegicus
tcctcctgctcctgct

SEQ ID NO: 519304 - DNA, 16 bp, R. norvegicus
tcctcctgctcttgct

SEQ ID NO: 519305 - DNA, 20 bp, R. norvegicus
tcctcctgctgctgctgctg

SEQ ID NO: 519306 - DNA, 16 bp, R. norvegicus
tcctcctgcttcacct

SEQ ID NO: 519307 - DNA, 16 bp, R. norvegicus
tcctcctggagacagg

SEQ ID NO: 519308 - DNA, 16 bp, R. norvegicus
tcctcctggctacctt

SEQ ID NO: 519309 - DNA, 16 bp, R. norvegicus
tcctcctggctcagct

SEQ ID NO: 519310 - DNA, 16 bp, R. norvegicus
tcctcctggctggcat

SEQ ID NO: 519311 - DNA, 16 bp, R. norvegicus
tcctcctggctgtctg

SEQ ID NO: 519312 - DNA, 16 bp, R. norvegicus
tcctcctggcttgctc

SEQ ID NO: 519313 - DNA, 16 bp, R. norvegicus
tcctcctgtctctact

SEQ ID NO: 519314 - DNA, 16 bp, R. norvegicus
tcctcctgtctctgct

SEQ ID NO: 519315 - DNA, 16 bp, R. norvegicus
tcctcctgtctttacc

SEQ ID NO: 519316 - DNA, 16 bp, R. norvegicus
tcctcctgtgtctgcc

SEQ ID NO: 519317 - DNA, 16 bp, R. norvegicus
tcctccttcctccagc

SEQ ID NO: 519318 - DNA, 16 bp, R. norvegicus
tcctcctttgaggaat

SEQ ID NO: 519319 - DNA, 16 bp, R. norvegicus
tcctcggcagcatctg

SEQ ID NO: 519320 - DNA, 16 bp, R. norvegicus
tcctcgggaagagcag

SEQ ID NO: 519321 - DNA, 16 bp, R. norvegicus
tcctcgtccttgtcct

SEQ ID NO: 519322 - DNA, 16 bp, R. norvegicus
tcctctaacaaagcca

SEQ ID NO: 519323 - DNA, 16 bp, R. norvegicus
tcctctaccagaggag

SEQ ID NO: 519324 - DNA, 16 bp, R. norvegicus
tcctctacccaaagga

SEQ ID NO: 519325 - DNA, 16 bp, R. norvegicus
tcctctcagaggctct

SEQ ID NO: 519326 - DNA, 16 bp, R. norvegicus
tcctctcagatgactg

SEQ ID NO: 519327 - DNA, 16 bp, R. norvegicus
tcctctcccactgatg

SEQ ID NO: 519328 - DNA, 16 bp, R. norvegicus
tcctctccgatgactc

SEQ ID NO: 519329 - DNA, 16 bp, R. norvegicus
tcctctcctgtgtgtg

SEQ ID NO: 519330 - DNA, 16 bp, R. norvegicus
tcctctctatggcctt

SEQ ID NO: 519331 - DNA, 16 bp, R. norvegicus
tcctctctcagagctg

SEQ ID NO: 519332 - DNA, 16 bp, R. norvegicus
tcctctctccagtttc

SEQ ID NO: 519333 - DNA, 16 bp, R. norvegicus
tcctctctcctgtgtc

SEQ ID NO: 519334 - DNA, 16 bp, R. norvegicus
tcctctcttcccagtc

SEQ ID NO: 519335 - DNA, 16 bp, R. norvegicus
tcctctcttcctgcca

SEQ ID NO: 519336 - DNA, 16 bp, R. norvegicus
tcctctctttcagcca

SEQ ID NO: 519337 - DNA, 16 bp, R. norvegicus
tcctctgaaagaacaa

SEQ ID NO: 519338 - DNA, 16 bp, R. norvegicus
tcctctgaaagagaag

SEQ ID NO: 519339 - DNA, 16 bp, R. norvegicus
tcctctgaagaacagc

SEQ ID NO: 519340 - DNA, 16 bp, R. norvegicus
tcctctgaagacacca

SEQ ID NO: 519341 - DNA, 16 bp, R. norvegicus
tcctctgacctcagca

SEQ ID NO: 519342 - DNA, 16 bp, R. norvegicus
tcctctgacctctact

SEQ ID NO: 519343 - DNA, 16 bp, R. norvegicus
tcctctgaccttcaaa

SEQ ID NO: 519344 - DNA, 16 bp, R. norvegicus
tcctctgacttccaca

SEQ ID NO: 519345 - DNA, 16 bp, R. norvegicus
tcctctgagaaggtgg

SEQ ID NO: 519346 - DNA, 16 bp, R. norvegicus
tcctctgagaagttct

SEQ ID NO: 519347 - DNA, 16 bp, R. norvegicus
tcctctgaggagaagg

SEQ ID NO: 519348 - DNA, 16 bp, R. norvegicus
tcctctgagtgctggg

SEQ ID NO: 519349 - DNA, 16 bp, R. norvegicus
tcctctgcaagaacag

SEQ ID NO: 519350 - DNA, 16 bp, R. norvegicus
tcctctgcaagagcag

SEQ ID NO: 519351 - DNA, 16 bp, R. norvegicus
tcctctgcaggaaccc

SEQ ID NO: 519352 - DNA, 16 bp, R. norvegicus
tcctctgcccacagtc

SEQ ID NO: 519353 - DNA, 16 bp, R. norvegicus
tcctctgcccctgtgt

SEQ ID NO: 519354 - DNA, 16 bp, R. norvegicus
tcctctgctgtgtctg

SEQ ID NO: 519355 - DNA, 16 bp, R. norvegicus
tcctctggaagagctg

SEQ ID NO: 519356 - DNA, 16 bp, R. norvegicus
tcctctgggagagaag

SEQ ID NO: 519357 - DNA, 16 bp, R. norvegicus
tcctctggtgtcagag

SEQ ID NO: 519358 - DNA, 16 bp, R. norvegicus
tcctctggtttcacag

SEQ ID NO: 519359 - DNA, 16 bp, R. norvegicus
tcctctgtaagagctg

SEQ ID NO: 519360 - DNA, 16 bp, R. norvegicus
tcctctgtaggagcag

SEQ ID NO: 519361 - DNA, 16 bp, R. norvegicus
tcctctgttcttaaga

SEQ ID NO: 519362 - DNA, 16 bp, R. norvegicus
tcctcttagtaccact

SEQ ID NO: 519363 - DNA, 16 bp, R. norvegicus
tcctcttccaaaatga

SEQ ID NO: 519364 - DNA, 16 bp, R. norvegicus
tcctcttccacacaga

SEQ ID NO: 519365 - DNA, 16 bp, R. norvegicus
tcctcttcctcagagg

SEQ ID NO: 519366 - DNA, 16 bp, R. norvegicus
tcctcttcctgctgct

SEQ ID NO: 519367 - DNA, 16 bp, R. norvegicus
tcctcttctcaaagga

SEQ ID NO: 519368 - DNA, 16 bp, R. norvegicus
tcctcttgctcctgct

SEQ ID NO: 519369 - DNA, 16 bp, R. norvegicus
tcctcttgcttctgct

SEQ ID NO: 519370 - DNA, 16 bp, R. norvegicus
tcctcttggaagagaa

SEQ ID NO: 519371 - DNA, 16 bp, R. norvegicus
tcctcttgggtcagaa

SEQ ID NO: 519372 - DNA, 16 bp, R. norvegicus
tcctcttggttcagga

SEQ ID NO: 519373 - DNA, 16 bp, R. norvegicus
tcctctttctccaaat

SEQ ID NO: 519374 - DNA, 16 bp, R. norvegicus
tcctcttttgagaatt

SEQ ID NO: 519375 - DNA, 16 bp, R. norvegicus
tcctgaaaacaaaaca

SEQ ID NO: 519376 - DNA, 16 bp, R. norvegicus
tcctgaaacaaaagga

SEQ ID NO: 519377 - DNA, 16 bp, R. norvegicus
tcctgaaagctgtcct

SEQ ID NO: 519378 - DNA, 16 bp, R. norvegicus
tcctgaaatcacctgt

SEQ ID NO: 519379 - DNA, 16 bp, R. norvegicus
tcctgaaatgcttccc

SEQ ID NO: 519380 - DNA, 16 bp, R. norvegicus
tcctgaacatttcttt

SEQ ID NO: 519381 - DNA, 16 bp, R. norvegicus
tcctgaactgtcctgg

SEQ ID NO: 519382 - DNA, 16 bp, R. norvegicus
tcctgaagaaccatca

SEQ ID NO: 519383 - DNA, 16 bp, R. norvegicus
tcctgaagaagcaggc

SEQ ID NO: 519384 - DNA, 16 bp, R. norvegicus
tcctgaagaggctttc

SEQ ID NO: 519385 - DNA, 16 bp, R. norvegicus
tcctgaagctcaagtt

SEQ ID NO: 519386 - DNA, 16 bp, R. norvegicus
tcctgaagctcttcct

SEQ ID NO: 519387 - DNA, 16 bp, R. norvegicus
tcctgaaggaggaaca

SEQ ID NO: 519388 - DNA, 16 bp, R. norvegicus
tcctgaaggctccagg

SEQ ID NO: 519389 - DNA, 16 bp, R. norvegicus
tcctgaatatatatgc

SEQ ID NO: 519390 - DNA, 16 bp, R. norvegicus
tcctgaatgagcagag

SEQ ID NO: 519391 - DNA, 16 bp, R. norvegicus
tcctgaatgctgggat

SEQ ID NO: 519392 - DNA, 16 bp, R. norvegicus
tcctgaccaagaagca

SEQ ID NO: 519393 - DNA, 16 bp, R. norvegicus
tcctgaccctgcctga

SEQ ID NO: 519394 - DNA, 16 bp, R. norvegicus
tcctgactcagcctcc

SEQ ID NO: 519395 - DNA, 16 bp, R. norvegicus
tcctgactctgcctcc

SEQ ID NO: 519396 - DNA, 16 bp, R. norvegicus
tcctgagaacccagag

SEQ ID NO: 519397 - DNA, 16 bp, R. norvegicus
tcctgagagtctctgt

SEQ ID NO: 519398 - DNA, 16 bp, R. norvegicus
tcctgagagttgtcct

SEQ ID NO: 519399 - DNA, 16 bp, R. norvegicus
tcctgagatgaagcct

SEQ ID NO: 519400 - DNA, 16 bp, R. norvegicus
tcctgagatggcctgc

SEQ ID NO: 519401 - DNA, 16 bp, R. norvegicus
tcctgagattctttct

SEQ ID NO: 519402 - DNA, 16 bp, R. norvegicus
tcctgagattgcagag

SEQ ID NO: 519403 - DNA, 16 bp, R. norvegicus
tcctgagcatgctcag

SEQ ID NO: 519404 - DNA, 16 bp, R. norvegicus
tcctgagctcaattcc

SEQ ID NO: 519405 - DNA, 16 bp, R. norvegicus
tcctgagcttcctcct

SEQ ID NO: 519406 - DNA, 16 bp, R. norvegicus
tcctgagcttctctct

SEQ ID NO: 519407 - DNA, 16 bp, R. norvegicus
tcctgaggaaatagaa

SEQ ID NO: 519408 - DNA, 16 bp, R. norvegicus
tcctgaggaactgcca

SEQ ID NO: 519409 - DNA, 16 bp, R. norvegicus
tcctgaggaatgacat

SEQ ID NO: 519410 - DNA, 16 bp, R. norvegicus
tcctgaggacccaggt

SEQ ID NO: 519411 - DNA, 16 bp, R. norvegicus
tcctgaggcctccagg

SEQ ID NO: 519412 - DNA, 16 bp, R. norvegicus
tcctgaggctgaaaaa

SEQ ID NO: 519413 - DNA, 16 bp, R. norvegicus
tcctgaggctgaagag

SEQ ID NO: 519414 - DNA, 16 bp, R. norvegicus
tcctgaggctgaccac

SEQ ID NO: 519415 - DNA, 16 bp, R. norvegicus
tcctgagggttccagg

SEQ ID NO: 519416 - DNA, 16 bp, R. norvegicus
tcctgaggtcctgggt

SEQ ID NO: 519417 - DNA, 16 bp, R. norvegicus
tcctgagtagctggga

SEQ ID NO: 519418 - DNA, 16 bp, R. norvegicus
tcctgagtgagatagc

SEQ ID NO: 519419 - DNA, 16 bp, R. norvegicus
tcctgagttcatctct

SEQ ID NO: 519420 - DNA, 16 bp, R. norvegicus
tcctgagttttcagct

SEQ ID NO: 519421 - DNA, 16 bp, R. norvegicus
tcctgatcctcctcct

SEQ ID NO: 519422 - DNA, 16 bp, R. norvegicus
tcctgatcctcctgtc

SEQ ID NO: 519423 - DNA, 16 bp, R. norvegicus
tcctgatgccaagaag

SEQ ID NO: 519424 - DNA, 16 bp, R. norvegicus
tcctgatgtagaactc

SEQ ID NO: 519425 - DNA, 16 bp, R. norvegicus
tcctgattggtggttg

SEQ ID NO: 519426 - DNA, 16 bp, R. norvegicus
tcctgatttcactggg

SEQ ID NO: 519427 - DNA, 17 bp, R. norvegicus
tcctgcaagactctcaa

SEQ ID NO: 519428 - DNA, 16 bp, R. norvegicus
tcctgcaagcagcaga

SEQ ID NO: 519429 - DNA, 16 bp, R. norvegicus
tcctgcaagttgtcct

SEQ ID NO: 519430 - DNA, 16 bp, R. norvegicus
tcctgcacttctttaa

SEQ ID NO: 519431 - DNA, 16 bp, R. norvegicus
tcctgcagaagaccca

SEQ ID NO: 519432 - DNA, 16 bp, R. norvegicus
tcctgcagaggactca

SEQ ID NO: 519433 - DNA, 16 bp, R. norvegicus
tcctgcagcaacttga

SEQ ID NO: 519434 - DNA, 16 bp, R. norvegicus
tcctgcagcagatgga

SEQ ID NO: 519435 - DNA, 16 bp, R. norvegicus
tcctgcagcagcttgt

SEQ ID NO: 519436 - DNA, 16 bp, R. norvegicus
tcctgcagctcaagtt

SEQ ID NO: 519437 - DNA, 16 bp, R. norvegicus
tcctgcaggaggacct

SEQ ID NO: 519438 - DNA, 17 bp, R. norvegicus
tcctgccagccgggcac

SEQ ID NO: 519439 - DNA, 16 bp, R. norvegicus
tcctgccatgacttcc

SEQ ID NO: 519440 - DNA, 16 bp, R. norvegicus
tcctgcccaggctgga

SEQ ID NO: 519441 - DNA, 16 bp, R. norvegicus
tcctgccccagcctcc

SEQ ID NO: 519442 - DNA, 16 bp, R. norvegicus
tcctgccccaggctcc

SEQ ID NO: 519443 - DNA, 16 bp, R. norvegicus
tcctgcccctggaaca

SEQ ID NO: 519444 - DNA, 16 bp, R. norvegicus
tcctgccctgactgcc

SEQ ID NO: 519445 - DNA, 16 bp, R. norvegicus
tcctgccctgttggag

SEQ ID NO: 519446 - DNA, 16 bp, R. norvegicus
tcctgccctgtttggg

SEQ ID NO: 519447 - DNA, 16 bp, R. norvegicus
tcctgcctcaaagaaa

SEQ ID NO: 519448 - DNA, 16 bp, R. norvegicus
tcctgcctcaactttc

SEQ ID NO: 519449 - DNA, 16 bp, R. norvegicus
tcctgcctcaccactc

SEQ ID NO: 519450 - DNA, 16 bp, R. norvegicus
tcctgcctcaccttcc

SEQ ID NO: 519451 - DNA, 16 bp, R. norvegicus
tcctgcctcagcagcc

SEQ ID NO: 519452 - DNA, 16 bp, R. norvegicus
tcctgcctcagcatcc

SEQ ID NO: 519453 - DNA, 16 bp, R. norvegicus
tcctgcctcagccacc

SEQ ID NO: 519454 - DNA, 16 bp, R. norvegicus
tcctgcctcagcctgc

SEQ ID NO: 519455 - DNA, 16 bp, R. norvegicus
tcctgcctcagctccc

SEQ ID NO: 519456 - DNA, 16 bp, R. norvegicus
tcctgcctcagcttat

SEQ ID NO: 519457 - DNA, 16 bp, R. norvegicus
tcctgcctcagtttcc

SEQ ID NO: 519458 - DNA, 16 bp, R. norvegicus
tcctgcctcagtttct

SEQ ID NO: 519459 - DNA, 16 bp, R. norvegicus
tcctgcctcatcttcc

SEQ ID NO: 519460 - DNA, 16 bp, R. norvegicus
tcctgcctccagattc

SEQ ID NO: 519461 - DNA, 16 bp, R. norvegicus
tcctgcctccagctcc

SEQ ID NO: 519462 - DNA, 16 bp, R. norvegicus
tcctgcctccaggttc

SEQ ID NO: 519463 - DNA, 16 bp, R. norvegicus
tcctgcctcggcctcc

SEQ ID NO: 519464 - DNA, 16 bp, R. norvegicus
tcctgcctctctgctg

SEQ ID NO: 519465 - DNA, 16 bp, R. norvegicus
tcctgcctctgttcct

SEQ ID NO: 519466 - DNA, 16 bp, R. norvegicus
tcctgcctcttcctca

SEQ ID NO: 519467 - DNA, 16 bp, R. norvegicus
tcctgccttagccttt

SEQ ID NO: 519468 - DNA, 16 bp, R. norvegicus
tcctgccttcatttcc

SEQ ID NO: 519469 - DNA, 16 bp, R. norvegicus
tcctgccttcctgcct

SEQ ID NO: 519470 - DNA, 16 bp, R. norvegicus
tcctgccttcctttgg

SEQ ID NO: 519471 - DNA, 16 bp, R. norvegicus
tcctgccttctactca

SEQ ID NO: 519472 - DNA, 16 bp, R. norvegicus
tcctgccttgatgaaa

SEQ ID NO: 519473 - DNA, 16 bp, R. norvegicus
tcctgccttgatttct

SEQ ID NO: 519474 - DNA, 16 bp, R. norvegicus
tcctgccttggcagga

SEQ ID NO: 519475 - DNA, 16 bp, R. norvegicus
tcctgccttgtgctga

SEQ ID NO: 519476 - DNA, 16 bp, R. norvegicus
tcctgctaaggttgga

SEQ ID NO: 519477 - DNA, 16 bp, R. norvegicus
tcctgctcatctctct

SEQ ID NO: 519478 - DNA, 16 bp, R. norvegicus
tcctgctccctgtgct

SEQ ID NO: 519479 - DNA, 16 bp, R. norvegicus
tcctgctcctgctctc

SEQ ID NO: 519480 - DNA, 16 bp, R. norvegicus
tcctgctccttctgct

SEQ ID NO: 519481 - DNA, 16 bp, R. norvegicus
tcctgctctggcctct

SEQ ID NO: 519482 - DNA, 16 bp, R. norvegicus
tcctgctctgtcccct

SEQ ID NO: 519483 - DNA, 16 bp, R. norvegicus
tcctgctctgtcttct

SEQ ID NO: 519484 - DNA, 16 bp, R. norvegicus
tcctgctctgttgtct

SEQ ID NO: 519485 - DNA, 16 bp, R. norvegicus
tcctgctgaattgtgc

SEQ ID NO: 519486 - DNA, 16 bp, R. norvegicus
tcctgctgccatgcct

SEQ ID NO: 519487 - DNA, 16 bp, R. norvegicus
tcctgctgcctcagcc

SEQ ID NO: 519488 - DNA, 16 bp, R. norvegicus
tcctgctgcctgcaga

SEQ ID NO: 519489 - DNA, 16 bp, R. norvegicus
tcctgctgcctgcctg

SEQ ID NO: 519490 - DNA, 16 bp, R. norvegicus
tcctgctgctcctgct

SEQ ID NO: 519491 - DNA, 16 bp, R. norvegicus
tcctgctgctcctggg

SEQ ID NO: 519492 - DNA, 16 bp, R. norvegicus
tcctgctgctccttgg

SEQ ID NO: 519493 - DNA, 16 bp, R. norvegicus
tcctgctgctgcctct

SEQ ID NO: 519494 - DNA, 16 bp, R. norvegicus
tcctgctgctgccttt

SEQ ID NO: 519495 - DNA, 16 bp, R. norvegicus
tcctgctgctgctcct

SEQ ID NO: 519496 - DNA, 16 bp, R. norvegicus
tcctgctgctgctgct

SEQ ID NO: 519497 - DNA, 17 bp, R. norvegicus
tcctgctgctgctgctt

SEQ ID NO: 519498 - DNA, 16 bp, R. norvegicus
tcctgctgctgctgtc

SEQ ID NO: 519499 - DNA, 16 bp, R. norvegicus
tcctgctgctgtgcct

SEQ ID NO: 519500 - DNA, 16 bp, R. norvegicus
tcctgctggtccctcc

SEQ ID NO: 519501 - DNA, 16 bp, R. norvegicus
tcctgctgtcctgctg

SEQ ID NO: 519502 - DNA, 16 bp, R. norvegicus
tcctgctgttgccctg

SEQ ID NO: 519503 - DNA, 16 bp, R. norvegicus
tcctgcttcagcttcc

SEQ ID NO: 519504 - DNA, 16 bp, R. norvegicus
tcctgcttcatcctcc

SEQ ID NO: 519505 - DNA, 16 bp, R. norvegicus
tcctgcttgaattcct

SEQ ID NO: 519506 - DNA, 16 bp, R. norvegicus
tcctgctttctttcag

SEQ ID NO: 519507 - DNA, 16 bp, R. norvegicus
tcctggaaaaaaaaaa

SEQ ID NO: 519508 - DNA, 16 bp, R. norvegicus
tcctggaaaaatcagg

SEQ ID NO: 519509 - DNA, 16 bp, R. norvegicus
tcctggaaagggcagc

SEQ ID NO: 519510 - DNA, 16 bp, R. norvegicus
tcctggaacagctgca

SEQ ID NO: 519511 - DNA, 16 bp, R. norvegicus
tcctggaactcacaga

SEQ ID NO: 519512 - DNA, 16 bp, R. norvegicus
tcctggaactcactct

SEQ ID NO: 519513 - DNA, 16 bp, R. norvegicus
tcctggaactcactgc

SEQ ID NO: 519514 - DNA, 16 bp, R. norvegicus
tcctggaactggaatt

SEQ ID NO: 519515 - DNA, 16 bp, R. norvegicus
tcctggaactggactt

SEQ ID NO: 519516 - DNA, 16 bp, R. norvegicus
tcctggaagaggttca

SEQ ID NO: 519517 - DNA, 16 bp, R. norvegicus
tcctggaaggggcggc

SEQ ID NO: 519518 - DNA, 16 bp, R. norvegicus
tcctggaattacaggt

SEQ ID NO: 519519 - DNA, 16 bp, R. norvegicus
tcctggaattcctgta

SEQ ID NO: 519520 - DNA, 16 bp, R. norvegicus
tcctggacagccagga

SEQ ID NO: 519521 - DNA, 16 bp, R. norvegicus
tcctggacagtgcctt

SEQ ID NO: 519522 - DNA, 16 bp, R. norvegicus
tcctggacctggagtt

SEQ ID NO: 519523 - DNA, 16 bp, R. norvegicus
tcctggacttcctgga

SEQ ID NO: 519524 - DNA, 16 bp, R. norvegicus
tcctggacttgctgtg

SEQ ID NO: 519525 - DNA, 16 bp, R. norvegicus
tcctggagacacttgg

SEQ ID NO: 519526 - DNA, 16 bp, R. norvegicus
tcctggagatgaaaaa

SEQ ID NO: 519527 - DNA, 16 bp, R. norvegicus
tcctggagctcactat

SEQ ID NO: 519528 - DNA, 16 bp, R. norvegicus
tcctggagctcactct

SEQ ID NO: 519529 - DNA, 16 bp, R. norvegicus
tcctggagctgcagtt

SEQ ID NO: 519530 - DNA, 16 bp, R. norvegicus
tcctggagctggaatt

SEQ ID NO: 519531 - DNA, 16 bp, R. norvegicus
tcctggaggcagcaga

SEQ ID NO: 519532 - DNA, 16 bp, R. norvegicus
tcctggagtcattcct

SEQ ID NO: 519533 - DNA, 16 bp, R. norvegicus
tcctggagtttttgtt

SEQ ID NO: 519534 - DNA, 16 bp, R. norvegicus
tcctggatgacctctt

SEQ ID NO: 519535 - DNA, 16 bp, R. norvegicus
tcctggatggttttct

SEQ ID NO: 519536 - DNA, 16 bp, R. norvegicus
tcctggattcccctcc

SEQ ID NO: 519537 - DNA, 16 bp, R. norvegicus
tcctggattcctgtcc

SEQ ID NO: 519538 - DNA, 16 bp, R. norvegicus
tcctggatttcctgga

SEQ ID NO: 519539 - DNA, 29 bp, R. norvegicus
tcctggatttcctgtatgttttggaccat

SEQ ID NO: 519540 - DNA, 16 bp, R. norvegicus
tcctggcaaacctgga

SEQ ID NO: 519541 - DNA, 16 bp, R. norvegicus
tcctggcacacaggct

SEQ ID NO: 519542 - DNA, 16 bp, R. norvegicus
tcctggcagaaaacaa

SEQ ID NO: 519543 - DNA, 16 bp, R. norvegicus
tcctggcattcaggag

SEQ ID NO: 519544 - DNA, 16 bp, R. norvegicus
tcctggccatcctgga

SEQ ID NO: 519545 - DNA, 16 bp, R. norvegicus
tcctggccctcagggc

SEQ ID NO: 519546 - DNA, 16 bp, R. norvegicus
tcctggccttccacat

SEQ ID NO: 519547 - DNA, 16 bp, R. norvegicus
tcctggctcagcctcc

SEQ ID NO: 519548 - DNA, 16 bp, R. norvegicus
tcctggctctcctgga

SEQ ID NO: 519549 - DNA, 16 bp, R. norvegicus
tcctggctctgctgct

SEQ ID NO: 519550 - DNA, 16 bp, R. norvegicus
tcctggctgacctcca

SEQ ID NO: 519551 - DNA, 16 bp, R. norvegicus
tcctggctgcagtcag

SEQ ID NO: 519552 - DNA, 16 bp, R. norvegicus
tcctggctgccctgga

SEQ ID NO: 519553 - DNA, 16 bp, R. norvegicus
tcctggctgccttcag

SEQ ID NO: 519554 - DNA, 16 bp, R. norvegicus
tcctggctgccttgga

SEQ ID NO: 519555 - DNA, 16 bp, R. norvegicus
tcctggctgtcctaaa

SEQ ID NO: 519556 - DNA, 16 bp, R. norvegicus
tcctggctgtcctgga

SEQ ID NO: 519557 - DNA, 16 bp, R. norvegicus
tcctggctgtcttgga

SEQ ID NO: 519558 - DNA, 16 bp, R. norvegicus
tcctgggacatcaagt

SEQ ID NO: 519559 - DNA, 16 bp, R. norvegicus
tcctgggagaggcttt

SEQ ID NO: 519560 - DNA, 16 bp, R. norvegicus
tcctgggaggcctgct

SEQ ID NO: 519561 - DNA, 16 bp, R. norvegicus
tcctgggaggccttca

SEQ ID NO: 519562 - DNA, 16 bp, R. norvegicus
tcctgggatgtctctg

SEQ ID NO: 519563 - DNA, 16 bp, R. norvegicus
tcctgggcagaagtca

SEQ ID NO: 519564 - DNA, 16 bp, R. norvegicus
tcctgggccctcatct

SEQ ID NO: 519565 - DNA, 16 bp, R. norvegicus
tcctgggccctccacc

SEQ ID NO: 519566 - DNA, 16 bp, R. norvegicus
tcctgggctctgtaag

SEQ ID NO: 519567 - DNA, 16 bp, R. norvegicus
tcctggggtccctgaa

SEQ ID NO: 519568 - DNA, 16 bp, R. norvegicus
tcctgggtcccctgca

SEQ ID NO: 519569 - DNA, 16 bp, R. norvegicus
tcctgggtcctgctaa

SEQ ID NO: 519570 - DNA, 16 bp, R. norvegicus
tcctgggtgctataag

SEQ ID NO: 519571 - DNA, 16 bp, R. norvegicus
tcctgggtgctgggtt

SEQ ID NO: 519572 - DNA, 17 bp, R. norvegicus
tcctgggtgtgttgcct

SEQ ID NO: 519573 - DNA, 16 bp, R. norvegicus
tcctgggttcctgtgc

SEQ ID NO: 519574 - DNA, 16 bp, R. norvegicus
tcctggtaccttctcc

SEQ ID NO: 519575 - DNA, 16 bp, R. norvegicus
tcctggtatttttgtt

SEQ ID NO: 519576 - DNA, 16 bp, R. norvegicus
tcctggtcatccaggc

SEQ ID NO: 519577 - DNA, 16 bp, R. norvegicus
tcctggtcctcctcct

SEQ ID NO: 519578 - DNA, 16 bp, R. norvegicus
tcctggtcctctgcct

SEQ ID NO: 519579 - DNA, 16 bp, R. norvegicus
tcctggtcctggtcct

SEQ ID NO: 519580 - DNA, 16 bp, R. norvegicus
tcctggtctcccctct

SEQ ID NO: 519581 - DNA, 17 bp, R. norvegicus
tcctggtgaggtgctgg

SEQ ID NO: 519582 - DNA, 16 bp, R. norvegicus
tcctggtggctgccac

SEQ ID NO: 519583 - DNA, 16 bp, R. norvegicus
tcctggtgtgaccaag

SEQ ID NO: 519584 - DNA, 16 bp, R. norvegicus
tcctggttgccaccct

SEQ ID NO: 519585 - DNA, 16 bp, R. norvegicus
tcctggtttcccttct

SEQ ID NO: 519586 - DNA, 16 bp, R. norvegicus
tcctggtttcctggat

SEQ ID NO: 519587 - DNA, 16 bp, R. norvegicus
tcctggttttccctct

SEQ ID NO: 519588 - DNA, 16 bp, R. norvegicus
tcctggttttcctgga

SEQ ID NO: 519589 - DNA, 16 bp, R. norvegicus
tcctgtaattcttttt

SEQ ID NO: 519590 - DNA, 16 bp, R. norvegicus
tcctgtaccaatgagt

SEQ ID NO: 519591 - DNA, 18 bp, R. norvegicus
tcctgtacctgcccctca

SEQ ID NO: 519592 - DNA, 16 bp, R. norvegicus
tcctgtactggctggt

SEQ ID NO: 519593 - DNA, 16 bp, R. norvegicus
tcctgtagagacctcc

SEQ ID NO: 519594 - DNA, 16 bp, R. norvegicus
tcctgtaggattgtgt

SEQ ID NO: 519595 - DNA, 16 bp, R. norvegicus
tcctgtatttttttaa

SEQ ID NO: 519596 - DNA, 16 bp, R. norvegicus
tcctgtcagcccgcac

SEQ ID NO: 519597 - DNA, 16 bp, R. norvegicus
tcctgtcagcctgaac

SEQ ID NO: 519598 - DNA, 16 bp, R. norvegicus
tcctgtccacaagcac

SEQ ID NO: 519599 - DNA, 16 bp, R. norvegicus
tcctgtccagatattt

SEQ ID NO: 519600 - DNA, 16 bp, R. norvegicus
tcctgtccataagcac

SEQ ID NO: 519601 - DNA, 16 bp, R. norvegicus
tcctgtcccagattgc

SEQ ID NO: 519602 - DNA, 16 bp, R. norvegicus
tcctgtcctcactgct

SEQ ID NO: 519603 - DNA, 16 bp, R. norvegicus
tcctgtcctcagggtc

SEQ ID NO: 519604 - DNA, 16 bp, R. norvegicus
tcctgtcctgacttct

SEQ ID NO: 519605 - DNA, 16 bp, R. norvegicus
tcctgtcctggagcat

SEQ ID NO: 519606 - DNA, 16 bp, R. norvegicus
tcctgtctcaggctcc

SEQ ID NO: 519607 - DNA, 16 bp, R. norvegicus
tcctgtctccaaaaca

SEQ ID NO: 519608 - DNA, 16 bp, R. norvegicus
tcctgtctccacctct

SEQ ID NO: 519609 - DNA, 16 bp, R. norvegicus
tcctgtctccagcttc

SEQ ID NO: 519610 - DNA, 16 bp, R. norvegicus
tcctgtctccatcccc

SEQ ID NO: 519611 - DNA, 16 bp, R. norvegicus
tcctgtctccatctcc

SEQ ID NO: 519612 - DNA, 16 bp, R. norvegicus
tcctgtctctccccat

SEQ ID NO: 519613 - DNA, 16 bp, R. norvegicus
tcctgtctgaaagcat

SEQ ID NO: 519614 - DNA, 16 bp, R. norvegicus
tcctgtctgcaggcat

SEQ ID NO: 519615 - DNA, 16 bp, R. norvegicus
tcctgtctggctacag

SEQ ID NO: 519616 - DNA, 16 bp, R. norvegicus
tcctgtgacttccaca

SEQ ID NO: 519617 - DNA, 16 bp, R. norvegicus
tcctgtgagaccagct

SEQ ID NO: 519618 - DNA, 16 bp, R. norvegicus
tcctgtgccatgcctg

SEQ ID NO: 519619 - DNA, 16 bp, R. norvegicus
tcctgtgcttgcctct

SEQ ID NO: 519620 - DNA, 16 bp, R. norvegicus
tcctgtggaagagcag

SEQ ID NO: 519621 - DNA, 16 bp, R. norvegicus
tcctgtggaccaggcg

SEQ ID NO: 519622 - DNA, 16 bp, R. norvegicus
tcctgtggagaaacag

SEQ ID NO: 519623 - DNA, 16 bp, R. norvegicus
tcctgtggagcaggcc

SEQ ID NO: 519624 - DNA, 16 bp, R. norvegicus
tcctgtggagctggag

SEQ ID NO: 519625 - DNA, 16 bp, R. norvegicus
tcctgtggaggctgga

SEQ ID NO: 519626 - DNA, 16 bp, R. norvegicus
tcctgtggcctctgtg

SEQ ID NO: 519627 - DNA, 16 bp, R. norvegicus
tcctgtggctgaagtt

SEQ ID NO: 519628 - DNA, 16 bp, R. norvegicus
tcctgtgggcctgaag

SEQ ID NO: 519629 - DNA, 16 bp, R. norvegicus
tcctgtgggtctgtgt

SEQ ID NO: 519630 - DNA, 16 bp, R. norvegicus
tcctgtgggtgctggg

SEQ ID NO: 519631 - DNA, 16 bp, R. norvegicus
tcctgtgtccttggtt

SEQ ID NO: 519632 - DNA, 16 bp, R. norvegicus
tcctgtgtgctgggat

SEQ ID NO: 519633 - DNA, 16 bp, R. norvegicus
tcctgtgttctgtgga

SEQ ID NO: 519634 - DNA, 16 bp, R. norvegicus
tcctgttatctttgtt

SEQ ID NO: 519635 - DNA, 16 bp, R. norvegicus
tcctgttcaaaggaaa

SEQ ID NO: 519636 - DNA, 16 bp, R. norvegicus
tcctgttcccacctcc

SEQ ID NO: 519637 - DNA, 16 bp, R. norvegicus
tcctgttcccagaggc

SEQ ID NO: 519638 - DNA, 16 bp, R. norvegicus
tcctgttcccattccc

SEQ ID NO: 519639 - DNA, 16 bp, R. norvegicus
tcctgttccccagttg

SEQ ID NO: 519640 - DNA, 16 bp, R. norvegicus
tcctgttcctgttcct

SEQ ID NO: 519641 - DNA, 16 bp, R. norvegicus
tcctgttctcatttca

SEQ ID NO: 519642 - DNA, 16 bp, R. norvegicus
tcctgttgccaggcct

SEQ ID NO: 519643 - DNA, 16 bp, R. norvegicus
tcctgttgctgctgct

SEQ ID NO: 519644 - DNA, 16 bp, R. norvegicus
tcctgtttacatatct

SEQ ID NO: 519645 - DNA, 28 bp, R. norvegicus
tcctgtttatctcccagaataaaaggga

SEQ ID NO: 519646 - DNA, 16 bp, R. norvegicus
tcctgtttcctgcctc

SEQ ID NO: 519647 - DNA, 16 bp, R. norvegicus
tcctgtttcttcctgc

SEQ ID NO: 519648 - DNA, 16 bp, R. norvegicus
tcctgtttgcctttgg

SEQ ID NO: 519649 - DNA, 16 bp, R. norvegicus
tcctgttttcctggtt

SEQ ID NO: 519650 - DNA, 16 bp, R. norvegicus
tccttaatatctttct

SEQ ID NO: 519651 - DNA, 16 bp, R. norvegicus
tccttacacactgttc

SEQ ID NO: 519652 - DNA, 16 bp, R. norvegicus
tccttagtttttcttc

SEQ ID NO: 519653 - DNA, 16 bp, R. norvegicus
tccttatctgtatcag

SEQ ID NO: 519654 - DNA, 16 bp, R. norvegicus
tccttatgctgggctt

SEQ ID NO: 519655 - DNA, 16 bp, R. norvegicus
tccttattttgaaaca

SEQ ID NO: 519656 - DNA, 16 bp, R. norvegicus
tccttcaatctttcct

SEQ ID NO: 519657 - DNA, 16 bp, R. norvegicus
tccttcactttctgct

SEQ ID NO: 519658 - DNA, 16 bp, R. norvegicus
tccttcagaggtcctg

SEQ ID NO: 519659 - DNA, 16 bp, R. norvegicus
tccttcagcccttccc

SEQ ID NO: 519660 - DNA, 16 bp, R. norvegicus
tccttcagccctttcc

SEQ ID NO: 519661 - DNA, 16 bp, R. norvegicus
tccttcagcctctctt

SEQ ID NO: 519662 - DNA, 16 bp, R. norvegicus
tccttcagcctctgct

SEQ ID NO: 519663 - DNA, 16 bp, R. norvegicus
tccttcaggctctgct

SEQ ID NO: 519664 - DNA, 16 bp, R. norvegicus
tccttcagggtcctgc

SEQ ID NO: 519665 - DNA, 16 bp, R. norvegicus
tccttcaggttccagt

SEQ ID NO: 519666 - DNA, 16 bp, R. norvegicus
tccttcagtctctaat

SEQ ID NO: 519667 - DNA, 16 bp, R. norvegicus
tccttcagtctcttct

SEQ ID NO: 519668 - DNA, 16 bp, R. norvegicus
tccttcagtctgttct

SEQ ID NO: 519669 - DNA, 16 bp, R. norvegicus
tccttcagtggtggac

SEQ ID NO: 519670 - DNA, 16 bp, R. norvegicus
tccttcatcccctctg

SEQ ID NO: 519671 - DNA, 16 bp, R. norvegicus
tccttcattgctggta

SEQ ID NO: 519672 - DNA, 16 bp, R. norvegicus
tccttccagctttgtt

SEQ ID NO: 519673 - DNA, 16 bp, R. norvegicus
tccttccagtttctcc

SEQ ID NO: 519674 - DNA, 16 bp, R. norvegicus
tccttccatccatcct

SEQ ID NO: 519675 - DNA, 16 bp, R. norvegicus
tccttccatctctgct

SEQ ID NO: 519676 - DNA, 16 bp, R. norvegicus
tccttccattttccca

SEQ ID NO: 519677 - DNA, 16 bp, R. norvegicus
tccttcccaagctgct

SEQ ID NO: 519678 - DNA, 16 bp, R. norvegicus
tccttcccagacagtt

SEQ ID NO: 519679 - DNA, 16 bp, R. norvegicus
tccttcccattcatcc

SEQ ID NO: 519680 - DNA, 16 bp, R. norvegicus
tccttccccaaggaca

SEQ ID NO: 519681 - DNA, 16 bp, R. norvegicus
tccttcctcagccttc

SEQ ID NO: 519682 - DNA, 16 bp, R. norvegicus
tccttcctccagcacc

SEQ ID NO: 519683 - DNA, 16 bp, R. norvegicus
tccttcctccatgcct

SEQ ID NO: 519684 - DNA, 16 bp, R. norvegicus
tccttcctctgtgtct

SEQ ID NO: 519685 - DNA, 16 bp, R. norvegicus
tccttcctgcctgcct

SEQ ID NO: 519686 - DNA, 16 bp, R. norvegicus
tccttccttccaccat

SEQ ID NO: 519687 - DNA, 16 bp, R. norvegicus
tccttccttccagtct

SEQ ID NO: 519688 - DNA, 16 bp, R. norvegicus
tccttccttccttgtg

SEQ ID NO: 519689 - DNA, 16 bp, R. norvegicus
tccttccttgagttcc

SEQ ID NO: 519690 - DNA, 16 bp, R. norvegicus
tccttctaagactgaa

SEQ ID NO: 519691 - DNA, 16 bp, R. norvegicus
tccttctatgattttg

SEQ ID NO: 519692 - DNA, 16 bp, R. norvegicus
tccttctcaagtagtg

SEQ ID NO: 519693 - DNA, 16 bp, R. norvegicus
tccttctcactctctg

SEQ ID NO: 519694 - DNA, 16 bp, R. norvegicus
tccttctccaccacca

SEQ ID NO: 519695 - DNA, 16 bp, R. norvegicus
tccttctcccatgtcc

SEQ ID NO: 519696 - DNA, 16 bp, R. norvegicus
tccttctcctccaaag

SEQ ID NO: 519697 - DNA, 16 bp, R. norvegicus
tccttctctgaagcca

SEQ ID NO: 519698 - DNA, 16 bp, R. norvegicus
tccttctctgattcct

SEQ ID NO: 519699 - DNA, 16 bp, R. norvegicus
tccttctcttctttga

SEQ ID NO: 519700 - DNA, 16 bp, R. norvegicus
tccttctgcgtctgtt

SEQ ID NO: 519701 - DNA, 16 bp, R. norvegicus
tccttctggtctgaac

SEQ ID NO: 519702 - DNA, 16 bp, R. norvegicus
tccttctgtccatcca

SEQ ID NO: 519703 - DNA, 16 bp, R. norvegicus
tccttctgtctctgct

SEQ ID NO: 519704 - DNA, 16 bp, R. norvegicus
tccttctgtgtctgtc

SEQ ID NO: 519705 - DNA, 17 bp, R. norvegicus
tccttctgttcccagga

SEQ ID NO: 519706 - DNA, 16 bp, R. norvegicus
tccttctgtttccatt

SEQ ID NO: 519707 - DNA, 16 bp, R. norvegicus
tccttcttctataagg

SEQ ID NO: 519708 - DNA, 16 bp, R. norvegicus
tccttctttacaaggg

SEQ ID NO: 519709 - DNA, 16 bp, R. norvegicus
tccttctttctccaca

SEQ ID NO: 519710 - DNA, 16 bp, R. norvegicus
tccttgaaattctgca

SEQ ID NO: 519711 - DNA, 16 bp, R. norvegicus
tccttgaagaaaaaaa

SEQ ID NO: 519712 - DNA, 16 bp, R. norvegicus
tccttgaaggaaatga

SEQ ID NO: 519713 - DNA, 16 bp, R. norvegicus
tccttgaccaatctcc

SEQ ID NO: 519714 - DNA, 16 bp, R. norvegicus
tccttgatgaaggaga

SEQ ID NO: 519715 - DNA, 18 bp, R. norvegicus
tccttgcagagcaacaaa

SEQ ID NO: 519716 - DNA, 16 bp, R. norvegicus
tccttgcagcttttaa

SEQ ID NO: 519717 - DNA, 16 bp, R. norvegicus
tccttgccagcatctc

SEQ ID NO: 519718 - DNA, 16 bp, R. norvegicus
tccttgccagcatctt

SEQ ID NO: 519719 - DNA, 16 bp, R. norvegicus
tccttgctggatgagg

SEQ ID NO: 519720 - DNA, 16 bp, R. norvegicus
tccttggaagctctgg

SEQ ID NO: 519721 - DNA, 16 bp, R. norvegicus
tccttggactcaggct

SEQ ID NO: 519722 - DNA, 16 bp, R. norvegicus
tccttggcagcatctg

SEQ ID NO: 519723 - DNA, 16 bp, R. norvegicus
tccttgggagctctgg

SEQ ID NO: 519724 - DNA, 16 bp, R. norvegicus
tccttgggcacttccc

SEQ ID NO: 519725 - DNA, 16 bp, R. norvegicus
tccttggggctgatag

SEQ ID NO: 519726 - DNA, 16 bp, R. norvegicus
tccttggtccctggtt

SEQ ID NO: 519727 - DNA, 16 bp, R. norvegicus
tccttgtacagagctc

SEQ ID NO: 519728 - DNA, 16 bp, R. norvegicus
tccttgtacccaggcc

SEQ ID NO: 519729 - DNA, 16 bp, R. norvegicus
tccttgtcagcatttg

SEQ ID NO: 519730 - DNA, 16 bp, R. norvegicus
tccttgtccttgtcct

SEQ ID NO: 519731 - DNA, 16 bp, R. norvegicus
tccttgtgctgggatt

SEQ ID NO: 519732 - DNA, 16 bp, R. norvegicus
tccttgttttatgttg

SEQ ID NO: 519733 - DNA, 16 bp, R. norvegicus
tcctttaaaaggagaa

SEQ ID NO: 519734 - DNA, 16 bp, R. norvegicus
tcctttaaggctctcc

SEQ ID NO: 519735 - DNA, 16 bp, R. norvegicus
tcctttatctcctcca

SEQ ID NO: 519736 - DNA, 16 bp, R. norvegicus
tcctttattgcttcta

SEQ ID NO: 519737 - DNA, 16 bp, R. norvegicus
tcctttattttcaaaa

SEQ ID NO: 519738 - DNA, 16 bp, R. norvegicus
tcctttcacatgtttg

SEQ ID NO: 519739 - DNA, 16 bp, R. norvegicus
tcctttcagtgctctg

SEQ ID NO: 519740 - DNA, 16 bp, R. norvegicus
tcctttccagtgaggc

SEQ ID NO: 519741 - DNA, 16 bp, R. norvegicus
tcctttccctctgagg

SEQ ID NO: 519742 - DNA, 16 bp, R. norvegicus
tcctttcctcccagtc

SEQ ID NO: 519743 - DNA, 16 bp, R. norvegicus
tcctttcctcctcaac

SEQ ID NO: 519744 - DNA, 16 bp, R. norvegicus
tcctttctcaaaaaaa

SEQ ID NO: 519745 - DNA, 16 bp, R. norvegicus
tcctttctgatgactc

SEQ ID NO: 519746 - DNA, 16 bp, R. norvegicus
tcctttctgtctttca

SEQ ID NO: 519747 - DNA, 16 bp, R. norvegicus
tcctttctttaaaaag

SEQ ID NO: 519748 - DNA, 16 bp, R. norvegicus
tcctttgaagggctgg

SEQ ID NO: 519749 - DNA, 16 bp, R. norvegicus
tcctttgatgagaatg

SEQ ID NO: 519750 - DNA, 16 bp, R. norvegicus
tcctttgcatgacccc

SEQ ID NO: 519751 - DNA, 16 bp, R. norvegicus
tccttttaaaaaatat

SEQ ID NO: 519752 - DNA, 16 bp, R. norvegicus
tccttttaacactgct

SEQ ID NO: 519753 - DNA, 16 bp, R. norvegicus
tccttttattgttgaa

SEQ ID NO: 519754 - DNA, 16 bp, R. norvegicus
tccttttcccagaggc

SEQ ID NO: 519755 - DNA, 16 bp, R. norvegicus
tccttttcctctctga

SEQ ID NO: 519756 - DNA, 16 bp, R. norvegicus
tccttttctcttcaga

SEQ ID NO: 519757 - DNA, 16 bp, R. norvegicus
tccttttggatctggg

SEQ ID NO: 519758 - DNA, 17 bp, R. norvegicus
tccttttgggtgtattt

SEQ ID NO: 519759 - DNA, 16 bp, R. norvegicus
tccttttgtggtctga

SEQ ID NO: 519760 - DNA, 16 bp, R. norvegicus
tccttttgtgtctgag

SEQ ID NO: 519761 - DNA, 16 bp, R. norvegicus
tcctttttaaaaagat

SEQ ID NO: 519762 - DNA, 16 bp, R. norvegicus
tcctttttaaaagaat

SEQ ID NO: 519763 - DNA, 16 bp, R. norvegicus
tcgaagaagctgagaa

SEQ ID NO: 519764 - DNA, 16 bp, R. norvegicus
tcgaattcctattctt

SEQ ID NO: 519765 - DNA, 16 bp, R. norvegicus
tcgacaaaattgaaac

SEQ ID NO: 519766 - DNA, 16 bp, R. norvegicus
tcgacaaatgagacct

SEQ ID NO: 519767 - DNA, 16 bp, R. norvegicus
tcgacagaggaatgga

SEQ ID NO: 519768 - DNA, 16 bp, R. norvegicus
tcgaccagggtctggg

SEQ ID NO: 519769 - DNA, 17 bp, R. norvegicus
tcgagatctaggggagc

SEQ ID NO: 519770 - DNA, 16 bp, R. norvegicus
tcgagtctcaggatgg

SEQ ID NO: 519771 - DNA, 16 bp, R. norvegicus
tcgattatataaacaa

SEQ ID NO: 519772 - DNA, 16 bp, R. norvegicus
tcgcagcattgggaag

SEQ ID NO: 519773 - DNA, 16 bp, R. norvegicus
tcgccagaaaccatga

SEQ ID NO: 519774 - DNA, 16 bp, R. norvegicus
tcgccagcacctgctg

SEQ ID NO: 519775 - DNA, 16 bp, R. norvegicus
tcgccatctgcttatc

SEQ ID NO: 519776 - DNA, 17 bp, R. norvegicus
tcgctccaatcctgagg

SEQ ID NO: 519777 - DNA, 16 bp, R. norvegicus
tcgctcgctcgctcgc

SEQ ID NO: 519778 - DNA, 16 bp, R. norvegicus
tcgcttccctgagaga

SEQ ID NO: 519779 - DNA, 16 bp, R. norvegicus
tcggactccagaggaa

SEQ ID NO: 519780 - DNA, 16 bp, R. norvegicus
tcggagctctgagctc

SEQ ID NO: 519781 - DNA, 16 bp, R. norvegicus
tcggattgcagactgg

SEQ ID NO: 519782 - DNA, 16 bp, R. norvegicus
tcggcactggtcagcc

SEQ ID NO: 519783 - DNA, 18 bp, R. norvegicus
tcggcagcaaccaggaag

SEQ ID NO: 519784 - DNA, 16 bp, R. norvegicus
tcggcagcagctctct

SEQ ID NO: 519785 - DNA, 16 bp, R. norvegicus
tcggcaggtcgcagac

SEQ ID NO: 519786 - DNA, 16 bp, R. norvegicus
tcggcattcctcatct

SEQ ID NO: 519787 - DNA, 17 bp, R. norvegicus
tcggcctgcactccttt

SEQ ID NO: 519788 - DNA, 16 bp, R. norvegicus
tcgggaatgtgggcag

SEQ ID NO: 519789 - DNA, 16 bp, R. norvegicus
tcgggactggaactca

SEQ ID NO: 519790 - DNA, 16 bp, R. norvegicus
tcgggagactgaggca

SEQ ID NO: 519791 - DNA, 16 bp, R. norvegicus
tcggttcccagcacct

SEQ ID NO: 519792 - DNA, 16 bp, R. norvegicus
tcgtcaccaccaccac

SEQ ID NO: 519793 - DNA, 16 bp, R. norvegicus
tcgtcatcatcatcgt

SEQ ID NO: 519794 - DNA, 17 bp, R. norvegicus
tcgtcgtcgtcctcctc

SEQ ID NO: 519795 - DNA, 16 bp, R. norvegicus
tcgtcgtcgtcgtcgt

SEQ ID NO: 519796 - DNA, 16 bp, R. norvegicus
tcgtctcttcttttgg

SEQ ID NO: 519797 - DNA, 16 bp, R. norvegicus
tcgtgagttcaattcc

SEQ ID NO: 519798 - DNA, 16 bp, R. norvegicus
tcgtgcctagaagatg

SEQ ID NO: 519799 - DNA, 16 bp, R. norvegicus
tcgtgtctgtctttgt

SEQ ID NO: 519800 - DNA, 16 bp, R. norvegicus
tcgttccatcttctga

SEQ ID NO: 519801 - DNA, 16 bp, R. norvegicus
tctaaaactggaaata

SEQ ID NO: 519802 - DNA, 21 bp, R. norvegicus
tctaaaactggtcttcaataa

SEQ ID NO: 519803 - DNA, 16 bp, R. norvegicus
tctaaaagtcctgcct

SEQ ID NO: 519804 - DNA, 16 bp, R. norvegicus
tctaaaccccattttt

SEQ ID NO: 519805 - DNA, 16 bp, R. norvegicus
tctaaagagcaagttc

SEQ ID NO: 519806 - DNA, 16 bp, R. norvegicus
tctaaagccagagcta

SEQ ID NO: 519807 - DNA, 16 bp, R. norvegicus
tctaaaggaacagaac

SEQ ID NO: 519808 - DNA, 16 bp, R. norvegicus
tctaaattgagaaaat

SEQ ID NO: 519809 - DNA, 16 bp, R. norvegicus
tctaaatttaagaaat

SEQ ID NO: 519810 - DNA, 16 bp, R. norvegicus
tctaactattataaat

SEQ ID NO: 519811 - DNA, 16 bp, R. norvegicus
tctaactttttgagtt

SEQ ID NO: 519812 - DNA, 16 bp, R. norvegicus
tctaagaaataaaaat

SEQ ID NO: 519813 - DNA, 16 bp, R. norvegicus
tctaagagcctcctga

SEQ ID NO: 519814 - DNA, 23 bp, R. norvegicus
tctaagatcaagaatccacaaat

SEQ ID NO: 519815 - DNA, 16 bp, R. norvegicus
tctaagatcttcctca

SEQ ID NO: 519816 - DNA, 16 bp, R. norvegicus
tctaagccatctctct

SEQ ID NO: 519817 - DNA, 16 bp, R. norvegicus
tctaagttcaaggcca

SEQ ID NO: 519818 - DNA, 16 bp, R. norvegicus
tctaatgagataatta

SEQ ID NO: 519819 - DNA, 16 bp, R. norvegicus
tctaattggatgtctg

SEQ ID NO: 519820 - DNA, 16 bp, R. norvegicus
tctacaaaacaaagaa

SEQ ID NO: 519821 - DNA, 16 bp, R. norvegicus
tctacaaacatctgtg

SEQ ID NO: 519822 - DNA, 16 bp, R. norvegicus
tctacaagagcagtat

SEQ ID NO: 519823 - DNA, 16 bp, R. norvegicus
tctacaataagaactt

SEQ ID NO: 519824 - DNA, 16 bp, R. norvegicus
tctacacagtgaggtc

SEQ ID NO: 519825 - DNA, 16 bp, R. norvegicus
tctacacagtgagttc

SEQ ID NO: 519826 - DNA, 16 bp, R. norvegicus
tctacagactgagttc

SEQ ID NO: 519827 - DNA, 16 bp, R. norvegicus
tctacagagaaagttc

SEQ ID NO: 519828 - DNA, 17 bp, R. norvegicus
tctacagagacaccaca

SEQ ID NO: 519829 - DNA, 16 bp, R. norvegicus
tctacagagacttgaa

SEQ ID NO: 519830 - DNA, 16 bp, R. norvegicus
tctacagagcaaattc

SEQ ID NO: 519831 - DNA, 16 bp, R. norvegicus
tctacagagcatttca

SEQ ID NO: 519832 - DNA, 26 bp, R. norvegicus
tctacagattcaatgcaatccccatt

SEQ ID NO: 519833 - DNA, 16 bp, R. norvegicus
tctacagcaatcctga

SEQ ID NO: 519834 - DNA, 16 bp, R. norvegicus
tctacagcactcctgt

SEQ ID NO: 519835 - DNA, 16 bp, R. norvegicus
tctacagcacttctga

SEQ ID NO: 519836 - DNA, 16 bp, R. norvegicus
tctacagcctgatctt

SEQ ID NO: 519837 - DNA, 16 bp, R. norvegicus
tctacagcttcttgtc

SEQ ID NO: 519838 - DNA, 17 bp, R. norvegicus
tctacagggagaagccc

SEQ ID NO: 519839 - DNA, 16 bp, R. norvegicus
tctacagggagagttc

SEQ ID NO: 519840 - DNA, 16 bp, R. norvegicus
tctacaggttctattt

SEQ ID NO: 519841 - DNA, 16 bp, R. norvegicus
tctacagtggggaggg

SEQ ID NO: 519842 - DNA, 16 bp, R. norvegicus
tctacatccagggttg

SEQ ID NO: 519843 - DNA, 16 bp, R. norvegicus
tctacatcctcatctg

SEQ ID NO: 519844 - DNA, 16 bp, R. norvegicus
tctacatctggatcag

SEQ ID NO: 519845 - DNA, 16 bp, R. norvegicus
tctacatgttgaactc

SEQ ID NO: 519846 - DNA, 16 bp, R. norvegicus
tctacattgcaagttc

SEQ ID NO: 519847 - DNA, 16 bp, R. norvegicus
tctaccaacaatggag

SEQ ID NO: 519848 - DNA, 16 bp, R. norvegicus
tctaccactgagcaat

SEQ ID NO: 519849 - DNA, 16 bp, R. norvegicus
tctaccactgagctac

SEQ ID NO: 519850 - DNA, 16 bp, R. norvegicus
tctaccagaacctgac

SEQ ID NO: 519851 - DNA, 16 bp, R. norvegicus
tctacccatccatcta

SEQ ID NO: 519852 - DNA, 16 bp, R. norvegicus
tctaccccaggactgc

SEQ ID NO: 519853 - DNA, 16 bp, R. norvegicus
tctacctcccaagtgc

SEQ ID NO: 519854 - DNA, 16 bp, R. norvegicus
tctacctctgcctcct

SEQ ID NO: 519855 - DNA, 16 bp, R. norvegicus
tctacctgaagaccaa

SEQ ID NO: 519856 - DNA, 16 bp, R. norvegicus
tctacctgaagaccca

SEQ ID NO: 519857 - DNA, 16 bp, R. norvegicus
tctacctgaggaccca

SEQ ID NO: 519858 - DNA, 16 bp, R. norvegicus
tctacctgcatgctgc

SEQ ID NO: 519859 - DNA, 16 bp, R. norvegicus
tctacctgccagtctc

SEQ ID NO: 519860 - DNA, 16 bp, R. norvegicus
tctacctgcctctgtt

SEQ ID NO: 519861 - DNA, 16 bp, R. norvegicus
tctacctgcctggctc

SEQ ID NO: 519862 - DNA, 16 bp, R. norvegicus
tctacctgtcctggaa

SEQ ID NO: 519863 - DNA, 16 bp, R. norvegicus
tctacctgtctccatc

SEQ ID NO: 519864 - DNA, 16 bp, R. norvegicus
tctacctgtgtgtctc

SEQ ID NO: 519865 - DNA, 16 bp, R. norvegicus
tctacctttctgtctc

SEQ ID NO: 519866 - DNA, 16 bp, R. norvegicus
tctactacataaacaa

SEQ ID NO: 519867 - DNA, 16 bp, R. norvegicus
tctactatgttcatag

SEQ ID NO: 519868 - DNA, 16 bp, R. norvegicus
tctactcctctactct

SEQ ID NO: 519869 - DNA, 16 bp, R. norvegicus
tctactgctgtgatga

SEQ ID NO: 519870 - DNA, 16 bp, R. norvegicus
tctactggcatcttca

SEQ ID NO: 519871 - DNA, 16 bp, R. norvegicus
tctactgggagtcctg

SEQ ID NO: 519872 - DNA, 16 bp, R. norvegicus
tctacttcctcttctg

SEQ ID NO: 519873 - DNA, 16 bp, R. norvegicus
tctacttctttctgaa

SEQ ID NO: 519874 - DNA, 16 bp, R. norvegicus
tctactttgtgtgtgt

SEQ ID NO: 519875 - DNA, 16 bp, R. norvegicus
tctagaaaggctgagg

SEQ ID NO: 519876 - DNA, 16 bp, R. norvegicus
tctagaaagtaccaga

SEQ ID NO: 519877 - DNA, 16 bp, R. norvegicus
tctagaagaacagcaa

SEQ ID NO: 519878 - DNA, 16 bp, R. norvegicus
tctagaagacctgagt

SEQ ID NO: 519879 - DNA, 16 bp, R. norvegicus
tctagaagcttccagg

SEQ ID NO: 519880 - DNA, 16 bp, R. norvegicus
tctagaggaccagagt

SEQ ID NO: 519881 - DNA, 16 bp, R. norvegicus
tctagaggacctaggt

SEQ ID NO: 519882 - DNA, 16 bp, R. norvegicus
tctagaggatctgaca

SEQ ID NO: 519883 - DNA, 16 bp, R. norvegicus
tctagaggggaaacca

SEQ ID NO: 519884 - DNA, 16 bp, R. norvegicus
tctagagttgagaaga

SEQ ID NO: 519885 - DNA, 16 bp, R. norvegicus
tctagcagaagagaat

SEQ ID NO: 519886 - DNA, 16 bp, R. norvegicus
tctagcagagcctctt

SEQ ID NO: 519887 - DNA, 16 bp, R. norvegicus
tctagcccctccccct

SEQ ID NO: 519888 - DNA, 16 bp, R. norvegicus
tctagcctcagtgaga

SEQ ID NO: 519889 - DNA, 16 bp, R. norvegicus
tctagctttgcttagt

SEQ ID NO: 519890 - DNA, 18 bp, R. norvegicus
tctaggaccggacacttc

SEQ ID NO: 519891 - DNA, 16 bp, R. norvegicus
tctaggagataacaga

SEQ ID NO: 519892 - DNA, 16 bp, R. norvegicus
tctaggatcttctggc

SEQ ID NO: 519893 - DNA, 16 bp, R. norvegicus
tctaggttcagtcaga

SEQ ID NO: 519894 - DNA, 16 bp, R. norvegicus
tctaggttttctgtct

SEQ ID NO: 519895 - DNA, 16 bp, R. norvegicus
tctagtcaagttgaca

SEQ ID NO: 519896 - DNA, 16 bp, R. norvegicus
tctagtcccatccatt

SEQ ID NO: 519897 - DNA, 16 bp, R. norvegicus
tctagttcttttcctc

SEQ ID NO: 519898 - DNA, 16 bp, R. norvegicus
tctagttgacataaaa

SEQ ID NO: 519899 - DNA, 16 bp, R. norvegicus
tctataaacaaactga

SEQ ID NO: 519900 - DNA, 16 bp, R. norvegicus
tctataaataaaaatg

SEQ ID NO: 519901 - DNA, 16 bp, R. norvegicus
tctataagtttgaggc

SEQ ID NO: 519902 - DNA, 16 bp, R. norvegicus
tctatacccagatcct

SEQ ID NO: 519903 - DNA, 16 bp, R. norvegicus
tctatacctattatgc

SEQ ID NO: 519904 - DNA, 16 bp, R. norvegicus
tctatagaaaagagaa

SEQ ID NO: 519905 - DNA, 16 bp, R. norvegicus
tctatatactgagttc

SEQ ID NO: 519906 - DNA, 16 bp, R. norvegicus
tctatatagtgagttc

SEQ ID NO: 519907 - DNA, 16 bp, R. norvegicus
tctatcaatctatcta

SEQ ID NO: 519908 - DNA, 16 bp, R. norvegicus
tctatcagatgttgga

SEQ ID NO: 519909 - DNA, 16 bp, R. norvegicus
tctatcctaaaaccaa

SEQ ID NO: 519910 - DNA, 16 bp, R. norvegicus
tctatcctacagcaaa

SEQ ID NO: 519911 - DNA, 16 bp, R. norvegicus
tctatctacccatcca

SEQ ID NO: 519912 - DNA, 16 bp, R. norvegicus
tctatctatcatctat

SEQ ID NO: 519913 - DNA, 26 bp, R. norvegicus
tctatctatctatctatctatctatc

SEQ ID NO: 519914 - DNA, 16 bp, R. norvegicus
tctatctccattttca

SEQ ID NO: 519915 - DNA, 16 bp, R. norvegicus
tctatctcctgggatt

SEQ ID NO: 519916 - DNA, 16 bp, R. norvegicus
tctatctctatctcta

SEQ ID NO: 519917 - DNA, 17 bp, R. norvegicus
tctatctctctatctct

SEQ ID NO: 519918 - DNA, 16 bp, R. norvegicus
tctatctctctcatct

SEQ ID NO: 519919 - DNA, 16 bp, R. norvegicus
tctatctgcctgactc

SEQ ID NO: 519920 - DNA, 16 bp, R. norvegicus
tctatctgtctatcta

SEQ ID NO: 519921 - DNA, 16 bp, R. norvegicus
tctatgaagaactgaa

SEQ ID NO: 519922 - DNA, 16 bp, R. norvegicus
tctatgaagatgcttc

SEQ ID NO: 519923 - DNA, 16 bp, R. norvegicus
tctatgaagatttgat

SEQ ID NO: 519924 - DNA, 16 bp, R. norvegicus
tctatgaaggactgat

SEQ ID NO: 519925 - DNA, 16 bp, R. norvegicus
tctatgaaggtctcat

SEQ ID NO: 519926 - DNA, 16 bp, R. norvegicus
tctatgaatttgttga

SEQ ID NO: 519927 - DNA, 17 bp, R. norvegicus
tctatgacaaaaccaaa

SEQ ID NO: 519928 - DNA, 22 bp, R. norvegicus
tctatgactgcaaagcctgcct

SEQ ID NO: 519929 - DNA, 16 bp, R. norvegicus
tctatgagggtgtttc

SEQ ID NO: 519930 - DNA, 16 bp, R. norvegicus
tctatgatcaacaatt

SEQ ID NO: 519931 - DNA, 16 bp, R. norvegicus
tctatggcacctccat

SEQ ID NO: 519932 - DNA, 16 bp, R. norvegicus
tctatggtactttttg

SEQ ID NO: 519933 - DNA, 16 bp, R. norvegicus
tctatggtatcttctg

SEQ ID NO: 519934 - DNA, 16 bp, R. norvegicus
tctatgtatctgtgta

SEQ ID NO: 519935 - DNA, 16 bp, R. norvegicus
tctatgtgccctgact

SEQ ID NO: 519936 - DNA, 16 bp, R. norvegicus
tctatgtgtctgtatg

SEQ ID NO: 519937 - DNA, 16 bp, R. norvegicus
tctatgtgtttgaggc

SEQ ID NO: 519938 - DNA, 16 bp, R. norvegicus
tctatgttatcttctg

SEQ ID NO: 519939 - DNA, 16 bp, R. norvegicus
tctattcccagcactg

SEQ ID NO: 519940 - DNA, 16 bp, R. norvegicus
tctattctcagttcag

SEQ ID NO: 519941 - DNA, 16 bp, R. norvegicus
tctattgccatgaaga

SEQ ID NO: 519942 - DNA, 16 bp, R. norvegicus
tctatttattctcctg

SEQ ID NO: 519943 - DNA, 16 bp, R. norvegicus
tctatttcctgaagat

SEQ ID NO: 519944 - DNA, 16 bp, R. norvegicus
tctatttgcagatgat

SEQ ID NO: 519945 - DNA, 16 bp, R. norvegicus
tctatttgtgtgtgtg

SEQ ID NO: 519946 - DNA, 16 bp, R. norvegicus
tctattttgtggaaaa

SEQ ID NO: 519947 - DNA, 16 bp, R. norvegicus
tctcaaaaaacatttt

SEQ ID NO: 519948 - DNA, 16 bp, R. norvegicus
tctcaaaaaagccaaa

SEQ ID NO: 519949 - DNA, 16 bp, R. norvegicus
tctcaaaaacctgaca

SEQ ID NO: 519950 - DNA, 16 bp, R. norvegicus
tctcaaaaagaaagga

SEQ ID NO: 519951 - DNA, 16 bp, R. norvegicus
tctcaaaaatattaat

SEQ ID NO: 519952 - DNA, 16 bp, R. norvegicus
tctcaaaacagcctag

SEQ ID NO: 519953 - DNA, 16 bp, R. norvegicus
tctcaaaagaaaaata

SEQ ID NO: 519954 - DNA, 16 bp, R. norvegicus
tctcaaaagactaaaa

SEQ ID NO: 519955 - DNA, 16 bp, R. norvegicus
tctcaaaagagagaga

SEQ ID NO: 519956 - DNA, 16 bp, R. norvegicus
tctcaaaataaacaca

SEQ ID NO: 519957 - DNA, 17 bp, R. norvegicus
tctcaaacactggatca

SEQ ID NO: 519958 - DNA, 16 bp, R. norvegicus
tctcaaaccccagcct

SEQ ID NO: 519959 - DNA, 16 bp, R. norvegicus
tctcaaactcacagaa

SEQ ID NO: 519960 - DNA, 16 bp, R. norvegicus
tctcaaactcctgggc

SEQ ID NO: 519961 - DNA, 16 bp, R. norvegicus
tctcaaagaaacaact

SEQ ID NO: 519962 - DNA, 16 bp, R. norvegicus
tctcaaagaagcaaaa

SEQ ID NO: 519963 - DNA, 16 bp, R. norvegicus
tctcaaagaggatgtc

SEQ ID NO: 519964 - DNA, 16 bp, R. norvegicus
tctcaaagcctgcctc

SEQ ID NO: 519965 - DNA, 16 bp, R. norvegicus
tctcaaaggctgaaaa

SEQ ID NO: 519966 - DNA, 16 bp, R. norvegicus
tctcaaattcatctga

SEQ ID NO: 519967 - DNA, 16 bp, R. norvegicus
tctcaacaacaatgga

SEQ ID NO: 519968 - DNA, 16 bp, R. norvegicus
tctcaacaacaatggc

SEQ ID NO: 519969 - DNA, 16 bp, R. norvegicus
tctcaacagcaatgga

SEQ ID NO: 519970 - DNA, 16 bp, R. norvegicus
tctcaacattcctaat

SEQ ID NO: 519971 - DNA, 16 bp, R. norvegicus
tctcaacctgtggatc

SEQ ID NO: 519972 - DNA, 16 bp, R. norvegicus
tctcaacctgttggtt

SEQ ID NO: 519973 - DNA, 16 bp, R. norvegicus
tctcaactaacctgga

SEQ ID NO: 519974 - DNA, 16 bp, R. norvegicus
tctcaagatcaatgga

SEQ ID NO: 519975 - DNA, 16 bp, R. norvegicus
tctcaaggaaaaaaaa

SEQ ID NO: 519976 - DNA, 16 bp, R. norvegicus
tctcaatatcagtggt

SEQ ID NO: 519977 - DNA, 16 bp, R. norvegicus
tctcaatcagctgctg

SEQ ID NO: 519978 - DNA, 16 bp, R. norvegicus
tctcaatgccctggca

SEQ ID NO: 519979 - DNA, 16 bp, R. norvegicus
tctcacaacacacaca

SEQ ID NO: 519980 - DNA, 16 bp, R. norvegicus
tctcacaagaacagca

SEQ ID NO: 519981 - DNA, 16 bp, R. norvegicus
tctcacacacattctc

SEQ ID NO: 519982 - DNA, 16 bp, R. norvegicus
tctcacaccacagcaa

SEQ ID NO: 519983 - DNA, 16 bp, R. norvegicus
tctcacagcactcctc

SEQ ID NO: 519984 - DNA, 16 bp, R. norvegicus
tctcacagctctggag

SEQ ID NO: 519985 - DNA, 16 bp, R. norvegicus
tctcacaggagaaggg

SEQ ID NO: 519986 - DNA, 16 bp, R. norvegicus
tctcaccacctcaagg

SEQ ID NO: 519987 - DNA, 17 bp, R. norvegicus
tctcaccagaaactatg

SEQ ID NO: 519988 - DNA, 17 bp, R. norvegicus
tctcacctccaaggtct

SEQ ID NO: 519989 - DNA, 16 bp, R. norvegicus
tctcacctccacacac

SEQ ID NO: 519990 - DNA, 16 bp, R. norvegicus
tctcacctcctgggtc

SEQ ID NO: 519991 - DNA, 16 bp, R. norvegicus
tctcacctgtgctttc

SEQ ID NO: 519992 - DNA, 16 bp, R. norvegicus
tctcaccttccacctt

SEQ ID NO: 519993 - DNA, 16 bp, R. norvegicus
tctcactaaatctgga

SEQ ID NO: 519994 - DNA, 16 bp, R. norvegicus
tctcactcaggatggt

SEQ ID NO: 519995 - DNA, 16 bp, R. norvegicus
tctcactctctcacac

SEQ ID NO: 519996 - DNA, 16 bp, R. norvegicus
tctcactgaactggaa

SEQ ID NO: 519997 - DNA, 16 bp, R. norvegicus
tctcactgaagccaga

SEQ ID NO: 519998 - DNA, 16 bp, R. norvegicus
tctcactgagaccaga

SEQ ID NO: 519999 - DNA, 16 bp, R. norvegicus
tctcactgaggccaca

SEQ ID NO: 520000 - DNA, 16 bp, R. norvegicus
tctcactgagtccaga

SEQ ID NO: 520001 - DNA, 16 bp, R. norvegicus
tctcactgatgtcaga

SEQ ID NO: 520002 - DNA, 16 bp, R. norvegicus
tctcactgcagcaggg

SEQ ID NO: 520003 - DNA, 16 bp, R. norvegicus
tctcactggcctgaag

SEQ ID NO: 520004 - DNA, 16 bp, R. norvegicus
tctcactgtgtagccc

SEQ ID NO: 520005 - DNA, 16 bp, R. norvegicus
tctcagaaaacaagat

SEQ ID NO: 520006 - DNA, 16 bp, R. norvegicus
tctcagaaaacacttt

SEQ ID NO: 520007 - DNA, 16 bp, R. norvegicus
tctcagaaaagactga

SEQ ID NO: 520008 - DNA, 16 bp, R. norvegicus
tctcagaaaattgaac

SEQ ID NO: 520009 - DNA, 16 bp, R. norvegicus
tctcagaaagaagaaa

SEQ ID NO: 520010 - DNA, 16 bp, R. norvegicus
tctcagaaagatccac

SEQ ID NO: 520011 - DNA, 16 bp, R. norvegicus
tctcagaaattaaaaa

SEQ ID NO: 520012 - DNA, 16 bp, R. norvegicus
tctcagaagacagaga

SEQ ID NO: 520013 - DNA, 16 bp, R. norvegicus
tctcagaagagacttt

SEQ ID NO: 520014 - DNA, 16 bp, R. norvegicus
tctcagaagaggaaac

SEQ ID NO: 520015 - DNA, 16 bp, R. norvegicus
tctcagacacagggga

SEQ ID NO: 520016 - DNA, 16 bp, R. norvegicus
tctcagaccaccactg

SEQ ID NO: 520017 - DNA, 16 bp, R. norvegicus
tctcagaccactactt

SEQ ID NO: 520018 - DNA, 16 bp, R. norvegicus
tctcagagcttacctc

SEQ ID NO: 520019 - DNA, 16 bp, R. norvegicus
tctcagaggaggaggg

SEQ ID NO: 520020 - DNA, 16 bp, R. norvegicus
tctcagaggcagaaga

SEQ ID NO: 520021 - DNA, 16 bp, R. norvegicus
tctcagaggcaggagg

SEQ ID NO: 520022 - DNA, 16 bp, R. norvegicus
tctcagagttgctttg

SEQ ID NO: 520023 - DNA, 16 bp, R. norvegicus
tctcagatgctcaagt

SEQ ID NO: 520024 - DNA, 16 bp, R. norvegicus
tctcagcaaccacatg

SEQ ID NO: 520025 - DNA, 16 bp, R. norvegicus
tctcagcaacttcagt

SEQ ID NO: 520026 - DNA, 16 bp, R. norvegicus
tctcagcacaaaggag

SEQ ID NO: 520027 - DNA, 16 bp, R. norvegicus
tctcagcacccacaca

SEQ ID NO: 520028 - DNA, 16 bp, R. norvegicus
tctcagcacctcaagg

SEQ ID NO: 520029 - DNA, 16 bp, R. norvegicus
tctcagcaccttctcc

SEQ ID NO: 520030 - DNA, 16 bp, R. norvegicus
tctcagcactcaagag

SEQ ID NO: 520031 - DNA, 16 bp, R. norvegicus
tctcagcactccagag

SEQ ID NO: 520032 - DNA, 16 bp, R. norvegicus
tctcagcactggggaa

SEQ ID NO: 520033 - DNA, 16 bp, R. norvegicus
tctcagcactggggag

SEQ ID NO: 520034 - DNA, 16 bp, R. norvegicus
tctcagcacttggcag

SEQ ID NO: 520035 - DNA, 16 bp, R. norvegicus
tctcagcacttgggtg

SEQ ID NO: 520036 - DNA, 16 bp, R. norvegicus
tctcagcagcagaaga

SEQ ID NO: 520037 - DNA, 16 bp, R. norvegicus
tctcagcagcagcagc

SEQ ID NO: 520038 - DNA, 16 bp, R. norvegicus
tctcagcagccattga

SEQ ID NO: 520039 - DNA, 16 bp, R. norvegicus
tctcagccacctctcc

SEQ ID NO: 520040 - DNA, 16 bp, R. norvegicus
tctcagccattcagca

SEQ ID NO: 520041 - DNA, 16 bp, R. norvegicus
tctcagccatttggaa

SEQ ID NO: 520042 - DNA, 16 bp, R. norvegicus
tctcagcccctctcct

SEQ ID NO: 520043 - DNA, 16 bp, R. norvegicus
tctcagcccctctctc

SEQ ID NO: 520044 - DNA, 17 bp, R. norvegicus
tctcagccctcaccagc

SEQ ID NO: 520045 - DNA, 16 bp, R. norvegicus
tctcagcctcagaggg

SEQ ID NO: 520046 - DNA, 16 bp, R. norvegicus
tctcagcctctcagcc

SEQ ID NO: 520047 - DNA, 16 bp, R. norvegicus
tctcagctacttggga

SEQ ID NO: 520048 - DNA, 16 bp, R. norvegicus
tctcagctattcagca

SEQ ID NO: 520049 - DNA, 16 bp, R. norvegicus
tctcagctccagtctc

SEQ ID NO: 520050 - DNA, 16 bp, R. norvegicus
tctcagctcctccagc

SEQ ID NO: 520051 - DNA, 16 bp, R. norvegicus
tctcagctgaagaata

SEQ ID NO: 520052 - DNA, 16 bp, R. norvegicus
tctcagctgagaatta

SEQ ID NO: 520053 - DNA, 16 bp, R. norvegicus
tctcagcttcctgtcc

SEQ ID NO: 520054 - DNA, 16 bp, R. norvegicus
tctcagcttcttccag

SEQ ID NO: 520055 - DNA, 16 bp, R. norvegicus
tctcagctttctggat

SEQ ID NO: 520056 - DNA, 16 bp, R. norvegicus
tctcaggaaaacaaaa

SEQ ID NO: 520057 - DNA, 16 bp, R. norvegicus
tctcaggaaaagaaga

SEQ ID NO: 520058 - DNA, 16 bp, R. norvegicus
tctcaggaaacaaaaa

SEQ ID NO: 520059 - DNA, 16 bp, R. norvegicus
tctcaggactcaaaag

SEQ ID NO: 520060 - DNA, 16 bp, R. norvegicus
tctcaggagaaaagga

SEQ ID NO: 520061 - DNA, 16 bp, R. norvegicus
tctcaggaggagcagg

SEQ ID NO: 520062 - DNA, 16 bp, R. norvegicus
tctcaggatgtctgta

SEQ ID NO: 520063 - DNA, 16 bp, R. norvegicus
tctcaggattgtcccc

SEQ ID NO: 520064 - DNA, 16 bp, R. norvegicus
tctcaggcacagggat

SEQ ID NO: 520065 - DNA, 17 bp, R. norvegicus
tctcaggcagggatcct

SEQ ID NO: 520066 - DNA, 16 bp, R. norvegicus
tctcaggcataaaaga

SEQ ID NO: 520067 - DNA, 16 bp, R. norvegicus
tctcaggctcctgctg

SEQ ID NO: 520068 - DNA, 16 bp, R. norvegicus
tctcaggctggcctgg

SEQ ID NO: 520069 - DNA, 16 bp, R. norvegicus
tctcaggggcagatga

SEQ ID NO: 520070 - DNA, 16 bp, R. norvegicus
tctcagggggagaaga

SEQ ID NO: 520071 - DNA, 16 bp, R. norvegicus
tctcaggggtccagga

SEQ ID NO: 520072 - DNA, 16 bp, R. norvegicus
tctcaggtacagaaga

SEQ ID NO: 520073 - DNA, 16 bp, R. norvegicus
tctcagtatctaatga

SEQ ID NO: 520074 - DNA, 16 bp, R. norvegicus
tctcagtcaactgctg

SEQ ID NO: 520075 - DNA, 16 bp, R. norvegicus
tctcagtcagcaaagc

SEQ ID NO: 520076 - DNA, 16 bp, R. norvegicus
tctcagtcagttgctt

SEQ ID NO: 520077 - DNA, 16 bp, R. norvegicus
tctcagtgctcaggag

SEQ ID NO: 520078 - DNA, 16 bp, R. norvegicus
tctcagtgctgagatt

SEQ ID NO: 520079 - DNA, 16 bp, R. norvegicus
tctcagtggaagagga

SEQ ID NO: 520080 - DNA, 16 bp, R. norvegicus
tctcagtgtgtgtctc

SEQ ID NO: 520081 - DNA, 16 bp, R. norvegicus
tctcagttctctctct

SEQ ID NO: 520082 - DNA, 16 bp, R. norvegicus
tctcataggctctttt

SEQ ID NO: 520083 - DNA, 16 bp, R. norvegicus
tctcatcaatgcacag

SEQ ID NO: 520084 - DNA, 16 bp, R. norvegicus
tctcatcaatggaaag

SEQ ID NO: 520085 - DNA, 16 bp, R. norvegicus
tctcatctctctctgt

SEQ ID NO: 520086 - DNA, 16 bp, R. norvegicus
tctcatctgtaaagtg

SEQ ID NO: 520087 - DNA, 16 bp, R. norvegicus
tctcatgaagacattt

SEQ ID NO: 520088 - DNA, 16 bp, R. norvegicus
tctcatgagaagagag

SEQ ID NO: 520089 - DNA, 17 bp, R. norvegicus
tctcatgagcaagggat

SEQ ID NO: 520090 - DNA, 16 bp, R. norvegicus
tctcatgctgggagaa

SEQ ID NO: 520091 - DNA, 16 bp, R. norvegicus
tctcatggaggcattt

SEQ ID NO: 520092 - DNA, 21 bp, R. norvegicus
tctcatggtactttctccaaa

SEQ ID NO: 520093 - DNA, 16 bp, R. norvegicus
tctcatggtatcttct

SEQ ID NO: 520094 - DNA, 16 bp, R. norvegicus
tctcatgtagcccagg

SEQ ID NO: 520095 - DNA, 16 bp, R. norvegicus
tctcattcaaaccaca

SEQ ID NO: 520096 - DNA, 16 bp, R. norvegicus
tctcattggtggggcc

SEQ ID NO: 520097 - DNA, 16 bp, R. norvegicus
tctccaaaatcaacca

SEQ ID NO: 520098 - DNA, 16 bp, R. norvegicus
tctccaaaattaacca

SEQ ID NO: 520099 - DNA, 16 bp, R. norvegicus
tctccaaagcatctgc

SEQ ID NO: 520100 - DNA, 16 bp, R. norvegicus
tctccaactcagagat

SEQ ID NO: 520101 - DNA, 16 bp, R. norvegicus
tctccaactcctttca

SEQ ID NO: 520102 - DNA, 16 bp, R. norvegicus
tctccaagatccatga

SEQ ID NO: 520103 - DNA, 16 bp, R. norvegicus
tctccaagctctgcct

SEQ ID NO: 520104 - DNA, 16 bp, R. norvegicus
tctccaaggcagcttg

SEQ ID NO: 520105 - DNA, 16 bp, R. norvegicus
tctccaaggtcaattt

SEQ ID NO: 520106 - DNA, 34 bp, R. norvegicus
tctccaagtacataaaagaatacatactggagag

SEQ ID NO: 520107 - DNA, 16 bp, R. norvegicus
tctccaatacttttaa

SEQ ID NO: 520108 - DNA, 16 bp, R. norvegicus
tctccacatccctgcc

SEQ ID NO: 520109 - DNA, 16 bp, R. norvegicus
tctccacatcctcgct

SEQ ID NO: 520110 - DNA, 16 bp, R. norvegicus
tctccacatccttttc

SEQ ID NO: 520111 - DNA, 16 bp, R. norvegicus
tctccacctcccaagt

SEQ ID NO: 520112 - DNA, 16 bp, R. norvegicus
tctccactggaggagt

SEQ ID NO: 520113 - DNA, 16 bp, R. norvegicus
tctccagaaagcagca

SEQ ID NO: 520114 - DNA, 16 bp, R. norvegicus
tctccagaacccatat

SEQ ID NO: 520115 - DNA, 16 bp, R. norvegicus
tctccagaatccatgt

SEQ ID NO: 520116 - DNA, 16 bp, R. norvegicus
tctccagagagaaagc

SEQ ID NO: 520117 - DNA, 16 bp, R. norvegicus
tctccagagagacaca

SEQ ID NO: 520118 - DNA, 16 bp, R. norvegicus
tctccagagagtctca

SEQ ID NO: 520119 - DNA, 16 bp, R. norvegicus
tctccagaggaagagc

SEQ ID NO: 520120 - DNA, 16 bp, R. norvegicus
tctccagagttgtctc

SEQ ID NO: 520121 - DNA, 16 bp, R. norvegicus
tctccagcagaaactc

SEQ ID NO: 520122 - DNA, 16 bp, R. norvegicus
tctccagcatccatgt

SEQ ID NO: 520123 - DNA, 16 bp, R. norvegicus
tctccagcccaagggt

SEQ ID NO: 520124 - DNA, 16 bp, R. norvegicus
tctccagcccacactg

SEQ ID NO: 520125 - DNA, 16 bp, R. norvegicus
tctccagcccacagct

SEQ ID NO: 520126 - DNA, 16 bp, R. norvegicus
tctccagcccagcagc

SEQ ID NO: 520127 - DNA, 16 bp, R. norvegicus
tctccagcccagctct

SEQ ID NO: 520128 - DNA, 16 bp, R. norvegicus
tctccagcccaggagc

SEQ ID NO: 520129 - DNA, 16 bp, R. norvegicus
tctccagcccatcttt

SEQ ID NO: 520130 - DNA, 16 bp, R. norvegicus
tctccagcccatgatg

SEQ ID NO: 520131 - DNA, 16 bp, R. norvegicus
tctccagccccaacct

SEQ ID NO: 520132 - DNA, 16 bp, R. norvegicus
tctccagccccacaaa

SEQ ID NO: 520133 - DNA, 16 bp, R. norvegicus
tctccagccccagcat

SEQ ID NO: 520134 - DNA, 16 bp, R. norvegicus
tctccagccccaggaa

SEQ ID NO: 520135 - DNA, 16 bp, R. norvegicus
tctccagccccaggat

SEQ ID NO: 520136 - DNA, 16 bp, R. norvegicus
tctccagccccaggcc

SEQ ID NO: 520137 - DNA, 16 bp, R. norvegicus
tctccagccccagtga

SEQ ID NO: 520138 - DNA, 16 bp, R. norvegicus
tctccagccccatcct

SEQ ID NO: 520139 - DNA, 16 bp, R. norvegicus
tctccagccccatctc

SEQ ID NO: 520140 - DNA, 16 bp, R. norvegicus
tctccagccccatggc

SEQ ID NO: 520141 - DNA, 16 bp, R. norvegicus
tctccagccccattcc

SEQ ID NO: 520142 - DNA, 16 bp, R. norvegicus
tctccagcccccaagg

SEQ ID NO: 520143 - DNA, 16 bp, R. norvegicus
tctccagcccccacag

SEQ ID NO: 520144 - DNA, 16 bp, R. norvegicus
tctccagcccccactt

SEQ ID NO: 520145 - DNA, 16 bp, R. norvegicus
tctccagcccccattt

SEQ ID NO: 520146 - DNA, 16 bp, R. norvegicus
tctccagccccccaag

SEQ ID NO: 520147 - DNA, 16 bp, R. norvegicus
tctccagcccccgagg

SEQ ID NO: 520148 - DNA, 16 bp, R. norvegicus
tctccagcccccttga

SEQ ID NO: 520149 - DNA, 16 bp, R. norvegicus
tctccagcccctcagg

SEQ ID NO: 520150 - DNA, 16 bp, R. norvegicus
tctccagcccctcatt

SEQ ID NO: 520151 - DNA, 16 bp, R. norvegicus
tctccagcccctccct

SEQ ID NO: 520152 - DNA, 16 bp, R. norvegicus
tctccagcccctcttc

SEQ ID NO: 520153 - DNA, 16 bp, R. norvegicus
tctccagcccctggtc

SEQ ID NO: 520154 - DNA, 16 bp, R. norvegicus
tctccagcccctgtgc

SEQ ID NO: 520155 - DNA, 16 bp, R. norvegicus
tctccagcccctttcc

SEQ ID NO: 520156 - DNA, 16 bp, R. norvegicus
tctccagccctcaaag

SEQ ID NO: 520157 - DNA, 16 bp, R. norvegicus
tctccagccctcagcc

SEQ ID NO: 520158 - DNA, 16 bp, R. norvegicus
tctccagccctccagt

SEQ ID NO: 520159 - DNA, 16 bp, R. norvegicus
tctccagccctctgct

SEQ ID NO: 520160 - DNA, 16 bp, R. norvegicus
tctccagccctcttcc

SEQ ID NO: 520161 - DNA, 16 bp, R. norvegicus
tctccagccctctttt

SEQ ID NO: 520162 - DNA, 16 bp, R. norvegicus
tctccagccctgaaaa

SEQ ID NO: 520163 - DNA, 16 bp, R. norvegicus
tctccagccctgacct

SEQ ID NO: 520164 - DNA, 16 bp, R. norvegicus
tctccagccctgagat

SEQ ID NO: 520165 - DNA, 16 bp, R. norvegicus
tctccagccctgtctt

SEQ ID NO: 520166 - DNA, 16 bp, R. norvegicus
tctccagccctgtgca

SEQ ID NO: 520167 - DNA, 16 bp, R. norvegicus
tctccagccctgtgct

SEQ ID NO: 520168 - DNA, 16 bp, R. norvegicus
tctccagccctttctc

SEQ ID NO: 520169 - DNA, 16 bp, R. norvegicus
tctccagcctcctccc

SEQ ID NO: 520170 - DNA, 16 bp, R. norvegicus
tctccagctccttttc

SEQ ID NO: 520171 - DNA, 16 bp, R. norvegicus
tctccagctctgccct

SEQ ID NO: 520172 - DNA, 16 bp, R. norvegicus
tctccagctcttccct

SEQ ID NO: 520173 - DNA, 16 bp, R. norvegicus
tctccagcttcttcct

SEQ ID NO: 520174 - DNA, 18 bp, R. norvegicus
tctccaggaaatggacaa

SEQ ID NO: 520175 - DNA, 16 bp, R. norvegicus
tctccagggctggaga

SEQ ID NO: 520176 - DNA, 16 bp, R. norvegicus
tctccagttctgcctc

SEQ ID NO: 520177 - DNA, 16 bp, R. norvegicus
tctccagtttctggct

SEQ ID NO: 520178 - DNA, 16 bp, R. norvegicus
tctccagttttcagag

SEQ ID NO: 520179 - DNA, 16 bp, R. norvegicus
tctccatcaaaattct

SEQ ID NO: 520180 - DNA, 16 bp, R. norvegicus
tctccatcatctccat

SEQ ID NO: 520181 - DNA, 16 bp, R. norvegicus
tctccatcctggccta

SEQ ID NO: 520182 - DNA, 16 bp, R. norvegicus
tctccatctagctctg

SEQ ID NO: 520183 - DNA, 16 bp, R. norvegicus
tctccatctctctctg

SEQ ID NO: 520184 - DNA, 16 bp, R. norvegicus
tctccatctctgcctc

SEQ ID NO: 520185 - DNA, 16 bp, R. norvegicus
tctccatcttcctgcc

SEQ ID NO: 520186 - DNA, 16 bp, R. norvegicus
tctccatgcaaatgag

SEQ ID NO: 520187 - DNA, 16 bp, R. norvegicus
tctccatgctaatgag

SEQ ID NO: 520188 - DNA, 16 bp, R. norvegicus
tctccatggcctctgt

SEQ ID NO: 520189 - DNA, 16 bp, R. norvegicus
tctccatggctgcctt

SEQ ID NO: 520190 - DNA, 16 bp, R. norvegicus
tctccatggcttcctc

SEQ ID NO: 520191 - DNA, 16 bp, R. norvegicus
tctccatgtatactct

SEQ ID NO: 520192 - DNA, 16 bp, R. norvegicus
tctccatgtcaagatc

SEQ ID NO: 520193 - DNA, 16 bp, R. norvegicus
tctccatgtcctcacc

SEQ ID NO: 520194 - DNA, 16 bp, R. norvegicus
tctccattgagaagtt

SEQ ID NO: 520195 - DNA, 16 bp, R. norvegicus
tctccattgagtcctg

SEQ ID NO: 520196 - DNA, 16 bp, R. norvegicus
tctccattggagtccc

SEQ ID NO: 520197 - DNA, 16 bp, R. norvegicus
tctccattgttggtgg

SEQ ID NO: 520198 - DNA, 16 bp, R. norvegicus
tctcccaagtactgag

SEQ ID NO: 520199 - DNA, 18 bp, R. norvegicus
tctcccaatatatggctg

SEQ ID NO: 520200 - DNA, 16 bp, R. norvegicus
tctcccaccaaaaaaa

SEQ ID NO: 520201 - DNA, 16 bp, R. norvegicus
tctcccacctgccaca

SEQ ID NO: 520202 - DNA, 16 bp, R. norvegicus
tctcccactgtggcca

SEQ ID NO: 520203 - DNA, 16 bp, R. norvegicus
tctcccagatgtctct

SEQ ID NO: 520204 - DNA, 16 bp, R. norvegicus
tctcccagcaaagcaa

SEQ ID NO: 520205 - DNA, 16 bp, R. norvegicus
tctcccagctccttcc

SEQ ID NO: 520206 - DNA, 16 bp, R. norvegicus
tctcccaggtctctgg

SEQ ID NO: 520207 - DNA, 17 bp, R. norvegicus
tctcccatccaaaaaga

SEQ ID NO: 520208 - DNA, 16 bp, R. norvegicus
tctcccatccagttcc

SEQ ID NO: 520209 - DNA, 16 bp, R. norvegicus
tctccccagaaaaagt

SEQ ID NO: 520210 - DNA, 16 bp, R. norvegicus
tctccccagcccagaa

SEQ ID NO: 520211 - DNA, 16 bp, R. norvegicus
tctccccagcccccag

SEQ ID NO: 520212 - DNA, 16 bp, R. norvegicus
tctccccagccctcca

SEQ ID NO: 520213 - DNA, 16 bp, R. norvegicus
tctcccccagcagcct

SEQ ID NO: 520214 - DNA, 16 bp, R. norvegicus
tctcccccatacctga

SEQ ID NO: 520215 - DNA, 16 bp, R. norvegicus
tctccccctatttatt

SEQ ID NO: 520216 - DNA, 16 bp, R. norvegicus
tctccccttctatgtg

SEQ ID NO: 520217 - DNA, 16 bp, R. norvegicus
tctcccctttattggg

SEQ ID NO: 520218 - DNA, 16 bp, R. norvegicus
tctccctacctcagca

SEQ ID NO: 520219 - DNA, 16 bp, R. norvegicus
tctccctcaatgttaa

SEQ ID NO: 520220 - DNA, 16 bp, R. norvegicus
tctccctccaactggt

SEQ ID NO: 520221 - DNA, 16 bp, R. norvegicus
tctccctcctcctcag

SEQ ID NO: 520222 - DNA, 16 bp, R. norvegicus
tctccctctggaacca

SEQ ID NO: 520223 - DNA, 16 bp, R. norvegicus
tctccctctgtgcttt

SEQ ID NO: 520224 - DNA, 16 bp, R. norvegicus
tctccctctgtgtctc

SEQ ID NO: 520225 - DNA, 16 bp, R. norvegicus
tctccctgctctgggg

SEQ ID NO: 520226 - DNA, 16 bp, R. norvegicus
tctccctgcttcctgc

SEQ ID NO: 520227 - DNA, 16 bp, R. norvegicus
tctccctgcttctctg

SEQ ID NO: 520228 - DNA, 16 bp, R. norvegicus
tctccctggctccctg

SEQ ID NO: 520229 - DNA, 16 bp, R. norvegicus
tctccctgtcccttca

SEQ ID NO: 520230 - DNA, 16 bp, R. norvegicus
tctccctgtctccctg

SEQ ID NO: 520231 - DNA, 16 bp, R. norvegicus
tctccctgtgcctcag

SEQ ID NO: 520232 - DNA, 16 bp, R. norvegicus
tctcccttccaagaag

SEQ ID NO: 520233 - DNA, 16 bp, R. norvegicus
tctcccttctcagagg

SEQ ID NO: 520234 - DNA, 16 bp, R. norvegicus
tctccctttcagcttc

SEQ ID NO: 520235 - DNA, 16 bp, R. norvegicus
tctcccttttctgatt

SEQ ID NO: 520236 - DNA, 16 bp, R. norvegicus
tctccgctgtcctctc

SEQ ID NO: 520237 - DNA, 16 bp, R. norvegicus
tctcctaaatgctggg

SEQ ID NO: 520238 - DNA, 16 bp, R. norvegicus
tctcctagaactagag

SEQ ID NO: 520239 - DNA, 16 bp, R. norvegicus
tctcctagagctggag

SEQ ID NO: 520240 - DNA, 16 bp, R. norvegicus
tctcctcacagcagtg

SEQ ID NO: 520241 - DNA, 16 bp, R. norvegicus
tctcctcacattgatg

SEQ ID NO: 520242 - DNA, 16 bp, R. norvegicus
tctcctcagagaagga

SEQ ID NO: 520243 - DNA, 16 bp, R. norvegicus
tctcctcagcctcctg

SEQ ID NO: 520244 - DNA, 16 bp, R. norvegicus
tctcctcagctcctga

SEQ ID NO: 520245 - DNA, 16 bp, R. norvegicus
tctcctcagctctgca

SEQ ID NO: 520246 - DNA, 16 bp, R. norvegicus
tctcctcaggtgacag

SEQ ID NO: 520247 - DNA, 16 bp, R. norvegicus
tctcctcaggtgatga

SEQ ID NO: 520248 - DNA, 16 bp, R. norvegicus
tctcctccaagtgacc

SEQ ID NO: 520249 - DNA, 16 bp, R. norvegicus
tctcctccaggagacc

SEQ ID NO: 520250 - DNA, 16 bp, R. norvegicus
tctcctcccagtcctg

SEQ ID NO: 520251 - DNA, 16 bp, R. norvegicus
tctcctcccataactg

SEQ ID NO: 520252 - DNA, 16 bp, R. norvegicus
tctcctcctcctgctg

SEQ ID NO: 520253 - DNA, 16 bp, R. norvegicus
tctcctctgaattctc

SEQ ID NO: 520254 - DNA, 16 bp, R. norvegicus
tctcctctggcctcca

SEQ ID NO: 520255 - DNA, 16 bp, R. norvegicus
tctcctctggcctcct

SEQ ID NO: 520256 - DNA, 16 bp, R. norvegicus
tctcctctgtgttctc

SEQ ID NO: 520257 - DNA, 16 bp, R. norvegicus
tctcctcttgctcctg

SEQ ID NO: 520258 - DNA, 16 bp, R. norvegicus
tctcctgaaaggctca

SEQ ID NO: 520259 - DNA, 16 bp, R. norvegicus
tctcctgaattgctct

SEQ ID NO: 520260 - DNA, 16 bp, R. norvegicus
tctcctgacctctgtg

SEQ ID NO: 520261 - DNA, 16 bp, R. norvegicus
tctcctgagagacaaa

SEQ ID NO: 520262 - DNA, 16 bp, R. norvegicus
tctcctgagaggcttc

SEQ ID NO: 520263 - DNA, 16 bp, R. norvegicus
tctcctgccattggtg

SEQ ID NO: 520264 - DNA, 16 bp, R. norvegicus
tctcctgccccagcct

SEQ ID NO: 520265 - DNA, 16 bp, R. norvegicus
tctcctgcctccaccc

SEQ ID NO: 520266 - DNA, 16 bp, R. norvegicus
tctcctgcctctgctt

SEQ ID NO: 520267 - DNA, 16 bp, R. norvegicus
tctcctgctctcagta

SEQ ID NO: 520268 - DNA, 16 bp, R. norvegicus
tctcctgctgctgctg

SEQ ID NO: 520269 - DNA, 16 bp, R. norvegicus
tctcctgcttcagctt

SEQ ID NO: 520270 - DNA, 16 bp, R. norvegicus
tctcctgcttctcagg

SEQ ID NO: 520271 - DNA, 16 bp, R. norvegicus
tctcctggaaaaactg

SEQ ID NO: 520272 - DNA, 16 bp, R. norvegicus
tctcctggaactggag

SEQ ID NO: 520273 - DNA, 16 bp, R. norvegicus
tctcctggacctggag

SEQ ID NO: 520274 - DNA, 16 bp, R. norvegicus
tctcctggagacagaa

SEQ ID NO: 520275 - DNA, 16 bp, R. norvegicus
tctcctggaggagaac

SEQ ID NO: 520276 - DNA, 16 bp, R. norvegicus
tctcctggcagctctc

SEQ ID NO: 520277 - DNA, 16 bp, R. norvegicus
tctcctggcctccatg

SEQ ID NO: 520278 - DNA, 16 bp, R. norvegicus
tctcctggctgtctct

SEQ ID NO: 520279 - DNA, 16 bp, R. norvegicus
tctcctggggttgggg

SEQ ID NO: 520280 - DNA, 16 bp, R. norvegicus
tctcctgtacctgccc

SEQ ID NO: 520281 - DNA, 16 bp, R. norvegicus
tctcctgtagctctta

SEQ ID NO: 520282 - DNA, 16 bp, R. norvegicus
tctcctgtctccaccc

SEQ ID NO: 520283 - DNA, 16 bp, R. norvegicus
tctcctgtctccatct

SEQ ID NO: 520284 - DNA, 16 bp, R. norvegicus
tctcctgtctgcctcc

SEQ ID NO: 520285 - DNA, 16 bp, R. norvegicus
tctcctgtgcccatgt

SEQ ID NO: 520286 - DNA, 16 bp, R. norvegicus
tctccttaactgccaa

SEQ ID NO: 520287 - DNA, 16 bp, R. norvegicus
tctccttcaaaccacc

SEQ ID NO: 520288 - DNA, 16 bp, R. norvegicus
tctccttccactgtgt

SEQ ID NO: 520289 - DNA, 16 bp, R. norvegicus
tctccttcctctctga

SEQ ID NO: 520290 - DNA, 16 bp, R. norvegicus
tctccttctacaatgt

SEQ ID NO: 520291 - DNA, 16 bp, R. norvegicus
tctccttctaccacgt

SEQ ID NO: 520292 - DNA, 16 bp, R. norvegicus
tctccttctactctgt

SEQ ID NO: 520293 - DNA, 16 bp, R. norvegicus
tctccttctatgtggg

SEQ ID NO: 520294 - DNA, 16 bp, R. norvegicus
tctccttctccatgct

SEQ ID NO: 520295 - DNA, 16 bp, R. norvegicus
tctccttctcctctga

SEQ ID NO: 520296 - DNA, 16 bp, R. norvegicus
tctccttctctgagga

SEQ ID NO: 520297 - DNA, 16 bp, R. norvegicus
tctccttctgccatgt

SEQ ID NO: 520298 - DNA, 16 bp, R. norvegicus
tctccttctgccttta

SEQ ID NO: 520299 - DNA, 16 bp, R. norvegicus
tctccttctgctgcct

SEQ ID NO: 520300 - DNA, 16 bp, R. norvegicus
tctccttgagcactgg

SEQ ID NO: 520301 - DNA, 16 bp, R. norvegicus
tctccttgcctcagtc

SEQ ID NO: 520302 - DNA, 16 bp, R. norvegicus
tctccttgcctctgtc

SEQ ID NO: 520303 - DNA, 16 bp, R. norvegicus
tctccttgggcagctg

SEQ ID NO: 520304 - DNA, 16 bp, R. norvegicus
tctcctttctccacat

SEQ ID NO: 520305 - DNA, 16 bp, R. norvegicus
tctcctttgagttctc

SEQ ID NO: 520306 - DNA, 16 bp, R. norvegicus
tctcctttgcttctga

SEQ ID NO: 520307 - DNA, 22 bp, R. norvegicus
tctcctttgttccagaaaacca

SEQ ID NO: 520308 - DNA, 16 bp, R. norvegicus
tctccttttccagttt

SEQ ID NO: 520309 - DNA, 16 bp, R. norvegicus
tctccttttcctctga

SEQ ID NO: 520310 - DNA, 16 bp, R. norvegicus
tctccttttgttggag

SEQ ID NO: 520311 - DNA, 16 bp, R. norvegicus
tctcgaaatcagtctg

SEQ ID NO: 520312 - DNA, 17 bp, R. norvegicus
tctcgtggggtgctgcc

SEQ ID NO: 520313 - DNA, 16 bp, R. norvegicus
tctctaaagtcacaga

SEQ ID NO: 520314 - DNA, 16 bp, R. norvegicus
tctctaaatgagcgct

SEQ ID NO: 520315 - DNA, 16 bp, R. norvegicus
tctctaacaacaaaaa

SEQ ID NO: 520316 - DNA, 16 bp, R. norvegicus
tctctaatttcttcaa

SEQ ID NO: 520317 - DNA, 16 bp, R. norvegicus
tctctaattttgttga

SEQ ID NO: 520318 - DNA, 16 bp, R. norvegicus
tctctacactggggca

SEQ ID NO: 520319 - DNA, 16 bp, R. norvegicus
tctctaccactgagtt

SEQ ID NO: 520320 - DNA, 16 bp, R. norvegicus
tctctagaacaaaaag

SEQ ID NO: 520321 - DNA, 16 bp, R. norvegicus
tctctagaggaacaga

SEQ ID NO: 520322 - DNA, 16 bp, R. norvegicus
tctctaggaagtgcca

SEQ ID NO: 520323 - DNA, 16 bp, R. norvegicus
tctctagtgtttcttt

SEQ ID NO: 520324 - DNA, 16 bp, R. norvegicus
tctctatcttggtaat

SEQ ID NO: 520325 - DNA, 16 bp, R. norvegicus
tctctatgaagaactg

SEQ ID NO: 520326 - DNA, 16 bp, R. norvegicus
tctctatgaagccctg

SEQ ID NO: 520327 - DNA, 16 bp, R. norvegicus
tctctatgaagtcatg

SEQ ID NO: 520328 - DNA, 16 bp, R. norvegicus
tctctatgcagccctg

SEQ ID NO: 520329 - DNA, 16 bp, R. norvegicus
tctctatggagtcatg

SEQ ID NO: 520330 - DNA, 16 bp, R. norvegicus
tctctatgtagtcctg

SEQ ID NO: 520331 - DNA, 16 bp, R. norvegicus
tctctatgtgcttcta

SEQ ID NO: 520332 - DNA, 16 bp, R. norvegicus
tctctattctgggttt

SEQ ID NO: 520333 - DNA, 16 bp, R. norvegicus
tctctcaagaaagaaa

SEQ ID NO: 520334 - DNA, 16 bp, R. norvegicus
tctctcacagaggcca

SEQ ID NO: 520335 - DNA, 16 bp, R. norvegicus
tctctcacatctgcag

SEQ ID NO: 520336 - DNA, 16 bp, R. norvegicus
tctctcaccatcaatg

SEQ ID NO: 520337 - DNA, 16 bp, R. norvegicus
tctctcactcctccat

SEQ ID NO: 520338 - DNA, 16 bp, R. norvegicus
tctctcactgactctg

SEQ ID NO: 520339 - DNA, 16 bp, R. norvegicus
tctctcactgtctctt

SEQ ID NO: 520340 - DNA, 16 bp, R. norvegicus
tctctcactgtctgtc

SEQ ID NO: 520341 - DNA, 16 bp, R. norvegicus
tctctcagacactgag

SEQ ID NO: 520342 - DNA, 16 bp, R. norvegicus
tctctcagagcagaag

SEQ ID NO: 520343 - DNA, 16 bp, R. norvegicus
tctctcagcagtcatt

SEQ ID NO: 520344 - DNA, 16 bp, R. norvegicus
tctctcagggaagtga

SEQ ID NO: 520345 - DNA, 16 bp, R. norvegicus
tctctcagtgcctcca

SEQ ID NO: 520346 - DNA, 16 bp, R. norvegicus
tctctcatgtttcttt

SEQ ID NO: 520347 - DNA, 16 bp, R. norvegicus
tctctcattctctaca

SEQ ID NO: 520348 - DNA, 16 bp, R. norvegicus
tctctcattggcttgg

SEQ ID NO: 520349 - DNA, 16 bp, R. norvegicus
tctctccaacactttt

SEQ ID NO: 520350 - DNA, 16 bp, R. norvegicus
tctctccaacccctgt

SEQ ID NO: 520351 - DNA, 16 bp, R. norvegicus
tctctccagaccccag

SEQ ID NO: 520352 - DNA, 16 bp, R. norvegicus
tctctccagaccccta

SEQ ID NO: 520353 - DNA, 16 bp, R. norvegicus
tctctccagcccagaa

SEQ ID NO: 520354 - DNA, 16 bp, R. norvegicus
tctctccagcccagca

SEQ ID NO: 520355 - DNA, 16 bp, R. norvegicus
tctctccagcccagct

SEQ ID NO: 520356 - DNA, 16 bp, R. norvegicus
tctctccagcccaggt

SEQ ID NO: 520357 - DNA, 16 bp, R. norvegicus
tctctccagcccccag

SEQ ID NO: 520358 - DNA, 16 bp, R. norvegicus
tctctccagcccctgc

SEQ ID NO: 520359 - DNA, 16 bp, R. norvegicus
tctctccagccccttc

SEQ ID NO: 520360 - DNA, 16 bp, R. norvegicus
tctctccagcccggaa

SEQ ID NO: 520361 - DNA, 16 bp, R. norvegicus
tctctccagccctcca

SEQ ID NO: 520362 - DNA, 16 bp, R. norvegicus
tctctccagcccttgg

SEQ ID NO: 520363 - DNA, 16 bp, R. norvegicus
tctctccagccctttc

SEQ ID NO: 520364 - DNA, 16 bp, R. norvegicus
tctctccagcctccac

SEQ ID NO: 520365 - DNA, 16 bp, R. norvegicus
tctctccagcctctag

SEQ ID NO: 520366 - DNA, 16 bp, R. norvegicus
tctctccagcctctgt

SEQ ID NO: 520367 - DNA, 16 bp, R. norvegicus
tctctccagcctgact

SEQ ID NO: 520368 - DNA, 16 bp, R. norvegicus
tctctccagcctgggc

SEQ ID NO: 520369 - DNA, 16 bp, R. norvegicus
tctctccagccttgtt

SEQ ID NO: 520370 - DNA, 16 bp, R. norvegicus
tctctccagctcccca

SEQ ID NO: 520371 - DNA, 16 bp, R. norvegicus
tctctccagctcccta

SEQ ID NO: 520372 - DNA, 16 bp, R. norvegicus
tctctccagctccctc

SEQ ID NO: 520373 - DNA, 16 bp, R. norvegicus
tctctccagcttccaa

SEQ ID NO: 520374 - DNA, 16 bp, R. norvegicus
tctctccaggcccagg

SEQ ID NO: 520375 - DNA, 16 bp, R. norvegicus
tctctccagtcccaca

SEQ ID NO: 520376 - DNA, 16 bp, R. norvegicus
tctctccagtccccta

SEQ ID NO: 520377 - DNA, 16 bp, R. norvegicus
tctctccagtccctgg

SEQ ID NO: 520378 - DNA, 16 bp, R. norvegicus
tctctccagtcccttg

SEQ ID NO: 520379 - DNA, 16 bp, R. norvegicus
tctctccatcccccaa

SEQ ID NO: 520380 - DNA, 16 bp, R. norvegicus
tctctccatctttctg

SEQ ID NO: 520381 - DNA, 16 bp, R. norvegicus
tctctcccaaggtgtt

SEQ ID NO: 520382 - DNA, 16 bp, R. norvegicus
tctctcccagcccctc

SEQ ID NO: 520383 - DNA, 16 bp, R. norvegicus
tctctcccggggcgtt

SEQ ID NO: 520384 - DNA, 16 bp, R. norvegicus
tctctccctttgagtc

SEQ ID NO: 520385 - DNA, 16 bp, R. norvegicus
tctctcctaccacgtg

SEQ ID NO: 520386 - DNA, 16 bp, R. norvegicus
tctctcctccctgcca

SEQ ID NO: 520387 - DNA, 16 bp, R. norvegicus
tctctcctctctgcca

SEQ ID NO: 520388 - DNA, 16 bp, R. norvegicus
tctctcctctgaaaag

SEQ ID NO: 520389 - DNA, 16 bp, R. norvegicus
tctctcctgagaaatg

SEQ ID NO: 520390 - DNA, 16 bp, R. norvegicus
tctctcctgagacatg

SEQ ID NO: 520391 - DNA, 16 bp, R. norvegicus
tctctcctgccatgtg

SEQ ID NO: 520392 - DNA, 16 bp, R. norvegicus
tctctcctgctgctgc

SEQ ID NO: 520393 - DNA, 16 bp, R. norvegicus
tctctcctgtcctgca

SEQ ID NO: 520394 - DNA, 16 bp, R. norvegicus
tctctccttctatcat

SEQ ID NO: 520395 - DNA, 16 bp, R. norvegicus
tctctctacccatcta

SEQ ID NO: 520396 - DNA, 16 bp, R. norvegicus
tctctctagcccctgc

SEQ ID NO: 520397 - DNA, 16 bp, R. norvegicus
tctctctatgtctctc

SEQ ID NO: 520398 - DNA, 16 bp, R. norvegicus
tctctctcacatacac

SEQ ID NO: 520399 - DNA, 16 bp, R. norvegicus
tctctctcagcctctc

SEQ ID NO: 520400 - DNA, 16 bp, R. norvegicus
tctctctccatcctca

SEQ ID NO: 520401 - DNA, 16 bp, R. norvegicus
tctctctcccaccggg

SEQ ID NO: 520402 - DNA, 16 bp, R. norvegicus
tctctctcctgctgct

SEQ ID NO: 520403 - DNA, 16 bp, R. norvegicus
tctctctctacctcac

SEQ ID NO: 520404 - DNA, 16 bp, R. norvegicus
tctctctctcagattt

SEQ ID NO: 520405 - DNA, 16 bp, R. norvegicus
tctctctctccagcct

SEQ ID NO: 520406 - DNA, 16 bp, R. norvegicus
tctctctctccatcca

SEQ ID NO: 520407 - DNA, 16 bp, R. norvegicus
tctctctctccatctg

SEQ ID NO: 520408 - DNA, 16 bp, R. norvegicus
tctctctctccatgcc

SEQ ID NO: 520409 - DNA, 16 bp, R. norvegicus
tctctctctccatgtg

SEQ ID NO: 520410 - DNA, 16 bp, R. norvegicus
tctctctctctcatgc

SEQ ID NO: 520411 - DNA, 16 bp, R. norvegicus
tctctctctcttctga

SEQ ID NO: 520412 - DNA, 16 bp, R. norvegicus
tctctctctgaacctg

SEQ ID NO: 520413 - DNA, 16 bp, R. norvegicus
tctctctctgactgtg

SEQ ID NO: 520414 - DNA, 16 bp, R. norvegicus
tctctctctgagtttg

SEQ ID NO: 520415 - DNA, 16 bp, R. norvegicus
tctctctctgctacct

SEQ ID NO: 520416 - DNA, 16 bp, R. norvegicus
tctctctctgctcctg

SEQ ID NO: 520417 - DNA, 16 bp, R. norvegicus
tctctctctgcttcat

SEQ ID NO: 520418 - DNA, 16 bp, R. norvegicus
tctctctctggcctct

SEQ ID NO: 520419 - DNA, 16 bp, R. norvegicus
tctctctctgtgaatg

SEQ ID NO: 520420 - DNA, 16 bp, R. norvegicus
tctctctctgttcctg

SEQ ID NO: 520421 - DNA, 16 bp, R. norvegicus
tctctctcttttacac

SEQ ID NO: 520422 - DNA, 16 bp, R. norvegicus
tctctctgaggccaga

SEQ ID NO: 520423 - DNA, 16 bp, R. norvegicus
tctctctgatgattct

SEQ ID NO: 520424 - DNA, 16 bp, R. norvegicus
tctctctgcagccctg

SEQ ID NO: 520425 - DNA, 16 bp, R. norvegicus
tctctctgcagcctgt

SEQ ID NO: 520426 - DNA, 16 bp, R. norvegicus
tctctctgcagtgttt

SEQ ID NO: 520427 - DNA, 16 bp, R. norvegicus
tctctctgccccaccc

SEQ ID NO: 520428 - DNA, 16 bp, R. norvegicus
tctctctgcctcatgc

SEQ ID NO: 520429 - DNA, 16 bp, R. norvegicus
tctctctgcctcctgc

SEQ ID NO: 520430 - DNA, 16 bp, R. norvegicus
tctctctgcctttctg

SEQ ID NO: 520431 - DNA, 17 bp, R. norvegicus
tctctctgcgtgtgtgt

SEQ ID NO: 520432 - DNA, 16 bp, R. norvegicus
tctctctgctgcttcc

SEQ ID NO: 520433 - DNA, 16 bp, R. norvegicus
tctctctggaaatcag

SEQ ID NO: 520434 - DNA, 16 bp, R. norvegicus
tctctctggaaccata

SEQ ID NO: 520435 - DNA, 16 bp, R. norvegicus
tctctctggccttctt

SEQ ID NO: 520436 - DNA, 16 bp, R. norvegicus
tctctctgggtgtgtg

SEQ ID NO: 520437 - DNA, 16 bp, R. norvegicus
tctctctgtagtcctg

SEQ ID NO: 520438 - DNA, 16 bp, R. norvegicus
tctctctgtatctgag

SEQ ID NO: 520439 - DNA, 16 bp, R. norvegicus
tctctctgtcacactg

SEQ ID NO: 520440 - DNA, 16 bp, R. norvegicus
tctctctgtgcctctg

SEQ ID NO: 520441 - DNA, 16 bp, R. norvegicus
tctctctgtgtagcac

SEQ ID NO: 520442 - DNA, 16 bp, R. norvegicus
tctctctgtgtctgct

SEQ ID NO: 520443 - DNA, 16 bp, R. norvegicus
tctctctgtgtgtatc

SEQ ID NO: 520444 - DNA, 16 bp, R. norvegicus
tctctcttcatttctg

SEQ ID NO: 520445 - DNA, 16 bp, R. norvegicus
tctctcttccagctct

SEQ ID NO: 520446 - DNA, 16 bp, R. norvegicus
tctctcttccatctat

SEQ ID NO: 520447 - DNA, 16 bp, R. norvegicus
tctctcttcccagatg

SEQ ID NO: 520448 - DNA, 16 bp, R. norvegicus
tctctcttccctgaca

SEQ ID NO: 520449 - DNA, 16 bp, R. norvegicus
tctctcttcctgtgtg

SEQ ID NO: 520450 - DNA, 16 bp, R. norvegicus
tctctcttctatacct

SEQ ID NO: 520451 - DNA, 16 bp, R. norvegicus
tctctcttctgtatct

SEQ ID NO: 520452 - DNA, 16 bp, R. norvegicus
tctctctttacacaca

SEQ ID NO: 520453 - DNA, 16 bp, R. norvegicus
tctctctttctttaga

SEQ ID NO: 520454 - DNA, 16 bp, R. norvegicus
tctctgaaaaacaaaa

SEQ ID NO: 520455 - DNA, 16 bp, R. norvegicus
tctctgaagaaacaaa

SEQ ID NO: 520456 - DNA, 16 bp, R. norvegicus
tctctgaagaaagcaa

SEQ ID NO: 520457 - DNA, 16 bp, R. norvegicus
tctctgaagaaataaa

SEQ ID NO: 520458 - DNA, 16 bp, R. norvegicus
tctctgaagaagaaat

SEQ ID NO: 520459 - DNA, 16 bp, R. norvegicus
tctctgaagatcctcc

SEQ ID NO: 520460 - DNA, 16 bp, R. norvegicus
tctctgaagcagagag

SEQ ID NO: 520461 - DNA, 16 bp, R. norvegicus
tctctgaatctctgtc

SEQ ID NO: 520462 - DNA, 16 bp, R. norvegicus
tctctgacctctacac

SEQ ID NO: 520463 - DNA, 16 bp, R. norvegicus
tctctgacctctgacc

SEQ ID NO: 520464 - DNA, 16 bp, R. norvegicus
tctctgactctgttcc

SEQ ID NO: 520465 - DNA, 16 bp, R. norvegicus
tctctgacttctgtga

SEQ ID NO: 520466 - DNA, 16 bp, R. norvegicus
tctctgagactttcta

SEQ ID NO: 520467 - DNA, 16 bp, R. norvegicus
tctctgagagacccaa

SEQ ID NO: 520468 - DNA, 16 bp, R. norvegicus
tctctgagagcctcaa

SEQ ID NO: 520469 - DNA, 16 bp, R. norvegicus
tctctgagagctgcca

SEQ ID NO: 520470 - DNA, 16 bp, R. norvegicus
tctctgagccctgagg

SEQ ID NO: 520471 - DNA, 16 bp, R. norvegicus
tctctgaggcttgctg

SEQ ID NO: 520472 - DNA, 16 bp, R. norvegicus
tctctgatgaagactg

SEQ ID NO: 520473 - DNA, 16 bp, R. norvegicus
tctctgcaagaacaac

SEQ ID NO: 520474 - DNA, 16 bp, R. norvegicus
tctctgcagcccaggc

SEQ ID NO: 520475 - DNA, 16 bp, R. norvegicus
tctctgcagccctggg

SEQ ID NO: 520476 - DNA, 16 bp, R. norvegicus
tctctgcatcagtttc

SEQ ID NO: 520477 - DNA, 16 bp, R. norvegicus
tctctgcatcctctcc

SEQ ID NO: 520478 - DNA, 16 bp, R. norvegicus
tctctgcatcctgagt

SEQ ID NO: 520479 - DNA, 16 bp, R. norvegicus
tctctgcatctgcttt

SEQ ID NO: 520480 - DNA, 16 bp, R. norvegicus
tctctgcccaagccag

SEQ ID NO: 520481 - DNA, 16 bp, R. norvegicus
tctctgcctccaaagt

SEQ ID NO: 520482 - DNA, 16 bp, R. norvegicus
tctctgcctctcaagt

SEQ ID NO: 520483 - DNA, 16 bp, R. norvegicus
tctctgcctctctggt

SEQ ID NO: 520484 - DNA, 16 bp, R. norvegicus
tctctgcctctgttcc

SEQ ID NO: 520485 - DNA, 16 bp, R. norvegicus
tctctgcctctgtttc

SEQ ID NO: 520486 - DNA, 16 bp, R. norvegicus
tctctgcctgcagatc

SEQ ID NO: 520487 - DNA, 16 bp, R. norvegicus
tctctgcctgcttcct

SEQ ID NO: 520488 - DNA, 16 bp, R. norvegicus
tctctgcctggtggca

SEQ ID NO: 520489 - DNA, 16 bp, R. norvegicus
tctctgccttctgcct

SEQ ID NO: 520490 - DNA, 16 bp, R. norvegicus
tctctgctcacctcca

SEQ ID NO: 520491 - DNA, 16 bp, R. norvegicus
tctctgctccagactt

SEQ ID NO: 520492 - DNA, 16 bp, R. norvegicus
tctctgctccaggtgt

SEQ ID NO: 520493 - DNA, 16 bp, R. norvegicus
tctctgctccatctcc

SEQ ID NO: 520494 - DNA, 16 bp, R. norvegicus
tctctgctccatcttc

SEQ ID NO: 520495 - DNA, 16 bp, R. norvegicus
tctctgctccatgctt

SEQ ID NO: 520496 - DNA, 17 bp, R. norvegicus
tctctgctcccaaaccc

SEQ ID NO: 520497 - DNA, 16 bp, R. norvegicus
tctctgctccctgcca

SEQ ID NO: 520498 - DNA, 16 bp, R. norvegicus
tctctgctcctcatgg

SEQ ID NO: 520499 - DNA, 16 bp, R. norvegicus
tctctgctcctgcacc

SEQ ID NO: 520500 - DNA, 16 bp, R. norvegicus
tctctgctctctgtct

SEQ ID NO: 520501 - DNA, 16 bp, R. norvegicus
tctctgctctgctctc

SEQ ID NO: 520502 - DNA, 16 bp, R. norvegicus
tctctgctcttctgca

SEQ ID NO: 520503 - DNA, 16 bp, R. norvegicus
tctctgctgagaagtc

SEQ ID NO: 520504 - DNA, 16 bp, R. norvegicus
tctctgctgtgcttct

SEQ ID NO: 520505 - DNA, 16 bp, R. norvegicus
tctctgctgtgtatgt

SEQ ID NO: 520506 - DNA, 16 bp, R. norvegicus
tctctgcttccccaga

SEQ ID NO: 520507 - DNA, 16 bp, R. norvegicus
tctctgcttcctccca

SEQ ID NO: 520508 - DNA, 16 bp, R. norvegicus
tctctgcttcctgact

SEQ ID NO: 520509 - DNA, 16 bp, R. norvegicus
tctctgcttcctgagt

SEQ ID NO: 520510 - DNA, 16 bp, R. norvegicus
tctctgcttctcatcc

SEQ ID NO: 520511 - DNA, 16 bp, R. norvegicus
tctctggaagaacaga

SEQ ID NO: 520512 - DNA, 16 bp, R. norvegicus
tctctggaatctacct

SEQ ID NO: 520513 - DNA, 16 bp, R. norvegicus
tctctggaggaacaga

SEQ ID NO: 520514 - DNA, 16 bp, R. norvegicus
tctctggaggaatttt

SEQ ID NO: 520515 - DNA, 16 bp, R. norvegicus
tctctggaggtgagca

SEQ ID NO: 520516 - DNA, 16 bp, R. norvegicus
tctctggatgactttt

SEQ ID NO: 520517 - DNA, 16 bp, R. norvegicus
tctctggatgcccttt

SEQ ID NO: 520518 - DNA, 16 bp, R. norvegicus
tctctggcagagcctc

SEQ ID NO: 520519 - DNA, 16 bp, R. norvegicus
tctctggcctctgtga

SEQ ID NO: 520520 - DNA, 16 bp, R. norvegicus
tctctggctcattctg

SEQ ID NO: 520521 - DNA, 16 bp, R. norvegicus
tctctggctccttctg

SEQ ID NO: 520522 - DNA, 16 bp, R. norvegicus
tctctggctggagaga

SEQ ID NO: 520523 - DNA, 16 bp, R. norvegicus
tctctggctgtcttgg

SEQ ID NO: 520524 - DNA, 16 bp, R. norvegicus
tctctggcttccacat

SEQ ID NO: 520525 - DNA, 16 bp, R. norvegicus
tctctgggaactctgc

SEQ ID NO: 520526 - DNA, 16 bp, R. norvegicus
tctctgggaagaggaa

SEQ ID NO: 520527 - DNA, 26 bp, R. norvegicus
tctctgggaatctcacggtggacagc

SEQ ID NO: 520528 - DNA, 16 bp, R. norvegicus
tctctgggagttctga

SEQ ID NO: 520529 - DNA, 16 bp, R. norvegicus
tctctgggcatgcctg

SEQ ID NO: 520530 - DNA, 16 bp, R. norvegicus
tctctgggctggtggt

SEQ ID NO: 520531 - DNA, 16 bp, R. norvegicus
tctctggggtccctgt

SEQ ID NO: 520532 - DNA, 16 bp, R. norvegicus
tctctgggtcagggaa

SEQ ID NO: 520533 - DNA, 16 bp, R. norvegicus
tctctgggtggccttt

SEQ ID NO: 520534 - DNA, 16 bp, R. norvegicus
tctctggtagaaattt

SEQ ID NO: 520535 - DNA, 16 bp, R. norvegicus
tctctggtccatcttt

SEQ ID NO: 520536 - DNA, 16 bp, R. norvegicus
tctctggtgttggctg

SEQ ID NO: 520537 - DNA, 16 bp, R. norvegicus
tctctgtaagttccag

SEQ ID NO: 520538 - DNA, 16 bp, R. norvegicus
tctctgtacaaagatc

SEQ ID NO: 520539 - DNA, 16 bp, R. norvegicus
tctctgtacagccctg

SEQ ID NO: 520540 - DNA, 21 bp, R. norvegicus
tctctgtacatacatctcgga

SEQ ID NO: 520541 - DNA, 28 bp, R. norvegicus
tctctgtagaatgaggtttgttcagagg

SEQ ID NO: 520542 - DNA, 16 bp, R. norvegicus
tctctgtatgtgtgtc

SEQ ID NO: 520543 - DNA, 16 bp, R. norvegicus
tctctgtccacacatc

SEQ ID NO: 520544 - DNA, 16 bp, R. norvegicus
tctctgtcctgtctcc

SEQ ID NO: 520545 - DNA, 16 bp, R. norvegicus
tctctgtctatccatc

SEQ ID NO: 520546 - DNA, 16 bp, R. norvegicus
tctctgtctccatccc

SEQ ID NO: 520547 - DNA, 16 bp, R. norvegicus
tctctgtctccatctc

SEQ ID NO: 520548 - DNA, 16 bp, R. norvegicus
tctctgtctccccagc

SEQ ID NO: 520549 - DNA, 16 bp, R. norvegicus
tctctgtctctcactt

SEQ ID NO: 520550 - DNA, 16 bp, R. norvegicus
tctctgtctctctatc

SEQ ID NO: 520551 - DNA, 16 bp, R. norvegicus
tctctgtctctctgtc

SEQ ID NO: 520552 - DNA, 16 bp, R. norvegicus
tctctgtctctgagtg

SEQ ID NO: 520553 - DNA, 17 bp, R. norvegicus
tctctgtctctgtctct

SEQ ID NO: 520554 - DNA, 16 bp, R. norvegicus
tctctgtgagtctgtg

SEQ ID NO: 520555 - DNA, 16 bp, R. norvegicus
tctctgtgcatttgag

SEQ ID NO: 520556 - DNA, 16 bp, R. norvegicus
tctctgtgcctctgtg

SEQ ID NO: 520557 - DNA, 16 bp, R. norvegicus
tctctgtgctaactcc

SEQ ID NO: 520558 - DNA, 17 bp, R. norvegicus
tctctgtggcggcagca

SEQ ID NO: 520559 - DNA, 28 bp, R. norvegicus
tctctgtggctcgggacagacaggcctc

SEQ ID NO: 520560 - DNA, 16 bp, R. norvegicus
tctctgtgggcaggtt

SEQ ID NO: 520561 - DNA, 16 bp, R. norvegicus
tctctgtgtagtttct

SEQ ID NO: 520562 - DNA, 16 bp, R. norvegicus
tctctgtgtggccctg

SEQ ID NO: 520563 - DNA, 16 bp, R. norvegicus
tctctgtgtgtacatg

SEQ ID NO: 520564 - DNA, 16 bp, R. norvegicus
tctctgtgtgtatatg

SEQ ID NO: 520565 - DNA, 16 bp, R. norvegicus
tctctgtgtgtgtcct

SEQ ID NO: 520566 - DNA, 16 bp, R. norvegicus
tctctgtgtgtgtctg

SEQ ID NO: 520567 - DNA, 16 bp, R. norvegicus
tctctgtgttggatgt

SEQ ID NO: 520568 - DNA, 16 bp, R. norvegicus
tctctgtgtttctctg

SEQ ID NO: 520569 - DNA, 16 bp, R. norvegicus
tctctgtgttttccaa

SEQ ID NO: 520570 - DNA, 16 bp, R. norvegicus
tctctgttgtgaattc

SEQ ID NO: 520571 - DNA, 16 bp, R. norvegicus
tctctgtttcttgtgc

SEQ ID NO: 520572 - DNA, 16 bp, R. norvegicus
tctctgttttatgaaa

SEQ ID NO: 520573 - DNA, 16 bp, R. norvegicus
tctctgttttcatttc

SEQ ID NO: 520574 - DNA, 16 bp, R. norvegicus
tctcttactgctttta

SEQ ID NO: 520575 - DNA, 16 bp, R. norvegicus
tctcttactggcctgg

SEQ ID NO: 520576 - DNA, 16 bp, R. norvegicus
tctcttaggagagatc

SEQ ID NO: 520577 - DNA, 16 bp, R. norvegicus
tctcttatgttggggt

SEQ ID NO: 520578 - DNA, 16 bp, R. norvegicus
tctcttcagagcaatg

SEQ ID NO: 520579 - DNA, 16 bp, R. norvegicus
tctcttcatacccctg

SEQ ID NO: 520580 - DNA, 16 bp, R. norvegicus
tctcttcatagcagtg

SEQ ID NO: 520581 - DNA, 16 bp, R. norvegicus
tctcttccaagaggaa

SEQ ID NO: 520582 - DNA, 16 bp, R. norvegicus
tctcttccatctctag

SEQ ID NO: 520583 - DNA, 16 bp, R. norvegicus
tctcttcccactgatg

SEQ ID NO: 520584 - DNA, 16 bp, R. norvegicus
tctcttcctggcttcc

SEQ ID NO: 520585 - DNA, 16 bp, R. norvegicus
tctcttctagctcttg

SEQ ID NO: 520586 - DNA, 16 bp, R. norvegicus
tctcttctatctctgt

SEQ ID NO: 520587 - DNA, 16 bp, R. norvegicus
tctcttctccagctct

SEQ ID NO: 520588 - DNA, 16 bp, R. norvegicus
tctcttctgaagggaa

SEQ ID NO: 520589 - DNA, 16 bp, R. norvegicus
tctcttctgctcagct

SEQ ID NO: 520590 - DNA, 16 bp, R. norvegicus
tctcttctggtgtgtc

SEQ ID NO: 520591 - DNA, 24 bp, R. norvegicus
tctcttctggtttcccaggcttgt

SEQ ID NO: 520592 - DNA, 16 bp, R. norvegicus
tctcttctgtacctat

SEQ ID NO: 520593 - DNA, 16 bp, R. norvegicus
tctcttcttcccaagt

SEQ ID NO: 520594 - DNA, 22 bp, R. norvegicus
tctcttgaataccatcaataaa

SEQ ID NO: 520595 - DNA, 16 bp, R. norvegicus
tctcttgagaagtctg

SEQ ID NO: 520596 - DNA, 16 bp, R. norvegicus
tctcttgagttcaagg

SEQ ID NO: 520597 - DNA, 16 bp, R. norvegicus
tctcttgcctcagcct

SEQ ID NO: 520598 - DNA, 16 bp, R. norvegicus
tctcttgctgaacctg

SEQ ID NO: 520599 - DNA, 16 bp, R. norvegicus
tctcttgggaccctgt

SEQ ID NO: 520600 - DNA, 16 bp, R. norvegicus
tctctttaagattcaa

SEQ ID NO: 520601 - DNA, 16 bp, R. norvegicus
tctctttagaaagcaa

SEQ ID NO: 520602 - DNA, 16 bp, R. norvegicus
tctctttctaccatgt

SEQ ID NO: 520603 - DNA, 16 bp, R. norvegicus
tctctttgtagaccag

SEQ ID NO: 520604 - DNA, 16 bp, R. norvegicus
tctctttgtcctcagc

SEQ ID NO: 520605 - DNA, 16 bp, R. norvegicus
tctctttgttccaagc

SEQ ID NO: 520606 - DNA, 16 bp, R. norvegicus
tctcttttatgaatgt

SEQ ID NO: 520607 - DNA, 16 bp, R. norvegicus
tctctttttaaaaata

SEQ ID NO: 520608 - DNA, 16 bp, R. norvegicus
tctgaaaaacaaaaac

SEQ ID NO: 520609 - DNA, 16 bp, R. norvegicus
tctgaaaaattggaag

SEQ ID NO: 520610 - DNA, 16 bp, R. norvegicus
tctgaaaacagctaca

SEQ ID NO: 520611 - DNA, 16 bp, R. norvegicus
tctgaaaacagtgaca

SEQ ID NO: 520612 - DNA, 16 bp, R. norvegicus
tctgaaaacatctaca

SEQ ID NO: 520613 - DNA, 16 bp, R. norvegicus
tctgaaaactatccaa

SEQ ID NO: 520614 - DNA, 16 bp, R. norvegicus
tctgaaaagaaactgg

SEQ ID NO: 520615 - DNA, 16 bp, R. norvegicus
tctgaaaccacaagcc

SEQ ID NO: 520616 - DNA, 16 bp, R. norvegicus
tctgaaactgtgagcc

SEQ ID NO: 520617 - DNA, 16 bp, R. norvegicus
tctgaaagaaaaataa

SEQ ID NO: 520618 - DNA, 16 bp, R. norvegicus
tctgaaagaaaagaaa

SEQ ID NO: 520619 - DNA, 16 bp, R. norvegicus
tctgaaagaaaagcag

SEQ ID NO: 520620 - DNA, 16 bp, R. norvegicus
tctgaaagagagagag

SEQ ID NO: 520621 - DNA, 16 bp, R. norvegicus
tctgaaagagcagtta

SEQ ID NO: 520622 - DNA, 16 bp, R. norvegicus
tctgaaagctctaaaa

SEQ ID NO: 520623 - DNA, 16 bp, R. norvegicus
tctgaaatatattttt

SEQ ID NO: 520624 - DNA, 16 bp, R. norvegicus
tctgaaattcttttct

SEQ ID NO: 520625 - DNA, 16 bp, R. norvegicus
tctgaacagaatacca

SEQ ID NO: 520626 - DNA, 16 bp, R. norvegicus
tctgaaccccatgttt

SEQ ID NO: 520627 - DNA, 16 bp, R. norvegicus
tctgaactaaaaccat

SEQ ID NO: 520628 - DNA, 16 bp, R. norvegicus
tctgaactcagtcaga

SEQ ID NO: 520629 - DNA, 16 bp, R. norvegicus
tctgaactcctgatcc

SEQ ID NO: 520630 - DNA, 16 bp, R. norvegicus
tctgaactctggccct

SEQ ID NO: 520631 - DNA, 16 bp, R. norvegicus
tctgaactcttgctgg

SEQ ID NO: 520632 - DNA, 16 bp, R. norvegicus
tctgaacttctttgct

SEQ ID NO: 520633 - DNA, 16 bp, R. norvegicus
tctgaagaaaagaatt

SEQ ID NO: 520634 - DNA, 18 bp, R. norvegicus
tctgaagaaagaaattga

SEQ ID NO: 520635 - DNA, 16 bp, R. norvegicus
tctgaagaaagaagct

SEQ ID NO: 520636 - DNA, 16 bp, R. norvegicus
tctgaagaaagaattt

SEQ ID NO: 520637 - DNA, 16 bp, R. norvegicus
tctgaagaaattcaaa

SEQ ID NO: 520638 - DNA, 16 bp, R. norvegicus
tctgaagaaccaccag

SEQ ID NO: 520639 - DNA, 16 bp, R. norvegicus
tctgaagaagaaattg

SEQ ID NO: 520640 - DNA, 16 bp, R. norvegicus
tctgaagaagaagaag

SEQ ID NO: 520641 - DNA, 16 bp, R. norvegicus
tctgaagacagaggca

SEQ ID NO: 520642 - DNA, 16 bp, R. norvegicus
tctgaagacagcaaca

SEQ ID NO: 520643 - DNA, 19 bp, R. norvegicus
tctgaagacagctacagta

SEQ ID NO: 520644 - DNA, 20 bp, R. norvegicus
tctgaagacagctacagtgt

SEQ ID NO: 520645 - DNA, 16 bp, R. norvegicus
tctgaagacagctata

SEQ ID NO: 520646 - DNA, 16 bp, R. norvegicus
tctgaagacagtgaca

SEQ ID NO: 520647 - DNA, 16 bp, R. norvegicus
tctgaagacagtggca

SEQ ID NO: 520648 - DNA, 16 bp, R. norvegicus
tctgaagactgctttg

SEQ ID NO: 520649 - DNA, 16 bp, R. norvegicus
tctgaagagaaagaga

SEQ ID NO: 520650 - DNA, 16 bp, R. norvegicus
tctgaagagagcaata

SEQ ID NO: 520651 - DNA, 16 bp, R. norvegicus
tctgaagagagcgaca

SEQ ID NO: 520652 - DNA, 16 bp, R. norvegicus
tctgaagagagttaca

SEQ ID NO: 520653 - DNA, 16 bp, R. norvegicus
tctgaagagcagccag

SEQ ID NO: 520654 - DNA, 16 bp, R. norvegicus
tctgaagaggaaacag

SEQ ID NO: 520655 - DNA, 19 bp, R. norvegicus
tctgaagatagcgacagtg

SEQ ID NO: 520656 - DNA, 16 bp, R. norvegicus
tctgaagccagagcca

SEQ ID NO: 520657 - DNA, 16 bp, R. norvegicus
tctgaaggaagaggag

SEQ ID NO: 520658 - DNA, 16 bp, R. norvegicus
tctgaaggagctgaag

SEQ ID NO: 520659 - DNA, 16 bp, R. norvegicus
tctgaaggcactcagc

SEQ ID NO: 520660 - DNA, 16 bp, R. norvegicus
tctgaaggcagccaga

SEQ ID NO: 520661 - DNA, 16 bp, R. norvegicus
tctgaaggcagtgaca

SEQ ID NO: 520662 - DNA, 16 bp, R. norvegicus
tctgaaggccttccag

SEQ ID NO: 520663 - DNA, 16 bp, R. norvegicus
tctgaaggctgctggc

SEQ ID NO: 520664 - DNA, 16 bp, R. norvegicus
tctgaagtccaccctt

SEQ ID NO: 520665 - DNA, 16 bp, R. norvegicus
tctgaagttctcttct

SEQ ID NO: 520666 - DNA, 16 bp, R. norvegicus
tctgaagttggaccag

SEQ ID NO: 520667 - DNA, 16 bp, R. norvegicus
tctgaatacacacaca

SEQ ID NO: 520668 - DNA, 16 bp, R. norvegicus
tctgaatacagctaca

SEQ ID NO: 520669 - DNA, 17 bp, R. norvegicus
tctgaatgtgtctctca

SEQ ID NO: 520670 - DNA, 16 bp, R. norvegicus
tctgaatttctctttg

SEQ ID NO: 520671 - DNA, 16 bp, R. norvegicus
tctgaattttaaaaat

SEQ ID NO: 520672 - DNA, 16 bp, R. norvegicus
tctgacaagattgaga

SEQ ID NO: 520673 - DNA, 16 bp, R. norvegicus
tctgacactctctctc

SEQ ID NO: 520674 - DNA, 16 bp, R. norvegicus
tctgacatgcaggtgt

SEQ ID NO: 520675 - DNA, 16 bp, R. norvegicus
tctgaccacatttctg

SEQ ID NO: 520676 - DNA, 16 bp, R. norvegicus
tctgacccctcttcct

SEQ ID NO: 520677 - DNA, 16 bp, R. norvegicus
tctgaccctgggctcc

SEQ ID NO: 520678 - DNA, 16 bp, R. norvegicus
tctgacctctgtaggc

SEQ ID NO: 520679 - DNA, 16 bp, R. norvegicus
tctgactcagactctg

SEQ ID NO: 520680 - DNA, 16 bp, R. norvegicus
tctgactcaggaagac

SEQ ID NO: 520681 - DNA, 16 bp, R. norvegicus
tctgactcagttgcct

SEQ ID NO: 520682 - DNA, 17 bp, R. norvegicus
tctgactccagaggaaa

SEQ ID NO: 520683 - DNA, 16 bp, R. norvegicus
tctgactctgactctg

SEQ ID NO: 520684 - DNA, 16 bp, R. norvegicus
tctgactctgcctctg

SEQ ID NO: 520685 - DNA, 16 bp, R. norvegicus
tctgactgaattgctt

SEQ ID NO: 520686 - DNA, 17 bp, R. norvegicus
tctgactgtgtctctca

SEQ ID NO: 520687 - DNA, 16 bp, R. norvegicus
tctgacttccacaagc

SEQ ID NO: 520688 - DNA, 16 bp, R. norvegicus
tctgagaaaaataaaa

SEQ ID NO: 520689 - DNA, 16 bp, R. norvegicus
tctgagaaaataaaag

SEQ ID NO: 520690 - DNA, 16 bp, R. norvegicus
tctgagaaacatccag

SEQ ID NO: 520691 - DNA, 16 bp, R. norvegicus
tctgagaaaccaccag

SEQ ID NO: 520692 - DNA, 16 bp, R. norvegicus
tctgagaaaggactga

SEQ ID NO: 520693 - DNA, 16 bp, R. norvegicus
tctgagacagacagac

SEQ ID NO: 520694 - DNA, 16 bp, R. norvegicus
tctgagacctcaaagc

SEQ ID NO: 520695 - DNA, 16 bp, R. norvegicus
tctgagagctcccaga

SEQ ID NO: 520696 - DNA, 16 bp, R. norvegicus
tctgagaggaaggaac

SEQ ID NO: 520697 - DNA, 16 bp, R. norvegicus
tctgagaggctctgtc

SEQ ID NO: 520698 - DNA, 16 bp, R. norvegicus
tctgagatcttcatca

SEQ ID NO: 520699 - DNA, 16 bp, R. norvegicus
tctgagccactgagcc

SEQ ID NO: 520700 - DNA, 17 bp, R. norvegicus
tctgagccagagcactg

SEQ ID NO: 520701 - DNA, 16 bp, R. norvegicus
tctgagccatctctct

SEQ ID NO: 520702 - DNA, 16 bp, R. norvegicus
tctgagcccagagctg

SEQ ID NO: 520703 - DNA, 16 bp, R. norvegicus
tctgagcccagcaaca

SEQ ID NO: 520704 - DNA, 16 bp, R. norvegicus
tctgagccctgagggg

SEQ ID NO: 520705 - DNA, 20 bp, R. norvegicus
tctgagcttcctttcatatt

SEQ ID NO: 520706 - DNA, 16 bp, R. norvegicus
tctgaggaaccaccat

SEQ ID NO: 520707 - DNA, 16 bp, R. norvegicus
tctgaggaacctccaa

SEQ ID NO: 520708 - DNA, 16 bp, R. norvegicus
tctgaggaagctccag

SEQ ID NO: 520709 - DNA, 16 bp, R. norvegicus
tctgaggaccagcaga

SEQ ID NO: 520710 - DNA, 16 bp, R. norvegicus
tctgaggaccctgcta

SEQ ID NO: 520711 - DNA, 16 bp, R. norvegicus
tctgaggactcagcta

SEQ ID NO: 520712 - DNA, 16 bp, R. norvegicus
tctgaggagaaatgga

SEQ ID NO: 520713 - DNA, 16 bp, R. norvegicus
tctgaggagaaggaaa

SEQ ID NO: 520714 - DNA, 16 bp, R. norvegicus
tctgaggatgaacagt

SEQ ID NO: 520715 - DNA, 16 bp, R. norvegicus
tctgaggatgaccttg

SEQ ID NO: 520716 - DNA, 16 bp, R. norvegicus
tctgagggcccactaa

SEQ ID NO: 520717 - DNA, 16 bp, R. norvegicus
tctgaggggcagaaga

SEQ ID NO: 520718 - DNA, 16 bp, R. norvegicus
tctgagggggaaaaaa

SEQ ID NO: 520719 - DNA, 16 bp, R. norvegicus
tctgaggtcagcctga

SEQ ID NO: 520720 - DNA, 16 bp, R. norvegicus
tctgaggtcagcctgg

SEQ ID NO: 520721 - DNA, 16 bp, R. norvegicus
tctgaggtctttgatt

SEQ ID NO: 520722 - DNA, 16 bp, R. norvegicus
tctgaggtttcagaag

SEQ ID NO: 520723 - DNA, 17 bp, R. norvegicus
tctgagtacctgcagaa

SEQ ID NO: 520724 - DNA, 16 bp, R. norvegicus
tctgagtccaaggcca

SEQ ID NO: 520725 - DNA, 16 bp, R. norvegicus
tctgagtccaccaggc

SEQ ID NO: 520726 - DNA, 16 bp, R. norvegicus
tctgagtccctccaaa

SEQ ID NO: 520727 - DNA, 16 bp, R. norvegicus
tctgagtctgaggtca

SEQ ID NO: 520728 - DNA, 16 bp, R. norvegicus
tctgagtctgtctgtc

SEQ ID NO: 520729 - DNA, 16 bp, R. norvegicus
tctgagtctgtttcct

SEQ ID NO: 520730 - DNA, 16 bp, R. norvegicus
tctgagtgtgtgtttg

SEQ ID NO: 520731 - DNA, 16 bp, R. norvegicus
tctgagttcagggcca

SEQ ID NO: 520732 - DNA, 16 bp, R. norvegicus
tctgagttccaagaca

SEQ ID NO: 520733 - DNA, 16 bp, R. norvegicus
tctgagttccaggcta

SEQ ID NO: 520734 - DNA, 16 bp, R. norvegicus
tctgagttcttctttg

SEQ ID NO: 520735 - DNA, 16 bp, R. norvegicus
tctgagttggaggcta

SEQ ID NO: 520736 - DNA, 16 bp, R. norvegicus
tctgagtttgaggcca

SEQ ID NO: 520737 - DNA, 16 bp, R. norvegicus
tctgagtttgagtcca

SEQ ID NO: 520738 - DNA, 16 bp, R. norvegicus
tctgagtttgtctttg

SEQ ID NO: 520739 - DNA, 16 bp, R. norvegicus
tctgataaaccagcag

SEQ ID NO: 520740 - DNA, 16 bp, R. norvegicus
tctgatcatgatttaa

SEQ ID NO: 520741 - DNA, 16 bp, R. norvegicus
tctgatccctggaacc

SEQ ID NO: 520742 - DNA, 16 bp, R. norvegicus
tctgatcctgatataa

SEQ ID NO: 520743 - DNA, 16 bp, R. norvegicus
tctgatgaatttttta

SEQ ID NO: 520744 - DNA, 16 bp, R. norvegicus
tctgatgacttcttct

SEQ ID NO: 520745 - DNA, 16 bp, R. norvegicus
tctgatgatgttttta

SEQ ID NO: 520746 - DNA, 16 bp, R. norvegicus
tctgatgattccatgt

SEQ ID NO: 520747 - DNA, 16 bp, R. norvegicus
tctgatgccctcctct

SEQ ID NO: 520748 - DNA, 16 bp, R. norvegicus
tctgatgccctcttcc

SEQ ID NO: 520749 - DNA, 16 bp, R. norvegicus
tctgatgctcctgcct

SEQ ID NO: 520750 - DNA, 16 bp, R. norvegicus
tctgatggctctggct

SEQ ID NO: 520751 - DNA, 16 bp, R. norvegicus
tctgatgttctctttc

SEQ ID NO: 520752 - DNA, 16 bp, R. norvegicus
tctgattattctggct

SEQ ID NO: 520753 - DNA, 16 bp, R. norvegicus
tctgattctgattctg

SEQ ID NO: 520754 - DNA, 16 bp, R. norvegicus
tctgattcttctgcct

SEQ ID NO: 520755 - DNA, 16 bp, R. norvegicus
tctgattggtgtaaga

SEQ ID NO: 520756 - DNA, 16 bp, R. norvegicus
tctgatttttttcaat

SEQ ID NO: 520757 - DNA, 16 bp, R. norvegicus
tctgcaacagctcctg

SEQ ID NO: 520758 - DNA, 16 bp, R. norvegicus
tctgcaagaacagaaa

SEQ ID NO: 520759 - DNA, 16 bp, R. norvegicus
tctgcaagagcaacca

SEQ ID NO: 520760 - DNA, 16 bp, R. norvegicus
tctgcaagagcaccaa

SEQ ID NO: 520761 - DNA, 16 bp, R. norvegicus
tctgcaagggcaacaa

SEQ ID NO: 520762 - DNA, 16 bp, R. norvegicus
tctgcacaagatcaag

SEQ ID NO: 520763 - DNA, 16 bp, R. norvegicus
tctgcaccaatatcat

SEQ ID NO: 520764 - DNA, 16 bp, R. norvegicus
tctgcacccactccca

SEQ ID NO: 520765 - DNA, 16 bp, R. norvegicus
tctgcaccctggagct

SEQ ID NO: 520766 - DNA, 16 bp, R. norvegicus
tctgcacctctcctgt

SEQ ID NO: 520767 - DNA, 16 bp, R. norvegicus
tctgcacctgtgcccc

SEQ ID NO: 520768 - DNA, 16 bp, R. norvegicus
tctgcaccttgaccag

SEQ ID NO: 520769 - DNA, 16 bp, R. norvegicus
tctgcacttgcaagtg

SEQ ID NO: 520770 - DNA, 16 bp, R. norvegicus
tctgcagaacatttca

SEQ ID NO: 520771 - DNA, 16 bp, R. norvegicus
tctgcagaaccagggc

SEQ ID NO: 520772 - DNA, 16 bp, R. norvegicus
tctgcagaagccagaa

SEQ ID NO: 520773 - DNA, 16 bp, R. norvegicus
tctgcagacagcaaac

SEQ ID NO: 520774 - DNA, 16 bp, R. norvegicus
tctgcagacagctaca

SEQ ID NO: 520775 - DNA, 16 bp, R. norvegicus
tctgcagagaccagaa

SEQ ID NO: 520776 - DNA, 16 bp, R. norvegicus
tctgcagagagcccct

SEQ ID NO: 520777 - DNA, 16 bp, R. norvegicus
tctgcagcagcagcaa

SEQ ID NO: 520778 - DNA, 16 bp, R. norvegicus
tctgcagcctctggag

SEQ ID NO: 520779 - DNA, 16 bp, R. norvegicus
tctgcagctctgaaac

SEQ ID NO: 520780 - DNA, 16 bp, R. norvegicus
tctgcagctgacaaaa

SEQ ID NO: 520781 - DNA, 16 bp, R. norvegicus
tctgcaggaaatgtac

SEQ ID NO: 520782 - DNA, 16 bp, R. norvegicus
tctgcaggagcagcca

SEQ ID NO: 520783 - DNA, 19 bp, R. norvegicus
tctgcaggcacacagcgct

SEQ ID NO: 520784 - DNA, 16 bp, R. norvegicus
tctgcaggcactcaga

SEQ ID NO: 520785 - DNA, 16 bp, R. norvegicus
tctgcaggcagcagga

SEQ ID NO: 520786 - DNA, 16 bp, R. norvegicus
tctgcaggcagctagg

SEQ ID NO: 520787 - DNA, 16 bp, R. norvegicus
tctgcagggctcacct

SEQ ID NO: 520788 - DNA, 16 bp, R. norvegicus
tctgcaggggcagcaa

SEQ ID NO: 520789 - DNA, 16 bp, R. norvegicus
tctgcataagctcctg

SEQ ID NO: 520790 - DNA, 16 bp, R. norvegicus
tctgcatcagctcctg

SEQ ID NO: 520791 - DNA, 16 bp, R. norvegicus
tctgcatcggctcctg

SEQ ID NO: 520792 - DNA, 16 bp, R. norvegicus
tctgcatctctgtctc

SEQ ID NO: 520793 - DNA, 16 bp, R. norvegicus
tctgcatctgtgtctg

SEQ ID NO: 520794 - DNA, 16 bp, R. norvegicus
tctgcatgaagctgct

SEQ ID NO: 520795 - DNA, 16 bp, R. norvegicus
tctgcatgcacatgtg

SEQ ID NO: 520796 - DNA, 16 bp, R. norvegicus
tctgcattcatggctg

SEQ ID NO: 520797 - DNA, 16 bp, R. norvegicus
tctgcattgaaatcct

SEQ ID NO: 520798 - DNA, 16 bp, R. norvegicus
tctgcatttcttctca

SEQ ID NO: 520799 - DNA, 16 bp, R. norvegicus
tctgcattttggccat

SEQ ID NO: 520800 - DNA, 16 bp, R. norvegicus
tctgccaaagcctgac

SEQ ID NO: 520801 - DNA, 16 bp, R. norvegicus
tctgccaagtcagaat

SEQ ID NO: 520802 - DNA, 16 bp, R. norvegicus
tctgccagagccagac

SEQ ID NO: 520803 - DNA, 16 bp, R. norvegicus
tctgccagagcctgag

SEQ ID NO: 520804 - DNA, 16 bp, R. norvegicus
tctgccagggcctgac

SEQ ID NO: 520805 - DNA, 16 bp, R. norvegicus
tctgccagtctcagaa

SEQ ID NO: 520806 - DNA, 16 bp, R. norvegicus
tctgccatgacaataa

SEQ ID NO: 520807 - DNA, 16 bp, R. norvegicus
tctgccatttctgaca

SEQ ID NO: 520808 - DNA, 16 bp, R. norvegicus
tctgcccactgtgggt

SEQ ID NO: 520809 - DNA, 16 bp, R. norvegicus
tctgcccagcagctga

SEQ ID NO: 520810 - DNA, 16 bp, R. norvegicus
tctgcccagtggctgc

SEQ ID NO: 520811 - DNA, 16 bp, R. norvegicus
tctgcccagtgtggag

SEQ ID NO: 520812 - DNA, 16 bp, R. norvegicus
tctgcccctgggattc

SEQ ID NO: 520813 - DNA, 16 bp, R. norvegicus
tctgcccctgtatttg

SEQ ID NO: 520814 - DNA, 16 bp, R. norvegicus
tctgcccctgttctaa

SEQ ID NO: 520815 - DNA, 16 bp, R. norvegicus
tctgccctctcttcta

SEQ ID NO: 520816 - DNA, 16 bp, R. norvegicus
tctgccctctgcttcc

SEQ ID NO: 520817 - DNA, 16 bp, R. norvegicus
tctgccctctgtcctc

SEQ ID NO: 520818 - DNA, 16 bp, R. norvegicus
tctgccctgccctgcc

SEQ ID NO: 520819 - DNA, 16 bp, R. norvegicus
tctgccctgcctctgc

SEQ ID NO: 520820 - DNA, 16 bp, R. norvegicus
tctgccctttcagagc

SEQ ID NO: 520821 - DNA, 16 bp, R. norvegicus
tctgcctacattcctg

SEQ ID NO: 520822 - DNA, 16 bp, R. norvegicus
tctgcctattacaaat

SEQ ID NO: 520823 - DNA, 16 bp, R. norvegicus
tctgcctcaaacaaaa

SEQ ID NO: 520824 - DNA, 16 bp, R. norvegicus
tctgcctcagcttcca

SEQ ID NO: 520825 - DNA, 16 bp, R. norvegicus
tctgcctcagcttctc

SEQ ID NO: 520826 - DNA, 16 bp, R. norvegicus
tctgcctcagtgggag

SEQ ID NO: 520827 - DNA, 16 bp, R. norvegicus
tctgcctcagtttccc

SEQ ID NO: 520828 - DNA, 16 bp, R. norvegicus
tctgcctcatcttctg

SEQ ID NO: 520829 - DNA, 16 bp, R. norvegicus
tctgcctccagagtgc

SEQ ID NO: 520830 - DNA, 16 bp, R. norvegicus
tctgcctccagggtgc

SEQ ID NO: 520831 - DNA, 16 bp, R. norvegicus
tctgcctccagtgctg

SEQ ID NO: 520832 - DNA, 16 bp, R. norvegicus
tctgcctccccaccct

SEQ ID NO: 520833 - DNA, 16 bp, R. norvegicus
tctgcctcccgagggc

SEQ ID NO: 520834 - DNA, 16 bp, R. norvegicus
tctgcctccctctgtc

SEQ ID NO: 520835 - DNA, 16 bp, R. norvegicus
tctgcctcctgaatgc

SEQ ID NO: 520836 - DNA, 16 bp, R. norvegicus
tctgcctcctgagtgt

SEQ ID NO: 520837 - DNA, 16 bp, R. norvegicus
tctgcctcctgggcac

SEQ ID NO: 520838 - DNA, 16 bp, R. norvegicus
tctgcctcctgtatgc

SEQ ID NO: 520839 - DNA, 16 bp, R. norvegicus
tctgcctccttcctga

SEQ ID NO: 520840 - DNA, 17 bp, R. norvegicus
tctgcctctctgagggt

SEQ ID NO: 520841 - DNA, 16 bp, R. norvegicus
tctgcctctctgatgg

SEQ ID NO: 520842 - DNA, 16 bp, R. norvegicus
tctgcctctctggagg

SEQ ID NO: 520843 - DNA, 16 bp, R. norvegicus
tctgcctctgaatttg

SEQ ID NO: 520844 - DNA, 16 bp, R. norvegicus
tctgcctctgcatttg

SEQ ID NO: 520845 - DNA, 16 bp, R. norvegicus
tctgcctctgccacct

SEQ ID NO: 520846 - DNA, 16 bp, R. norvegicus
tctgcctctgccctct

SEQ ID NO: 520847 - DNA, 16 bp, R. norvegicus
tctgcctctgcccttc

SEQ ID NO: 520848 - DNA, 16 bp, R. norvegicus
tctgcctctgcctctc

SEQ ID NO: 520849 - DNA, 16 bp, R. norvegicus
tctgcctctgcctgcc

SEQ ID NO: 520850 - DNA, 16 bp, R. norvegicus
tctgcctctgctgctc

SEQ ID NO: 520851 - DNA, 16 bp, R. norvegicus
tctgcctctgtcactg

SEQ ID NO: 520852 - DNA, 16 bp, R. norvegicus
tctgcctctgtctccc

SEQ ID NO: 520853 - DNA, 16 bp, R. norvegicus
tctgcctctgtcttcc

SEQ ID NO: 520854 - DNA, 16 bp, R. norvegicus
tctgcctgcaccaaga

SEQ ID NO: 520855 - DNA, 16 bp, R. norvegicus
tctgcctgcatccctg

SEQ ID NO: 520856 - DNA, 16 bp, R. norvegicus
tctgcctgcccttgcc

SEQ ID NO: 520857 - DNA, 16 bp, R. norvegicus
tctgcctgcctccacc

SEQ ID NO: 520858 - DNA, 16 bp, R. norvegicus
tctgcctgcctctgct

SEQ ID NO: 520859 - DNA, 16 bp, R. norvegicus
tctgcctgccttccct

SEQ ID NO: 520860 - DNA, 16 bp, R. norvegicus
tctgcctgccttcctg

SEQ ID NO: 520861 - DNA, 16 bp, R. norvegicus
tctgcctgccttgtgg

SEQ ID NO: 520862 - DNA, 16 bp, R. norvegicus
tctgcctgcctttgta

SEQ ID NO: 520863 - DNA, 16 bp, R. norvegicus
tctgcctgctcagtgc

SEQ ID NO: 520864 - DNA, 16 bp, R. norvegicus
tctgcctgctcctgga

SEQ ID NO: 520865 - DNA, 16 bp, R. norvegicus
tctgcctgctgtcctg

SEQ ID NO: 520866 - DNA, 16 bp, R. norvegicus
tctgcctgcttctggc

SEQ ID NO: 520867 - DNA, 16 bp, R. norvegicus
tctgcctgcttcttcc

SEQ ID NO: 520868 - DNA, 16 bp, R. norvegicus
tctgcctgcttgccct

SEQ ID NO: 520869 - DNA, 16 bp, R. norvegicus
tctgcctggaagtgaa

SEQ ID NO: 520870 - DNA, 16 bp, R. norvegicus
tctgcctggacactgc

SEQ ID NO: 520871 - DNA, 16 bp, R. norvegicus
tctgcctgtcctggaa

SEQ ID NO: 520872 - DNA, 16 bp, R. norvegicus
tctgcctgtctctgtt

SEQ ID NO: 520873 - DNA, 16 bp, R. norvegicus
tctgcctgtctgtgtg

SEQ ID NO: 520874 - DNA, 16 bp, R. norvegicus
tctgcctgtctttgct

SEQ ID NO: 520875 - DNA, 16 bp, R. norvegicus
tctgcctgtgcctctg

SEQ ID NO: 520876 - DNA, 16 bp, R. norvegicus
tctgcctgtttctgta

SEQ ID NO: 520877 - DNA, 16 bp, R. norvegicus
tctgccttcctctgcc

SEQ ID NO: 520878 - DNA, 16 bp, R. norvegicus
tctgccttctgcctgc

SEQ ID NO: 520879 - DNA, 16 bp, R. norvegicus
tctgcctttatctgtt

SEQ ID NO: 520880 - DNA, 16 bp, R. norvegicus
tctgcctttctctgtc

SEQ ID NO: 520881 - DNA, 16 bp, R. norvegicus
tctgcctttctttgcc

SEQ ID NO: 520882 - DNA, 16 bp, R. norvegicus
tctgccttttgtatct

SEQ ID NO: 520883 - DNA, 16 bp, R. norvegicus
tctgccttttgtttca

SEQ ID NO: 520884 - DNA, 16 bp, R. norvegicus
tctgctaaacacaatg

SEQ ID NO: 520885 - DNA, 16 bp, R. norvegicus
tctgctacatatatat

SEQ ID NO: 520886 - DNA, 16 bp, R. norvegicus
tctgctcacagcaatg

SEQ ID NO: 520887 - DNA, 16 bp, R. norvegicus
tctgctcacctctgct

SEQ ID NO: 520888 - DNA, 16 bp, R. norvegicus
tctgctcagcacctca

SEQ ID NO: 520889 - DNA, 16 bp, R. norvegicus
tctgctccaacctttg

SEQ ID NO: 520890 - DNA, 16 bp, R. norvegicus
tctgctccacacgttg

SEQ ID NO: 520891 - DNA, 16 bp, R. norvegicus
tctgctccactccttg

SEQ ID NO: 520892 - DNA, 16 bp, R. norvegicus
tctgctccagacagct

SEQ ID NO: 520893 - DNA, 16 bp, R. norvegicus
tctgctccagcaaaac

SEQ ID NO: 520894 - DNA, 16 bp, R. norvegicus
tctgctccaggggcag

SEQ ID NO: 520895 - DNA, 16 bp, R. norvegicus
tctgctccagttgttg

SEQ ID NO: 520896 - DNA, 16 bp, R. norvegicus
tctgctccatccccta

SEQ ID NO: 520897 - DNA, 16 bp, R. norvegicus
tctgctccatcccctg

SEQ ID NO: 520898 - DNA, 16 bp, R. norvegicus
tctgctccattatttt

SEQ ID NO: 520899 - DNA, 16 bp, R. norvegicus
tctgctccattctttt

SEQ ID NO: 520900 - DNA, 16 bp, R. norvegicus
tctgctccccagaaga

SEQ ID NO: 520901 - DNA, 16 bp, R. norvegicus
tctgctcctgcttgag

SEQ ID NO: 520902 - DNA, 16 bp, R. norvegicus
tctgctctcagcattc

SEQ ID NO: 520903 - DNA, 16 bp, R. norvegicus
tctgctctcagctgtg

SEQ ID NO: 520904 - DNA, 16 bp, R. norvegicus
tctgctctcaggagtg

SEQ ID NO: 520905 - DNA, 16 bp, R. norvegicus
tctgctctcctctgct

SEQ ID NO: 520906 - DNA, 16 bp, R. norvegicus
tctgctctcctgccct

SEQ ID NO: 520907 - DNA, 16 bp, R. norvegicus
tctgctctccttcatc

SEQ ID NO: 520908 - DNA, 16 bp, R. norvegicus
tctgctctctccagct

SEQ ID NO: 520909 - DNA, 16 bp, R. norvegicus
tctgctctctgtgtct

SEQ ID NO: 520910 - DNA, 16 bp, R. norvegicus
tctgctctgtcctctg

SEQ ID NO: 520911 - DNA, 16 bp, R. norvegicus
tctgctctgttctgtt

SEQ ID NO: 520912 - DNA, 16 bp, R. norvegicus
tctgctcttcagcctg

SEQ ID NO: 520913 - DNA, 16 bp, R. norvegicus
tctgctcttccagagg

SEQ ID NO: 520914 - DNA, 16 bp, R. norvegicus
tctgctcttgcagaag

SEQ ID NO: 520915 - DNA, 16 bp, R. norvegicus
tctgctcttggctgtg

SEQ ID NO: 520916 - DNA, 16 bp, R. norvegicus
tctgctgaggcctgtt

SEQ ID NO: 520917 - DNA, 16 bp, R. norvegicus
tctgctgcaaggaagc

SEQ ID NO: 520918 - DNA, 16 bp, R. norvegicus
tctgctgcacacaggg

SEQ ID NO: 520919 - DNA, 16 bp, R. norvegicus
tctgctgcagccaggg

SEQ ID NO: 520920 - DNA, 16 bp, R. norvegicus
tctgctgcctttggat

SEQ ID NO: 520921 - DNA, 16 bp, R. norvegicus
tctgctgctgctgctt

SEQ ID NO: 520922 - DNA, 16 bp, R. norvegicus
tctgctgctggcattc

SEQ ID NO: 520923 - DNA, 16 bp, R. norvegicus
tctgctgcttctcctc

SEQ ID NO: 520924 - DNA, 16 bp, R. norvegicus
tctgctgcttctcctg

SEQ ID NO: 520925 - DNA, 16 bp, R. norvegicus
tctgctggaagtgggc

SEQ ID NO: 520926 - DNA, 16 bp, R. norvegicus
tctgctggaggtgagc

SEQ ID NO: 520927 - DNA, 53 bp, R. norvegicus
tctgctggatattctctgagtcccagcctggaagctcctatccagaagacacc

SEQ ID NO: 520928 - DNA, 16 bp, R. norvegicus
tctgctgggctctgtg

SEQ ID NO: 520929 - DNA, 16 bp, R. norvegicus
tctgctgtcacctgaa

SEQ ID NO: 520930 - DNA, 16 bp, R. norvegicus
tctgctgtcatctgag

SEQ ID NO: 520931 - DNA, 16 bp, R. norvegicus
tctgctgtctcctgag

SEQ ID NO: 520932 - DNA, 16 bp, R. norvegicus
tctgctgtgctgtgct

SEQ ID NO: 520933 - DNA, 16 bp, R. norvegicus
tctgctgttgctgctg

SEQ ID NO: 520934 - DNA, 16 bp, R. norvegicus
tctgcttcagcaaaac

SEQ ID NO: 520935 - DNA, 16 bp, R. norvegicus
tctgcttcagttcctt

SEQ ID NO: 520936 - DNA, 16 bp, R. norvegicus
tctgcttcatgtttgt

SEQ ID NO: 520937 - DNA, 16 bp, R. norvegicus
tctgcttccctctgca

SEQ ID NO: 520938 - DNA, 16 bp, R. norvegicus
tctgcttccctggtgc

SEQ ID NO: 520939 - DNA, 16 bp, R. norvegicus
tctgcttcctgactat

SEQ ID NO: 520940 - DNA, 16 bp, R. norvegicus
tctgcttcctgactga

SEQ ID NO: 520941 - DNA, 16 bp, R. norvegicus
tctgcttcctgactgg

SEQ ID NO: 520942 - DNA, 16 bp, R. norvegicus
tctgcttcctggaaga

SEQ ID NO: 520943 - DNA, 16 bp, R. norvegicus
tctgcttcctggccac

SEQ ID NO: 520944 - DNA, 16 bp, R. norvegicus
tctgcttcctgttcct

SEQ ID NO: 520945 - DNA, 16 bp, R. norvegicus
tctgcttctatgaagg

SEQ ID NO: 520946 - DNA, 16 bp, R. norvegicus
tctgcttctcaagtgc

SEQ ID NO: 520947 - DNA, 16 bp, R. norvegicus
tctgcttctctgcctc

SEQ ID NO: 520948 - DNA, 16 bp, R. norvegicus
tctgcttctgactctt

SEQ ID NO: 520949 - DNA, 16 bp, R. norvegicus
tctgcttctgcctctg

SEQ ID NO: 520950 - DNA, 16 bp, R. norvegicus
tctgcttctgctcctg

SEQ ID NO: 520951 - DNA, 16 bp, R. norvegicus
tctgcttctgcttctg

SEQ ID NO: 520952 - DNA, 16 bp, R. norvegicus
tctgcttctgtctcag

SEQ ID NO: 520953 - DNA, 16 bp, R. norvegicus
tctgcttctgttcctg

SEQ ID NO: 520954 - DNA, 16 bp, R. norvegicus
tctgcttctgtttctg

SEQ ID NO: 520955 - DNA, 16 bp, R. norvegicus
tctgcttcttggctgt

SEQ ID NO: 520956 - DNA, 16 bp, R. norvegicus
tctgcttgtatatatg

SEQ ID NO: 520957 - DNA, 16 bp, R. norvegicus
tctgctttcccaggct

SEQ ID NO: 520958 - DNA, 16 bp, R. norvegicus
tctgctttctctggag

SEQ ID NO: 520959 - DNA, 16 bp, R. norvegicus
tctgctttgatgtgga

SEQ ID NO: 520960 - DNA, 16 bp, R. norvegicus
tctgctttgctgttac

SEQ ID NO: 520961 - DNA, 16 bp, R. norvegicus
tctgctttggttcctg

SEQ ID NO: 520962 - DNA, 16 bp, R. norvegicus
tctgcttttgcctcct

SEQ ID NO: 520963 - DNA, 16 bp, R. norvegicus
tctggaaaagcagaga

SEQ ID NO: 520964 - DNA, 16 bp, R. norvegicus
tctggaaacagcatca

SEQ ID NO: 520965 - DNA, 16 bp, R. norvegicus
tctggaaagaacacag

SEQ ID NO: 520966 - DNA, 16 bp, R. norvegicus
tctggaaatcagcctg

SEQ ID NO: 520967 - DNA, 16 bp, R. norvegicus
tctggaaatcagtatg

SEQ ID NO: 520968 - DNA, 47 bp, R. norvegicus
tctggaaatcagtctggaggttcctcagaaaattggacattgaacta

SEQ ID NO: 520969 - DNA, 16 bp, R. norvegicus
tctggaaatccatctg

SEQ ID NO: 520970 - DNA, 16 bp, R. norvegicus
tctggaacacatggac

SEQ ID NO: 520971 - DNA, 16 bp, R. norvegicus
tctggaacatatgggc

SEQ ID NO: 520972 - DNA, 16 bp, R. norvegicus
tctggaacattctgga

SEQ ID NO: 520973 - DNA, 16 bp, R. norvegicus
tctggaagaaaaagaa

SEQ ID NO: 520974 - DNA, 16 bp, R. norvegicus
tctggaagaaatggac

SEQ ID NO: 520975 - DNA, 16 bp, R. norvegicus
tctggaagaacagctg

SEQ ID NO: 520976 - DNA, 16 bp, R. norvegicus
tctggaagaacagtat

SEQ ID NO: 520977 - DNA, 16 bp, R. norvegicus
tctggaagaagagcaa

SEQ ID NO: 520978 - DNA, 16 bp, R. norvegicus
tctggaagaagagtca

SEQ ID NO: 520979 - DNA, 16 bp, R. norvegicus
tctggaagacattgtt

SEQ ID NO: 520980 - DNA, 16 bp, R. norvegicus
tctggaagagcaactg

SEQ ID NO: 520981 - DNA, 16 bp, R. norvegicus
tctggaagagcagaag

SEQ ID NO: 520982 - DNA, 16 bp, R. norvegicus
tctggaagagcagttg

SEQ ID NO: 520983 - DNA, 16 bp, R. norvegicus
tctggaagagcatcca

SEQ ID NO: 520984 - DNA, 16 bp, R. norvegicus
tctggaagagctctta

SEQ ID NO: 520985 - DNA, 16 bp, R. norvegicus
tctggaagagtccaga

SEQ ID NO: 520986 - DNA, 16 bp, R. norvegicus
tctggaagctgcctga

SEQ ID NO: 520987 - DNA, 16 bp, R. norvegicus
tctggaaggacttggg

SEQ ID NO: 520988 - DNA, 16 bp, R. norvegicus
tctggaaggagagtgt

SEQ ID NO: 520989 - DNA, 16 bp, R. norvegicus
tctggaatcaatggga

SEQ ID NO: 520990 - DNA, 16 bp, R. norvegicus
tctggaattaactgaa

SEQ ID NO: 520991 - DNA, 16 bp, R. norvegicus
tctggacctgagctct

SEQ ID NO: 520992 - DNA, 16 bp, R. norvegicus
tctggactcagagaag

SEQ ID NO: 520993 - DNA, 16 bp, R. norvegicus
tctggactccatgggt

SEQ ID NO: 520994 - DNA, 16 bp, R. norvegicus
tctggactctcagaag

SEQ ID NO: 520995 - DNA, 16 bp, R. norvegicus
tctggactctccctgt

SEQ ID NO: 520996 - DNA, 16 bp, R. norvegicus
tctggactgatgtcat

SEQ ID NO: 520997 - DNA, 16 bp, R. norvegicus
tctggagaaatcacca

SEQ ID NO: 520998 - DNA, 16 bp, R. norvegicus
tctggagacagaagca

SEQ ID NO: 520999 - DNA, 16 bp, R. norvegicus
tctggagacagagaca

SEQ ID NO: 521000 - DNA, 16 bp, R. norvegicus
tctggagacagctaca

SEQ ID NO: 521001 - DNA, 16 bp, R. norvegicus
tctggagactgaggca

SEQ ID NO: 521002 - DNA, 16 bp, R. norvegicus
tctggagactggcttt

SEQ ID NO: 521003 - DNA, 16 bp, R. norvegicus
tctggagagacagctc

SEQ ID NO: 521004 - DNA, 16 bp, R. norvegicus
tctggagaggtggctc

SEQ ID NO: 521005 - DNA, 16 bp, R. norvegicus
tctggagatcagtctg

SEQ ID NO: 521006 - DNA, 16 bp, R. norvegicus
tctggagctagagtta

SEQ ID NO: 521007 - DNA, 16 bp, R. norvegicus
tctggagctgaagtta

SEQ ID NO: 521008 - DNA, 16 bp, R. norvegicus
tctggaggacttcaag

SEQ ID NO: 521009 - DNA, 16 bp, R. norvegicus
tctggaggatggccct

SEQ ID NO: 521010 - DNA, 16 bp, R. norvegicus
tctggaggcagaagct

SEQ ID NO: 521011 - DNA, 16 bp, R. norvegicus
tctggaggccagaaga

SEQ ID NO: 521012 - DNA, 16 bp, R. norvegicus
tctggaggctgaggca

SEQ ID NO: 521013 - DNA, 16 bp, R. norvegicus
tctggaggctgggaag

SEQ ID NO: 521014 - DNA, 16 bp, R. norvegicus
tctggaggtcctcaga

SEQ ID NO: 521015 - DNA, 16 bp, R. norvegicus
tctggaggtgcctcag

SEQ ID NO: 521016 - DNA, 16 bp, R. norvegicus
tctggaggttcctcaa

SEQ ID NO: 521017 - DNA, 16 bp, R. norvegicus
tctggaggttcctctg

SEQ ID NO: 521018 - DNA, 17 bp, R. norvegicus
tctggaggttcttcaga

SEQ ID NO: 521019 - DNA, 16 bp, R. norvegicus
tctggagtcagaggca

SEQ ID NO: 521020 - DNA, 16 bp, R. norvegicus
tctggagtgctggggt

SEQ ID NO: 521021 - DNA, 16 bp, R. norvegicus
tctggatgacatttcc

SEQ ID NO: 521022 - DNA, 16 bp, R. norvegicus
tctggatgcagaggca

SEQ ID NO: 521023 - DNA, 16 bp, R. norvegicus
tctggatggcctttct

SEQ ID NO: 521024 - DNA, 16 bp, R. norvegicus
tctggatgtccttttc

SEQ ID NO: 521025 - DNA, 16 bp, R. norvegicus
tctggattaaaatttt

SEQ ID NO: 521026 - DNA, 16 bp, R. norvegicus
tctggatttaactttg

SEQ ID NO: 521027 - DNA, 16 bp, R. norvegicus
tctggcagaccagctc

SEQ ID NO: 521028 - DNA, 16 bp, R. norvegicus
tctggcagggagctgg

SEQ ID NO: 521029 - DNA, 16 bp, R. norvegicus
tctggcatcaatgaga

SEQ ID NO: 521030 - DNA, 16 bp, R. norvegicus
tctggccaagcctctc

SEQ ID NO: 521031 - DNA, 16 bp, R. norvegicus
tctggccacacacaca

SEQ ID NO: 521032 - DNA, 16 bp, R. norvegicus
tctggccagaagtctg

SEQ ID NO: 521033 - DNA, 16 bp, R. norvegicus
tctggccaggatcttc

SEQ ID NO: 521034 - DNA, 16 bp, R. norvegicus
tctggccatttcttct

SEQ ID NO: 521035 - DNA, 16 bp, R. norvegicus
tctggcctcagcagga

SEQ ID NO: 521036 - DNA, 16 bp, R. norvegicus
tctggcctcagcctcc

SEQ ID NO: 521037 - DNA, 16 bp, R. norvegicus
tctggcctcagtagga

SEQ ID NO: 521038 - DNA, 16 bp, R. norvegicus
tctggcctcagtgaga

SEQ ID NO: 521039 - DNA, 16 bp, R. norvegicus
tctggcctccacacag

SEQ ID NO: 521040 - DNA, 16 bp, R. norvegicus
tctggcctccaggttc

SEQ ID NO: 521041 - DNA, 16 bp, R. norvegicus
tctggcctccatgtgc

SEQ ID NO: 521042 - DNA, 16 bp, R. norvegicus
tctggcctctatgggc

SEQ ID NO: 521043 - DNA, 16 bp, R. norvegicus
tctggcctctccaggc

SEQ ID NO: 521044 - DNA, 16 bp, R. norvegicus
tctggcctctctgggc

SEQ ID NO: 521045 - DNA, 16 bp, R. norvegicus
tctggcctctgcaggc

SEQ ID NO: 521046 - DNA, 16 bp, R. norvegicus
tctggccttgaactca

SEQ ID NO: 521047 - DNA, 16 bp, R. norvegicus
tctggctagcctgaaa

SEQ ID NO: 521048 - DNA, 16 bp, R. norvegicus
tctggctcctacagtc

SEQ ID NO: 521049 - DNA, 16 bp, R. norvegicus
tctggctcctcttcct

SEQ ID NO: 521050 - DNA, 16 bp, R. norvegicus
tctggctcctgttggc

SEQ ID NO: 521051 - DNA, 16 bp, R. norvegicus
tctggctgccctggaa

SEQ ID NO: 521052 - DNA, 16 bp, R. norvegicus
tctggctgcctctgcc

SEQ ID NO: 521053 - DNA, 16 bp, R. norvegicus
tctggctgctctggaa

SEQ ID NO: 521054 - DNA, 16 bp, R. norvegicus
tctggctgctcttgag

SEQ ID NO: 521055 - DNA, 16 bp, R. norvegicus
tctggctggaacttca

SEQ ID NO: 521056 - DNA, 16 bp, R. norvegicus
tctggctggcctgcag

SEQ ID NO: 521057 - DNA, 16 bp, R. norvegicus
tctggctggctggctg

SEQ ID NO: 521058 - DNA, 16 bp, R. norvegicus
tctggctgtgacaaag

SEQ ID NO: 521059 - DNA, 16 bp, R. norvegicus
tctggctgtgtcactc

SEQ ID NO: 521060 - DNA, 16 bp, R. norvegicus
tctggctgtgtctccc

SEQ ID NO: 521061 - DNA, 16 bp, R. norvegicus
tctggctgttacaaat

SEQ ID NO: 521062 - DNA, 16 bp, R. norvegicus
tctggctgttctgaaa

SEQ ID NO: 521063 - DNA, 16 bp, R. norvegicus
tctggcttacttcact

SEQ ID NO: 521064 - DNA, 16 bp, R. norvegicus
tctggcttcaatggga

SEQ ID NO: 521065 - DNA, 16 bp, R. norvegicus
tctggcttcccaggtg

SEQ ID NO: 521066 - DNA, 16 bp, R. norvegicus
tctggcttcctcaggt

SEQ ID NO: 521067 - DNA, 16 bp, R. norvegicus
tctggcttctgctgct

SEQ ID NO: 521068 - DNA, 16 bp, R. norvegicus
tctggcttctttgtca

SEQ ID NO: 521069 - DNA, 16 bp, R. norvegicus
tctggctttcacaatc

SEQ ID NO: 521070 - DNA, 16 bp, R. norvegicus
tctggcttttaaagtt

SEQ ID NO: 521071 - DNA, 16 bp, R. norvegicus
tctgggaaaaaaaaat

SEQ ID NO: 521072 - DNA, 16 bp, R. norvegicus
tctgggaaagaatcag

SEQ ID NO: 521073 - DNA, 16 bp, R. norvegicus
tctgggaaagagagag

SEQ ID NO: 521074 - DNA, 17 bp, R. norvegicus
tctgggaacagagagct

SEQ ID NO: 521075 - DNA, 16 bp, R. norvegicus
tctgggaagaaggaac

SEQ ID NO: 521076 - DNA, 16 bp, R. norvegicus
tctgggaagagggagc

SEQ ID NO: 521077 - DNA, 16 bp, R. norvegicus
tctgggaagatggctc

SEQ ID NO: 521078 - DNA, 16 bp, R. norvegicus
tctgggaagcagaagc

SEQ ID NO: 521079 - DNA, 16 bp, R. norvegicus
tctgggacagaatcct

SEQ ID NO: 521080 - DNA, 31 bp, R. norvegicus
tctgggacaggcaggaactggccaggcaaat

SEQ ID NO: 521081 - DNA, 16 bp, R. norvegicus
tctgggacattatgaa

SEQ ID NO: 521082 - DNA, 16 bp, R. norvegicus
tctgggaccagaggag

SEQ ID NO: 521083 - DNA, 16 bp, R. norvegicus
tctgggacccacacat

SEQ ID NO: 521084 - DNA, 16 bp, R. norvegicus
tctgggaccgggcact

SEQ ID NO: 521085 - DNA, 16 bp, R. norvegicus
tctgggactcagtttc

SEQ ID NO: 521086 - DNA, 16 bp, R. norvegicus
tctgggacttcctaaa

SEQ ID NO: 521087 - DNA, 16 bp, R. norvegicus
tctgggagagagagga

SEQ ID NO: 521088 - DNA, 16 bp, R. norvegicus
tctgggagagcagcag

SEQ ID NO: 521089 - DNA, 16 bp, R. norvegicus
tctgggagaggagaaa

SEQ ID NO: 521090 - DNA, 16 bp, R. norvegicus
tctgggagcagatgga

SEQ ID NO: 521091 - DNA, 16 bp, R. norvegicus
tctgggaggagagagc

SEQ ID NO: 521092 - DNA, 16 bp, R. norvegicus
tctgggaggagaggag

SEQ ID NO: 521093 - DNA, 16 bp, R. norvegicus
tctgggaggagttggg

SEQ ID NO: 521094 - DNA, 16 bp, R. norvegicus
tctgggatgaagccaa

SEQ ID NO: 521095 - DNA, 16 bp, R. norvegicus
tctgggatgagctaga

SEQ ID NO: 521096 - DNA, 16 bp, R. norvegicus
tctgggcacaggaaga

SEQ ID NO: 521097 - DNA, 16 bp, R. norvegicus
tctgggcagtgtctgg

SEQ ID NO: 521098 - DNA, 16 bp, R. norvegicus
tctgggcatgctcagt

SEQ ID NO: 521099 - DNA, 16 bp, R. norvegicus
tctgggcatgtaccca

SEQ ID NO: 521100 - DNA, 16 bp, R. norvegicus
tctgggccacaccctc

SEQ ID NO: 521101 - DNA, 16 bp, R. norvegicus
tctgggcctgggtggt

SEQ ID NO: 521102 - DNA, 16 bp, R. norvegicus
tctgggccttcagttc

SEQ ID NO: 521103 - DNA, 16 bp, R. norvegicus
tctgggctggtagtcc

SEQ ID NO: 521104 - DNA, 16 bp, R. norvegicus
tctgggcttctcttct

SEQ ID NO: 521105 - DNA, 16 bp, R. norvegicus
tctgggcttctttcct

SEQ ID NO: 521106 - DNA, 16 bp, R. norvegicus
tctggggaagactatt

SEQ ID NO: 521107 - DNA, 24 bp, R. norvegicus
tctggggaccgaacccagggcctt

SEQ ID NO: 521108 - DNA, 16 bp, R. norvegicus
tctggggaggagatgg

SEQ ID NO: 521109 - DNA, 16 bp, R. norvegicus
tctggggattgaactc

SEQ ID NO: 521110 - DNA, 16 bp, R. norvegicus
tctggggctgcagaga

SEQ ID NO: 521111 - DNA, 16 bp, R. norvegicus
tctgggggaaaaaaaa

SEQ ID NO: 521112 - DNA, 16 bp, R. norvegicus
tctgggggatctgaca

SEQ ID NO: 521113 - DNA, 16 bp, R. norvegicus
tctggggggaaaaaaa

SEQ ID NO: 521114 - DNA, 16 bp, R. norvegicus
tctggggggttgggga

SEQ ID NO: 521115 - DNA, 16 bp, R. norvegicus
tctgggtcatccttcc

SEQ ID NO: 521116 - DNA, 16 bp, R. norvegicus
tctgggtcctggccct

SEQ ID NO: 521117 - DNA, 16 bp, R. norvegicus
tctgggtcttcagttt

SEQ ID NO: 521118 - DNA, 16 bp, R. norvegicus
tctgggtctttaattc

SEQ ID NO: 521119 - DNA, 16 bp, R. norvegicus
tctgggtgactcttac

SEQ ID NO: 521120 - DNA, 16 bp, R. norvegicus
tctgggtgcagatgga

SEQ ID NO: 521121 - DNA, 16 bp, R. norvegicus
tctgggttgatgtgga

SEQ ID NO: 521122 - DNA, 16 bp, R. norvegicus
tctgggttgtttacag

SEQ ID NO: 521123 - DNA, 32 bp, R. norvegicus
tctggtaatcttactgtggcaagttgggaaaa

SEQ ID NO: 521124 - DNA, 16 bp, R. norvegicus
tctggtactatgaaag

SEQ ID NO: 521125 - DNA, 16 bp, R. norvegicus
tctggtactttctgga

SEQ ID NO: 521126 - DNA, 16 bp, R. norvegicus
tctggtataattttga

SEQ ID NO: 521127 - DNA, 16 bp, R. norvegicus
tctggtattttcattt

SEQ ID NO: 521128 - DNA, 16 bp, R. norvegicus
tctggtcctctggaaa

SEQ ID NO: 521129 - DNA, 16 bp, R. norvegicus
tctggtcctgagctct

SEQ ID NO: 521130 - DNA, 16 bp, R. norvegicus
tctggtcctgggcatt

SEQ ID NO: 521131 - DNA, 16 bp, R. norvegicus
tctggtccttctgcct

SEQ ID NO: 521132 - DNA, 16 bp, R. norvegicus
tctggtgagacgtctg

SEQ ID NO: 521133 - DNA, 16 bp, R. norvegicus
tctggtggcacatgcc

SEQ ID NO: 521134 - DNA, 16 bp, R. norvegicus
tctggtggggtctgat

SEQ ID NO: 521135 - DNA, 16 bp, R. norvegicus
tctggtgggtctgaag

SEQ ID NO: 521136 - DNA, 16 bp, R. norvegicus
tctggtggtcaggatg

SEQ ID NO: 521137 - DNA, 16 bp, R. norvegicus
tctggtggttgatatt

SEQ ID NO: 521138 - DNA, 16 bp, R. norvegicus
tctggtgtatctcaag

SEQ ID NO: 521139 - DNA, 16 bp, R. norvegicus
tctggtgtctgagatg

SEQ ID NO: 521140 - DNA, 22 bp, R. norvegicus
tctggtgtgaggtggaatctca

SEQ ID NO: 521141 - DNA, 16 bp, R. norvegicus
tctggtgtggctgaag

SEQ ID NO: 521142 - DNA, 22 bp, R. norvegicus
tctggtgtgtctgaagacagcg

SEQ ID NO: 521143 - DNA, 16 bp, R. norvegicus
tctggtgtgtctgaga

SEQ ID NO: 521144 - DNA, 17 bp, R. norvegicus
tctggtgtgtgaagaca

SEQ ID NO: 521145 - DNA, 17 bp, R. norvegicus
tctggttctgggtcctt

SEQ ID NO: 521146 - DNA, 17 bp, R. norvegicus
tctggttggttgatatt

SEQ ID NO: 521147 - DNA, 16 bp, R. norvegicus
tctggttgttggcatt

SEQ ID NO: 521148 - DNA, 16 bp, R. norvegicus
tctggtttcagtcaga

SEQ ID NO: 521149 - DNA, 16 bp, R. norvegicus
tctggtttccacatgc

SEQ ID NO: 521150 - DNA, 16 bp, R. norvegicus
tctggtttctgaagca

SEQ ID NO: 521151 - DNA, 16 bp, R. norvegicus
tctggtttgaacctgt

SEQ ID NO: 521152 - DNA, 16 bp, R. norvegicus
tctggttttctatatc

SEQ ID NO: 521153 - DNA, 16 bp, R. norvegicus
tctgtaaaactctcct

SEQ ID NO: 521154 - DNA, 16 bp, R. norvegicus
tctgtaaaatgggtgt

SEQ ID NO: 521155 - DNA, 16 bp, R. norvegicus
tctgtaaatagtgata

SEQ ID NO: 521156 - DNA, 16 bp, R. norvegicus
tctgtaactccaattt

SEQ ID NO: 521157 - DNA, 16 bp, R. norvegicus
tctgtaactgtaagcc

SEQ ID NO: 521158 - DNA, 16 bp, R. norvegicus
tctgtaagaatagcaa

SEQ ID NO: 521159 - DNA, 16 bp, R. norvegicus
tctgtaaggcaaaaaa

SEQ ID NO: 521160 - DNA, 16 bp, R. norvegicus
tctgtaatcccagccc

SEQ ID NO: 521161 - DNA, 16 bp, R. norvegicus
tctgtaatttctttct

SEQ ID NO: 521162 - DNA, 16 bp, R. norvegicus
tctgtacaaatactat

SEQ ID NO: 521163 - DNA, 16 bp, R. norvegicus
tctgtacatgtgtctg

SEQ ID NO: 521164 - DNA, 16 bp, R. norvegicus
tctgtacattgttttt

SEQ ID NO: 521165 - DNA, 16 bp, R. norvegicus
tctgtaccaatgccat

SEQ ID NO: 521166 - DNA, 16 bp, R. norvegicus
tctgtaccaggtcctc

SEQ ID NO: 521167 - DNA, 16 bp, R. norvegicus
tctgtacccacacaca

SEQ ID NO: 521168 - DNA, 16 bp, R. norvegicus
tctgtagaatgctttt

SEQ ID NO: 521169 - DNA, 16 bp, R. norvegicus
tctgtagatcaggctg

SEQ ID NO: 521170 - DNA, 16 bp, R. norvegicus
tctgtagattgcttat

SEQ ID NO: 521171 - DNA, 16 bp, R. norvegicus
tctgtagctcaggaga

SEQ ID NO: 521172 - DNA, 16 bp, R. norvegicus
tctgtaggcttcctgt

SEQ ID NO: 521173 - DNA, 16 bp, R. norvegicus
tctgtagggcattttc

SEQ ID NO: 521174 - DNA, 16 bp, R. norvegicus
tctgtagtaaaacact

SEQ ID NO: 521175 - DNA, 16 bp, R. norvegicus
tctgtatatatgtata

SEQ ID NO: 521176 - DNA, 16 bp, R. norvegicus
tctgtatattttggat

SEQ ID NO: 521177 - DNA, 16 bp, R. norvegicus
tctgtatccctttaat

SEQ ID NO: 521178 - DNA, 16 bp, R. norvegicus
tctgtatctactcctc

SEQ ID NO: 521179 - DNA, 16 bp, R. norvegicus
tctgtatctgagttct

SEQ ID NO: 521180 - DNA, 16 bp, R. norvegicus
tctgtatgacaagacc

SEQ ID NO: 521181 - DNA, 16 bp, R. norvegicus
tctgtatgacatctgc

SEQ ID NO: 521182 - DNA, 16 bp, R. norvegicus
tctgtatgacatctgt

SEQ ID NO: 521183 - DNA, 16 bp, R. norvegicus
tctgtatgtgtctctg

SEQ ID NO: 521184 - DNA, 16 bp, R. norvegicus
tctgtatttacatttc

SEQ ID NO: 521185 - DNA, 16 bp, R. norvegicus
tctgtatttccagagt

SEQ ID NO: 521186 - DNA, 16 bp, R. norvegicus
tctgtatttctttctg

SEQ ID NO: 521187 - DNA, 16 bp, R. norvegicus
tctgtattttaaacca

SEQ ID NO: 521188 - DNA, 16 bp, R. norvegicus
tctgtcacaagagctg

SEQ ID NO: 521189 - DNA, 16 bp, R. norvegicus
tctgtcaccctcttct

SEQ ID NO: 521190 - DNA, 16 bp, R. norvegicus
tctgtcactccagctc

SEQ ID NO: 521191 - DNA, 17 bp, R. norvegicus
tctgtcagaccattctg

SEQ ID NO: 521192 - DNA, 16 bp, R. norvegicus
tctgtcagatgtggag

SEQ ID NO: 521193 - DNA, 16 bp, R. norvegicus
tctgtcagcctggatt

SEQ ID NO: 521194 - DNA, 16 bp, R. norvegicus
tctgtcagtctctgct

SEQ ID NO: 521195 - DNA, 16 bp, R. norvegicus
tctgtcatctctgtct

SEQ ID NO: 521196 - DNA, 16 bp, R. norvegicus
tctgtcatttcttcat

SEQ ID NO: 521197 - DNA, 16 bp, R. norvegicus
tctgtcatttttattg

SEQ ID NO: 521198 - DNA, 16 bp, R. norvegicus
tctgtccatctgtcta

SEQ ID NO: 521199 - DNA, 16 bp, R. norvegicus
tctgtcccacaaggtc

SEQ ID NO: 521200 - DNA, 16 bp, R. norvegicus
tctgtccccaggggaa

SEQ ID NO: 521201 - DNA, 16 bp, R. norvegicus
tctgtcccctgagagg

SEQ ID NO: 521202 - DNA, 16 bp, R. norvegicus
tctgtccctgtcctct

SEQ ID NO: 521203 - DNA, 16 bp, R. norvegicus
tctgtccgtctgtctg

SEQ ID NO: 521204 - DNA, 16 bp, R. norvegicus
tctgtcctcagtgtac

SEQ ID NO: 521205 - DNA, 16 bp, R. norvegicus
tctgtcctccagacag

SEQ ID NO: 521206 - DNA, 16 bp, R. norvegicus
tctgtccttcctcacc

SEQ ID NO: 521207 - DNA, 16 bp, R. norvegicus
tctgtccttcctgtct

SEQ ID NO: 521208 - DNA, 16 bp, R. norvegicus
tctgtccttctgtcct

SEQ ID NO: 521209 - DNA, 16 bp, R. norvegicus
tctgtctcatctctct

SEQ ID NO: 521210 - DNA, 16 bp, R. norvegicus
tctgtctccatctctc

SEQ ID NO: 521211 - DNA, 16 bp, R. norvegicus
tctgtctcccccaccc

SEQ ID NO: 521212 - DNA, 16 bp, R. norvegicus
tctgtctcctcagagt

SEQ ID NO: 521213 - DNA, 16 bp, R. norvegicus
tctgtctccttctgtc

SEQ ID NO: 521214 - DNA, 16 bp, R. norvegicus
tctgtctctcactccc

SEQ ID NO: 521215 - DNA, 16 bp, R. norvegicus
tctgtctctctttcat

SEQ ID NO: 521216 - DNA, 16 bp, R. norvegicus
tctgtctctgctctgt

SEQ ID NO: 521217 - DNA, 16 bp, R. norvegicus
tctgtctctgcttcct

SEQ ID NO: 521218 - DNA, 16 bp, R. norvegicus
tctgtctcttgagtgt

SEQ ID NO: 521219 - DNA, 16 bp, R. norvegicus
tctgtctgagctctgt

SEQ ID NO: 521220 - DNA, 16 bp, R. norvegicus
tctgtctgcatcttct

SEQ ID NO: 521221 - DNA, 16 bp, R. norvegicus
tctgtctgccctgccc

SEQ ID NO: 521222 - DNA, 16 bp, R. norvegicus
tctgtctgcctccctc

SEQ ID NO: 521223 - DNA, 16 bp, R. norvegicus
tctgtctgccttcctg

SEQ ID NO: 521224 - DNA, 16 bp, R. norvegicus
tctgtctgcttgcctg

SEQ ID NO: 521225 - DNA, 16 bp, R. norvegicus
tctgtctggagtctgc

SEQ ID NO: 521226 - DNA, 16 bp, R. norvegicus
tctgtctggctgtctg

SEQ ID NO: 521227 - DNA, 16 bp, R. norvegicus
tctgtctgtccacctg

SEQ ID NO: 521228 - DNA, 16 bp, R. norvegicus
tctgtctgtccatcca

SEQ ID NO: 521229 - DNA, 16 bp, R. norvegicus
tctgtctgtccctctg

SEQ ID NO: 521230 - DNA, 16 bp, R. norvegicus
tctgtctgtccttccc

SEQ ID NO: 521231 - DNA, 16 bp, R. norvegicus
tctgtctgtctgcctc

SEQ ID NO: 521232 - DNA, 16 bp, R. norvegicus
tctgtctgtctgtcat

SEQ ID NO: 521233 - DNA, 16 bp, R. norvegicus
tctgtctgtctgtcct

SEQ ID NO: 521234 - DNA, 16 bp, R. norvegicus
tctgtctgtctgtctc

SEQ ID NO: 521235 - DNA, 16 bp, R. norvegicus
tctgtctgtctgtctg

SEQ ID NO: 521236 - DNA, 16 bp, R. norvegicus
tctgtctgtctgtgct

SEQ ID NO: 521237 - DNA, 16 bp, R. norvegicus
tctgtctgtctgtgtg

SEQ ID NO: 521238 - DNA, 16 bp, R. norvegicus
tctgtctgtctgttca

SEQ ID NO: 521239 - DNA, 16 bp, R. norvegicus
tctgtctgtctgtttc

SEQ ID NO: 521240 - DNA, 16 bp, R. norvegicus
tctgtctgtctgtttg

SEQ ID NO: 521241 - DNA, 16 bp, R. norvegicus
tctgtctgtcttattt

SEQ ID NO: 521242 - DNA, 16 bp, R. norvegicus
tctgtctgtcttccct

SEQ ID NO: 521243 - DNA, 16 bp, R. norvegicus
tctgtctgtcttggaa

SEQ ID NO: 521244 - DNA, 16 bp, R. norvegicus
tctgtctgtcttgtct

SEQ ID NO: 521245 - DNA, 16 bp, R. norvegicus
tctgtctgtgtctctc

SEQ ID NO: 521246 - DNA, 16 bp, R. norvegicus
tctgtctgtgtctgtg

SEQ ID NO: 521247 - DNA, 16 bp, R. norvegicus
tctgtctgtgtgcgtg

SEQ ID NO: 521248 - DNA, 16 bp, R. norvegicus
tctgtctgtgtgtctc

SEQ ID NO: 521249 - DNA, 16 bp, R. norvegicus
tctgtcttcctctgct

SEQ ID NO: 521250 - DNA, 16 bp, R. norvegicus
tctgtctttctgggtc

SEQ ID NO: 521251 - DNA, 16 bp, R. norvegicus
tctgtgaagaaagaaa

SEQ ID NO: 521252 - DNA, 16 bp, R. norvegicus
tctgtgaatttttctt

SEQ ID NO: 521253 - DNA, 16 bp, R. norvegicus
tctgtgacatcatcaa

SEQ ID NO: 521254 - DNA, 16 bp, R. norvegicus
tctgtgactccagctc

SEQ ID NO: 521255 - DNA, 16 bp, R. norvegicus
tctgtgactgtgttac

SEQ ID NO: 521256 - DNA, 16 bp, R. norvegicus
tctgtgagagcagcca

SEQ ID NO: 521257 - DNA, 16 bp, R. norvegicus
tctgtgagcccccatg

SEQ ID NO: 521258 - DNA, 16 bp, R. norvegicus
tctgtgaggaagtttc

SEQ ID NO: 521259 - DNA, 16 bp, R. norvegicus
tctgtgaggacagctc

SEQ ID NO: 521260 - DNA, 16 bp, R. norvegicus
tctgtgaggtgtggag

SEQ ID NO: 521261 - DNA, 16 bp, R. norvegicus
tctgtgagtctcattc

SEQ ID NO: 521262 - DNA, 16 bp, R. norvegicus
tctgtgagtctgagac

SEQ ID NO: 521263 - DNA, 16 bp, R. norvegicus
tctgtgatggaggagg

SEQ ID NO: 521264 - DNA, 16 bp, R. norvegicus
tctgtgattattttgt

SEQ ID NO: 521265 - DNA, 16 bp, R. norvegicus
tctgtgattggtttac

SEQ ID NO: 521266 - DNA, 16 bp, R. norvegicus
tctgtgcacatgcatg

SEQ ID NO: 521267 - DNA, 16 bp, R. norvegicus
tctgtgcactacatgc

SEQ ID NO: 521268 - DNA, 16 bp, R. norvegicus
tctgtgcatatgtgta

SEQ ID NO: 521269 - DNA, 16 bp, R. norvegicus
tctgtgcatcatgtgc

SEQ ID NO: 521270 - DNA, 16 bp, R. norvegicus
tctgtgcatctggggt

SEQ ID NO: 521271 - DNA, 16 bp, R. norvegicus
tctgtgcatgtgcatg

SEQ ID NO: 521272 - DNA, 16 bp, R. norvegicus
tctgtgcatgtgtatg

SEQ ID NO: 521273 - DNA, 16 bp, R. norvegicus
tctgtgccaagcaacc

SEQ ID NO: 521274 - DNA, 16 bp, R. norvegicus
tctgtgccacctttac

SEQ ID NO: 521275 - DNA, 16 bp, R. norvegicus
tctgtgccccctgggc

SEQ ID NO: 521276 - DNA, 21 bp, R. norvegicus
tctgtgctcagctcacacatg

SEQ ID NO: 521277 - DNA, 16 bp, R. norvegicus
tctgtgctcattcttc

SEQ ID NO: 521278 - DNA, 16 bp, R. norvegicus
tctgtgctctctctct

SEQ ID NO: 521279 - DNA, 16 bp, R. norvegicus
tctgtgctttctttat

SEQ ID NO: 521280 - DNA, 16 bp, R. norvegicus
tctgtggacacctgca

SEQ ID NO: 521281 - DNA, 16 bp, R. norvegicus
tctgtggaccaggctg

SEQ ID NO: 521282 - DNA, 16 bp, R. norvegicus
tctgtggacttctgat

SEQ ID NO: 521283 - DNA, 16 bp, R. norvegicus
tctgtggagtcctgac

SEQ ID NO: 521284 - DNA, 16 bp, R. norvegicus
tctgtggattacagca

SEQ ID NO: 521285 - DNA, 16 bp, R. norvegicus
tctgtggattatatcc

SEQ ID NO: 521286 - DNA, 16 bp, R. norvegicus
tctgtggcaagcactt

SEQ ID NO: 521287 - DNA, 16 bp, R. norvegicus
tctgtggcagcccaga

SEQ ID NO: 521288 - DNA, 19 bp, R. norvegicus
tctgtggccttttggggtt

SEQ ID NO: 521289 - DNA, 16 bp, R. norvegicus
tctgtggctctgtggc

SEQ ID NO: 521290 - DNA, 16 bp, R. norvegicus
tctgtgggcccttgca

SEQ ID NO: 521291 - DNA, 16 bp, R. norvegicus
tctgtggggcagaatg

SEQ ID NO: 521292 - DNA, 16 bp, R. norvegicus
tctgtggtctctgtgg

SEQ ID NO: 521293 - DNA, 16 bp, R. norvegicus
tctgtggtttttcaag

SEQ ID NO: 521294 - DNA, 16 bp, R. norvegicus
tctgtgtaccatgtat

SEQ ID NO: 521295 - DNA, 16 bp, R. norvegicus
tctgtgtagccttgac

SEQ ID NO: 521296 - DNA, 16 bp, R. norvegicus
tctgtgtagccttgtc

SEQ ID NO: 521297 - DNA, 16 bp, R. norvegicus
tctgtgtatagtcttt

SEQ ID NO: 521298 - DNA, 16 bp, R. norvegicus
tctgtgtatatataca

SEQ ID NO: 521299 - DNA, 16 bp, R. norvegicus
tctgtgtatatattat

SEQ ID NO: 521300 - DNA, 16 bp, R. norvegicus
tctgtgtatatgttat

SEQ ID NO: 521301 - DNA, 16 bp, R. norvegicus
tctgtgtcaccctggc

SEQ ID NO: 521302 - DNA, 16 bp, R. norvegicus
tctgtgtcagctcctg

SEQ ID NO: 521303 - DNA, 16 bp, R. norvegicus
tctgtgtctctcagga

SEQ ID NO: 521304 - DNA, 16 bp, R. norvegicus
tctgtgtctctccctg

SEQ ID NO: 521305 - DNA, 16 bp, R. norvegicus
tctgtgtctctgcctg

SEQ ID NO: 521306 - DNA, 16 bp, R. norvegicus
tctgtgtctgtgtatg

SEQ ID NO: 521307 - DNA, 16 bp, R. norvegicus
tctgtgtctgtgtcag

SEQ ID NO: 521308 - DNA, 16 bp, R. norvegicus
tctgtgtgacatgtgt

SEQ ID NO: 521309 - DNA, 16 bp, R. norvegicus
tctgtgtgaccctggc

SEQ ID NO: 521310 - DNA, 16 bp, R. norvegicus
tctgtgtgagtgcatg

SEQ ID NO: 521311 - DNA, 16 bp, R. norvegicus
tctgtgtgagtgtgtc

SEQ ID NO: 521312 - DNA, 16 bp, R. norvegicus
tctgtgtgcatctgtg

SEQ ID NO: 521313 - DNA, 16 bp, R. norvegicus
tctgtgtgccaccatg

SEQ ID NO: 521314 - DNA, 16 bp, R. norvegicus
tctgtgtgcctctgcc

SEQ ID NO: 521315 - DNA, 16 bp, R. norvegicus
tctgtgtgtaaatgtg

SEQ ID NO: 521316 - DNA, 16 bp, R. norvegicus
tctgtgtgtatgtggt

SEQ ID NO: 521317 - DNA, 16 bp, R. norvegicus
tctgtgtgtctatgtg

SEQ ID NO: 521318 - DNA, 16 bp, R. norvegicus
tctgtgtgtctctgta

SEQ ID NO: 521319 - DNA, 16 bp, R. norvegicus
tctgtgtgtctgaatg

SEQ ID NO: 521320 - DNA, 16 bp, R. norvegicus
tctgtgtgtctgtcta

SEQ ID NO: 521321 - DNA, 16 bp, R. norvegicus
tctgtgtgtctgtgtg

SEQ ID NO: 521322 - DNA, 16 bp, R. norvegicus
tctgtgtgtggctgtg

SEQ ID NO: 521323 - DNA, 16 bp, R. norvegicus
tctgtgtgtgtgagtg

SEQ ID NO: 521324 - DNA, 16 bp, R. norvegicus
tctgtgttctttccag

SEQ ID NO: 521325 - DNA, 19 bp, R. norvegicus
tctgtgtttgtcaggctct

SEQ ID NO: 521326 - DNA, 16 bp, R. norvegicus
tctgtgtttgtgtctc

SEQ ID NO: 521327 - DNA, 16 bp, R. norvegicus
tctgtgttttccaaag

SEQ ID NO: 521328 - DNA, 16 bp, R. norvegicus
tctgtgttttctgaag

SEQ ID NO: 521329 - DNA, 16 bp, R. norvegicus
tctgttaaatcatttt

SEQ ID NO: 521330 - DNA, 16 bp, R. norvegicus
tctgttaaattcattt

SEQ ID NO: 521331 - DNA, 16 bp, R. norvegicus
tctgttactttcactg

SEQ ID NO: 521332 - DNA, 16 bp, R. norvegicus
tctgttagaattaaga

SEQ ID NO: 521333 - DNA, 16 bp, R. norvegicus
tctgttagtctatatc

SEQ ID NO: 521334 - DNA, 16 bp, R. norvegicus
tctgttataaactttg

SEQ ID NO: 521335 - DNA, 16 bp, R. norvegicus
tctgttcacactccca

SEQ ID NO: 521336 - DNA, 16 bp, R. norvegicus
tctgttcaggatcttc

SEQ ID NO: 521337 - DNA, 16 bp, R. norvegicus
tctgttcatggaagtg

SEQ ID NO: 521338 - DNA, 16 bp, R. norvegicus
tctgttcatggcagta

SEQ ID NO: 521339 - DNA, 16 bp, R. norvegicus
tctgttcatgtgtatt

SEQ ID NO: 521340 - DNA, 16 bp, R. norvegicus
tctgttccaaactttg

SEQ ID NO: 521341 - DNA, 16 bp, R. norvegicus
tctgttcccatatctg

SEQ ID NO: 521342 - DNA, 17 bp, R. norvegicus
tctgttcctgagattct

SEQ ID NO: 521343 - DNA, 16 bp, R. norvegicus
tctgttcctggtttaa

SEQ ID NO: 521344 - DNA, 16 bp, R. norvegicus
tctgttctaactatcc

SEQ ID NO: 521345 - DNA, 16 bp, R. norvegicus
tctgttctcagctctt

SEQ ID NO: 521346 - DNA, 16 bp, R. norvegicus
tctgttctgtcctgtt

SEQ ID NO: 521347 - DNA, 16 bp, R. norvegicus
tctgttctgtgtctct

SEQ ID NO: 521348 - DNA, 17 bp, R. norvegicus
tctgttgaaggacatct

SEQ ID NO: 521349 - DNA, 16 bp, R. norvegicus
tctgttgaaggacatt

SEQ ID NO: 521350 - DNA, 16 bp, R. norvegicus
tctgttgagaatactg

SEQ ID NO: 521351 - DNA, 17 bp, R. norvegicus
tctgttgagggacatct

SEQ ID NO: 521352 - DNA, 16 bp, R. norvegicus
tctgttgcaagtgacc

SEQ ID NO: 521353 - DNA, 16 bp, R. norvegicus
tctgttgccatggcaa

SEQ ID NO: 521354 - DNA, 16 bp, R. norvegicus
tctgttgcccaggctg

SEQ ID NO: 521355 - DNA, 16 bp, R. norvegicus
tctgttgccctggctg

SEQ ID NO: 521356 - DNA, 16 bp, R. norvegicus
tctgttgcctcccttt

SEQ ID NO: 521357 - DNA, 16 bp, R. norvegicus
tctgttgctatgacaa

SEQ ID NO: 521358 - DNA, 16 bp, R. norvegicus
tctgttgctgtggtaa

SEQ ID NO: 521359 - DNA, 16 bp, R. norvegicus
tctgttgttaggtctc

SEQ ID NO: 521360 - DNA, 16 bp, R. norvegicus
tctgtttagcttttgt

SEQ ID NO: 521361 - DNA, 16 bp, R. norvegicus
tctgtttagttctgtg

SEQ ID NO: 521362 - DNA, 16 bp, R. norvegicus
tctgtttatctctgtc

SEQ ID NO: 521363 - DNA, 16 bp, R. norvegicus
tctgtttcactgtgga

SEQ ID NO: 521364 - DNA, 16 bp, R. norvegicus
tctgtttccatccact

SEQ ID NO: 521365 - DNA, 16 bp, R. norvegicus
tctgtttcccgagtgc

SEQ ID NO: 521366 - DNA, 16 bp, R. norvegicus
tctgtttccctgtctc

SEQ ID NO: 521367 - DNA, 16 bp, R. norvegicus
tctgtttcctcattta

SEQ ID NO: 521368 - DNA, 16 bp, R. norvegicus
tctgtttcctgtccat

SEQ ID NO: 521369 - DNA, 16 bp, R. norvegicus
tctgtttctctgtgtg

SEQ ID NO: 521370 - DNA, 16 bp, R. norvegicus
tctgtttctcttccat

SEQ ID NO: 521371 - DNA, 16 bp, R. norvegicus
tctgtttctttgttca

SEQ ID NO: 521372 - DNA, 16 bp, R. norvegicus
tctgtttgcctctgtc

SEQ ID NO: 521373 - DNA, 16 bp, R. norvegicus
tctgtttgtgtatgtg

SEQ ID NO: 521374 - DNA, 16 bp, R. norvegicus
tctgtttgttacttgt

SEQ ID NO: 521375 - DNA, 16 bp, R. norvegicus
tctgttttaaaagaaa

SEQ ID NO: 521376 - DNA, 16 bp, R. norvegicus
tctgttttcattcttc

SEQ ID NO: 521377 - DNA, 16 bp, R. norvegicus
tctgttttgaggcagg

SEQ ID NO: 521378 - DNA, 16 bp, R. norvegicus
tctgttttgattttca

SEQ ID NO: 521379 - DNA, 16 bp, R. norvegicus
tctgtttttcagagtg

SEQ ID NO: 521380 - DNA, 16 bp, R. norvegicus
tcttaaaaaaaaaagt

SEQ ID NO: 521381 - DNA, 16 bp, R. norvegicus
tcttaaaagaaacatt

SEQ ID NO: 521382 - DNA, 16 bp, R. norvegicus
tcttaaagaacaatca

SEQ ID NO: 521383 - DNA, 17 bp, R. norvegicus
tcttaaagcataagcca

SEQ ID NO: 521384 - DNA, 16 bp, R. norvegicus
tcttaaagtcctccag

SEQ ID NO: 521385 - DNA, 16 bp, R. norvegicus
tcttaaatctcgcagg

SEQ ID NO: 521386 - DNA, 16 bp, R. norvegicus
tcttaactgctaagca

SEQ ID NO: 521387 - DNA, 16 bp, R. norvegicus
tcttaagaaatggctg

SEQ ID NO: 521388 - DNA, 16 bp, R. norvegicus
tcttacaaactgaatc

SEQ ID NO: 521389 - DNA, 17 bp, R. norvegicus
tcttacaataaaagcct

SEQ ID NO: 521390 - DNA, 16 bp, R. norvegicus
tcttacacattaccaa

SEQ ID NO: 521391 - DNA, 16 bp, R. norvegicus
tcttacacttcagtaa

SEQ ID NO: 521392 - DNA, 16 bp, R. norvegicus
tcttacctgtgttcct

SEQ ID NO: 521393 - DNA, 16 bp, R. norvegicus
tcttactgaaagcaat

SEQ ID NO: 521394 - DNA, 16 bp, R. norvegicus
tcttagaaaacatcag

SEQ ID NO: 521395 - DNA, 16 bp, R. norvegicus
tcttagaactggagtt

SEQ ID NO: 521396 - DNA, 16 bp, R. norvegicus
tcttagaggacagtta

SEQ ID NO: 521397 - DNA, 34 bp, R. norvegicus
tcttagcaggacccagggcttccccttccactgg

SEQ ID NO: 521398 - DNA, 16 bp, R. norvegicus
tcttagccattttgat

SEQ ID NO: 521399 - DNA, 16 bp, R. norvegicus
tcttagcttcctggaa

SEQ ID NO: 521400 - DNA, 17 bp, R. norvegicus
tcttaggcatataccca

SEQ ID NO: 521401 - DNA, 40 bp, R. norvegicus
tcttatacagtttcctcttgggccagggatgtgggcaggg

SEQ ID NO: 521402 - DNA, 16 bp, R. norvegicus
tcttatactgaaacca

SEQ ID NO: 521403 - DNA, 16 bp, R. norvegicus
tcttatcaattggacc

SEQ ID NO: 521404 - DNA, 16 bp, R. norvegicus
tcttatgaatattgat

SEQ ID NO: 521405 - DNA, 16 bp, R. norvegicus
tcttatggaagagttt

SEQ ID NO: 521406 - DNA, 16 bp, R. norvegicus
tcttattgacagtgtc

SEQ ID NO: 521407 - DNA, 16 bp, R. norvegicus
tcttattgattatgtc

SEQ ID NO: 521408 - DNA, 16 bp, R. norvegicus
tcttcaaaatggatct

SEQ ID NO: 521409 - DNA, 16 bp, R. norvegicus
tcttcaaagaaaaaaa

SEQ ID NO: 521410 - DNA, 16 bp, R. norvegicus
tcttcaaagacatgaa

SEQ ID NO: 521411 - DNA, 16 bp, R. norvegicus
tcttcaaagacttgaa

SEQ ID NO: 521412 - DNA, 16 bp, R. norvegicus
tcttcaacaaactcat

SEQ ID NO: 521413 - DNA, 16 bp, R. norvegicus
tcttcaacctgtctct

SEQ ID NO: 521414 - DNA, 16 bp, R. norvegicus
tcttcaagaatttttt

SEQ ID NO: 521415 - DNA, 16 bp, R. norvegicus
tcttcaagcagtttat

SEQ ID NO: 521416 - DNA, 16 bp, R. norvegicus
tcttcaataacaagaa

SEQ ID NO: 521417 - DNA, 16 bp, R. norvegicus
tcttcaatggctttct

SEQ ID NO: 521418 - DNA, 16 bp, R. norvegicus
tcttcaatttgtttct

SEQ ID NO: 521419 - DNA, 16 bp, R. norvegicus
tcttcaattttgttcc

SEQ ID NO: 521420 - DNA, 16 bp, R. norvegicus
tcttcacaacaacaga

SEQ ID NO: 521421 - DNA, 16 bp, R. norvegicus
tcttcacagaccttga

SEQ ID NO: 521422 - DNA, 16 bp, R. norvegicus
tcttcacagcaataga

SEQ ID NO: 521423 - DNA, 16 bp, R. norvegicus
tcttcacagcaatgac

SEQ ID NO: 521424 - DNA, 16 bp, R. norvegicus
tcttcacagcactgga

SEQ ID NO: 521425 - DNA, 16 bp, R. norvegicus
tcttcacagccacaga

SEQ ID NO: 521426 - DNA, 16 bp, R. norvegicus
tcttcacagccataaa

SEQ ID NO: 521427 - DNA, 16 bp, R. norvegicus
tcttcacagccataga

SEQ ID NO: 521428 - DNA, 16 bp, R. norvegicus
tcttcacaggtcacct

SEQ ID NO: 521429 - DNA, 17 bp, R. norvegicus
tcttcacatcctcgcca

SEQ ID NO: 521430 - DNA, 19 bp, R. norvegicus
tcttcaccaccatggagaa

SEQ ID NO: 521431 - DNA, 16 bp, R. norvegicus
tcttcacctgtgtctt

SEQ ID NO: 521432 - DNA, 16 bp, R. norvegicus
tcttcagaaaccagaa

SEQ ID NO: 521433 - DNA, 16 bp, R. norvegicus
tcttcagacacaacag

SEQ ID NO: 521434 - DNA, 16 bp, R. norvegicus
tcttcagacacagaag

SEQ ID NO: 521435 - DNA, 16 bp, R. norvegicus
tcttcagacatatcag

SEQ ID NO: 521436 - DNA, 16 bp, R. norvegicus
tcttcagagacatgaa

SEQ ID NO: 521437 - DNA, 16 bp, R. norvegicus
tcttcagagacttcaa

SEQ ID NO: 521438 - DNA, 16 bp, R. norvegicus
tcttcagagactttaa

SEQ ID NO: 521439 - DNA, 16 bp, R. norvegicus
tcttcagagagaagat

SEQ ID NO: 521440 - DNA, 16 bp, R. norvegicus
tcttcagagagctaga

SEQ ID NO: 521441 - DNA, 16 bp, R. norvegicus
tcttcagagagttaca

SEQ ID NO: 521442 - DNA, 16 bp, R. norvegicus
tcttcagagcaagaaa

SEQ ID NO: 521443 - DNA, 16 bp, R. norvegicus
tcttcagagcaatgga

SEQ ID NO: 521444 - DNA, 16 bp, R. norvegicus
tcttcagaggccagaa

SEQ ID NO: 521445 - DNA, 16 bp, R. norvegicus
tcttcagagtcttcaa

SEQ ID NO: 521446 - DNA, 16 bp, R. norvegicus
tcttcagataccagaa

SEQ ID NO: 521447 - DNA, 16 bp, R. norvegicus
tcttcagattctgttg

SEQ ID NO: 521448 - DNA, 16 bp, R. norvegicus
tcttcagcttcctcca

SEQ ID NO: 521449 - DNA, 16 bp, R. norvegicus
tcttcagcttcttcaa

SEQ ID NO: 521450 - DNA, 16 bp, R. norvegicus
tcttcaggaggtctcc

SEQ ID NO: 521451 - DNA, 16 bp, R. norvegicus
tcttcaggcagcagga

SEQ ID NO: 521452 - DNA, 16 bp, R. norvegicus
tcttcagggacttgaa

SEQ ID NO: 521453 - DNA, 16 bp, R. norvegicus
tcttcagtcattttct

SEQ ID NO: 521454 - DNA, 16 bp, R. norvegicus
tcttcagtctcaggag

SEQ ID NO: 521455 - DNA, 16 bp, R. norvegicus
tcttcagtgcctgaga

SEQ ID NO: 521456 - DNA, 16 bp, R. norvegicus
tcttcatagagttaaa

SEQ ID NO: 521457 - DNA, 16 bp, R. norvegicus
tcttcatcatcaccat

SEQ ID NO: 521458 - DNA, 16 bp, R. norvegicus
tcttcatcatcatcat

SEQ ID NO: 521459 - DNA, 16 bp, R. norvegicus
tcttcatctatgttaa

SEQ ID NO: 521460 - DNA, 16 bp, R. norvegicus
tcttcatctgaaggaa

SEQ ID NO: 521461 - DNA, 16 bp, R. norvegicus
tcttcatctgcaggct

SEQ ID NO: 521462 - DNA, 16 bp, R. norvegicus
tcttcatcttcatctg

SEQ ID NO: 521463 - DNA, 16 bp, R. norvegicus
tcttcatgtaaatgaa

SEQ ID NO: 521464 - DNA, 16 bp, R. norvegicus
tcttcatgtgggcccc

SEQ ID NO: 521465 - DNA, 16 bp, R. norvegicus
tcttcatttccatccc

SEQ ID NO: 521466 - DNA, 16 bp, R. norvegicus
tcttccaaaggacctg

SEQ ID NO: 521467 - DNA, 16 bp, R. norvegicus
tcttccaccagcagcc

SEQ ID NO: 521468 - DNA, 16 bp, R. norvegicus
tcttccactgaggcca

SEQ ID NO: 521469 - DNA, 16 bp, R. norvegicus
tcttccagaaaaaaaa

SEQ ID NO: 521470 - DNA, 16 bp, R. norvegicus
tcttccagaactttct

SEQ ID NO: 521471 - DNA, 16 bp, R. norvegicus
tcttccagaagacaca

SEQ ID NO: 521472 - DNA, 16 bp, R. norvegicus
tcttccagaagaccaa

SEQ ID NO: 521473 - DNA, 16 bp, R. norvegicus
tcttccagaagcttct

SEQ ID NO: 521474 - DNA, 16 bp, R. norvegicus
tcttccagacacagca

SEQ ID NO: 521475 - DNA, 16 bp, R. norvegicus
tcttccagagaaccct

SEQ ID NO: 521476 - DNA, 16 bp, R. norvegicus
tcttccagagaatcca

SEQ ID NO: 521477 - DNA, 16 bp, R. norvegicus
tcttccagaggacctg

SEQ ID NO: 521478 - DNA, 16 bp, R. norvegicus
tcttccagaggactgg

SEQ ID NO: 521479 - DNA, 16 bp, R. norvegicus
tcttccagaggtcata

SEQ ID NO: 521480 - DNA, 16 bp, R. norvegicus
tcttccagaggtccag

SEQ ID NO: 521481 - DNA, 19 bp, R. norvegicus
tcttccagaggtcctgagc

SEQ ID NO: 521482 - DNA, 23 bp, R. norvegicus
tcttccagaggtcctgagttcaa

SEQ ID NO: 521483 - DNA, 16 bp, R. norvegicus
tcttccagaggttctg

SEQ ID NO: 521484 - DNA, 16 bp, R. norvegicus
tcttccagagtacctg

SEQ ID NO: 521485 - DNA, 16 bp, R. norvegicus
tcttccagatctttct

SEQ ID NO: 521486 - DNA, 16 bp, R. norvegicus
tcttccagcctcaaaa

SEQ ID NO: 521487 - DNA, 16 bp, R. norvegicus
tcttccagcctttcct

SEQ ID NO: 521488 - DNA, 16 bp, R. norvegicus
tcttccagcttttccc

SEQ ID NO: 521489 - DNA, 16 bp, R. norvegicus
tcttccaggcagctag

SEQ ID NO: 521490 - DNA, 16 bp, R. norvegicus
tcttccaggcagctct

SEQ ID NO: 521491 - DNA, 16 bp, R. norvegicus
tcttccagtcctttcc

SEQ ID NO: 521492 - DNA, 16 bp, R. norvegicus
tcttccagttctgtct

SEQ ID NO: 521493 - DNA, 18 bp, R. norvegicus
tcttccagttttttctct

SEQ ID NO: 521494 - DNA, 16 bp, R. norvegicus
tcttcccagtcccacc

SEQ ID NO: 521495 - DNA, 16 bp, R. norvegicus
tcttcccagtgctggg

SEQ ID NO: 521496 - DNA, 16 bp, R. norvegicus
tcttcccattcattac

SEQ ID NO: 521497 - DNA, 16 bp, R. norvegicus
tcttccccaagctgct

SEQ ID NO: 521498 - DNA, 16 bp, R. norvegicus
tcttccccaatttttc

SEQ ID NO: 521499 - DNA, 16 bp, R. norvegicus
tcttccccagagaaga

SEQ ID NO: 521500 - DNA, 16 bp, R. norvegicus
tcttccccagggaaga

SEQ ID NO: 521501 - DNA, 16 bp, R. norvegicus
tcttccccttggcctt

SEQ ID NO: 521502 - DNA, 16 bp, R. norvegicus
tcttccctggagaaga

SEQ ID NO: 521503 - DNA, 16 bp, R. norvegicus
tcttccctggggaagg

SEQ ID NO: 521504 - DNA, 16 bp, R. norvegicus
tcttccctgtggtccc

SEQ ID NO: 521505 - DNA, 16 bp, R. norvegicus
tcttcccttgggccct

SEQ ID NO: 521506 - DNA, 16 bp, R. norvegicus
tcttccgagtgctggg

SEQ ID NO: 521507 - DNA, 20 bp, R. norvegicus
tcttccgctcctgagattct

SEQ ID NO: 521508 - DNA, 16 bp, R. norvegicus
tcttccggcctccatg

SEQ ID NO: 521509 - DNA, 38 bp, R. norvegicus
tcttcctacaacaaggaggactttgtgcagccttaaaa

SEQ ID NO: 521510 - DNA, 16 bp, R. norvegicus
tcttcctagttgctgc

SEQ ID NO: 521511 - DNA, 16 bp, R. norvegicus
tcttcctatgagttgc

SEQ ID NO: 521512 - DNA, 16 bp, R. norvegicus
tcttcctcaacctcct

SEQ ID NO: 521513 - DNA, 16 bp, R. norvegicus
tcttcctcagcctcct

SEQ ID NO: 521514 - DNA, 16 bp, R. norvegicus
tcttcctcagcttcct

SEQ ID NO: 521515 - DNA, 16 bp, R. norvegicus
tcttcctcagtcactt

SEQ ID NO: 521516 - DNA, 16 bp, R. norvegicus
tcttcctcagtcattt

SEQ ID NO: 521517 - DNA, 16 bp, R. norvegicus
tcttcctcagtcttga

SEQ ID NO: 521518 - DNA, 16 bp, R. norvegicus
tcttcctcagtgttcc

SEQ ID NO: 521519 - DNA, 16 bp, R. norvegicus
tcttcctcatcctcat

SEQ ID NO: 521520 - DNA, 16 bp, R. norvegicus
tcttcctcccagtccc

SEQ ID NO: 521521 - DNA, 16 bp, R. norvegicus
tcttcctccgcatcct

SEQ ID NO: 521522 - DNA, 16 bp, R. norvegicus
tcttcctctacagcta

SEQ ID NO: 521523 - DNA, 16 bp, R. norvegicus
tcttcctctattgctt

SEQ ID NO: 521524 - DNA, 16 bp, R. norvegicus
tcttcctctcctggct

SEQ ID NO: 521525 - DNA, 16 bp, R. norvegicus
tcttcctctgtgtctg

SEQ ID NO: 521526 - DNA, 16 bp, R. norvegicus
tcttcctcttcaagat

SEQ ID NO: 521527 - DNA, 16 bp, R. norvegicus
tcttcctgaagtcctg

SEQ ID NO: 521528 - DNA, 16 bp, R. norvegicus
tcttcctgagatggtt

SEQ ID NO: 521529 - DNA, 16 bp, R. norvegicus
tcttcctgcagcagat

SEQ ID NO: 521530 - DNA, 16 bp, R. norvegicus
tcttcctgcctctgtg

SEQ ID NO: 521531 - DNA, 16 bp, R. norvegicus
tcttcctgcctctgtt

SEQ ID NO: 521532 - DNA, 16 bp, R. norvegicus
tcttcctgctgcctga

SEQ ID NO: 521533 - DNA, 16 bp, R. norvegicus
tcttcctgctgcctgt

SEQ ID NO: 521534 - DNA, 16 bp, R. norvegicus
tcttcctgctgccttc

SEQ ID NO: 521535 - DNA, 16 bp, R. norvegicus
tcttcctgctgtctgt

SEQ ID NO: 521536 - DNA, 16 bp, R. norvegicus
tcttcctgcttcagct

SEQ ID NO: 521537 - DNA, 16 bp, R. norvegicus
tcttcctgcttctctg

SEQ ID NO: 521538 - DNA, 16 bp, R. norvegicus
tcttcctggaagaggc

SEQ ID NO: 521539 - DNA, 16 bp, R. norvegicus
tcttcctggagaaagc

SEQ ID NO: 521540 - DNA, 23 bp, R. norvegicus
tcttcctggatcaactgctgatg

SEQ ID NO: 521541 - DNA, 30 bp, R. norvegicus
tcttcctggatcaactgctgatggaagttc

SEQ ID NO: 521542 - DNA, 16 bp, R. norvegicus
tcttcctggtggctgc

SEQ ID NO: 521543 - DNA, 16 bp, R. norvegicus
tcttcctgtctgtctg

SEQ ID NO: 521544 - DNA, 16 bp, R. norvegicus
tcttcctgtggaattt

SEQ ID NO: 521545 - DNA, 16 bp, R. norvegicus
tcttcctgttcctaga

SEQ ID NO: 521546 - DNA, 16 bp, R. norvegicus
tcttccttcagagact

SEQ ID NO: 521547 - DNA, 16 bp, R. norvegicus
tcttccttgaccagat

SEQ ID NO: 521548 - DNA, 16 bp, R. norvegicus
tcttccttgaccatgt

SEQ ID NO: 521549 - DNA, 16 bp, R. norvegicus
tcttccttggccagca

SEQ ID NO: 521550 - DNA, 16 bp, R. norvegicus
tcttccttggtttctg

SEQ ID NO: 521551 - DNA, 16 bp, R. norvegicus
tcttcctttccaatct

SEQ ID NO: 521552 - DNA, 16 bp, R. norvegicus
tcttccttttgttcta

SEQ ID NO: 521553 - DNA, 16 bp, R. norvegicus
tcttctaagtgggatt

SEQ ID NO: 521554 - DNA, 16 bp, R. norvegicus
tcttctacatgatgac

SEQ ID NO: 521555 - DNA, 16 bp, R. norvegicus
tcttctacatggtgac

SEQ ID NO: 521556 - DNA, 16 bp, R. norvegicus
tcttctacctgcagac

SEQ ID NO: 521557 - DNA, 16 bp, R. norvegicus
tcttctacgtgttgac

SEQ ID NO: 521558 - DNA, 16 bp, R. norvegicus
tcttctactgtgtctg

SEQ ID NO: 521559 - DNA, 16 bp, R. norvegicus
tcttctagcctccatg

SEQ ID NO: 521560 - DNA, 16 bp, R. norvegicus
tcttctcaaaagacag

SEQ ID NO: 521561 - DNA, 16 bp, R. norvegicus
tcttctcaatacctca

SEQ ID NO: 521562 - DNA, 16 bp, R. norvegicus
tcttctcacttcaaat

SEQ ID NO: 521563 - DNA, 16 bp, R. norvegicus
tcttctcagcacccca

SEQ ID NO: 521564 - DNA, 16 bp, R. norvegicus
tcttctcagcagccca

SEQ ID NO: 521565 - DNA, 16 bp, R. norvegicus
tcttctcagcatccca

SEQ ID NO: 521566 - DNA, 16 bp, R. norvegicus
tcttctcagtgctggg

SEQ ID NO: 521567 - DNA, 16 bp, R. norvegicus
tcttctccaagagcag

SEQ ID NO: 521568 - DNA, 16 bp, R. norvegicus
tcttctccagggaaga

SEQ ID NO: 521569 - DNA, 16 bp, R. norvegicus
tcttctccagtccagg

SEQ ID NO: 521570 - DNA, 16 bp, R. norvegicus
tcttctccatcccaag

SEQ ID NO: 521571 - DNA, 16 bp, R. norvegicus
tcttctccatctccca

SEQ ID NO: 521572 - DNA, 16 bp, R. norvegicus
tcttctcctattttga

SEQ ID NO: 521573 - DNA, 16 bp, R. norvegicus
tcttctcctcagagaa

SEQ ID NO: 521574 - DNA, 16 bp, R. norvegicus
tcttctcctcctattg

SEQ ID NO: 521575 - DNA, 16 bp, R. norvegicus
tcttctcctggctgcc

SEQ ID NO: 521576 - DNA, 16 bp, R. norvegicus
tcttctcggcacctca

SEQ ID NO: 521577 - DNA, 16 bp, R. norvegicus
tcttctctaaactttg

SEQ ID NO: 521578 - DNA, 16 bp, R. norvegicus
tcttctctctcctcag

SEQ ID NO: 521579 - DNA, 16 bp, R. norvegicus
tcttctctggaacaac

SEQ ID NO: 521580 - DNA, 16 bp, R. norvegicus
tcttctctttctccaa

SEQ ID NO: 521581 - DNA, 16 bp, R. norvegicus
tcttctgaaagagcag

SEQ ID NO: 521582 - DNA, 16 bp, R. norvegicus
tcttctgaactccatg

SEQ ID NO: 521583 - DNA, 16 bp, R. norvegicus
tcttctgaaggtcctg

SEQ ID NO: 521584 - DNA, 16 bp, R. norvegicus
tcttctgacttctgtg

SEQ ID NO: 521585 - DNA, 16 bp, R. norvegicus
tcttctgagagcttct

SEQ ID NO: 521586 - DNA, 16 bp, R. norvegicus
tcttctgagatcatct

SEQ ID NO: 521587 - DNA, 16 bp, R. norvegicus
tcttctgatctccaag

SEQ ID NO: 521588 - DNA, 16 bp, R. norvegicus
tcttctgatctccatg

SEQ ID NO: 521589 - DNA, 16 bp, R. norvegicus
tcttctgatttccaca

SEQ ID NO: 521590 - DNA, 16 bp, R. norvegicus
tcttctgccctctgtg

SEQ ID NO: 521591 - DNA, 16 bp, R. norvegicus
tcttctgcctctacct

SEQ ID NO: 521592 - DNA, 16 bp, R. norvegicus
tcttctgcctctgcct

SEQ ID NO: 521593 - DNA, 16 bp, R. norvegicus
tcttctgcctgttaag

SEQ ID NO: 521594 - DNA, 16 bp, R. norvegicus
tcttctgccttagcct

SEQ ID NO: 521595 - DNA, 16 bp, R. norvegicus
tcttctgctgtgtctg

SEQ ID NO: 521596 - DNA, 16 bp, R. norvegicus
tcttctggaaaagcag

SEQ ID NO: 521597 - DNA, 16 bp, R. norvegicus
tcttctggaagggcag

SEQ ID NO: 521598 - DNA, 16 bp, R. norvegicus
tcttctggaggagcag

SEQ ID NO: 521599 - DNA, 16 bp, R. norvegicus
tcttctggccaccatg

SEQ ID NO: 521600 - DNA, 16 bp, R. norvegicus
tcttctggccccttct

SEQ ID NO: 521601 - DNA, 16 bp, R. norvegicus
tcttctggcctccatg

SEQ ID NO: 521602 - DNA, 16 bp, R. norvegicus
tcttctggccttcatg

SEQ ID NO: 521603 - DNA, 16 bp, R. norvegicus
tcttctggcctttgca

SEQ ID NO: 521604 - DNA, 16 bp, R. norvegicus
tcttctggctcctgtg

SEQ ID NO: 521605 - DNA, 16 bp, R. norvegicus
tcttctggctccttct

SEQ ID NO: 521606 - DNA, 16 bp, R. norvegicus
tcttctggcttctgca

SEQ ID NO: 521607 - DNA, 16 bp, R. norvegicus
tcttctggcttcttca

SEQ ID NO: 521608 - DNA, 16 bp, R. norvegicus
tcttctggctttcaca

SEQ ID NO: 521609 - DNA, 17 bp, R. norvegicus
tcttctggtatgtctga

SEQ ID NO: 521610 - DNA, 16 bp, R. norvegicus
tcttctggtgtctgtg

SEQ ID NO: 521611 - DNA, 16 bp, R. norvegicus
tcttctggtgtgcatg

SEQ ID NO: 521612 - DNA, 16 bp, R. norvegicus
tcttctggttcaatct

SEQ ID NO: 521613 - DNA, 16 bp, R. norvegicus
tcttctggttcccaga

SEQ ID NO: 521614 - DNA, 16 bp, R. norvegicus
tcttctgtaattttgt

SEQ ID NO: 521615 - DNA, 16 bp, R. norvegicus
tcttctgtcctgggac

SEQ ID NO: 521616 - DNA, 16 bp, R. norvegicus
tcttctgtctccatct

SEQ ID NO: 521617 - DNA, 16 bp, R. norvegicus
tcttctgtctttcaca

SEQ ID NO: 521618 - DNA, 16 bp, R. norvegicus
tcttctgtgatattcc

SEQ ID NO: 521619 - DNA, 16 bp, R. norvegicus
tcttctgtgatcttca

SEQ ID NO: 521620 - DNA, 16 bp, R. norvegicus
tcttctgtgatgttcc

SEQ ID NO: 521621 - DNA, 16 bp, R. norvegicus
tcttctgttggtgatg

SEQ ID NO: 521622 - DNA, 16 bp, R. norvegicus
tcttcttagcatctca

SEQ ID NO: 521623 - DNA, 16 bp, R. norvegicus
tcttcttcaaattcat

SEQ ID NO: 521624 - DNA, 16 bp, R. norvegicus
tcttcttcaatgtctt

SEQ ID NO: 521625 - DNA, 16 bp, R. norvegicus
tcttcttcacctgcct

SEQ ID NO: 521626 - DNA, 16 bp, R. norvegicus
tcttcttcacctgctt

SEQ ID NO: 521627 - DNA, 16 bp, R. norvegicus
tcttcttcagcttcat

SEQ ID NO: 521628 - DNA, 16 bp, R. norvegicus
tcttcttcagcttcct

SEQ ID NO: 521629 - DNA, 16 bp, R. norvegicus
tcttcttcctcccaag

SEQ ID NO: 521630 - DNA, 16 bp, R. norvegicus
tcttcttgaccttcat

SEQ ID NO: 521631 - DNA, 16 bp, R. norvegicus
tcttcttgcctttgcc

SEQ ID NO: 521632 - DNA, 16 bp, R. norvegicus
tcttcttgtatgtgtt

SEQ ID NO: 521633 - DNA, 16 bp, R. norvegicus
tcttcttgtcacccac

SEQ ID NO: 521634 - DNA, 16 bp, R. norvegicus
tcttctttcttataaa

SEQ ID NO: 521635 - DNA, 16 bp, R. norvegicus
tcttctttgaattctt

SEQ ID NO: 521636 - DNA, 16 bp, R. norvegicus
tcttctttgagcatga

SEQ ID NO: 521637 - DNA, 16 bp, R. norvegicus
tcttgaaaaaaaattt

SEQ ID NO: 521638 - DNA, 16 bp, R. norvegicus
tcttgaaaaacaaata

SEQ ID NO: 521639 - DNA, 16 bp, R. norvegicus
tcttgaaaaacaacaa

SEQ ID NO: 521640 - DNA, 16 bp, R. norvegicus
tcttgaaaaacagaaa

SEQ ID NO: 521641 - DNA, 16 bp, R. norvegicus
tcttgaaaggggaaaa

SEQ ID NO: 521642 - DNA, 16 bp, R. norvegicus
tcttgaaagtgaagga

SEQ ID NO: 521643 - DNA, 17 bp, R. norvegicus
tcttgaaatggcagttg

SEQ ID NO: 521644 - DNA, 16 bp, R. norvegicus
tcttgaaccatccctg

SEQ ID NO: 521645 - DNA, 16 bp, R. norvegicus
tcttgaagaaaaaaaa

SEQ ID NO: 521646 - DNA, 16 bp, R. norvegicus
tcttgaagaggaccag

SEQ ID NO: 521647 - DNA, 16 bp, R. norvegicus
tcttgaaggaaaaaaa

SEQ ID NO: 521648 - DNA, 16 bp, R. norvegicus
tcttgagaaacaggaa

SEQ ID NO: 521649 - DNA, 16 bp, R. norvegicus
tcttgagacaggatct

SEQ ID NO: 521650 - DNA, 19 bp, R. norvegicus
tcttgagcatatacccaaa

SEQ ID NO: 521651 - DNA, 16 bp, R. norvegicus
tcttgaggcagcagag

SEQ ID NO: 521652 - DNA, 16 bp, R. norvegicus
tcttgaggctggagag

SEQ ID NO: 521653 - DNA, 16 bp, R. norvegicus
tcttgagtactggaat

SEQ ID NO: 521654 - DNA, 16 bp, R. norvegicus
tcttgagtttgaggcc

SEQ ID NO: 521655 - DNA, 16 bp, R. norvegicus
tcttgatatctagttt

SEQ ID NO: 521656 - DNA, 16 bp, R. norvegicus
tcttgatcttacagca

SEQ ID NO: 521657 - DNA, 16 bp, R. norvegicus
tcttgatcttcatgtg

SEQ ID NO: 521658 - DNA, 17 bp, R. norvegicus
tcttgatctttcaaaga

SEQ ID NO: 521659 - DNA, 16 bp, R. norvegicus
tcttgattaatgattg

SEQ ID NO: 521660 - DNA, 16 bp, R. norvegicus
tcttgatttgactttg

SEQ ID NO: 521661 - DNA, 17 bp, R. norvegicus
tcttgatttttgacaaa

SEQ ID NO: 521662 - DNA, 16 bp, R. norvegicus
tcttgcaaagaaccca

SEQ ID NO: 521663 - DNA, 16 bp, R. norvegicus
tcttgcagaagaccca

SEQ ID NO: 521664 - DNA, 16 bp, R. norvegicus
tcttgcagatgaccca

SEQ ID NO: 521665 - DNA, 16 bp, R. norvegicus
tcttgcattcagcatt

SEQ ID NO: 521666 - DNA, 16 bp, R. norvegicus
tcttgccaaaatggaa

SEQ ID NO: 521667 - DNA, 16 bp, R. norvegicus
tcttgccaagattgga

SEQ ID NO: 521668 - DNA, 16 bp, R. norvegicus
tcttgccccaccccca

SEQ ID NO: 521669 - DNA, 16 bp, R. norvegicus
tcttgccttcctgccc

SEQ ID NO: 521670 - DNA, 16 bp, R. norvegicus
tcttgcgcttcctagg

SEQ ID NO: 521671 - DNA, 16 bp, R. norvegicus
tcttgctgactctgaa

SEQ ID NO: 521672 - DNA, 16 bp, R. norvegicus
tcttgctgatgccaag

SEQ ID NO: 521673 - DNA, 16 bp, R. norvegicus
tcttgctgcctgcaga

SEQ ID NO: 521674 - DNA, 16 bp, R. norvegicus
tcttgctgctgctgct

SEQ ID NO: 521675 - DNA, 31 bp, R. norvegicus
tcttgctgctggtctccctagtgagcctgtg

SEQ ID NO: 521676 - DNA, 16 bp, R. norvegicus
tcttgctgtgtgacaa

SEQ ID NO: 521677 - DNA, 16 bp, R. norvegicus
tcttgcttatgaatat

SEQ ID NO: 521678 - DNA, 16 bp, R. norvegicus
tcttgctttgctggtg

SEQ ID NO: 521679 - DNA, 16 bp, R. norvegicus
tcttggaaagtgcctt

SEQ ID NO: 521680 - DNA, 16 bp, R. norvegicus
tcttggagaggaaaga

SEQ ID NO: 521681 - DNA, 16 bp, R. norvegicus
tcttggagatggagga

SEQ ID NO: 521682 - DNA, 16 bp, R. norvegicus
tcttggagcaactgaa

SEQ ID NO: 521683 - DNA, 16 bp, R. norvegicus
tcttggagcagaaaag

SEQ ID NO: 521684 - DNA, 16 bp, R. norvegicus
tcttggaggaaactgt

SEQ ID NO: 521685 - DNA, 16 bp, R. norvegicus
tcttggatctgttgag

SEQ ID NO: 521686 - DNA, 16 bp, R. norvegicus
tcttggattaaaggtg

SEQ ID NO: 521687 - DNA, 16 bp, R. norvegicus
tcttggattcaggttg

SEQ ID NO: 521688 - DNA, 16 bp, R. norvegicus
tcttggatttatttat

SEQ ID NO: 521689 - DNA, 16 bp, R. norvegicus
tcttggcacttgggag

SEQ ID NO: 521690 - DNA, 16 bp, R. norvegicus
tcttggcatcaccaat

SEQ ID NO: 521691 - DNA, 16 bp, R. norvegicus
tcttggcatcagcatt

SEQ ID NO: 521692 - DNA, 16 bp, R. norvegicus
tcttggctgtcctgga

SEQ ID NO: 521693 - DNA, 16 bp, R. norvegicus
tcttggcttccctcag

SEQ ID NO: 521694 - DNA, 16 bp, R. norvegicus
tcttggctttccccaa

SEQ ID NO: 521695 - DNA, 16 bp, R. norvegicus
tcttgggagcagaaga

SEQ ID NO: 521696 - DNA, 16 bp, R. norvegicus
tcttgggcagcaaaga

SEQ ID NO: 521697 - DNA, 22 bp, R. norvegicus
tcttgggccagggatgtgggcg

SEQ ID NO: 521698 - DNA, 16 bp, R. norvegicus
tcttgggctatcttta

SEQ ID NO: 521699 - DNA, 16 bp, R. norvegicus
tcttggggaatcacca

SEQ ID NO: 521700 - DNA, 16 bp, R. norvegicus
tcttggggcctctcct

SEQ ID NO: 521701 - DNA, 16 bp, R. norvegicus
tcttggggttcacagt

SEQ ID NO: 521702 - DNA, 16 bp, R. norvegicus
tcttggggtttccaag

SEQ ID NO: 521703 - DNA, 16 bp, R. norvegicus
tcttggtctccaaaaa

SEQ ID NO: 521704 - DNA, 16 bp, R. norvegicus
tcttggtctctctgtg

SEQ ID NO: 521705 - DNA, 16 bp, R. norvegicus
tcttggtggattttct

SEQ ID NO: 521706 - DNA, 16 bp, R. norvegicus
tcttggtggtgggagg

SEQ ID NO: 521707 - DNA, 16 bp, R. norvegicus
tcttggttcagtcaga

SEQ ID NO: 521708 - DNA, 16 bp, R. norvegicus
tcttggttgatttcag

SEQ ID NO: 521709 - DNA, 16 bp, R. norvegicus
tcttggttggggattt

SEQ ID NO: 521710 - DNA, 16 bp, R. norvegicus
tcttggtttctctatg

SEQ ID NO: 521711 - DNA, 16 bp, R. norvegicus
tcttgtacatttatga

SEQ ID NO: 521712 - DNA, 16 bp, R. norvegicus
tcttgtatgtttataa

SEQ ID NO: 521713 - DNA, 16 bp, R. norvegicus
tcttgtcaaatgcttt

SEQ ID NO: 521714 - DNA, 16 bp, R. norvegicus
tcttgtctcaaaaaca

SEQ ID NO: 521715 - DNA, 16 bp, R. norvegicus
tcttgtctctctgcct

SEQ ID NO: 521716 - DNA, 16 bp, R. norvegicus
tcttgtcttcagttct

SEQ ID NO: 521717 - DNA, 16 bp, R. norvegicus
tcttgtgacttctctt

SEQ ID NO: 521718 - DNA, 16 bp, R. norvegicus
tcttgtgcttcagctg

SEQ ID NO: 521719 - DNA, 16 bp, R. norvegicus
tcttgtggaatagttt

SEQ ID NO: 521720 - DNA, 16 bp, R. norvegicus
tcttgtggaggacctg

SEQ ID NO: 521721 - DNA, 16 bp, R. norvegicus
tcttgtggagtgggcc

SEQ ID NO: 521722 - DNA, 16 bp, R. norvegicus
tcttgttaattttctc

SEQ ID NO: 521723 - DNA, 16 bp, R. norvegicus
tcttgttctattacat

SEQ ID NO: 521724 - DNA, 16 bp, R. norvegicus
tcttgttgccctgtgt

SEQ ID NO: 521725 - DNA, 16 bp, R. norvegicus
tcttgttgctacttca

SEQ ID NO: 521726 - DNA, 16 bp, R. norvegicus
tcttgttgctatgata

SEQ ID NO: 521727 - DNA, 16 bp, R. norvegicus
tcttgttttggtccag

SEQ ID NO: 521728 - DNA, 16 bp, R. norvegicus
tctttaaaaaaatatg

SEQ ID NO: 521729 - DNA, 16 bp, R. norvegicus
tctttaaaaagaaaat

SEQ ID NO: 521730 - DNA, 16 bp, R. norvegicus
tctttaaaaagcacag

SEQ ID NO: 521731 - DNA, 16 bp, R. norvegicus
tctttaaaaatgttat

SEQ ID NO: 521732 - DNA, 16 bp, R. norvegicus
tctttaaaagagaaaa

SEQ ID NO: 521733 - DNA, 22 bp, R. norvegicus
tctttaaaagccttgaccttag

SEQ ID NO: 521734 - DNA, 16 bp, R. norvegicus
tctttaagaaatattt

SEQ ID NO: 521735 - DNA, 16 bp, R. norvegicus
tctttaagacaaagga

SEQ ID NO: 521736 - DNA, 16 bp, R. norvegicus
tctttaataacaataa

SEQ ID NO: 521737 - DNA, 16 bp, R. norvegicus
tctttactttaaaaaa

SEQ ID NO: 521738 - DNA, 16 bp, R. norvegicus
tctttagaaaacaaat

SEQ ID NO: 521739 - DNA, 16 bp, R. norvegicus
tctttagaaaataaaa

SEQ ID NO: 521740 - DNA, 16 bp, R. norvegicus
tctttagggtttatgg

SEQ ID NO: 521741 - DNA, 16 bp, R. norvegicus
tctttatcaaatatca

SEQ ID NO: 521742 - DNA, 16 bp, R. norvegicus
tctttatgggatttat

SEQ ID NO: 521743 - DNA, 16 bp, R. norvegicus
tctttatgtagtggct

SEQ ID NO: 521744 - DNA, 16 bp, R. norvegicus
tctttattggtaaaat

SEQ ID NO: 521745 - DNA, 16 bp, R. norvegicus
tctttatttagatttc

SEQ ID NO: 521746 - DNA, 16 bp, R. norvegicus
tctttatttttctgga

SEQ ID NO: 521747 - DNA, 16 bp, R. norvegicus
tctttcaacaagccca

SEQ ID NO: 521748 - DNA, 16 bp, R. norvegicus
tctttcaactgcttgt

SEQ ID NO: 521749 - DNA, 16 bp, R. norvegicus
tctttcaagaaagaaa

SEQ ID NO: 521750 - DNA, 16 bp, R. norvegicus
tctttcactatctagg

SEQ ID NO: 521751 - DNA, 16 bp, R. norvegicus
tctttcactgccccac

SEQ ID NO: 521752 - DNA, 16 bp, R. norvegicus
tctttcagattttcca

SEQ ID NO: 521753 - DNA, 16 bp, R. norvegicus
tctttcagcctttccc

SEQ ID NO: 521754 - DNA, 16 bp, R. norvegicus
tctttcagttgtttat

SEQ ID NO: 521755 - DNA, 16 bp, R. norvegicus
tctttcagtttttaaa

SEQ ID NO: 521756 - DNA, 16 bp, R. norvegicus
tctttcatcacagcaa

SEQ ID NO: 521757 - DNA, 16 bp, R. norvegicus
tctttcatgtggagat

SEQ ID NO: 521758 - DNA, 16 bp, R. norvegicus
tctttccaccatgtga

SEQ ID NO: 521759 - DNA, 16 bp, R. norvegicus
tctttccagccccttg

SEQ ID NO: 521760 - DNA, 16 bp, R. norvegicus
tctttccatctcctga

SEQ ID NO: 521761 - DNA, 16 bp, R. norvegicus
tctttccatcttcgga

SEQ ID NO: 521762 - DNA, 17 bp, R. norvegicus
tctttccatcttctgag

SEQ ID NO: 521763 - DNA, 16 bp, R. norvegicus
tctttcccacagcctt

SEQ ID NO: 521764 - DNA, 16 bp, R. norvegicus
tctttcctacagcctt

SEQ ID NO: 521765 - DNA, 16 bp, R. norvegicus
tctttcctctcaaata

SEQ ID NO: 521766 - DNA, 16 bp, R. norvegicus
tctttcctctttccaa

SEQ ID NO: 521767 - DNA, 16 bp, R. norvegicus
tctttcctgtgtgtgt

SEQ ID NO: 521768 - DNA, 16 bp, R. norvegicus
tctttctatgtctctg

SEQ ID NO: 521769 - DNA, 16 bp, R. norvegicus
tctttctcaaagaaaa

SEQ ID NO: 521770 - DNA, 16 bp, R. norvegicus
tctttctcaccctgtt

SEQ ID NO: 521771 - DNA, 16 bp, R. norvegicus
tctttctcagcatcct

SEQ ID NO: 521772 - DNA, 16 bp, R. norvegicus
tctttctccacaccct

SEQ ID NO: 521773 - DNA, 16 bp, R. norvegicus
tctttctccatgtcct

SEQ ID NO: 521774 - DNA, 16 bp, R. norvegicus
tctttctcctgtgact

SEQ ID NO: 521775 - DNA, 16 bp, R. norvegicus
tctttctctgcaacct

SEQ ID NO: 521776 - DNA, 16 bp, R. norvegicus
tctttctctgcatctt

SEQ ID NO: 521777 - DNA, 16 bp, R. norvegicus
tctttctctgtcactt

SEQ ID NO: 521778 - DNA, 16 bp, R. norvegicus
tctttctgcatcctct

SEQ ID NO: 521779 - DNA, 16 bp, R. norvegicus
tctttctgcctcatct

SEQ ID NO: 521780 - DNA, 16 bp, R. norvegicus
tctttctgctagccct

SEQ ID NO: 521781 - DNA, 16 bp, R. norvegicus
tctttctggctctggg

SEQ ID NO: 521782 - DNA, 16 bp, R. norvegicus
tctttctgtcttcatt

SEQ ID NO: 521783 - DNA, 16 bp, R. norvegicus
tctttctgtgtctggg

SEQ ID NO: 521784 - DNA, 16 bp, R. norvegicus
tctttcttaatgtcct

SEQ ID NO: 521785 - DNA, 16 bp, R. norvegicus
tctttcttcagagatg

SEQ ID NO: 521786 - DNA, 16 bp, R. norvegicus
tctttcttcagtttct

SEQ ID NO: 521787 - DNA, 16 bp, R. norvegicus
tctttcttgaactcct

SEQ ID NO: 521788 - DNA, 16 bp, R. norvegicus
tctttctttctgtatc

SEQ ID NO: 521789 - DNA, 16 bp, R. norvegicus
tctttctttgttggat

SEQ ID NO: 521790 - DNA, 16 bp, R. norvegicus
tctttcttttctctga

SEQ ID NO: 521791 - DNA, 16 bp, R. norvegicus
tctttgaaaaaaatta

SEQ ID NO: 521792 - DNA, 16 bp, R. norvegicus
tctttgaaaaattgga

SEQ ID NO: 521793 - DNA, 16 bp, R. norvegicus
tctttgaaaatataaa

SEQ ID NO: 521794 - DNA, 16 bp, R. norvegicus
tctttgaaaatatcaa

SEQ ID NO: 521795 - DNA, 16 bp, R. norvegicus
tctttgaaaatattta

SEQ ID NO: 521796 - DNA, 16 bp, R. norvegicus
tctttgaagaaagaaa

SEQ ID NO: 521797 - DNA, 17 bp, R. norvegicus
tctttgaagaaatggat

SEQ ID NO: 521798 - DNA, 16 bp, R. norvegicus
tctttgaagaatttga

SEQ ID NO: 521799 - DNA, 16 bp, R. norvegicus
tctttgaagagttgga

SEQ ID NO: 521800 - DNA, 16 bp, R. norvegicus
tctttgaatattttct

SEQ ID NO: 521801 - DNA, 16 bp, R. norvegicus
tctttgacagtttcat

SEQ ID NO: 521802 - DNA, 16 bp, R. norvegicus
tctttgaccattgtgt

SEQ ID NO: 521803 - DNA, 16 bp, R. norvegicus
tctttgactcttgtgt

SEQ ID NO: 521804 - DNA, 16 bp, R. norvegicus
tctttgagaaagtcaa

SEQ ID NO: 521805 - DNA, 16 bp, R. norvegicus
tctttgagaacttcat

SEQ ID NO: 521806 - DNA, 16 bp, R. norvegicus
tctttgagaatttcct

SEQ ID NO: 521807 - DNA, 16 bp, R. norvegicus
tctttgagataaggtc

SEQ ID NO: 521808 - DNA, 16 bp, R. norvegicus
tctttgatgagtatgt

SEQ ID NO: 521809 - DNA, 16 bp, R. norvegicus
tctttgatgtgttcct

SEQ ID NO: 521810 - DNA, 16 bp, R. norvegicus
tctttgatgtgtttct

SEQ ID NO: 521811 - DNA, 16 bp, R. norvegicus
tctttgcaagagcaac

SEQ ID NO: 521812 - DNA, 16 bp, R. norvegicus
tctttgcatgcttttg

SEQ ID NO: 521813 - DNA, 16 bp, R. norvegicus
tctttgccaaaggagc

SEQ ID NO: 521814 - DNA, 16 bp, R. norvegicus
tctttgcctctcactt

SEQ ID NO: 521815 - DNA, 16 bp, R. norvegicus
tctttgcctctctctg

SEQ ID NO: 521816 - DNA, 16 bp, R. norvegicus
tctttgcctgcttgct

SEQ ID NO: 521817 - DNA, 16 bp, R. norvegicus
tctttgcctgcttgtc

SEQ ID NO: 521818 - DNA, 16 bp, R. norvegicus
tctttgcctgttcctc

SEQ ID NO: 521819 - DNA, 16 bp, R. norvegicus
tctttgcttcatacat

SEQ ID NO: 521820 - DNA, 16 bp, R. norvegicus
tctttgctttgttgcc

SEQ ID NO: 521821 - DNA, 16 bp, R. norvegicus
tctttggagaccctga

SEQ ID NO: 521822 - DNA, 16 bp, R. norvegicus
tctttggatttttcct

SEQ ID NO: 521823 - DNA, 16 bp, R. norvegicus
tctttggctacacagt

SEQ ID NO: 521824 - DNA, 16 bp, R. norvegicus
tctttgggttccatat

SEQ ID NO: 521825 - DNA, 16 bp, R. norvegicus
tctttggtgcattttt

SEQ ID NO: 521826 - DNA, 16 bp, R. norvegicus
tctttggttgaggaac

SEQ ID NO: 521827 - DNA, 16 bp, R. norvegicus
tctttgtattattcaa

SEQ ID NO: 521828 - DNA, 16 bp, R. norvegicus
tctttgtcgctgaggt

SEQ ID NO: 521829 - DNA, 16 bp, R. norvegicus
tctttgtctgaagtag

SEQ ID NO: 521830 - DNA, 16 bp, R. norvegicus
tctttgtgacctctgg

SEQ ID NO: 521831 - DNA, 16 bp, R. norvegicus
tctttgtgagtttgtg

SEQ ID NO: 521832 - DNA, 16 bp, R. norvegicus
tctttgtgtggtttga

SEQ ID NO: 521833 - DNA, 16 bp, R. norvegicus
tctttgttatacgttg

SEQ ID NO: 521834 - DNA, 16 bp, R. norvegicus
tctttgttgagaagtc

SEQ ID NO: 521835 - DNA, 16 bp, R. norvegicus
tctttgttttattaaa

SEQ ID NO: 521836 - DNA, 16 bp, R. norvegicus
tctttgtttttctgaa

SEQ ID NO: 521837 - DNA, 16 bp, R. norvegicus
tcttttaaaaaaaatc

SEQ ID NO: 521838 - DNA, 16 bp, R. norvegicus
tcttttaaaaaattct

SEQ ID NO: 521839 - DNA, 16 bp, R. norvegicus
tcttttaaaaacaatt

SEQ ID NO: 521840 - DNA, 16 bp, R. norvegicus
tcttttaaaaatactt

SEQ ID NO: 521841 - DNA, 16 bp, R. norvegicus
tcttttaaaagaataa

SEQ ID NO: 521842 - DNA, 16 bp, R. norvegicus
tcttttaaagaagaaa

SEQ ID NO: 521843 - DNA, 16 bp, R. norvegicus
tcttttaaatgctttt

SEQ ID NO: 521844 - DNA, 16 bp, R. norvegicus
tcttttaaatgtattt

SEQ ID NO: 521845 - DNA, 16 bp, R. norvegicus
tcttttaattttgaaa

SEQ ID NO: 521846 - DNA, 16 bp, R. norvegicus
tcttttagttaatttg

SEQ ID NO: 521847 - DNA, 16 bp, R. norvegicus
tcttttagttgaaaat

SEQ ID NO: 521848 - DNA, 16 bp, R. norvegicus
tcttttagtttcattg

SEQ ID NO: 521849 - DNA, 16 bp, R. norvegicus
tcttttatacaaatga

SEQ ID NO: 521850 - DNA, 16 bp, R. norvegicus
tcttttcacagcaata

SEQ ID NO: 521851 - DNA, 18 bp, R. norvegicus
tcttttcaggacactccc

SEQ ID NO: 521852 - DNA, 16 bp, R. norvegicus
tcttttcattgtgccc

SEQ ID NO: 521853 - DNA, 16 bp, R. norvegicus
tcttttccaatttata

SEQ ID NO: 521854 - DNA, 16 bp, R. norvegicus
tcttttccatctcttg

SEQ ID NO: 521855 - DNA, 16 bp, R. norvegicus
tcttttccattacctc

SEQ ID NO: 521856 - DNA, 16 bp, R. norvegicus
tcttttctaaaaaaaa

SEQ ID NO: 521857 - DNA, 16 bp, R. norvegicus
tcttttctcatataat

SEQ ID NO: 521858 - DNA, 16 bp, R. norvegicus
tcttttctccaactcc

SEQ ID NO: 521859 - DNA, 16 bp, R. norvegicus
tcttttctccagtgta

SEQ ID NO: 521860 - DNA, 16 bp, R. norvegicus
tcttttctgatgactt

SEQ ID NO: 521861 - DNA, 16 bp, R. norvegicus
tcttttctggttcagt

SEQ ID NO: 521862 - DNA, 16 bp, R. norvegicus
tcttttcttgtccagt

SEQ ID NO: 521863 - DNA, 16 bp, R. norvegicus
tcttttgacctccatg

SEQ ID NO: 521864 - DNA, 16 bp, R. norvegicus
tcttttgacctctgca

SEQ ID NO: 521865 - DNA, 16 bp, R. norvegicus
tcttttggctttctat

SEQ ID NO: 521866 - DNA, 16 bp, R. norvegicus
tcttttgggtagagga

SEQ ID NO: 521867 - DNA, 16 bp, R. norvegicus
tcttttggtctccatg

SEQ ID NO: 521868 - DNA, 16 bp, R. norvegicus
tcttttgtaaaaaaaa

SEQ ID NO: 521869 - DNA, 16 bp, R. norvegicus
tcttttgtaaaatttt

SEQ ID NO: 521870 - DNA, 16 bp, R. norvegicus
tcttttgtgactgaat

SEQ ID NO: 521871 - DNA, 16 bp, R. norvegicus
tctttttaaaaaacaa

SEQ ID NO: 521872 - DNA, 16 bp, R. norvegicus
tctttttaaatgaaaa

SEQ ID NO: 521873 - DNA, 16 bp, R. norvegicus
tctttttattctagaa

SEQ ID NO: 521874 - DNA, 16 bp, R. norvegicus
tctttttattgagaaa

SEQ ID NO: 521875 - DNA, 16 bp, R. norvegicus
tctttttctctgcatt

SEQ ID NO: 521876 - DNA, 16 bp, R. norvegicus
tctttttctttaaaga

SEQ ID NO: 521877 - DNA, 16 bp, R. norvegicus
tctttttctttaactg

SEQ ID NO: 521878 - DNA, 16 bp, R. norvegicus
tctttttgtacctgtt

SEQ ID NO: 521879 - DNA, 16 bp, R. norvegicus
tctttttgtcccaaga

SEQ ID NO: 521880 - DNA, 16 bp, R. norvegicus
tcttttttaaaaaatg

SEQ ID NO: 521881 - DNA, 16 bp, R. norvegicus
tcttttttcctttgga

SEQ ID NO: 521882 - DNA, 16 bp, R. norvegicus
tctttttttaaagaca

SEQ ID NO: 521883 - DNA, 16 bp, R. norvegicus
tctttttttcaaaaaa

SEQ ID NO: 521884 - DNA, 16 bp, R. norvegicus
tctttttttcccagag

SEQ ID NO: 521885 - DNA, 16 bp, R. norvegicus
tctttttttcccattg

SEQ ID NO: 521886 - DNA, 16 bp, R. norvegicus
tgaaaaaaaaatcact

SEQ ID NO: 521887 - DNA, 16 bp, R. norvegicus
tgaaaaaaatcacaca

SEQ ID NO: 521888 - DNA, 16 bp, R. norvegicus
tgaaaaaaatgttttt

SEQ ID NO: 521889 - DNA, 21 bp, R. norvegicus
tgaaaaaagatagcattttca

SEQ ID NO: 521890 - DNA, 16 bp, R. norvegicus
tgaaaaaatgcctcca

SEQ ID NO: 521891 - DNA, 16 bp, R. norvegicus
tgaaaaaattcacaga

SEQ ID NO: 521892 - DNA, 16 bp, R. norvegicus
tgaaaaacacagatat

SEQ ID NO: 521893 - DNA, 16 bp, R. norvegicus
tgaaaaacagaaagga

SEQ ID NO: 521894 - DNA, 16 bp, R. norvegicus
tgaaaaactaaattca

SEQ ID NO: 521895 - DNA, 16 bp, R. norvegicus
tgaaaaactagggaag

SEQ ID NO: 521896 - DNA, 16 bp, R. norvegicus
tgaaaaagatggagca

SEQ ID NO: 521897 - DNA, 16 bp, R. norvegicus
tgaaaaatgcaaaaag

SEQ ID NO: 521898 - DNA, 16 bp, R. norvegicus
tgaaaacacacatgca

SEQ ID NO: 521899 - DNA, 16 bp, R. norvegicus
tgaaaacacagatatt

SEQ ID NO: 521900 - DNA, 16 bp, R. norvegicus
tgaaaacagaaaggaa

SEQ ID NO: 521901 - DNA, 16 bp, R. norvegicus
tgaaaacagaaggaaa

SEQ ID NO: 521902 - DNA, 16 bp, R. norvegicus
tgaaaacagatgcaaa

SEQ ID NO: 521903 - DNA, 16 bp, R. norvegicus
tgaaaacagcaacagt

SEQ ID NO: 521904 - DNA, 16 bp, R. norvegicus
tgaaaacataattaaa

SEQ ID NO: 521905 - DNA, 16 bp, R. norvegicus
tgaaaacattaagaaa

SEQ ID NO: 521906 - DNA, 16 bp, R. norvegicus
tgaaaaccaaaggaag

SEQ ID NO: 521907 - DNA, 16 bp, R. norvegicus
tgaaaacctttcacaa

SEQ ID NO: 521908 - DNA, 16 bp, R. norvegicus
tgaaaactttaagaca

SEQ ID NO: 521909 - DNA, 16 bp, R. norvegicus
tgaaaagaagaggtca

SEQ ID NO: 521910 - DNA, 16 bp, R. norvegicus
tgaaaagagaattata

SEQ ID NO: 521911 - DNA, 16 bp, R. norvegicus
tgaaaagatggctcag

SEQ ID NO: 521912 - DNA, 16 bp, R. norvegicus
tgaaaaggaagacaca

SEQ ID NO: 521913 - DNA, 16 bp, R. norvegicus
tgaaaagggaaacaaa

SEQ ID NO: 521914 - DNA, 16 bp, R. norvegicus
tgaaaagggagctata

SEQ ID NO: 521915 - DNA, 16 bp, R. norvegicus
tgaaaataaatatttc

SEQ ID NO: 521916 - DNA, 16 bp, R. norvegicus
tgaaaatacagaaaat

SEQ ID NO: 521917 - DNA, 16 bp, R. norvegicus
tgaaaataccctgcag

SEQ ID NO: 521918 - DNA, 16 bp, R. norvegicus
tgaaaatatcatcctg

SEQ ID NO: 521919 - DNA, 16 bp, R. norvegicus
tgaaaatattgctaag

SEQ ID NO: 521920 - DNA, 16 bp, R. norvegicus
tgaaaatatttacaat

SEQ ID NO: 521921 - DNA, 16 bp, R. norvegicus
tgaaaatatttcaaaa

SEQ ID NO: 521922 - DNA, 16 bp, R. norvegicus
tgaaaatattttagaa

SEQ ID NO: 521923 - DNA, 16 bp, R. norvegicus
tgaaaatattttatgt

SEQ ID NO: 521924 - DNA, 16 bp, R. norvegicus
tgaaaatcaaaactac

SEQ ID NO: 521925 - DNA, 16 bp, R. norvegicus
tgaaaatcttgaggaa

SEQ ID NO: 521926 - DNA, 16 bp, R. norvegicus
tgaaaatgaaaataca

SEQ ID NO: 521927 - DNA, 16 bp, R. norvegicus
tgaaaatgaagaaaca

SEQ ID NO: 521928 - DNA, 16 bp, R. norvegicus
tgaaaatgaaggaaca

SEQ ID NO: 521929 - DNA, 16 bp, R. norvegicus
tgaaaatgaaggcact

SEQ ID NO: 521930 - DNA, 16 bp, R. norvegicus
tgaaaatgatgacaca

SEQ ID NO: 521931 - DNA, 16 bp, R. norvegicus
tgaaaatgatggtaca

SEQ ID NO: 521932 - DNA, 16 bp, R. norvegicus
tgaaaatgcctaatgt

SEQ ID NO: 521933 - DNA, 16 bp, R. norvegicus
tgaaaatgcctttgac

SEQ ID NO: 521934 - DNA, 16 bp, R. norvegicus
tgaaaatgctgagaaa

SEQ ID NO: 521935 - DNA, 16 bp, R. norvegicus
tgaaaatgctgtgttt

SEQ ID NO: 521936 - DNA, 16 bp, R. norvegicus
tgaaaatggaaaatgg

SEQ ID NO: 521937 - DNA, 16 bp, R. norvegicus
tgaaaatggtaatgga

SEQ ID NO: 521938 - DNA, 16 bp, R. norvegicus
tgaaaatggtttcttt

SEQ ID NO: 521939 - DNA, 16 bp, R. norvegicus
tgaaaatgtcatacat

SEQ ID NO: 521940 - DNA, 16 bp, R. norvegicus
tgaaaatgtggagaaa

SEQ ID NO: 521941 - DNA, 16 bp, R. norvegicus
tgaaaatgtttataaa

SEQ ID NO: 521942 - DNA, 16 bp, R. norvegicus
tgaaacaaagtctcac

SEQ ID NO: 521943 - DNA, 16 bp, R. norvegicus
tgaaacaaatgaattt

SEQ ID NO: 521944 - DNA, 16 bp, R. norvegicus
tgaaacactcagtcct

SEQ ID NO: 521945 - DNA, 16 bp, R. norvegicus
tgaaacactgtttctt

SEQ ID NO: 521946 - DNA, 16 bp, R. norvegicus
tgaaacagaaaagtga

SEQ ID NO: 521947 - DNA, 16 bp, R. norvegicus
tgaaacagatggagga

SEQ ID NO: 521948 - DNA, 16 bp, R. norvegicus
tgaaacagatggatcc

SEQ ID NO: 521949 - DNA, 16 bp, R. norvegicus
tgaaacagggtctctc

SEQ ID NO: 521950 - DNA, 16 bp, R. norvegicus
tgaaacattcacattt

SEQ ID NO: 521951 - DNA, 16 bp, R. norvegicus
tgaaacattccttcct

SEQ ID NO: 521952 - DNA, 16 bp, R. norvegicus
tgaaaccaaaagaaga

SEQ ID NO: 521953 - DNA, 16 bp, R. norvegicus
tgaaacccaagaagga

SEQ ID NO: 521954 - DNA, 16 bp, R. norvegicus
tgaaaccctggtgacc

SEQ ID NO: 521955 - DNA, 16 bp, R. norvegicus
tgaaaccctgtctgaa

SEQ ID NO: 521956 - DNA, 16 bp, R. norvegicus
tgaaactcaaaaagaa

SEQ ID NO: 521957 - DNA, 16 bp, R. norvegicus
tgaaactcaagaatga

SEQ ID NO: 521958 - DNA, 16 bp, R. norvegicus
tgaaactcaagaggaa

SEQ ID NO: 521959 - DNA, 16 bp, R. norvegicus
tgaaactcacaaagaa

SEQ ID NO: 521960 - DNA, 16 bp, R. norvegicus
tgaaactcataggcaa

SEQ ID NO: 521961 - DNA, 16 bp, R. norvegicus
tgaaactctagaagaa

SEQ ID NO: 521962 - DNA, 16 bp, R. norvegicus
tgaaactctgtctcaa

SEQ ID NO: 521963 - DNA, 16 bp, R. norvegicus
tgaaactgaacagatt

SEQ ID NO: 521964 - DNA, 16 bp, R. norvegicus
tgaaactgtgagcaag

SEQ ID NO: 521965 - DNA, 16 bp, R. norvegicus
tgaaagaaaacaggcc

SEQ ID NO: 521966 - DNA, 16 bp, R. norvegicus
tgaaagaaaacagttc

SEQ ID NO: 521967 - DNA, 16 bp, R. norvegicus
tgaaagaaaatgcaaa

SEQ ID NO: 521968 - DNA, 16 bp, R. norvegicus
tgaaagaaagcaagaa

SEQ ID NO: 521969 - DNA, 16 bp, R. norvegicus
tgaaagaaagcaagga

SEQ ID NO: 521970 - DNA, 16 bp, R. norvegicus
tgaaagaaatacaaga

SEQ ID NO: 521971 - DNA, 16 bp, R. norvegicus
tgaaagaacacaggaa

SEQ ID NO: 521972 - DNA, 16 bp, R. norvegicus
tgaaagaactaaacca

SEQ ID NO: 521973 - DNA, 16 bp, R. norvegicus
tgaaagaactccagga

SEQ ID NO: 521974 - DNA, 16 bp, R. norvegicus
tgaaagaacttcaggg

SEQ ID NO: 521975 - DNA, 16 bp, R. norvegicus
tgaaagaacttgaagg

SEQ ID NO: 521976 - DNA, 16 bp, R. norvegicus
tgaaagaagaaaacca

SEQ ID NO: 521977 - DNA, 16 bp, R. norvegicus
tgaaagaagattattt

SEQ ID NO: 521978 - DNA, 16 bp, R. norvegicus
tgaaagaattaaacaa

SEQ ID NO: 521979 - DNA, 16 bp, R. norvegicus
tgaaagaattcaggaa

SEQ ID NO: 521980 - DNA, 16 bp, R. norvegicus
tgaaagaattccaaga

SEQ ID NO: 521981 - DNA, 16 bp, R. norvegicus
tgaaagacaaaggaca

SEQ ID NO: 521982 - DNA, 16 bp, R. norvegicus
tgaaagacagaaagga

SEQ ID NO: 521983 - DNA, 16 bp, R. norvegicus
tgaaagacctttatga

SEQ ID NO: 521984 - DNA, 16 bp, R. norvegicus
tgaaagactatgggga

SEQ ID NO: 521985 - DNA, 16 bp, R. norvegicus
tgaaagagaaactaaa

SEQ ID NO: 521986 - DNA, 16 bp, R. norvegicus
tgaaagagagacagac

SEQ ID NO: 521987 - DNA, 16 bp, R. norvegicus
tgaaagagatgaaggg

SEQ ID NO: 521988 - DNA, 16 bp, R. norvegicus
tgaaagagcagtcagg

SEQ ID NO: 521989 - DNA, 16 bp, R. norvegicus
tgaaagagctgaagaa

SEQ ID NO: 521990 - DNA, 16 bp, R. norvegicus
tgaaagagctgaaggt

SEQ ID NO: 521991 - DNA, 16 bp, R. norvegicus
tgaaagagcttgaaga

SEQ ID NO: 521992 - DNA, 16 bp, R. norvegicus
tgaaagagttagatgc

SEQ ID NO: 521993 - DNA, 16 bp, R. norvegicus
tgaaagataaaaccac

SEQ ID NO: 521994 - DNA, 16 bp, R. norvegicus
tgaaagatatgtatga

SEQ ID NO: 521995 - DNA, 16 bp, R. norvegicus
tgaaagatgtatatga

SEQ ID NO: 521996 - DNA, 16 bp, R. norvegicus
tgaaagatgtgtatga

SEQ ID NO: 521997 - DNA, 44 bp, R. norvegicus
tgaaagattagaagctttaagaaggaaaggtgcacctaagaaaa

SEQ ID NO: 521998 - DNA, 16 bp, R. norvegicus
tgaaagattcagagaa

SEQ ID NO: 521999 - DNA, 16 bp, R. norvegicus
tgaaagatttatatga

SEQ ID NO: 522000 - DNA, 16 bp, R. norvegicus
tgaaagcaagcaggca

SEQ ID NO: 522001 - DNA, 16 bp, R. norvegicus
tgaaagcatctttaaa

SEQ ID NO: 522002 - DNA, 20 bp, R. norvegicus
tgaaagccttggtatagagg

SEQ ID NO: 522003 - DNA, 16 bp, R. norvegicus
tgaaagcctttgttct

SEQ ID NO: 522004 - DNA, 16 bp, R. norvegicus
tgaaagctagccagca

SEQ ID NO: 522005 - DNA, 16 bp, R. norvegicus
tgaaaggaaacaggtc

SEQ ID NO: 522006 - DNA, 16 bp, R. norvegicus
tgaaaggaaagaacca

SEQ ID NO: 522007 - DNA, 16 bp, R. norvegicus
tgaaaggaaagaactg

SEQ ID NO: 522008 - DNA, 16 bp, R. norvegicus
tgaaaggagagaacca

SEQ ID NO: 522009 - DNA, 17 bp, R. norvegicus
tgaaaggagttaaagct

SEQ ID NO: 522010 - DNA, 16 bp, R. norvegicus
tgaaaggatttttaaa

SEQ ID NO: 522011 - DNA, 16 bp, R. norvegicus
tgaaaggcaaaggaca

SEQ ID NO: 522012 - DNA, 16 bp, R. norvegicus
tgaaaggcagaagcag

SEQ ID NO: 522013 - DNA, 16 bp, R. norvegicus
tgaaagggaaataaca

SEQ ID NO: 522014 - DNA, 16 bp, R. norvegicus
tgaaagggactggata

SEQ ID NO: 522015 - DNA, 16 bp, R. norvegicus
tgaaagtcctggaaag

SEQ ID NO: 522016 - DNA, 16 bp, R. norvegicus
tgaaagtggttattct

SEQ ID NO: 522017 - DNA, 16 bp, R. norvegicus
tgaaagtgtgttgaat

SEQ ID NO: 522018 - DNA, 16 bp, R. norvegicus
tgaaagtgttcatcag

SEQ ID NO: 522019 - DNA, 16 bp, R. norvegicus
tgaaagttaattttat

SEQ ID NO: 522020 - DNA, 16 bp, R. norvegicus
tgaaagttctagaaga

SEQ ID NO: 522021 - DNA, 16 bp, R. norvegicus
tgaaataaaatgcaaa

SEQ ID NO: 522022 - DNA, 16 bp, R. norvegicus
tgaaatagcaacaaaa

SEQ ID NO: 522023 - DNA, 16 bp, R. norvegicus
tgaaatccagaagtgt

SEQ ID NO: 522024 - DNA, 16 bp, R. norvegicus
tgaaatccccattaaa

SEQ ID NO: 522025 - DNA, 16 bp, R. norvegicus
tgaaatctctctctct

SEQ ID NO: 522026 - DNA, 16 bp, R. norvegicus
tgaaatgaaaactcaa

SEQ ID NO: 522027 - DNA, 16 bp, R. norvegicus
tgaaatgtgaaaataa

SEQ ID NO: 522028 - DNA, 16 bp, R. norvegicus
tgaaatgttatataga

SEQ ID NO: 522029 - DNA, 16 bp, R. norvegicus
tgaaattcaataaaaa

SEQ ID NO: 522030 - DNA, 16 bp, R. norvegicus
tgaaattcaatgaaaa

SEQ ID NO: 522031 - DNA, 16 bp, R. norvegicus
tgaaattcataggcag

SEQ ID NO: 522032 - DNA, 16 bp, R. norvegicus
tgaaattcctgctgcc

SEQ ID NO: 522033 - DNA, 16 bp, R. norvegicus
tgaaattcttaagaaa

SEQ ID NO: 522034 - DNA, 16 bp, R. norvegicus
tgaaattgccaaagaa

SEQ ID NO: 522035 - DNA, 16 bp, R. norvegicus
tgaaattgccaaataa

SEQ ID NO: 522036 - DNA, 16 bp, R. norvegicus
tgaaatttcagggttg

SEQ ID NO: 522037 - DNA, 16 bp, R. norvegicus
tgaaatttccaaagaa

SEQ ID NO: 522038 - DNA, 16 bp, R. norvegicus
tgaaattttctcatct

SEQ ID NO: 522039 - DNA, 16 bp, R. norvegicus
tgaacaaaatggactt

SEQ ID NO: 522040 - DNA, 16 bp, R. norvegicus
tgaacaaattgaaaat

SEQ ID NO: 522041 - DNA, 16 bp, R. norvegicus
tgaacaacagaaagag

SEQ ID NO: 522042 - DNA, 16 bp, R. norvegicus
tgaacaagactggcac

SEQ ID NO: 522043 - DNA, 16 bp, R. norvegicus
tgaacaaggaatagtt

SEQ ID NO: 522044 - DNA, 16 bp, R. norvegicus
tgaacaaggctctact

SEQ ID NO: 522045 - DNA, 16 bp, R. norvegicus
tgaacaagtagaagcc

SEQ ID NO: 522046 - DNA, 16 bp, R. norvegicus
tgaacacacatatgca

SEQ ID NO: 522047 - DNA, 16 bp, R. norvegicus
tgaacacagagaagtc

SEQ ID NO: 522048 - DNA, 16 bp, R. norvegicus
tgaacacagcctccac

SEQ ID NO: 522049 - DNA, 16 bp, R. norvegicus
tgaacacagtggagta

SEQ ID NO: 522050 - DNA, 16 bp, R. norvegicus
tgaacaccaatgccaa

SEQ ID NO: 522051 - DNA, 16 bp, R. norvegicus
tgaacacccaggaatg

SEQ ID NO: 522052 - DNA, 16 bp, R. norvegicus
tgaacaggaaaagagg

SEQ ID NO: 522053 - DNA, 16 bp, R. norvegicus
tgaacataggattatt

SEQ ID NO: 522054 - DNA, 16 bp, R. norvegicus
tgaacataggggagca

SEQ ID NO: 522055 - DNA, 16 bp, R. norvegicus
tgaacatagtgcagca

SEQ ID NO: 522056 - DNA, 16 bp, R. norvegicus
tgaacatagtggatca

SEQ ID NO: 522057 - DNA, 16 bp, R. norvegicus
tgaacatatttataat

SEQ ID NO: 522058 - DNA, 16 bp, R. norvegicus
tgaacatcaatgtgga

SEQ ID NO: 522059 - DNA, 16 bp, R. norvegicus
tgaacatccaaacaca

SEQ ID NO: 522060 - DNA, 19 bp, R. norvegicus
tgaacatctctacctccag

SEQ ID NO: 522061 - DNA, 16 bp, R. norvegicus
tgaacatctgtgcccc

SEQ ID NO: 522062 - DNA, 16 bp, R. norvegicus
tgaacatgatgctgga

SEQ ID NO: 522063 - DNA, 16 bp, R. norvegicus
tgaacatggaaataga

SEQ ID NO: 522064 - DNA, 16 bp, R. norvegicus
tgaacatggagaagtc

SEQ ID NO: 522065 - DNA, 16 bp, R. norvegicus
tgaacatgggagattt

SEQ ID NO: 522066 - DNA, 16 bp, R. norvegicus
tgaacattgtggagca

SEQ ID NO: 522067 - DNA, 16 bp, R. norvegicus
tgaacattttttattt

SEQ ID NO: 522068 - DNA, 16 bp, R. norvegicus
tgaaccacaaaccaaa

SEQ ID NO: 522069 - DNA, 16 bp, R. norvegicus
tgaaccacaatgccaa

SEQ ID NO: 522070 - DNA, 16 bp, R. norvegicus
tgaaccacatggactt

SEQ ID NO: 522071 - DNA, 16 bp, R. norvegicus
tgaaccagagagaaaa

SEQ ID NO: 522072 - DNA, 16 bp, R. norvegicus
tgaaccagcaccagtt

SEQ ID NO: 522073 - DNA, 16 bp, R. norvegicus
tgaaccagcactgttt

SEQ ID NO: 522074 - DNA, 16 bp, R. norvegicus
tgaaccagccatccag

SEQ ID NO: 522075 - DNA, 16 bp, R. norvegicus
tgaaccagggacctct

SEQ ID NO: 522076 - DNA, 16 bp, R. norvegicus
tgaaccagtagctttt

SEQ ID NO: 522077 - DNA, 16 bp, R. norvegicus
tgaaccatcttcccag

SEQ ID NO: 522078 - DNA, 16 bp, R. norvegicus
tgaaccatcttctcag

SEQ ID NO: 522079 - DNA, 16 bp, R. norvegicus
tgaaccatgcagtcaa

SEQ ID NO: 522080 - DNA, 16 bp, R. norvegicus
tgaacccagacccgga

SEQ ID NO: 522081 - DNA, 16 bp, R. norvegicus
tgaacccaggtccact

SEQ ID NO: 522082 - DNA, 16 bp, R. norvegicus
tgaacccaggtccttg

SEQ ID NO: 522083 - DNA, 16 bp, R. norvegicus
tgaaccccagtgaatg

SEQ ID NO: 522084 - DNA, 16 bp, R. norvegicus
tgaaccccattgttta

SEQ ID NO: 522085 - DNA, 16 bp, R. norvegicus
tgaaccgagagaagag

SEQ ID NO: 522086 - DNA, 16 bp, R. norvegicus
tgaacctcagaaccta

SEQ ID NO: 522087 - DNA, 16 bp, R. norvegicus
tgaacctccttttcct

SEQ ID NO: 522088 - DNA, 16 bp, R. norvegicus
tgaacctctgaatttg

SEQ ID NO: 522089 - DNA, 17 bp, R. norvegicus
tgaacctctgtggccat

SEQ ID NO: 522090 - DNA, 16 bp, R. norvegicus
tgaacctgcaagccag

SEQ ID NO: 522091 - DNA, 16 bp, R. norvegicus
tgaacctggtcctctg

SEQ ID NO: 522092 - DNA, 16 bp, R. norvegicus
tgaacgtagtggagca

SEQ ID NO: 522093 - DNA, 16 bp, R. norvegicus
tgaactaaatggactt

SEQ ID NO: 522094 - DNA, 16 bp, R. norvegicus
tgaactacaacccaga

SEQ ID NO: 522095 - DNA, 16 bp, R. norvegicus
tgaactacctgaagac

SEQ ID NO: 522096 - DNA, 16 bp, R. norvegicus
tgaactacctgagaac

SEQ ID NO: 522097 - DNA, 16 bp, R. norvegicus
tgaactagaaaatata

SEQ ID NO: 522098 - DNA, 16 bp, R. norvegicus
tgaactataatgtaaa

SEQ ID NO: 522099 - DNA, 16 bp, R. norvegicus
tgaactatttctccag

SEQ ID NO: 522100 - DNA, 16 bp, R. norvegicus
tgaactcaaagagatc

SEQ ID NO: 522101 - DNA, 16 bp, R. norvegicus
tgaactcaagacctca

SEQ ID NO: 522102 - DNA, 16 bp, R. norvegicus
tgaactcaagacctgt

SEQ ID NO: 522103 - DNA, 16 bp, R. norvegicus
tgaactcaagatctct

SEQ ID NO: 522104 - DNA, 16 bp, R. norvegicus
tgaactcaattcttca

SEQ ID NO: 522105 - DNA, 16 bp, R. norvegicus
tgaactcacagagagc

SEQ ID NO: 522106 - DNA, 16 bp, R. norvegicus
tgaactcacagagatc

SEQ ID NO: 522107 - DNA, 16 bp, R. norvegicus
tgaactcacagatacc

SEQ ID NO: 522108 - DNA, 16 bp, R. norvegicus
tgaactcacatcctct

SEQ ID NO: 522109 - DNA, 16 bp, R. norvegicus
tgaactcagagagatc

SEQ ID NO: 522110 - DNA, 16 bp, R. norvegicus
tgaactcaggacctga

SEQ ID NO: 522111 - DNA, 16 bp, R. norvegicus
tgaactcaggagctct

SEQ ID NO: 522112 - DNA, 16 bp, R. norvegicus
tgaactcaggtcccca

SEQ ID NO: 522113 - DNA, 16 bp, R. norvegicus
tgaactcattgtcaca

SEQ ID NO: 522114 - DNA, 16 bp, R. norvegicus
tgaactgaactctaat

SEQ ID NO: 522115 - DNA, 16 bp, R. norvegicus
tgaactgcactgactg

SEQ ID NO: 522116 - DNA, 16 bp, R. norvegicus
tgaactgcatgaggat

SEQ ID NO: 522117 - DNA, 16 bp, R. norvegicus
tgaactggaagctcag

SEQ ID NO: 522118 - DNA, 16 bp, R. norvegicus
tgaactggattgctgg

SEQ ID NO: 522119 - DNA, 16 bp, R. norvegicus
tgaactgtatccccag

SEQ ID NO: 522120 - DNA, 16 bp, R. norvegicus
tgaacttaattcccca

SEQ ID NO: 522121 - DNA, 16 bp, R. norvegicus
tgaacttcaaattgtt

SEQ ID NO: 522122 - DNA, 16 bp, R. norvegicus
tgaacttctgattccc

SEQ ID NO: 522123 - DNA, 16 bp, R. norvegicus
tgaacttctgctcttc

SEQ ID NO: 522124 - DNA, 16 bp, R. norvegicus
tgaacttgagtcttct

SEQ ID NO: 522125 - DNA, 16 bp, R. norvegicus
tgaactttccttccca

SEQ ID NO: 522126 - DNA, 16 bp, R. norvegicus
tgaacttttaatatgt

SEQ ID NO: 522127 - DNA, 16 bp, R. norvegicus
tgaagaaaaacatttt

SEQ ID NO: 522128 - DNA, 16 bp, R. norvegicus
tgaagaaaacacaaac

SEQ ID NO: 522129 - DNA, 16 bp, R. norvegicus
tgaagaaaactgactt

SEQ ID NO: 522130 - DNA, 16 bp, R. norvegicus
tgaagaaaagatcatc

SEQ ID NO: 522131 - DNA, 16 bp, R. norvegicus
tgaagaaaagcagaaa

SEQ ID NO: 522132 - DNA, 16 bp, R. norvegicus
tgaagaaaaggtcatg

SEQ ID NO: 522133 - DNA, 16 bp, R. norvegicus
tgaagaaaagttcatc

SEQ ID NO: 522134 - DNA, 16 bp, R. norvegicus
tgaagaaaatatcaaa

SEQ ID NO: 522135 - DNA, 16 bp, R. norvegicus
tgaagaaaatattcaa

SEQ ID NO: 522136 - DNA, 16 bp, R. norvegicus
tgaagaaaatgactcc

SEQ ID NO: 522137 - DNA, 16 bp, R. norvegicus
tgaagaaaatgcccca

SEQ ID NO: 522138 - DNA, 16 bp, R. norvegicus
tgaagaaacacacaca

SEQ ID NO: 522139 - DNA, 16 bp, R. norvegicus
tgaagaaactgaagca

SEQ ID NO: 522140 - DNA, 16 bp, R. norvegicus
tgaagaaactgaagga

SEQ ID NO: 522141 - DNA, 16 bp, R. norvegicus
tgaagaaactgcaagg

SEQ ID NO: 522142 - DNA, 16 bp, R. norvegicus
tgaagaaagaacttga

SEQ ID NO: 522143 - DNA, 16 bp, R. norvegicus
tgaagaaagaatttga

SEQ ID NO: 522144 - DNA, 16 bp, R. norvegicus
tgaagaaagacatgaa

SEQ ID NO: 522145 - DNA, 16 bp, R. norvegicus
tgaagaaagcaattga

SEQ ID NO: 522146 - DNA, 16 bp, R. norvegicus
tgaagaaatcagaaaa

SEQ ID NO: 522147 - DNA, 16 bp, R. norvegicus
tgaagaaatgaatgaa

SEQ ID NO: 522148 - DNA, 16 bp, R. norvegicus
tgaagaaattgaagaa

SEQ ID NO: 522149 - DNA, 16 bp, R. norvegicus
tgaagaacaagctgca

SEQ ID NO: 522150 - DNA, 16 bp, R. norvegicus
tgaagaacattgtcaa

SEQ ID NO: 522151 - DNA, 16 bp, R. norvegicus
tgaagaacattttgaa

SEQ ID NO: 522152 - DNA, 16 bp, R. norvegicus
tgaagaacctgatcaa

SEQ ID NO: 522153 - DNA, 16 bp, R. norvegicus
tgaagaactcaagaaa

SEQ ID NO: 522154 - DNA, 16 bp, R. norvegicus
tgaagaactcagaaga

SEQ ID NO: 522155 - DNA, 16 bp, R. norvegicus
tgaagaactctcagct

SEQ ID NO: 522156 - DNA, 16 bp, R. norvegicus
tgaagaactgagttca

SEQ ID NO: 522157 - DNA, 16 bp, R. norvegicus
tgaagaactgagtttg

SEQ ID NO: 522158 - DNA, 16 bp, R. norvegicus
tgaagaacttccagac

SEQ ID NO: 522159 - DNA, 16 bp, R. norvegicus
tgaagaacttccttag

SEQ ID NO: 522160 - DNA, 16 bp, R. norvegicus
tgaagaacttttccca

SEQ ID NO: 522161 - DNA, 16 bp, R. norvegicus
tgaagaagaaaattga

SEQ ID NO: 522162 - DNA, 16 bp, R. norvegicus
tgaagaagaaattgaa

SEQ ID NO: 522163 - DNA, 16 bp, R. norvegicus
tgaagaagaaggatga

SEQ ID NO: 522164 - DNA, 16 bp, R. norvegicus
tgaagaagaatgcaga

SEQ ID NO: 522165 - DNA, 16 bp, R. norvegicus
tgaagaagaatttcag

SEQ ID NO: 522166 - DNA, 16 bp, R. norvegicus
tgaagaagaccccaga

SEQ ID NO: 522167 - DNA, 16 bp, R. norvegicus
tgaagaagatgaaggg

SEQ ID NO: 522168 - DNA, 16 bp, R. norvegicus
tgaagaagcaccatga

SEQ ID NO: 522169 - DNA, 17 bp, R. norvegicus
tgaagaagccagaagag

SEQ ID NO: 522170 - DNA, 16 bp, R. norvegicus
tgaagaagctgaagca

SEQ ID NO: 522171 - DNA, 16 bp, R. norvegicus
tgaagaagctgaagga

SEQ ID NO: 522172 - DNA, 16 bp, R. norvegicus
tgaagaagctgaaggg

SEQ ID NO: 522173 - DNA, 16 bp, R. norvegicus
tgaagaagctggccag

SEQ ID NO: 522174 - DNA, 16 bp, R. norvegicus
tgaagaaggagctgag

SEQ ID NO: 522175 - DNA, 16 bp, R. norvegicus
tgaagaagtgtgtgtg

SEQ ID NO: 522176 - DNA, 16 bp, R. norvegicus
tgaagaagttagagaa

SEQ ID NO: 522177 - DNA, 16 bp, R. norvegicus
tgaagaagttctcaga

SEQ ID NO: 522178 - DNA, 16 bp, R. norvegicus
tgaagaatatcaaatg

SEQ ID NO: 522179 - DNA, 16 bp, R. norvegicus
tgaagaatcagagaaa

SEQ ID NO: 522180 - DNA, 16 bp, R. norvegicus
tgaagaatccttcatc

SEQ ID NO: 522181 - DNA, 16 bp, R. norvegicus
tgaagaattattttta

SEQ ID NO: 522182 - DNA, 16 bp, R. norvegicus
tgaagaattcagggat

SEQ ID NO: 522183 - DNA, 16 bp, R. norvegicus
tgaagaattctatcaa

SEQ ID NO: 522184 - DNA, 16 bp, R. norvegicus
tgaagaattctgccaa

SEQ ID NO: 522185 - DNA, 16 bp, R. norvegicus
tgaagaattgcattgg

SEQ ID NO: 522186 - DNA, 26 bp, R. norvegicus
tgaagaatttgtggtagaaaaagtac

SEQ ID NO: 522187 - DNA, 16 bp, R. norvegicus
tgaagacaaacagaag

SEQ ID NO: 522188 - DNA, 16 bp, R. norvegicus
tgaagacaaagaaatg

SEQ ID NO: 522189 - DNA, 16 bp, R. norvegicus
tgaagacaagatagaa

SEQ ID NO: 522190 - DNA, 16 bp, R. norvegicus
tgaagacaatgacagt

SEQ ID NO: 522191 - DNA, 16 bp, R. norvegicus
tgaagacactgaagaa

SEQ ID NO: 522192 - DNA, 16 bp, R. norvegicus
tgaagacagagcactc

SEQ ID NO: 522193 - DNA, 16 bp, R. norvegicus
tgaagacagcaacatt

SEQ ID NO: 522194 - DNA, 16 bp, R. norvegicus
tgaagacagctacact

SEQ ID NO: 522195 - DNA, 16 bp, R. norvegicus
tgaagacagcttcagt

SEQ ID NO: 522196 - DNA, 16 bp, R. norvegicus
tgaagacagggacagt

SEQ ID NO: 522197 - DNA, 16 bp, R. norvegicus
tgaagacagtgatggt

SEQ ID NO: 522198 - DNA, 16 bp, R. norvegicus
tgaagacagtgtactt

SEQ ID NO: 522199 - DNA, 16 bp, R. norvegicus
tgaagaccaagaaata

SEQ ID NO: 522200 - DNA, 16 bp, R. norvegicus
tgaagaccaagctgaa

SEQ ID NO: 522201 - DNA, 16 bp, R. norvegicus
tgaagaccaagctgca

SEQ ID NO: 522202 - DNA, 16 bp, R. norvegicus
tgaagaccactttgac

SEQ ID NO: 522203 - DNA, 16 bp, R. norvegicus
tgaagaccagaagatc

SEQ ID NO: 522204 - DNA, 16 bp, R. norvegicus
tgaagaccagcaaagc

SEQ ID NO: 522205 - DNA, 16 bp, R. norvegicus
tgaagaccagctgaga

SEQ ID NO: 522206 - DNA, 55 bp, R. norvegicus
tgaagacccagaaatgaacccacacacctatgggcacttgatttttgacaaagga

SEQ ID NO: 522207 - DNA, 25 bp, R. norvegicus
tgaagacccagaaatgaacccacat

SEQ ID NO: 522208 - DNA, 20 bp, R. norvegicus
tgaagacccagaaatgaact

SEQ ID NO: 522209 - DNA, 16 bp, R. norvegicus
tgaagacccagctgca

SEQ ID NO: 522210 - DNA, 16 bp, R. norvegicus
tgaagacctgagttca

SEQ ID NO: 522211 - DNA, 23 bp, R. norvegicus
tgaagactattggaaaaggaagc

SEQ ID NO: 522212 - DNA, 16 bp, R. norvegicus
tgaagactcccaactt

SEQ ID NO: 522213 - DNA, 16 bp, R. norvegicus
tgaagacttagaaatg

SEQ ID NO: 522214 - DNA, 16 bp, R. norvegicus
tgaagacttgatgccc

SEQ ID NO: 522215 - DNA, 16 bp, R. norvegicus
tgaagagaaacagaaa

SEQ ID NO: 522216 - DNA, 16 bp, R. norvegicus
tgaagagaacatcaat

SEQ ID NO: 522217 - DNA, 16 bp, R. norvegicus
tgaagagaagctgctg

SEQ ID NO: 522218 - DNA, 16 bp, R. norvegicus
tgaagagacacaatga

SEQ ID NO: 522219 - DNA, 16 bp, R. norvegicus
tgaagagacaccatga

SEQ ID NO: 522220 - DNA, 16 bp, R. norvegicus
tgaagagacaccatgg

SEQ ID NO: 522221 - DNA, 16 bp, R. norvegicus
tgaagagactgtgtgc

SEQ ID NO: 522222 - DNA, 16 bp, R. norvegicus
tgaagagagtggggtg

SEQ ID NO: 522223 - DNA, 16 bp, R. norvegicus
tgaagagataccatgg

SEQ ID NO: 522224 - DNA, 16 bp, R. norvegicus
tgaagagatcacctcc

SEQ ID NO: 522225 - DNA, 16 bp, R. norvegicus
tgaagagatgactcag

SEQ ID NO: 522226 - DNA, 16 bp, R. norvegicus
tgaagagatgatagaa

SEQ ID NO: 522227 - DNA, 16 bp, R. norvegicus
tgaagagatggctcag

SEQ ID NO: 522228 - DNA, 16 bp, R. norvegicus
tgaagagatggctgag

SEQ ID NO: 522229 - DNA, 16 bp, R. norvegicus
tgaagagattgctcag

SEQ ID NO: 522230 - DNA, 16 bp, R. norvegicus
tgaagagcaactgagg

SEQ ID NO: 522231 - DNA, 16 bp, R. norvegicus
tgaagagcaatgtgga

SEQ ID NO: 522232 - DNA, 16 bp, R. norvegicus
tgaagagctacaggaa

SEQ ID NO: 522233 - DNA, 16 bp, R. norvegicus
tgaagagctggctcag

SEQ ID NO: 522234 - DNA, 16 bp, R. norvegicus
tgaagagcttgaagga

SEQ ID NO: 522235 - DNA, 16 bp, R. norvegicus
tgaagaggaaacagaa

SEQ ID NO: 522236 - DNA, 16 bp, R. norvegicus
tgaagaggaaatgaat

SEQ ID NO: 522237 - DNA, 16 bp, R. norvegicus
tgaagaggacaaatag

SEQ ID NO: 522238 - DNA, 16 bp, R. norvegicus
tgaagaggacccagca

SEQ ID NO: 522239 - DNA, 16 bp, R. norvegicus
tgaagaggacctgggt

SEQ ID NO: 522240 - DNA, 16 bp, R. norvegicus
tgaagaggagagagcc

SEQ ID NO: 522241 - DNA, 16 bp, R. norvegicus
tgaagaggatgtggag

SEQ ID NO: 522242 - DNA, 16 bp, R. norvegicus
tgaagaggccagagga

SEQ ID NO: 522243 - DNA, 16 bp, R. norvegicus
tgaagaggccatctcc

SEQ ID NO: 522244 - DNA, 16 bp, R. norvegicus
tgaagaggtagctcag

SEQ ID NO: 522245 - DNA, 16 bp, R. norvegicus
tgaagaggtcagaaga

SEQ ID NO: 522246 - DNA, 16 bp, R. norvegicus
tgaagaggtggctcag

SEQ ID NO: 522247 - DNA, 16 bp, R. norvegicus
tgaagagtcccagctc

SEQ ID NO: 522248 - DNA, 16 bp, R. norvegicus
tgaagagtgagtggag

SEQ ID NO: 522249 - DNA, 16 bp, R. norvegicus
tgaagagtgtgtgtga

SEQ ID NO: 522250 - DNA, 16 bp, R. norvegicus
tgaagatacaacatac

SEQ ID NO: 522251 - DNA, 16 bp, R. norvegicus
tgaagatacaatattc

SEQ ID NO: 522252 - DNA, 16 bp, R. norvegicus
tgaagatatagaactc

SEQ ID NO: 522253 - DNA, 16 bp, R. norvegicus
tgaagatatagctcag

SEQ ID NO: 522254 - DNA, 16 bp, R. norvegicus
tgaagatattcactgg

SEQ ID NO: 522255 - DNA, 16 bp, R. norvegicus
tgaagatatttactgg

SEQ ID NO: 522256 - DNA, 16 bp, R. norvegicus
tgaagatatttatatc

SEQ ID NO: 522257 - DNA, 16 bp, R. norvegicus
tgaagatcaagaagaa

SEQ ID NO: 522258 - DNA, 16 bp, R. norvegicus
tgaagatcagtgaaga

SEQ ID NO: 522259 - DNA, 16 bp, R. norvegicus
tgaagatcttagaaga

SEQ ID NO: 522260 - DNA, 16 bp, R. norvegicus
tgaagatgaactttca

SEQ ID NO: 522261 - DNA, 16 bp, R. norvegicus
tgaagatgaccttgaa

SEQ ID NO: 522262 - DNA, 16 bp, R. norvegicus
tgaagatgaccttgag

SEQ ID NO: 522263 - DNA, 16 bp, R. norvegicus
tgaagatgactttgaa

SEQ ID NO: 522264 - DNA, 17 bp, R. norvegicus
tgaagatgagactatga

SEQ ID NO: 522265 - DNA, 16 bp, R. norvegicus
tgaagatgagtgggtg

SEQ ID NO: 522266 - DNA, 16 bp, R. norvegicus
tgaagatgctcccatt

SEQ ID NO: 522267 - DNA, 16 bp, R. norvegicus
tgaagatgctgaaggg

SEQ ID NO: 522268 - DNA, 16 bp, R. norvegicus
tgaagatgcttggccc

SEQ ID NO: 522269 - DNA, 16 bp, R. norvegicus
tgaagatggagaactc

SEQ ID NO: 522270 - DNA, 16 bp, R. norvegicus
tgaagatggagcagag

SEQ ID NO: 522271 - DNA, 16 bp, R. norvegicus
tgaagatgtaattgaa

SEQ ID NO: 522272 - DNA, 16 bp, R. norvegicus
tgaagatgtcagaaga

SEQ ID NO: 522273 - DNA, 16 bp, R. norvegicus
tgaagatgtctaccag

SEQ ID NO: 522274 - DNA, 16 bp, R. norvegicus
tgaagatttccattca

SEQ ID NO: 522275 - DNA, 17 bp, R. norvegicus
tgaagatttctttaggt

SEQ ID NO: 522276 - DNA, 16 bp, R. norvegicus
tgaagatttgagttgg

SEQ ID NO: 522277 - DNA, 16 bp, R. norvegicus
tgaagattttcaagtt

SEQ ID NO: 522278 - DNA, 16 bp, R. norvegicus
tgaagattttgtgggt

SEQ ID NO: 522279 - DNA, 16 bp, R. norvegicus
tgaagcaataaagaaa

SEQ ID NO: 522280 - DNA, 16 bp, R. norvegicus
tgaagcagagaatgaa

SEQ ID NO: 522281 - DNA, 16 bp, R. norvegicus
tgaagcagaggcaggt

SEQ ID NO: 522282 - DNA, 16 bp, R. norvegicus
tgaagcagcaacaaaa

SEQ ID NO: 522283 - DNA, 16 bp, R. norvegicus
tgaagcagccagccag

SEQ ID NO: 522284 - DNA, 16 bp, R. norvegicus
tgaagcaggaggattc

SEQ ID NO: 522285 - DNA, 16 bp, R. norvegicus
tgaagccagcctggtt

SEQ ID NO: 522286 - DNA, 16 bp, R. norvegicus
tgaagcccagagagcc

SEQ ID NO: 522287 - DNA, 17 bp, R. norvegicus
tgaagcctacttgatca

SEQ ID NO: 522288 - DNA, 16 bp, R. norvegicus
tgaagcctccaacaca

SEQ ID NO: 522289 - DNA, 17 bp, R. norvegicus
tgaagcgcaaggccctg

SEQ ID NO: 522290 - DNA, 16 bp, R. norvegicus
tgaagctcattggcca

SEQ ID NO: 522291 - DNA, 16 bp, R. norvegicus
tgaagctcccagaaag

SEQ ID NO: 522292 - DNA, 28 bp, R. norvegicus
tgaagctcccggaagaggcggcacaggt

SEQ ID NO: 522293 - DNA, 16 bp, R. norvegicus
tgaagctctcagaaga

SEQ ID NO: 522294 - DNA, 16 bp, R. norvegicus
tgaagctgccaagttc

SEQ ID NO: 522295 - DNA, 16 bp, R. norvegicus
tgaagctggagccatg

SEQ ID NO: 522296 - DNA, 16 bp, R. norvegicus
tgaagctggaggactt

SEQ ID NO: 522297 - DNA, 16 bp, R. norvegicus
tgaagctggccttgaa

SEQ ID NO: 522298 - DNA, 16 bp, R. norvegicus
tgaagctgtgtgtgtg

SEQ ID NO: 522299 - DNA, 16 bp, R. norvegicus
tgaaggaaaatggagg

SEQ ID NO: 522300 - DNA, 16 bp, R. norvegicus
tgaaggaaacagagaa

SEQ ID NO: 522301 - DNA, 16 bp, R. norvegicus
tgaaggaaaggccatc

SEQ ID NO: 522302 - DNA, 16 bp, R. norvegicus
tgaaggaacactcatt

SEQ ID NO: 522303 - DNA, 16 bp, R. norvegicus
tgaaggaactgaaagg

SEQ ID NO: 522304 - DNA, 16 bp, R. norvegicus
tgaaggaactgaaggg

SEQ ID NO: 522305 - DNA, 16 bp, R. norvegicus
tgaaggaagaaatcaa

SEQ ID NO: 522306 - DNA, 16 bp, R. norvegicus
tgaaggaagggccaac

SEQ ID NO: 522307 - DNA, 16 bp, R. norvegicus
tgaaggaattaaacaa

SEQ ID NO: 522308 - DNA, 16 bp, R. norvegicus
tgaaggaattacaaat

SEQ ID NO: 522309 - DNA, 16 bp, R. norvegicus
tgaaggaattgagcaa

SEQ ID NO: 522310 - DNA, 16 bp, R. norvegicus
tgaaggaatttaaaat

SEQ ID NO: 522311 - DNA, 16 bp, R. norvegicus
tgaaggaatttaacaa

SEQ ID NO: 522312 - DNA, 16 bp, R. norvegicus
tgaaggagaggccatc

SEQ ID NO: 522313 - DNA, 16 bp, R. norvegicus
tgaaggagctaaagga

SEQ ID NO: 522314 - DNA, 16 bp, R. norvegicus
tgaaggagctgaaatg

SEQ ID NO: 522315 - DNA, 16 bp, R. norvegicus
tgaaggagctgaagaa

SEQ ID NO: 522316 - DNA, 16 bp, R. norvegicus
tgaaggagctgaagca

SEQ ID NO: 522317 - DNA, 16 bp, R. norvegicus
tgaaggagctgaagga

SEQ ID NO: 522318 - DNA, 16 bp, R. norvegicus
tgaaggagctgaaggg

SEQ ID NO: 522319 - DNA, 16 bp, R. norvegicus
tgaaggagctgaaggt

SEQ ID NO: 522320 - DNA, 16 bp, R. norvegicus
tgaaggagctgagggg

SEQ ID NO: 522321 - DNA, 16 bp, R. norvegicus
tgaaggagctggagga

SEQ ID NO: 522322 - DNA, 16 bp, R. norvegicus
tgaaggaggaaaagac

SEQ ID NO: 522323 - DNA, 16 bp, R. norvegicus
tgaaggaggaggagac

SEQ ID NO: 522324 - DNA, 16 bp, R. norvegicus
tgaaggaggtgaagag

SEQ ID NO: 522325 - DNA, 16 bp, R. norvegicus
tgaaggaggtgaagga

SEQ ID NO: 522326 - DNA, 16 bp, R. norvegicus
tgaaggagtcagagaa

SEQ ID NO: 522327 - DNA, 16 bp, R. norvegicus
tgaaggagttaaagaa

SEQ ID NO: 522328 - DNA, 16 bp, R. norvegicus
tgaaggagttgaaggg

SEQ ID NO: 522329 - DNA, 16 bp, R. norvegicus
tgaaggagttggaaaa

SEQ ID NO: 522330 - DNA, 16 bp, R. norvegicus
tgaaggatctgaagag

SEQ ID NO: 522331 - DNA, 16 bp, R. norvegicus
tgaaggatttgaacaa

SEQ ID NO: 522332 - DNA, 16 bp, R. norvegicus
tgaaggcaaaacattc

SEQ ID NO: 522333 - DNA, 16 bp, R. norvegicus
tgaaggcaaacagaag

SEQ ID NO: 522334 - DNA, 18 bp, R. norvegicus
tgaaggcaacagtggtgc

SEQ ID NO: 522335 - DNA, 16 bp, R. norvegicus
tgaaggcatgaagggt

SEQ ID NO: 522336 - DNA, 16 bp, R. norvegicus
tgaaggccaagctgca

SEQ ID NO: 522337 - DNA, 16 bp, R. norvegicus
tgaaggccagaagatt

SEQ ID NO: 522338 - DNA, 16 bp, R. norvegicus
tgaaggccttccagga

SEQ ID NO: 522339 - DNA, 17 bp, R. norvegicus
tgaaggctgaggaaccc

SEQ ID NO: 522340 - DNA, 16 bp, R. norvegicus
tgaaggctgctgggag

SEQ ID NO: 522341 - DNA, 16 bp, R. norvegicus
tgaagggaaatgaagg

SEQ ID NO: 522342 - DNA, 16 bp, R. norvegicus
tgaagggaaatggaga

SEQ ID NO: 522343 - DNA, 16 bp, R. norvegicus
tgaagggcttctcctc

SEQ ID NO: 522344 - DNA, 16 bp, R. norvegicus
tgaaggggagcagatt

SEQ ID NO: 522345 - DNA, 16 bp, R. norvegicus
tgaaggggatggcaac

SEQ ID NO: 522346 - DNA, 16 bp, R. norvegicus
tgaaggggcttgcaac

SEQ ID NO: 522347 - DNA, 16 bp, R. norvegicus
tgaaggggcttgcaat

SEQ ID NO: 522348 - DNA, 16 bp, R. norvegicus
tgaaggggtgttgtat

SEQ ID NO: 522349 - DNA, 16 bp, R. norvegicus
tgaaggggtgttttat

SEQ ID NO: 522350 - DNA, 17 bp, R. norvegicus
tgaagggtggggccaaa

SEQ ID NO: 522351 - DNA, 16 bp, R. norvegicus
tgaagggtgtcatttt

SEQ ID NO: 522352 - DNA, 16 bp, R. norvegicus
tgaagggtgttgaatt

SEQ ID NO: 522353 - DNA, 16 bp, R. norvegicus
tgaaggtcaaagggca

SEQ ID NO: 522354 - DNA, 16 bp, R. norvegicus
tgaaggtcaagaagga

SEQ ID NO: 522355 - DNA, 16 bp, R. norvegicus
tgaaggtgtcctgcaa

SEQ ID NO: 522356 - DNA, 16 bp, R. norvegicus
tgaaggtgtttcccca

SEQ ID NO: 522357 - DNA, 16 bp, R. norvegicus
tgaagtagcaacaaaa

SEQ ID NO: 522358 - DNA, 16 bp, R. norvegicus
tgaagtcagcctgggc

SEQ ID NO: 522359 - DNA, 16 bp, R. norvegicus
tgaagtcagcctggtc

SEQ ID NO: 522360 - DNA, 16 bp, R. norvegicus
tgaagtcatttttttg

SEQ ID NO: 522361 - DNA, 16 bp, R. norvegicus
tgaagtccaagaagaa

SEQ ID NO: 522362 - DNA, 16 bp, R. norvegicus
tgaagtcctatccaga

SEQ ID NO: 522363 - DNA, 16 bp, R. norvegicus
tgaagtctcagaagct

SEQ ID NO: 522364 - DNA, 16 bp, R. norvegicus
tgaagtctgtcatgga

SEQ ID NO: 522365 - DNA, 16 bp, R. norvegicus
tgaagtgcaatgtgtg

SEQ ID NO: 522366 - DNA, 16 bp, R. norvegicus
tgaagtgggatgaccc

SEQ ID NO: 522367 - DNA, 16 bp, R. norvegicus
tgaagtgtgtttcctg

SEQ ID NO: 522368 - DNA, 16 bp, R. norvegicus
tgaagttatttttcag

SEQ ID NO: 522369 - DNA, 16 bp, R. norvegicus
tgaagttcttgtcata

SEQ ID NO: 522370 - DNA, 16 bp, R. norvegicus
tgaagttgacttggag

SEQ ID NO: 522371 - DNA, 16 bp, R. norvegicus
tgaagttgttaatcag

SEQ ID NO: 522372 - DNA, 16 bp, R. norvegicus
tgaagttgttctctga

SEQ ID NO: 522373 - DNA, 16 bp, R. norvegicus
tgaataaaacaggaag

SEQ ID NO: 522374 - DNA, 16 bp, R. norvegicus
tgaataaaattggcta

SEQ ID NO: 522375 - DNA, 16 bp, R. norvegicus
tgaataaataaacaat

SEQ ID NO: 522376 - DNA, 16 bp, R. norvegicus
tgaataaatacataaa

SEQ ID NO: 522377 - DNA, 16 bp, R. norvegicus
tgaataagcttggccc

SEQ ID NO: 522378 - DNA, 16 bp, R. norvegicus
tgaatacatcttaaaa

SEQ ID NO: 522379 - DNA, 16 bp, R. norvegicus
tgaataccagctttag

SEQ ID NO: 522380 - DNA, 16 bp, R. norvegicus
tgaatacttcagtcct

SEQ ID NO: 522381 - DNA, 16 bp, R. norvegicus
tgaatagatatgagga

SEQ ID NO: 522382 - DNA, 16 bp, R. norvegicus
tgaatagtattctgtt

SEQ ID NO: 522383 - DNA, 16 bp, R. norvegicus
tgaatatagaaaatgt

SEQ ID NO: 522384 - DNA, 16 bp, R. norvegicus
tgaatatatgaatata

SEQ ID NO: 522385 - DNA, 16 bp, R. norvegicus
tgaatatcaatgccaa

SEQ ID NO: 522386 - DNA, 16 bp, R. norvegicus
tgaatatccaaataca

SEQ ID NO: 522387 - DNA, 17 bp, R. norvegicus
tgaatatgaagtgtcct

SEQ ID NO: 522388 - DNA, 16 bp, R. norvegicus
tgaatatgtgagtgtg

SEQ ID NO: 522389 - DNA, 16 bp, R. norvegicus
tgaatatgtgtgtgtg

SEQ ID NO: 522390 - DNA, 16 bp, R. norvegicus
tgaatatgtgtttgtg

SEQ ID NO: 522391 - DNA, 16 bp, R. norvegicus
tgaatattgttgcaaa

SEQ ID NO: 522392 - DNA, 16 bp, R. norvegicus
tgaatattttgatgtg

SEQ ID NO: 522393 - DNA, 18 bp, R. norvegicus
tgaatatttttactcaca

SEQ ID NO: 522394 - DNA, 16 bp, R. norvegicus
tgaatatttttatttc

SEQ ID NO: 522395 - DNA, 16 bp, R. norvegicus
tgaatatttttgttcc

SEQ ID NO: 522396 - DNA, 16 bp, R. norvegicus
tgaatcacagaaaaac

SEQ ID NO: 522397 - DNA, 16 bp, R. norvegicus
tgaatcacagtgcaca

SEQ ID NO: 522398 - DNA, 16 bp, R. norvegicus
tgaatcagaaaagaaa

SEQ ID NO: 522399 - DNA, 16 bp, R. norvegicus
tgaatcataatacaaa

SEQ ID NO: 522400 - DNA, 16 bp, R. norvegicus
tgaatccaagaacaaa

SEQ ID NO: 522401 - DNA, 16 bp, R. norvegicus
tgaatcccagcatttg

SEQ ID NO: 522402 - DNA, 16 bp, R. norvegicus
tgaatcccccagaagt

SEQ ID NO: 522403 - DNA, 16 bp, R. norvegicus
tgaatctaatagagga

SEQ ID NO: 522404 - DNA, 16 bp, R. norvegicus
tgaatctacctccagc

SEQ ID NO: 522405 - DNA, 16 bp, R. norvegicus
tgaatctgaaaagctt

SEQ ID NO: 522406 - DNA, 16 bp, R. norvegicus
tgaatctgtagattac

SEQ ID NO: 522407 - DNA, 16 bp, R. norvegicus
tgaatctgtgctggcc

SEQ ID NO: 522408 - DNA, 16 bp, R. norvegicus
tgaatgaaaacctagc

SEQ ID NO: 522409 - DNA, 16 bp, R. norvegicus
tgaatgaaatgaaaat

SEQ ID NO: 522410 - DNA, 16 bp, R. norvegicus
tgaatgaacaaatgaa

SEQ ID NO: 522411 - DNA, 17 bp, R. norvegicus
tgaatgaaggtcagaga

SEQ ID NO: 522412 - DNA, 16 bp, R. norvegicus
tgaatgaatagatgga

SEQ ID NO: 522413 - DNA, 16 bp, R. norvegicus
tgaatgaatgaaaaag

SEQ ID NO: 522414 - DNA, 16 bp, R. norvegicus
tgaatgaatgaacgaa

SEQ ID NO: 522415 - DNA, 16 bp, R. norvegicus
tgaatgagactcagac

SEQ ID NO: 522416 - DNA, 16 bp, R. norvegicus
tgaatgcacacacaca

SEQ ID NO: 522417 - DNA, 16 bp, R. norvegicus
tgaatgctctttcaga

SEQ ID NO: 522418 - DNA, 16 bp, R. norvegicus
tgaatggaaatgtgca

SEQ ID NO: 522419 - DNA, 16 bp, R. norvegicus
tgaatggaaggaagga

SEQ ID NO: 522420 - DNA, 16 bp, R. norvegicus
tgaatggatgaatgaa

SEQ ID NO: 522421 - DNA, 16 bp, R. norvegicus
tgaatgggtgggggaa

SEQ ID NO: 522422 - DNA, 16 bp, R. norvegicus
tgaatgtaacaggaag

SEQ ID NO: 522423 - DNA, 16 bp, R. norvegicus
tgaatgtatgtataca

SEQ ID NO: 522424 - DNA, 16 bp, R. norvegicus
tgaatgtcactgctgc

SEQ ID NO: 522425 - DNA, 16 bp, R. norvegicus
tgaatgtggtggtttg

SEQ ID NO: 522426 - DNA, 16 bp, R. norvegicus
tgaatgttagatattt

SEQ ID NO: 522427 - DNA, 16 bp, R. norvegicus
tgaatgttatactcct

SEQ ID NO: 522428 - DNA, 16 bp, R. norvegicus
tgaattaatgagtgaa

SEQ ID NO: 522429 - DNA, 16 bp, R. norvegicus
tgaattaattagggag

SEQ ID NO: 522430 - DNA, 16 bp, R. norvegicus
tgaattattttcttct

SEQ ID NO: 522431 - DNA, 16 bp, R. norvegicus
tgaattcattggtggc

SEQ ID NO: 522432 - DNA, 16 bp, R. norvegicus
tgaattccaagacagc

SEQ ID NO: 522433 - DNA, 16 bp, R. norvegicus
tgaattccaagatagc

SEQ ID NO: 522434 - DNA, 16 bp, R. norvegicus
tgaattccaggccaac

SEQ ID NO: 522435 - DNA, 16 bp, R. norvegicus
tgaattccaggccaat

SEQ ID NO: 522436 - DNA, 16 bp, R. norvegicus
tgaattccatccccag

SEQ ID NO: 522437 - DNA, 16 bp, R. norvegicus
tgaattctgtgttcaa

SEQ ID NO: 522438 - DNA, 16 bp, R. norvegicus
tgaattcttgatctct

SEQ ID NO: 522439 - DNA, 16 bp, R. norvegicus
tgaattctttgcatat

SEQ ID NO: 522440 - DNA, 16 bp, R. norvegicus
tgaattctttgtgtat

SEQ ID NO: 522441 - DNA, 16 bp, R. norvegicus
tgaatttaaccaagca

SEQ ID NO: 522442 - DNA, 16 bp, R. norvegicus
tgaatttcatgaagac

SEQ ID NO: 522443 - DNA, 16 bp, R. norvegicus
tgaatttcatgaagcc

SEQ ID NO: 522444 - DNA, 16 bp, R. norvegicus
tgaatttcctcagttt

SEQ ID NO: 522445 - DNA, 16 bp, R. norvegicus
tgaatttcctctggat

SEQ ID NO: 522446 - DNA, 16 bp, R. norvegicus
tgaatttgaaagagag

SEQ ID NO: 522447 - DNA, 16 bp, R. norvegicus
tgaatttgagagggag

SEQ ID NO: 522448 - DNA, 16 bp, R. norvegicus
tgaatttgaggccagc

SEQ ID NO: 522449 - DNA, 16 bp, R. norvegicus
tgaatttgcaaatgtt

SEQ ID NO: 522450 - DNA, 17 bp, R. norvegicus
tgaatttgcagattgct

SEQ ID NO: 522451 - DNA, 16 bp, R. norvegicus
tgaatttgttgaaaaa

SEQ ID NO: 522452 - DNA, 16 bp, R. norvegicus
tgaattttctttttaa

SEQ ID NO: 522453 - DNA, 16 bp, R. norvegicus
tgaattttgtcaaagg

SEQ ID NO: 522454 - DNA, 16 bp, R. norvegicus
tgaatttttcaaagaa

SEQ ID NO: 522455 - DNA, 16 bp, R. norvegicus
tgacaaaaagcaattt

SEQ ID NO: 522456 - DNA, 16 bp, R. norvegicus
tgacaaaaccaaactt

SEQ ID NO: 522457 - DNA, 16 bp, R. norvegicus
tgacaaaacggcaacc

SEQ ID NO: 522458 - DNA, 16 bp, R. norvegicus
tgacaaaagcaactta

SEQ ID NO: 522459 - DNA, 16 bp, R. norvegicus
tgacaaaagtgtggat

SEQ ID NO: 522460 - DNA, 16 bp, R. norvegicus
tgacaaaatacctgag

SEQ ID NO: 522461 - DNA, 16 bp, R. norvegicus
tgacaaaatttaatac

SEQ ID NO: 522462 - DNA, 16 bp, R. norvegicus
tgacaaacacagaggc

SEQ ID NO: 522463 - DNA, 16 bp, R. norvegicus
tgacaaagaaatcaaa

SEQ ID NO: 522464 - DNA, 16 bp, R. norvegicus
tgacaaagccacaaaa

SEQ ID NO: 522465 - DNA, 16 bp, R. norvegicus
tgacaaaggaaaagaa

SEQ ID NO: 522466 - DNA, 16 bp, R. norvegicus
tgacaaaggacccaaa

SEQ ID NO: 522467 - DNA, 16 bp, R. norvegicus
tgacaaatacagaggc

SEQ ID NO: 522468 - DNA, 16 bp, R. norvegicus
tgacaaatacagaggt

SEQ ID NO: 522469 - DNA, 16 bp, R. norvegicus
tgacaaatactggaga

SEQ ID NO: 522470 - DNA, 16 bp, R. norvegicus
tgacaaatcagagaaa

SEQ ID NO: 522471 - DNA, 16 bp, R. norvegicus
tgacaacatctggaat

SEQ ID NO: 522472 - DNA, 16 bp, R. norvegicus
tgacaaccaacagatt

SEQ ID NO: 522473 - DNA, 16 bp, R. norvegicus
tgacaaccacctgtaa

SEQ ID NO: 522474 - DNA, 16 bp, R. norvegicus
tgacaaccaggaatgg

SEQ ID NO: 522475 - DNA, 16 bp, R. norvegicus
tgacaactcactgtcc

SEQ ID NO: 522476 - DNA, 16 bp, R. norvegicus
tgacaactgtccagga

SEQ ID NO: 522477 - DNA, 16 bp, R. norvegicus
tgacaagagcttcaag

SEQ ID NO: 522478 - DNA, 16 bp, R. norvegicus
tgacaagctggctcat

SEQ ID NO: 522479 - DNA, 16 bp, R. norvegicus
tgacaaggaggattca

SEQ ID NO: 522480 - DNA, 16 bp, R. norvegicus
tgacaataaatgcctt

SEQ ID NO: 522481 - DNA, 16 bp, R. norvegicus
tgacaatcattatcct

SEQ ID NO: 522482 - DNA, 16 bp, R. norvegicus
tgacaatgaaaaaagc

SEQ ID NO: 522483 - DNA, 16 bp, R. norvegicus
tgacaatgagttcaag

SEQ ID NO: 522484 - DNA, 16 bp, R. norvegicus
tgacaatggctaagat

SEQ ID NO: 522485 - DNA, 16 bp, R. norvegicus
tgacacaacagtaaaa

SEQ ID NO: 522486 - DNA, 16 bp, R. norvegicus
tgacacaacagtcaag

SEQ ID NO: 522487 - DNA, 16 bp, R. norvegicus
tgacacaagccagggt

SEQ ID NO: 522488 - DNA, 18 bp, R. norvegicus
tgacacaagctggagtta

SEQ ID NO: 522489 - DNA, 16 bp, R. norvegicus
tgacacacttcctaca

SEQ ID NO: 522490 - DNA, 16 bp, R. norvegicus
tgacacacttcctcca

SEQ ID NO: 522491 - DNA, 17 bp, R. norvegicus
tgacacacttggggaga

SEQ ID NO: 522492 - DNA, 16 bp, R. norvegicus
tgacacactttctcca

SEQ ID NO: 522493 - DNA, 16 bp, R. norvegicus
tgacacagctggagtt

SEQ ID NO: 522494 - DNA, 16 bp, R. norvegicus
tgacacaggatctctc

SEQ ID NO: 522495 - DNA, 16 bp, R. norvegicus
tgacacaggcccacag

SEQ ID NO: 522496 - DNA, 16 bp, R. norvegicus
tgacaccaaaagttcc

SEQ ID NO: 522497 - DNA, 16 bp, R. norvegicus
tgacaccaaatgctgg

SEQ ID NO: 522498 - DNA, 16 bp, R. norvegicus
tgacaccagagaggtg

SEQ ID NO: 522499 - DNA, 16 bp, R. norvegicus
tgacacccttcctcca

SEQ ID NO: 522500 - DNA, 16 bp, R. norvegicus
tgacacctgagcaggt

SEQ ID NO: 522501 - DNA, 16 bp, R. norvegicus
tgacaccttctggcct

SEQ ID NO: 522502 - DNA, 16 bp, R. norvegicus
tgacactcaagaagaa

SEQ ID NO: 522503 - DNA, 16 bp, R. norvegicus
tgacactttcacaggg

SEQ ID NO: 522504 - DNA, 16 bp, R. norvegicus
tgacactttgctgaag

SEQ ID NO: 522505 - DNA, 16 bp, R. norvegicus
tgacagaaaacaggaa

SEQ ID NO: 522506 - DNA, 16 bp, R. norvegicus
tgacagaaagcccacg

SEQ ID NO: 522507 - DNA, 16 bp, R. norvegicus
tgacagacaggcagac

SEQ ID NO: 522508 - DNA, 16 bp, R. norvegicus
tgacagagaaacagct

SEQ ID NO: 522509 - DNA, 16 bp, R. norvegicus
tgacagcacacacaag

SEQ ID NO: 522510 - DNA, 16 bp, R. norvegicus
tgacagcagacctaaa

SEQ ID NO: 522511 - DNA, 16 bp, R. norvegicus
tgacagcagcagcagc

SEQ ID NO: 522512 - DNA, 16 bp, R. norvegicus
tgacagctacagtgta

SEQ ID NO: 522513 - DNA, 16 bp, R. norvegicus
tgacagctaccataca

SEQ ID NO: 522514 - DNA, 16 bp, R. norvegicus
tgacagctgtttctct

SEQ ID NO: 522515 - DNA, 16 bp, R. norvegicus
tgacaggagcctggtg

SEQ ID NO: 522516 - DNA, 16 bp, R. norvegicus
tgacaggatcctgaga

SEQ ID NO: 522517 - DNA, 16 bp, R. norvegicus
tgacagtgggatggca

SEQ ID NO: 522518 - DNA, 16 bp, R. norvegicus
tgacagtggtccttgt

SEQ ID NO: 522519 - DNA, 16 bp, R. norvegicus
tgacagtggtggtggt

SEQ ID NO: 522520 - DNA, 16 bp, R. norvegicus
tgacagtgtattcaca

SEQ ID NO: 522521 - DNA, 16 bp, R. norvegicus
tgacagtgtcctttgc

SEQ ID NO: 522522 - DNA, 16 bp, R. norvegicus
tgacagttcagatcct

SEQ ID NO: 522523 - DNA, 16 bp, R. norvegicus
tgacataaaactatct

SEQ ID NO: 522524 - DNA, 16 bp, R. norvegicus
tgacatcactctgcca

SEQ ID NO: 522525 - DNA, 16 bp, R. norvegicus
tgacatcagtcctgga

SEQ ID NO: 522526 - DNA, 16 bp, R. norvegicus
tgacatctactcctct

SEQ ID NO: 522527 - DNA, 16 bp, R. norvegicus
tgacatctgccaagga

SEQ ID NO: 522528 - DNA, 16 bp, R. norvegicus
tgacatctgcccagga

SEQ ID NO: 522529 - DNA, 16 bp, R. norvegicus
tgacatcttcctctgg

SEQ ID NO: 522530 - DNA, 16 bp, R. norvegicus
tgacatgatgataatg

SEQ ID NO: 522531 - DNA, 16 bp, R. norvegicus
tgacattattttcttt

SEQ ID NO: 522532 - DNA, 17 bp, R. norvegicus
tgacattcatggagaga

SEQ ID NO: 522533 - DNA, 16 bp, R. norvegicus
tgacatttaaaaataa

SEQ ID NO: 522534 - DNA, 16 bp, R. norvegicus
tgacatttattttatt

SEQ ID NO: 522535 - DNA, 16 bp, R. norvegicus
tgacatttgttttctc

SEQ ID NO: 522536 - DNA, 16 bp, R. norvegicus
tgacattttccctgct

SEQ ID NO: 522537 - DNA, 16 bp, R. norvegicus
tgacattttctaattc

SEQ ID NO: 522538 - DNA, 16 bp, R. norvegicus
tgacatttttcttttc

SEQ ID NO: 522539 - DNA, 16 bp, R. norvegicus
tgaccaaagcagctct

SEQ ID NO: 522540 - DNA, 16 bp, R. norvegicus
tgaccaaagtaactta

SEQ ID NO: 522541 - DNA, 16 bp, R. norvegicus
tgaccaacaactcaat

SEQ ID NO: 522542 - DNA, 16 bp, R. norvegicus
tgaccaacatgagttt

SEQ ID NO: 522543 - DNA, 16 bp, R. norvegicus
tgaccaactcagctac

SEQ ID NO: 522544 - DNA, 16 bp, R. norvegicus
tgaccaagatggaaat

SEQ ID NO: 522545 - DNA, 16 bp, R. norvegicus
tgaccaaggcaaatct

SEQ ID NO: 522546 - DNA, 16 bp, R. norvegicus
tgaccaaggcaactct

SEQ ID NO: 522547 - DNA, 16 bp, R. norvegicus
tgaccacagtgacttt

SEQ ID NO: 522548 - DNA, 16 bp, R. norvegicus
tgaccacagtttccct

SEQ ID NO: 522549 - DNA, 16 bp, R. norvegicus
tgaccactagagggca

SEQ ID NO: 522550 - DNA, 16 bp, R. norvegicus
tgaccactgagccatc

SEQ ID NO: 522551 - DNA, 16 bp, R. norvegicus
tgaccactgtggttga

SEQ ID NO: 522552 - DNA, 16 bp, R. norvegicus
tgaccacttgatattg

SEQ ID NO: 522553 - DNA, 16 bp, R. norvegicus
tgaccaggtggaaaaa

SEQ ID NO: 522554 - DNA, 16 bp, R. norvegicus
tgaccaggttctgcag

SEQ ID NO: 522555 - DNA, 16 bp, R. norvegicus
tgaccaggttgtcatt

SEQ ID NO: 522556 - DNA, 16 bp, R. norvegicus
tgaccagtaagcccca

SEQ ID NO: 522557 - DNA, 16 bp, R. norvegicus
tgaccagtggacccca

SEQ ID NO: 522558 - DNA, 16 bp, R. norvegicus
tgaccatataattgat

SEQ ID NO: 522559 - DNA, 37 bp, R. norvegicus
tgaccatataattggtcaaaaaacgggcctcaacaga

SEQ ID NO: 522560 - DNA, 16 bp, R. norvegicus
tgaccatggcaagtct

SEQ ID NO: 522561 - DNA, 16 bp, R. norvegicus
tgacccacttcctcta

SEQ ID NO: 522562 - DNA, 16 bp, R. norvegicus
tgaccccagcacacct

SEQ ID NO: 522563 - DNA, 16 bp, R. norvegicus
tgaccccagccccttg

SEQ ID NO: 522564 - DNA, 16 bp, R. norvegicus
tgaccccagtgcactg

SEQ ID NO: 522565 - DNA, 16 bp, R. norvegicus
tgaccctcagtgatgg

SEQ ID NO: 522566 - DNA, 16 bp, R. norvegicus
tgaccctcctgcaagc

SEQ ID NO: 522567 - DNA, 16 bp, R. norvegicus
tgaccctgaacttctg

SEQ ID NO: 522568 - DNA, 16 bp, R. norvegicus
tgaccctgagaagcca

SEQ ID NO: 522569 - DNA, 16 bp, R. norvegicus
tgaccctgagccacag

SEQ ID NO: 522570 - DNA, 16 bp, R. norvegicus
tgaccctggactatga

SEQ ID NO: 522571 - DNA, 16 bp, R. norvegicus
tgaccctggactcaga

SEQ ID NO: 522572 - DNA, 16 bp, R. norvegicus
tgaccctggactctgg

SEQ ID NO: 522573 - DNA, 16 bp, R. norvegicus
tgaccctggctggcct

SEQ ID NO: 522574 - DNA, 16 bp, R. norvegicus
tgaccctgggctccat

SEQ ID NO: 522575 - DNA, 16 bp, R. norvegicus
tgaccctggggtccaa

SEQ ID NO: 522576 - DNA, 16 bp, R. norvegicus
tgaccctgttggagga

SEQ ID NO: 522577 - DNA, 16 bp, R. norvegicus
tgacccttccacaggg

SEQ ID NO: 522578 - DNA, 16 bp, R. norvegicus
tgaccctttcacaggg

SEQ ID NO: 522579 - DNA, 16 bp, R. norvegicus
tgacctaacttgtctg

SEQ ID NO: 522580 - DNA, 16 bp, R. norvegicus
tgacctatttttgttg

SEQ ID NO: 522581 - DNA, 16 bp, R. norvegicus
tgacctcaaattcaaa

SEQ ID NO: 522582 - DNA, 20 bp, R. norvegicus
tgacctcaactacatggtct

SEQ ID NO: 522583 - DNA, 16 bp, R. norvegicus
tgacctcaagacacag

SEQ ID NO: 522584 - DNA, 16 bp, R. norvegicus
tgacctcctcctcctc

SEQ ID NO: 522585 - DNA, 16 bp, R. norvegicus
tgacctctgaaagagc

SEQ ID NO: 522586 - DNA, 16 bp, R. norvegicus
tgacctctgacctcta

SEQ ID NO: 522587 - DNA, 16 bp, R. norvegicus
tgacctctgacctctg

SEQ ID NO: 522588 - DNA, 16 bp, R. norvegicus
tgacctctgaccttca

SEQ ID NO: 522589 - DNA, 16 bp, R. norvegicus
tgacctgaagcagtat

SEQ ID NO: 522590 - DNA, 16 bp, R. norvegicus
tgacctgcatggtgaa

SEQ ID NO: 522591 - DNA, 16 bp, R. norvegicus
tgacctggaaactggg

SEQ ID NO: 522592 - DNA, 16 bp, R. norvegicus
tgacctgtgagctgaa

SEQ ID NO: 522593 - DNA, 16 bp, R. norvegicus
tgaccttaaccaagca

SEQ ID NO: 522594 - DNA, 16 bp, R. norvegicus
tgaccttagccaaaat

SEQ ID NO: 522595 - DNA, 16 bp, R. norvegicus
tgaccttcacaggcac

SEQ ID NO: 522596 - DNA, 16 bp, R. norvegicus
tgaccttccatggcct

SEQ ID NO: 522597 - DNA, 16 bp, R. norvegicus
tgaccttcctcctcag

SEQ ID NO: 522598 - DNA, 16 bp, R. norvegicus
tgaccttcctggtgga

SEQ ID NO: 522599 - DNA, 16 bp, R. norvegicus
tgaccttcctgtaagc

SEQ ID NO: 522600 - DNA, 16 bp, R. norvegicus
tgaccttgaacacctg

SEQ ID NO: 522601 - DNA, 16 bp, R. norvegicus
tgaccttgaacttgca

SEQ ID NO: 522602 - DNA, 16 bp, R. norvegicus
tgaccttgagttcctg

SEQ ID NO: 522603 - DNA, 16 bp, R. norvegicus
tgaccttgggctccaa

SEQ ID NO: 522604 - DNA, 16 bp, R. norvegicus
tgacctttctgcctcc

SEQ ID NO: 522605 - DNA, 16 bp, R. norvegicus
tgacctttgacctcca

SEQ ID NO: 522606 - DNA, 16 bp, R. norvegicus
tgacctttgacctctg

SEQ ID NO: 522607 - DNA, 16 bp, R. norvegicus
tgacggggctcgagac

SEQ ID NO: 522608 - DNA, 17 bp, R. norvegicus
tgactacattgacagct

SEQ ID NO: 522609 - DNA, 16 bp, R. norvegicus
tgactagagagagact

SEQ ID NO: 522610 - DNA, 16 bp, R. norvegicus
tgactatgtagaccag

SEQ ID NO: 522611 - DNA, 16 bp, R. norvegicus
tgactattatgtaatg

SEQ ID NO: 522612 - DNA, 16 bp, R. norvegicus
tgactattttaatttt

SEQ ID NO: 522613 - DNA, 16 bp, R. norvegicus
tgactcacacctccat

SEQ ID NO: 522614 - DNA, 16 bp, R. norvegicus
tgactcacctaaccca

SEQ ID NO: 522615 - DNA, 16 bp, R. norvegicus
tgactcagtaaataaa

SEQ ID NO: 522616 - DNA, 16 bp, R. norvegicus
tgactccaaaagttcc

SEQ ID NO: 522617 - DNA, 16 bp, R. norvegicus
tgactccagctccagg

SEQ ID NO: 522618 - DNA, 16 bp, R. norvegicus
tgactcctgtgcctgc

SEQ ID NO: 522619 - DNA, 16 bp, R. norvegicus
tgactctaaagccaga

SEQ ID NO: 522620 - DNA, 16 bp, R. norvegicus
tgactctagaagaaaa

SEQ ID NO: 522621 - DNA, 16 bp, R. norvegicus
tgactctctgaaggtt

SEQ ID NO: 522622 - DNA, 16 bp, R. norvegicus
tgactctgaggccagc

SEQ ID NO: 522623 - DNA, 16 bp, R. norvegicus
tgactctggccaagga

SEQ ID NO: 522624 - DNA, 16 bp, R. norvegicus
tgactgaaacagacac

SEQ ID NO: 522625 - DNA, 16 bp, R. norvegicus
tgactgaacccaaacc

SEQ ID NO: 522626 - DNA, 16 bp, R. norvegicus
tgactgaagacagtga

SEQ ID NO: 522627 - DNA, 16 bp, R. norvegicus
tgactgagatgaaaat

SEQ ID NO: 522628 - DNA, 16 bp, R. norvegicus
tgactgatgtggaagg

SEQ ID NO: 522629 - DNA, 16 bp, R. norvegicus
tgactgcatgtgacct

SEQ ID NO: 522630 - DNA, 16 bp, R. norvegicus
tgactgctcttcagag

SEQ ID NO: 522631 - DNA, 16 bp, R. norvegicus
tgactgcttctccaga

SEQ ID NO: 522632 - DNA, 16 bp, R. norvegicus
tgactggacagtaaaa

SEQ ID NO: 522633 - DNA, 16 bp, R. norvegicus
tgactggagcctgata

SEQ ID NO: 522634 - DNA, 16 bp, R. norvegicus
tgactgggctacctca

SEQ ID NO: 522635 - DNA, 16 bp, R. norvegicus
tgactggtggactcag

SEQ ID NO: 522636 - DNA, 22 bp, R. norvegicus
tgactggtgtgaggtggaatct

SEQ ID NO: 522637 - DNA, 16 bp, R. norvegicus
tgactggtgtgatgtg

SEQ ID NO: 522638 - DNA, 16 bp, R. norvegicus
tgactgtactggaact

SEQ ID NO: 522639 - DNA, 16 bp, R. norvegicus
tgactgtcagcaggtg

SEQ ID NO: 522640 - DNA, 16 bp, R. norvegicus
tgactgtcctggaact

SEQ ID NO: 522641 - DNA, 16 bp, R. norvegicus
tgactgtggaggtcag

SEQ ID NO: 522642 - DNA, 16 bp, R. norvegicus
tgactgtggatgtaat

SEQ ID NO: 522643 - DNA, 16 bp, R. norvegicus
tgactgtgtctgtgtc

SEQ ID NO: 522644 - DNA, 16 bp, R. norvegicus
tgactgtgtgtgtgag

SEQ ID NO: 522645 - DNA, 16 bp, R. norvegicus
tgacttaactgtcaaa

SEQ ID NO: 522646 - DNA, 16 bp, R. norvegicus
tgacttcaccagaacc

SEQ ID NO: 522647 - DNA, 16 bp, R. norvegicus
tgacttcactagaacc

SEQ ID NO: 522648 - DNA, 16 bp, R. norvegicus
tgacttcagtcctgag

SEQ ID NO: 522649 - DNA, 16 bp, R. norvegicus
tgacttcagttcccag

SEQ ID NO: 522650 - DNA, 16 bp, R. norvegicus
tgacttcatcaatatt

SEQ ID NO: 522651 - DNA, 16 bp, R. norvegicus
tgacttccaacccctc

SEQ ID NO: 522652 - DNA, 16 bp, R. norvegicus
tgacttccacaagcac

SEQ ID NO: 522653 - DNA, 16 bp, R. norvegicus
tgacttcctcaggcac

SEQ ID NO: 522654 - DNA, 16 bp, R. norvegicus
tgacttcctgtcctga

SEQ ID NO: 522655 - DNA, 16 bp, R. norvegicus
tgacttccttcaacaa

SEQ ID NO: 522656 - DNA, 16 bp, R. norvegicus
tgacttctctctgagc

SEQ ID NO: 522657 - DNA, 16 bp, R. norvegicus
tgacttctgcctttcc

SEQ ID NO: 522658 - DNA, 16 bp, R. norvegicus
tgacttcttccattcc

SEQ ID NO: 522659 - DNA, 16 bp, R. norvegicus
tgacttcttcctctcc

SEQ ID NO: 522660 - DNA, 16 bp, R. norvegicus
tgacttgagctttgta

SEQ ID NO: 522661 - DNA, 16 bp, R. norvegicus
tgacttggaggccagc

SEQ ID NO: 522662 - DNA, 16 bp, R. norvegicus
tgacttgtcaataaaa

SEQ ID NO: 522663 - DNA, 16 bp, R. norvegicus
tgactttaaggccagc

SEQ ID NO: 522664 - DNA, 16 bp, R. norvegicus
tgactttagagtcaag

SEQ ID NO: 522665 - DNA, 16 bp, R. norvegicus
tgactttctttgatga

SEQ ID NO: 522666 - DNA, 16 bp, R. norvegicus
tgactttgttggagga

SEQ ID NO: 522667 - DNA, 16 bp, R. norvegicus
tgacttttcttttaaa

SEQ ID NO: 522668 - DNA, 16 bp, R. norvegicus
tgactttttcctttct

SEQ ID NO: 522669 - DNA, 16 bp, R. norvegicus
tgacttttttttaaaa

SEQ ID NO: 522670 - DNA, 16 bp, R. norvegicus
tgagaaaaaaaatcat

SEQ ID NO: 522671 - DNA, 16 bp, R. norvegicus
tgagaaaaaatatttt

SEQ ID NO: 522672 - DNA, 16 bp, R. norvegicus
tgagaaaaacattcct

SEQ ID NO: 522673 - DNA, 16 bp, R. norvegicus
tgagaaaacaagagaa

SEQ ID NO: 522674 - DNA, 16 bp, R. norvegicus
tgagaaaatcaagata

SEQ ID NO: 522675 - DNA, 16 bp, R. norvegicus
tgagaaaatgaacaag

SEQ ID NO: 522676 - DNA, 16 bp, R. norvegicus
tgagaaaatgccacca

SEQ ID NO: 522677 - DNA, 16 bp, R. norvegicus
tgagaaaatgcctcag

SEQ ID NO: 522678 - DNA, 16 bp, R. norvegicus
tgagaaacagaaaaga

SEQ ID NO: 522679 - DNA, 16 bp, R. norvegicus
tgagaaaccaggaaag

SEQ ID NO: 522680 - DNA, 16 bp, R. norvegicus
tgagaaactgaggcag

SEQ ID NO: 522681 - DNA, 16 bp, R. norvegicus
tgagaaagaaattgaa

SEQ ID NO: 522682 - DNA, 16 bp, R. norvegicus
tgagaaagaagaacac

SEQ ID NO: 522683 - DNA, 16 bp, R. norvegicus
tgagaaagaagccaaa

SEQ ID NO: 522684 - DNA, 16 bp, R. norvegicus
tgagaaagacagacac

SEQ ID NO: 522685 - DNA, 16 bp, R. norvegicus
tgagaaagagtctctc

SEQ ID NO: 522686 - DNA, 16 bp, R. norvegicus
tgagaaagcatgtgac

SEQ ID NO: 522687 - DNA, 16 bp, R. norvegicus
tgagaaaggattgaag

SEQ ID NO: 522688 - DNA, 16 bp, R. norvegicus
tgagaaatacatctga

SEQ ID NO: 522689 - DNA, 16 bp, R. norvegicus
tgagaaatcatttgaa

SEQ ID NO: 522690 - DNA, 16 bp, R. norvegicus
tgagaacaatggagga

SEQ ID NO: 522691 - DNA, 16 bp, R. norvegicus
tgagaacacagagaag

SEQ ID NO: 522692 - DNA, 16 bp, R. norvegicus
tgagaacagctgctct

SEQ ID NO: 522693 - DNA, 16 bp, R. norvegicus
tgagaaccaaatccag

SEQ ID NO: 522694 - DNA, 16 bp, R. norvegicus
tgagaaccactgaact

SEQ ID NO: 522695 - DNA, 16 bp, R. norvegicus
tgagaaccatcccatg

SEQ ID NO: 522696 - DNA, 16 bp, R. norvegicus
tgagaacgggaccctc

SEQ ID NO: 522697 - DNA, 16 bp, R. norvegicus
tgagaactactgcctt

SEQ ID NO: 522698 - DNA, 16 bp, R. norvegicus
tgagaactcagaggag

SEQ ID NO: 522699 - DNA, 16 bp, R. norvegicus
tgagaactgggctctg

SEQ ID NO: 522700 - DNA, 16 bp, R. norvegicus
tgagaagaaaatatat

SEQ ID NO: 522701 - DNA, 16 bp, R. norvegicus
tgagaagaacacagaa

SEQ ID NO: 522702 - DNA, 16 bp, R. norvegicus
tgagaagaacttcaag

SEQ ID NO: 522703 - DNA, 16 bp, R. norvegicus
tgagaagaagccagaa

SEQ ID NO: 522704 - DNA, 16 bp, R. norvegicus
tgagaagaaggtctat

SEQ ID NO: 522705 - DNA, 16 bp, R. norvegicus
tgagaagaaggtgtat

SEQ ID NO: 522706 - DNA, 16 bp, R. norvegicus
tgagaagaggaaggct

SEQ ID NO: 522707 - DNA, 16 bp, R. norvegicus
tgagaagagtagcaat

SEQ ID NO: 522708 - DNA, 16 bp, R. norvegicus
tgagaagatcaatcct

SEQ ID NO: 522709 - DNA, 16 bp, R. norvegicus
tgagaagatgcagcat

SEQ ID NO: 522710 - DNA, 16 bp, R. norvegicus
tgagaagcactgttct

SEQ ID NO: 522711 - DNA, 16 bp, R. norvegicus
tgagaagcacttgaag

SEQ ID NO: 522712 - DNA, 16 bp, R. norvegicus
tgagaagctgaagcag

SEQ ID NO: 522713 - DNA, 16 bp, R. norvegicus
tgagaaggagggtgac

SEQ ID NO: 522714 - DNA, 16 bp, R. norvegicus
tgagaaggatcaggag

SEQ ID NO: 522715 - DNA, 16 bp, R. norvegicus
tgagaaggctgaggca

SEQ ID NO: 522716 - DNA, 16 bp, R. norvegicus
tgagaagtacctgaag

SEQ ID NO: 522717 - DNA, 16 bp, R. norvegicus
tgagaagtcaggtgta

SEQ ID NO: 522718 - DNA, 16 bp, R. norvegicus
tgagaagtgcctaaag

SEQ ID NO: 522719 - DNA, 16 bp, R. norvegicus
tgagaagtggaggcag

SEQ ID NO: 522720 - DNA, 16 bp, R. norvegicus
tgagaagtggatatta

SEQ ID NO: 522721 - DNA, 16 bp, R. norvegicus
tgagaatagttttcat

SEQ ID NO: 522722 - DNA, 16 bp, R. norvegicus
tgagaatatacccaaa

SEQ ID NO: 522723 - DNA, 16 bp, R. norvegicus
tgagaatatttttcac

SEQ ID NO: 522724 - DNA, 16 bp, R. norvegicus
tgagaatgcatttgac

SEQ ID NO: 522725 - DNA, 16 bp, R. norvegicus
tgagaatgctggtcct

SEQ ID NO: 522726 - DNA, 16 bp, R. norvegicus
tgagaatgggagaaat

SEQ ID NO: 522727 - DNA, 16 bp, R. norvegicus
tgagaatgggtcccca

SEQ ID NO: 522728 - DNA, 22 bp, R. norvegicus
tgagaatgtagacagcccaaaa

SEQ ID NO: 522729 - DNA, 17 bp, R. norvegicus
tgagaattctttgttta

SEQ ID NO: 522730 - DNA, 16 bp, R. norvegicus
tgagaattcttttttt

SEQ ID NO: 522731 - DNA, 16 bp, R. norvegicus
tgagaattgtttccta

SEQ ID NO: 522732 - DNA, 16 bp, R. norvegicus
tgagaatttcatgcat

SEQ ID NO: 522733 - DNA, 16 bp, R. norvegicus
tgagaatttgtttctc

SEQ ID NO: 522734 - DNA, 16 bp, R. norvegicus
tgagaattttatatat

SEQ ID NO: 522735 - DNA, 16 bp, R. norvegicus
tgagaattttgctgaa

SEQ ID NO: 522736 - DNA, 16 bp, R. norvegicus
tgagaattttgtacaa

SEQ ID NO: 522737 - DNA, 16 bp, R. norvegicus
tgagacaaaaatctca

SEQ ID NO: 522738 - DNA, 16 bp, R. norvegicus
tgagacaacagtacca

SEQ ID NO: 522739 - DNA, 16 bp, R. norvegicus
tgagacagaatctctc

SEQ ID NO: 522740 - DNA, 16 bp, R. norvegicus
tgagacagacagacag

SEQ ID NO: 522741 - DNA, 16 bp, R. norvegicus
tgagacagagacagag

SEQ ID NO: 522742 - DNA, 16 bp, R. norvegicus
tgagacagagtctttc

SEQ ID NO: 522743 - DNA, 16 bp, R. norvegicus
tgagacagatgtagat

SEQ ID NO: 522744 - DNA, 16 bp, R. norvegicus
tgagacaggaggattc

SEQ ID NO: 522745 - DNA, 16 bp, R. norvegicus
tgagacagggtttctt

SEQ ID NO: 522746 - DNA, 16 bp, R. norvegicus
tgagacaggttctctg

SEQ ID NO: 522747 - DNA, 16 bp, R. norvegicus
tgagacagtgtctccc

SEQ ID NO: 522748 - DNA, 16 bp, R. norvegicus
tgagacatttaactct

SEQ ID NO: 522749 - DNA, 16 bp, R. norvegicus
tgagacatttctccag

SEQ ID NO: 522750 - DNA, 16 bp, R. norvegicus
tgagaccagaaaagaa

SEQ ID NO: 522751 - DNA, 16 bp, R. norvegicus
tgagaccagccagggc

SEQ ID NO: 522752 - DNA, 16 bp, R. norvegicus
tgagaccagcctggac

SEQ ID NO: 522753 - DNA, 16 bp, R. norvegicus
tgagaccaggaatcca

SEQ ID NO: 522754 - DNA, 16 bp, R. norvegicus
tgagacccagcccatg

SEQ ID NO: 522755 - DNA, 16 bp, R. norvegicus
tgagaccccactttct

SEQ ID NO: 522756 - DNA, 16 bp, R. norvegicus
tgagacccccatctca

SEQ ID NO: 522757 - DNA, 21 bp, R. norvegicus
tgagactatcaatcagattgt

SEQ ID NO: 522758 - DNA, 16 bp, R. norvegicus
tgagactcaaacccag

SEQ ID NO: 522759 - DNA, 16 bp, R. norvegicus
tgagactctctttcca

SEQ ID NO: 522760 - DNA, 16 bp, R. norvegicus
tgagactctgtcaaaa

SEQ ID NO: 522761 - DNA, 16 bp, R. norvegicus
tgagactggccttgaa

SEQ ID NO: 522762 - DNA, 16 bp, R. norvegicus
tgagactgtgtcttct

SEQ ID NO: 522763 - DNA, 16 bp, R. norvegicus
tgagacttctatctca

SEQ ID NO: 522764 - DNA, 16 bp, R. norvegicus
tgagagaattgggctc

SEQ ID NO: 522765 - DNA, 16 bp, R. norvegicus
tgagagacagagccac

SEQ ID NO: 522766 - DNA, 16 bp, R. norvegicus
tgagagacccagccag

SEQ ID NO: 522767 - DNA, 16 bp, R. norvegicus
tgagagagaacttcag

SEQ ID NO: 522768 - DNA, 16 bp, R. norvegicus
tgagagagagcaagga

SEQ ID NO: 522769 - DNA, 16 bp, R. norvegicus
tgagagaggcagccat

SEQ ID NO: 522770 - DNA, 17 bp, R. norvegicus
tgagagatacaaccaga

SEQ ID NO: 522771 - DNA, 16 bp, R. norvegicus
tgagagatctctccat

SEQ ID NO: 522772 - DNA, 16 bp, R. norvegicus
tgagagatgtgtgtgt

SEQ ID NO: 522773 - DNA, 16 bp, R. norvegicus
tgagagcaagaaggca

SEQ ID NO: 522774 - DNA, 16 bp, R. norvegicus
tgagagcaagagagag

SEQ ID NO: 522775 - DNA, 16 bp, R. norvegicus
tgagagcacagggaag

SEQ ID NO: 522776 - DNA, 16 bp, R. norvegicus
tgagagcatcttcata

SEQ ID NO: 522777 - DNA, 16 bp, R. norvegicus
tgagagccactgcctt

SEQ ID NO: 522778 - DNA, 16 bp, R. norvegicus
tgagagccccaaggat

SEQ ID NO: 522779 - DNA, 16 bp, R. norvegicus
tgagagctctggtggg

SEQ ID NO: 522780 - DNA, 16 bp, R. norvegicus
tgagagctgtgggatt

SEQ ID NO: 522781 - DNA, 16 bp, R. norvegicus
tgagagctgtggtttt

SEQ ID NO: 522782 - DNA, 16 bp, R. norvegicus
tgagagctttgcagga

SEQ ID NO: 522783 - DNA, 16 bp, R. norvegicus
tgagaggagaaaccct

SEQ ID NO: 522784 - DNA, 16 bp, R. norvegicus
tgagaggagagaacct

SEQ ID NO: 522785 - DNA, 16 bp, R. norvegicus
tgagaggagagaactg

SEQ ID NO: 522786 - DNA, 16 bp, R. norvegicus
tgagaggatgtttttg

SEQ ID NO: 522787 - DNA, 16 bp, R. norvegicus
tgagaggcaaaggcag

SEQ ID NO: 522788 - DNA, 16 bp, R. norvegicus
tgagaggcagaagcag

SEQ ID NO: 522789 - DNA, 16 bp, R. norvegicus
tgagaggcagagggag

SEQ ID NO: 522790 - DNA, 16 bp, R. norvegicus
tgagaggccctaccag

SEQ ID NO: 522791 - DNA, 16 bp, R. norvegicus
tgagaggctccaccag

SEQ ID NO: 522792 - DNA, 16 bp, R. norvegicus
tgagaggctgaagcag

SEQ ID NO: 522793 - DNA, 16 bp, R. norvegicus
tgagaggctgtaccag

SEQ ID NO: 522794 - DNA, 16 bp, R. norvegicus
tgagagggagagtaga

SEQ ID NO: 522795 - DNA, 16 bp, R. norvegicus
tgagaggggcaccagc

SEQ ID NO: 522796 - DNA, 16 bp, R. norvegicus
tgagaggtccaacaag

SEQ ID NO: 522797 - DNA, 16 bp, R. norvegicus
tgagaggtggaggcag

SEQ ID NO: 522798 - DNA, 16 bp, R. norvegicus
tgagagtctctcagga

SEQ ID NO: 522799 - DNA, 16 bp, R. norvegicus
tgagagtctctcatct

SEQ ID NO: 522800 - DNA, 16 bp, R. norvegicus
tgagagtctctctctc

SEQ ID NO: 522801 - DNA, 16 bp, R. norvegicus
tgagagtgtgtgtata

SEQ ID NO: 522802 - DNA, 16 bp, R. norvegicus
tgagagtgtgtgtgaa

SEQ ID NO: 522803 - DNA, 16 bp, R. norvegicus
tgagagttctacatct

SEQ ID NO: 522804 - DNA, 16 bp, R. norvegicus
tgagagtttgaggcca

SEQ ID NO: 522805 - DNA, 16 bp, R. norvegicus
tgagataactcagacc

SEQ ID NO: 522806 - DNA, 16 bp, R. norvegicus
tgagatacaatgaaag

SEQ ID NO: 522807 - DNA, 16 bp, R. norvegicus
tgagatagaaaaccta

SEQ ID NO: 522808 - DNA, 16 bp, R. norvegicus
tgagatatattatctg

SEQ ID NO: 522809 - DNA, 16 bp, R. norvegicus
tgagatcaccatggac

SEQ ID NO: 522810 - DNA, 16 bp, R. norvegicus
tgagatccacctcaca

SEQ ID NO: 522811 - DNA, 16 bp, R. norvegicus
tgagatccagttgtaa

SEQ ID NO: 522812 - DNA, 16 bp, R. norvegicus
tgagatcctgagttca

SEQ ID NO: 522813 - DNA, 16 bp, R. norvegicus
tgagatcctgtcaaaa

SEQ ID NO: 522814 - DNA, 16 bp, R. norvegicus
tgagatctctctccca

SEQ ID NO: 522815 - DNA, 16 bp, R. norvegicus
tgagatctttgatttc

SEQ ID NO: 522816 - DNA, 16 bp, R. norvegicus
tgagatggatcagtgg

SEQ ID NO: 522817 - DNA, 16 bp, R. norvegicus
tgagatggctcagtgg

SEQ ID NO: 522818 - DNA, 16 bp, R. norvegicus
tgagatggtttctctg

SEQ ID NO: 522819 - DNA, 16 bp, R. norvegicus
tgagatgtttaatttt

SEQ ID NO: 522820 - DNA, 16 bp, R. norvegicus
tgagattaaaagcata

SEQ ID NO: 522821 - DNA, 16 bp, R. norvegicus
tgagattaaaggcatg

SEQ ID NO: 522822 - DNA, 16 bp, R. norvegicus
tgagattaaaggtgtg

SEQ ID NO: 522823 - DNA, 16 bp, R. norvegicus
tgagattatctcttct

SEQ ID NO: 522824 - DNA, 16 bp, R. norvegicus
tgagattatgcagtct

SEQ ID NO: 522825 - DNA, 16 bp, R. norvegicus
tgagattccagctctc

SEQ ID NO: 522826 - DNA, 16 bp, R. norvegicus
tgagatttcattttat

SEQ ID NO: 522827 - DNA, 16 bp, R. norvegicus
tgagatttcctttgtc

SEQ ID NO: 522828 - DNA, 16 bp, R. norvegicus
tgagcaagccagtgag

SEQ ID NO: 522829 - DNA, 16 bp, R. norvegicus
tgagcaagtcatggag

SEQ ID NO: 522830 - DNA, 16 bp, R. norvegicus
tgagcacacagtgagc

SEQ ID NO: 522831 - DNA, 17 bp, R. norvegicus
tgagcacagcctccaca

SEQ ID NO: 522832 - DNA, 16 bp, R. norvegicus
tgagcacaggcagaaa

SEQ ID NO: 522833 - DNA, 16 bp, R. norvegicus
tgagcacagtgcaggg

SEQ ID NO: 522834 - DNA, 16 bp, R. norvegicus
tgagcacatgtgcaca

SEQ ID NO: 522835 - DNA, 16 bp, R. norvegicus
tgagcaccagcactca

SEQ ID NO: 522836 - DNA, 16 bp, R. norvegicus
tgagcactcagatgag

SEQ ID NO: 522837 - DNA, 16 bp, R. norvegicus
tgagcactggagaaaa

SEQ ID NO: 522838 - DNA, 16 bp, R. norvegicus
tgagcagacagacaga

SEQ ID NO: 522839 - DNA, 16 bp, R. norvegicus
tgagcagcaccattcc

SEQ ID NO: 522840 - DNA, 16 bp, R. norvegicus
tgagcagcagcagcag

SEQ ID NO: 522841 - DNA, 16 bp, R. norvegicus
tgagcatagtggagca

SEQ ID NO: 522842 - DNA, 16 bp, R. norvegicus
tgagcatcaccaacag

SEQ ID NO: 522843 - DNA, 16 bp, R. norvegicus
tgagcatcaccacagc

SEQ ID NO: 522844 - DNA, 16 bp, R. norvegicus
tgagcatctctgcagt

SEQ ID NO: 522845 - DNA, 16 bp, R. norvegicus
tgagcatgaaagatct

SEQ ID NO: 522846 - DNA, 16 bp, R. norvegicus
tgagcatgattgttgg

SEQ ID NO: 522847 - DNA, 16 bp, R. norvegicus
tgagcatggggaaccc

SEQ ID NO: 522848 - DNA, 16 bp, R. norvegicus
tgagcatgtgtgtgca

SEQ ID NO: 522849 - DNA, 16 bp, R. norvegicus
tgagcatttttgttcc

SEQ ID NO: 522850 - DNA, 16 bp, R. norvegicus
tgagccaaaatgaacc

SEQ ID NO: 522851 - DNA, 16 bp, R. norvegicus
tgagccaccactgccc

SEQ ID NO: 522852 - DNA, 16 bp, R. norvegicus
tgagccaccactgcct

SEQ ID NO: 522853 - DNA, 16 bp, R. norvegicus
tgagccaccatatagt

SEQ ID NO: 522854 - DNA, 16 bp, R. norvegicus
tgagccaccatgcctg

SEQ ID NO: 522855 - DNA, 16 bp, R. norvegicus
tgagccacctcacagg

SEQ ID NO: 522856 - DNA, 16 bp, R. norvegicus
tgagccagatctccag

SEQ ID NO: 522857 - DNA, 16 bp, R. norvegicus
tgagccagcctggcct

SEQ ID NO: 522858 - DNA, 16 bp, R. norvegicus
tgagccagctctccaa

SEQ ID NO: 522859 - DNA, 16 bp, R. norvegicus
tgagccaggtggtggt

SEQ ID NO: 522860 - DNA, 16 bp, R. norvegicus
tgagccagtttgcaga

SEQ ID NO: 522861 - DNA, 16 bp, R. norvegicus
tgagccatctccatgg

SEQ ID NO: 522862 - DNA, 16 bp, R. norvegicus
tgagccatctgaccag

SEQ ID NO: 522863 - DNA, 16 bp, R. norvegicus
tgagccatcttcccat

SEQ ID NO: 522864 - DNA, 16 bp, R. norvegicus
tgagccatcttgccca

SEQ ID NO: 522865 - DNA, 16 bp, R. norvegicus
tgagccatcttgtcaa

SEQ ID NO: 522866 - DNA, 16 bp, R. norvegicus
tgagccatctttccag

SEQ ID NO: 522867 - DNA, 16 bp, R. norvegicus
tgagccattcccccag

SEQ ID NO: 522868 - DNA, 16 bp, R. norvegicus
tgagccattttcccag

SEQ ID NO: 522869 - DNA, 16 bp, R. norvegicus
tgagcccaggagttca

SEQ ID NO: 522870 - DNA, 16 bp, R. norvegicus
tgagcccagggcctca

SEQ ID NO: 522871 - DNA, 16 bp, R. norvegicus
tgagccctcacaggac

SEQ ID NO: 522872 - DNA, 18 bp, R. norvegicus
tgagcctcaggaccacag

SEQ ID NO: 522873 - DNA, 16 bp, R. norvegicus
tgagcctcagtttacc

SEQ ID NO: 522874 - DNA, 16 bp, R. norvegicus
tgagcctcagtttccc

SEQ ID NO: 522875 - DNA, 16 bp, R. norvegicus
tgagcctccacaggac

SEQ ID NO: 522876 - DNA, 16 bp, R. norvegicus
tgagcctccatgtgga

SEQ ID NO: 522877 - DNA, 19 bp, R. norvegicus
tgagcctcgggaccacagg

SEQ ID NO: 522878 - DNA, 16 bp, R. norvegicus
tgagcctggggactcc

SEQ ID NO: 522879 - DNA, 16 bp, R. norvegicus
tgagcctgtggaggcc

SEQ ID NO: 522880 - DNA, 16 bp, R. norvegicus
tgagcctttaatccca

SEQ ID NO: 522881 - DNA, 16 bp, R. norvegicus
tgagcgtgcatgtgtg

SEQ ID NO: 522882 - DNA, 16 bp, R. norvegicus
tgagctacacccccaa

SEQ ID NO: 522883 - DNA, 16 bp, R. norvegicus
tgagctacctctccag

SEQ ID NO: 522884 - DNA, 16 bp, R. norvegicus
tgagctagagaatgag

SEQ ID NO: 522885 - DNA, 16 bp, R. norvegicus
tgagctatctcatcag

SEQ ID NO: 522886 - DNA, 16 bp, R. norvegicus
tgagctcacagaaatc

SEQ ID NO: 522887 - DNA, 16 bp, R. norvegicus
tgagctcagggccagc

SEQ ID NO: 522888 - DNA, 16 bp, R. norvegicus
tgagctccaggctcaa

SEQ ID NO: 522889 - DNA, 16 bp, R. norvegicus
tgagctccaggttcag

SEQ ID NO: 522890 - DNA, 16 bp, R. norvegicus
tgagctccctgacagg

SEQ ID NO: 522891 - DNA, 16 bp, R. norvegicus
tgagctctgggttcag

SEQ ID NO: 522892 - DNA, 16 bp, R. norvegicus
tgagctcttggtgagg

SEQ ID NO: 522893 - DNA, 16 bp, R. norvegicus
tgagctgaccctgtgc

SEQ ID NO: 522894 - DNA, 16 bp, R. norvegicus
tgagctgagttctgtc

SEQ ID NO: 522895 - DNA, 16 bp, R. norvegicus
tgagctgcagccccag

SEQ ID NO: 522896 - DNA, 16 bp, R. norvegicus
tgagctgctctgtggg

SEQ ID NO: 522897 - DNA, 16 bp, R. norvegicus
tgagctggagaggtgg

SEQ ID NO: 522898 - DNA, 16 bp, R. norvegicus
tgagctggagcagatc

SEQ ID NO: 522899 - DNA, 16 bp, R. norvegicus
tgagctggctcagcag

SEQ ID NO: 522900 - DNA, 16 bp, R. norvegicus
tgagctgggccatgtg

SEQ ID NO: 522901 - DNA, 16 bp, R. norvegicus
tgagctgggcttcctg

SEQ ID NO: 522902 - DNA, 17 bp, R. norvegicus
tgagctggtagtcttca

SEQ ID NO: 522903 - DNA, 16 bp, R. norvegicus
tgagctggtggttctg

SEQ ID NO: 522904 - DNA, 23 bp, R. norvegicus
tgagctggtggttttcctgcctg

SEQ ID NO: 522905 - DNA, 16 bp, R. norvegicus
tgagcttcaggccagt

SEQ ID NO: 522906 - DNA, 16 bp, R. norvegicus
tgagcttcagtttcag

SEQ ID NO: 522907 - DNA, 16 bp, R. norvegicus
tgagcttcagtttcct

SEQ ID NO: 522908 - DNA, 16 bp, R. norvegicus
tgagcttcctttggtc

SEQ ID NO: 522909 - DNA, 16 bp, R. norvegicus
tgagcttgggacacag

SEQ ID NO: 522910 - DNA, 16 bp, R. norvegicus
tgagctttgtacaagg

SEQ ID NO: 522911 - DNA, 16 bp, R. norvegicus
tgaggaaacgcctcca

SEQ ID NO: 522912 - DNA, 16 bp, R. norvegicus
tgaggaaactgaggct

SEQ ID NO: 522913 - DNA, 16 bp, R. norvegicus
tgaggaaactgagtca

SEQ ID NO: 522914 - DNA, 16 bp, R. norvegicus
tgaggaaagaaatcga

SEQ ID NO: 522915 - DNA, 16 bp, R. norvegicus
tgaggaaagctgctaa

SEQ ID NO: 522916 - DNA, 16 bp, R. norvegicus
tgaggaaagtaactaa

SEQ ID NO: 522917 - DNA, 16 bp, R. norvegicus
tgaggaaagtagaaga

SEQ ID NO: 522918 - DNA, 16 bp, R. norvegicus
tgaggaaccatcagat

SEQ ID NO: 522919 - DNA, 16 bp, R. norvegicus
tgaggaagaagaggca

SEQ ID NO: 522920 - DNA, 16 bp, R. norvegicus
tgaggaagaatctcga

SEQ ID NO: 522921 - DNA, 16 bp, R. norvegicus
tgaggaagatacctga

SEQ ID NO: 522922 - DNA, 16 bp, R. norvegicus
tgaggaagcagaatta

SEQ ID NO: 522923 - DNA, 16 bp, R. norvegicus
tgaggaagctgaggag

SEQ ID NO: 522924 - DNA, 16 bp, R. norvegicus
tgaggaagtcagagga

SEQ ID NO: 522925 - DNA, 16 bp, R. norvegicus
tgaggaagtggaggca

SEQ ID NO: 522926 - DNA, 16 bp, R. norvegicus
tgaggaagttaaaaaa

SEQ ID NO: 522927 - DNA, 16 bp, R. norvegicus
tgaggaatgctggatg

SEQ ID NO: 522928 - DNA, 16 bp, R. norvegicus
tgaggaatgggatgag

SEQ ID NO: 522929 - DNA, 16 bp, R. norvegicus
tgaggaattcaaggcc

SEQ ID NO: 522930 - DNA, 16 bp, R. norvegicus
tgaggacactgaggac

SEQ ID NO: 522931 - DNA, 16 bp, R. norvegicus
tgaggacagcaacagt

SEQ ID NO: 522932 - DNA, 16 bp, R. norvegicus
tgaggacagcctgggc

SEQ ID NO: 522933 - DNA, 16 bp, R. norvegicus
tgaggacagtgacagt

SEQ ID NO: 522934 - DNA, 16 bp, R. norvegicus
tgaggacccagctata

SEQ ID NO: 522935 - DNA, 16 bp, R. norvegicus
tgaggacctaacccag

SEQ ID NO: 522936 - DNA, 19 bp, R. norvegicus
tgaggactcctggcatcga

SEQ ID NO: 522937 - DNA, 16 bp, R. norvegicus
tgaggactgtggctga

SEQ ID NO: 522938 - DNA, 16 bp, R. norvegicus
tgaggagaagcagaga

SEQ ID NO: 522939 - DNA, 16 bp, R. norvegicus
tgaggagacaggagag

SEQ ID NO: 522940 - DNA, 16 bp, R. norvegicus
tgaggagagcattgtt

SEQ ID NO: 522941 - DNA, 16 bp, R. norvegicus
tgaggagaggcaggag

SEQ ID NO: 522942 - DNA, 16 bp, R. norvegicus
tgaggagatggcccag

SEQ ID NO: 522943 - DNA, 16 bp, R. norvegicus
tgaggagatggctcag

SEQ ID NO: 522944 - DNA, 16 bp, R. norvegicus
tgaggagatggctctg

SEQ ID NO: 522945 - DNA, 16 bp, R. norvegicus
tgaggagctcagaaga

SEQ ID NO: 522946 - DNA, 16 bp, R. norvegicus
tgaggagctgctggca

SEQ ID NO: 522947 - DNA, 16 bp, R. norvegicus
tgaggagctgtcctca

SEQ ID NO: 522948 - DNA, 16 bp, R. norvegicus
tgaggaggaactggga

SEQ ID NO: 522949 - DNA, 16 bp, R. norvegicus
tgaggaggaaggtgac

SEQ ID NO: 522950 - DNA, 16 bp, R. norvegicus
tgaggaggaggctgtg

SEQ ID NO: 522951 - DNA, 16 bp, R. norvegicus
tgaggaggatgaggat

SEQ ID NO: 522952 - DNA, 16 bp, R. norvegicus
tgaggaggcagaagca

SEQ ID NO: 522953 - DNA, 16 bp, R. norvegicus
tgaggaggcagagaga

SEQ ID NO: 522954 - DNA, 16 bp, R. norvegicus
tgaggaggccagagga

SEQ ID NO: 522955 - DNA, 20 bp, R. norvegicus
tgaggagtgttcctctttct

SEQ ID NO: 522956 - DNA, 16 bp, R. norvegicus
tgaggatctccttgtc

SEQ ID NO: 522957 - DNA, 16 bp, R. norvegicus
tgaggatgacattgaa

SEQ ID NO: 522958 - DNA, 16 bp, R. norvegicus
tgaggatgactctgaa

SEQ ID NO: 522959 - DNA, 16 bp, R. norvegicus
tgaggatgaggaagag

SEQ ID NO: 522960 - DNA, 16 bp, R. norvegicus
tgaggatgaggagaaa

SEQ ID NO: 522961 - DNA, 16 bp, R. norvegicus
tgaggatgaggatggg

SEQ ID NO: 522962 - DNA, 16 bp, R. norvegicus
tgaggatgcctgcagc

SEQ ID NO: 522963 - DNA, 16 bp, R. norvegicus
tgaggatgcttgcagc

SEQ ID NO: 522964 - DNA, 16 bp, R. norvegicus
tgaggatggagcccag

SEQ ID NO: 522965 - DNA, 16 bp, R. norvegicus
tgaggatgtggagaaa

SEQ ID NO: 522966 - DNA, 16 bp, R. norvegicus
tgaggattatcgaatg

SEQ ID NO: 522967 - DNA, 16 bp, R. norvegicus
tgaggcagaaggatct

SEQ ID NO: 522968 - DNA, 16 bp, R. norvegicus
tgaggcagagtctcat

SEQ ID NO: 522969 - DNA, 16 bp, R. norvegicus
tgaggcagagtctctc

SEQ ID NO: 522970 - DNA, 16 bp, R. norvegicus
tgaggcaggaactgaa

SEQ ID NO: 522971 - DNA, 16 bp, R. norvegicus
tgaggcaggaaggttg

SEQ ID NO: 522972 - DNA, 16 bp, R. norvegicus
tgaggcaggagaacca

SEQ ID NO: 522973 - DNA, 16 bp, R. norvegicus
tgaggcaggctctgaa

SEQ ID NO: 522974 - DNA, 16 bp, R. norvegicus
tgaggcaggggaattg

SEQ ID NO: 522975 - DNA, 16 bp, R. norvegicus
tgaggcagtacctgac

SEQ ID NO: 522976 - DNA, 16 bp, R. norvegicus
tgaggcagtcattggt

SEQ ID NO: 522977 - DNA, 16 bp, R. norvegicus
tgaggccaccaggtgg

SEQ ID NO: 522978 - DNA, 16 bp, R. norvegicus
tgaggccagacaaggt

SEQ ID NO: 522979 - DNA, 16 bp, R. norvegicus
tgaggccagccagggc

SEQ ID NO: 522980 - DNA, 16 bp, R. norvegicus
tgaggccagcctaggt

SEQ ID NO: 522981 - DNA, 16 bp, R. norvegicus
tgaggccagcctgagc

SEQ ID NO: 522982 - DNA, 16 bp, R. norvegicus
tgaggccagccttggt

SEQ ID NO: 522983 - DNA, 16 bp, R. norvegicus
tgaggccaggcatgtg

SEQ ID NO: 522984 - DNA, 16 bp, R. norvegicus
tgaggccagtgggaaa

SEQ ID NO: 522985 - DNA, 16 bp, R. norvegicus
tgaggccctaggttca

SEQ ID NO: 522986 - DNA, 16 bp, R. norvegicus
tgaggccctgggttcg

SEQ ID NO: 522987 - DNA, 16 bp, R. norvegicus
tgaggccggcctgggc

SEQ ID NO: 522988 - DNA, 16 bp, R. norvegicus
tgaggcctctgggctc

SEQ ID NO: 522989 - DNA, 16 bp, R. norvegicus
tgaggcctggagagat

SEQ ID NO: 522990 - DNA, 16 bp, R. norvegicus
tgaggcctgttttgtg

SEQ ID NO: 522991 - DNA, 16 bp, R. norvegicus
tgaggctaaattaaaa

SEQ ID NO: 522992 - DNA, 16 bp, R. norvegicus
tgaggctagaaaaggc

SEQ ID NO: 522993 - DNA, 16 bp, R. norvegicus
tgaggctagacaaggc

SEQ ID NO: 522994 - DNA, 16 bp, R. norvegicus
tgaggctcagagaaag

SEQ ID NO: 522995 - DNA, 16 bp, R. norvegicus
tgaggctccttctctg

SEQ ID NO: 522996 - DNA, 16 bp, R. norvegicus
tgaggctgaagagatg

SEQ ID NO: 522997 - DNA, 16 bp, R. norvegicus
tgaggctgaagcagat

SEQ ID NO: 522998 - DNA, 16 bp, R. norvegicus
tgaggctgcacacact

SEQ ID NO: 522999 - DNA, 16 bp, R. norvegicus
tgaggctggggagatg

SEQ ID NO: 523000 - DNA, 16 bp, R. norvegicus
tgaggcttattttgtg

SEQ ID NO: 523001 - DNA, 16 bp, R. norvegicus
tgaggcttccaacaca

SEQ ID NO: 523002 - DNA, 16 bp, R. norvegicus
tgagggaaagaccatc

SEQ ID NO: 523003 - DNA, 16 bp, R. norvegicus
tgagggaagtcaggac

SEQ ID NO: 523004 - DNA, 16 bp, R. norvegicus
tgagggacaactgggt

SEQ ID NO: 523005 - DNA, 16 bp, R. norvegicus
tgagggacagggccag

SEQ ID NO: 523006 - DNA, 16 bp, R. norvegicus
tgagggagctggagag

SEQ ID NO: 523007 - DNA, 23 bp, R. norvegicus
tgagggagggacccctgcaaaaa

SEQ ID NO: 523008 - DNA, 16 bp, R. norvegicus
tgagggagttggttct

SEQ ID NO: 523009 - DNA, 16 bp, R. norvegicus
tgagggcagcctgagc

SEQ ID NO: 523010 - DNA, 16 bp, R. norvegicus
tgagggcagcctgggc

SEQ ID NO: 523011 - DNA, 16 bp, R. norvegicus
tgagggcaggcacaag

SEQ ID NO: 523012 - DNA, 16 bp, R. norvegicus
tgagggctcatctgca

SEQ ID NO: 523013 - DNA, 16 bp, R. norvegicus
tgaggggcagagccag

SEQ ID NO: 523014 - DNA, 16 bp, R. norvegicus
tgaggggctgaagaga

SEQ ID NO: 523015 - DNA, 16 bp, R. norvegicus
tgagggtccatctctc

SEQ ID NO: 523016 - DNA, 16 bp, R. norvegicus
tgagggtctccctgct

SEQ ID NO: 523017 - DNA, 16 bp, R. norvegicus
tgagggtctggagaga

SEQ ID NO: 523018 - DNA, 16 bp, R. norvegicus
tgagggtgctctccca

SEQ ID NO: 523019 - DNA, 16 bp, R. norvegicus
tgagggtgtttccaga

SEQ ID NO: 523020 - DNA, 16 bp, R. norvegicus
tgagggttttgctgga

SEQ ID NO: 523021 - DNA, 16 bp, R. norvegicus
tgaggtaaaatcttca

SEQ ID NO: 523022 - DNA, 16 bp, R. norvegicus
tgaggtaatgcatatt

SEQ ID NO: 523023 - DNA, 16 bp, R. norvegicus
tgaggtataagagtaa

SEQ ID NO: 523024 - DNA, 17 bp, R. norvegicus
tgaggtcaaagtccagg

SEQ ID NO: 523025 - DNA, 16 bp, R. norvegicus
tgaggtcaccctggtc

SEQ ID NO: 523026 - DNA, 16 bp, R. norvegicus
tgaggtcagcctggac

SEQ ID NO: 523027 - DNA, 16 bp, R. norvegicus
tgaggtcagtgtgggc

SEQ ID NO: 523028 - DNA, 16 bp, R. norvegicus
tgaggtcatcctggtc

SEQ ID NO: 523029 - DNA, 16 bp, R. norvegicus
tgaggtcccatctgtc

SEQ ID NO: 523030 - DNA, 16 bp, R. norvegicus
tgaggtctctgatcca

SEQ ID NO: 523031 - DNA, 16 bp, R. norvegicus
tgaggtgaaatctttt

SEQ ID NO: 523032 - DNA, 16 bp, R. norvegicus
tgaggtgacatggaaa

SEQ ID NO: 523033 - DNA, 16 bp, R. norvegicus
tgaggtgagaagaccc

SEQ ID NO: 523034 - DNA, 16 bp, R. norvegicus
tgaggtgatccaggac

SEQ ID NO: 523035 - DNA, 16 bp, R. norvegicus
tgaggtgctgtgaaga

SEQ ID NO: 523036 - DNA, 16 bp, R. norvegicus
tgaggtggaatatcag

SEQ ID NO: 523037 - DNA, 16 bp, R. norvegicus
tgaggtggaatttcag

SEQ ID NO: 523038 - DNA, 16 bp, R. norvegicus
tgaggtggctcacaac

SEQ ID NO: 523039 - DNA, 16 bp, R. norvegicus
tgaggtgtggctcagt

SEQ ID NO: 523040 - DNA, 16 bp, R. norvegicus
tgaggtgtgtgtatgt

SEQ ID NO: 523041 - DNA, 16 bp, R. norvegicus
tgaggttcctgcagca

SEQ ID NO: 523042 - DNA, 16 bp, R. norvegicus
tgaggttggaccccag

SEQ ID NO: 523043 - DNA, 16 bp, R. norvegicus
tgaggttggagtaggt

SEQ ID NO: 523044 - DNA, 16 bp, R. norvegicus
tgaggtttcaaaagtc

SEQ ID NO: 523045 - DNA, 16 bp, R. norvegicus
tgaggtttcagaagtc

SEQ ID NO: 523046 - DNA, 16 bp, R. norvegicus
tgagtacactgtcgcc

SEQ ID NO: 523047 - DNA, 16 bp, R. norvegicus
tgagtacactgttact

SEQ ID NO: 523048 - DNA, 16 bp, R. norvegicus
tgagtaccctgtcact

SEQ ID NO: 523049 - DNA, 17 bp, R. norvegicus
tgagtactattcattgc

SEQ ID NO: 523050 - DNA, 16 bp, R. norvegicus
tgagtagatgaaggct

SEQ ID NO: 523051 - DNA, 16 bp, R. norvegicus
tgagtatgtggagaaa

SEQ ID NO: 523052 - DNA, 16 bp, R. norvegicus
tgagtattctttgttt

SEQ ID NO: 523053 - DNA, 16 bp, R. norvegicus
tgagtattttgttcct

SEQ ID NO: 523054 - DNA, 16 bp, R. norvegicus
tgagtatttttccatc

SEQ ID NO: 523055 - DNA, 16 bp, R. norvegicus
tgagtcacctccccag

SEQ ID NO: 523056 - DNA, 16 bp, R. norvegicus
tgagtcagaattttga

SEQ ID NO: 523057 - DNA, 16 bp, R. norvegicus
tgagtcagagagaaaa

SEQ ID NO: 523058 - DNA, 16 bp, R. norvegicus
tgagtcagaggccagc

SEQ ID NO: 523059 - DNA, 16 bp, R. norvegicus
tgagtcatttcaccag

SEQ ID NO: 523060 - DNA, 16 bp, R. norvegicus
tgagtccaattcccag

SEQ ID NO: 523061 - DNA, 16 bp, R. norvegicus
tgagtccagacaaggc

SEQ ID NO: 523062 - DNA, 16 bp, R. norvegicus
tgagtcctctggaaaa

SEQ ID NO: 523063 - DNA, 16 bp, R. norvegicus
tgagtcctgagagtat

SEQ ID NO: 523064 - DNA, 16 bp, R. norvegicus
tgagtctagcctggtc

SEQ ID NO: 523065 - DNA, 16 bp, R. norvegicus
tgagtctctgcatctg

SEQ ID NO: 523066 - DNA, 16 bp, R. norvegicus
tgagtctgaagccagc

SEQ ID NO: 523067 - DNA, 16 bp, R. norvegicus
tgagtcttcccacttc

SEQ ID NO: 523068 - DNA, 16 bp, R. norvegicus
tgagtgacacagccag

SEQ ID NO: 523069 - DNA, 16 bp, R. norvegicus
tgagtgagtgtgcatg

SEQ ID NO: 523070 - DNA, 16 bp, R. norvegicus
tgagtgatgtaatcca

SEQ ID NO: 523071 - DNA, 16 bp, R. norvegicus
tgagtgcctgcggaaa

SEQ ID NO: 523072 - DNA, 16 bp, R. norvegicus
tgagtgctgagattaa

SEQ ID NO: 523073 - DNA, 16 bp, R. norvegicus
tgagtgctggggttac

SEQ ID NO: 523074 - DNA, 16 bp, R. norvegicus
tgagtgctgtgattaa

SEQ ID NO: 523075 - DNA, 16 bp, R. norvegicus
tgagtgctttgagagg

SEQ ID NO: 523076 - DNA, 16 bp, R. norvegicus
tgagtggggctgggga

SEQ ID NO: 523077 - DNA, 16 bp, R. norvegicus
tgagtgggggcaggag

SEQ ID NO: 523078 - DNA, 17 bp, R. norvegicus
tgagtgggtgctgccat

SEQ ID NO: 523079 - DNA, 16 bp, R. norvegicus
tgagtgggtggcccca

SEQ ID NO: 523080 - DNA, 16 bp, R. norvegicus
tgagtgtacatgtgtg

SEQ ID NO: 523081 - DNA, 16 bp, R. norvegicus
tgagtgtatatgtgtg

SEQ ID NO: 523082 - DNA, 36 bp, R. norvegicus
tgagtgtcccatgcattcaaacaacaagcatcttca

SEQ ID NO: 523083 - DNA, 16 bp, R. norvegicus
tgagtgtgagtgtgtg

SEQ ID NO: 523084 - DNA, 16 bp, R. norvegicus
tgagtgtgggcaggct

SEQ ID NO: 523085 - DNA, 16 bp, R. norvegicus
tgagtgtgtacacaca

SEQ ID NO: 523086 - DNA, 16 bp, R. norvegicus
tgagtgtgtacatgtg

SEQ ID NO: 523087 - DNA, 16 bp, R. norvegicus
tgagtgtgtctatgtg

SEQ ID NO: 523088 - DNA, 16 bp, R. norvegicus
tgagtgtgtgaatgtg

SEQ ID NO: 523089 - DNA, 16 bp, R. norvegicus
tgagtgtgtgcagtgt

SEQ ID NO: 523090 - DNA, 16 bp, R. norvegicus
tgagtgtgtgcttgtg

SEQ ID NO: 523091 - DNA, 16 bp, R. norvegicus
tgagtgtgtgtgagaa

SEQ ID NO: 523092 - DNA, 16 bp, R. norvegicus
tgagtgtgtgtgcctg

SEQ ID NO: 523093 - DNA, 16 bp, R. norvegicus
tgagttacctcagtca

SEQ ID NO: 523094 - DNA, 16 bp, R. norvegicus
tgagttagagaaagga

SEQ ID NO: 523095 - DNA, 16 bp, R. norvegicus
tgagttcaaaaccagc

SEQ ID NO: 523096 - DNA, 24 bp, R. norvegicus
tgagttcaaatcccagcaaccaca

SEQ ID NO: 523097 - DNA, 16 bp, R. norvegicus
tgagttcaagattagc

SEQ ID NO: 523098 - DNA, 16 bp, R. norvegicus
tgagttcaagcctcag

SEQ ID NO: 523099 - DNA, 16 bp, R. norvegicus
tgagttcaaggccacc

SEQ ID NO: 523100 - DNA, 16 bp, R. norvegicus
tgagttcaaggccatc

SEQ ID NO: 523101 - DNA, 16 bp, R. norvegicus
tgagttcaagggcagc

SEQ ID NO: 523102 - DNA, 16 bp, R. norvegicus
tgagttcaatcctgag

SEQ ID NO: 523103 - DNA, 16 bp, R. norvegicus
tgagttcagtgcccag

SEQ ID NO: 523104 - DNA, 16 bp, R. norvegicus
tgagttcatggctagc

SEQ ID NO: 523105 - DNA, 16 bp, R. norvegicus
tgagttccaagccagc

SEQ ID NO: 523106 - DNA, 16 bp, R. norvegicus
tgagttccatctcatg

SEQ ID NO: 523107 - DNA, 16 bp, R. norvegicus
tgagttccatctccag

SEQ ID NO: 523108 - DNA, 16 bp, R. norvegicus
tgagttcctggacagc

SEQ ID NO: 523109 - DNA, 16 bp, R. norvegicus
tgagttcctggtcagc

SEQ ID NO: 523110 - DNA, 16 bp, R. norvegicus
tgagttccttttatat

SEQ ID NO: 523111 - DNA, 16 bp, R. norvegicus
tgagttctataaggaa

SEQ ID NO: 523112 - DNA, 16 bp, R. norvegicus
tgagttcttctatgaa

SEQ ID NO: 523113 - DNA, 16 bp, R. norvegicus
tgagttgtgtagatgt

SEQ ID NO: 523114 - DNA, 16 bp, R. norvegicus
tgagtttcaggatagc

SEQ ID NO: 523115 - DNA, 16 bp, R. norvegicus
tgagtttccctcttct

SEQ ID NO: 523116 - DNA, 16 bp, R. norvegicus
tgagtttcctcagttt

SEQ ID NO: 523117 - DNA, 16 bp, R. norvegicus
tgagtttctcaaagaa

SEQ ID NO: 523118 - DNA, 16 bp, R. norvegicus
tgagtttgaagccagc

SEQ ID NO: 523119 - DNA, 16 bp, R. norvegicus
tgagtttgaaggagag

SEQ ID NO: 523120 - DNA, 16 bp, R. norvegicus
tgagtttgaggccaac

SEQ ID NO: 523121 - DNA, 16 bp, R. norvegicus
tgagtttgagtccagc

SEQ ID NO: 523122 - DNA, 16 bp, R. norvegicus
tgagtttgatccccag

SEQ ID NO: 523123 - DNA, 16 bp, R. norvegicus
tgagtttgattcccag

SEQ ID NO: 523124 - DNA, 16 bp, R. norvegicus
tgagtttgattccctg

SEQ ID NO: 523125 - DNA, 16 bp, R. norvegicus
tgagtttgatttcctg

SEQ ID NO: 523126 - DNA, 16 bp, R. norvegicus
tgagtttgctccccag

SEQ ID NO: 523127 - DNA, 16 bp, R. norvegicus
tgagtttggtccccag

SEQ ID NO: 523128 - DNA, 16 bp, R. norvegicus
tgagtttggttcccac

SEQ ID NO: 523129 - DNA, 16 bp, R. norvegicus
tgagtttgtaaaccaa

SEQ ID NO: 523130 - DNA, 23 bp, R. norvegicus
tgagttttccagtttttctggat

SEQ ID NO: 523131 - DNA, 16 bp, R. norvegicus
tgagttttcttgatga

SEQ ID NO: 523132 - DNA, 16 bp, R. norvegicus
tgagttttttaactta

SEQ ID NO: 523133 - DNA, 16 bp, R. norvegicus
tgataaaacaccatga

SEQ ID NO: 523134 - DNA, 16 bp, R. norvegicus
tgataaacagtctgag

SEQ ID NO: 523135 - DNA, 16 bp, R. norvegicus
tgataaacgacttcag

SEQ ID NO: 523136 - DNA, 16 bp, R. norvegicus
tgataaagatgctgaa

SEQ ID NO: 523137 - DNA, 16 bp, R. norvegicus
tgataaatatggatct

SEQ ID NO: 523138 - DNA, 16 bp, R. norvegicus
tgataaattgatatta

SEQ ID NO: 523139 - DNA, 16 bp, R. norvegicus
tgataagaacatcaag

SEQ ID NO: 523140 - DNA, 16 bp, R. norvegicus
tgataaggcaaggcca

SEQ ID NO: 523141 - DNA, 16 bp, R. norvegicus
tgataagtggatacta

SEQ ID NO: 523142 - DNA, 16 bp, R. norvegicus
tgataagtggatatta

SEQ ID NO: 523143 - DNA, 16 bp, R. norvegicus
tgataataaagaattg

SEQ ID NO: 523144 - DNA, 16 bp, R. norvegicus
tgataatgatgaagga

SEQ ID NO: 523145 - DNA, 16 bp, R. norvegicus
tgataatgtaatagaa

SEQ ID NO: 523146 - DNA, 16 bp, R. norvegicus
tgataatttcatatat

SEQ ID NO: 523147 - DNA, 16 bp, R. norvegicus
tgatacacagacatac

SEQ ID NO: 523148 - DNA, 16 bp, R. norvegicus
tgatacaccccacaga

SEQ ID NO: 523149 - DNA, 16 bp, R. norvegicus
tgatacactgttgaca

SEQ ID NO: 523150 - DNA, 16 bp, R. norvegicus
tgatacagatgaggac

SEQ ID NO: 523151 - DNA, 16 bp, R. norvegicus
tgatacagatgaggat

SEQ ID NO: 523152 - DNA, 16 bp, R. norvegicus
tgatacagatgagtat

SEQ ID NO: 523153 - DNA, 16 bp, R. norvegicus
tgatacagatgatgat

SEQ ID NO: 523154 - DNA, 16 bp, R. norvegicus
tgatacagcagcaaaa

SEQ ID NO: 523155 - DNA, 16 bp, R. norvegicus
tgatacaggggtggca

SEQ ID NO: 523156 - DNA, 17 bp, R. norvegicus
tgataccaaggccaaaa

SEQ ID NO: 523157 - DNA, 16 bp, R. norvegicus
tgataccctgtctttc

SEQ ID NO: 523158 - DNA, 16 bp, R. norvegicus
tgatagagagaaccag

SEQ ID NO: 523159 - DNA, 16 bp, R. norvegicus
tgatagaggacttata

SEQ ID NO: 523160 - DNA, 16 bp, R. norvegicus
tgatagaggactttaa

SEQ ID NO: 523161 - DNA, 16 bp, R. norvegicus
tgatagaggtcttata

SEQ ID NO: 523162 - DNA, 16 bp, R. norvegicus
tgatagatgaatggat

SEQ ID NO: 523163 - DNA, 16 bp, R. norvegicus
tgatagatgatagata

SEQ ID NO: 523164 - DNA, 16 bp, R. norvegicus
tgatagggacgacaga

SEQ ID NO: 523165 - DNA, 16 bp, R. norvegicus
tgatagggatgacaga

SEQ ID NO: 523166 - DNA, 16 bp, R. norvegicus
tgatagtcatggactc

SEQ ID NO: 523167 - DNA, 16 bp, R. norvegicus
tgatagtgagtggaac

SEQ ID NO: 523168 - DNA, 16 bp, R. norvegicus
tgatagttgaagtgct

SEQ ID NO: 523169 - DNA, 16 bp, R. norvegicus
tgatataactgtcttc

SEQ ID NO: 523170 - DNA, 16 bp, R. norvegicus
tgatatatatatatgt

SEQ ID NO: 523171 - DNA, 16 bp, R. norvegicus
tgatatccctgagagg

SEQ ID NO: 523172 - DNA, 16 bp, R. norvegicus
tgatatcctcttctgg

SEQ ID NO: 523173 - DNA, 16 bp, R. norvegicus
tgatatctgtccagaa

SEQ ID NO: 523174 - DNA, 16 bp, R. norvegicus
tgatatgtgacctctg

SEQ ID NO: 523175 - DNA, 16 bp, R. norvegicus
tgatattcaaaatata

SEQ ID NO: 523176 - DNA, 16 bp, R. norvegicus
tgatattcctctgttg

SEQ ID NO: 523177 - DNA, 16 bp, R. norvegicus
tgatattcctgaatta

SEQ ID NO: 523178 - DNA, 16 bp, R. norvegicus
tgatattgtaaaaatg

SEQ ID NO: 523179 - DNA, 16 bp, R. norvegicus
tgatatttctaaccta

SEQ ID NO: 523180 - DNA, 16 bp, R. norvegicus
tgatcaacaacttcag

SEQ ID NO: 523181 - DNA, 16 bp, R. norvegicus
tgatcaacctttctgt

SEQ ID NO: 523182 - DNA, 16 bp, R. norvegicus
tgatcaattttggaga

SEQ ID NO: 523183 - DNA, 16 bp, R. norvegicus
tgatcacagggacccc

SEQ ID NO: 523184 - DNA, 16 bp, R. norvegicus
tgatcagaagctgctg

SEQ ID NO: 523185 - DNA, 16 bp, R. norvegicus
tgatcaggaaaatgca

SEQ ID NO: 523186 - DNA, 16 bp, R. norvegicus
tgatcaggaaacacag

SEQ ID NO: 523187 - DNA, 16 bp, R. norvegicus
tgatcatccgtctaga

SEQ ID NO: 523188 - DNA, 16 bp, R. norvegicus
tgatcatcgtggatga

SEQ ID NO: 523189 - DNA, 16 bp, R. norvegicus
tgatcatgattctgga

SEQ ID NO: 523190 - DNA, 16 bp, R. norvegicus
tgatcatggagcagga

SEQ ID NO: 523191 - DNA, 16 bp, R. norvegicus
tgatcatggtggaaga

SEQ ID NO: 523192 - DNA, 16 bp, R. norvegicus
tgatcatggtggatga

SEQ ID NO: 523193 - DNA, 16 bp, R. norvegicus
tgatcatgtgcttttt

SEQ ID NO: 523194 - DNA, 16 bp, R. norvegicus
tgatcatttaattaga

SEQ ID NO: 523195 - DNA, 16 bp, R. norvegicus
tgatccaaatacaagg

SEQ ID NO: 523196 - DNA, 16 bp, R. norvegicus
tgatccaaatgcaagg

SEQ ID NO: 523197 - DNA, 16 bp, R. norvegicus
tgatccactcacaaac

SEQ ID NO: 523198 - DNA, 16 bp, R. norvegicus
tgatccagaacagctg

SEQ ID NO: 523199 - DNA, 16 bp, R. norvegicus
tgatccagggctccaa

SEQ ID NO: 523200 - DNA, 16 bp, R. norvegicus
tgatcccaaaattcca

SEQ ID NO: 523201 - DNA, 16 bp, R. norvegicus
tgatcccagcactcca

SEQ ID NO: 523202 - DNA, 16 bp, R. norvegicus
tgatcccatcccacag

SEQ ID NO: 523203 - DNA, 16 bp, R. norvegicus
tgatcctaaactgtcc

SEQ ID NO: 523204 - DNA, 16 bp, R. norvegicus
tgatcctcaggaccca

SEQ ID NO: 523205 - DNA, 18 bp, R. norvegicus
tgatcctgataaactcaa

SEQ ID NO: 523206 - DNA, 16 bp, R. norvegicus
tgatcctggtgaatga

SEQ ID NO: 523207 - DNA, 16 bp, R. norvegicus
tgatcctgtggaggct

SEQ ID NO: 523208 - DNA, 16 bp, R. norvegicus
tgatcctgttcagata

SEQ ID NO: 523209 - DNA, 16 bp, R. norvegicus
tgatccttctacctct

SEQ ID NO: 523210 - DNA, 16 bp, R. norvegicus
tgatccttctgtttct

SEQ ID NO: 523211 - DNA, 16 bp, R. norvegicus
tgatccttgtgcctct

SEQ ID NO: 523212 - DNA, 16 bp, R. norvegicus
tgatctacctgtttgt

SEQ ID NO: 523213 - DNA, 16 bp, R. norvegicus
tgatctctctctctct

SEQ ID NO: 523214 - DNA, 16 bp, R. norvegicus
tgatctctttcctggg

SEQ ID NO: 523215 - DNA, 16 bp, R. norvegicus
tgatctgatagaattc

SEQ ID NO: 523216 - DNA, 16 bp, R. norvegicus
tgatctgcagagtgag

SEQ ID NO: 523217 - DNA, 16 bp, R. norvegicus
tgatcttagagaataa

SEQ ID NO: 523218 - DNA, 16 bp, R. norvegicus
tgatcttagagcatat

SEQ ID NO: 523219 - DNA, 16 bp, R. norvegicus
tgatcttagccatgct

SEQ ID NO: 523220 - DNA, 16 bp, R. norvegicus
tgatcttagtgattct

SEQ ID NO: 523221 - DNA, 16 bp, R. norvegicus
tgatcttcctacttct

SEQ ID NO: 523222 - DNA, 16 bp, R. norvegicus
tgatcttccttcctcc

SEQ ID NO: 523223 - DNA, 16 bp, R. norvegicus
tgatcttcgcttccct

SEQ ID NO: 523224 - DNA, 16 bp, R. norvegicus
tgatcttctcattgaa

SEQ ID NO: 523225 - DNA, 16 bp, R. norvegicus
tgatcttctttcttct

SEQ ID NO: 523226 - DNA, 17 bp, R. norvegicus
tgatcttggtggatgat

SEQ ID NO: 523227 - DNA, 16 bp, R. norvegicus
tgatctttccaagagt

SEQ ID NO: 523228 - DNA, 16 bp, R. norvegicus
tgatctttgtacaagg

SEQ ID NO: 523229 - DNA, 16 bp, R. norvegicus
tgatcttttgaatttc

SEQ ID NO: 523230 - DNA, 16 bp, R. norvegicus
tgatgaaaacagaaat

SEQ ID NO: 523231 - DNA, 16 bp, R. norvegicus
tgatgaaaagagacag

SEQ ID NO: 523232 - DNA, 16 bp, R. norvegicus
tgatgaacaacttcag

SEQ ID NO: 523233 - DNA, 16 bp, R. norvegicus
tgatgaacagcagcat

SEQ ID NO: 523234 - DNA, 16 bp, R. norvegicus
tgatgaactgtgatgt

SEQ ID NO: 523235 - DNA, 16 bp, R. norvegicus
tgatgaagaagtagaa

SEQ ID NO: 523236 - DNA, 16 bp, R. norvegicus
tgatgaagatgatggt

SEQ ID NO: 523237 - DNA, 16 bp, R. norvegicus
tgatgaagatgtggag

SEQ ID NO: 523238 - DNA, 16 bp, R. norvegicus
tgatgaagccaaaaag

SEQ ID NO: 523239 - DNA, 16 bp, R. norvegicus
tgatgaagctaaaaaa

SEQ ID NO: 523240 - DNA, 16 bp, R. norvegicus
tgatgaatatgaagag

SEQ ID NO: 523241 - DNA, 16 bp, R. norvegicus
tgatgacaatgatgat

SEQ ID NO: 523242 - DNA, 16 bp, R. norvegicus
tgatgacagtggtggt

SEQ ID NO: 523243 - DNA, 16 bp, R. norvegicus
tgatgacagtgtcctt

SEQ ID NO: 523244 - DNA, 16 bp, R. norvegicus
tgatgacatcactcaa

SEQ ID NO: 523245 - DNA, 16 bp, R. norvegicus
tgatgaccaagctgca

SEQ ID NO: 523246 - DNA, 16 bp, R. norvegicus
tgatgacccaggactg

SEQ ID NO: 523247 - DNA, 16 bp, R. norvegicus
tgatgacgatgacaac

SEQ ID NO: 523248 - DNA, 16 bp, R. norvegicus
tgatgactacttctgg

SEQ ID NO: 523249 - DNA, 16 bp, R. norvegicus
tgatgactgagcaagg

SEQ ID NO: 523250 - DNA, 16 bp, R. norvegicus
tgatgagagtgaggta

SEQ ID NO: 523251 - DNA, 16 bp, R. norvegicus
tgatgaggatgtggag

SEQ ID NO: 523252 - DNA, 16 bp, R. norvegicus
tgatgatagagtactt

SEQ ID NO: 523253 - DNA, 16 bp, R. norvegicus
tgatgatgaacagtgc

SEQ ID NO: 523254 - DNA, 18 bp, R. norvegicus
tgatgatgacgatgacga

SEQ ID NO: 523255 - DNA, 16 bp, R. norvegicus
tgatgatgatacagga

SEQ ID NO: 523256 - DNA, 16 bp, R. norvegicus
tgatgatgatgaactg

SEQ ID NO: 523257 - DNA, 16 bp, R. norvegicus
tgatgatgatgactat

SEQ ID NO: 523258 - DNA, 16 bp, R. norvegicus
tgatgatgatgataac

SEQ ID NO: 523259 - DNA, 16 bp, R. norvegicus
tgatgatgatgatatc

SEQ ID NO: 523260 - DNA, 16 bp, R. norvegicus
tgatgatgatgatgat

SEQ ID NO: 523261 - DNA, 16 bp, R. norvegicus
tgatgatgatgatgca

SEQ ID NO: 523262 - DNA, 16 bp, R. norvegicus
tgatgatgatgatgta

SEQ ID NO: 523263 - DNA, 16 bp, R. norvegicus
tgatgatgatgatgtg

SEQ ID NO: 523264 - DNA, 16 bp, R. norvegicus
tgatgatgattatgct

SEQ ID NO: 523265 - DNA, 16 bp, R. norvegicus
tgatgatgccaagtat

SEQ ID NO: 523266 - DNA, 16 bp, R. norvegicus
tgatgatgcttccagg

SEQ ID NO: 523267 - DNA, 16 bp, R. norvegicus
tgatgatggactgaat

SEQ ID NO: 523268 - DNA, 16 bp, R. norvegicus
tgatgatggaggagga

SEQ ID NO: 523269 - DNA, 16 bp, R. norvegicus
tgatgatggcagtggt

SEQ ID NO: 523270 - DNA, 16 bp, R. norvegicus
tgatgatgtcacagaa

SEQ ID NO: 523271 - DNA, 16 bp, R. norvegicus
tgatgattaagaatgt

SEQ ID NO: 523272 - DNA, 16 bp, R. norvegicus
tgatgatttctgtgga

SEQ ID NO: 523273 - DNA, 16 bp, R. norvegicus
tgatgcacaacaaggc

SEQ ID NO: 523274 - DNA, 16 bp, R. norvegicus
tgatgcagaagccatg

SEQ ID NO: 523275 - DNA, 16 bp, R. norvegicus
tgatgcatttcctcca

SEQ ID NO: 523276 - DNA, 16 bp, R. norvegicus
tgatgccaagaagctc

SEQ ID NO: 523277 - DNA, 16 bp, R. norvegicus
tgatgccaagaagtgc

SEQ ID NO: 523278 - DNA, 16 bp, R. norvegicus
tgatgccagatgaggc

SEQ ID NO: 523279 - DNA, 16 bp, R. norvegicus
tgatgcccaggaatca

SEQ ID NO: 523280 - DNA, 16 bp, R. norvegicus
tgatgcccttgaagcc

SEQ ID NO: 523281 - DNA, 16 bp, R. norvegicus
tgatgcctgacaagac

SEQ ID NO: 523282 - DNA, 16 bp, R. norvegicus
tgatgcctttgctgaa

SEQ ID NO: 523283 - DNA, 16 bp, R. norvegicus
tgatgctatacagaca

SEQ ID NO: 523284 - DNA, 16 bp, R. norvegicus
tgatgctcttttctgg

SEQ ID NO: 523285 - DNA, 16 bp, R. norvegicus
tgatgctgaaggactt

SEQ ID NO: 523286 - DNA, 16 bp, R. norvegicus
tgatgctgatgctgat

SEQ ID NO: 523287 - DNA, 16 bp, R. norvegicus
tgatgctgatggtggt

SEQ ID NO: 523288 - DNA, 18 bp, R. norvegicus
tgatgctggagaacttca

SEQ ID NO: 523289 - DNA, 16 bp, R. norvegicus
tgatgctggagggctt

SEQ ID NO: 523290 - DNA, 16 bp, R. norvegicus
tgatgctgggcaatgc

SEQ ID NO: 523291 - DNA, 16 bp, R. norvegicus
tgatgctggtcttttc

SEQ ID NO: 523292 - DNA, 16 bp, R. norvegicus
tgatgctgtgatgatg

SEQ ID NO: 523293 - DNA, 16 bp, R. norvegicus
tgatgcttttgtctat

SEQ ID NO: 523294 - DNA, 16 bp, R. norvegicus
tgatggaaatagatgc

SEQ ID NO: 523295 - DNA, 16 bp, R. norvegicus
tgatggaagacttcaa

SEQ ID NO: 523296 - DNA, 16 bp, R. norvegicus
tgatggagacattttc

SEQ ID NO: 523297 - DNA, 16 bp, R. norvegicus
tgatggagagaccaag

SEQ ID NO: 523298 - DNA, 16 bp, R. norvegicus
tgatggagagtttgac

SEQ ID NO: 523299 - DNA, 16 bp, R. norvegicus
tgatggagtatgacct

SEQ ID NO: 523300 - DNA, 21 bp, R. norvegicus
tgatggagttaatgcaattgg

SEQ ID NO: 523301 - DNA, 27 bp, R. norvegicus
tgatggagttaatgtaattgggttgtg

SEQ ID NO: 523302 - DNA, 16 bp, R. norvegicus
tgatggatttccatgt

SEQ ID NO: 523303 - DNA, 16 bp, R. norvegicus
tgatggatttttttct

SEQ ID NO: 523304 - DNA, 16 bp, R. norvegicus
tgatggcaggaggtac

SEQ ID NO: 523305 - DNA, 16 bp, R. norvegicus
tgatggcagtggtggt

SEQ ID NO: 523306 - DNA, 16 bp, R. norvegicus
tgatggcctctctctg

SEQ ID NO: 523307 - DNA, 16 bp, R. norvegicus
tgatgggaaaccagga

SEQ ID NO: 523308 - DNA, 16 bp, R. norvegicus
tgatgggaactgaact

SEQ ID NO: 523309 - DNA, 16 bp, R. norvegicus
tgatgggaattgcaat

SEQ ID NO: 523310 - DNA, 16 bp, R. norvegicus
tgatgggaattgtatt

SEQ ID NO: 523311 - DNA, 16 bp, R. norvegicus
tgatgggacaagcatt

SEQ ID NO: 523312 - DNA, 16 bp, R. norvegicus
tgatgggcattgcatt

SEQ ID NO: 523313 - DNA, 16 bp, R. norvegicus
tgatggggaagggccc

SEQ ID NO: 523314 - DNA, 16 bp, R. norvegicus
tgatggggctggagag

SEQ ID NO: 523315 - DNA, 16 bp, R. norvegicus
tgatgggtgtgacttt

SEQ ID NO: 523316 - DNA, 16 bp, R. norvegicus
tgatggtacaacatac

SEQ ID NO: 523317 - DNA, 16 bp, R. norvegicus
tgatggtatagttttc

SEQ ID NO: 523318 - DNA, 16 bp, R. norvegicus
tgatggtgacaatgat

SEQ ID NO: 523319 - DNA, 16 bp, R. norvegicus
tgatggtgaggatgat

SEQ ID NO: 523320 - DNA, 16 bp, R. norvegicus
tgatggtgatggtgat

SEQ ID NO: 523321 - DNA, 16 bp, R. norvegicus
tgatggtggtagtggt

SEQ ID NO: 523322 - DNA, 16 bp, R. norvegicus
tgatggtggtgatgac

SEQ ID NO: 523323 - DNA, 16 bp, R. norvegicus
tgatggtggtgatgat

SEQ ID NO: 523324 - DNA, 16 bp, R. norvegicus
tgatggtggtgatggt

SEQ ID NO: 523325 - DNA, 16 bp, R. norvegicus
tgatggtggtggtaat

SEQ ID NO: 523326 - DNA, 16 bp, R. norvegicus
tgatggtgtacacctt

SEQ ID NO: 523327 - DNA, 16 bp, R. norvegicus
tgatggttaatcttga

SEQ ID NO: 523328 - DNA, 16 bp, R. norvegicus
tgatggttcagtttct

SEQ ID NO: 523329 - DNA, 16 bp, R. norvegicus
tgatggttgtgttgat

SEQ ID NO: 523330 - DNA, 16 bp, R. norvegicus
tgatggtttgcatatg

SEQ ID NO: 523331 - DNA, 16 bp, R. norvegicus
tgatggttttggcttc

SEQ ID NO: 523332 - DNA, 16 bp, R. norvegicus
tgatgtcaaagcagtc

SEQ ID NO: 523333 - DNA, 16 bp, R. norvegicus
tgatgtcactggaaaa

SEQ ID NO: 523334 - DNA, 16 bp, R. norvegicus
tgatgtcagctctgag

SEQ ID NO: 523335 - DNA, 16 bp, R. norvegicus
tgatgtcattattttt

SEQ ID NO: 523336 - DNA, 16 bp, R. norvegicus
tgatgtctatatgcag

SEQ ID NO: 523337 - DNA, 16 bp, R. norvegicus
tgatgtgaacagacac

SEQ ID NO: 523338 - DNA, 16 bp, R. norvegicus
tgatgtgagagggccc

SEQ ID NO: 523339 - DNA, 16 bp, R. norvegicus
tgatgtgcatttctct

SEQ ID NO: 523340 - DNA, 16 bp, R. norvegicus
tgatgtggaggccatg

SEQ ID NO: 523341 - DNA, 16 bp, R. norvegicus
tgatgtggatgctggg

SEQ ID NO: 523342 - DNA, 16 bp, R. norvegicus
tgatgtgtacttggat

SEQ ID NO: 523343 - DNA, 16 bp, R. norvegicus
tgatgtgttcttcaat

SEQ ID NO: 523344 - DNA, 16 bp, R. norvegicus
tgatgtgtttggatat

SEQ ID NO: 523345 - DNA, 16 bp, R. norvegicus
tgatgttaagattctt

SEQ ID NO: 523346 - DNA, 16 bp, R. norvegicus
tgatgttgatggtgat

SEQ ID NO: 523347 - DNA, 16 bp, R. norvegicus
tgatgttgctgctgct

SEQ ID NO: 523348 - DNA, 16 bp, R. norvegicus
tgatgttggctactgc

SEQ ID NO: 523349 - DNA, 16 bp, R. norvegicus
tgatgttgttgttctt

SEQ ID NO: 523350 - DNA, 16 bp, R. norvegicus
tgatgtttaaagagca

SEQ ID NO: 523351 - DNA, 16 bp, R. norvegicus
tgatgtttatgcagga

SEQ ID NO: 523352 - DNA, 16 bp, R. norvegicus
tgatgtttggctgtga

SEQ ID NO: 523353 - DNA, 16 bp, R. norvegicus
tgattatctgtcttga

SEQ ID NO: 523354 - DNA, 16 bp, R. norvegicus
tgattcagactctgag

SEQ ID NO: 523355 - DNA, 16 bp, R. norvegicus
tgattcagatgggagc

SEQ ID NO: 523356 - DNA, 16 bp, R. norvegicus
tgattcattctctgcc

SEQ ID NO: 523357 - DNA, 16 bp, R. norvegicus
tgattccctctctgct

SEQ ID NO: 523358 - DNA, 16 bp, R. norvegicus
tgattcctgggggcac

SEQ ID NO: 523359 - DNA, 16 bp, R. norvegicus
tgattcctgtgtcctg

SEQ ID NO: 523360 - DNA, 16 bp, R. norvegicus
tgattccttgtattgt

SEQ ID NO: 523361 - DNA, 16 bp, R. norvegicus
tgattctcttgcctcc

SEQ ID NO: 523362 - DNA, 16 bp, R. norvegicus
tgattctgataggttt

SEQ ID NO: 523363 - DNA, 16 bp, R. norvegicus
tgattcttcctctctc

SEQ ID NO: 523364 - DNA, 16 bp, R. norvegicus
tgattcttcttcttct

SEQ ID NO: 523365 - DNA, 16 bp, R. norvegicus
tgattcttgggcacct

SEQ ID NO: 523366 - DNA, 16 bp, R. norvegicus
tgattctttcctgcct

SEQ ID NO: 523367 - DNA, 16 bp, R. norvegicus
tgattcttttaagatt

SEQ ID NO: 523368 - DNA, 16 bp, R. norvegicus
tgattgatatgggagg

SEQ ID NO: 523369 - DNA, 16 bp, R. norvegicus
tgattgatgggggagg

SEQ ID NO: 523370 - DNA, 16 bp, R. norvegicus
tgattgatgtagaagg

SEQ ID NO: 523371 - DNA, 16 bp, R. norvegicus
tgattgcttctatttt

SEQ ID NO: 523372 - DNA, 16 bp, R. norvegicus
tgattggctccttgaa

SEQ ID NO: 523373 - DNA, 16 bp, R. norvegicus
tgattgttatcttctt

SEQ ID NO: 523374 - DNA, 16 bp, R. norvegicus
tgattgttctggctag

SEQ ID NO: 523375 - DNA, 16 bp, R. norvegicus
tgatttacctcactca

SEQ ID NO: 523376 - DNA, 16 bp, R. norvegicus
tgatttcacttttctt

SEQ ID NO: 523377 - DNA, 16 bp, R. norvegicus
tgatttcagctctcag

SEQ ID NO: 523378 - DNA, 16 bp, R. norvegicus
tgatttcagctcttag

SEQ ID NO: 523379 - DNA, 16 bp, R. norvegicus
tgatttccaaaatggc

SEQ ID NO: 523380 - DNA, 16 bp, R. norvegicus
tgatttccacagtgat

SEQ ID NO: 523381 - DNA, 17 bp, R. norvegicus
tgatttccagagtggtt

SEQ ID NO: 523382 - DNA, 16 bp, R. norvegicus
tgatttccagagttat

SEQ ID NO: 523383 - DNA, 16 bp, R. norvegicus
tgatttccagttgaac

SEQ ID NO: 523384 - DNA, 16 bp, R. norvegicus
tgatttccataatggt

SEQ ID NO: 523385 - DNA, 16 bp, R. norvegicus
tgatttccatagtgac

SEQ ID NO: 523386 - DNA, 16 bp, R. norvegicus
tgatttccttccttct

SEQ ID NO: 523387 - DNA, 16 bp, R. norvegicus
tgatttctccatgtcc

SEQ ID NO: 523388 - DNA, 16 bp, R. norvegicus
tgatttctcctcttcc

SEQ ID NO: 523389 - DNA, 16 bp, R. norvegicus
tgatttctgctctgag

SEQ ID NO: 523390 - DNA, 16 bp, R. norvegicus
tgatttcttttctcct

SEQ ID NO: 523391 - DNA, 16 bp, R. norvegicus
tgatttgaatgagaaa

SEQ ID NO: 523392 - DNA, 16 bp, R. norvegicus
tgattttaaatataga

SEQ ID NO: 523393 - DNA, 16 bp, R. norvegicus
tgattttattcaatat

SEQ ID NO: 523394 - DNA, 16 bp, R. norvegicus
tgattttattcagtat

SEQ ID NO: 523395 - DNA, 16 bp, R. norvegicus
tgattttcctgtctca

SEQ ID NO: 523396 - DNA, 16 bp, R. norvegicus
tgattttctcacagaa

SEQ ID NO: 523397 - DNA, 16 bp, R. norvegicus
tgattttgttgattct

SEQ ID NO: 523398 - DNA, 16 bp, R. norvegicus
tgatttttaaaaatgt

SEQ ID NO: 523399 - DNA, 16 bp, R. norvegicus
tgatttttaaaacatt

SEQ ID NO: 523400 - DNA, 16 bp, R. norvegicus
tgatttttttccccct

SEQ ID NO: 523401 - DNA, 16 bp, R. norvegicus
tgcaaaacaaggggga

SEQ ID NO: 523402 - DNA, 16 bp, R. norvegicus
tgcaaaagatatttaa

SEQ ID NO: 523403 - DNA, 16 bp, R. norvegicus
tgcaaaagatgctcca

SEQ ID NO: 523404 - DNA, 16 bp, R. norvegicus
tgcaaaagcaagaggt

SEQ ID NO: 523405 - DNA, 16 bp, R. norvegicus
tgcaaaccccttcaac

SEQ ID NO: 523406 - DNA, 16 bp, R. norvegicus
tgcaaacctctttagc

SEQ ID NO: 523407 - DNA, 16 bp, R. norvegicus
tgcaaaggccctgggg

SEQ ID NO: 523408 - DNA, 16 bp, R. norvegicus
tgcaaaggtcctgggg

SEQ ID NO: 523409 - DNA, 16 bp, R. norvegicus
tgcaaatagaagcaat

SEQ ID NO: 523410 - DNA, 16 bp, R. norvegicus
tgcaaatccatttgga

SEQ ID NO: 523411 - DNA, 16 bp, R. norvegicus
tgcaaatgaaaacaac

SEQ ID NO: 523412 - DNA, 16 bp, R. norvegicus
tgcaaatttcataaag

SEQ ID NO: 523413 - DNA, 21 bp, R. norvegicus
tgcaacagcgcaggatcctag

SEQ ID NO: 523414 - DNA, 16 bp, R. norvegicus
tgcaaccccaccagca

SEQ ID NO: 523415 - DNA, 16 bp, R. norvegicus
tgcaaccccataggga

SEQ ID NO: 523416 - DNA, 16 bp, R. norvegicus
tgcaagaaagctgcct

SEQ ID NO: 523417 - DNA, 16 bp, R. norvegicus
tgcaagaaggctgcct

SEQ ID NO: 523418 - DNA, 16 bp, R. norvegicus
tgcaagcaacctgcct

SEQ ID NO: 523419 - DNA, 16 bp, R. norvegicus
tgcaagcatagcagaa

SEQ ID NO: 523420 - DNA, 16 bp, R. norvegicus
tgcaagcatcttcatc

SEQ ID NO: 523421 - DNA, 16 bp, R. norvegicus
tgcaagcctgtgtgct

SEQ ID NO: 523422 - DNA, 16 bp, R. norvegicus
tgcaaggacagaaaat

SEQ ID NO: 523423 - DNA, 16 bp, R. norvegicus
tgcaaggatagttcaa

SEQ ID NO: 523424 - DNA, 16 bp, R. norvegicus
tgcaaggcaagcattt

SEQ ID NO: 523425 - DNA, 16 bp, R. norvegicus
tgcaaggccctgggct

SEQ ID NO: 523426 - DNA, 39 bp, R. norvegicus
tgcaatcccaccaacaatggaggagtgttcctctttctc

SEQ ID NO: 523427 - DNA, 16 bp, R. norvegicus
tgcaatgccaccagca

SEQ ID NO: 523428 - DNA, 16 bp, R. norvegicus
tgcaatgtccaaattt

SEQ ID NO: 523429 - DNA, 20 bp, R. norvegicus
tgcaatgtccaattttctga

SEQ ID NO: 523430 - DNA, 16 bp, R. norvegicus
tgcaattccagttcca

SEQ ID NO: 523431 - DNA, 16 bp, R. norvegicus
tgcaattcctatcaaa

SEQ ID NO: 523432 - DNA, 16 bp, R. norvegicus
tgcacaaaacttaagt

SEQ ID NO: 523433 - DNA, 16 bp, R. norvegicus
tgcacaaaataaataa

SEQ ID NO: 523434 - DNA, 16 bp, R. norvegicus
tgcacaagagaatgca

SEQ ID NO: 523435 - DNA, 16 bp, R. norvegicus
tgcacaatggagtatt

SEQ ID NO: 523436 - DNA, 16 bp, R. norvegicus
tgcacacaaacactca

SEQ ID NO: 523437 - DNA, 16 bp, R. norvegicus
tgcacacacaaacaca

SEQ ID NO: 523438 - DNA, 16 bp, R. norvegicus
tgcacacacaacacat

SEQ ID NO: 523439 - DNA, 16 bp, R. norvegicus
tgcacacacacaggca

SEQ ID NO: 523440 - DNA, 16 bp, R. norvegicus
tgcacacacacatgtg

SEQ ID NO: 523441 - DNA, 16 bp, R. norvegicus
tgcacacacaccaaca

SEQ ID NO: 523442 - DNA, 16 bp, R. norvegicus
tgcacacacagacaga

SEQ ID NO: 523443 - DNA, 16 bp, R. norvegicus
tgcacacacagatata

SEQ ID NO: 523444 - DNA, 16 bp, R. norvegicus
tgcacacacatacata

SEQ ID NO: 523445 - DNA, 16 bp, R. norvegicus
tgcacacacgtgcaca

SEQ ID NO: 523446 - DNA, 16 bp, R. norvegicus
tgcacacagagacaca

SEQ ID NO: 523447 - DNA, 16 bp, R. norvegicus
tgcacacagagagaga

SEQ ID NO: 523448 - DNA, 16 bp, R. norvegicus
tgcacacatccagacg

SEQ ID NO: 523449 - DNA, 16 bp, R. norvegicus
tgcacacatgaatgca

SEQ ID NO: 523450 - DNA, 16 bp, R. norvegicus
tgcacacatgcacaca

SEQ ID NO: 523451 - DNA, 16 bp, R. norvegicus
tgcacacatgcatgca

SEQ ID NO: 523452 - DNA, 16 bp, R. norvegicus
tgcacacatgtgaaca

SEQ ID NO: 523453 - DNA, 16 bp, R. norvegicus
tgcacacatgtgtgtt

SEQ ID NO: 523454 - DNA, 16 bp, R. norvegicus
tgcacacattcacaca

SEQ ID NO: 523455 - DNA, 16 bp, R. norvegicus
tgcacaccaccaccac

SEQ ID NO: 523456 - DNA, 16 bp, R. norvegicus
tgcacaccaccatgct

SEQ ID NO: 523457 - DNA, 16 bp, R. norvegicus
tgcacacctgtgatcc

SEQ ID NO: 523458 - DNA, 16 bp, R. norvegicus
tgcacacctttaatcc

SEQ ID NO: 523459 - DNA, 16 bp, R. norvegicus
tgcacacgcacacgca

SEQ ID NO: 523460 - DNA, 16 bp, R. norvegicus
tgcacacttttaatct

SEQ ID NO: 523461 - DNA, 16 bp, R. norvegicus
tgcacagaacacatgt

SEQ ID NO: 523462 - DNA, 16 bp, R. norvegicus
tgcacagacacacgca

SEQ ID NO: 523463 - DNA, 16 bp, R. norvegicus
tgcacagacacagctc

SEQ ID NO: 523464 - DNA, 16 bp, R. norvegicus
tgcacagacagacaga

SEQ ID NO: 523465 - DNA, 16 bp, R. norvegicus
tgcacagagaaaccct

SEQ ID NO: 523466 - DNA, 16 bp, R. norvegicus
tgcacagatgtgcaca

SEQ ID NO: 523467 - DNA, 16 bp, R. norvegicus
tgcacaggacccaagt

SEQ ID NO: 523468 - DNA, 16 bp, R. norvegicus
tgcacaggcatgcaca

SEQ ID NO: 523469 - DNA, 16 bp, R. norvegicus
tgcacagggccctggg

SEQ ID NO: 523470 - DNA, 16 bp, R. norvegicus
tgcacatacagacaag

SEQ ID NO: 523471 - DNA, 16 bp, R. norvegicus
tgcacatacccacaca

SEQ ID NO: 523472 - DNA, 16 bp, R. norvegicus
tgcacatatgtgtgtg

SEQ ID NO: 523473 - DNA, 16 bp, R. norvegicus
tgcacatctgcacaca

SEQ ID NO: 523474 - DNA, 16 bp, R. norvegicus
tgcacatgagggaggt

SEQ ID NO: 523475 - DNA, 16 bp, R. norvegicus
tgcacatgcacacaca

SEQ ID NO: 523476 - DNA, 16 bp, R. norvegicus
tgcacatgcacacaga

SEQ ID NO: 523477 - DNA, 16 bp, R. norvegicus
tgcacatgcactcaca

SEQ ID NO: 523478 - DNA, 16 bp, R. norvegicus
tgcacatgcatgcaga

SEQ ID NO: 523479 - DNA, 16 bp, R. norvegicus
tgcacatgccaggcaa

SEQ ID NO: 523480 - DNA, 16 bp, R. norvegicus
tgcacatgcgcacaca

SEQ ID NO: 523481 - DNA, 16 bp, R. norvegicus
tgcacatgggatgggt

SEQ ID NO: 523482 - DNA, 16 bp, R. norvegicus
tgcacatgtacatgca

SEQ ID NO: 523483 - DNA, 16 bp, R. norvegicus
tgcacatgtatgcaca

SEQ ID NO: 523484 - DNA, 16 bp, R. norvegicus
tgcacatgtatgtatg

SEQ ID NO: 523485 - DNA, 16 bp, R. norvegicus
tgcacatgtatgtgca

SEQ ID NO: 523486 - DNA, 16 bp, R. norvegicus
tgcacatgtgtgcaga

SEQ ID NO: 523487 - DNA, 16 bp, R. norvegicus
tgcacatgtgtgtaca

SEQ ID NO: 523488 - DNA, 16 bp, R. norvegicus
tgcacatgtgtgtacc

SEQ ID NO: 523489 - DNA, 16 bp, R. norvegicus
tgcacatgtgtgtact

SEQ ID NO: 523490 - DNA, 16 bp, R. norvegicus
tgcacatgtgtgtgct

SEQ ID NO: 523491 - DNA, 16 bp, R. norvegicus
tgcacatgtgtgtgtt

SEQ ID NO: 523492 - DNA, 16 bp, R. norvegicus
tgcacatttctttttt

SEQ ID NO: 523493 - DNA, 16 bp, R. norvegicus
tgcaccaccacctccc

SEQ ID NO: 523494 - DNA, 16 bp, R. norvegicus
tgcaccaccattcctg

SEQ ID NO: 523495 - DNA, 16 bp, R. norvegicus
tgcaccacctgcatgc

SEQ ID NO: 523496 - DNA, 18 bp, R. norvegicus
tgcaccacggttccagat

SEQ ID NO: 523497 - DNA, 16 bp, R. norvegicus
tgcaccactgtgcctg

SEQ ID NO: 523498 - DNA, 16 bp, R. norvegicus
tgcaccagctcctgct

SEQ ID NO: 523499 - DNA, 16 bp, R. norvegicus
tgcaccagctgagatg

SEQ ID NO: 523500 - DNA, 16 bp, R. norvegicus
tgcaccaggcctgcct

SEQ ID NO: 523501 - DNA, 21 bp, R. norvegicus
tgcaccagggttccagatggc

SEQ ID NO: 523502 - DNA, 16 bp, R. norvegicus
tgcacccacacacatg

SEQ ID NO: 523503 - DNA, 16 bp, R. norvegicus
tgcaccctcattgaca

SEQ ID NO: 523504 - DNA, 16 bp, R. norvegicus
tgcacctacacacaca

SEQ ID NO: 523505 - DNA, 16 bp, R. norvegicus
tgcacctgagattctc

SEQ ID NO: 523506 - DNA, 16 bp, R. norvegicus
tgcacctggagctgac

SEQ ID NO: 523507 - DNA, 16 bp, R. norvegicus
tgcaccttcaccaatg

SEQ ID NO: 523508 - DNA, 16 bp, R. norvegicus
tgcaccttcatcaatg

SEQ ID NO: 523509 - DNA, 16 bp, R. norvegicus
tgcacgcacaaacaca

SEQ ID NO: 523510 - DNA, 16 bp, R. norvegicus
tgcacgcacacgcgcg

SEQ ID NO: 523511 - DNA, 16 bp, R. norvegicus
tgcacgcacgcacgca

SEQ ID NO: 523512 - DNA, 16 bp, R. norvegicus
tgcacgcatacataca

SEQ ID NO: 523513 - DNA, 17 bp, R. norvegicus
tgcacgggtggaagaag

SEQ ID NO: 523514 - DNA, 16 bp, R. norvegicus
tgcactaaacccaact

SEQ ID NO: 523515 - DNA, 16 bp, R. norvegicus
tgcactcacatgcaca

SEQ ID NO: 523516 - DNA, 16 bp, R. norvegicus
tgcactcaggaagcag

SEQ ID NO: 523517 - DNA, 16 bp, R. norvegicus
tgcactcatgtgtgtg

SEQ ID NO: 523518 - DNA, 16 bp, R. norvegicus
tgcactgtgtgtgtgt

SEQ ID NO: 523519 - DNA, 16 bp, R. norvegicus
tgcacttcttggcatc

SEQ ID NO: 523520 - DNA, 16 bp, R. norvegicus
tgcacttctttgctcc

SEQ ID NO: 523521 - DNA, 16 bp, R. norvegicus
tgcacttgctaagcaa

SEQ ID NO: 523522 - DNA, 16 bp, R. norvegicus
tgcacttgtgtgcatg

SEQ ID NO: 523523 - DNA, 16 bp, R. norvegicus
tgcactttagtcatcc

SEQ ID NO: 523524 - DNA, 16 bp, R. norvegicus
tgcagaaaaccatcaa

SEQ ID NO: 523525 - DNA, 16 bp, R. norvegicus
tgcagaagacctgagt

SEQ ID NO: 523526 - DNA, 16 bp, R. norvegicus
tgcagaagacctgggt

SEQ ID NO: 523527 - DNA, 16 bp, R. norvegicus
tgcagaagaggaagca

SEQ ID NO: 523528 - DNA, 16 bp, R. norvegicus
tgcagaagaggagaca

SEQ ID NO: 523529 - DNA, 16 bp, R. norvegicus
tgcagaagaggaggag

SEQ ID NO: 523530 - DNA, 16 bp, R. norvegicus
tgcagaagatctgggt

SEQ ID NO: 523531 - DNA, 18 bp, R. norvegicus
tgcagaagatggaggcct

SEQ ID NO: 523532 - DNA, 16 bp, R. norvegicus
tgcagaagcagaagca

SEQ ID NO: 523533 - DNA, 16 bp, R. norvegicus
tgcagaagcaggcaga

SEQ ID NO: 523534 - DNA, 16 bp, R. norvegicus
tgcagaagccatagag

SEQ ID NO: 523535 - DNA, 16 bp, R. norvegicus
tgcagaaggaactgag

SEQ ID NO: 523536 - DNA, 16 bp, R. norvegicus
tgcagaaggagagaga

SEQ ID NO: 523537 - DNA, 16 bp, R. norvegicus
tgcagaagtaccaaaa

SEQ ID NO: 523538 - DNA, 16 bp, R. norvegicus
tgcagaagtcagaaga

SEQ ID NO: 523539 - DNA, 16 bp, R. norvegicus
tgcagacaaaacacct

SEQ ID NO: 523540 - DNA, 16 bp, R. norvegicus
tgcagacaaccacagc

SEQ ID NO: 523541 - DNA, 16 bp, R. norvegicus
tgcagacaaggctggc

SEQ ID NO: 523542 - DNA, 16 bp, R. norvegicus
tgcagacagagctgag

SEQ ID NO: 523543 - DNA, 16 bp, R. norvegicus
tgcagactttcatcca

SEQ ID NO: 523544 - DNA, 16 bp, R. norvegicus
tgcagagaaaccctgt

SEQ ID NO: 523545 - DNA, 16 bp, R. norvegicus
tgcagagaactgtgta

SEQ ID NO: 523546 - DNA, 16 bp, R. norvegicus
tgcagagaataagaga

SEQ ID NO: 523547 - DNA, 16 bp, R. norvegicus
tgcagagaccatgaag

SEQ ID NO: 523548 - DNA, 16 bp, R. norvegicus
tgcagagacccacagg

SEQ ID NO: 523549 - DNA, 16 bp, R. norvegicus
tgcagagagacagaca

SEQ ID NO: 523550 - DNA, 16 bp, R. norvegicus
tgcagagagcacagac

SEQ ID NO: 523551 - DNA, 16 bp, R. norvegicus
tgcagagagcagaagg

SEQ ID NO: 523552 - DNA, 16 bp, R. norvegicus
tgcagagatggctcag

SEQ ID NO: 523553 - DNA, 16 bp, R. norvegicus
tgcagagcagaagaga

SEQ ID NO: 523554 - DNA, 16 bp, R. norvegicus
tgcagagcctctcaga

SEQ ID NO: 523555 - DNA, 16 bp, R. norvegicus
tgcagagctggagaga

SEQ ID NO: 523556 - DNA, 16 bp, R. norvegicus
tgcagagctggctcag

SEQ ID NO: 523557 - DNA, 16 bp, R. norvegicus
tgcagaggacacaggt

SEQ ID NO: 523558 - DNA, 16 bp, R. norvegicus
tgcagaggacagaaga

SEQ ID NO: 523559 - DNA, 16 bp, R. norvegicus
tgcagaggacctgatt

SEQ ID NO: 523560 - DNA, 16 bp, R. norvegicus
tgcagaggacctggct

SEQ ID NO: 523561 - DNA, 16 bp, R. norvegicus
tgcagaggcaatggag

SEQ ID NO: 523562 - DNA, 16 bp, R. norvegicus
tgcagaggcagatgga

SEQ ID NO: 523563 - DNA, 16 bp, R. norvegicus
tgcagaggccacagag

SEQ ID NO: 523564 - DNA, 16 bp, R. norvegicus
tgcagagggcagaaga

SEQ ID NO: 523565 - DNA, 16 bp, R. norvegicus
tgcagagggcctgggt

SEQ ID NO: 523566 - DNA, 16 bp, R. norvegicus
tgcagagggtctgcca

SEQ ID NO: 523567 - DNA, 16 bp, R. norvegicus
tgcagataccaagaag

SEQ ID NO: 523568 - DNA, 16 bp, R. norvegicus
tgcagatcaatccatc

SEQ ID NO: 523569 - DNA, 16 bp, R. norvegicus
tgcagatgacaagaag

SEQ ID NO: 523570 - DNA, 16 bp, R. norvegicus
tgcagatgccaagaag

SEQ ID NO: 523571 - DNA, 16 bp, R. norvegicus
tgcagatgccagaaga

SEQ ID NO: 523572 - DNA, 16 bp, R. norvegicus
tgcagatgctaagaag

SEQ ID NO: 523573 - DNA, 16 bp, R. norvegicus
tgcagatgcttcattc

SEQ ID NO: 523574 - DNA, 16 bp, R. norvegicus
tgcagattcagtgcaa

SEQ ID NO: 523575 - DNA, 16 bp, R. norvegicus
tgcagcactcaggaaa

SEQ ID NO: 523576 - DNA, 16 bp, R. norvegicus
tgcagcagaaaagtta

SEQ ID NO: 523577 - DNA, 16 bp, R. norvegicus
tgcagcagaaaagttt

SEQ ID NO: 523578 - DNA, 16 bp, R. norvegicus
tgcagcagaaagatgg

SEQ ID NO: 523579 - DNA, 16 bp, R. norvegicus
tgcagcagaaattttg

SEQ ID NO: 523580 - DNA, 16 bp, R. norvegicus
tgcagcagagaatttg

SEQ ID NO: 523581 - DNA, 16 bp, R. norvegicus
tgcagcagagcactca

SEQ ID NO: 523582 - DNA, 16 bp, R. norvegicus
tgcagcagaggatggc

SEQ ID NO: 523583 - DNA, 16 bp, R. norvegicus
tgcagcagcaggagac

SEQ ID NO: 523584 - DNA, 16 bp, R. norvegicus
tgcagcagctcctgct

SEQ ID NO: 523585 - DNA, 16 bp, R. norvegicus
tgcagcagctggactg

SEQ ID NO: 523586 - DNA, 16 bp, R. norvegicus
tgcagcagctggtcac

SEQ ID NO: 523587 - DNA, 16 bp, R. norvegicus
tgcagcaggagctgag

SEQ ID NO: 523588 - DNA, 16 bp, R. norvegicus
tgcagcaggcaggaga

SEQ ID NO: 523589 - DNA, 16 bp, R. norvegicus
tgcagcagtctctgga

SEQ ID NO: 523590 - DNA, 16 bp, R. norvegicus
tgcagccaaccatcgg

SEQ ID NO: 523591 - DNA, 16 bp, R. norvegicus
tgcagccaccaagccc

SEQ ID NO: 523592 - DNA, 16 bp, R. norvegicus
tgcagcccactgtggg

SEQ ID NO: 523593 - DNA, 16 bp, R. norvegicus
tgcagcccaggcaggc

SEQ ID NO: 523594 - DNA, 16 bp, R. norvegicus
tgcagcctcagcagtg

SEQ ID NO: 523595 - DNA, 16 bp, R. norvegicus
tgcagcctcaggggtg

SEQ ID NO: 523596 - DNA, 16 bp, R. norvegicus
tgcagcctctggagtg

SEQ ID NO: 523597 - DNA, 16 bp, R. norvegicus
tgcagctcagtgacag

SEQ ID NO: 523598 - DNA, 16 bp, R. norvegicus
tgcagctctctctctc

SEQ ID NO: 523599 - DNA, 16 bp, R. norvegicus
tgcagctgaagccatg

SEQ ID NO: 523600 - DNA, 16 bp, R. norvegicus
tgcagctgcctttgag

SEQ ID NO: 523601 - DNA, 16 bp, R. norvegicus
tgcagctgcctttgtt

SEQ ID NO: 523602 - DNA, 16 bp, R. norvegicus
tgcagctggagccata

SEQ ID NO: 523603 - DNA, 16 bp, R. norvegicus
tgcagctggagtcctg

SEQ ID NO: 523604 - DNA, 16 bp, R. norvegicus
tgcagctggggccatg

SEQ ID NO: 523605 - DNA, 16 bp, R. norvegicus
tgcagctggtgccatg

SEQ ID NO: 523606 - DNA, 16 bp, R. norvegicus
tgcaggaaaatataaa

SEQ ID NO: 523607 - DNA, 16 bp, R. norvegicus
tgcaggaaacacacct

SEQ ID NO: 523608 - DNA, 16 bp, R. norvegicus
tgcaggaaacagtaac

SEQ ID NO: 523609 - DNA, 16 bp, R. norvegicus
tgcaggaagagaaacc

SEQ ID NO: 523610 - DNA, 16 bp, R. norvegicus
tgcaggaagccctggg

SEQ ID NO: 523611 - DNA, 16 bp, R. norvegicus
tgcaggaatagaaact

SEQ ID NO: 523612 - DNA, 16 bp, R. norvegicus
tgcaggaatggtttaa

SEQ ID NO: 523613 - DNA, 16 bp, R. norvegicus
tgcaggactggagaga

SEQ ID NO: 523614 - DNA, 16 bp, R. norvegicus
tgcaggagaagagtgt

SEQ ID NO: 523615 - DNA, 16 bp, R. norvegicus
tgcaggagaagctgag

SEQ ID NO: 523616 - DNA, 16 bp, R. norvegicus
tgcaggagatgactga

SEQ ID NO: 523617 - DNA, 16 bp, R. norvegicus
tgcaggagcagctgag

SEQ ID NO: 523618 - DNA, 16 bp, R. norvegicus
tgcaggagctggacct

SEQ ID NO: 523619 - DNA, 16 bp, R. norvegicus
tgcaggaggagctaag

SEQ ID NO: 523620 - DNA, 16 bp, R. norvegicus
tgcaggaggagctcag

SEQ ID NO: 523621 - DNA, 16 bp, R. norvegicus
tgcaggaggagctgaa

SEQ ID NO: 523622 - DNA, 16 bp, R. norvegicus
tgcaggaggaggaagg

SEQ ID NO: 523623 - DNA, 16 bp, R. norvegicus
tgcaggaggaggagga

SEQ ID NO: 523624 - DNA, 16 bp, R. norvegicus
tgcaggagggcttctg

SEQ ID NO: 523625 - DNA, 16 bp, R. norvegicus
tgcaggcaaaacacca

SEQ ID NO: 523626 - DNA, 16 bp, R. norvegicus
tgcaggcaaaataccc

SEQ ID NO: 523627 - DNA, 16 bp, R. norvegicus
tgcaggcaaccacagc

SEQ ID NO: 523628 - DNA, 16 bp, R. norvegicus
tgcaggcaagacactc

SEQ ID NO: 523629 - DNA, 16 bp, R. norvegicus
tgcaggcactcacagc

SEQ ID NO: 523630 - DNA, 16 bp, R. norvegicus
tgcaggcagaaaactg

SEQ ID NO: 523631 - DNA, 16 bp, R. norvegicus
tgcaggcagcaaggag

SEQ ID NO: 523632 - DNA, 16 bp, R. norvegicus
tgcaggcaggagctca

SEQ ID NO: 523633 - DNA, 16 bp, R. norvegicus
tgcaggccagccaggg

SEQ ID NO: 523634 - DNA, 16 bp, R. norvegicus
tgcaggccaggctggc

SEQ ID NO: 523635 - DNA, 16 bp, R. norvegicus
tgcaggcctgcaagag

SEQ ID NO: 523636 - DNA, 16 bp, R. norvegicus
tgcaggctcacaggaa

SEQ ID NO: 523637 - DNA, 16 bp, R. norvegicus
tgcaggctgagaggaa

SEQ ID NO: 523638 - DNA, 16 bp, R. norvegicus
tgcaggctgcaggctg

SEQ ID NO: 523639 - DNA, 16 bp, R. norvegicus
tgcaggctggtgcagg

SEQ ID NO: 523640 - DNA, 16 bp, R. norvegicus
tgcagggacaaaagtg

SEQ ID NO: 523641 - DNA, 16 bp, R. norvegicus
tgcagggacagaaatg

SEQ ID NO: 523642 - DNA, 17 bp, R. norvegicus
tgcagggcaacagcaga

SEQ ID NO: 523643 - DNA, 16 bp, R. norvegicus
tgcagggccagacgtg

SEQ ID NO: 523644 - DNA, 16 bp, R. norvegicus
tgcaggggacctgggt

SEQ ID NO: 523645 - DNA, 16 bp, R. norvegicus
tgcaggtatggtttaa

SEQ ID NO: 523646 - DNA, 16 bp, R. norvegicus
tgcaggtgaagacagg

SEQ ID NO: 523647 - DNA, 16 bp, R. norvegicus
tgcaggtgagccagcc

SEQ ID NO: 523648 - DNA, 16 bp, R. norvegicus
tgcaggtgagctggcc

SEQ ID NO: 523649 - DNA, 16 bp, R. norvegicus
tgcaggtgcccttgga

SEQ ID NO: 523650 - DNA, 16 bp, R. norvegicus
tgcaggtgctcatgga

SEQ ID NO: 523651 - DNA, 16 bp, R. norvegicus
tgcaggtgctgggaat

SEQ ID NO: 523652 - DNA, 16 bp, R. norvegicus
tgcaggtggagctgag

SEQ ID NO: 523653 - DNA, 16 bp, R. norvegicus
tgcaggtggaggtcag

SEQ ID NO: 523654 - DNA, 16 bp, R. norvegicus
tgcaggtgtgcaggtg

SEQ ID NO: 523655 - DNA, 16 bp, R. norvegicus
tgcagtacccaaggag

SEQ ID NO: 523656 - DNA, 16 bp, R. norvegicus
tgcagtatgtgtgtgt

SEQ ID NO: 523657 - DNA, 16 bp, R. norvegicus
tgcagtccaggctggc

SEQ ID NO: 523658 - DNA, 16 bp, R. norvegicus
tgcagtctcaggatgt

SEQ ID NO: 523659 - DNA, 16 bp, R. norvegicus
tgcagtctcctcccac

SEQ ID NO: 523660 - DNA, 16 bp, R. norvegicus
tgcagtgagaactctg

SEQ ID NO: 523661 - DNA, 16 bp, R. norvegicus
tgcagtgcagctcagt

SEQ ID NO: 523662 - DNA, 18 bp, R. norvegicus
tgcagtgccagcctcgtc

SEQ ID NO: 523663 - DNA, 16 bp, R. norvegicus
tgcagtgccagccttg

SEQ ID NO: 523664 - DNA, 16 bp, R. norvegicus
tgcagtgccccaagat

SEQ ID NO: 523665 - DNA, 16 bp, R. norvegicus
tgcagtgcctgcagag

SEQ ID NO: 523666 - DNA, 16 bp, R. norvegicus
tgcagtgctcatggag

SEQ ID NO: 523667 - DNA, 16 bp, R. norvegicus
tgcagtgctggagatc

SEQ ID NO: 523668 - DNA, 16 bp, R. norvegicus
tgcagtgctggggacc

SEQ ID NO: 523669 - DNA, 16 bp, R. norvegicus
tgcagtgggagccatg

SEQ ID NO: 523670 - DNA, 16 bp, R. norvegicus
tgcagtgggcagcagt

SEQ ID NO: 523671 - DNA, 16 bp, R. norvegicus
tgcagtggtcatggtg

SEQ ID NO: 523672 - DNA, 16 bp, R. norvegicus
tgcagtggttaagagc

SEQ ID NO: 523673 - DNA, 16 bp, R. norvegicus
tgcagtgtcctcattg

SEQ ID NO: 523674 - DNA, 16 bp, R. norvegicus
tgcagtgtcttacctg

SEQ ID NO: 523675 - DNA, 16 bp, R. norvegicus
tgcagtgtggatgcac

SEQ ID NO: 523676 - DNA, 16 bp, R. norvegicus
tgcagtgtgtgcagtg

SEQ ID NO: 523677 - DNA, 16 bp, R. norvegicus
tgcagttcctgcagag

SEQ ID NO: 523678 - DNA, 16 bp, R. norvegicus
tgcagttctttcaaac

SEQ ID NO: 523679 - DNA, 18 bp, R. norvegicus
tgcagttctttctacaat

SEQ ID NO: 523680 - DNA, 16 bp, R. norvegicus
tgcagttggagctctg

SEQ ID NO: 523681 - DNA, 16 bp, R. norvegicus
tgcagttgtttatcag

SEQ ID NO: 523682 - DNA, 16 bp, R. norvegicus
tgcagtttctccttgg

SEQ ID NO: 523683 - DNA, 16 bp, R. norvegicus
tgcagtttttgtttgt

SEQ ID NO: 523684 - DNA, 16 bp, R. norvegicus
tgcataaaaataataa

SEQ ID NO: 523685 - DNA, 16 bp, R. norvegicus
tgcatacacataaata

SEQ ID NO: 523686 - DNA, 16 bp, R. norvegicus
tgcatacatgtgcatg

SEQ ID NO: 523687 - DNA, 16 bp, R. norvegicus
tgcatacatgtgtaca

SEQ ID NO: 523688 - DNA, 16 bp, R. norvegicus
tgcatagaccaggctg

SEQ ID NO: 523689 - DNA, 16 bp, R. norvegicus
tgcatagcaagcacaa

SEQ ID NO: 523690 - DNA, 16 bp, R. norvegicus
tgcatatacacacaaa

SEQ ID NO: 523691 - DNA, 16 bp, R. norvegicus
tgcatatacattaaat

SEQ ID NO: 523692 - DNA, 16 bp, R. norvegicus
tgcatatatatatatg

SEQ ID NO: 523693 - DNA, 16 bp, R. norvegicus
tgcatatatatgcaaa

SEQ ID NO: 523694 - DNA, 16 bp, R. norvegicus
tgcatatatgtctgtg

SEQ ID NO: 523695 - DNA, 16 bp, R. norvegicus
tgcatatgaatatttt

SEQ ID NO: 523696 - DNA, 16 bp, R. norvegicus
tgcatatgcagcagag

SEQ ID NO: 523697 - DNA, 16 bp, R. norvegicus
tgcatatgtgtatatg

SEQ ID NO: 523698 - DNA, 16 bp, R. norvegicus
tgcatatgttcatgtg

SEQ ID NO: 523699 - DNA, 16 bp, R. norvegicus
tgcatatttatataca

SEQ ID NO: 523700 - DNA, 16 bp, R. norvegicus
tgcatatttgtgtata

SEQ ID NO: 523701 - DNA, 16 bp, R. norvegicus
tgcatattttggatat

SEQ ID NO: 523702 - DNA, 16 bp, R. norvegicus
tgcatcaccaacagaa

SEQ ID NO: 523703 - DNA, 16 bp, R. norvegicus
tgcatcagagacaact

SEQ ID NO: 523704 - DNA, 16 bp, R. norvegicus
tgcatcatcaagggaa

SEQ ID NO: 523705 - DNA, 16 bp, R. norvegicus
tgcatccacatacagt

SEQ ID NO: 523706 - DNA, 16 bp, R. norvegicus
tgcatccccatgtggg

SEQ ID NO: 523707 - DNA, 17 bp, R. norvegicus
tgcatcctcgccagcat

SEQ ID NO: 523708 - DNA, 16 bp, R. norvegicus
tgcatctacacaatgg

SEQ ID NO: 523709 - DNA, 16 bp, R. norvegicus
tgcatctaggggaatt

SEQ ID NO: 523710 - DNA, 16 bp, R. norvegicus
tgcatctgcatctcaa

SEQ ID NO: 523711 - DNA, 16 bp, R. norvegicus
tgcatctgcctcctga

SEQ ID NO: 523712 - DNA, 16 bp, R. norvegicus
tgcatctgctgtcacc

SEQ ID NO: 523713 - DNA, 16 bp, R. norvegicus
tgcatctgtagttcct

SEQ ID NO: 523714 - DNA, 16 bp, R. norvegicus
tgcatcttcaccaatg

SEQ ID NO: 523715 - DNA, 16 bp, R. norvegicus
tgcatcttctctgtct

SEQ ID NO: 523716 - DNA, 16 bp, R. norvegicus
tgcatctttaaaaaaa

SEQ ID NO: 523717 - DNA, 16 bp, R. norvegicus
tgcatgaaaaccaagc

SEQ ID NO: 523718 - DNA, 16 bp, R. norvegicus
tgcatgaacacacata

SEQ ID NO: 523719 - DNA, 16 bp, R. norvegicus
tgcatgaggaggtcag

SEQ ID NO: 523720 - DNA, 16 bp, R. norvegicus
tgcatgagtacacaca

SEQ ID NO: 523721 - DNA, 16 bp, R. norvegicus
tgcatgcaagtgtgtg

SEQ ID NO: 523722 - DNA, 16 bp, R. norvegicus
tgcatgcacacttgtg

SEQ ID NO: 523723 - DNA, 16 bp, R. norvegicus
tgcatgcacatgcaca

SEQ ID NO: 523724 - DNA, 16 bp, R. norvegicus
tgcatgcaggcagaca

SEQ ID NO: 523725 - DNA, 16 bp, R. norvegicus
tgcatgcagtgtgtga

SEQ ID NO: 523726 - DNA, 16 bp, R. norvegicus
tgcatgcatacacata

SEQ ID NO: 523727 - DNA, 16 bp, R. norvegicus
tgcatgcatatttgtg

SEQ ID NO: 523728 - DNA, 16 bp, R. norvegicus
tgcatgcatgcctgtg

SEQ ID NO: 523729 - DNA, 16 bp, R. norvegicus
tgcatgcatgggtgtg

SEQ ID NO: 523730 - DNA, 16 bp, R. norvegicus
tgcatgcatgtgaatg

SEQ ID NO: 523731 - DNA, 16 bp, R. norvegicus
tgcatgcatgtgtgtg

SEQ ID NO: 523732 - DNA, 16 bp, R. norvegicus
tgcatgcctggtgcct

SEQ ID NO: 523733 - DNA, 16 bp, R. norvegicus
tgcatgctaagcaagc

SEQ ID NO: 523734 - DNA, 16 bp, R. norvegicus
tgcatgctgctgccta

SEQ ID NO: 523735 - DNA, 16 bp, R. norvegicus
tgcatgctgtcacaat

SEQ ID NO: 523736 - DNA, 16 bp, R. norvegicus
tgcatgctgtttgtgg

SEQ ID NO: 523737 - DNA, 16 bp, R. norvegicus
tgcatggcaagcattt

SEQ ID NO: 523738 - DNA, 16 bp, R. norvegicus
tgcatgggggctcctg

SEQ ID NO: 523739 - DNA, 16 bp, R. norvegicus
tgcatgtacacccaca

SEQ ID NO: 523740 - DNA, 16 bp, R. norvegicus
tgcatgtatacacata

SEQ ID NO: 523741 - DNA, 16 bp, R. norvegicus
tgcatgtatatgtgta

SEQ ID NO: 523742 - DNA, 16 bp, R. norvegicus
tgcatgtatgcatgtg

SEQ ID NO: 523743 - DNA, 16 bp, R. norvegicus
tgcatgtatgtgtatg

SEQ ID NO: 523744 - DNA, 16 bp, R. norvegicus
tgcatgtgcaaatgtg

SEQ ID NO: 523745 - DNA, 16 bp, R. norvegicus
tgcatgtgcacacaca

SEQ ID NO: 523746 - DNA, 16 bp, R. norvegicus
tgcatgtgcctggtgc

SEQ ID NO: 523747 - DNA, 16 bp, R. norvegicus
tgcatgtgctgcacag

SEQ ID NO: 523748 - DNA, 19 bp, R. norvegicus
tgcatgtggaactgacaca

SEQ ID NO: 523749 - DNA, 16 bp, R. norvegicus
tgcatgtgtactgtgt

SEQ ID NO: 523750 - DNA, 16 bp, R. norvegicus
tgcatgtgtgcaagtg

SEQ ID NO: 523751 - DNA, 16 bp, R. norvegicus
tgcatgtgtgcaggtg

SEQ ID NO: 523752 - DNA, 16 bp, R. norvegicus
tgcatgtgtgcatgtg

SEQ ID NO: 523753 - DNA, 16 bp, R. norvegicus
tgcatgtgtgtctgtg

SEQ ID NO: 523754 - DNA, 16 bp, R. norvegicus
tgcatgtgtgtctttg

SEQ ID NO: 523755 - DNA, 16 bp, R. norvegicus
tgcatgtgtgtgattg

SEQ ID NO: 523756 - DNA, 16 bp, R. norvegicus
tgcatgtgtgtgcatg

SEQ ID NO: 523757 - DNA, 16 bp, R. norvegicus
tgcatgtgtgtgtgtg

SEQ ID NO: 523758 - DNA, 16 bp, R. norvegicus
tgcatgtgtgttttat

SEQ ID NO: 523759 - DNA, 16 bp, R. norvegicus
tgcatgtgtttacatg

SEQ ID NO: 523760 - DNA, 16 bp, R. norvegicus
tgcatgttcacatgtg

SEQ ID NO: 523761 - DNA, 16 bp, R. norvegicus
tgcatgttcatgtatg

SEQ ID NO: 523762 - DNA, 16 bp, R. norvegicus
tgcatgtttatgtata

SEQ ID NO: 523763 - DNA, 16 bp, R. norvegicus
tgcattcaggaagcag

SEQ ID NO: 523764 - DNA, 16 bp, R. norvegicus
tgcattccagccagag

SEQ ID NO: 523765 - DNA, 16 bp, R. norvegicus
tgcattccccatcaaa

SEQ ID NO: 523766 - DNA, 16 bp, R. norvegicus
tgcatttatttatata

SEQ ID NO: 523767 - DNA, 16 bp, R. norvegicus
tgcatttcaaatgtta

SEQ ID NO: 523768 - DNA, 16 bp, R. norvegicus
tgcatttcccttctga

SEQ ID NO: 523769 - DNA, 16 bp, R. norvegicus
tgcatttgtgtgtata

SEQ ID NO: 523770 - DNA, 16 bp, R. norvegicus
tgcatttgttgggact

SEQ ID NO: 523771 - DNA, 16 bp, R. norvegicus
tgcattttatttacat

SEQ ID NO: 523772 - DNA, 16 bp, R. norvegicus
tgcattttattttaaa

SEQ ID NO: 523773 - DNA, 16 bp, R. norvegicus
tgcattttcctccttt

SEQ ID NO: 523774 - DNA, 16 bp, R. norvegicus
tgcatttttatttaaa

SEQ ID NO: 523775 - DNA, 16 bp, R. norvegicus
tgcatttttctaaatg

SEQ ID NO: 523776 - DNA, 16 bp, R. norvegicus
tgccaaaacaaaacaa

SEQ ID NO: 523777 - DNA, 17 bp, R. norvegicus
tgccaaaacaaaggctg

SEQ ID NO: 523778 - DNA, 16 bp, R. norvegicus
tgccaaaatgaaaaca

SEQ ID NO: 523779 - DNA, 16 bp, R. norvegicus
tgccaaagccaaatgg

SEQ ID NO: 523780 - DNA, 16 bp, R. norvegicus
tgccaaatctgatgac

SEQ ID NO: 523781 - DNA, 16 bp, R. norvegicus
tgccaacaaccccaag

SEQ ID NO: 523782 - DNA, 16 bp, R. norvegicus
tgccaacaaggccatc

SEQ ID NO: 523783 - DNA, 16 bp, R. norvegicus
tgccaacagccaaagg

SEQ ID NO: 523784 - DNA, 16 bp, R. norvegicus
tgccaaccatccagag

SEQ ID NO: 523785 - DNA, 16 bp, R. norvegicus
tgccaacctgggctac

SEQ ID NO: 523786 - DNA, 16 bp, R. norvegicus
tgccaacttgacacaa

SEQ ID NO: 523787 - DNA, 16 bp, R. norvegicus
tgccaacttgatacaa

SEQ ID NO: 523788 - DNA, 16 bp, R. norvegicus
tgccaagaagaacttg

SEQ ID NO: 523789 - DNA, 16 bp, R. norvegicus
tgccaagaggaggctc

SEQ ID NO: 523790 - DNA, 16 bp, R. norvegicus
tgccaagcctcagcta

SEQ ID NO: 523791 - DNA, 16 bp, R. norvegicus
tgccaagtatgatgac

SEQ ID NO: 523792 - DNA, 16 bp, R. norvegicus
tgccaagtgcttgctg

SEQ ID NO: 523793 - DNA, 16 bp, R. norvegicus
tgccaatagctcttca

SEQ ID NO: 523794 - DNA, 19 bp, R. norvegicus
tgccaatccatgagcatgg

SEQ ID NO: 523795 - DNA, 16 bp, R. norvegicus
tgccacacacacacac

SEQ ID NO: 523796 - DNA, 16 bp, R. norvegicus
tgccacacactcagca

SEQ ID NO: 523797 - DNA, 16 bp, R. norvegicus
tgccacagaggccaga

SEQ ID NO: 523798 - DNA, 16 bp, R. norvegicus
tgccacagtctctgtg

SEQ ID NO: 523799 - DNA, 16 bp, R. norvegicus
tgccaccaaacctgac

SEQ ID NO: 523800 - DNA, 16 bp, R. norvegicus
tgccaccaagcctggc

SEQ ID NO: 523801 - DNA, 16 bp, R. norvegicus
tgccaccaagtctgag

SEQ ID NO: 523802 - DNA, 16 bp, R. norvegicus
tgccaccacacctgct

SEQ ID NO: 523803 - DNA, 16 bp, R. norvegicus
tgccaccacagcctgg

SEQ ID NO: 523804 - DNA, 16 bp, R. norvegicus
tgccaccacagctggc

SEQ ID NO: 523805 - DNA, 16 bp, R. norvegicus
tgccaccaccaccacc

SEQ ID NO: 523806 - DNA, 16 bp, R. norvegicus
tgccaccaccaccatc

SEQ ID NO: 523807 - DNA, 16 bp, R. norvegicus
tgccaccaccacccag

SEQ ID NO: 523808 - DNA, 16 bp, R. norvegicus
tgccaccaccacccgg

SEQ ID NO: 523809 - DNA, 16 bp, R. norvegicus
tgccaccaccaccctg

SEQ ID NO: 523810 - DNA, 16 bp, R. norvegicus
tgccaccaccaccgcc

SEQ ID NO: 523811 - DNA, 16 bp, R. norvegicus
tgccaccaccatccag

SEQ ID NO: 523812 - DNA, 16 bp, R. norvegicus
tgccaccactgctgct

SEQ ID NO: 523813 - DNA, 16 bp, R. norvegicus
tgccaccagcaatgga

SEQ ID NO: 523814 - DNA, 16 bp, R. norvegicus
tgccaccatgcttcct

SEQ ID NO: 523815 - DNA, 16 bp, R. norvegicus
tgccaccatgttctct

SEQ ID NO: 523816 - DNA, 16 bp, R. norvegicus
tgccacccacagagca

SEQ ID NO: 523817 - DNA, 16 bp, R. norvegicus
tgccacccctgagcag

SEQ ID NO: 523818 - DNA, 16 bp, R. norvegicus
tgccacccctgggcag

SEQ ID NO: 523819 - DNA, 16 bp, R. norvegicus
tgccaccccttctggg

SEQ ID NO: 523820 - DNA, 16 bp, R. norvegicus
tgccaccctcagcccc

SEQ ID NO: 523821 - DNA, 16 bp, R. norvegicus
tgccactccctgggtt

SEQ ID NO: 523822 - DNA, 16 bp, R. norvegicus
tgccactccctgtgcc

SEQ ID NO: 523823 - DNA, 16 bp, R. norvegicus
tgccactccctgtggg

SEQ ID NO: 523824 - DNA, 16 bp, R. norvegicus
tgccactctctcccta

SEQ ID NO: 523825 - DNA, 16 bp, R. norvegicus
tgccactctctggtga

SEQ ID NO: 523826 - DNA, 16 bp, R. norvegicus
tgccactgccactgcc

SEQ ID NO: 523827 - DNA, 16 bp, R. norvegicus
tgccactgtctctgtg

SEQ ID NO: 523828 - DNA, 16 bp, R. norvegicus
tgccactgtgcccagc

SEQ ID NO: 523829 - DNA, 16 bp, R. norvegicus
tgccacttcctcagac

SEQ ID NO: 523830 - DNA, 16 bp, R. norvegicus
tgccacttctgcagac

SEQ ID NO: 523831 - DNA, 17 bp, R. norvegicus
tgccagaattgtgttca

SEQ ID NO: 523832 - DNA, 16 bp, R. norvegicus
tgccagacttgtgggc

SEQ ID NO: 523833 - DNA, 16 bp, R. norvegicus
tgccagagaagccatg

SEQ ID NO: 523834 - DNA, 16 bp, R. norvegicus
tgccagagaaggccat

SEQ ID NO: 523835 - DNA, 16 bp, R. norvegicus
tgccagagcatgacaa

SEQ ID NO: 523836 - DNA, 16 bp, R. norvegicus
tgccagagccagacca

SEQ ID NO: 523837 - DNA, 16 bp, R. norvegicus
tgccagagctgtggga

SEQ ID NO: 523838 - DNA, 16 bp, R. norvegicus
tgccagagtcctactg

SEQ ID NO: 523839 - DNA, 16 bp, R. norvegicus
tgccagcagaaagaat

SEQ ID NO: 523840 - DNA, 16 bp, R. norvegicus
tgccagcagcaaacct

SEQ ID NO: 523841 - DNA, 16 bp, R. norvegicus
tgccagcagcagacca

SEQ ID NO: 523842 - DNA, 16 bp, R. norvegicus
tgccagccagccagcc

SEQ ID NO: 523843 - DNA, 16 bp, R. norvegicus
tgccagcccaggctac

SEQ ID NO: 523844 - DNA, 16 bp, R. norvegicus
tgccagcccaggtttc

SEQ ID NO: 523845 - DNA, 17 bp, R. norvegicus
tgccagccccagcatca

SEQ ID NO: 523846 - DNA, 16 bp, R. norvegicus
tgccagccctgggcag

SEQ ID NO: 523847 - DNA, 16 bp, R. norvegicus
tgccagcctggatgct

SEQ ID NO: 523848 - DNA, 17 bp, R. norvegicus
tgccagctgcctgagtg

SEQ ID NO: 523849 - DNA, 16 bp, R. norvegicus
tgccaggaaaccagga

SEQ ID NO: 523850 - DNA, 16 bp, R. norvegicus
tgccaggaaagcagga

SEQ ID NO: 523851 - DNA, 16 bp, R. norvegicus
tgccaggacagccaag

SEQ ID NO: 523852 - DNA, 16 bp, R. norvegicus
tgccaggagcaaacca

SEQ ID NO: 523853 - DNA, 16 bp, R. norvegicus
tgccaggcccagtctc

SEQ ID NO: 523854 - DNA, 16 bp, R. norvegicus
tgccaggctggcctca

SEQ ID NO: 523855 - DNA, 16 bp, R. norvegicus
tgccagggaagagaga

SEQ ID NO: 523856 - DNA, 16 bp, R. norvegicus
tgccagggatgcaggg

SEQ ID NO: 523857 - DNA, 16 bp, R. norvegicus
tgccagggcagggaga

SEQ ID NO: 523858 - DNA, 16 bp, R. norvegicus
tgccagggtggtgagg

SEQ ID NO: 523859 - DNA, 16 bp, R. norvegicus
tgccaggtgggtgctg

SEQ ID NO: 523860 - DNA, 16 bp, R. norvegicus
tgccagtcagaaccca

SEQ ID NO: 523861 - DNA, 16 bp, R. norvegicus
tgccagtccatgaaca

SEQ ID NO: 523862 - DNA, 26 bp, R. norvegicus
tgccatagtaataatgatttgtgtgc

SEQ ID NO: 523863 - DNA, 16 bp, R. norvegicus
tgccatcaagagggac

SEQ ID NO: 523864 - DNA, 16 bp, R. norvegicus
tgccatcactgccact

SEQ ID NO: 523865 - DNA, 16 bp, R. norvegicus
tgccatcctctgctac

SEQ ID NO: 523866 - DNA, 16 bp, R. norvegicus
tgccatcctcttcagc

SEQ ID NO: 523867 - DNA, 16 bp, R. norvegicus
tgccatcctgggtttt

SEQ ID NO: 523868 - DNA, 16 bp, R. norvegicus
tgccatctccactgca

SEQ ID NO: 523869 - DNA, 16 bp, R. norvegicus
tgccatgcctgcctgg

SEQ ID NO: 523870 - DNA, 16 bp, R. norvegicus
tgccatggcacacaca

SEQ ID NO: 523871 - DNA, 16 bp, R. norvegicus
tgccatgtagctcagg

SEQ ID NO: 523872 - DNA, 16 bp, R. norvegicus
tgccatgtccctgcct

SEQ ID NO: 523873 - DNA, 16 bp, R. norvegicus
tgccatgttttgtttt

SEQ ID NO: 523874 - DNA, 16 bp, R. norvegicus
tgccattccacagtca

SEQ ID NO: 523875 - DNA, 16 bp, R. norvegicus
tgccattccctggacc

SEQ ID NO: 523876 - DNA, 16 bp, R. norvegicus
tgccattccctgggct

SEQ ID NO: 523877 - DNA, 16 bp, R. norvegicus
tgccattctcactggt

SEQ ID NO: 523878 - DNA, 16 bp, R. norvegicus
tgccattgagtttgtt

SEQ ID NO: 523879 - DNA, 16 bp, R. norvegicus
tgccattgcaccttgg

SEQ ID NO: 523880 - DNA, 16 bp, R. norvegicus
tgcccaacaaggccac

SEQ ID NO: 523881 - DNA, 16 bp, R. norvegicus
tgcccaagaagaccat

SEQ ID NO: 523882 - DNA, 16 bp, R. norvegicus
tgcccaagccagtgtc

SEQ ID NO: 523883 - DNA, 16 bp, R. norvegicus
tgcccaaggccctggg

SEQ ID NO: 523884 - DNA, 16 bp, R. norvegicus
tgcccacacaaacaca

SEQ ID NO: 523885 - DNA, 16 bp, R. norvegicus
tgcccacacatctggg

SEQ ID NO: 523886 - DNA, 16 bp, R. norvegicus
tgcccacagagaccag

SEQ ID NO: 523887 - DNA, 16 bp, R. norvegicus
tgcccacagaggacag

SEQ ID NO: 523888 - DNA, 16 bp, R. norvegicus
tgcccacagcagccat

SEQ ID NO: 523889 - DNA, 16 bp, R. norvegicus
tgcccacatccctgga

SEQ ID NO: 523890 - DNA, 16 bp, R. norvegicus
tgcccacatcccttgc

SEQ ID NO: 523891 - DNA, 16 bp, R. norvegicus
tgcccacatccttggc

SEQ ID NO: 523892 - DNA, 16 bp, R. norvegicus
tgcccacatggcagct

SEQ ID NO: 523893 - DNA, 16 bp, R. norvegicus
tgcccaccactgccca

SEQ ID NO: 523894 - DNA, 16 bp, R. norvegicus
tgcccacctcaccagg

SEQ ID NO: 523895 - DNA, 16 bp, R. norvegicus
tgcccactctgtccct

SEQ ID NO: 523896 - DNA, 17 bp, R. norvegicus
tgcccagaagtgtggaa

SEQ ID NO: 523897 - DNA, 16 bp, R. norvegicus
tgcccagagctcccag

SEQ ID NO: 523898 - DNA, 16 bp, R. norvegicus
tgcccagcagctccag

SEQ ID NO: 523899 - DNA, 16 bp, R. norvegicus
tgcccagcccagccca

SEQ ID NO: 523900 - DNA, 16 bp, R. norvegicus
tgcccagccctgccca

SEQ ID NO: 523901 - DNA, 16 bp, R. norvegicus
tgcccagcctcagctg

SEQ ID NO: 523902 - DNA, 16 bp, R. norvegicus
tgcccagctacaggct

SEQ ID NO: 523903 - DNA, 16 bp, R. norvegicus
tgcccagctgcttggg

SEQ ID NO: 523904 - DNA, 16 bp, R. norvegicus
tgcccaggaagatgtg

SEQ ID NO: 523905 - DNA, 16 bp, R. norvegicus
tgcccaggggttgggg

SEQ ID NO: 523906 - DNA, 16 bp, R. norvegicus
tgcccagtcctagagg

SEQ ID NO: 523907 - DNA, 16 bp, R. norvegicus
tgcccatcaaggccat

SEQ ID NO: 523908 - DNA, 18 bp, R. norvegicus
tgcccatgatgtagaccc

SEQ ID NO: 523909 - DNA, 20 bp, R. norvegicus
tgcccatgatgtagacccca

SEQ ID NO: 523910 - DNA, 16 bp, R. norvegicus
tgcccatgcatgtgtg

SEQ ID NO: 523911 - DNA, 16 bp, R. norvegicus
tgcccatgtgctccag

SEQ ID NO: 523912 - DNA, 17 bp, R. norvegicus
tgccccaaatacaagga

SEQ ID NO: 523913 - DNA, 17 bp, R. norvegicus
tgccccaacataaaaaa

SEQ ID NO: 523914 - DNA, 16 bp, R. norvegicus
tgccccaactgcacag

SEQ ID NO: 523915 - DNA, 19 bp, R. norvegicus
tgccccagaaagaacaaga

SEQ ID NO: 523916 - DNA, 16 bp, R. norvegicus
tgccccagatgtggcc

SEQ ID NO: 523917 - DNA, 16 bp, R. norvegicus
tgccccagcaaaacat

SEQ ID NO: 523918 - DNA, 16 bp, R. norvegicus
tgccccagccccagcc

SEQ ID NO: 523919 - DNA, 16 bp, R. norvegicus
tgccccagggaagggg

SEQ ID NO: 523920 - DNA, 16 bp, R. norvegicus
tgcccccaaccctgaa

SEQ ID NO: 523921 - DNA, 16 bp, R. norvegicus
tgcccccctattccct

SEQ ID NO: 523922 - DNA, 16 bp, R. norvegicus
tgcccccttctgacct

SEQ ID NO: 523923 - DNA, 16 bp, R. norvegicus
tgcccctccctttgct

SEQ ID NO: 523924 - DNA, 16 bp, R. norvegicus
tgcccctctgcctctg

SEQ ID NO: 523925 - DNA, 16 bp, R. norvegicus
tgcccctgctcctgct

SEQ ID NO: 523926 - DNA, 16 bp, R. norvegicus
tgcccctgctccttct

SEQ ID NO: 523927 - DNA, 16 bp, R. norvegicus
tgcccctgcttctatg

SEQ ID NO: 523928 - DNA, 16 bp, R. norvegicus
tgcccctgtgacatgg

SEQ ID NO: 523929 - DNA, 16 bp, R. norvegicus
tgcccgtgcccgtgcc

SEQ ID NO: 523930 - DNA, 44 bp, R. norvegicus
tgccctagaaatgcttcaagaggagaggtcagaaaagcagggaa

SEQ ID NO: 523931 - DNA, 16 bp, R. norvegicus
tgccctagatgcctag

SEQ ID NO: 523932 - DNA, 16 bp, R. norvegicus
tgccctcaaaggccag

SEQ ID NO: 523933 - DNA, 16 bp, R. norvegicus
tgccctcactgtgccc

SEQ ID NO: 523934 - DNA, 16 bp, R. norvegicus
tgccctcattttcatt

SEQ ID NO: 523935 - DNA, 16 bp, R. norvegicus
tgccctctgaaagacc

SEQ ID NO: 523936 - DNA, 16 bp, R. norvegicus
tgccctctgacctcac

SEQ ID NO: 523937 - DNA, 16 bp, R. norvegicus
tgccctctgcaggcac

SEQ ID NO: 523938 - DNA, 16 bp, R. norvegicus
tgccctctgcatcagc

SEQ ID NO: 523939 - DNA, 16 bp, R. norvegicus
tgccctctggtggcca

SEQ ID NO: 523940 - DNA, 16 bp, R. norvegicus
tgccctcttctcctgt

SEQ ID NO: 523941 - DNA, 16 bp, R. norvegicus
tgccctcttctgaaga

SEQ ID NO: 523942 - DNA, 16 bp, R. norvegicus
tgccctcttctggcct

SEQ ID NO: 523943 - DNA, 16 bp, R. norvegicus
tgccctcttctgggca

SEQ ID NO: 523944 - DNA, 16 bp, R. norvegicus
tgccctcttctggtgc

SEQ ID NO: 523945 - DNA, 16 bp, R. norvegicus
tgccctcttctggtgt

SEQ ID NO: 523946 - DNA, 16 bp, R. norvegicus
tgccctcttcttgtgt

SEQ ID NO: 523947 - DNA, 16 bp, R. norvegicus
tgccctcttgtggtgt

SEQ ID NO: 523948 - DNA, 16 bp, R. norvegicus
tgccctgacattcccc

SEQ ID NO: 523949 - DNA, 16 bp, R. norvegicus
tgccctgacccagagg

SEQ ID NO: 523950 - DNA, 16 bp, R. norvegicus
tgccctgactttcttc

SEQ ID NO: 523951 - DNA, 16 bp, R. norvegicus
tgccctgagagagctg

SEQ ID NO: 523952 - DNA, 16 bp, R. norvegicus
tgccctgccacctgag

SEQ ID NO: 523953 - DNA, 16 bp, R. norvegicus
tgccctgccactgagc

SEQ ID NO: 523954 - DNA, 16 bp, R. norvegicus
tgccctgccttctctc

SEQ ID NO: 523955 - DNA, 16 bp, R. norvegicus
tgccctgctgctgctg

SEQ ID NO: 523956 - DNA, 16 bp, R. norvegicus
tgccctggaactcaca

SEQ ID NO: 523957 - DNA, 16 bp, R. norvegicus
tgccctggaaggacaa

SEQ ID NO: 523958 - DNA, 16 bp, R. norvegicus
tgccctggagttacct

SEQ ID NO: 523959 - DNA, 16 bp, R. norvegicus
tgccctggagttggag

SEQ ID NO: 523960 - DNA, 16 bp, R. norvegicus
tgccctggcattgccc

SEQ ID NO: 523961 - DNA, 16 bp, R. norvegicus
tgccctggctatcctg

SEQ ID NO: 523962 - DNA, 16 bp, R. norvegicus
tgccctggctgcagca

SEQ ID NO: 523963 - DNA, 16 bp, R. norvegicus
tgccctggcttccctg

SEQ ID NO: 523964 - DNA, 16 bp, R. norvegicus
tgccctgtagaccagg

SEQ ID NO: 523965 - DNA, 16 bp, R. norvegicus
tgccctgtccctgagg

SEQ ID NO: 523966 - DNA, 16 bp, R. norvegicus
tgccctgtcctgccct

SEQ ID NO: 523967 - DNA, 16 bp, R. norvegicus
tgccctgtgccctgtg

SEQ ID NO: 523968 - DNA, 16 bp, R. norvegicus
tgccctgtgtgtgagg

SEQ ID NO: 523969 - DNA, 16 bp, R. norvegicus
tgccctgtttgatttc

SEQ ID NO: 523970 - DNA, 16 bp, R. norvegicus
tgcccttaaccactaa

SEQ ID NO: 523971 - DNA, 16 bp, R. norvegicus
tgcccttacatttgga

SEQ ID NO: 523972 - DNA, 16 bp, R. norvegicus
tgcccttccacagagg

SEQ ID NO: 523973 - DNA, 16 bp, R. norvegicus
tgcccttccagaggac

SEQ ID NO: 523974 - DNA, 16 bp, R. norvegicus
tgcccttccagaggat

SEQ ID NO: 523975 - DNA, 16 bp, R. norvegicus
tgcccttcccaatact

SEQ ID NO: 523976 - DNA, 16 bp, R. norvegicus
tgcccttggaggctag

SEQ ID NO: 523977 - DNA, 16 bp, R. norvegicus
tgcccttgtctgaaga

SEQ ID NO: 523978 - DNA, 16 bp, R. norvegicus
tgccgcccacagtgga

SEQ ID NO: 523979 - DNA, 16 bp, R. norvegicus
tgccgccgccaccacc

SEQ ID NO: 523980 - DNA, 16 bp, R. norvegicus
tgccgccgccgccacc

SEQ ID NO: 523981 - DNA, 16 bp, R. norvegicus
tgccgctgcctcccaa

SEQ ID NO: 523982 - DNA, 16 bp, R. norvegicus
tgcctacaaaattcat

SEQ ID NO: 523983 - DNA, 16 bp, R. norvegicus
tgcctacaatcccagc

SEQ ID NO: 523984 - DNA, 16 bp, R. norvegicus
tgcctataactccagc

SEQ ID NO: 523985 - DNA, 16 bp, R. norvegicus
tgcctatctatcatct

SEQ ID NO: 523986 - DNA, 16 bp, R. norvegicus
tgcctatctgcctgcc

SEQ ID NO: 523987 - DNA, 16 bp, R. norvegicus
tgcctatgaaccacaa

SEQ ID NO: 523988 - DNA, 16 bp, R. norvegicus
tgcctcaagatctcca

SEQ ID NO: 523989 - DNA, 16 bp, R. norvegicus
tgcctcagcatgtgca

SEQ ID NO: 523990 - DNA, 16 bp, R. norvegicus
tgcctcagcctccaca

SEQ ID NO: 523991 - DNA, 16 bp, R. norvegicus
tgcctcagcctcccaa

SEQ ID NO: 523992 - DNA, 16 bp, R. norvegicus
tgcctcagcctcctac

SEQ ID NO: 523993 - DNA, 16 bp, R. norvegicus
tgcctcagcctcctcc

SEQ ID NO: 523994 - DNA, 16 bp, R. norvegicus
tgcctcagctcctgcc

SEQ ID NO: 523995 - DNA, 16 bp, R. norvegicus
tgcctcagtctctggg

SEQ ID NO: 523996 - DNA, 16 bp, R. norvegicus
tgcctcagttgttcct

SEQ ID NO: 523997 - DNA, 16 bp, R. norvegicus
tgcctcagtttaccca

SEQ ID NO: 523998 - DNA, 16 bp, R. norvegicus
tgcctcagtttcccca

SEQ ID NO: 523999 - DNA, 16 bp, R. norvegicus
tgcctcatttgaatcc

SEQ ID NO: 524000 - DNA, 16 bp, R. norvegicus
tgcctccaaaaggaaa

SEQ ID NO: 524001 - DNA, 16 bp, R. norvegicus
tgcctccaagaagaaa

SEQ ID NO: 524002 - DNA, 16 bp, R. norvegicus
tgcctccaccaccacc

SEQ ID NO: 524003 - DNA, 16 bp, R. norvegicus
tgcctccacctctgcc

SEQ ID NO: 524004 - DNA, 16 bp, R. norvegicus
tgcctccatattccct

SEQ ID NO: 524005 - DNA, 16 bp, R. norvegicus
tgcctccatcagattg

SEQ ID NO: 524006 - DNA, 16 bp, R. norvegicus
tgcctccatgaaaccc

SEQ ID NO: 524007 - DNA, 16 bp, R. norvegicus
tgcctcccacctccct

SEQ ID NO: 524008 - DNA, 16 bp, R. norvegicus
tgcctcccatctcacc

SEQ ID NO: 524009 - DNA, 16 bp, R. norvegicus
tgcctccctagagctg

SEQ ID NO: 524010 - DNA, 16 bp, R. norvegicus
tgcctccctctcccca

SEQ ID NO: 524011 - DNA, 16 bp, R. norvegicus
tgcctccctgctgctg

SEQ ID NO: 524012 - DNA, 16 bp, R. norvegicus
tgcctcctaagtgcca

SEQ ID NO: 524013 - DNA, 16 bp, R. norvegicus
tgcctcctatgtctgt

SEQ ID NO: 524014 - DNA, 16 bp, R. norvegicus
tgcctcctcttcctca

SEQ ID NO: 524015 - DNA, 16 bp, R. norvegicus
tgcctcctcttctaca

SEQ ID NO: 524016 - DNA, 16 bp, R. norvegicus
tgcctcctgactgtgg

SEQ ID NO: 524017 - DNA, 16 bp, R. norvegicus
tgcctcctgagtgtgg

SEQ ID NO: 524018 - DNA, 16 bp, R. norvegicus
tgcctcctggccctga

SEQ ID NO: 524019 - DNA, 16 bp, R. norvegicus
tgcctcctgtgagtat

SEQ ID NO: 524020 - DNA, 16 bp, R. norvegicus
tgcctcctgtgtgctg

SEQ ID NO: 524021 - DNA, 16 bp, R. norvegicus
tgcctccttctggtgt

SEQ ID NO: 524022 - DNA, 16 bp, R. norvegicus
tgcctccttgtattgg

SEQ ID NO: 524023 - DNA, 16 bp, R. norvegicus
tgcctcctttgtcaaa

SEQ ID NO: 524024 - DNA, 16 bp, R. norvegicus
tgcctctacagcccag

SEQ ID NO: 524025 - DNA, 16 bp, R. norvegicus
tgcctctacctctcca

SEQ ID NO: 524026 - DNA, 16 bp, R. norvegicus
tgcctctacctcttga

SEQ ID NO: 524027 - DNA, 16 bp, R. norvegicus
tgcctctacttcccaa

SEQ ID NO: 524028 - DNA, 16 bp, R. norvegicus
tgcctctacttcccca

SEQ ID NO: 524029 - DNA, 16 bp, R. norvegicus
tgcctctcagatattc

SEQ ID NO: 524030 - DNA, 16 bp, R. norvegicus
tgcctctccctccaga

SEQ ID NO: 524031 - DNA, 16 bp, R. norvegicus
tgcctctctacctctg

SEQ ID NO: 524032 - DNA, 16 bp, R. norvegicus
tgcctctctattctct

SEQ ID NO: 524033 - DNA, 16 bp, R. norvegicus
tgcctctctgaaggtc

SEQ ID NO: 524034 - DNA, 16 bp, R. norvegicus
tgcctctctgcctttc

SEQ ID NO: 524035 - DNA, 16 bp, R. norvegicus
tgcctctctggctttg

SEQ ID NO: 524036 - DNA, 16 bp, R. norvegicus
tgcctctcttgggcat

SEQ ID NO: 524037 - DNA, 16 bp, R. norvegicus
tgcctctgccactgcc

SEQ ID NO: 524038 - DNA, 16 bp, R. norvegicus
tgcctctgcctccacc

SEQ ID NO: 524039 - DNA, 16 bp, R. norvegicus
tgcctctgcctcccac

SEQ ID NO: 524040 - DNA, 16 bp, R. norvegicus
tgcctctgcctcccat

SEQ ID NO: 524041 - DNA, 16 bp, R. norvegicus
tgcctctgcctccttg

SEQ ID NO: 524042 - DNA, 16 bp, R. norvegicus
tgcctctgcctctggc

SEQ ID NO: 524043 - DNA, 16 bp, R. norvegicus
tgcctctgcctgctgg

SEQ ID NO: 524044 - DNA, 16 bp, R. norvegicus
tgcctctgcctgtgcc

SEQ ID NO: 524045 - DNA, 16 bp, R. norvegicus
tgcctctgccttccga

SEQ ID NO: 524046 - DNA, 16 bp, R. norvegicus
tgcctctgccttcctg

SEQ ID NO: 524047 - DNA, 16 bp, R. norvegicus
tgcctctgctctcagg

SEQ ID NO: 524048 - DNA, 16 bp, R. norvegicus
tgcctctgcttcctgg

SEQ ID NO: 524049 - DNA, 16 bp, R. norvegicus
tgcctctgcttccttc

SEQ ID NO: 524050 - DNA, 16 bp, R. norvegicus
tgcctctggagtgcta

SEQ ID NO: 524051 - DNA, 16 bp, R. norvegicus
tgcctctgtatcccaa

SEQ ID NO: 524052 - DNA, 16 bp, R. norvegicus
tgcctctgtctccctg

SEQ ID NO: 524053 - DNA, 16 bp, R. norvegicus
tgcctctgtgcctctg

SEQ ID NO: 524054 - DNA, 16 bp, R. norvegicus
tgcctctgtgtgcctc

SEQ ID NO: 524055 - DNA, 16 bp, R. norvegicus
tgcctctgtgtgttct

SEQ ID NO: 524056 - DNA, 16 bp, R. norvegicus
tgcctctgtttagttt

SEQ ID NO: 524057 - DNA, 16 bp, R. norvegicus
tgcctcttcctcctga

SEQ ID NO: 524058 - DNA, 16 bp, R. norvegicus
tgcctcttgccatcat

SEQ ID NO: 524059 - DNA, 16 bp, R. norvegicus
tgcctctttctcctga

SEQ ID NO: 524060 - DNA, 16 bp, R. norvegicus
tgcctgaaagccagta

SEQ ID NO: 524061 - DNA, 16 bp, R. norvegicus
tgcctgaatgctgcca

SEQ ID NO: 524062 - DNA, 16 bp, R. norvegicus
tgcctgacctggaact

SEQ ID NO: 524063 - DNA, 16 bp, R. norvegicus
tgcctgagatgaagcc

SEQ ID NO: 524064 - DNA, 16 bp, R. norvegicus
tgcctgagcccagagc

SEQ ID NO: 524065 - DNA, 16 bp, R. norvegicus
tgcctgaggatcctgc

SEQ ID NO: 524066 - DNA, 16 bp, R. norvegicus
tgcctgagggagagcc

SEQ ID NO: 524067 - DNA, 16 bp, R. norvegicus
tgcctgagggtgctca

SEQ ID NO: 524068 - DNA, 17 bp, R. norvegicus
tgcctgagttcagggat

SEQ ID NO: 524069 - DNA, 16 bp, R. norvegicus
tgcctgagttccagtc

SEQ ID NO: 524070 - DNA, 16 bp, R. norvegicus
tgcctgcaaaaggaaa

SEQ ID NO: 524071 - DNA, 16 bp, R. norvegicus
tgcctgcaaatttcaa

SEQ ID NO: 524072 - DNA, 16 bp, R. norvegicus
tgcctgcagagagctg

SEQ ID NO: 524073 - DNA, 16 bp, R. norvegicus
tgcctgcagagggcag

SEQ ID NO: 524074 - DNA, 16 bp, R. norvegicus
tgcctgcagaggtcag

SEQ ID NO: 524075 - DNA, 16 bp, R. norvegicus
tgcctgcagcagctct

SEQ ID NO: 524076 - DNA, 16 bp, R. norvegicus
tgcctgcaggctgcca

SEQ ID NO: 524077 - DNA, 16 bp, R. norvegicus
tgcctgcaggctgtgc

SEQ ID NO: 524078 - DNA, 16 bp, R. norvegicus
tgcctgcatctgtctc

SEQ ID NO: 524079 - DNA, 16 bp, R. norvegicus
tgcctgcatgccacca

SEQ ID NO: 524080 - DNA, 16 bp, R. norvegicus
tgcctgcatgtgcctg

SEQ ID NO: 524081 - DNA, 16 bp, R. norvegicus
tgcctgcatgtgtacc

SEQ ID NO: 524082 - DNA, 16 bp, R. norvegicus
tgcctgccaagtgctg

SEQ ID NO: 524083 - DNA, 16 bp, R. norvegicus
tgcctgccacttgctg

SEQ ID NO: 524084 - DNA, 16 bp, R. norvegicus
tgcctgccagcctgcc

SEQ ID NO: 524085 - DNA, 16 bp, R. norvegicus
tgcctgcctcagcttc

SEQ ID NO: 524086 - DNA, 16 bp, R. norvegicus
tgcctgcctcctggga

SEQ ID NO: 524087 - DNA, 16 bp, R. norvegicus
tgcctgcctcttcttc

SEQ ID NO: 524088 - DNA, 16 bp, R. norvegicus
tgcctgcctctttctc

SEQ ID NO: 524089 - DNA, 16 bp, R. norvegicus
tgcctgcctgcatgct

SEQ ID NO: 524090 - DNA, 16 bp, R. norvegicus
tgcctgcctgcatgtc

SEQ ID NO: 524091 - DNA, 16 bp, R. norvegicus
tgcctgcctgcccgcc

SEQ ID NO: 524092 - DNA, 16 bp, R. norvegicus
tgcctgcctgcctccc

SEQ ID NO: 524093 - DNA, 17 bp, R. norvegicus
tgcctgcctgcctgcct

SEQ ID NO: 524094 - DNA, 16 bp, R. norvegicus
tgcctgcctgccttcc

SEQ ID NO: 524095 - DNA, 16 bp, R. norvegicus
tgcctgcctgccttct

SEQ ID NO: 524096 - DNA, 16 bp, R. norvegicus
tgcctgcctgcttccc

SEQ ID NO: 524097 - DNA, 17 bp, R. norvegicus
tgcctgcctggcctgct

SEQ ID NO: 524098 - DNA, 16 bp, R. norvegicus
tgcctgcctgtctgct

SEQ ID NO: 524099 - DNA, 16 bp, R. norvegicus
tgcctgcctgtctgtc

SEQ ID NO: 524100 - DNA, 16 bp, R. norvegicus
tgcctgcctgttgcca

SEQ ID NO: 524101 - DNA, 16 bp, R. norvegicus
tgcctgcctttgtttc

SEQ ID NO: 524102 - DNA, 16 bp, R. norvegicus
tgcctgctcttccaga

SEQ ID NO: 524103 - DNA, 16 bp, R. norvegicus
tgcctgctgattcaga

SEQ ID NO: 524104 - DNA, 16 bp, R. norvegicus
tgcctgctgcctgtgg

SEQ ID NO: 524105 - DNA, 16 bp, R. norvegicus
tgcctgctgcttgttc

SEQ ID NO: 524106 - DNA, 16 bp, R. norvegicus
tgcctgcttctgcttc

SEQ ID NO: 524107 - DNA, 16 bp, R. norvegicus
tgcctggaagacagtc

SEQ ID NO: 524108 - DNA, 16 bp, R. norvegicus
tgcctggacactgtca

SEQ ID NO: 524109 - DNA, 17 bp, R. norvegicus
tgcctggacttgctttt

SEQ ID NO: 524110 - DNA, 16 bp, R. norvegicus
tgcctggagttcctgc

SEQ ID NO: 524111 - DNA, 16 bp, R. norvegicus
tgcctggcactgtaaa

SEQ ID NO: 524112 - DNA, 16 bp, R. norvegicus
tgcctgggatgcagcc

SEQ ID NO: 524113 - DNA, 16 bp, R. norvegicus
tgcctgggctggcatt

SEQ ID NO: 524114 - DNA, 16 bp, R. norvegicus
tgcctggtcctctcag

SEQ ID NO: 524115 - DNA, 18 bp, R. norvegicus
tgcctggtgagattggga

SEQ ID NO: 524116 - DNA, 16 bp, R. norvegicus
tgcctggtgcctgggg

SEQ ID NO: 524117 - DNA, 16 bp, R. norvegicus
tgcctggtgtccatgg

SEQ ID NO: 524118 - DNA, 16 bp, R. norvegicus
tgcctggtttggcctc

SEQ ID NO: 524119 - DNA, 16 bp, R. norvegicus
tgcctgtaaaactcat

SEQ ID NO: 524120 - DNA, 16 bp, R. norvegicus
tgcctgtaattccagc

SEQ ID NO: 524121 - DNA, 16 bp, R. norvegicus
tgcctgtcctgaaact

SEQ ID NO: 524122 - DNA, 16 bp, R. norvegicus
tgcctgtctctacctc

SEQ ID NO: 524123 - DNA, 16 bp, R. norvegicus
tgcctgtctgctgcct

SEQ ID NO: 524124 - DNA, 16 bp, R. norvegicus
tgcctgtctgtctgtc

SEQ ID NO: 524125 - DNA, 16 bp, R. norvegicus
tgcctgtgaaagccag

SEQ ID NO: 524126 - DNA, 16 bp, R. norvegicus
tgcctgtgaatgtgtg

SEQ ID NO: 524127 - DNA, 16 bp, R. norvegicus
tgcctgtgcctctgtg

SEQ ID NO: 524128 - DNA, 16 bp, R. norvegicus
tgcctgtgcctgtgtg

SEQ ID NO: 524129 - DNA, 16 bp, R. norvegicus
tgcctgtgcgtgtgtg

SEQ ID NO: 524130 - DNA, 16 bp, R. norvegicus
tgcctgtggaagacag

SEQ ID NO: 524131 - DNA, 16 bp, R. norvegicus
tgcctgtggagatcag

SEQ ID NO: 524132 - DNA, 16 bp, R. norvegicus
tgcctgtggaggccag

SEQ ID NO: 524133 - DNA, 16 bp, R. norvegicus
tgcctgtgtctctcag

SEQ ID NO: 524134 - DNA, 16 bp, R. norvegicus
tgcctgtgtctctgtg

SEQ ID NO: 524135 - DNA, 16 bp, R. norvegicus
tgcctgtgtctgtctc

SEQ ID NO: 524136 - DNA, 16 bp, R. norvegicus
tgcctgtgtgagagtg

SEQ ID NO: 524137 - DNA, 16 bp, R. norvegicus
tgcctgtgtgtctgtg

SEQ ID NO: 524138 - DNA, 16 bp, R. norvegicus
tgcctgtgtgtgtgcg

SEQ ID NO: 524139 - DNA, 16 bp, R. norvegicus
tgcctgtgtgtgtggt

SEQ ID NO: 524140 - DNA, 16 bp, R. norvegicus
tgcctgttcttccaga

SEQ ID NO: 524141 - DNA, 16 bp, R. norvegicus
tgccttaagctcctga

SEQ ID NO: 524142 - DNA, 17 bp, R. norvegicus
tgccttacagaagcttc

SEQ ID NO: 524143 - DNA, 16 bp, R. norvegicus
tgccttatctgacatc

SEQ ID NO: 524144 - DNA, 16 bp, R. norvegicus
tgccttatttataata

SEQ ID NO: 524145 - DNA, 16 bp, R. norvegicus
tgccttcagtcccagc

SEQ ID NO: 524146 - DNA, 16 bp, R. norvegicus
tgccttcatcatggtg

SEQ ID NO: 524147 - DNA, 16 bp, R. norvegicus
tgccttccagaagctt

SEQ ID NO: 524148 - DNA, 16 bp, R. norvegicus
tgccttcccagtgcta

SEQ ID NO: 524149 - DNA, 16 bp, R. norvegicus
tgccttccctgggctg

SEQ ID NO: 524150 - DNA, 16 bp, R. norvegicus
tgccttcccttgcctt

SEQ ID NO: 524151 - DNA, 16 bp, R. norvegicus
tgccttcctctgcctt

SEQ ID NO: 524152 - DNA, 16 bp, R. norvegicus
tgccttcctgcataaa

SEQ ID NO: 524153 - DNA, 16 bp, R. norvegicus
tgccttcctgcctgcc

SEQ ID NO: 524154 - DNA, 16 bp, R. norvegicus
tgccttcctgctcctg

SEQ ID NO: 524155 - DNA, 16 bp, R. norvegicus
tgccttcctggacact

SEQ ID NO: 524156 - DNA, 16 bp, R. norvegicus
tgccttctacacctcc

SEQ ID NO: 524157 - DNA, 16 bp, R. norvegicus
tgccttctactcctgt

SEQ ID NO: 524158 - DNA, 16 bp, R. norvegicus
tgccttctattcctct

SEQ ID NO: 524159 - DNA, 16 bp, R. norvegicus
tgccttctctgccatg

SEQ ID NO: 524160 - DNA, 16 bp, R. norvegicus
tgccttctctgctctg

SEQ ID NO: 524161 - DNA, 16 bp, R. norvegicus
tgccttctgatctcca

SEQ ID NO: 524162 - DNA, 16 bp, R. norvegicus
tgccttctgccctctg

SEQ ID NO: 524163 - DNA, 16 bp, R. norvegicus
tgccttcttccagcct

SEQ ID NO: 524164 - DNA, 16 bp, R. norvegicus
tgccttcttctcccag

SEQ ID NO: 524165 - DNA, 16 bp, R. norvegicus
tgccttcttctggact

SEQ ID NO: 524166 - DNA, 16 bp, R. norvegicus
tgccttcttctggttt

SEQ ID NO: 524167 - DNA, 16 bp, R. norvegicus
tgccttgaagcatgga

SEQ ID NO: 524168 - DNA, 16 bp, R. norvegicus
tgccttgaatccctga

SEQ ID NO: 524169 - DNA, 16 bp, R. norvegicus
tgccttgccaacactg

SEQ ID NO: 524170 - DNA, 16 bp, R. norvegicus
tgccttgcccagcctt

SEQ ID NO: 524171 - DNA, 16 bp, R. norvegicus
tgccttgcctggcctc

SEQ ID NO: 524172 - DNA, 16 bp, R. norvegicus
tgccttggctgtcctg

SEQ ID NO: 524173 - DNA, 16 bp, R. norvegicus
tgccttgtatttgggg

SEQ ID NO: 524174 - DNA, 16 bp, R. norvegicus
tgccttgtccagcctt

SEQ ID NO: 524175 - DNA, 16 bp, R. norvegicus
tgccttgtctggtctc

SEQ ID NO: 524176 - DNA, 16 bp, R. norvegicus
tgcctttaatccaagc

SEQ ID NO: 524177 - DNA, 16 bp, R. norvegicus
tgcctttatatcttac

SEQ ID NO: 524178 - DNA, 16 bp, R. norvegicus
tgcctttattgtgttt

SEQ ID NO: 524179 - DNA, 16 bp, R. norvegicus
tgcctttctgtctgtg

SEQ ID NO: 524180 - DNA, 16 bp, R. norvegicus
tgcctttctttttaaa

SEQ ID NO: 524181 - DNA, 16 bp, R. norvegicus
tgcctttgcctcccga

SEQ ID NO: 524182 - DNA, 16 bp, R. norvegicus
tgcctttggaagccag

SEQ ID NO: 524183 - DNA, 16 bp, R. norvegicus
tgcctttggatgaaga

SEQ ID NO: 524184 - DNA, 16 bp, R. norvegicus
tgcctttggtcatggt

SEQ ID NO: 524185 - DNA, 16 bp, R. norvegicus
tgccttttccaggagc

SEQ ID NO: 524186 - DNA, 16 bp, R. norvegicus
tgccttttctggcctc

SEQ ID NO: 524187 - DNA, 16 bp, R. norvegicus
tgcctttttgaaagaa

SEQ ID NO: 524188 - DNA, 16 bp, R. norvegicus
tgcgcacgcgcgcgca

SEQ ID NO: 524189 - DNA, 16 bp, R. norvegicus
tgcgccaccactgccc

SEQ ID NO: 524190 - DNA, 16 bp, R. norvegicus
tgcgcgcacacatgca

SEQ ID NO: 524191 - DNA, 16 bp, R. norvegicus
tgcgcgcgcacatgca

SEQ ID NO: 524192 - DNA, 16 bp, R. norvegicus
tgcgcgctctctctct

SEQ ID NO: 524193 - DNA, 16 bp, R. norvegicus
tgcgcgtgcgcacacg

SEQ ID NO: 524194 - DNA, 16 bp, R. norvegicus
tgcggcaggctctgaa

SEQ ID NO: 524195 - DNA, 16 bp, R. norvegicus
tgcgggagggcccagg

SEQ ID NO: 524196 - DNA, 16 bp, R. norvegicus
tgcgtgcacgtgtgtg

SEQ ID NO: 524197 - DNA, 16 bp, R. norvegicus
tgcgtgcgtgcgtgcg

SEQ ID NO: 524198 - DNA, 18 bp, R. norvegicus
tgcgtgcgtgcgtgcgtg

SEQ ID NO: 524199 - DNA, 16 bp, R. norvegicus
tgcgtgcgtgtgtgtg

SEQ ID NO: 524200 - DNA, 16 bp, R. norvegicus
tgcgtgggtgctggga

SEQ ID NO: 524201 - DNA, 16 bp, R. norvegicus
tgcgtgtgtgagtgtg

SEQ ID NO: 524202 - DNA, 16 bp, R. norvegicus
tgcgtgtgtgtgcgtg

SEQ ID NO: 524203 - DNA, 16 bp, R. norvegicus
tgctaaaccagcactg

SEQ ID NO: 524204 - DNA, 24 bp, R. norvegicus
tgctaacccaatcacagaaagaca

SEQ ID NO: 524205 - DNA, 17 bp, R. norvegicus
tgctaagaaggtacaag

SEQ ID NO: 524206 - DNA, 16 bp, R. norvegicus
tgctaagagagggaga

SEQ ID NO: 524207 - DNA, 18 bp, R. norvegicus
tgctaagaggaaaactcg

SEQ ID NO: 524208 - DNA, 16 bp, R. norvegicus
tgctaagcaagcactt

SEQ ID NO: 524209 - DNA, 16 bp, R. norvegicus
tgctaaggtggtgagg

SEQ ID NO: 524210 - DNA, 16 bp, R. norvegicus
tgctaatgctaagaag

SEQ ID NO: 524211 - DNA, 16 bp, R. norvegicus
tgctacaaatgcagct

SEQ ID NO: 524212 - DNA, 16 bp, R. norvegicus
tgctacagagagcaga

SEQ ID NO: 524213 - DNA, 16 bp, R. norvegicus
tgctacatatgtgact

SEQ ID NO: 524214 - DNA, 16 bp, R. norvegicus
tgctacatatgtggca

SEQ ID NO: 524215 - DNA, 16 bp, R. norvegicus
tgctaccacatctggc

SEQ ID NO: 524216 - DNA, 16 bp, R. norvegicus
tgctacctatgagatc

SEQ ID NO: 524217 - DNA, 17 bp, R. norvegicus
tgctacctatgaggaca

SEQ ID NO: 524218 - DNA, 16 bp, R. norvegicus
tgctacctatgtggtt

SEQ ID NO: 524219 - DNA, 16 bp, R. norvegicus
tgctacctgtgcagtt

SEQ ID NO: 524220 - DNA, 16 bp, R. norvegicus
tgctactgctgctgct

SEQ ID NO: 524221 - DNA, 16 bp, R. norvegicus
tgctactgttgctgct

SEQ ID NO: 524222 - DNA, 16 bp, R. norvegicus
tgctactgttgttgtt

SEQ ID NO: 524223 - DNA, 16 bp, R. norvegicus
tgctactttacaactg

SEQ ID NO: 524224 - DNA, 16 bp, R. norvegicus
tgctagacaagccctc

SEQ ID NO: 524225 - DNA, 16 bp, R. norvegicus
tgctagagaaggagct

SEQ ID NO: 524226 - DNA, 16 bp, R. norvegicus
tgctagagaggcagag

SEQ ID NO: 524227 - DNA, 16 bp, R. norvegicus
tgctagagcacttgcc

SEQ ID NO: 524228 - DNA, 16 bp, R. norvegicus
tgctagcagcaaaccc

SEQ ID NO: 524229 - DNA, 16 bp, R. norvegicus
tgctagcagccctcag

SEQ ID NO: 524230 - DNA, 16 bp, R. norvegicus
tgctaggcaggggctc

SEQ ID NO: 524231 - DNA, 16 bp, R. norvegicus
tgctaggcttctgttt

SEQ ID NO: 524232 - DNA, 18 bp, R. norvegicus
tgctaggggagttacaag

SEQ ID NO: 524233 - DNA, 20 bp, R. norvegicus
tgctaggtaagcgctctacc

SEQ ID NO: 524234 - DNA, 16 bp, R. norvegicus
tgctaggtaccagcct

SEQ ID NO: 524235 - DNA, 16 bp, R. norvegicus
tgctatcctcctgcct

SEQ ID NO: 524236 - DNA, 17 bp, R. norvegicus
tgctatctggaactgtt

SEQ ID NO: 524237 - DNA, 16 bp, R. norvegicus
tgctatctttttccca

SEQ ID NO: 524238 - DNA, 16 bp, R. norvegicus
tgctatggagagacac

SEQ ID NO: 524239 - DNA, 16 bp, R. norvegicus
tgctattataaataag

SEQ ID NO: 524240 - DNA, 16 bp, R. norvegicus
tgctattccacagtca

SEQ ID NO: 524241 - DNA, 16 bp, R. norvegicus
tgctatttgtcctgtt

SEQ ID NO: 524242 - DNA, 16 bp, R. norvegicus
tgctcaacaaagccat

SEQ ID NO: 524243 - DNA, 16 bp, R. norvegicus
tgctcaacaagaccat

SEQ ID NO: 524244 - DNA, 16 bp, R. norvegicus
tgctcaacctgttttc

SEQ ID NO: 524245 - DNA, 16 bp, R. norvegicus
tgctcaataaatattt

SEQ ID NO: 524246 - DNA, 16 bp, R. norvegicus
tgctcacagaaagaga

SEQ ID NO: 524247 - DNA, 16 bp, R. norvegicus
tgctcacagcagcctt

SEQ ID NO: 524248 - DNA, 16 bp, R. norvegicus
tgctcacaggcctctg

SEQ ID NO: 524249 - DNA, 16 bp, R. norvegicus
tgctcacatttccagc

SEQ ID NO: 524250 - DNA, 16 bp, R. norvegicus
tgctcacccacactca

SEQ ID NO: 524251 - DNA, 16 bp, R. norvegicus
tgctcactgcgtgtgg

SEQ ID NO: 524252 - DNA, 16 bp, R. norvegicus
tgctcagagaagaggc

SEQ ID NO: 524253 - DNA, 16 bp, R. norvegicus
tgctcagcctgctctc

SEQ ID NO: 524254 - DNA, 16 bp, R. norvegicus
tgctcagggcagggct

SEQ ID NO: 524255 - DNA, 16 bp, R. norvegicus
tgctcagtaaatattt

SEQ ID NO: 524256 - DNA, 16 bp, R. norvegicus
tgctcagtctgttctt

SEQ ID NO: 524257 - DNA, 16 bp, R. norvegicus
tgctcatgccatgctg

SEQ ID NO: 524258 - DNA, 16 bp, R. norvegicus
tgctcatggctagcct

SEQ ID NO: 524259 - DNA, 16 bp, R. norvegicus
tgctcatggctggcct

SEQ ID NO: 524260 - DNA, 16 bp, R. norvegicus
tgctcatgtgtttgag

SEQ ID NO: 524261 - DNA, 16 bp, R. norvegicus
tgctcattcttcctct

SEQ ID NO: 524262 - DNA, 17 bp, R. norvegicus
tgctccaaatttgtctc

SEQ ID NO: 524263 - DNA, 16 bp, R. norvegicus
tgctccacatcctcac

SEQ ID NO: 524264 - DNA, 16 bp, R. norvegicus
tgctccactatattca

SEQ ID NO: 524265 - DNA, 17 bp, R. norvegicus
tgctccactatgttcat

SEQ ID NO: 524266 - DNA, 17 bp, R. norvegicus
tgctccactatgttcgt

SEQ ID NO: 524267 - DNA, 17 bp, R. norvegicus
tgctccactttgttcat

SEQ ID NO: 524268 - DNA, 16 bp, R. norvegicus
tgctccaggacaggaa

SEQ ID NO: 524269 - DNA, 16 bp, R. norvegicus
tgctccaggcaccaag

SEQ ID NO: 524270 - DNA, 16 bp, R. norvegicus
tgctccaggttcccag

SEQ ID NO: 524271 - DNA, 16 bp, R. norvegicus
tgctccagtggaaggc

SEQ ID NO: 524272 - DNA, 16 bp, R. norvegicus
tgctccattgtgttca

SEQ ID NO: 524273 - DNA, 16 bp, R. norvegicus
tgctcccacagaggac

SEQ ID NO: 524274 - DNA, 16 bp, R. norvegicus
tgctcccagaactgaa

SEQ ID NO: 524275 - DNA, 16 bp, R. norvegicus
tgctcccagaccccat

SEQ ID NO: 524276 - DNA, 16 bp, R. norvegicus
tgctcccccacctgcc

SEQ ID NO: 524277 - DNA, 16 bp, R. norvegicus
tgctccctcttctgca

SEQ ID NO: 524278 - DNA, 16 bp, R. norvegicus
tgctccctggaaggca

SEQ ID NO: 524279 - DNA, 16 bp, R. norvegicus
tgctcctaaccattga

SEQ ID NO: 524280 - DNA, 16 bp, R. norvegicus
tgctcctatattccta

SEQ ID NO: 524281 - DNA, 16 bp, R. norvegicus
tgctcctcctcaccct

SEQ ID NO: 524282 - DNA, 16 bp, R. norvegicus
tgctcctcctcactct

SEQ ID NO: 524283 - DNA, 16 bp, R. norvegicus
tgctcctcctgcttct

SEQ ID NO: 524284 - DNA, 16 bp, R. norvegicus
tgctcctgagaatctc

SEQ ID NO: 524285 - DNA, 16 bp, R. norvegicus
tgctcctgagtttgtg

SEQ ID NO: 524286 - DNA, 16 bp, R. norvegicus
tgctcctgcccctgct

SEQ ID NO: 524287 - DNA, 16 bp, R. norvegicus
tgctcctgctccttct

SEQ ID NO: 524288 - DNA, 16 bp, R. norvegicus
tgctcctgcttcctct

SEQ ID NO: 524289 - DNA, 16 bp, R. norvegicus
tgctcctgcttctgct

SEQ ID NO: 524290 - DNA, 16 bp, R. norvegicus
tgctcctggaggccag

SEQ ID NO: 524291 - DNA, 16 bp, R. norvegicus
tgctcctggatttgtg

SEQ ID NO: 524292 - DNA, 16 bp, R. norvegicus
tgctcctggtggctgg

SEQ ID NO: 524293 - DNA, 16 bp, R. norvegicus
tgctcctgtaaataac

SEQ ID NO: 524294 - DNA, 16 bp, R. norvegicus
tgctcctgtaagtaac

SEQ ID NO: 524295 - DNA, 16 bp, R. norvegicus
tgctcctgtctctgcc

SEQ ID NO: 524296 - DNA, 16 bp, R. norvegicus
tgctcctgtgggcctg

SEQ ID NO: 524297 - DNA, 16 bp, R. norvegicus
tgctccttcagtctct

SEQ ID NO: 524298 - DNA, 16 bp, R. norvegicus
tgctccttttacctag

SEQ ID NO: 524299 - DNA, 16 bp, R. norvegicus
tgctcgcacacacaca

SEQ ID NO: 524300 - DNA, 16 bp, R. norvegicus
tgctctacacagtgag

SEQ ID NO: 524301 - DNA, 16 bp, R. norvegicus
tgctctactcaatcat

SEQ ID NO: 524302 - DNA, 17 bp, R. norvegicus
tgctctcacctgagttt

SEQ ID NO: 524303 - DNA, 16 bp, R. norvegicus
tgctctcagaggccag

SEQ ID NO: 524304 - DNA, 16 bp, R. norvegicus
tgctctcagtgctcct

SEQ ID NO: 524305 - DNA, 16 bp, R. norvegicus
tgctctcccagaaact

SEQ ID NO: 524306 - DNA, 16 bp, R. norvegicus
tgctctctctgcccct

SEQ ID NO: 524307 - DNA, 16 bp, R. norvegicus
tgctctctctggcctc

SEQ ID NO: 524308 - DNA, 16 bp, R. norvegicus
tgctctctgggcacag

SEQ ID NO: 524309 - DNA, 16 bp, R. norvegicus
tgctctctgtgctccc

SEQ ID NO: 524310 - DNA, 16 bp, R. norvegicus
tgctctctgtgtgtgt

SEQ ID NO: 524311 - DNA, 16 bp, R. norvegicus
tgctctcttctcattc

SEQ ID NO: 524312 - DNA, 16 bp, R. norvegicus
tgctctgaactgctga

SEQ ID NO: 524313 - DNA, 16 bp, R. norvegicus
tgctctgacaaaagca

SEQ ID NO: 524314 - DNA, 16 bp, R. norvegicus
tgctctgacagaggac

SEQ ID NO: 524315 - DNA, 16 bp, R. norvegicus
tgctctgcagcctcgg

SEQ ID NO: 524316 - DNA, 16 bp, R. norvegicus
tgctctgccatcatgg

SEQ ID NO: 524317 - DNA, 16 bp, R. norvegicus
tgctctgcctctgtgc

SEQ ID NO: 524318 - DNA, 16 bp, R. norvegicus
tgctctgcgggaggcc

SEQ ID NO: 524319 - DNA, 16 bp, R. norvegicus
tgctctgctctcctct

SEQ ID NO: 524320 - DNA, 16 bp, R. norvegicus
tgctctgctctctctg

SEQ ID NO: 524321 - DNA, 16 bp, R. norvegicus
tgctctgctctgttct

SEQ ID NO: 524322 - DNA, 16 bp, R. norvegicus
tgctctgctgctgctg

SEQ ID NO: 524323 - DNA, 16 bp, R. norvegicus
tgctctggactcttcc

SEQ ID NO: 524324 - DNA, 16 bp, R. norvegicus
tgctctggtgaattct

SEQ ID NO: 524325 - DNA, 16 bp, R. norvegicus
tgctctggtggaactt

SEQ ID NO: 524326 - DNA, 16 bp, R. norvegicus
tgctctgtgctccaca

SEQ ID NO: 524327 - DNA, 16 bp, R. norvegicus
tgctctgttctgctct

SEQ ID NO: 524328 - DNA, 16 bp, R. norvegicus
tgctctgttgaaaatg

SEQ ID NO: 524329 - DNA, 16 bp, R. norvegicus
tgctcttaaccactgg

SEQ ID NO: 524330 - DNA, 16 bp, R. norvegicus
tgctcttaacccctga

SEQ ID NO: 524331 - DNA, 16 bp, R. norvegicus
tgctcttacagaggac

SEQ ID NO: 524332 - DNA, 16 bp, R. norvegicus
tgctcttagcactgct

SEQ ID NO: 524333 - DNA, 16 bp, R. norvegicus
tgctcttagccactgg

SEQ ID NO: 524334 - DNA, 16 bp, R. norvegicus
tgctcttcacctctga

SEQ ID NO: 524335 - DNA, 16 bp, R. norvegicus
tgctcttccacaggtc

SEQ ID NO: 524336 - DNA, 16 bp, R. norvegicus
tgctcttccagaggat

SEQ ID NO: 524337 - DNA, 16 bp, R. norvegicus
tgctcttctagaggtc

SEQ ID NO: 524338 - DNA, 16 bp, R. norvegicus
tgctcttctggtgtgt

SEQ ID NO: 524339 - DNA, 16 bp, R. norvegicus
tgctcttgaagaagac

SEQ ID NO: 524340 - DNA, 16 bp, R. norvegicus
tgctcttgcagagacc

SEQ ID NO: 524341 - DNA, 16 bp, R. norvegicus
tgctcttgcagagagc

SEQ ID NO: 524342 - DNA, 16 bp, R. norvegicus
tgctcttgcagaggac

SEQ ID NO: 524343 - DNA, 16 bp, R. norvegicus
tgctcttgctgaagac

SEQ ID NO: 524344 - DNA, 17 bp, R. norvegicus
tgctcttggaccagatc

SEQ ID NO: 524345 - DNA, 16 bp, R. norvegicus
tgctcttggattcaat

SEQ ID NO: 524346 - DNA, 16 bp, R. norvegicus
tgctctttctagctct

SEQ ID NO: 524347 - DNA, 16 bp, R. norvegicus
tgctcttttagaggtc

SEQ ID NO: 524348 - DNA, 16 bp, R. norvegicus
tgctgaaaaagtattt

SEQ ID NO: 524349 - DNA, 16 bp, R. norvegicus
tgctgaaaaagtcttt

SEQ ID NO: 524350 - DNA, 16 bp, R. norvegicus
tgctgaaaatgcaatc

SEQ ID NO: 524351 - DNA, 16 bp, R. norvegicus
tgctgaaaggactgga

SEQ ID NO: 524352 - DNA, 16 bp, R. norvegicus
tgctgaacaagctcac

SEQ ID NO: 524353 - DNA, 16 bp, R. norvegicus
tgctgaacatttcttt

SEQ ID NO: 524354 - DNA, 16 bp, R. norvegicus
tgctgaagacagcaca

SEQ ID NO: 524355 - DNA, 16 bp, R. norvegicus
tgctgaagatgtttat

SEQ ID NO: 524356 - DNA, 16 bp, R. norvegicus
tgctgaagcaacagaa

SEQ ID NO: 524357 - DNA, 16 bp, R. norvegicus
tgctgaaggaagtgtg

SEQ ID NO: 524358 - DNA, 16 bp, R. norvegicus
tgctgaaggtgttcat

SEQ ID NO: 524359 - DNA, 16 bp, R. norvegicus
tgctgaatcatctctc

SEQ ID NO: 524360 - DNA, 16 bp, R. norvegicus
tgctgacactggtctt

SEQ ID NO: 524361 - DNA, 16 bp, R. norvegicus
tgctgacagaagcctg

SEQ ID NO: 524362 - DNA, 16 bp, R. norvegicus
tgctgacagagcctct

SEQ ID NO: 524363 - DNA, 16 bp, R. norvegicus
tgctgacagcagcctg

SEQ ID NO: 524364 - DNA, 16 bp, R. norvegicus
tgctgacaggagcctg

SEQ ID NO: 524365 - DNA, 16 bp, R. norvegicus
tgctgacaggagctgg

SEQ ID NO: 524366 - DNA, 16 bp, R. norvegicus
tgctgacaggagtctg

SEQ ID NO: 524367 - DNA, 16 bp, R. norvegicus
tgctgacaggatcctg

SEQ ID NO: 524368 - DNA, 16 bp, R. norvegicus
tgctgacagtagcctg

SEQ ID NO: 524369 - DNA, 16 bp, R. norvegicus
tgctgacccctgtggt

SEQ ID NO: 524370 - DNA, 16 bp, R. norvegicus
tgctgacccctttggt

SEQ ID NO: 524371 - DNA, 16 bp, R. norvegicus
tgctgaccctcagggc

SEQ ID NO: 524372 - DNA, 16 bp, R. norvegicus
tgctgaccctgaggaa

SEQ ID NO: 524373 - DNA, 16 bp, R. norvegicus
tgctgacctctgtggt

SEQ ID NO: 524374 - DNA, 16 bp, R. norvegicus
tgctgacctgtgagct

SEQ ID NO: 524375 - DNA, 16 bp, R. norvegicus
tgctgactcatgtttg

SEQ ID NO: 524376 - DNA, 16 bp, R. norvegicus
tgctgactgtctgtca

SEQ ID NO: 524377 - DNA, 16 bp, R. norvegicus
tgctgagaaagggaaa

SEQ ID NO: 524378 - DNA, 16 bp, R. norvegicus
tgctgagaagaagtta

SEQ ID NO: 524379 - DNA, 16 bp, R. norvegicus
tgctgagaagaatgta

SEQ ID NO: 524380 - DNA, 16 bp, R. norvegicus
tgctgagaagtgctcc

SEQ ID NO: 524381 - DNA, 16 bp, R. norvegicus
tgctgagaatgctatc

SEQ ID NO: 524382 - DNA, 16 bp, R. norvegicus
tgctgagacaagaccc

SEQ ID NO: 524383 - DNA, 16 bp, R. norvegicus
tgctgagagacaggag

SEQ ID NO: 524384 - DNA, 16 bp, R. norvegicus
tgctgagatggctcag

SEQ ID NO: 524385 - DNA, 16 bp, R. norvegicus
tgctgagattaaaggc

SEQ ID NO: 524386 - DNA, 16 bp, R. norvegicus
tgctgagattacaggc

SEQ ID NO: 524387 - DNA, 16 bp, R. norvegicus
tgctgagcaagcattt

SEQ ID NO: 524388 - DNA, 16 bp, R. norvegicus
tgctgagcaggtccac

SEQ ID NO: 524389 - DNA, 16 bp, R. norvegicus
tgctgagccctgccct

SEQ ID NO: 524390 - DNA, 16 bp, R. norvegicus
tgctgagccttctttc

SEQ ID NO: 524391 - DNA, 16 bp, R. norvegicus
tgctgagctcatggaa

SEQ ID NO: 524392 - DNA, 16 bp, R. norvegicus
tgctgaggaagtagct

SEQ ID NO: 524393 - DNA, 16 bp, R. norvegicus
tgctgaggacctgggt

SEQ ID NO: 524394 - DNA, 16 bp, R. norvegicus
tgctgaggcctggctg

SEQ ID NO: 524395 - DNA, 16 bp, R. norvegicus
tgctgaggctgaagca

SEQ ID NO: 524396 - DNA, 16 bp, R. norvegicus
tgctgagtcacctctc

SEQ ID NO: 524397 - DNA, 16 bp, R. norvegicus
tgctgagtggactgga

SEQ ID NO: 524398 - DNA, 16 bp, R. norvegicus
tgctgagtggagcctc

SEQ ID NO: 524399 - DNA, 16 bp, R. norvegicus
tgctgatacacaggct

SEQ ID NO: 524400 - DNA, 16 bp, R. norvegicus
tgctgatgcccagaag

SEQ ID NO: 524401 - DNA, 16 bp, R. norvegicus
tgctgatggcaagaag

SEQ ID NO: 524402 - DNA, 16 bp, R. norvegicus
tgctgatggtggtggt

SEQ ID NO: 524403 - DNA, 16 bp, R. norvegicus
tgctgatgtcaagatg

SEQ ID NO: 524404 - DNA, 16 bp, R. norvegicus
tgctgattccaagaag

SEQ ID NO: 524405 - DNA, 16 bp, R. norvegicus
tgctgcaaagagaagt

SEQ ID NO: 524406 - DNA, 16 bp, R. norvegicus
tgctgcaagggcagca

SEQ ID NO: 524407 - DNA, 16 bp, R. norvegicus
tgctgcacagagaaac

SEQ ID NO: 524408 - DNA, 16 bp, R. norvegicus
tgctgcactggagcag

SEQ ID NO: 524409 - DNA, 16 bp, R. norvegicus
tgctgcagaaggagct

SEQ ID NO: 524410 - DNA, 16 bp, R. norvegicus
tgctgcagagacactg

SEQ ID NO: 524411 - DNA, 16 bp, R. norvegicus
tgctgcaggaggaagt

SEQ ID NO: 524412 - DNA, 16 bp, R. norvegicus
tgctgcaggagtgtgc

SEQ ID NO: 524413 - DNA, 16 bp, R. norvegicus
tgctgcaggtggtgag

SEQ ID NO: 524414 - DNA, 17 bp, R. norvegicus
tgctgccaccacagaga

SEQ ID NO: 524415 - DNA, 16 bp, R. norvegicus
tgctgccaccaccacc

SEQ ID NO: 524416 - DNA, 16 bp, R. norvegicus
tgctgccactgcagag

SEQ ID NO: 524417 - DNA, 20 bp, R. norvegicus
tgctgccagcagtctagctg

SEQ ID NO: 524418 - DNA, 16 bp, R. norvegicus
tgctgccaggctcaga

SEQ ID NO: 524419 - DNA, 16 bp, R. norvegicus
tgctgccatgttccct

SEQ ID NO: 524420 - DNA, 16 bp, R. norvegicus
tgctgccattcttcct

SEQ ID NO: 524421 - DNA, 16 bp, R. norvegicus
tgctgcccccacagag

SEQ ID NO: 524422 - DNA, 16 bp, R. norvegicus
tgctgccctcactgag

SEQ ID NO: 524423 - DNA, 16 bp, R. norvegicus
tgctgccctcctccca

SEQ ID NO: 524424 - DNA, 16 bp, R. norvegicus
tgctgccctctggtgg

SEQ ID NO: 524425 - DNA, 16 bp, R. norvegicus
tgctgccctcttctga

SEQ ID NO: 524426 - DNA, 16 bp, R. norvegicus
tgctgccctgctgctg

SEQ ID NO: 524427 - DNA, 16 bp, R. norvegicus
tgctgccctggcctgt

SEQ ID NO: 524428 - DNA, 16 bp, R. norvegicus
tgctgcctacaggaag

SEQ ID NO: 524429 - DNA, 16 bp, R. norvegicus
tgctgcctacatgaaa

SEQ ID NO: 524430 - DNA, 16 bp, R. norvegicus
tgctgcctcaagaaga

SEQ ID NO: 524431 - DNA, 16 bp, R. norvegicus
tgctgcctcagcctcc

SEQ ID NO: 524432 - DNA, 16 bp, R. norvegicus
tgctgcctcctgagtg

SEQ ID NO: 524433 - DNA, 16 bp, R. norvegicus
tgctgcctctgttcct

SEQ ID NO: 524434 - DNA, 16 bp, R. norvegicus
tgctgcctgcctcctg

SEQ ID NO: 524435 - DNA, 16 bp, R. norvegicus
tgctgcctggttgatg

SEQ ID NO: 524436 - DNA, 16 bp, R. norvegicus
tgctgcctggtttgtg

SEQ ID NO: 524437 - DNA, 16 bp, R. norvegicus
tgctgccttttcctgg

SEQ ID NO: 524438 - DNA, 16 bp, R. norvegicus
tgctgcggctgcagag

SEQ ID NO: 524439 - DNA, 16 bp, R. norvegicus
tgctgcgggccaggat

SEQ ID NO: 524440 - DNA, 16 bp, R. norvegicus
tgctgctactactgct

SEQ ID NO: 524441 - DNA, 16 bp, R. norvegicus
tgctgctatcattgac

SEQ ID NO: 524442 - DNA, 16 bp, R. norvegicus
tgctgctctcacagaa

SEQ ID NO: 524443 - DNA, 16 bp, R. norvegicus
tgctgctcttctggag

SEQ ID NO: 524444 - DNA, 16 bp, R. norvegicus
tgctgctgaccattgt

SEQ ID NO: 524445 - DNA, 16 bp, R. norvegicus
tgctgctgaggatgtg

SEQ ID NO: 524446 - DNA, 16 bp, R. norvegicus
tgctgctgccaccacc

SEQ ID NO: 524447 - DNA, 16 bp, R. norvegicus
tgctgctgccgctgcc

SEQ ID NO: 524448 - DNA, 16 bp, R. norvegicus
tgctgctgcctcctga

SEQ ID NO: 524449 - DNA, 16 bp, R. norvegicus
tgctgctgcctgctgc

SEQ ID NO: 524450 - DNA, 16 bp, R. norvegicus
tgctgctgctactgct

SEQ ID NO: 524451 - DNA, 16 bp, R. norvegicus
tgctgctgctactgtt

SEQ ID NO: 524452 - DNA, 16 bp, R. norvegicus
tgctgctgctcctccc

SEQ ID NO: 524453 - DNA, 17 bp, R. norvegicus
tgctgctgctcctcctg

SEQ ID NO: 524454 - DNA, 16 bp, R. norvegicus
tgctgctgctcctgtt

SEQ ID NO: 524455 - DNA, 16 bp, R. norvegicus
tgctgctgctctgctg

SEQ ID NO: 524456 - DNA, 16 bp, R. norvegicus
tgctgctgctgacctg

SEQ ID NO: 524457 - DNA, 16 bp, R. norvegicus
tgctgctgctgatggt

SEQ ID NO: 524458 - DNA, 16 bp, R. norvegicus
tgctgctgctgcaggg

SEQ ID NO: 524459 - DNA, 16 bp, R. norvegicus
tgctgctgctgccacc

SEQ ID NO: 524460 - DNA, 16 bp, R. norvegicus
tgctgctgctgccctc

SEQ ID NO: 524461 - DNA, 16 bp, R. norvegicus
tgctgctgctgccctg

SEQ ID NO: 524462 - DNA, 16 bp, R. norvegicus
tgctgctgctgcctcc

SEQ ID NO: 524463 - DNA, 16 bp, R. norvegicus
tgctgctgctgcggag

SEQ ID NO: 524464 - DNA, 16 bp, R. norvegicus
tgctgctgctgcggct

SEQ ID NO: 524465 - DNA, 16 bp, R. norvegicus
tgctgctgctgctatt

SEQ ID NO: 524466 - DNA, 16 bp, R. norvegicus
tgctgctgctgctgat

SEQ ID NO: 524467 - DNA, 16 bp, R. norvegicus
tgctgctgctgctgcg

SEQ ID NO: 524468 - DNA, 16 bp, R. norvegicus
tgctgctgctgctgct

SEQ ID NO: 524469 - DNA, 18 bp, R. norvegicus
tgctgctgctgctgctgc

SEQ ID NO: 524470 - DNA, 16 bp, R. norvegicus
tgctgctgctgctttc

SEQ ID NO: 524471 - DNA, 16 bp, R. norvegicus
tgctgctgctgctttg

SEQ ID NO: 524472 - DNA, 16 bp, R. norvegicus
tgctgctgctggaacc

SEQ ID NO: 524473 - DNA, 18 bp, R. norvegicus
tgctgctgctggtgctgc

SEQ ID NO: 524474 - DNA, 16 bp, R. norvegicus
tgctgctgctggtgtg

SEQ ID NO: 524475 - DNA, 16 bp, R. norvegicus
tgctgctgctgtcata

SEQ ID NO: 524476 - DNA, 16 bp, R. norvegicus
tgctgctgctgtccct

SEQ ID NO: 524477 - DNA, 16 bp, R. norvegicus
tgctgctgctgtgcct

SEQ ID NO: 524478 - DNA, 16 bp, R. norvegicus
tgctgctgctgtgctg

SEQ ID NO: 524479 - DNA, 16 bp, R. norvegicus
tgctgctgctgtggct

SEQ ID NO: 524480 - DNA, 16 bp, R. norvegicus
tgctgctgctgtggtt

SEQ ID NO: 524481 - DNA, 16 bp, R. norvegicus
tgctgctgctgtgtgt

SEQ ID NO: 524482 - DNA, 16 bp, R. norvegicus
tgctgctgctgttgat

SEQ ID NO: 524483 - DNA, 16 bp, R. norvegicus
tgctgctgctgttgta

SEQ ID NO: 524484 - DNA, 16 bp, R. norvegicus
tgctgctgctgttgtt

SEQ ID NO: 524485 - DNA, 16 bp, R. norvegicus
tgctgctgctgttttc

SEQ ID NO: 524486 - DNA, 16 bp, R. norvegicus
tgctgctgcttctctg

SEQ ID NO: 524487 - DNA, 16 bp, R. norvegicus
tgctgctgcttctgct

SEQ ID NO: 524488 - DNA, 16 bp, R. norvegicus
tgctgctgctttgttt

SEQ ID NO: 524489 - DNA, 16 bp, R. norvegicus
tgctgctggcattggc

SEQ ID NO: 524490 - DNA, 16 bp, R. norvegicus
tgctgctggccaagga

SEQ ID NO: 524491 - DNA, 16 bp, R. norvegicus
tgctgctgggtcaggg

SEQ ID NO: 524492 - DNA, 16 bp, R. norvegicus
tgctgctggtgatgat

SEQ ID NO: 524493 - DNA, 16 bp, R. norvegicus
tgctgctgtaataaaa

SEQ ID NO: 524494 - DNA, 16 bp, R. norvegicus
tgctgctgtgctccct

SEQ ID NO: 524495 - DNA, 16 bp, R. norvegicus
tgctgctgtgctgctg

SEQ ID NO: 524496 - DNA, 16 bp, R. norvegicus
tgctgctgttgctgtt

SEQ ID NO: 524497 - DNA, 16 bp, R. norvegicus
tgctgctgttgcttct

SEQ ID NO: 524498 - DNA, 16 bp, R. norvegicus
tgctgctgttgttact

SEQ ID NO: 524499 - DNA, 16 bp, R. norvegicus
tgctgcttcctggctt

SEQ ID NO: 524500 - DNA, 16 bp, R. norvegicus
tgctgcttctgctgct

SEQ ID NO: 524501 - DNA, 16 bp, R. norvegicus
tgctgcttctgttgtt

SEQ ID NO: 524502 - DNA, 16 bp, R. norvegicus
tgctgcttttccagag

SEQ ID NO: 524503 - DNA, 16 bp, R. norvegicus
tgctgcttttgcaaag

SEQ ID NO: 524504 - DNA, 16 bp, R. norvegicus
tgctggaaactaaact

SEQ ID NO: 524505 - DNA, 16 bp, R. norvegicus
tgctggaaactgagct

SEQ ID NO: 524506 - DNA, 16 bp, R. norvegicus
tgctggaacttgaact

SEQ ID NO: 524507 - DNA, 16 bp, R. norvegicus
tgctggaagctgctgt

SEQ ID NO: 524508 - DNA, 16 bp, R. norvegicus
tgctggaatcctgaag

SEQ ID NO: 524509 - DNA, 16 bp, R. norvegicus
tgctggacctagtgag

SEQ ID NO: 524510 - DNA, 16 bp, R. norvegicus
tgctggagaagaaact

SEQ ID NO: 524511 - DNA, 16 bp, R. norvegicus
tgctggagaagatgtg

SEQ ID NO: 524512 - DNA, 16 bp, R. norvegicus
tgctggagaagcagag

SEQ ID NO: 524513 - DNA, 16 bp, R. norvegicus
tgctggagaaggaacc

SEQ ID NO: 524514 - DNA, 16 bp, R. norvegicus
tgctggagaaggagtt

SEQ ID NO: 524515 - DNA, 16 bp, R. norvegicus
tgctggagagaaggct

SEQ ID NO: 524516 - DNA, 16 bp, R. norvegicus
tgctggagagctcacc

SEQ ID NO: 524517 - DNA, 16 bp, R. norvegicus
tgctggagaggtagct

SEQ ID NO: 524518 - DNA, 16 bp, R. norvegicus
tgctggagcacatgaa

SEQ ID NO: 524519 - DNA, 16 bp, R. norvegicus
tgctggagccttttcc

SEQ ID NO: 524520 - DNA, 16 bp, R. norvegicus
tgctggagctgctggg

SEQ ID NO: 524521 - DNA, 16 bp, R. norvegicus
tgctggagctggagag

SEQ ID NO: 524522 - DNA, 16 bp, R. norvegicus
tgctggagcttgctgg

SEQ ID NO: 524523 - DNA, 16 bp, R. norvegicus
tgctggaggaactgag

SEQ ID NO: 524524 - DNA, 16 bp, R. norvegicus
tgctggaggaagtctg

SEQ ID NO: 524525 - DNA, 18 bp, R. norvegicus
tgctggaggaattcaaga

SEQ ID NO: 524526 - DNA, 16 bp, R. norvegicus
tgctggaggacatcaa

SEQ ID NO: 524527 - DNA, 16 bp, R. norvegicus
tgctggaggagcccag

SEQ ID NO: 524528 - DNA, 16 bp, R. norvegicus
tgctggaggagctgag

SEQ ID NO: 524529 - DNA, 16 bp, R. norvegicus
tgctggaggaggtgtg

SEQ ID NO: 524530 - DNA, 16 bp, R. norvegicus
tgctggagggcttcaa

SEQ ID NO: 524531 - DNA, 16 bp, R. norvegicus
tgctggatcccctgga

SEQ ID NO: 524532 - DNA, 16 bp, R. norvegicus
tgctggatgcagatgt

SEQ ID NO: 524533 - DNA, 16 bp, R. norvegicus
tgctggatgtgggctc

SEQ ID NO: 524534 - DNA, 16 bp, R. norvegicus
tgctggatttggagaa

SEQ ID NO: 524535 - DNA, 16 bp, R. norvegicus
tgctggcaaaggctgt

SEQ ID NO: 524536 - DNA, 16 bp, R. norvegicus
tgctggcagccaatgg

SEQ ID NO: 524537 - DNA, 16 bp, R. norvegicus
tgctggcagccttcag

SEQ ID NO: 524538 - DNA, 16 bp, R. norvegicus
tgctggccagacctcc

SEQ ID NO: 524539 - DNA, 16 bp, R. norvegicus
tgctggccctcaaggc

SEQ ID NO: 524540 - DNA, 16 bp, R. norvegicus
tgctggcctgagctct

SEQ ID NO: 524541 - DNA, 16 bp, R. norvegicus
tgctggctaattttat

SEQ ID NO: 524542 - DNA, 16 bp, R. norvegicus
tgctggctgccagcct

SEQ ID NO: 524543 - DNA, 16 bp, R. norvegicus
tgctggctgctggctg

SEQ ID NO: 524544 - DNA, 16 bp, R. norvegicus
tgctggctgtgcctgg

SEQ ID NO: 524545 - DNA, 16 bp, R. norvegicus
tgctgggaacagaacc

SEQ ID NO: 524546 - DNA, 16 bp, R. norvegicus
tgctgggaaccaacct

SEQ ID NO: 524547 - DNA, 16 bp, R. norvegicus
tgctgggaactcagga

SEQ ID NO: 524548 - DNA, 16 bp, R. norvegicus
tgctgggaactgaacc

SEQ ID NO: 524549 - DNA, 16 bp, R. norvegicus
tgctgggaactgtact

SEQ ID NO: 524550 - DNA, 16 bp, R. norvegicus
tgctgggaatcaaagc

SEQ ID NO: 524551 - DNA, 16 bp, R. norvegicus
tgctgggactcaaact

SEQ ID NO: 524552 - DNA, 16 bp, R. norvegicus
tgctgggagaaagaaa

SEQ ID NO: 524553 - DNA, 16 bp, R. norvegicus
tgctgggagaaggaga

SEQ ID NO: 524554 - DNA, 16 bp, R. norvegicus
tgctgggagagagaaa

SEQ ID NO: 524555 - DNA, 16 bp, R. norvegicus
tgctgggagagcctgg

SEQ ID NO: 524556 - DNA, 16 bp, R. norvegicus
tgctgggatgaaaagc

SEQ ID NO: 524557 - DNA, 16 bp, R. norvegicus
tgctgggatgacaggc

SEQ ID NO: 524558 - DNA, 16 bp, R. norvegicus
tgctgggattacaggc

SEQ ID NO: 524559 - DNA, 16 bp, R. norvegicus
tgctgggattggaggc

SEQ ID NO: 524560 - DNA, 16 bp, R. norvegicus
tgctgggcagaaggga

SEQ ID NO: 524561 - DNA, 16 bp, R. norvegicus
tgctgggcaggttctg

SEQ ID NO: 524562 - DNA, 16 bp, R. norvegicus
tgctgggcatggtggc

SEQ ID NO: 524563 - DNA, 16 bp, R. norvegicus
tgctgggcttaaaggt

SEQ ID NO: 524564 - DNA, 16 bp, R. norvegicus
tgctggggaactgaac

SEQ ID NO: 524565 - DNA, 23 bp, R. norvegicus
tgctggggatttagctcagtggt

SEQ ID NO: 524566 - DNA, 16 bp, R. norvegicus
tgctggggctgctggg

SEQ ID NO: 524567 - DNA, 16 bp, R. norvegicus
tgctggggctggagag

SEQ ID NO: 524568 - DNA, 16 bp, R. norvegicus
tgctgggggctggaga

SEQ ID NO: 524569 - DNA, 16 bp, R. norvegicus
tgctggggtcacaggc

SEQ ID NO: 524570 - DNA, 16 bp, R. norvegicus
tgctgggtttaaaggc

SEQ ID NO: 524571 - DNA, 16 bp, R. norvegicus
tgctggtcagctgaag

SEQ ID NO: 524572 - DNA, 16 bp, R. norvegicus
tgctggtcagctggag

SEQ ID NO: 524573 - DNA, 16 bp, R. norvegicus
tgctggtcattgttgt

SEQ ID NO: 524574 - DNA, 16 bp, R. norvegicus
tgctggtctttgctga

SEQ ID NO: 524575 - DNA, 16 bp, R. norvegicus
tgctggtgaagcttgt

SEQ ID NO: 524576 - DNA, 16 bp, R. norvegicus
tgctggtgctgctggt

SEQ ID NO: 524577 - DNA, 16 bp, R. norvegicus
tgctggtgctggtggt

SEQ ID NO: 524578 - DNA, 16 bp, R. norvegicus
tgctggtggaagactg

SEQ ID NO: 524579 - DNA, 16 bp, R. norvegicus
tgctggtggccaatgg

SEQ ID NO: 524580 - DNA, 16 bp, R. norvegicus
tgctggtgggaataca

SEQ ID NO: 524581 - DNA, 16 bp, R. norvegicus
tgctggtggtggtgat

SEQ ID NO: 524582 - DNA, 16 bp, R. norvegicus
tgctggtgtggatgtg

SEQ ID NO: 524583 - DNA, 16 bp, R. norvegicus
tgctggtgtgtctgaa

SEQ ID NO: 524584 - DNA, 16 bp, R. norvegicus
tgctggttcaactggc

SEQ ID NO: 524585 - DNA, 16 bp, R. norvegicus
tgctggtttaactgga

SEQ ID NO: 524586 - DNA, 16 bp, R. norvegicus
tgctggtttctgcctg

SEQ ID NO: 524587 - DNA, 16 bp, R. norvegicus
tgctgtaacaaaatac

SEQ ID NO: 524588 - DNA, 16 bp, R. norvegicus
tgctgtagagctgttt

SEQ ID NO: 524589 - DNA, 16 bp, R. norvegicus
tgctgtagctgctgct

SEQ ID NO: 524590 - DNA, 16 bp, R. norvegicus
tgctgtatatggtttt

SEQ ID NO: 524591 - DNA, 16 bp, R. norvegicus
tgctgtatcctggctg

SEQ ID NO: 524592 - DNA, 16 bp, R. norvegicus
tgctgtattccggctg

SEQ ID NO: 524593 - DNA, 16 bp, R. norvegicus
tgctgtattttgcttt

SEQ ID NO: 524594 - DNA, 16 bp, R. norvegicus
tgctgtcaagctgatg

SEQ ID NO: 524595 - DNA, 16 bp, R. norvegicus
tgctgtcaagctggtg

SEQ ID NO: 524596 - DNA, 17 bp, R. norvegicus
tgctgtcaccagagttt

SEQ ID NO: 524597 - DNA, 17 bp, R. norvegicus
tgctgtcacccgagttt

SEQ ID NO: 524598 - DNA, 16 bp, R. norvegicus
tgctgtcacctgactt

SEQ ID NO: 524599 - DNA, 16 bp, R. norvegicus
tgctgtcatttgagtt

SEQ ID NO: 524600 - DNA, 16 bp, R. norvegicus
tgctgtccagctgctg

SEQ ID NO: 524601 - DNA, 16 bp, R. norvegicus
tgctgtccaggatgtg

SEQ ID NO: 524602 - DNA, 19 bp, R. norvegicus
tgctgtccaggggctctct

SEQ ID NO: 524603 - DNA, 16 bp, R. norvegicus
tgctgtcctttataaa

SEQ ID NO: 524604 - DNA, 18 bp, R. norvegicus
tgctgtcgccagagtttt

SEQ ID NO: 524605 - DNA, 17 bp, R. norvegicus
tgctgtcgcctgagttt

SEQ ID NO: 524606 - DNA, 18 bp, R. norvegicus
tgctgtcgctggagtttt

SEQ ID NO: 524607 - DNA, 16 bp, R. norvegicus
tgctgtctctgacagt

SEQ ID NO: 524608 - DNA, 16 bp, R. norvegicus
tgctgtctgctatgca

SEQ ID NO: 524609 - DNA, 16 bp, R. norvegicus
tgctgtctgtctttct

SEQ ID NO: 524610 - DNA, 16 bp, R. norvegicus
tgctgtcttcagacac

SEQ ID NO: 524611 - DNA, 17 bp, R. norvegicus
tgctgtcttcagacaca

SEQ ID NO: 524612 - DNA, 16 bp, R. norvegicus
tgctgtgaacagtcac

SEQ ID NO: 524613 - DNA, 16 bp, R. norvegicus
tgctgtgaaccaaact

SEQ ID NO: 524614 - DNA, 16 bp, R. norvegicus
tgctgtgaagagacat

SEQ ID NO: 524615 - DNA, 16 bp, R. norvegicus
tgctgtgatgatgctg

SEQ ID NO: 524616 - DNA, 16 bp, R. norvegicus
tgctgtgctcacactg

SEQ ID NO: 524617 - DNA, 16 bp, R. norvegicus
tgctgtgctgcccagg

SEQ ID NO: 524618 - DNA, 16 bp, R. norvegicus
tgctgtgctgtgcccc

SEQ ID NO: 524619 - DNA, 16 bp, R. norvegicus
tgctgtggatgctgtg

SEQ ID NO: 524620 - DNA, 16 bp, R. norvegicus
tgctgtggcagagcct

SEQ ID NO: 524621 - DNA, 16 bp, R. norvegicus
tgctgtggctgtggct

SEQ ID NO: 524622 - DNA, 16 bp, R. norvegicus
tgctgtggggctggag

SEQ ID NO: 524623 - DNA, 16 bp, R. norvegicus
tgctgtggtacacaca

SEQ ID NO: 524624 - DNA, 16 bp, R. norvegicus
tgctgtggtcatggag

SEQ ID NO: 524625 - DNA, 16 bp, R. norvegicus
tgctgtggtgggagaa

SEQ ID NO: 524626 - DNA, 17 bp, R. norvegicus
tgctgtggtgtgctgtg

SEQ ID NO: 524627 - DNA, 16 bp, R. norvegicus
tgctgtggtgtgctta

SEQ ID NO: 524628 - DNA, 16 bp, R. norvegicus
tgctgtggtgtgcttg

SEQ ID NO: 524629 - DNA, 16 bp, R. norvegicus
tgctgtgtatgctgtg

SEQ ID NO: 524630 - DNA, 16 bp, R. norvegicus
tgctgtgtatgggata

SEQ ID NO: 524631 - DNA, 16 bp, R. norvegicus
tgctgtgtatgtgctg

SEQ ID NO: 524632 - DNA, 16 bp, R. norvegicus
tgctgtgtcatcattt

SEQ ID NO: 524633 - DNA, 16 bp, R. norvegicus
tgctgtgtctgaagat

SEQ ID NO: 524634 - DNA, 16 bp, R. norvegicus
tgctgtgtggatgctg

SEQ ID NO: 524635 - DNA, 16 bp, R. norvegicus
tgctgtgtgggtactg

SEQ ID NO: 524636 - DNA, 16 bp, R. norvegicus
tgctgttactgctgtt

SEQ ID NO: 524637 - DNA, 16 bp, R. norvegicus
tgctgttcatcagcaa

SEQ ID NO: 524638 - DNA, 16 bp, R. norvegicus
tgctgttcttccagag

SEQ ID NO: 524639 - DNA, 16 bp, R. norvegicus
tgctgttcttggtgat

SEQ ID NO: 524640 - DNA, 16 bp, R. norvegicus
tgctgttgccaagaag

SEQ ID NO: 524641 - DNA, 16 bp, R. norvegicus
tgctgtttctaattat

SEQ ID NO: 524642 - DNA, 16 bp, R. norvegicus
tgctgtttctcctggt

SEQ ID NO: 524643 - DNA, 16 bp, R. norvegicus
tgctgtttctgctgct

SEQ ID NO: 524644 - DNA, 16 bp, R. norvegicus
tgctgttttatgatga

SEQ ID NO: 524645 - DNA, 16 bp, R. norvegicus
tgctgttttctggctg

SEQ ID NO: 524646 - DNA, 16 bp, R. norvegicus
tgctgttttgattgtg

SEQ ID NO: 524647 - DNA, 16 bp, R. norvegicus
tgcttaaaaatgcaga

SEQ ID NO: 524648 - DNA, 16 bp, R. norvegicus
tgcttagaaagttgtt

SEQ ID NO: 524649 - DNA, 16 bp, R. norvegicus
tgcttagcttcctgtg

SEQ ID NO: 524650 - DNA, 16 bp, R. norvegicus
tgcttagtcaccagag

SEQ ID NO: 524651 - DNA, 16 bp, R. norvegicus
tgcttcaagattctct

SEQ ID NO: 524652 - DNA, 17 bp, R. norvegicus
tgcttcaccaacagaat

SEQ ID NO: 524653 - DNA, 16 bp, R. norvegicus
tgcttcactctttctt

SEQ ID NO: 524654 - DNA, 16 bp, R. norvegicus
tgcttcagtccttctt

SEQ ID NO: 524655 - DNA, 16 bp, R. norvegicus
tgcttcagtttgtcca

SEQ ID NO: 524656 - DNA, 18 bp, R. norvegicus
tgcttcatcccaggcatg

SEQ ID NO: 524657 - DNA, 16 bp, R. norvegicus
tgcttcatctgtttca

SEQ ID NO: 524658 - DNA, 16 bp, R. norvegicus
tgcttcattccttcct

SEQ ID NO: 524659 - DNA, 16 bp, R. norvegicus
tgcttccacatggaca

SEQ ID NO: 524660 - DNA, 16 bp, R. norvegicus
tgcttccagacaggag

SEQ ID NO: 524661 - DNA, 16 bp, R. norvegicus
tgcttccagccatgat

SEQ ID NO: 524662 - DNA, 16 bp, R. norvegicus
tgcttccagttgagaa

SEQ ID NO: 524663 - DNA, 16 bp, R. norvegicus
tgcttcccaagtgcag

SEQ ID NO: 524664 - DNA, 16 bp, R. norvegicus
tgcttccccacatttt

SEQ ID NO: 524665 - DNA, 16 bp, R. norvegicus
tgcttccccagtgcta

SEQ ID NO: 524666 - DNA, 16 bp, R. norvegicus
tgcttcctgagtcctg

SEQ ID NO: 524667 - DNA, 16 bp, R. norvegicus
tgcttcctggctacca

SEQ ID NO: 524668 - DNA, 16 bp, R. norvegicus
tgcttcctgggtgctg

SEQ ID NO: 524669 - DNA, 16 bp, R. norvegicus
tgcttcctgtggcttg

SEQ ID NO: 524670 - DNA, 16 bp, R. norvegicus
tgcttctaccagtata

SEQ ID NO: 524671 - DNA, 16 bp, R. norvegicus
tgcttctacctgctga

SEQ ID NO: 524672 - DNA, 16 bp, R. norvegicus
tgcttctatgagggtg

SEQ ID NO: 524673 - DNA, 16 bp, R. norvegicus
tgcttctatggggatg

SEQ ID NO: 524674 - DNA, 16 bp, R. norvegicus
tgcttctattttgtga

SEQ ID NO: 524675 - DNA, 16 bp, R. norvegicus
tgcttctccagcacca

SEQ ID NO: 524676 - DNA, 16 bp, R. norvegicus
tgcttctcctgctgct

SEQ ID NO: 524677 - DNA, 16 bp, R. norvegicus
tgcttctctcagggaa

SEQ ID NO: 524678 - DNA, 16 bp, R. norvegicus
tgcttctctggagtct

SEQ ID NO: 524679 - DNA, 16 bp, R. norvegicus
tgcttctctttctcca

SEQ ID NO: 524680 - DNA, 16 bp, R. norvegicus
tgcttctgcagacttg

SEQ ID NO: 524681 - DNA, 16 bp, R. norvegicus
tgcttctgcctcctcc

SEQ ID NO: 524682 - DNA, 16 bp, R. norvegicus
tgcttctgcctctggg

SEQ ID NO: 524683 - DNA, 16 bp, R. norvegicus
tgcttctgcctctgtc

SEQ ID NO: 524684 - DNA, 16 bp, R. norvegicus
tgcttctgcctttgct

SEQ ID NO: 524685 - DNA, 16 bp, R. norvegicus
tgcttctgctgctgct

SEQ ID NO: 524686 - DNA, 16 bp, R. norvegicus
tgcttctgctgcttct

SEQ ID NO: 524687 - DNA, 16 bp, R. norvegicus
tgcttctggcaaaatg

SEQ ID NO: 524688 - DNA, 16 bp, R. norvegicus
tgcttctggccatgat

SEQ ID NO: 524689 - DNA, 16 bp, R. norvegicus
tgcttctggcctctgt

SEQ ID NO: 524690 - DNA, 16 bp, R. norvegicus
tgcttctgtcaggcat

SEQ ID NO: 524691 - DNA, 16 bp, R. norvegicus
tgcttctgtcatggct

SEQ ID NO: 524692 - DNA, 16 bp, R. norvegicus
tgcttctgtctcctga

SEQ ID NO: 524693 - DNA, 16 bp, R. norvegicus
tgcttctgtggactca

SEQ ID NO: 524694 - DNA, 16 bp, R. norvegicus
tgcttctgtgtctgtg

SEQ ID NO: 524695 - DNA, 16 bp, R. norvegicus
tgcttctgtttcctga

SEQ ID NO: 524696 - DNA, 16 bp, R. norvegicus
tgcttcttggccattt

SEQ ID NO: 524697 - DNA, 16 bp, R. norvegicus
tgcttcttggtcattt

SEQ ID NO: 524698 - DNA, 16 bp, R. norvegicus
tgcttctttgaggatg

SEQ ID NO: 524699 - DNA, 16 bp, R. norvegicus
tgcttgaaaaaaaaaa

SEQ ID NO: 524700 - DNA, 16 bp, R. norvegicus
tgcttgaagaagatct

SEQ ID NO: 524701 - DNA, 16 bp, R. norvegicus
tgcttgacattattgt

SEQ ID NO: 524702 - DNA, 16 bp, R. norvegicus
tgcttgaggccaggga

SEQ ID NO: 524703 - DNA, 16 bp, R. norvegicus
tgcttgagtccaggga

SEQ ID NO: 524704 - DNA, 16 bp, R. norvegicus
tgcttgcaaaactcat

SEQ ID NO: 524705 - DNA, 16 bp, R. norvegicus
tgcttgcaaagaaaaa

SEQ ID NO: 524706 - DNA, 16 bp, R. norvegicus
tgcttgcatgtgtgca

SEQ ID NO: 524707 - DNA, 16 bp, R. norvegicus
tgcttgccacacaagc

SEQ ID NO: 524708 - DNA, 16 bp, R. norvegicus
tgcttgcccagcatgt

SEQ ID NO: 524709 - DNA, 16 bp, R. norvegicus
tgcttgcctagaaagc

SEQ ID NO: 524710 - DNA, 16 bp, R. norvegicus
tgcttgcctgcttgct

SEQ ID NO: 524711 - DNA, 16 bp, R. norvegicus
tgcttgctgccaagcc

SEQ ID NO: 524712 - DNA, 16 bp, R. norvegicus
tgcttgctggcttgct

SEQ ID NO: 524713 - DNA, 16 bp, R. norvegicus
tgcttgcttacttgct

SEQ ID NO: 524714 - DNA, 16 bp, R. norvegicus
tgcttggaagacattt

SEQ ID NO: 524715 - DNA, 16 bp, R. norvegicus
tgcttggattacaggt

SEQ ID NO: 524716 - DNA, 16 bp, R. norvegicus
tgcttggcccggggag

SEQ ID NO: 524717 - DNA, 16 bp, R. norvegicus
tgcttggtgcctgtgg

SEQ ID NO: 524718 - DNA, 16 bp, R. norvegicus
tgcttgtagacaggag

SEQ ID NO: 524719 - DNA, 16 bp, R. norvegicus
tgctttaaaaaaaaaa

SEQ ID NO: 524720 - DNA, 16 bp, R. norvegicus
tgctttcaaaacaaga

SEQ ID NO: 524721 - DNA, 16 bp, R. norvegicus
tgctttcactaccagg

SEQ ID NO: 524722 - DNA, 16 bp, R. norvegicus
tgctttctcagcttct

SEQ ID NO: 524723 - DNA, 16 bp, R. norvegicus
tgctttctctgcatct

SEQ ID NO: 524724 - DNA, 16 bp, R. norvegicus
tgctttctgccatgat

SEQ ID NO: 524725 - DNA, 16 bp, R. norvegicus
tgctttctgcttcctg

SEQ ID NO: 524726 - DNA, 16 bp, R. norvegicus
tgctttcttctgcctg

SEQ ID NO: 524727 - DNA, 16 bp, R. norvegicus
tgctttgaacatagtt

SEQ ID NO: 524728 - DNA, 16 bp, R. norvegicus
tgctttgagttttagt

SEQ ID NO: 524729 - DNA, 16 bp, R. norvegicus
tgctttgatgaaacac

SEQ ID NO: 524730 - DNA, 16 bp, R. norvegicus
tgctttgcagcctcag

SEQ ID NO: 524731 - DNA, 16 bp, R. norvegicus
tgctttgcctgtgtgt

SEQ ID NO: 524732 - DNA, 16 bp, R. norvegicus
tgctttgctttgcttc

SEQ ID NO: 524733 - DNA, 16 bp, R. norvegicus
tgctttggagggagag

SEQ ID NO: 524734 - DNA, 16 bp, R. norvegicus
tgctttggcagaggac

SEQ ID NO: 524735 - DNA, 16 bp, R. norvegicus
tgctttggtcttggtg

SEQ ID NO: 524736 - DNA, 16 bp, R. norvegicus
tgctttggtgggacaa

SEQ ID NO: 524737 - DNA, 16 bp, R. norvegicus
tgctttgtttttaaag

SEQ ID NO: 524738 - DNA, 16 bp, R. norvegicus
tgcttttaaccccagc

SEQ ID NO: 524739 - DNA, 16 bp, R. norvegicus
tgcttttaagatttat

SEQ ID NO: 524740 - DNA, 16 bp, R. norvegicus
tgcttttaatattatt

SEQ ID NO: 524741 - DNA, 16 bp, R. norvegicus
tgcttttaatcttctt

SEQ ID NO: 524742 - DNA, 16 bp, R. norvegicus
tgcttttacctgctga

SEQ ID NO: 524743 - DNA, 16 bp, R. norvegicus
tgcttttactgtgttt

SEQ ID NO: 524744 - DNA, 16 bp, R. norvegicus
tgcttttataaataaa

SEQ ID NO: 524745 - DNA, 16 bp, R. norvegicus
tgcttttatattttaa

SEQ ID NO: 524746 - DNA, 16 bp, R. norvegicus
tgcttttatttggaag

SEQ ID NO: 524747 - DNA, 16 bp, R. norvegicus
tgcttttccagaggac

SEQ ID NO: 524748 - DNA, 17 bp, R. norvegicus
tgcttttccagaggtct

SEQ ID NO: 524749 - DNA, 16 bp, R. norvegicus
tgcttttccagaggtt

SEQ ID NO: 524750 - DNA, 16 bp, R. norvegicus
tgcttttcctgtgtgt

SEQ ID NO: 524751 - DNA, 16 bp, R. norvegicus
tgcttttctcctttgg

SEQ ID NO: 524752 - DNA, 16 bp, R. norvegicus
tgcttttctgatgtgt

SEQ ID NO: 524753 - DNA, 16 bp, R. norvegicus
tgcttttgaaaatgct

SEQ ID NO: 524754 - DNA, 16 bp, R. norvegicus
tgcttttggaaaatgg

SEQ ID NO: 524755 - DNA, 16 bp, R. norvegicus
tgcttttggtcagggt

SEQ ID NO: 524756 - DNA, 16 bp, R. norvegicus
tgcttttgtgatattt

SEQ ID NO: 524757 - DNA, 16 bp, R. norvegicus
tgctttttaaaaaata

SEQ ID NO: 524758 - DNA, 16 bp, R. norvegicus
tgctttttaaatgttt

SEQ ID NO: 524759 - DNA, 16 bp, R. norvegicus
tgctttttccattgtc

SEQ ID NO: 524760 - DNA, 16 bp, R. norvegicus
tgctttttctacagtg

SEQ ID NO: 524761 - DNA, 16 bp, R. norvegicus
tgctttttctctattc

SEQ ID NO: 524762 - DNA, 16 bp, R. norvegicus
tgctttttgttttgag

SEQ ID NO: 524763 - DNA, 16 bp, R. norvegicus
tgctttttttccccca

SEQ ID NO: 524764 - DNA, 16 bp, R. norvegicus
tggaaaaaaataaatc

SEQ ID NO: 524765 - DNA, 16 bp, R. norvegicus
tggaaaaaaatcttca

SEQ ID NO: 524766 - DNA, 16 bp, R. norvegicus
tggaaaaaagcatttt

SEQ ID NO: 524767 - DNA, 16 bp, R. norvegicus
tggaaaaacaaaagca

SEQ ID NO: 524768 - DNA, 16 bp, R. norvegicus
tggaaaaacaggctta

SEQ ID NO: 524769 - DNA, 16 bp, R. norvegicus
tggaaaaactgcagca

SEQ ID NO: 524770 - DNA, 16 bp, R. norvegicus
tggaaaaagaagcaat

SEQ ID NO: 524771 - DNA, 16 bp, R. norvegicus
tggaaaaagatgaaca

SEQ ID NO: 524772 - DNA, 16 bp, R. norvegicus
tggaaaaataaagttg

SEQ ID NO: 524773 - DNA, 16 bp, R. norvegicus
tggaaaaatatcttca

SEQ ID NO: 524774 - DNA, 16 bp, R. norvegicus
tggaaaacaattttac

SEQ ID NO: 524775 - DNA, 16 bp, R. norvegicus
tggaaaacagaaagct

SEQ ID NO: 524776 - DNA, 16 bp, R. norvegicus
tggaaaacagacagca

SEQ ID NO: 524777 - DNA, 16 bp, R. norvegicus
tggaaaaccactttcc

SEQ ID NO: 524778 - DNA, 16 bp, R. norvegicus
tggaaaactattttcc

SEQ ID NO: 524779 - DNA, 16 bp, R. norvegicus
tggaaaactcaaatta

SEQ ID NO: 524780 - DNA, 16 bp, R. norvegicus
tggaaaactgttttcc

SEQ ID NO: 524781 - DNA, 16 bp, R. norvegicus
tggaaaagaagaagcc

SEQ ID NO: 524782 - DNA, 16 bp, R. norvegicus
tggaaaagaagctgag

SEQ ID NO: 524783 - DNA, 16 bp, R. norvegicus
tggaaaagagaaagca

SEQ ID NO: 524784 - DNA, 16 bp, R. norvegicus
tggaaaagaggaagct

SEQ ID NO: 524785 - DNA, 16 bp, R. norvegicus
tggaaaagcaaaacaa

SEQ ID NO: 524786 - DNA, 16 bp, R. norvegicus
tggaaaagcaagatgt

SEQ ID NO: 524787 - DNA, 16 bp, R. norvegicus
tggaaaagcaagattt

SEQ ID NO: 524788 - DNA, 16 bp, R. norvegicus
tggaaaagccattgag

SEQ ID NO: 524789 - DNA, 16 bp, R. norvegicus
tggaaaaggacagcat

SEQ ID NO: 524790 - DNA, 16 bp, R. norvegicus
tggaaaaggagaagtc

SEQ ID NO: 524791 - DNA, 16 bp, R. norvegicus
tggaaaaggagctgag

SEQ ID NO: 524792 - DNA, 25 bp, R. norvegicus
tggaaaaggcaaaggctaaagaact

SEQ ID NO: 524793 - DNA, 16 bp, R. norvegicus
tggaaaagtgtgtgtg

SEQ ID NO: 524794 - DNA, 16 bp, R. norvegicus
tggaaaagttttgttt

SEQ ID NO: 524795 - DNA, 16 bp, R. norvegicus
tggaaaatcaggaatt

SEQ ID NO: 524796 - DNA, 16 bp, R. norvegicus
tggaaaatctaaaaaa

SEQ ID NO: 524797 - DNA, 16 bp, R. norvegicus
tggaaaatctagaaga

SEQ ID NO: 524798 - DNA, 16 bp, R. norvegicus
tggaaaattatttttc

SEQ ID NO: 524799 - DNA, 16 bp, R. norvegicus
tggaaaatttggagga

SEQ ID NO: 524800 - DNA, 16 bp, R. norvegicus
tggaaacaaaattaaa

SEQ ID NO: 524801 - DNA, 16 bp, R. norvegicus
tggaaacaaccaagat

SEQ ID NO: 524802 - DNA, 16 bp, R. norvegicus
tggaaacaacccagat

SEQ ID NO: 524803 - DNA, 16 bp, R. norvegicus
tggaaacaaggaaagg

SEQ ID NO: 524804 - DNA, 17 bp, R. norvegicus
tggaaacagaaattaca

SEQ ID NO: 524805 - DNA, 16 bp, R. norvegicus
tggaaacagaaattca

SEQ ID NO: 524806 - DNA, 16 bp, R. norvegicus
tggaaacagacgcaga

SEQ ID NO: 524807 - DNA, 16 bp, R. norvegicus
tggaaacagagattta

SEQ ID NO: 524808 - DNA, 16 bp, R. norvegicus
tggaaacagatgaaga

SEQ ID NO: 524809 - DNA, 16 bp, R. norvegicus
tggaaacatcctcaca

SEQ ID NO: 524810 - DNA, 16 bp, R. norvegicus
tggaaaccgggaatgg

SEQ ID NO: 524811 - DNA, 16 bp, R. norvegicus
tggaaacttctagaaa

SEQ ID NO: 524812 - DNA, 16 bp, R. norvegicus
tggaaacttgatgccc

SEQ ID NO: 524813 - DNA, 16 bp, R. norvegicus
tggaaagaaaaaagtc

SEQ ID NO: 524814 - DNA, 16 bp, R. norvegicus
tggaaagaacccagac

SEQ ID NO: 524815 - DNA, 17 bp, R. norvegicus
tggaaagaacccagata

SEQ ID NO: 524816 - DNA, 88 bp, R. norvegicus
tggaaagaacccagatgcccttcaacagaggaatggatacagaaaatgtggtacatctacacaatggaatattactcagctatcaaaa

SEQ ID NO: 524817 - DNA, 33 bp, R. norvegicus
tggaaagaacccagatgcccttcaacagaggag

SEQ ID NO: 524818 - DNA, 16 bp, R. norvegicus
tggaaagaacccaggt

SEQ ID NO: 524819 - DNA, 16 bp, R. norvegicus
tggaaagaacctagat

SEQ ID NO: 524820 - DNA, 16 bp, R. norvegicus
tggaaagaactcaaat

SEQ ID NO: 524821 - DNA, 16 bp, R. norvegicus
tggaaagaactcagat

SEQ ID NO: 524822 - DNA, 16 bp, R. norvegicus
tggaaagagaaattct

SEQ ID NO: 524823 - DNA, 16 bp, R. norvegicus
tggaaagatagctcag

SEQ ID NO: 524824 - DNA, 16 bp, R. norvegicus
tggaaagatggctcag

SEQ ID NO: 524825 - DNA, 16 bp, R. norvegicus
tggaaagattgtaaga

SEQ ID NO: 524826 - DNA, 16 bp, R. norvegicus
tggaaagccagaggag

SEQ ID NO: 524827 - DNA, 17 bp, R. norvegicus
tggaaagccgtgatagc

SEQ ID NO: 524828 - DNA, 16 bp, R. norvegicus
tggaaaggaaagggtt

SEQ ID NO: 524829 - DNA, 16 bp, R. norvegicus
tggaaaggaagaaatt

SEQ ID NO: 524830 - DNA, 16 bp, R. norvegicus
tggaaaggaagaactc

SEQ ID NO: 524831 - DNA, 16 bp, R. norvegicus
tggaaaggaagaagtc

SEQ ID NO: 524832 - DNA, 16 bp, R. norvegicus
tggaaagtgaacaact

SEQ ID NO: 524833 - DNA, 16 bp, R. norvegicus
tggaaagtgtgaagaa

SEQ ID NO: 524834 - DNA, 16 bp, R. norvegicus
tggaaagttctagaaa

SEQ ID NO: 524835 - DNA, 16 bp, R. norvegicus
tggaaagttgttctcc

SEQ ID NO: 524836 - DNA, 16 bp, R. norvegicus
tggaaataaaacaata

SEQ ID NO: 524837 - DNA, 16 bp, R. norvegicus
tggaaatacagacagc

SEQ ID NO: 524838 - DNA, 16 bp, R. norvegicus
tggaaatagaaactaa

SEQ ID NO: 524839 - DNA, 16 bp, R. norvegicus
tggaaatatgcaacct

SEQ ID NO: 524840 - DNA, 16 bp, R. norvegicus
tggaaatcaaaggaca

SEQ ID NO: 524841 - DNA, 16 bp, R. norvegicus
tggaaatcaaatccag

SEQ ID NO: 524842 - DNA, 16 bp, R. norvegicus
tggaaatcagtctggt

SEQ ID NO: 524843 - DNA, 16 bp, R. norvegicus
tggaaatcttcattct

SEQ ID NO: 524844 - DNA, 16 bp, R. norvegicus
tggaaatctttttttt

SEQ ID NO: 524845 - DNA, 16 bp, R. norvegicus
tggaaatgaaggaaga

SEQ ID NO: 524846 - DNA, 16 bp, R. norvegicus
tggaaatggagaagaa

SEQ ID NO: 524847 - DNA, 16 bp, R. norvegicus
tggaaatggagaggag

SEQ ID NO: 524848 - DNA, 16 bp, R. norvegicus
tggaaatgtgtgtgtg

SEQ ID NO: 524849 - DNA, 16 bp, R. norvegicus
tggaaattaaaaacaa

SEQ ID NO: 524850 - DNA, 16 bp, R. norvegicus
tggaaattgaacccag

SEQ ID NO: 524851 - DNA, 16 bp, R. norvegicus
tggaacaagatgcaga

SEQ ID NO: 524852 - DNA, 16 bp, R. norvegicus
tggaacacagcttttt

SEQ ID NO: 524853 - DNA, 16 bp, R. norvegicus
tggaacagaagtgaag

SEQ ID NO: 524854 - DNA, 35 bp, R. norvegicus
tggaacagaattgaagacccagaaatgaacccaca

SEQ ID NO: 524855 - DNA, 20 bp, R. norvegicus
tggaacagcagattcaaggt

SEQ ID NO: 524856 - DNA, 16 bp, R. norvegicus
tggaacagtttgagga

SEQ ID NO: 524857 - DNA, 16 bp, R. norvegicus
tggaaccagaaaagat

SEQ ID NO: 524858 - DNA, 29 bp, R. norvegicus
tggaacccatcacgtttggagatttcacc

SEQ ID NO: 524859 - DNA, 16 bp, R. norvegicus
tggaacccgagcctgc

SEQ ID NO: 524860 - DNA, 16 bp, R. norvegicus
tggaacccttttcctc

SEQ ID NO: 524861 - DNA, 16 bp, R. norvegicus
tggaaccggagttaca

SEQ ID NO: 524862 - DNA, 16 bp, R. norvegicus
tggaacctgaaagaaa

SEQ ID NO: 524863 - DNA, 42 bp, R. norvegicus
tggaacgtctctcacgagtcccagagcctgcgcgattggggc

SEQ ID NO: 524864 - DNA, 17 bp, R. norvegicus
tggaacgtcttccaggg

SEQ ID NO: 524865 - DNA, 16 bp, R. norvegicus
tggaactatttgagaa

SEQ ID NO: 524866 - DNA, 16 bp, R. norvegicus
tggaactcaagcaagt

SEQ ID NO: 524867 - DNA, 16 bp, R. norvegicus
tggaactcactgtgta

SEQ ID NO: 524868 - DNA, 16 bp, R. norvegicus
tggaactcagaaatcc

SEQ ID NO: 524869 - DNA, 16 bp, R. norvegicus
tggaactcagaggaca

SEQ ID NO: 524870 - DNA, 16 bp, R. norvegicus
tggaactcagggcctc

SEQ ID NO: 524871 - DNA, 16 bp, R. norvegicus
tggaactcagtctgga

SEQ ID NO: 524872 - DNA, 16 bp, R. norvegicus
tggaactctcagctct

SEQ ID NO: 524873 - DNA, 16 bp, R. norvegicus
tggaactctttctgta

SEQ ID NO: 524874 - DNA, 16 bp, R. norvegicus
tggaactgaggtgtcc

SEQ ID NO: 524875 - DNA, 16 bp, R. norvegicus
tggaactggaactgga

SEQ ID NO: 524876 - DNA, 16 bp, R. norvegicus
tggaactggaatgaca

SEQ ID NO: 524877 - DNA, 16 bp, R. norvegicus
tggaactggagataca

SEQ ID NO: 524878 - DNA, 16 bp, R. norvegicus
tggaactggagctatg

SEQ ID NO: 524879 - DNA, 16 bp, R. norvegicus
tggaactggagtcatg

SEQ ID NO: 524880 - DNA, 16 bp, R. norvegicus
tggaactggagttaga

SEQ ID NO: 524881 - DNA, 16 bp, R. norvegicus
tggaactggagttcag

SEQ ID NO: 524882 - DNA, 16 bp, R. norvegicus
tggaactgtttgtgaa

SEQ ID NO: 524883 - DNA, 16 bp, R. norvegicus
tggaacttcttttcct

SEQ ID NO: 524884 - DNA, 16 bp, R. norvegicus
tggaacttgccaagta

SEQ ID NO: 524885 - DNA, 16 bp, R. norvegicus
tggaacttgctgtgta

SEQ ID NO: 524886 - DNA, 16 bp, R. norvegicus
tggaagaaaaaagaac

SEQ ID NO: 524887 - DNA, 16 bp, R. norvegicus
tggaagaaaacaaaga

SEQ ID NO: 524888 - DNA, 16 bp, R. norvegicus
tggaagaaaacatcca

SEQ ID NO: 524889 - DNA, 16 bp, R. norvegicus
tggaagaaaagaacca

SEQ ID NO: 524890 - DNA, 16 bp, R. norvegicus
tggaagaaactgagga

SEQ ID NO: 524891 - DNA, 16 bp, R. norvegicus
tggaagaaagacagca

SEQ ID NO: 524892 - DNA, 16 bp, R. norvegicus
tggaagaaatgaacaa

SEQ ID NO: 524893 - DNA, 16 bp, R. norvegicus
tggaagaacagaaaga

SEQ ID NO: 524894 - DNA, 16 bp, R. norvegicus
tggaagaacagcaaga

SEQ ID NO: 524895 - DNA, 16 bp, R. norvegicus
tggaagaacagcctgt

SEQ ID NO: 524896 - DNA, 16 bp, R. norvegicus
tggaagaacaggaagt

SEQ ID NO: 524897 - DNA, 16 bp, R. norvegicus
tggaagaactgggttc

SEQ ID NO: 524898 - DNA, 16 bp, R. norvegicus
tggaagaagaaacaga

SEQ ID NO: 524899 - DNA, 16 bp, R. norvegicus
tggaagaagagaacca

SEQ ID NO: 524900 - DNA, 16 bp, R. norvegicus
tggaagaagagaatca

SEQ ID NO: 524901 - DNA, 16 bp, R. norvegicus
tggaagaagaggcaga

SEQ ID NO: 524902 - DNA, 16 bp, R. norvegicus
tggaagaagctgaaga

SEQ ID NO: 524903 - DNA, 16 bp, R. norvegicus
tggaagaagctgagaa

SEQ ID NO: 524904 - DNA, 16 bp, R. norvegicus
tggaagaagctgagga

SEQ ID NO: 524905 - DNA, 16 bp, R. norvegicus
tggaagaaggaacctc

SEQ ID NO: 524906 - DNA, 16 bp, R. norvegicus
tggaagaagtcaggac

SEQ ID NO: 524907 - DNA, 16 bp, R. norvegicus
tggaagaagttgaaga

SEQ ID NO: 524908 - DNA, 16 bp, R. norvegicus
tggaagacaccaagaa

SEQ ID NO: 524909 - DNA, 16 bp, R. norvegicus
tggaagacactgtttc

SEQ ID NO: 524910 - DNA, 16 bp, R. norvegicus
tggaagacagaggaca

SEQ ID NO: 524911 - DNA, 16 bp, R. norvegicus
tggaagacagtgaaga

SEQ ID NO: 524912 - DNA, 16 bp, R. norvegicus
tggaagacattgtttc

SEQ ID NO: 524913 - DNA, 16 bp, R. norvegicus
tggaagacttagagaa

SEQ ID NO: 524914 - DNA, 16 bp, R. norvegicus
tggaagactttaagaa

SEQ ID NO: 524915 - DNA, 16 bp, R. norvegicus
tggaagagaaaacaaa

SEQ ID NO: 524916 - DNA, 16 bp, R. norvegicus
tggaagagaaaatctc

SEQ ID NO: 524917 - DNA, 16 bp, R. norvegicus
tggaagagagagctgg

SEQ ID NO: 524918 - DNA, 16 bp, R. norvegicus
tggaagagagtgaaga

SEQ ID NO: 524919 - DNA, 16 bp, R. norvegicus
tggaagagcagcagcc

SEQ ID NO: 524920 - DNA, 16 bp, R. norvegicus
tggaagagcagcaggt

SEQ ID NO: 524921 - DNA, 16 bp, R. norvegicus
tggaagagcagcagtg

SEQ ID NO: 524922 - DNA, 16 bp, R. norvegicus
tggaagagctagagaa

SEQ ID NO: 524923 - DNA, 16 bp, R. norvegicus
tggaagagctggagga

SEQ ID NO: 524924 - DNA, 16 bp, R. norvegicus
tggaagagcttgaaga

SEQ ID NO: 524925 - DNA, 16 bp, R. norvegicus
tggaagaggagacaga

SEQ ID NO: 524926 - DNA, 16 bp, R. norvegicus
tggaagaggaggcaga

SEQ ID NO: 524927 - DNA, 16 bp, R. norvegicus
tggaagaggaggtaga

SEQ ID NO: 524928 - DNA, 16 bp, R. norvegicus
tggaagagggagcaga

SEQ ID NO: 524929 - DNA, 16 bp, R. norvegicus
tggaagagggcatcag

SEQ ID NO: 524930 - DNA, 16 bp, R. norvegicus
tggaagagtgctgctt

SEQ ID NO: 524931 - DNA, 16 bp, R. norvegicus
tggaagagttggagga

SEQ ID NO: 524932 - DNA, 16 bp, R. norvegicus
tggaagagttggggga

SEQ ID NO: 524933 - DNA, 16 bp, R. norvegicus
tggaagagtttggaga

SEQ ID NO: 524934 - DNA, 16 bp, R. norvegicus
tggaagatgggaagga

SEQ ID NO: 524935 - DNA, 16 bp, R. norvegicus
tggaagcaatcaagaa

SEQ ID NO: 524936 - DNA, 16 bp, R. norvegicus
tggaagcagagaacca

SEQ ID NO: 524937 - DNA, 16 bp, R. norvegicus
tggaagcagatgcaga

SEQ ID NO: 524938 - DNA, 16 bp, R. norvegicus
tggaagcaggagctga

SEQ ID NO: 524939 - DNA, 16 bp, R. norvegicus
tggaagcatcatcagc

SEQ ID NO: 524940 - DNA, 16 bp, R. norvegicus
tggaagccagaagaag

SEQ ID NO: 524941 - DNA, 16 bp, R. norvegicus
tggaagccagagaggg

SEQ ID NO: 524942 - DNA, 16 bp, R. norvegicus
tggaagccagaggaag

SEQ ID NO: 524943 - DNA, 16 bp, R. norvegicus
tggaagccagaggctg

SEQ ID NO: 524944 - DNA, 16 bp, R. norvegicus
tggaagccagtgttct

SEQ ID NO: 524945 - DNA, 16 bp, R. norvegicus
tggaagcctacagaga

SEQ ID NO: 524946 - DNA, 16 bp, R. norvegicus
tggaagctctgggtgg

SEQ ID NO: 524947 - DNA, 16 bp, R. norvegicus
tggaagctctggtagc

SEQ ID NO: 524948 - DNA, 17 bp, R. norvegicus
tggaagctctggttgtt

SEQ ID NO: 524949 - DNA, 19 bp, R. norvegicus
tggaagctcttgttgcttg

SEQ ID NO: 524950 - DNA, 16 bp, R. norvegicus
tggaagctgaacaact

SEQ ID NO: 524951 - DNA, 16 bp, R. norvegicus
tggaagctggtgtttt

SEQ ID NO: 524952 - DNA, 16 bp, R. norvegicus
tggaagctgtggtgtg

SEQ ID NO: 524953 - DNA, 16 bp, R. norvegicus
tggaaggaaaactcca

SEQ ID NO: 524954 - DNA, 16 bp, R. norvegicus
tggaaggaaaagaatt

SEQ ID NO: 524955 - DNA, 16 bp, R. norvegicus
tggaaggaactggaaa

SEQ ID NO: 524956 - DNA, 16 bp, R. norvegicus
tggaaggactggagga

SEQ ID NO: 524957 - DNA, 16 bp, R. norvegicus
tggaaggagagactca

SEQ ID NO: 524958 - DNA, 16 bp, R. norvegicus
tggaaggagaggactg

SEQ ID NO: 524959 - DNA, 16 bp, R. norvegicus
tggaaggcactttcca

SEQ ID NO: 524960 - DNA, 16 bp, R. norvegicus
tggaaggcatcttgct

SEQ ID NO: 524961 - DNA, 17 bp, R. norvegicus
tggaagggatatttctt

SEQ ID NO: 524962 - DNA, 16 bp, R. norvegicus
tggaagggctcatgac

SEQ ID NO: 524963 - DNA, 16 bp, R. norvegicus
tggaaggggatgccct

SEQ ID NO: 524964 - DNA, 16 bp, R. norvegicus
tggaagggggaacaaa

SEQ ID NO: 524965 - DNA, 16 bp, R. norvegicus
tggaagggtccagact

SEQ ID NO: 524966 - DNA, 16 bp, R. norvegicus
tggaaggtggagacag

SEQ ID NO: 524967 - DNA, 16 bp, R. norvegicus
tggaaggttctggaag

SEQ ID NO: 524968 - DNA, 16 bp, R. norvegicus
tggaagtcaatggtgg

SEQ ID NO: 524969 - DNA, 16 bp, R. norvegicus
tggaagtcagttttct

SEQ ID NO: 524970 - DNA, 16 bp, R. norvegicus
tggaagtcggaggaca

SEQ ID NO: 524971 - DNA, 16 bp, R. norvegicus
tggaagtgtaagacaa

SEQ ID NO: 524972 - DNA, 16 bp, R. norvegicus
tggaagttcaaagcca

SEQ ID NO: 524973 - DNA, 16 bp, R. norvegicus
tggaagtttctggttt

SEQ ID NO: 524974 - DNA, 16 bp, R. norvegicus
tggaataaagaaagca

SEQ ID NO: 524975 - DNA, 17 bp, R. norvegicus
tggaataacaaaaaact

SEQ ID NO: 524976 - DNA, 16 bp, R. norvegicus
tggaataacaaaaagc

SEQ ID NO: 524977 - DNA, 16 bp, R. norvegicus
tggaatattttgagaa

SEQ ID NO: 524978 - DNA, 16 bp, R. norvegicus
tggaatccagaagagg

SEQ ID NO: 524979 - DNA, 16 bp, R. norvegicus
tggaatccagctcaag

SEQ ID NO: 524980 - DNA, 16 bp, R. norvegicus
tggaatcccagtttct

SEQ ID NO: 524981 - DNA, 16 bp, R. norvegicus
tggaatcctctgctcc

SEQ ID NO: 524982 - DNA, 16 bp, R. norvegicus
tggaatctcagaattg

SEQ ID NO: 524983 - DNA, 16 bp, R. norvegicus
tggaatctgaagagac

SEQ ID NO: 524984 - DNA, 16 bp, R. norvegicus
tggaatctgatgcctt

SEQ ID NO: 524985 - DNA, 16 bp, R. norvegicus
tggaatggatcccaag

SEQ ID NO: 524986 - DNA, 16 bp, R. norvegicus
tggaatgggatgttac

SEQ ID NO: 524987 - DNA, 16 bp, R. norvegicus
tggaatgggggcttat

SEQ ID NO: 524988 - DNA, 16 bp, R. norvegicus
tggaatggtttgtccc

SEQ ID NO: 524989 - DNA, 16 bp, R. norvegicus
tggaatgtggtggttt

SEQ ID NO: 524990 - DNA, 16 bp, R. norvegicus
tggaatgttcaatttt

SEQ ID NO: 524991 - DNA, 16 bp, R. norvegicus
tggaattaaactcagg

SEQ ID NO: 524992 - DNA, 16 bp, R. norvegicus
tggaattagaggtgtg

SEQ ID NO: 524993 - DNA, 16 bp, R. norvegicus
tggaattcttactcta

SEQ ID NO: 524994 - DNA, 16 bp, R. norvegicus
tggaattcttcaggga

SEQ ID NO: 524995 - DNA, 16 bp, R. norvegicus
tggaattctttcaagg

SEQ ID NO: 524996 - DNA, 16 bp, R. norvegicus
tggaattgaagttaca

SEQ ID NO: 524997 - DNA, 16 bp, R. norvegicus
tggaattgaatcaaag

SEQ ID NO: 524998 - DNA, 16 bp, R. norvegicus
tggaatttcagtgttg

SEQ ID NO: 524999 - DNA, 16 bp, R. norvegicus
tggaatttccccagga

SEQ ID NO: 525000 - DNA, 16 bp, R. norvegicus
tggaattttcaaagaa

SEQ ID NO: 525001 - DNA, 16 bp, R. norvegicus
tggaattttgatgaag

SEQ ID NO: 525002 - DNA, 16 bp, R. norvegicus
tggacaaattcctaga

SEQ ID NO: 525003 - DNA, 16 bp, R. norvegicus
tggacaagaagaaagg

SEQ ID NO: 525004 - DNA, 16 bp, R. norvegicus
tggacaagaaggaagg

SEQ ID NO: 525005 - DNA, 16 bp, R. norvegicus
tggacaaggctggtaa

SEQ ID NO: 525006 - DNA, 16 bp, R. norvegicus
tggacaatatttacag

SEQ ID NO: 525007 - DNA, 16 bp, R. norvegicus
tggacaatcctgagaa

SEQ ID NO: 525008 - DNA, 16 bp, R. norvegicus
tggacaatgccagcat

SEQ ID NO: 525009 - DNA, 16 bp, R. norvegicus
tggacaatgtgcagag

SEQ ID NO: 525010 - DNA, 16 bp, R. norvegicus
tggacacaaccctgga

SEQ ID NO: 525011 - DNA, 16 bp, R. norvegicus
tggacacacagcagct

SEQ ID NO: 525012 - DNA, 16 bp, R. norvegicus
tggacacagcagggca

SEQ ID NO: 525013 - DNA, 16 bp, R. norvegicus
tggacacagggtcaga

SEQ ID NO: 525014 - DNA, 16 bp, R. norvegicus
tggacacaggtgaaaa

SEQ ID NO: 525015 - DNA, 16 bp, R. norvegicus
tggacaccagaagagg

SEQ ID NO: 525016 - DNA, 16 bp, R. norvegicus
tggacaccaggatcct

SEQ ID NO: 525017 - DNA, 16 bp, R. norvegicus
tggacactcccactga

SEQ ID NO: 525018 - DNA, 16 bp, R. norvegicus
tggacactgccatgcc

SEQ ID NO: 525019 - DNA, 16 bp, R. norvegicus
tggacactgctgtgct

SEQ ID NO: 525020 - DNA, 16 bp, R. norvegicus
tggacagaactggaaa

SEQ ID NO: 525021 - DNA, 16 bp, R. norvegicus
tggacagagctgcaca

SEQ ID NO: 525022 - DNA, 16 bp, R. norvegicus
tggacagatgaatgga

SEQ ID NO: 525023 - DNA, 16 bp, R. norvegicus
tggacagcacctgagg

SEQ ID NO: 525024 - DNA, 16 bp, R. norvegicus
tggacaggaaagcagg

SEQ ID NO: 525025 - DNA, 16 bp, R. norvegicus
tggacaggaagctggg

SEQ ID NO: 525026 - DNA, 16 bp, R. norvegicus
tggacagtgttggtgg

SEQ ID NO: 525027 - DNA, 16 bp, R. norvegicus
tggacatagtactacc

SEQ ID NO: 525028 - DNA, 16 bp, R. norvegicus
tggacatcaacatggc

SEQ ID NO: 525029 - DNA, 16 bp, R. norvegicus
tggacatccaggcacc

SEQ ID NO: 525030 - DNA, 16 bp, R. norvegicus
tggacatggtggtaca

SEQ ID NO: 525031 - DNA, 17 bp, R. norvegicus
tggaccaagaggaaact

SEQ ID NO: 525032 - DNA, 16 bp, R. norvegicus
tggaccacttcctcca

SEQ ID NO: 525033 - DNA, 16 bp, R. norvegicus
tggaccagaaagaaat

SEQ ID NO: 525034 - DNA, 16 bp, R. norvegicus
tggaccagaaggggaa

SEQ ID NO: 525035 - DNA, 16 bp, R. norvegicus
tggaccagcacttggg

SEQ ID NO: 525036 - DNA, 17 bp, R. norvegicus
tggaccagcagcttttt

SEQ ID NO: 525037 - DNA, 16 bp, R. norvegicus
tggaccagctagtgta

SEQ ID NO: 525038 - DNA, 16 bp, R. norvegicus
tggaccaggaagcaga

SEQ ID NO: 525039 - DNA, 16 bp, R. norvegicus
tggaccaggagaggaa

SEQ ID NO: 525040 - DNA, 16 bp, R. norvegicus
tggacccaccttgctg

SEQ ID NO: 525041 - DNA, 22 bp, R. norvegicus
tggaccccatcacagttgaaga

SEQ ID NO: 525042 - DNA, 16 bp, R. norvegicus
tggacccccaatgcag

SEQ ID NO: 525043 - DNA, 16 bp, R. norvegicus
tggaccctcagaagta

SEQ ID NO: 525044 - DNA, 16 bp, R. norvegicus
tggaccctcccaccct

SEQ ID NO: 525045 - DNA, 16 bp, R. norvegicus
tggaccgctttgggcc

SEQ ID NO: 525046 - DNA, 16 bp, R. norvegicus
tggacctatggttcca

SEQ ID NO: 525047 - DNA, 16 bp, R. norvegicus
tggacctggaggggga

SEQ ID NO: 525048 - DNA, 16 bp, R. norvegicus
tggacctgtcactgga

SEQ ID NO: 525049 - DNA, 16 bp, R. norvegicus
tggacgagaaggaaga

SEQ ID NO: 525050 - DNA, 16 bp, R. norvegicus
tggacgagcagccagt

SEQ ID NO: 525051 - DNA, 30 bp, R. norvegicus
tggactagtccaggaattgagacaatccat

SEQ ID NO: 525052 - DNA, 16 bp, R. norvegicus
tggactatgatctgga

SEQ ID NO: 525053 - DNA, 16 bp, R. norvegicus
tggactcaggacacac

SEQ ID NO: 525054 - DNA, 16 bp, R. norvegicus
tggactccaaccctct

SEQ ID NO: 525055 - DNA, 17 bp, R. norvegicus
tggactccagctgttac

SEQ ID NO: 525056 - DNA, 16 bp, R. norvegicus
tggactctatccctct

SEQ ID NO: 525057 - DNA, 16 bp, R. norvegicus
tggactctgatgatgc

SEQ ID NO: 525058 - DNA, 16 bp, R. norvegicus
tggactgaacctctga

SEQ ID NO: 525059 - DNA, 16 bp, R. norvegicus
tggactgactctgggc

SEQ ID NO: 525060 - DNA, 16 bp, R. norvegicus
tggactgcacacagca

SEQ ID NO: 525061 - DNA, 16 bp, R. norvegicus
tggactgcctgaagaa

SEQ ID NO: 525062 - DNA, 16 bp, R. norvegicus
tggactggcatttgtg

SEQ ID NO: 525063 - DNA, 16 bp, R. norvegicus
tggactgggaagggaa

SEQ ID NO: 525064 - DNA, 16 bp, R. norvegicus
tggactggtggttctg

SEQ ID NO: 525065 - DNA, 16 bp, R. norvegicus
tggactgtaacctgaa

SEQ ID NO: 525066 - DNA, 16 bp, R. norvegicus
tggactgtaccttggg

SEQ ID NO: 525067 - DNA, 16 bp, R. norvegicus
tggactgtgaaaaaaa

SEQ ID NO: 525068 - DNA, 16 bp, R. norvegicus
tggactgtggtttcca

SEQ ID NO: 525069 - DNA, 16 bp, R. norvegicus
tggacttccttttcct

SEQ ID NO: 525070 - DNA, 16 bp, R. norvegicus
tggacttgaactttat

SEQ ID NO: 525071 - DNA, 16 bp, R. norvegicus
tggacttgagctttgt

SEQ ID NO: 525072 - DNA, 16 bp, R. norvegicus
tggacttggagaccct

SEQ ID NO: 525073 - DNA, 16 bp, R. norvegicus
tggacttgttggaaga

SEQ ID NO: 525074 - DNA, 16 bp, R. norvegicus
tggactttctgtcatt

SEQ ID NO: 525075 - DNA, 16 bp, R. norvegicus
tggactttgagatttc

SEQ ID NO: 525076 - DNA, 16 bp, R. norvegicus
tggagaaaacaaaaca

SEQ ID NO: 525077 - DNA, 16 bp, R. norvegicus
tggagaaaagaaaaca

SEQ ID NO: 525078 - DNA, 16 bp, R. norvegicus
tggagaaaagacccgc

SEQ ID NO: 525079 - DNA, 16 bp, R. norvegicus
tggagaaaaggaaaca

SEQ ID NO: 525080 - DNA, 16 bp, R. norvegicus
tggagaaaatggaaca

SEQ ID NO: 525081 - DNA, 16 bp, R. norvegicus
tggagaaaccaagaaa

SEQ ID NO: 525082 - DNA, 16 bp, R. norvegicus
tggagaaactctgtct

SEQ ID NO: 525083 - DNA, 16 bp, R. norvegicus
tggagaaagaaacagg

SEQ ID NO: 525084 - DNA, 16 bp, R. norvegicus
tggagaaagaaattga

SEQ ID NO: 525085 - DNA, 16 bp, R. norvegicus
tggagaaagaactgag

SEQ ID NO: 525086 - DNA, 16 bp, R. norvegicus
tggagaaagagaaact

SEQ ID NO: 525087 - DNA, 16 bp, R. norvegicus
tggagaaagaggaaac

SEQ ID NO: 525088 - DNA, 16 bp, R. norvegicus
tggagaaagaggatca

SEQ ID NO: 525089 - DNA, 16 bp, R. norvegicus
tggagaaaggattgaa

SEQ ID NO: 525090 - DNA, 16 bp, R. norvegicus
tggagaaagtatgtca

SEQ ID NO: 525091 - DNA, 16 bp, R. norvegicus
tggagaaatgcaaatc

SEQ ID NO: 525092 - DNA, 16 bp, R. norvegicus
tggagaaattagaaaa

SEQ ID NO: 525093 - DNA, 16 bp, R. norvegicus
tggagaaattagagaa

SEQ ID NO: 525094 - DNA, 16 bp, R. norvegicus
tggagaactatattga

SEQ ID NO: 525095 - DNA, 16 bp, R. norvegicus
tggagaactctcagct

SEQ ID NO: 525096 - DNA, 16 bp, R. norvegicus
tggagaactttaagaa

SEQ ID NO: 525097 - DNA, 16 bp, R. norvegicus
tggagaagaaactgag

SEQ ID NO: 525098 - DNA, 16 bp, R. norvegicus
tggagaagaaagggtt

SEQ ID NO: 525099 - DNA, 16 bp, R. norvegicus
tggagaagaaatggga

SEQ ID NO: 525100 - DNA, 16 bp, R. norvegicus
tggagaagaatttcag

SEQ ID NO: 525101 - DNA, 16 bp, R. norvegicus
tggagaagacacagtg

SEQ ID NO: 525102 - DNA, 16 bp, R. norvegicus
tggagaagaccctgag

SEQ ID NO: 525103 - DNA, 16 bp, R. norvegicus
tggagaagacctcaga

SEQ ID NO: 525104 - DNA, 16 bp, R. norvegicus
tggagaagagattgaa

SEQ ID NO: 525105 - DNA, 16 bp, R. norvegicus
tggagaagagccttga

SEQ ID NO: 525106 - DNA, 16 bp, R. norvegicus
tggagaagcagccagt

SEQ ID NO: 525107 - DNA, 16 bp, R. norvegicus
tggagaagccattcta

SEQ ID NO: 525108 - DNA, 16 bp, R. norvegicus
tggagaagctagagaa

SEQ ID NO: 525109 - DNA, 16 bp, R. norvegicus
tggagaagctgagagt

SEQ ID NO: 525110 - DNA, 16 bp, R. norvegicus
tggagaagctgcccag

SEQ ID NO: 525111 - DNA, 16 bp, R. norvegicus
tggagaaggaggaaca

SEQ ID NO: 525112 - DNA, 16 bp, R. norvegicus
tggagaaggcctttgc

SEQ ID NO: 525113 - DNA, 16 bp, R. norvegicus
tggagaagtgtgtgtg

SEQ ID NO: 525114 - DNA, 16 bp, R. norvegicus
tggagaagttagagaa

SEQ ID NO: 525115 - DNA, 16 bp, R. norvegicus
tggagaattttatcag

SEQ ID NO: 525116 - DNA, 16 bp, R. norvegicus
tggagacaaagtgtgg

SEQ ID NO: 525117 - DNA, 16 bp, R. norvegicus
tggagacaaagtttga

SEQ ID NO: 525118 - DNA, 16 bp, R. norvegicus
tggagacaagagaatc

SEQ ID NO: 525119 - DNA, 81 bp, R. norvegicus
tggagacaagctggacctcaccttaccaacaagctatcaaatctgttatgtttaaacagtgagacctccaaggaaggagat

SEQ ID NO: 525120 - DNA, 16 bp, R. norvegicus
tggagacactgaggca

SEQ ID NO: 525121 - DNA, 16 bp, R. norvegicus
tggagacactgggtgt

SEQ ID NO: 525122 - DNA, 16 bp, R. norvegicus
tggagacagaaattaa

SEQ ID NO: 525123 - DNA, 16 bp, R. norvegicus
tggagacagaagcaga

SEQ ID NO: 525124 - DNA, 16 bp, R. norvegicus
tggagacagagaagga

SEQ ID NO: 525125 - DNA, 16 bp, R. norvegicus
tggagacagaggaaca

SEQ ID NO: 525126 - DNA, 16 bp, R. norvegicus
tggagacagaggagga

SEQ ID NO: 525127 - DNA, 16 bp, R. norvegicus
tggagacaggagcatc

SEQ ID NO: 525128 - DNA, 16 bp, R. norvegicus
tggagacagggaagga

SEQ ID NO: 525129 - DNA, 16 bp, R. norvegicus
tggagacagggctcag

SEQ ID NO: 525130 - DNA, 16 bp, R. norvegicus
tggagacaggggcagg

SEQ ID NO: 525131 - DNA, 16 bp, R. norvegicus
tggagacaggtggatt

SEQ ID NO: 525132 - DNA, 16 bp, R. norvegicus
tggagacattttctta

SEQ ID NO: 525133 - DNA, 16 bp, R. norvegicus
tggagaccccaggaag

SEQ ID NO: 525134 - DNA, 16 bp, R. norvegicus
tggagaccctcttcct

SEQ ID NO: 525135 - DNA, 16 bp, R. norvegicus
tggagacggagaagga

SEQ ID NO: 525136 - DNA, 16 bp, R. norvegicus
tggagacgtggctcag

SEQ ID NO: 525137 - DNA, 16 bp, R. norvegicus
tggagactctgaaagc

SEQ ID NO: 525138 - DNA, 16 bp, R. norvegicus
tggagacttttcagag

SEQ ID NO: 525139 - DNA, 16 bp, R. norvegicus
tggagagaaaagggtt

SEQ ID NO: 525140 - DNA, 16 bp, R. norvegicus
tggagagaaactcaaa

SEQ ID NO: 525141 - DNA, 16 bp, R. norvegicus
tggagagaaactggga

SEQ ID NO: 525142 - DNA, 16 bp, R. norvegicus
tggagagaaacttgat

SEQ ID NO: 525143 - DNA, 16 bp, R. norvegicus
tggagagaaagataga

SEQ ID NO: 525144 - DNA, 16 bp, R. norvegicus
tggagagaaggttctg

SEQ ID NO: 525145 - DNA, 16 bp, R. norvegicus
tggagagaagtttgag

SEQ ID NO: 525146 - DNA, 16 bp, R. norvegicus
tggagagaatcttgaa

SEQ ID NO: 525147 - DNA, 16 bp, R. norvegicus
tggagagacatctcag

SEQ ID NO: 525148 - DNA, 16 bp, R. norvegicus
tggagagaccactcag

SEQ ID NO: 525149 - DNA, 16 bp, R. norvegicus
tggagagactggattt

SEQ ID NO: 525150 - DNA, 16 bp, R. norvegicus
tggagagagaactcag

SEQ ID NO: 525151 - DNA, 16 bp, R. norvegicus
tggagagagagacaga

SEQ ID NO: 525152 - DNA, 16 bp, R. norvegicus
tggagagagagatggc

SEQ ID NO: 525153 - DNA, 16 bp, R. norvegicus
tggagagaggcaagcg

SEQ ID NO: 525154 - DNA, 16 bp, R. norvegicus
tggagagaggcaagtg

SEQ ID NO: 525155 - DNA, 16 bp, R. norvegicus
tggagagagtgggcag

SEQ ID NO: 525156 - DNA, 16 bp, R. norvegicus
tggagagatgctcaga

SEQ ID NO: 525157 - DNA, 16 bp, R. norvegicus
tggagagatggctcag

SEQ ID NO: 525158 - DNA, 16 bp, R. norvegicus
tggagagatggcttct

SEQ ID NO: 525159 - DNA, 16 bp, R. norvegicus
tggagagatggttcag

SEQ ID NO: 525160 - DNA, 16 bp, R. norvegicus
tggagagattgttcag

SEQ ID NO: 525161 - DNA, 16 bp, R. norvegicus
tggagagcaaccaata

SEQ ID NO: 525162 - DNA, 16 bp, R. norvegicus
tggagagccagctcag

SEQ ID NO: 525163 - DNA, 16 bp, R. norvegicus
tggagagcctgcagct

SEQ ID NO: 525164 - DNA, 16 bp, R. norvegicus
tggagagctctggcaa

SEQ ID NO: 525165 - DNA, 16 bp, R. norvegicus
tggagagctgaagcag

SEQ ID NO: 525166 - DNA, 16 bp, R. norvegicus
tggagagctggctcag

SEQ ID NO: 525167 - DNA, 16 bp, R. norvegicus
tggagaggaaaccagg

SEQ ID NO: 525168 - DNA, 16 bp, R. norvegicus
tggagaggaacctgag

SEQ ID NO: 525169 - DNA, 16 bp, R. norvegicus
tggagaggaagaagtc

SEQ ID NO: 525170 - DNA, 16 bp, R. norvegicus
tggagaggaggctcag

SEQ ID NO: 525171 - DNA, 16 bp, R. norvegicus
tggagaggtggctctg

SEQ ID NO: 525172 - DNA, 16 bp, R. norvegicus
tggagagtgtcctttc

SEQ ID NO: 525173 - DNA, 17 bp, R. norvegicus
tggagatagaaaaccta

SEQ ID NO: 525174 - DNA, 16 bp, R. norvegicus
tggagatcagaaaaca

SEQ ID NO: 525175 - DNA, 16 bp, R. norvegicus
tggagatcctgcagct

SEQ ID NO: 525176 - DNA, 16 bp, R. norvegicus
tggagatcctgcagga

SEQ ID NO: 525177 - DNA, 16 bp, R. norvegicus
tggagatcctgcagtt

SEQ ID NO: 525178 - DNA, 16 bp, R. norvegicus
tggagatctcagaaga

SEQ ID NO: 525179 - DNA, 16 bp, R. norvegicus
tggagatcttcctcct

SEQ ID NO: 525180 - DNA, 16 bp, R. norvegicus
tggagatgaacagcaa

SEQ ID NO: 525181 - DNA, 16 bp, R. norvegicus
tggagatgaccttgaa

SEQ ID NO: 525182 - DNA, 16 bp, R. norvegicus
tggagatgagtgagtg

SEQ ID NO: 525183 - DNA, 16 bp, R. norvegicus
tggagatgctgctgct

SEQ ID NO: 525184 - DNA, 16 bp, R. norvegicus
tggagatggagaactt

SEQ ID NO: 525185 - DNA, 16 bp, R. norvegicus
tggagatggagacagg

SEQ ID NO: 525186 - DNA, 16 bp, R. norvegicus
tggagatggcccacca

SEQ ID NO: 525187 - DNA, 16 bp, R. norvegicus
tggagatgggctttga

SEQ ID NO: 525188 - DNA, 16 bp, R. norvegicus
tggagatggggagatg

SEQ ID NO: 525189 - DNA, 16 bp, R. norvegicus
tggagattgtattgaa

SEQ ID NO: 525190 - DNA, 20 bp, R. norvegicus
tggagatttagctcagtggt

SEQ ID NO: 525191 - DNA, 16 bp, R. norvegicus
tggagatttggctcag

SEQ ID NO: 525192 - DNA, 16 bp, R. norvegicus
tggagattttcaagtt

SEQ ID NO: 525193 - DNA, 16 bp, R. norvegicus
tggagcaaaccaaagc

SEQ ID NO: 525194 - DNA, 16 bp, R. norvegicus
tggagcaaataaatct

SEQ ID NO: 525195 - DNA, 16 bp, R. norvegicus
tggagcactcagtcct

SEQ ID NO: 525196 - DNA, 16 bp, R. norvegicus
tggagcagaaactgaa

SEQ ID NO: 525197 - DNA, 16 bp, R. norvegicus
tggagcagaaactgag

SEQ ID NO: 525198 - DNA, 16 bp, R. norvegicus
tggagcagagaatgaa

SEQ ID NO: 525199 - DNA, 16 bp, R. norvegicus
tggagcagagacagaa

SEQ ID NO: 525200 - DNA, 16 bp, R. norvegicus
tggagcagagaccaaa

SEQ ID NO: 525201 - DNA, 16 bp, R. norvegicus
tggagcagagcaggtg

SEQ ID NO: 525202 - DNA, 16 bp, R. norvegicus
tggagcagaggctgtc

SEQ ID NO: 525203 - DNA, 16 bp, R. norvegicus
tggagcaggaagctga

SEQ ID NO: 525204 - DNA, 16 bp, R. norvegicus
tggagcaggagctgag

SEQ ID NO: 525205 - DNA, 16 bp, R. norvegicus
tggagcaggaggatca

SEQ ID NO: 525206 - DNA, 16 bp, R. norvegicus
tggagcaggtgatgga

SEQ ID NO: 525207 - DNA, 16 bp, R. norvegicus
tggagcatatatattt

SEQ ID NO: 525208 - DNA, 16 bp, R. norvegicus
tggagcatcttctggg

SEQ ID NO: 525209 - DNA, 16 bp, R. norvegicus
tggagcatgaagaaag

SEQ ID NO: 525210 - DNA, 16 bp, R. norvegicus
tggagcatgtgaaagg

SEQ ID NO: 525211 - DNA, 16 bp, R. norvegicus
tggagcatgtgtccat

SEQ ID NO: 525212 - DNA, 16 bp, R. norvegicus
tggagccaccacagca

SEQ ID NO: 525213 - DNA, 16 bp, R. norvegicus
tggagccatgggtcag

SEQ ID NO: 525214 - DNA, 16 bp, R. norvegicus
tggagccatggttctg

SEQ ID NO: 525215 - DNA, 16 bp, R. norvegicus
tggagcccagaggcct

SEQ ID NO: 525216 - DNA, 16 bp, R. norvegicus
tggagcccatggtcag

SEQ ID NO: 525217 - DNA, 16 bp, R. norvegicus
tggagcccatgttaaa

SEQ ID NO: 525218 - DNA, 16 bp, R. norvegicus
tggagccccagtgcag

SEQ ID NO: 525219 - DNA, 16 bp, R. norvegicus
tggagccctcaggaca

SEQ ID NO: 525220 - DNA, 16 bp, R. norvegicus
tggagccctgcacctg

SEQ ID NO: 525221 - DNA, 16 bp, R. norvegicus
tggagccctgctggag

SEQ ID NO: 525222 - DNA, 16 bp, R. norvegicus
tggagcctggggactc

SEQ ID NO: 525223 - DNA, 16 bp, R. norvegicus
tggagcctggtggcag

SEQ ID NO: 525224 - DNA, 16 bp, R. norvegicus
tggagctcccagagac

SEQ ID NO: 525225 - DNA, 16 bp, R. norvegicus
tggagctctgtgagtt

SEQ ID NO: 525226 - DNA, 16 bp, R. norvegicus
tggagctgaagcacat

SEQ ID NO: 525227 - DNA, 16 bp, R. norvegicus
tggagctgagagttct

SEQ ID NO: 525228 - DNA, 16 bp, R. norvegicus
tggagctgaggacgga

SEQ ID NO: 525229 - DNA, 16 bp, R. norvegicus
tggagctgcagtttct

SEQ ID NO: 525230 - DNA, 16 bp, R. norvegicus
tggagctgcatgaaaa

SEQ ID NO: 525231 - DNA, 16 bp, R. norvegicus
tggagctggaaagatg

SEQ ID NO: 525232 - DNA, 16 bp, R. norvegicus
tggagctggagaagtg

SEQ ID NO: 525233 - DNA, 16 bp, R. norvegicus
tggagctggagttaca

SEQ ID NO: 525234 - DNA, 16 bp, R. norvegicus
tggagctggctcaggg

SEQ ID NO: 525235 - DNA, 16 bp, R. norvegicus
tggagctgggagctgg

SEQ ID NO: 525236 - DNA, 16 bp, R. norvegicus
tggagctggggacaga

SEQ ID NO: 525237 - DNA, 16 bp, R. norvegicus
tggagctggtcctgag

SEQ ID NO: 525238 - DNA, 16 bp, R. norvegicus
tggagctgtttgggaa

SEQ ID NO: 525239 - DNA, 16 bp, R. norvegicus
tggagcttctcagagg

SEQ ID NO: 525240 - DNA, 16 bp, R. norvegicus
tggaggaaatagagaa

SEQ ID NO: 525241 - DNA, 16 bp, R. norvegicus
tggaggaaatgagtca

SEQ ID NO: 525242 - DNA, 16 bp, R. norvegicus
tggaggaaatggaaaa

SEQ ID NO: 525243 - DNA, 16 bp, R. norvegicus
tggaggaaatggagaa

SEQ ID NO: 525244 - DNA, 16 bp, R. norvegicus
tggaggaaatggccaa

SEQ ID NO: 525245 - DNA, 16 bp, R. norvegicus
tggaggaaatgggcaa

SEQ ID NO: 525246 - DNA, 16 bp, R. norvegicus
tggaggaagagaacca

SEQ ID NO: 525247 - DNA, 16 bp, R. norvegicus
tggaggaagatgagga

SEQ ID NO: 525248 - DNA, 16 bp, R. norvegicus
tggaggaagcaaagaa

SEQ ID NO: 525249 - DNA, 16 bp, R. norvegicus
tggaggaagcagagga

SEQ ID NO: 525250 - DNA, 16 bp, R. norvegicus
tggaggaagctgaaga

SEQ ID NO: 525251 - DNA, 16 bp, R. norvegicus
tggaggaaggactgga

SEQ ID NO: 525252 - DNA, 16 bp, R. norvegicus
tggaggaaggagctga

SEQ ID NO: 525253 - DNA, 16 bp, R. norvegicus
tggaggaaggaggttg

SEQ ID NO: 525254 - DNA, 16 bp, R. norvegicus
tggaggaagggcagcc

SEQ ID NO: 525255 - DNA, 16 bp, R. norvegicus
tggaggaatatggaag

SEQ ID NO: 525256 - DNA, 16 bp, R. norvegicus
tggaggaattagaaaa

SEQ ID NO: 525257 - DNA, 16 bp, R. norvegicus
tggaggaattgcagaa

SEQ ID NO: 525258 - DNA, 16 bp, R. norvegicus
tggaggaatttaagaa

SEQ ID NO: 525259 - DNA, 16 bp, R. norvegicus
tggaggaatttctttt

SEQ ID NO: 525260 - DNA, 16 bp, R. norvegicus
tggaggacagcctttg

SEQ ID NO: 525261 - DNA, 16 bp, R. norvegicus
tggaggacatcaagaa

SEQ ID NO: 525262 - DNA, 16 bp, R. norvegicus
tggaggacatctgggt

SEQ ID NO: 525263 - DNA, 16 bp, R. norvegicus
tggaggacctgggttt

SEQ ID NO: 525264 - DNA, 16 bp, R. norvegicus
tggaggacttcaagac

SEQ ID NO: 525265 - DNA, 16 bp, R. norvegicus
tggaggacttccagaa

SEQ ID NO: 525266 - DNA, 16 bp, R. norvegicus
tggaggactttgagaa

SEQ ID NO: 525267 - DNA, 16 bp, R. norvegicus
tggaggagaaagttta

SEQ ID NO: 525268 - DNA, 16 bp, R. norvegicus
tggaggagacagagaa

SEQ ID NO: 525269 - DNA, 16 bp, R. norvegicus
tggaggagagactgaa

SEQ ID NO: 525270 - DNA, 16 bp, R. norvegicus
tggaggagataaagga

SEQ ID NO: 525271 - DNA, 16 bp, R. norvegicus
tggaggagctagagaa

SEQ ID NO: 525272 - DNA, 16 bp, R. norvegicus
tggaggagctcctcca

SEQ ID NO: 525273 - DNA, 16 bp, R. norvegicus
tggaggagctgagaat

SEQ ID NO: 525274 - DNA, 16 bp, R. norvegicus
tggaggagctggagga

SEQ ID NO: 525275 - DNA, 16 bp, R. norvegicus
tggaggaggaagatca

SEQ ID NO: 525276 - DNA, 16 bp, R. norvegicus
tggaggaggaatggat

SEQ ID NO: 525277 - DNA, 16 bp, R. norvegicus
tggaggaggagctgag

SEQ ID NO: 525278 - DNA, 16 bp, R. norvegicus
tggaggaggaggcagg

SEQ ID NO: 525279 - DNA, 16 bp, R. norvegicus
tggaggaggagtgcag

SEQ ID NO: 525280 - DNA, 16 bp, R. norvegicus
tggaggaggcgtggcc

SEQ ID NO: 525281 - DNA, 16 bp, R. norvegicus
tggaggaggtgtgcca

SEQ ID NO: 525282 - DNA, 16 bp, R. norvegicus
tggaggaggtgtggcc

SEQ ID NO: 525283 - DNA, 16 bp, R. norvegicus
tggaggagtgctgctg

SEQ ID NO: 525284 - DNA, 16 bp, R. norvegicus
tggaggagtgctgctt

SEQ ID NO: 525285 - DNA, 16 bp, R. norvegicus
tggaggagttctctgg

SEQ ID NO: 525286 - DNA, 16 bp, R. norvegicus
tggaggagtttgagaa

SEQ ID NO: 525287 - DNA, 16 bp, R. norvegicus
tggaggattcctggag

SEQ ID NO: 525288 - DNA, 16 bp, R. norvegicus
tggaggcagagaaaga

SEQ ID NO: 525289 - DNA, 16 bp, R. norvegicus
tggaggcagagaagga

SEQ ID NO: 525290 - DNA, 16 bp, R. norvegicus
tggaggcagaggcagg

SEQ ID NO: 525291 - DNA, 16 bp, R. norvegicus
tggaggcagaggcagt

SEQ ID NO: 525292 - DNA, 16 bp, R. norvegicus
tggaggcagaggctga

SEQ ID NO: 525293 - DNA, 16 bp, R. norvegicus
tggaggcagagggatc

SEQ ID NO: 525294 - DNA, 16 bp, R. norvegicus
tggaggcagcagaatg

SEQ ID NO: 525295 - DNA, 16 bp, R. norvegicus
tggaggcaggagccga

SEQ ID NO: 525296 - DNA, 16 bp, R. norvegicus
tggaggcaggaggatg

SEQ ID NO: 525297 - DNA, 16 bp, R. norvegicus
tggaggcattagagaa

SEQ ID NO: 525298 - DNA, 16 bp, R. norvegicus
tggaggccacagggag

SEQ ID NO: 525299 - DNA, 16 bp, R. norvegicus
tggaggccagaagagg

SEQ ID NO: 525300 - DNA, 16 bp, R. norvegicus
tggaggccagcttggg

SEQ ID NO: 525301 - DNA, 16 bp, R. norvegicus
tggaggccagtctggg

SEQ ID NO: 525302 - DNA, 16 bp, R. norvegicus
tggaggcctcaggaag

SEQ ID NO: 525303 - DNA, 16 bp, R. norvegicus
tggaggccttggtaaa

SEQ ID NO: 525304 - DNA, 16 bp, R. norvegicus
tggaggctgaacaatg

SEQ ID NO: 525305 - DNA, 16 bp, R. norvegicus
tggaggctggttctct

SEQ ID NO: 525306 - DNA, 16 bp, R. norvegicus
tggaggctgtgttcac

SEQ ID NO: 525307 - DNA, 16 bp, R. norvegicus
tggagggaccatggct

SEQ ID NO: 525308 - DNA, 16 bp, R. norvegicus
tggagggagagagctg

SEQ ID NO: 525309 - DNA, 16 bp, R. norvegicus
tggagggaggagctga

SEQ ID NO: 525310 - DNA, 16 bp, R. norvegicus
tggagggaggagggca

SEQ ID NO: 525311 - DNA, 16 bp, R. norvegicus
tggagggcagaggaag

SEQ ID NO: 525312 - DNA, 16 bp, R. norvegicus
tggaggggaggacagg

SEQ ID NO: 525313 - DNA, 16 bp, R. norvegicus
tggaggggtaacctgg

SEQ ID NO: 525314 - DNA, 16 bp, R. norvegicus
tggaggggtgctgctt

SEQ ID NO: 525315 - DNA, 16 bp, R. norvegicus
tggaggtaaagtttgg

SEQ ID NO: 525316 - DNA, 16 bp, R. norvegicus
tggaggtcaaaggaca

SEQ ID NO: 525317 - DNA, 16 bp, R. norvegicus
tggaggtcagaaaaag

SEQ ID NO: 525318 - DNA, 16 bp, R. norvegicus
tggaggtcagaagtca

SEQ ID NO: 525319 - DNA, 16 bp, R. norvegicus
tggaggtcagcaagta

SEQ ID NO: 525320 - DNA, 16 bp, R. norvegicus
tggaggtcagcacgta

SEQ ID NO: 525321 - DNA, 16 bp, R. norvegicus
tggaggtccctcagaa

SEQ ID NO: 525322 - DNA, 16 bp, R. norvegicus
tggaggtcctgcacca

SEQ ID NO: 525323 - DNA, 16 bp, R. norvegicus
tggaggtcctgcagct

SEQ ID NO: 525324 - DNA, 16 bp, R. norvegicus
tggaggtcctggatcc

SEQ ID NO: 525325 - DNA, 16 bp, R. norvegicus
tggaggtccttgacca

SEQ ID NO: 525326 - DNA, 16 bp, R. norvegicus
tggaggtgaaactggg

SEQ ID NO: 525327 - DNA, 18 bp, R. norvegicus
tggaggtgcctcagaaaa

SEQ ID NO: 525328 - DNA, 16 bp, R. norvegicus
tggaggtggaagcagg

SEQ ID NO: 525329 - DNA, 16 bp, R. norvegicus
tggaggtgtggccctg

SEQ ID NO: 525330 - DNA, 16 bp, R. norvegicus
tggaggtgtggctcag

SEQ ID NO: 525331 - DNA, 16 bp, R. norvegicus
tggagtactatacagc

SEQ ID NO: 525332 - DNA, 16 bp, R. norvegicus
tggagtagctgtggcc

SEQ ID NO: 525333 - DNA, 16 bp, R. norvegicus
tggagtcagctgtgct

SEQ ID NO: 525334 - DNA, 16 bp, R. norvegicus
tggagtcaggaggatc

SEQ ID NO: 525335 - DNA, 16 bp, R. norvegicus
tggagtcatttctctc

SEQ ID NO: 525336 - DNA, 16 bp, R. norvegicus
tggagtccattttgtg

SEQ ID NO: 525337 - DNA, 17 bp, R. norvegicus
tggagtccttcatacac

SEQ ID NO: 525338 - DNA, 16 bp, R. norvegicus
tggagtctcactgggt

SEQ ID NO: 525339 - DNA, 16 bp, R. norvegicus
tggagtctccaaggca

SEQ ID NO: 525340 - DNA, 16 bp, R. norvegicus
tggagtctgaacccaa

SEQ ID NO: 525341 - DNA, 16 bp, R. norvegicus
tggagtctgaacttaa

SEQ ID NO: 525342 - DNA, 16 bp, R. norvegicus
tggagtctgaggcagg

SEQ ID NO: 525343 - DNA, 16 bp, R. norvegicus
tggagtgatggagaca

SEQ ID NO: 525344 - DNA, 16 bp, R. norvegicus
tggagtggaaaccagg

SEQ ID NO: 525345 - DNA, 16 bp, R. norvegicus
tggagttccagacagt

SEQ ID NO: 525346 - DNA, 16 bp, R. norvegicus
tggagttcctatcctc

SEQ ID NO: 525347 - DNA, 16 bp, R. norvegicus
tggagttcctgcctgg

SEQ ID NO: 525348 - DNA, 16 bp, R. norvegicus
tggagttcgaccccga

SEQ ID NO: 525349 - DNA, 16 bp, R. norvegicus
tggagttctccatcta

SEQ ID NO: 525350 - DNA, 16 bp, R. norvegicus
tggagttctggagttc

SEQ ID NO: 525351 - DNA, 16 bp, R. norvegicus
tggagttgttcctttg

SEQ ID NO: 525352 - DNA, 16 bp, R. norvegicus
tggataaagaaaacat

SEQ ID NO: 525353 - DNA, 16 bp, R. norvegicus
tggataaagaaaacca

SEQ ID NO: 525354 - DNA, 16 bp, R. norvegicus
tggataagatggatga

SEQ ID NO: 525355 - DNA, 16 bp, R. norvegicus
tggataatattgttat

SEQ ID NO: 525356 - DNA, 16 bp, R. norvegicus
tggatacaatgtaacc

SEQ ID NO: 525357 - DNA, 17 bp, R. norvegicus
tggatacagaaaatgta

SEQ ID NO: 525358 - DNA, 16 bp, R. norvegicus
tggatagaaacttgaa

SEQ ID NO: 525359 - DNA, 16 bp, R. norvegicus
tggatagaggagaagt

SEQ ID NO: 525360 - DNA, 16 bp, R. norvegicus
tggatagttttagctt

SEQ ID NO: 525361 - DNA, 16 bp, R. norvegicus
tggatatcctggaact

SEQ ID NO: 525362 - DNA, 16 bp, R. norvegicus
tggatatgagccctct

SEQ ID NO: 525363 - DNA, 17 bp, R. norvegicus
tggatattctctgagtc

SEQ ID NO: 525364 - DNA, 16 bp, R. norvegicus
tggatattttcttatt

SEQ ID NO: 525365 - DNA, 16 bp, R. norvegicus
tggatatttttcttta

SEQ ID NO: 525366 - DNA, 16 bp, R. norvegicus
tggatcaccaagcagg

SEQ ID NO: 525367 - DNA, 16 bp, R. norvegicus
tggatcactaggtcct

SEQ ID NO: 525368 - DNA, 16 bp, R. norvegicus
tggatcagaggtcatt

SEQ ID NO: 525369 - DNA, 16 bp, R. norvegicus
tggatcagtagaatta

SEQ ID NO: 525370 - DNA, 16 bp, R. norvegicus
tggatcatggcaaaag

SEQ ID NO: 525371 - DNA, 16 bp, R. norvegicus
tggatccatctgtaaa

SEQ ID NO: 525372 - DNA, 16 bp, R. norvegicus
tggatcccaaagtggg

SEQ ID NO: 525373 - DNA, 16 bp, R. norvegicus
tggatcccagacattg

SEQ ID NO: 525374 - DNA, 16 bp, R. norvegicus
tggatccccaagtgag

SEQ ID NO: 525375 - DNA, 16 bp, R. norvegicus
tggatcccctggcact

SEQ ID NO: 525376 - DNA, 16 bp, R. norvegicus
tggatcccgttacaga

SEQ ID NO: 525377 - DNA, 16 bp, R. norvegicus
tggatcccttgaaact

SEQ ID NO: 525378 - DNA, 16 bp, R. norvegicus
tggatcctcagaaaat

SEQ ID NO: 525379 - DNA, 17 bp, R. norvegicus
tggatcctcaggtagta

SEQ ID NO: 525380 - DNA, 16 bp, R. norvegicus
tggatcctctgaagct

SEQ ID NO: 525381 - DNA, 16 bp, R. norvegicus
tggatctcacagaggc

SEQ ID NO: 525382 - DNA, 16 bp, R. norvegicus
tggatctcctgggatg

SEQ ID NO: 525383 - DNA, 16 bp, R. norvegicus
tggatctctatgagtt

SEQ ID NO: 525384 - DNA, 16 bp, R. norvegicus
tggatctctttgagtt

SEQ ID NO: 525385 - DNA, 16 bp, R. norvegicus
tggatctgagagtcag

SEQ ID NO: 525386 - DNA, 16 bp, R. norvegicus
tggatctgggagagag

SEQ ID NO: 525387 - DNA, 16 bp, R. norvegicus
tggatctggggaagag

SEQ ID NO: 525388 - DNA, 16 bp, R. norvegicus
tggatctgtttagaaa

SEQ ID NO: 525389 - DNA, 16 bp, R. norvegicus
tggatcttgttctcct

SEQ ID NO: 525390 - DNA, 16 bp, R. norvegicus
tggatctttctgagaa

SEQ ID NO: 525391 - DNA, 16 bp, R. norvegicus
tggatgaaactggaaa

SEQ ID NO: 525392 - DNA, 16 bp, R. norvegicus
tggatgaaatggaaaa

SEQ ID NO: 525393 - DNA, 16 bp, R. norvegicus
tggatgaacagatgga

SEQ ID NO: 525394 - DNA, 16 bp, R. norvegicus
tggatgaagatgtaga

SEQ ID NO: 525395 - DNA, 16 bp, R. norvegicus
tggatgaagccaagaa

SEQ ID NO: 525396 - DNA, 16 bp, R. norvegicus
tggatgaagcctctca

SEQ ID NO: 525397 - DNA, 16 bp, R. norvegicus
tggatgaagctaagaa

SEQ ID NO: 525398 - DNA, 16 bp, R. norvegicus
tggatgaatggaagga

SEQ ID NO: 525399 - DNA, 16 bp, R. norvegicus
tggatgaattagggaa

SEQ ID NO: 525400 - DNA, 16 bp, R. norvegicus
tggatgacctgtccat

SEQ ID NO: 525401 - DNA, 16 bp, R. norvegicus
tggatgactacacaga

SEQ ID NO: 525402 - DNA, 16 bp, R. norvegicus
tggatgacttttcctt

SEQ ID NO: 525403 - DNA, 16 bp, R. norvegicus
tggatgagaaatgtcc

SEQ ID NO: 525404 - DNA, 16 bp, R. norvegicus
tggatgagaaggaaga

SEQ ID NO: 525405 - DNA, 16 bp, R. norvegicus
tggatgagaatggccc

SEQ ID NO: 525406 - DNA, 16 bp, R. norvegicus
tggatgagagtggggt

SEQ ID NO: 525407 - DNA, 18 bp, R. norvegicus
tggatgagcagacagtgc

SEQ ID NO: 525408 - DNA, 16 bp, R. norvegicus
tggatgagtgttcccc

SEQ ID NO: 525409 - DNA, 16 bp, R. norvegicus
tggatgatctttcctt

SEQ ID NO: 525410 - DNA, 16 bp, R. norvegicus
tggatgatgatgatga

SEQ ID NO: 525411 - DNA, 16 bp, R. norvegicus
tggatgatgggtggat

SEQ ID NO: 525412 - DNA, 16 bp, R. norvegicus
tggatgatgttttgct

SEQ ID NO: 525413 - DNA, 16 bp, R. norvegicus
tggatgcaactgctag

SEQ ID NO: 525414 - DNA, 16 bp, R. norvegicus
tggatgcagaagccat

SEQ ID NO: 525415 - DNA, 16 bp, R. norvegicus
tggatgcagcagaagg

SEQ ID NO: 525416 - DNA, 16 bp, R. norvegicus
tggatgcccaggtggg

SEQ ID NO: 525417 - DNA, 16 bp, R. norvegicus
tggatgccctgactga

SEQ ID NO: 525418 - DNA, 16 bp, R. norvegicus
tggatgccctggtgaa

SEQ ID NO: 525419 - DNA, 16 bp, R. norvegicus
tggatgcctgggatga

SEQ ID NO: 525420 - DNA, 16 bp, R. norvegicus
tggatgctccagtcct

SEQ ID NO: 525421 - DNA, 16 bp, R. norvegicus
tggatgcttccatcct

SEQ ID NO: 525422 - DNA, 16 bp, R. norvegicus
tggatggaaaactggg

SEQ ID NO: 525423 - DNA, 16 bp, R. norvegicus
tggatggaactgaaaa

SEQ ID NO: 525424 - DNA, 16 bp, R. norvegicus
tggatggaaggaaaga

SEQ ID NO: 525425 - DNA, 16 bp, R. norvegicus
tggatggacagaagga

SEQ ID NO: 525426 - DNA, 16 bp, R. norvegicus
tggatggacagatggg

SEQ ID NO: 525427 - DNA, 16 bp, R. norvegicus
tggatggataggtaga

SEQ ID NO: 525428 - DNA, 16 bp, R. norvegicus
tggatggatgaacaga

SEQ ID NO: 525429 - DNA, 16 bp, R. norvegicus
tggatggatggactga

SEQ ID NO: 525430 - DNA, 16 bp, R. norvegicus
tggatggcagaggcca

SEQ ID NO: 525431 - DNA, 16 bp, R. norvegicus
tggatggcctttccct

SEQ ID NO: 525432 - DNA, 16 bp, R. norvegicus
tggatggctcctgagg

SEQ ID NO: 525433 - DNA, 16 bp, R. norvegicus
tggatggctgtatacg

SEQ ID NO: 525434 - DNA, 16 bp, R. norvegicus
tggatggtggatggat

SEQ ID NO: 525435 - DNA, 16 bp, R. norvegicus
tggatggttttcgctc

SEQ ID NO: 525436 - DNA, 16 bp, R. norvegicus
tggatgtatatgtgtg

SEQ ID NO: 525437 - DNA, 16 bp, R. norvegicus
tggatgtcagaagagg

SEQ ID NO: 525438 - DNA, 16 bp, R. norvegicus
tggatgtcagaggaca

SEQ ID NO: 525439 - DNA, 16 bp, R. norvegicus
tggatgtcctgaaact

SEQ ID NO: 525440 - DNA, 16 bp, R. norvegicus
tggatgtgagccacca

SEQ ID NO: 525441 - DNA, 16 bp, R. norvegicus
tggatgtgtcagaata

SEQ ID NO: 525442 - DNA, 16 bp, R. norvegicus
tggatgtgtcctgaga

SEQ ID NO: 525443 - DNA, 16 bp, R. norvegicus
tggatgtgtgcagagt

SEQ ID NO: 525444 - DNA, 16 bp, R. norvegicus
tggatgttccttcagt

SEQ ID NO: 525445 - DNA, 16 bp, R. norvegicus
tggatgttttgcttgt

SEQ ID NO: 525446 - DNA, 16 bp, R. norvegicus
tggattacctcattca

SEQ ID NO: 525447 - DNA, 16 bp, R. norvegicus
tggattccctggagct

SEQ ID NO: 525448 - DNA, 16 bp, R. norvegicus
tggattcctgtgagtt

SEQ ID NO: 525449 - DNA, 16 bp, R. norvegicus
tggattcctgtgtttg

SEQ ID NO: 525450 - DNA, 16 bp, R. norvegicus
tggattcttcaacttt

SEQ ID NO: 525451 - DNA, 16 bp, R. norvegicus
tggattgaaggagctg

SEQ ID NO: 525452 - DNA, 16 bp, R. norvegicus
tggattgatggatgga

SEQ ID NO: 525453 - DNA, 16 bp, R. norvegicus
tggattggtggaaaga

SEQ ID NO: 525454 - DNA, 16 bp, R. norvegicus
tggatttatgtggagg

SEQ ID NO: 525455 - DNA, 16 bp, R. norvegicus
tggatttatttcccat

SEQ ID NO: 525456 - DNA, 16 bp, R. norvegicus
tggatttcatggatgt

SEQ ID NO: 525457 - DNA, 16 bp, R. norvegicus
tggatttcattatact

SEQ ID NO: 525458 - DNA, 16 bp, R. norvegicus
tggatttcctggacat

SEQ ID NO: 525459 - DNA, 16 bp, R. norvegicus
tggatttctcctttga

SEQ ID NO: 525460 - DNA, 16 bp, R. norvegicus
tggatttgatccccag

SEQ ID NO: 525461 - DNA, 17 bp, R. norvegicus
tggatttggattcctag

SEQ ID NO: 525462 - DNA, 16 bp, R. norvegicus
tggatttgggtgcaga

SEQ ID NO: 525463 - DNA, 16 bp, R. norvegicus
tggatttgtcctttga

SEQ ID NO: 525464 - DNA, 16 bp, R. norvegicus
tggattttaaaagaga

SEQ ID NO: 525465 - DNA, 16 bp, R. norvegicus
tggattttcctttgat

SEQ ID NO: 525466 - DNA, 16 bp, R. norvegicus
tggattttctgtatgt

SEQ ID NO: 525467 - DNA, 16 bp, R. norvegicus
tggattttgtttcttg

SEQ ID NO: 525468 - DNA, 16 bp, R. norvegicus
tggatttttatgaaaa

SEQ ID NO: 525469 - DNA, 16 bp, R. norvegicus
tggatttttccatcta

SEQ ID NO: 525470 - DNA, 16 bp, R. norvegicus
tggatttttcctatga

SEQ ID NO: 525471 - DNA, 16 bp, R. norvegicus
tggattttttttaaag

SEQ ID NO: 525472 - DNA, 16 bp, R. norvegicus
tggcaaaatggacatt

SEQ ID NO: 525473 - DNA, 16 bp, R. norvegicus
tggcaaagactctcag

SEQ ID NO: 525474 - DNA, 16 bp, R. norvegicus
tggcaaagtgcttgcc

SEQ ID NO: 525475 - DNA, 16 bp, R. norvegicus
tggcaaatataatgaa

SEQ ID NO: 525476 - DNA, 16 bp, R. norvegicus
tggcaaatggatggaa

SEQ ID NO: 525477 - DNA, 16 bp, R. norvegicus
tggcaacaaaacaagg

SEQ ID NO: 525478 - DNA, 16 bp, R. norvegicus
tggcaacatagagccc

SEQ ID NO: 525479 - DNA, 16 bp, R. norvegicus
tggcaaccccatcact

SEQ ID NO: 525480 - DNA, 16 bp, R. norvegicus
tggcaagaacaagggc

SEQ ID NO: 525481 - DNA, 16 bp, R. norvegicus
tggcaagaagcaagtg

SEQ ID NO: 525482 - DNA, 16 bp, R. norvegicus
tggcaagagatcacat

SEQ ID NO: 525483 - DNA, 16 bp, R. norvegicus
tggcaagccccttcag

SEQ ID NO: 525484 - DNA, 16 bp, R. norvegicus
tggcaaggatgaggag

SEQ ID NO: 525485 - DNA, 16 bp, R. norvegicus
tggcaaggctgtggag

SEQ ID NO: 525486 - DNA, 16 bp, R. norvegicus
tggcaagttcaaagcc

SEQ ID NO: 525487 - DNA, 16 bp, R. norvegicus
tggcacaagaggaaac

SEQ ID NO: 525488 - DNA, 16 bp, R. norvegicus
tggcacacataccttg

SEQ ID NO: 525489 - DNA, 16 bp, R. norvegicus
tggcacagcctctcag

SEQ ID NO: 525490 - DNA, 16 bp, R. norvegicus
tggcacaggatcagct

SEQ ID NO: 525491 - DNA, 16 bp, R. norvegicus
tggcacagtctctcag

SEQ ID NO: 525492 - DNA, 16 bp, R. norvegicus
tggcaccaccaacaat

SEQ ID NO: 525493 - DNA, 16 bp, R. norvegicus
tggcaccatgaagaga

SEQ ID NO: 525494 - DNA, 16 bp, R. norvegicus
tggcaccattccctaa

SEQ ID NO: 525495 - DNA, 16 bp, R. norvegicus
tggcacccaacaaggc

SEQ ID NO: 525496 - DNA, 16 bp, R. norvegicus
tggcacccacatggtg

SEQ ID NO: 525497 - DNA, 16 bp, R. norvegicus
tggcacgaacacactc

SEQ ID NO: 525498 - DNA, 16 bp, R. norvegicus
tggcactattatgaag

SEQ ID NO: 525499 - DNA, 16 bp, R. norvegicus
tggcactgacatctag

SEQ ID NO: 525500 - DNA, 16 bp, R. norvegicus
tggcactgagattttc

SEQ ID NO: 525501 - DNA, 16 bp, R. norvegicus
tggcactggagaagga

SEQ ID NO: 525502 - DNA, 16 bp, R. norvegicus
tggcactgtttgagaa

SEQ ID NO: 525503 - DNA, 16 bp, R. norvegicus
tggcactgtttgggga

SEQ ID NO: 525504 - DNA, 16 bp, R. norvegicus
tggcagaaaaagaaaa

SEQ ID NO: 525505 - DNA, 16 bp, R. norvegicus
tggcagaaagagagaa

SEQ ID NO: 525506 - DNA, 16 bp, R. norvegicus
tggcagaagaagagaa

SEQ ID NO: 525507 - DNA, 16 bp, R. norvegicus
tggcagaaggagagaa

SEQ ID NO: 525508 - DNA, 16 bp, R. norvegicus
tggcagactctctgca

SEQ ID NO: 525509 - DNA, 16 bp, R. norvegicus
tggcagagaggcagag

SEQ ID NO: 525510 - DNA, 16 bp, R. norvegicus
tggcagagcctttcag

SEQ ID NO: 525511 - DNA, 16 bp, R. norvegicus
tggcagaggaaatctc

SEQ ID NO: 525512 - DNA, 16 bp, R. norvegicus
tggcagaggcagacag

SEQ ID NO: 525513 - DNA, 16 bp, R. norvegicus
tggcagaggcctggct

SEQ ID NO: 525514 - DNA, 16 bp, R. norvegicus
tggcagagtccaggca

SEQ ID NO: 525515 - DNA, 16 bp, R. norvegicus
tggcagcaaacacctt

SEQ ID NO: 525516 - DNA, 16 bp, R. norvegicus
tggcagcacaggccag

SEQ ID NO: 525517 - DNA, 16 bp, R. norvegicus
tggcagcagatgggaa

SEQ ID NO: 525518 - DNA, 16 bp, R. norvegicus
tggcagcagcaaccag

SEQ ID NO: 525519 - DNA, 16 bp, R. norvegicus
tggcagcagcaggcag

SEQ ID NO: 525520 - DNA, 16 bp, R. norvegicus
tggcagcagcttcttg

SEQ ID NO: 525521 - DNA, 16 bp, R. norvegicus
tggcagcaggcagcag

SEQ ID NO: 525522 - DNA, 16 bp, R. norvegicus
tggcagcaggcagctg

SEQ ID NO: 525523 - DNA, 16 bp, R. norvegicus
tggcagcaggggctgg

SEQ ID NO: 525524 - DNA, 16 bp, R. norvegicus
tggcagcagtggcagc

SEQ ID NO: 525525 - DNA, 16 bp, R. norvegicus
tggcagccttatttat

SEQ ID NO: 525526 - DNA, 16 bp, R. norvegicus
tggcagctcagaacca

SEQ ID NO: 525527 - DNA, 16 bp, R. norvegicus
tggcagctcagtgtct

SEQ ID NO: 525528 - DNA, 16 bp, R. norvegicus
tggcagctcataacta

SEQ ID NO: 525529 - DNA, 16 bp, R. norvegicus
tggcagctcttccaga

SEQ ID NO: 525530 - DNA, 16 bp, R. norvegicus
tggcagcttgcacagc

SEQ ID NO: 525531 - DNA, 16 bp, R. norvegicus
tggcagctttggccat

SEQ ID NO: 525532 - DNA, 16 bp, R. norvegicus
tggcaggacaatatgg

SEQ ID NO: 525533 - DNA, 16 bp, R. norvegicus
tggcaggaccaaaagc

SEQ ID NO: 525534 - DNA, 16 bp, R. norvegicus
tggcaggaccatgggc

SEQ ID NO: 525535 - DNA, 16 bp, R. norvegicus
tggcaggagcttgaag

SEQ ID NO: 525536 - DNA, 16 bp, R. norvegicus
tggcaggcctcattct

SEQ ID NO: 525537 - DNA, 16 bp, R. norvegicus
tggcaggctgaccagc

SEQ ID NO: 525538 - DNA, 16 bp, R. norvegicus
tggcagggaagaaaga

SEQ ID NO: 525539 - DNA, 16 bp, R. norvegicus
tggcagggcagtttct

SEQ ID NO: 525540 - DNA, 16 bp, R. norvegicus
tggcagtcaggaagca

SEQ ID NO: 525541 - DNA, 16 bp, R. norvegicus
tggcagtgagcaggca

SEQ ID NO: 525542 - DNA, 16 bp, R. norvegicus
tggcagtgatggcatg

SEQ ID NO: 525543 - DNA, 16 bp, R. norvegicus
tggcagtgatggtggt

SEQ ID NO: 525544 - DNA, 16 bp, R. norvegicus
tggcagtgggcaggca

SEQ ID NO: 525545 - DNA, 16 bp, R. norvegicus
tggcagtgtcctttgc

SEQ ID NO: 525546 - DNA, 16 bp, R. norvegicus
tggcagtgtggcagtg

SEQ ID NO: 525547 - DNA, 16 bp, R. norvegicus
tggcagttcaggagac

SEQ ID NO: 525548 - DNA, 16 bp, R. norvegicus
tggcatcagtgtaaaa

SEQ ID NO: 525549 - DNA, 16 bp, R. norvegicus
tggcatcatcagaacc

SEQ ID NO: 525550 - DNA, 18 bp, R. norvegicus
tggcatcatcagagccca

SEQ ID NO: 525551 - DNA, 16 bp, R. norvegicus
tggcatcattaggagg

SEQ ID NO: 525552 - DNA, 16 bp, R. norvegicus
tggcatccaggcagac

SEQ ID NO: 525553 - DNA, 16 bp, R. norvegicus
tggcatcctctgctac

SEQ ID NO: 525554 - DNA, 20 bp, R. norvegicus
tggcatcctctgtgatgtca

SEQ ID NO: 525555 - DNA, 16 bp, R. norvegicus
tggcatccttctttgc

SEQ ID NO: 525556 - DNA, 16 bp, R. norvegicus
tggcatctccagtaca

SEQ ID NO: 525557 - DNA, 16 bp, R. norvegicus
tggcatcttgggcttg

SEQ ID NO: 525558 - DNA, 16 bp, R. norvegicus
tggcatgatggcaacc

SEQ ID NO: 525559 - DNA, 16 bp, R. norvegicus
tggcatgcaagggact

SEQ ID NO: 525560 - DNA, 16 bp, R. norvegicus
tggcatgcaggtgtac

SEQ ID NO: 525561 - DNA, 16 bp, R. norvegicus
tggcatggctgtggca

SEQ ID NO: 525562 - DNA, 17 bp, R. norvegicus
tggcatgtcctaggctg

SEQ ID NO: 525563 - DNA, 16 bp, R. norvegicus
tggcattaacattgtt

SEQ ID NO: 525564 - DNA, 16 bp, R. norvegicus
tggcattatctcaaaa

SEQ ID NO: 525565 - DNA, 16 bp, R. norvegicus
tggcattatttctatc

SEQ ID NO: 525566 - DNA, 16 bp, R. norvegicus
tggcattgttgtcctt

SEQ ID NO: 525567 - DNA, 16 bp, R. norvegicus
tggcatttgcattctc

SEQ ID NO: 525568 - DNA, 16 bp, R. norvegicus
tggccaaagctgctga

SEQ ID NO: 525569 - DNA, 16 bp, R. norvegicus
tggccaacagaaaaca

SEQ ID NO: 525570 - DNA, 16 bp, R. norvegicus
tggccaaccaataacc

SEQ ID NO: 525571 - DNA, 17 bp, R. norvegicus
tggccaagaaacaccta

SEQ ID NO: 525572 - DNA, 16 bp, R. norvegicus
tggccaagaaagaaat

SEQ ID NO: 525573 - DNA, 16 bp, R. norvegicus
tggccaagaagcaagt

SEQ ID NO: 525574 - DNA, 17 bp, R. norvegicus
tggccaagaagcaccta

SEQ ID NO: 525575 - DNA, 16 bp, R. norvegicus
tggccaagagaatgaa

SEQ ID NO: 525576 - DNA, 16 bp, R. norvegicus
tggccaagatcaataa

SEQ ID NO: 525577 - DNA, 16 bp, R. norvegicus
tggccaaggtcaagcc

SEQ ID NO: 525578 - DNA, 16 bp, R. norvegicus
tggccacaaagcacct

SEQ ID NO: 525579 - DNA, 16 bp, R. norvegicus
tggccacagagactca

SEQ ID NO: 525580 - DNA, 16 bp, R. norvegicus
tggccacagatgttca

SEQ ID NO: 525581 - DNA, 16 bp, R. norvegicus
tggccaccatgcctga

SEQ ID NO: 525582 - DNA, 16 bp, R. norvegicus
tggccactagagggca

SEQ ID NO: 525583 - DNA, 16 bp, R. norvegicus
tggccactgtgcctca

SEQ ID NO: 525584 - DNA, 16 bp, R. norvegicus
tggccagcaaactcca

SEQ ID NO: 525585 - DNA, 16 bp, R. norvegicus
tggccagccagcctca

SEQ ID NO: 525586 - DNA, 16 bp, R. norvegicus
tggccagcctctactc

SEQ ID NO: 525587 - DNA, 16 bp, R. norvegicus
tggccaggagaatgaa

SEQ ID NO: 525588 - DNA, 16 bp, R. norvegicus
tggccaggatgtggag

SEQ ID NO: 525589 - DNA, 16 bp, R. norvegicus
tggccagtgagcacca

SEQ ID NO: 525590 - DNA, 16 bp, R. norvegicus
tggccatagcagctga

SEQ ID NO: 525591 - DNA, 16 bp, R. norvegicus
tggccatagtgtctct

SEQ ID NO: 525592 - DNA, 17 bp, R. norvegicus
tggccatcatcaaagca

SEQ ID NO: 525593 - DNA, 16 bp, R. norvegicus
tggccatcctatcaaa

SEQ ID NO: 525594 - DNA, 16 bp, R. norvegicus
tggccatcctggaact

SEQ ID NO: 525595 - DNA, 16 bp, R. norvegicus
tggccatcttgccaaa

SEQ ID NO: 525596 - DNA, 16 bp, R. norvegicus
tggccatgggtctctg

SEQ ID NO: 525597 - DNA, 16 bp, R. norvegicus
tggccatggtggagca

SEQ ID NO: 525598 - DNA, 16 bp, R. norvegicus
tggccatggtgtctct

SEQ ID NO: 525599 - DNA, 16 bp, R. norvegicus
tggccatgttggagga

SEQ ID NO: 525600 - DNA, 16 bp, R. norvegicus
tggccattcctttggt

SEQ ID NO: 525601 - DNA, 16 bp, R. norvegicus
tggccatttgaccaaa

SEQ ID NO: 525602 - DNA, 16 bp, R. norvegicus
tggccattttccaaaa

SEQ ID NO: 525603 - DNA, 16 bp, R. norvegicus
tggccattttcccaaa

SEQ ID NO: 525604 - DNA, 16 bp, R. norvegicus
tggccatttttaaaat

SEQ ID NO: 525605 - DNA, 16 bp, R. norvegicus
tggcccagaaagtggc

SEQ ID NO: 525606 - DNA, 16 bp, R. norvegicus
tggcccagagacagaa

SEQ ID NO: 525607 - DNA, 16 bp, R. norvegicus
tggcccagagggctgc

SEQ ID NO: 525608 - DNA, 18 bp, R. norvegicus
tggcccagatcccgtgat

SEQ ID NO: 525609 - DNA, 35 bp, R. norvegicus
tggcccagcttggctgtgagcaaaaactcccaggc

SEQ ID NO: 525610 - DNA, 16 bp, R. norvegicus
tggcccaggaagtgac

SEQ ID NO: 525611 - DNA, 16 bp, R. norvegicus
tggcccaggagcggca

SEQ ID NO: 525612 - DNA, 16 bp, R. norvegicus
tggcccaggcagtggc

SEQ ID NO: 525613 - DNA, 16 bp, R. norvegicus
tggcccaggtgcatgc

SEQ ID NO: 525614 - DNA, 16 bp, R. norvegicus
tggcccagtggttaag

SEQ ID NO: 525615 - DNA, 16 bp, R. norvegicus
tggccccacccctcac

SEQ ID NO: 525616 - DNA, 16 bp, R. norvegicus
tggccccagggagtgg

SEQ ID NO: 525617 - DNA, 16 bp, R. norvegicus
tggccccatgcctcaa

SEQ ID NO: 525618 - DNA, 16 bp, R. norvegicus
tggcccggaaacaggg

SEQ ID NO: 525619 - DNA, 16 bp, R. norvegicus
tggccctacctcagga

SEQ ID NO: 525620 - DNA, 16 bp, R. norvegicus
tggccctcctcctcag

SEQ ID NO: 525621 - DNA, 16 bp, R. norvegicus
tggccctcctgcctcc

SEQ ID NO: 525622 - DNA, 16 bp, R. norvegicus
tggccctgcagcagca

SEQ ID NO: 525623 - DNA, 16 bp, R. norvegicus
tggccctggacttttt

SEQ ID NO: 525624 - DNA, 16 bp, R. norvegicus
tggccctggccctgcc

SEQ ID NO: 525625 - DNA, 16 bp, R. norvegicus
tggccctggctgccct

SEQ ID NO: 525626 - DNA, 16 bp, R. norvegicus
tggccctggctgtcct

SEQ ID NO: 525627 - DNA, 16 bp, R. norvegicus
tggccctggtggaggg

SEQ ID NO: 525628 - DNA, 16 bp, R. norvegicus
tggccctggtggcagg

SEQ ID NO: 525629 - DNA, 16 bp, R. norvegicus
tggccctgttggagga

SEQ ID NO: 525630 - DNA, 16 bp, R. norvegicus
tggcctacagtttcag

SEQ ID NO: 525631 - DNA, 16 bp, R. norvegicus
tggcctagaaactggg

SEQ ID NO: 525632 - DNA, 16 bp, R. norvegicus
tggcctagaactccca

SEQ ID NO: 525633 - DNA, 16 bp, R. norvegicus
tggcctcaaaactcac

SEQ ID NO: 525634 - DNA, 16 bp, R. norvegicus
tggcctcaaactcaag

SEQ ID NO: 525635 - DNA, 16 bp, R. norvegicus
tggcctcaaactcaga

SEQ ID NO: 525636 - DNA, 16 bp, R. norvegicus
tggcctcaagctcatg

SEQ ID NO: 525637 - DNA, 16 bp, R. norvegicus
tggcctcagtgggaga

SEQ ID NO: 525638 - DNA, 16 bp, R. norvegicus
tggcctccaacttaca

SEQ ID NO: 525639 - DNA, 16 bp, R. norvegicus
tggcctccacgggcac

SEQ ID NO: 525640 - DNA, 16 bp, R. norvegicus
tggcctccatagactc

SEQ ID NO: 525641 - DNA, 16 bp, R. norvegicus
tggcctccccagtgct

SEQ ID NO: 525642 - DNA, 18 bp, R. norvegicus
tggcctccgccgtgccag

SEQ ID NO: 525643 - DNA, 16 bp, R. norvegicus
tggcctccgtgggaga

SEQ ID NO: 525644 - DNA, 16 bp, R. norvegicus
tggcctcctggcctcc

SEQ ID NO: 525645 - DNA, 16 bp, R. norvegicus
tggcctcctttcctct

SEQ ID NO: 525646 - DNA, 16 bp, R. norvegicus
tggcctcgttggagga

SEQ ID NO: 525647 - DNA, 16 bp, R. norvegicus
tggcctctgaggatac

SEQ ID NO: 525648 - DNA, 16 bp, R. norvegicus
tggcctctgcaaacac

SEQ ID NO: 525649 - DNA, 16 bp, R. norvegicus
tggcctctgcatctgc

SEQ ID NO: 525650 - DNA, 16 bp, R. norvegicus
tggcctctgccatcca

SEQ ID NO: 525651 - DNA, 16 bp, R. norvegicus
tggcctctgcctcagc

SEQ ID NO: 525652 - DNA, 16 bp, R. norvegicus
tggcctctgcctcctg

SEQ ID NO: 525653 - DNA, 16 bp, R. norvegicus
tggcctctgctccttc

SEQ ID NO: 525654 - DNA, 16 bp, R. norvegicus
tggcctctgcttcact

SEQ ID NO: 525655 - DNA, 16 bp, R. norvegicus
tggcctctgcttctgt

SEQ ID NO: 525656 - DNA, 16 bp, R. norvegicus
tggcctctgtaggcat

SEQ ID NO: 525657 - DNA, 16 bp, R. norvegicus
tggcctctgtatttgc

SEQ ID NO: 525658 - DNA, 16 bp, R. norvegicus
tggcctctgtgagcac

SEQ ID NO: 525659 - DNA, 16 bp, R. norvegicus
tggcctctgtggaaga

SEQ ID NO: 525660 - DNA, 16 bp, R. norvegicus
tggcctctgtgggaac

SEQ ID NO: 525661 - DNA, 16 bp, R. norvegicus
tggcctctgtgggctc

SEQ ID NO: 525662 - DNA, 16 bp, R. norvegicus
tggcctctgtggtcac

SEQ ID NO: 525663 - DNA, 16 bp, R. norvegicus
tggcctcttcccttct

SEQ ID NO: 525664 - DNA, 16 bp, R. norvegicus
tggcctcttctggcct

SEQ ID NO: 525665 - DNA, 16 bp, R. norvegicus
tggcctgaaaaccagg

SEQ ID NO: 525666 - DNA, 16 bp, R. norvegicus
tggcctgaactcagag

SEQ ID NO: 525667 - DNA, 16 bp, R. norvegicus
tggcctgaagctcact

SEQ ID NO: 525668 - DNA, 16 bp, R. norvegicus
tggcctgcacacacac

SEQ ID NO: 525669 - DNA, 16 bp, R. norvegicus
tggcctgcaggcagaa

SEQ ID NO: 525670 - DNA, 16 bp, R. norvegicus
tggcctgctcagcctg

SEQ ID NO: 525671 - DNA, 16 bp, R. norvegicus
tggcctggaacccaca

SEQ ID NO: 525672 - DNA, 16 bp, R. norvegicus
tggcctggaactcaga

SEQ ID NO: 525673 - DNA, 16 bp, R. norvegicus
tggcctggaactgact

SEQ ID NO: 525674 - DNA, 16 bp, R. norvegicus
tggcctggagaagcca

SEQ ID NO: 525675 - DNA, 16 bp, R. norvegicus
tggcctggagctcatc

SEQ ID NO: 525676 - DNA, 16 bp, R. norvegicus
tggcctggcctggcct

SEQ ID NO: 525677 - DNA, 16 bp, R. norvegicus
tggcctgggagcacgg

SEQ ID NO: 525678 - DNA, 16 bp, R. norvegicus
tggcctgtgggcatgt

SEQ ID NO: 525679 - DNA, 16 bp, R. norvegicus
tggccttattgggcac

SEQ ID NO: 525680 - DNA, 16 bp, R. norvegicus
tggccttatttgtgat

SEQ ID NO: 525681 - DNA, 16 bp, R. norvegicus
tggccttcctctactc

SEQ ID NO: 525682 - DNA, 16 bp, R. norvegicus
tggccttgaacctgct

SEQ ID NO: 525683 - DNA, 16 bp, R. norvegicus
tggccttgaactctga

SEQ ID NO: 525684 - DNA, 16 bp, R. norvegicus
tggccttgatggagaa

SEQ ID NO: 525685 - DNA, 16 bp, R. norvegicus
tggccttgatttctgt

SEQ ID NO: 525686 - DNA, 21 bp, R. norvegicus
tggccttgcgcttgctaggca

SEQ ID NO: 525687 - DNA, 16 bp, R. norvegicus
tggccttgctggaaga

SEQ ID NO: 525688 - DNA, 16 bp, R. norvegicus
tggccttggactcaga

SEQ ID NO: 525689 - DNA, 16 bp, R. norvegicus
tggccttggccttggc

SEQ ID NO: 525690 - DNA, 16 bp, R. norvegicus
tggccttgggacacac

SEQ ID NO: 525691 - DNA, 16 bp, R. norvegicus
tggccttgggcatcaa

SEQ ID NO: 525692 - DNA, 16 bp, R. norvegicus
tggccttggtggagga

SEQ ID NO: 525693 - DNA, 16 bp, R. norvegicus
tggccttgttgaacat

SEQ ID NO: 525694 - DNA, 16 bp, R. norvegicus
tggccttgttggatga

SEQ ID NO: 525695 - DNA, 16 bp, R. norvegicus
tggccttgttggggga

SEQ ID NO: 525696 - DNA, 16 bp, R. norvegicus
tggcctttcattcagt

SEQ ID NO: 525697 - DNA, 16 bp, R. norvegicus
tggcctttccttcagt

SEQ ID NO: 525698 - DNA, 16 bp, R. norvegicus
tggcctttggtggtaa

SEQ ID NO: 525699 - DNA, 16 bp, R. norvegicus
tggcgagaagtctggt

SEQ ID NO: 525700 - DNA, 16 bp, R. norvegicus
tggcgaggatatggag

SEQ ID NO: 525701 - DNA, 16 bp, R. norvegicus
tggcgcaagaggaaac

SEQ ID NO: 525702 - DNA, 16 bp, R. norvegicus
tggcgcaggcctttaa

SEQ ID NO: 525703 - DNA, 16 bp, R. norvegicus
tggcgccctcttctgg

SEQ ID NO: 525704 - DNA, 16 bp, R. norvegicus
tggcgctggcttctgc

SEQ ID NO: 525705 - DNA, 16 bp, R. norvegicus
tggcggcagcaaccag

SEQ ID NO: 525706 - DNA, 16 bp, R. norvegicus
tggcggcggcagcagc

SEQ ID NO: 525707 - DNA, 38 bp, R. norvegicus
tggctaagatcaaaaactcaggtgacagcagatgctgg

SEQ ID NO: 525708 - DNA, 16 bp, R. norvegicus
tggctaagatcaaaac

SEQ ID NO: 525709 - DNA, 16 bp, R. norvegicus
tggctaatgtctcagc

SEQ ID NO: 525710 - DNA, 16 bp, R. norvegicus
tggctacaacttcaag

SEQ ID NO: 525711 - DNA, 16 bp, R. norvegicus
tggctacaggaggtgg

SEQ ID NO: 525712 - DNA, 16 bp, R. norvegicus
tggctaccctgaaact

SEQ ID NO: 525713 - DNA, 16 bp, R. norvegicus
tggctacctgcacaag

SEQ ID NO: 525714 - DNA, 16 bp, R. norvegicus
tggctactgatttgtt

SEQ ID NO: 525715 - DNA, 16 bp, R. norvegicus
tggctacttcataact

SEQ ID NO: 525716 - DNA, 16 bp, R. norvegicus
tggctagcctggaact

SEQ ID NO: 525717 - DNA, 16 bp, R. norvegicus
tggctatcctggatct

SEQ ID NO: 525718 - DNA, 16 bp, R. norvegicus
tggctatcctgggact

SEQ ID NO: 525719 - DNA, 16 bp, R. norvegicus
tggctcaaagtggcta

SEQ ID NO: 525720 - DNA, 16 bp, R. norvegicus
tggctcacaaccatcc

SEQ ID NO: 525721 - DNA, 16 bp, R. norvegicus
tggctcacacctgtga

SEQ ID NO: 525722 - DNA, 16 bp, R. norvegicus
tggctcacacttcatt

SEQ ID NO: 525723 - DNA, 16 bp, R. norvegicus
tggctcacaggttcag

SEQ ID NO: 525724 - DNA, 16 bp, R. norvegicus
tggctcacagtttgga

SEQ ID NO: 525725 - DNA, 16 bp, R. norvegicus
tggctcagcagacaga

SEQ ID NO: 525726 - DNA, 16 bp, R. norvegicus
tggctcagcagctcag

SEQ ID NO: 525727 - DNA, 16 bp, R. norvegicus
tggctcagcaggaaga

SEQ ID NO: 525728 - DNA, 16 bp, R. norvegicus
tggctcagcaggtaac

SEQ ID NO: 525729 - DNA, 16 bp, R. norvegicus
tggctcagcaggtaca

SEQ ID NO: 525730 - DNA, 16 bp, R. norvegicus
tggctcagccaataaa

SEQ ID NO: 525731 - DNA, 16 bp, R. norvegicus
tggctcagctgataaa

SEQ ID NO: 525732 - DNA, 16 bp, R. norvegicus
tggctcagctgtgaag

SEQ ID NO: 525733 - DNA, 16 bp, R. norvegicus
tggctcagtcaataaa

SEQ ID NO: 525734 - DNA, 16 bp, R. norvegicus
tggctcagtcagtcaa

SEQ ID NO: 525735 - DNA, 16 bp, R. norvegicus
tggctcagtgcctaag

SEQ ID NO: 525736 - DNA, 16 bp, R. norvegicus
tggctcagtggctaaa

SEQ ID NO: 525737 - DNA, 16 bp, R. norvegicus
tggctcagtggctaag

SEQ ID NO: 525738 - DNA, 16 bp, R. norvegicus
tggctcagtgggtaga

SEQ ID NO: 525739 - DNA, 16 bp, R. norvegicus
tggctcagtgggtcag

SEQ ID NO: 525740 - DNA, 31 bp, R. norvegicus
tggctcagtggtagagcccctgcctagaatc

SEQ ID NO: 525741 - DNA, 16 bp, R. norvegicus
tggctcagtggttaaa

SEQ ID NO: 525742 - DNA, 16 bp, R. norvegicus
tggctcagttggtaaa

SEQ ID NO: 525743 - DNA, 16 bp, R. norvegicus
tggctcatgctctaag

SEQ ID NO: 525744 - DNA, 16 bp, R. norvegicus
tggctccaaaaagaaa

SEQ ID NO: 525745 - DNA, 16 bp, R. norvegicus
tggctccaaatgcata

SEQ ID NO: 525746 - DNA, 16 bp, R. norvegicus
tggctccatgctgccc

SEQ ID NO: 525747 - DNA, 16 bp, R. norvegicus
tggctccctccatgtg

SEQ ID NO: 525748 - DNA, 16 bp, R. norvegicus
tggctcctgtcttagg

SEQ ID NO: 525749 - DNA, 16 bp, R. norvegicus
tggctccttctgggtg

SEQ ID NO: 525750 - DNA, 16 bp, R. norvegicus
tggctcctttgtcaag

SEQ ID NO: 525751 - DNA, 16 bp, R. norvegicus
tggctctactctgttt

SEQ ID NO: 525752 - DNA, 16 bp, R. norvegicus
tggctctcccactgcc

SEQ ID NO: 525753 - DNA, 16 bp, R. norvegicus
tggctctctccttcta

SEQ ID NO: 525754 - DNA, 16 bp, R. norvegicus
tggctctctggggtct

SEQ ID NO: 525755 - DNA, 16 bp, R. norvegicus
tggctctgagtatctg

SEQ ID NO: 525756 - DNA, 16 bp, R. norvegicus
tggctctgcacccagt

SEQ ID NO: 525757 - DNA, 16 bp, R. norvegicus
tggctctgcagctttt

SEQ ID NO: 525758 - DNA, 16 bp, R. norvegicus
tggctctgcctctgcc

SEQ ID NO: 525759 - DNA, 16 bp, R. norvegicus
tggctctggctgcata

SEQ ID NO: 525760 - DNA, 16 bp, R. norvegicus
tggctctggctttaga

SEQ ID NO: 525761 - DNA, 16 bp, R. norvegicus
tggctctgtgagtaaa

SEQ ID NO: 525762 - DNA, 16 bp, R. norvegicus
tggctctgtggctctg

SEQ ID NO: 525763 - DNA, 16 bp, R. norvegicus
tggctcttacactctt

SEQ ID NO: 525764 - DNA, 16 bp, R. norvegicus
tggctcttacagtctt

SEQ ID NO: 525765 - DNA, 16 bp, R. norvegicus
tggctcttctagctca

SEQ ID NO: 525766 - DNA, 16 bp, R. norvegicus
tggctgaagtcatggg

SEQ ID NO: 525767 - DNA, 16 bp, R. norvegicus
tggctgaatataaaat

SEQ ID NO: 525768 - DNA, 16 bp, R. norvegicus
tggctgacaagtacct

SEQ ID NO: 525769 - DNA, 16 bp, R. norvegicus
tggctgacagccatct

SEQ ID NO: 525770 - DNA, 16 bp, R. norvegicus
tggctgaccagcaaac

SEQ ID NO: 525771 - DNA, 16 bp, R. norvegicus
tggctgagaaacaact

SEQ ID NO: 525772 - DNA, 16 bp, R. norvegicus
tggctgagaagaactt

SEQ ID NO: 525773 - DNA, 16 bp, R. norvegicus
tggctgagaagcacct

SEQ ID NO: 525774 - DNA, 16 bp, R. norvegicus
tggctgagaagcccct

SEQ ID NO: 525775 - DNA, 16 bp, R. norvegicus
tggctgagaagctcct

SEQ ID NO: 525776 - DNA, 16 bp, R. norvegicus
tggctgagaaggacct

SEQ ID NO: 525777 - DNA, 16 bp, R. norvegicus
tggctgagaagtacct

SEQ ID NO: 525778 - DNA, 16 bp, R. norvegicus
tggctgagaagttcct

SEQ ID NO: 525779 - DNA, 16 bp, R. norvegicus
tggctgagctgaagca

SEQ ID NO: 525780 - DNA, 16 bp, R. norvegicus
tggctgaggagatggc

SEQ ID NO: 525781 - DNA, 16 bp, R. norvegicus
tggctgcagagatggc

SEQ ID NO: 525782 - DNA, 16 bp, R. norvegicus
tggctgcagcactcag

SEQ ID NO: 525783 - DNA, 16 bp, R. norvegicus
tggctgcagctgctgc

SEQ ID NO: 525784 - DNA, 16 bp, R. norvegicus
tggctgcagggagctg

SEQ ID NO: 525785 - DNA, 16 bp, R. norvegicus
tggctgcataaacaag

SEQ ID NO: 525786 - DNA, 16 bp, R. norvegicus
tggctgccccagaact

SEQ ID NO: 525787 - DNA, 16 bp, R. norvegicus
tggctgccctagaact

SEQ ID NO: 525788 - DNA, 16 bp, R. norvegicus
tggctgccctggagct

SEQ ID NO: 525789 - DNA, 16 bp, R. norvegicus
tggctgcccttgcaga

SEQ ID NO: 525790 - DNA, 16 bp, R. norvegicus
tggctgcctctgtctc

SEQ ID NO: 525791 - DNA, 16 bp, R. norvegicus
tggctgccttttgccc

SEQ ID NO: 525792 - DNA, 16 bp, R. norvegicus
tggctgctactctgcc

SEQ ID NO: 525793 - DNA, 16 bp, R. norvegicus
tggctgctccttcaga

SEQ ID NO: 525794 - DNA, 16 bp, R. norvegicus
tggctgctcttccaca

SEQ ID NO: 525795 - DNA, 16 bp, R. norvegicus
tggctgctcttcccaa

SEQ ID NO: 525796 - DNA, 16 bp, R. norvegicus
tggctgctcttcctga

SEQ ID NO: 525797 - DNA, 16 bp, R. norvegicus
tggctgctcttctgga

SEQ ID NO: 525798 - DNA, 16 bp, R. norvegicus
tggctgctgagagaga

SEQ ID NO: 525799 - DNA, 16 bp, R. norvegicus
tggctgctgagggagg

SEQ ID NO: 525800 - DNA, 16 bp, R. norvegicus
tggctgctgccgccgc

SEQ ID NO: 525801 - DNA, 16 bp, R. norvegicus
tggctgctggaaattg

SEQ ID NO: 525802 - DNA, 16 bp, R. norvegicus
tggctgctggcatctt

SEQ ID NO: 525803 - DNA, 16 bp, R. norvegicus
tggctgctggctggct

SEQ ID NO: 525804 - DNA, 16 bp, R. norvegicus
tggctgcttacatctc

SEQ ID NO: 525805 - DNA, 16 bp, R. norvegicus
tggctgcttatgggat

SEQ ID NO: 525806 - DNA, 16 bp, R. norvegicus
tggctgcttccttctg

SEQ ID NO: 525807 - DNA, 17 bp, R. norvegicus
tggctggaaaacaactt

SEQ ID NO: 525808 - DNA, 16 bp, R. norvegicus
tggctggagacactgg

SEQ ID NO: 525809 - DNA, 16 bp, R. norvegicus
tggctggagacatgtg

SEQ ID NO: 525810 - DNA, 16 bp, R. norvegicus
tggctggagacattgg

SEQ ID NO: 525811 - DNA, 16 bp, R. norvegicus
tggctggatttgtaga

SEQ ID NO: 525812 - DNA, 16 bp, R. norvegicus
tggctggccaggaact

SEQ ID NO: 525813 - DNA, 16 bp, R. norvegicus
tggctggccaggaagc

SEQ ID NO: 525814 - DNA, 16 bp, R. norvegicus
tggctggccagtctag

SEQ ID NO: 525815 - DNA, 16 bp, R. norvegicus
tggctggcctagaact

SEQ ID NO: 525816 - DNA, 16 bp, R. norvegicus
tggctggcctgcagaa

SEQ ID NO: 525817 - DNA, 16 bp, R. norvegicus
tggctggcctggacct

SEQ ID NO: 525818 - DNA, 16 bp, R. norvegicus
tggctggctggctgct

SEQ ID NO: 525819 - DNA, 16 bp, R. norvegicus
tggctgggaagatggc

SEQ ID NO: 525820 - DNA, 16 bp, R. norvegicus
tggctgggaagggaga

SEQ ID NO: 525821 - DNA, 16 bp, R. norvegicus
tggctgggagaagagg

SEQ ID NO: 525822 - DNA, 16 bp, R. norvegicus
tggctgggcagaaaga

SEQ ID NO: 525823 - DNA, 16 bp, R. norvegicus
tggctggtgaggtcat

SEQ ID NO: 525824 - DNA, 16 bp, R. norvegicus
tggctggttacctctc

SEQ ID NO: 525825 - DNA, 16 bp, R. norvegicus
tggctgtatttgcttc

SEQ ID NO: 525826 - DNA, 16 bp, R. norvegicus
tggctgtcatgaaact

SEQ ID NO: 525827 - DNA, 16 bp, R. norvegicus
tggctgtccaagaact

SEQ ID NO: 525828 - DNA, 16 bp, R. norvegicus
tggctgtccaggaact

SEQ ID NO: 525829 - DNA, 16 bp, R. norvegicus
tggctgtcccaaaact

SEQ ID NO: 525830 - DNA, 16 bp, R. norvegicus
tggctgtcctagaact

SEQ ID NO: 525831 - DNA, 16 bp, R. norvegicus
tggctgtcctagactc

SEQ ID NO: 525832 - DNA, 16 bp, R. norvegicus
tggctgtcctgaaact

SEQ ID NO: 525833 - DNA, 16 bp, R. norvegicus
tggctgtcctgaactt

SEQ ID NO: 525834 - DNA, 16 bp, R. norvegicus
tggctgtcctggaact

SEQ ID NO: 525835 - DNA, 16 bp, R. norvegicus
tggctgtcctggtgct

SEQ ID NO: 525836 - DNA, 16 bp, R. norvegicus
tggctgtctggagtct

SEQ ID NO: 525837 - DNA, 16 bp, R. norvegicus
tggctgtctgggaact

SEQ ID NO: 525838 - DNA, 16 bp, R. norvegicus
tggctgtcttctgaga

SEQ ID NO: 525839 - DNA, 16 bp, R. norvegicus
tggctgtcttggaact

SEQ ID NO: 525840 - DNA, 16 bp, R. norvegicus
tggctgtcttggacct

SEQ ID NO: 525841 - DNA, 16 bp, R. norvegicus
tggctgtgagacacca

SEQ ID NO: 525842 - DNA, 16 bp, R. norvegicus
tggctgtgagcagcca

SEQ ID NO: 525843 - DNA, 16 bp, R. norvegicus
tggctgtgagcattcg

SEQ ID NO: 525844 - DNA, 16 bp, R. norvegicus
tggctgtgcctctctc

SEQ ID NO: 525845 - DNA, 16 bp, R. norvegicus
tggctgtgctctggtg

SEQ ID NO: 525846 - DNA, 16 bp, R. norvegicus
tggctgtgcttctcag

SEQ ID NO: 525847 - DNA, 16 bp, R. norvegicus
tggctgtggctggctg

SEQ ID NO: 525848 - DNA, 16 bp, R. norvegicus
tggctgtgggtgtctg

SEQ ID NO: 525849 - DNA, 16 bp, R. norvegicus
tggctgtgggtttctt

SEQ ID NO: 525850 - DNA, 16 bp, R. norvegicus
tggctgtgtctttcag

SEQ ID NO: 525851 - DNA, 16 bp, R. norvegicus
tggctgttctagaact

SEQ ID NO: 525852 - DNA, 16 bp, R. norvegicus
tggctgttcttccaga

SEQ ID NO: 525853 - DNA, 16 bp, R. norvegicus
tggctgtttctgctgg

SEQ ID NO: 525854 - DNA, 16 bp, R. norvegicus
tggctgttttagaact

SEQ ID NO: 525855 - DNA, 16 bp, R. norvegicus
tggcttaccagctgta

SEQ ID NO: 525856 - DNA, 16 bp, R. norvegicus
tggcttatatccactt

SEQ ID NO: 525857 - DNA, 16 bp, R. norvegicus
tggcttcacttctcca

SEQ ID NO: 525858 - DNA, 16 bp, R. norvegicus
tggcttcctttggatg

SEQ ID NO: 525859 - DNA, 16 bp, R. norvegicus
tggcttcctttgggtg

SEQ ID NO: 525860 - DNA, 16 bp, R. norvegicus
tggcttctctctcagc

SEQ ID NO: 525861 - DNA, 16 bp, R. norvegicus
tggcttctgagaattc

SEQ ID NO: 525862 - DNA, 16 bp, R. norvegicus
tggcttctgcattagc

SEQ ID NO: 525863 - DNA, 16 bp, R. norvegicus
tggcttctgctccagt

SEQ ID NO: 525864 - DNA, 16 bp, R. norvegicus
tggcttcttcatcaaa

SEQ ID NO: 525865 - DNA, 16 bp, R. norvegicus
tggcttctttatttaa

SEQ ID NO: 525866 - DNA, 16 bp, R. norvegicus
tggcttctttgtgaaa

SEQ ID NO: 525867 - DNA, 16 bp, R. norvegicus
tggcttctttgttaaa

SEQ ID NO: 525868 - DNA, 16 bp, R. norvegicus
tggcttgctgctggca

SEQ ID NO: 525869 - DNA, 16 bp, R. norvegicus
tggcttgcttagcttg

SEQ ID NO: 525870 - DNA, 16 bp, R. norvegicus
tggctttcaaccatct

SEQ ID NO: 525871 - DNA, 16 bp, R. norvegicus
tggctttcagcagggg

SEQ ID NO: 525872 - DNA, 16 bp, R. norvegicus
tggctttctctcctgc

SEQ ID NO: 525873 - DNA, 16 bp, R. norvegicus
tggctttcttcatgct

SEQ ID NO: 525874 - DNA, 16 bp, R. norvegicus
tggctttgagcatcca

SEQ ID NO: 525875 - DNA, 16 bp, R. norvegicus
tggcttttacttatga

SEQ ID NO: 525876 - DNA, 16 bp, R. norvegicus
tggcttttatgtggat

SEQ ID NO: 525877 - DNA, 16 bp, R. norvegicus
tggcttttctttttaa

SEQ ID NO: 525878 - DNA, 16 bp, R. norvegicus
tggctttttaaaaaaa

SEQ ID NO: 525879 - DNA, 16 bp, R. norvegicus
tggctttttaaaaaat

SEQ ID NO: 525880 - DNA, 16 bp, R. norvegicus
tggctttttacatgag

SEQ ID NO: 525881 - DNA, 16 bp, R. norvegicus
tggctttttcttctgg

SEQ ID NO: 525882 - DNA, 16 bp, R. norvegicus
tgggaaaaagaagaac

SEQ ID NO: 525883 - DNA, 16 bp, R. norvegicus
tgggaaaagaagagac

SEQ ID NO: 525884 - DNA, 16 bp, R. norvegicus
tgggaaaagatcctta

SEQ ID NO: 525885 - DNA, 16 bp, R. norvegicus
tgggaaaagatctttg

SEQ ID NO: 525886 - DNA, 16 bp, R. norvegicus
tgggaaaccgggaaaa

SEQ ID NO: 525887 - DNA, 16 bp, R. norvegicus
tgggaaactgaggcag

SEQ ID NO: 525888 - DNA, 16 bp, R. norvegicus
tgggaaagagctttga

SEQ ID NO: 525889 - DNA, 16 bp, R. norvegicus
tgggaaatctttccat

SEQ ID NO: 525890 - DNA, 16 bp, R. norvegicus
tgggaaatgtagttct

SEQ ID NO: 525891 - DNA, 16 bp, R. norvegicus
tgggaaatttcaacac

SEQ ID NO: 525892 - DNA, 16 bp, R. norvegicus
tgggaacagaaagctg

SEQ ID NO: 525893 - DNA, 16 bp, R. norvegicus
tgggaacagagagctg

SEQ ID NO: 525894 - DNA, 16 bp, R. norvegicus
tgggaacatcagaaat

SEQ ID NO: 525895 - DNA, 16 bp, R. norvegicus
tgggaaccaaaccagg

SEQ ID NO: 525896 - DNA, 16 bp, R. norvegicus
tgggaactacaagttc

SEQ ID NO: 525897 - DNA, 16 bp, R. norvegicus
tgggaactgaaccctg

SEQ ID NO: 525898 - DNA, 16 bp, R. norvegicus
tgggaactgaagctgg

SEQ ID NO: 525899 - DNA, 16 bp, R. norvegicus
tgggaactgaatgtgg

SEQ ID NO: 525900 - DNA, 16 bp, R. norvegicus
tgggaactgcccagct

SEQ ID NO: 525901 - DNA, 16 bp, R. norvegicus
tgggaagaaaaacaaa

SEQ ID NO: 525902 - DNA, 16 bp, R. norvegicus
tgggaagaagaaagca

SEQ ID NO: 525903 - DNA, 16 bp, R. norvegicus
tgggaagaagtggatt

SEQ ID NO: 525904 - DNA, 16 bp, R. norvegicus
tgggaagacagaggca

SEQ ID NO: 525905 - DNA, 16 bp, R. norvegicus
tgggaagacagctcag

SEQ ID NO: 525906 - DNA, 16 bp, R. norvegicus
tgggaagacgtccacg

SEQ ID NO: 525907 - DNA, 16 bp, R. norvegicus
tgggaagagacctcat

SEQ ID NO: 525908 - DNA, 16 bp, R. norvegicus
tgggaagagagacaga

SEQ ID NO: 525909 - DNA, 16 bp, R. norvegicus
tgggaagaggaaacct

SEQ ID NO: 525910 - DNA, 16 bp, R. norvegicus
tgggaagaggaacaaa

SEQ ID NO: 525911 - DNA, 16 bp, R. norvegicus
tgggaagagggaacct

SEQ ID NO: 525912 - DNA, 16 bp, R. norvegicus
tgggaagatggcccag

SEQ ID NO: 525913 - DNA, 16 bp, R. norvegicus
tgggaagcaagaagag

SEQ ID NO: 525914 - DNA, 16 bp, R. norvegicus
tgggaagcagacacag

SEQ ID NO: 525915 - DNA, 16 bp, R. norvegicus
tgggaagcagagacag

SEQ ID NO: 525916 - DNA, 16 bp, R. norvegicus
tgggaagcagagagag

SEQ ID NO: 525917 - DNA, 16 bp, R. norvegicus
tgggaagcagaggcgg

SEQ ID NO: 525918 - DNA, 16 bp, R. norvegicus
tgggaagctgaggaag

SEQ ID NO: 525919 - DNA, 16 bp, R. norvegicus
tgggaaggaagagtga

SEQ ID NO: 525920 - DNA, 16 bp, R. norvegicus
tgggaaggaagcagag

SEQ ID NO: 525921 - DNA, 16 bp, R. norvegicus
tgggaaggattgtggg

SEQ ID NO: 525922 - DNA, 16 bp, R. norvegicus
tgggaaggcaggaggg

SEQ ID NO: 525923 - DNA, 16 bp, R. norvegicus
tgggaaggctgagaac

SEQ ID NO: 525924 - DNA, 16 bp, R. norvegicus
tgggaaggtggtcctg

SEQ ID NO: 525925 - DNA, 16 bp, R. norvegicus
tgggaagtagaggcag

SEQ ID NO: 525926 - DNA, 16 bp, R. norvegicus
tgggaatagaacttgg

SEQ ID NO: 525927 - DNA, 16 bp, R. norvegicus
tgggaatatagctcag

SEQ ID NO: 525928 - DNA, 16 bp, R. norvegicus
tgggaatatggctcag

SEQ ID NO: 525929 - DNA, 16 bp, R. norvegicus
tgggaatcaaactcag

SEQ ID NO: 525930 - DNA, 16 bp, R. norvegicus
tgggaatgccaagaag

SEQ ID NO: 525931 - DNA, 16 bp, R. norvegicus
tgggaatggaactcag

SEQ ID NO: 525932 - DNA, 16 bp, R. norvegicus
tgggaatgggaacagg

SEQ ID NO: 525933 - DNA, 16 bp, R. norvegicus
tgggaatgtaaattag

SEQ ID NO: 525934 - DNA, 16 bp, R. norvegicus
tgggaattgaacccca

SEQ ID NO: 525935 - DNA, 16 bp, R. norvegicus
tgggaattgtattgaa

SEQ ID NO: 525936 - DNA, 24 bp, R. norvegicus
tgggaatttagctcagtggtagag

SEQ ID NO: 525937 - DNA, 16 bp, R. norvegicus
tgggacaaaaaggcca

SEQ ID NO: 525938 - DNA, 16 bp, R. norvegicus
tgggacactatggtgc

SEQ ID NO: 525939 - DNA, 16 bp, R. norvegicus
tgggacagagacagac

SEQ ID NO: 525940 - DNA, 16 bp, R. norvegicus
tgggacagtcattggt

SEQ ID NO: 525941 - DNA, 16 bp, R. norvegicus
tgggacagttgatgct

SEQ ID NO: 525942 - DNA, 16 bp, R. norvegicus
tgggacatgttcttct

SEQ ID NO: 525943 - DNA, 16 bp, R. norvegicus
tgggaccacccaccca

SEQ ID NO: 525944 - DNA, 16 bp, R. norvegicus
tgggaccagccagagc

SEQ ID NO: 525945 - DNA, 16 bp, R. norvegicus
tgggaccagctggagc

SEQ ID NO: 525946 - DNA, 16 bp, R. norvegicus
tgggaccaggcacttc

SEQ ID NO: 525947 - DNA, 16 bp, R. norvegicus
tgggaccaggtcagct

SEQ ID NO: 525948 - DNA, 16 bp, R. norvegicus
tgggacccagaagtcc

SEQ ID NO: 525949 - DNA, 16 bp, R. norvegicus
tgggaccctgagaagc

SEQ ID NO: 525950 - DNA, 16 bp, R. norvegicus
tgggactcagttctct

SEQ ID NO: 525951 - DNA, 16 bp, R. norvegicus
tgggactcagtttccc

SEQ ID NO: 525952 - DNA, 16 bp, R. norvegicus
tgggactcctaaagca

SEQ ID NO: 525953 - DNA, 16 bp, R. norvegicus
tgggactcctgagttt

SEQ ID NO: 525954 - DNA, 16 bp, R. norvegicus
tgggactctgcatctg

SEQ ID NO: 525955 - DNA, 16 bp, R. norvegicus
tgggactggagagatg

SEQ ID NO: 525956 - DNA, 16 bp, R. norvegicus
tgggactgggaagaaa

SEQ ID NO: 525957 - DNA, 16 bp, R. norvegicus
tgggactgggctccac

SEQ ID NO: 525958 - DNA, 16 bp, R. norvegicus
tgggacttgggcagtg

SEQ ID NO: 525959 - DNA, 16 bp, R. norvegicus
tgggagaaagctgttg

SEQ ID NO: 525960 - DNA, 16 bp, R. norvegicus
tgggagaaataatctt

SEQ ID NO: 525961 - DNA, 16 bp, R. norvegicus
tgggagaacctggagg

SEQ ID NO: 525962 - DNA, 16 bp, R. norvegicus
tgggagaagaagccct

SEQ ID NO: 525963 - DNA, 16 bp, R. norvegicus
tgggagaagagaactg

SEQ ID NO: 525964 - DNA, 16 bp, R. norvegicus
tgggagaagagtttga

SEQ ID NO: 525965 - DNA, 16 bp, R. norvegicus
tgggagaaggagaatt

SEQ ID NO: 525966 - DNA, 16 bp, R. norvegicus
tgggagaaggggtatt

SEQ ID NO: 525967 - DNA, 16 bp, R. norvegicus
tgggagaatgggaatg

SEQ ID NO: 525968 - DNA, 16 bp, R. norvegicus
tgggagacagagccag

SEQ ID NO: 525969 - DNA, 16 bp, R. norvegicus
tgggagacagagctca

SEQ ID NO: 525970 - DNA, 16 bp, R. norvegicus
tgggagacagaggaag

SEQ ID NO: 525971 - DNA, 16 bp, R. norvegicus
tgggagacagaggtgg

SEQ ID NO: 525972 - DNA, 16 bp, R. norvegicus
tgggagacagagtcag

SEQ ID NO: 525973 - DNA, 16 bp, R. norvegicus
tgggagacttcactct

SEQ ID NO: 525974 - DNA, 16 bp, R. norvegicus
tgggagagagaactca

SEQ ID NO: 525975 - DNA, 16 bp, R. norvegicus
tgggagagagagctca

SEQ ID NO: 525976 - DNA, 16 bp, R. norvegicus
tgggagagtttggaga

SEQ ID NO: 525977 - DNA, 16 bp, R. norvegicus
tgggagatgtgtggct

SEQ ID NO: 525978 - DNA, 16 bp, R. norvegicus
tgggagcagagagatg

SEQ ID NO: 525979 - DNA, 16 bp, R. norvegicus
tgggagcagatgcaga

SEQ ID NO: 525980 - DNA, 16 bp, R. norvegicus
tgggagcagtgagctg

SEQ ID NO: 525981 - DNA, 16 bp, R. norvegicus
tgggagcatggggctg

SEQ ID NO: 525982 - DNA, 16 bp, R. norvegicus
tgggagccagaggcag

SEQ ID NO: 525983 - DNA, 16 bp, R. norvegicus
tgggagcctggcatgg

SEQ ID NO: 525984 - DNA, 16 bp, R. norvegicus
tgggagctctggaggg

SEQ ID NO: 525985 - DNA, 16 bp, R. norvegicus
tgggagctctggggag

SEQ ID NO: 525986 - DNA, 16 bp, R. norvegicus
tgggagctctggtggt

SEQ ID NO: 525987 - DNA, 16 bp, R. norvegicus
tgggagctgaaccaaa

SEQ ID NO: 525988 - DNA, 16 bp, R. norvegicus
tgggagctgaactcag

SEQ ID NO: 525989 - DNA, 16 bp, R. norvegicus
tgggagctggagacag

SEQ ID NO: 525990 - DNA, 16 bp, R. norvegicus
tgggagctggggaccg

SEQ ID NO: 525991 - DNA, 16 bp, R. norvegicus
tgggagctttgggggt

SEQ ID NO: 525992 - DNA, 16 bp, R. norvegicus
tgggaggaagagacag

SEQ ID NO: 525993 - DNA, 16 bp, R. norvegicus
tgggaggactgctctt

SEQ ID NO: 525994 - DNA, 16 bp, R. norvegicus
tgggaggagaagcccc

SEQ ID NO: 525995 - DNA, 16 bp, R. norvegicus
tgggaggagacagagg

SEQ ID NO: 525996 - DNA, 16 bp, R. norvegicus
tgggaggagagaacca

SEQ ID NO: 525997 - DNA, 16 bp, R. norvegicus
tgggaggagcctagtg

SEQ ID NO: 525998 - DNA, 16 bp, R. norvegicus
tgggaggagggtggca

SEQ ID NO: 525999 - DNA, 16 bp, R. norvegicus
tgggaggatgaggcag

SEQ ID NO: 526000 - DNA, 16 bp, R. norvegicus
tgggaggcaaaagcag

SEQ ID NO: 526001 - DNA, 16 bp, R. norvegicus
tgggaggcagagaaag

SEQ ID NO: 526002 - DNA, 16 bp, R. norvegicus
tgggaggcaggcagtg

SEQ ID NO: 526003 - DNA, 16 bp, R. norvegicus
tgggaggcctcccctt

SEQ ID NO: 526004 - DNA, 17 bp, R. norvegicus
tgggaggcgtggcaggt

SEQ ID NO: 526005 - DNA, 16 bp, R. norvegicus
tgggaggctaaggcaa

SEQ ID NO: 526006 - DNA, 16 bp, R. norvegicus
tgggaggctgaggaag

SEQ ID NO: 526007 - DNA, 16 bp, R. norvegicus
tgggaggggaggacct

SEQ ID NO: 526008 - DNA, 16 bp, R. norvegicus
tgggaggggcatgtga

SEQ ID NO: 526009 - DNA, 16 bp, R. norvegicus
tgggaggtaaagacag

SEQ ID NO: 526010 - DNA, 16 bp, R. norvegicus
tgggaggtgaagacag

SEQ ID NO: 526011 - DNA, 16 bp, R. norvegicus
tgggaggtgcaggcag

SEQ ID NO: 526012 - DNA, 16 bp, R. norvegicus
tgggaggtggaggcaa

SEQ ID NO: 526013 - DNA, 16 bp, R. norvegicus
tgggaggtggggagac

SEQ ID NO: 526014 - DNA, 16 bp, R. norvegicus
tgggagtcagctctct

SEQ ID NO: 526015 - DNA, 16 bp, R. norvegicus
tgggagtgagagcatc

SEQ ID NO: 526016 - DNA, 16 bp, R. norvegicus
tgggagtgcaaatttg

SEQ ID NO: 526017 - DNA, 16 bp, R. norvegicus
tgggagtggctgggtg

SEQ ID NO: 526018 - DNA, 16 bp, R. norvegicus
tgggagttccttctgc

SEQ ID NO: 526019 - DNA, 16 bp, R. norvegicus
tgggagtttatacttt

SEQ ID NO: 526020 - DNA, 16 bp, R. norvegicus
tgggagtttgaggtca

SEQ ID NO: 526021 - DNA, 16 bp, R. norvegicus
tgggatacatgaaacc

SEQ ID NO: 526022 - DNA, 16 bp, R. norvegicus
tgggatattttcatct

SEQ ID NO: 526023 - DNA, 16 bp, R. norvegicus
tgggatccacagacag

SEQ ID NO: 526024 - DNA, 16 bp, R. norvegicus
tgggatccttttcctc

SEQ ID NO: 526025 - DNA, 16 bp, R. norvegicus
tgggatctgacagtga

SEQ ID NO: 526026 - DNA, 16 bp, R. norvegicus
tgggatctgatgatgc

SEQ ID NO: 526027 - DNA, 16 bp, R. norvegicus
tgggatcttctggctt

SEQ ID NO: 526028 - DNA, 16 bp, R. norvegicus
tgggatgaactagaaa

SEQ ID NO: 526029 - DNA, 16 bp, R. norvegicus
tgggatgaagaactct

SEQ ID NO: 526030 - DNA, 16 bp, R. norvegicus
tgggatgagaggccct

SEQ ID NO: 526031 - DNA, 41 bp, R. norvegicus
tgggatgagatggaccatctgattccacctcccaacaggat

SEQ ID NO: 526032 - DNA, 16 bp, R. norvegicus
tgggatggacccccag

SEQ ID NO: 526033 - DNA, 16 bp, R. norvegicus
tgggatggagaagaaa

SEQ ID NO: 526034 - DNA, 16 bp, R. norvegicus
tgggatggatcccagg

SEQ ID NO: 526035 - DNA, 16 bp, R. norvegicus
tgggatgtaaagtgaa

SEQ ID NO: 526036 - DNA, 16 bp, R. norvegicus
tgggatgtaaattaat

SEQ ID NO: 526037 - DNA, 16 bp, R. norvegicus
tgggatgtggaacagt

SEQ ID NO: 526038 - DNA, 16 bp, R. norvegicus
tgggattaaaaatgtg

SEQ ID NO: 526039 - DNA, 16 bp, R. norvegicus
tgggattaaaggcagc

SEQ ID NO: 526040 - DNA, 16 bp, R. norvegicus
tgggattaaaggcatt

SEQ ID NO: 526041 - DNA, 16 bp, R. norvegicus
tgggattaaaggtata

SEQ ID NO: 526042 - DNA, 16 bp, R. norvegicus
tgggattacaagcaag

SEQ ID NO: 526043 - DNA, 16 bp, R. norvegicus
tgggattacagacagg

SEQ ID NO: 526044 - DNA, 16 bp, R. norvegicus
tgggattacagatggg

SEQ ID NO: 526045 - DNA, 16 bp, R. norvegicus
tgggattacagctgtg

SEQ ID NO: 526046 - DNA, 16 bp, R. norvegicus
tgggattacaggcaca

SEQ ID NO: 526047 - DNA, 16 bp, R. norvegicus
tgggattaggacagaa

SEQ ID NO: 526048 - DNA, 16 bp, R. norvegicus
tgggattataagcata

SEQ ID NO: 526049 - DNA, 16 bp, R. norvegicus
tgggattcctgtgtgt

SEQ ID NO: 526050 - DNA, 16 bp, R. norvegicus
tgggattgcaacctgg

SEQ ID NO: 526051 - DNA, 16 bp, R. norvegicus
tgggattgcttcaggt

SEQ ID NO: 526052 - DNA, 16 bp, R. norvegicus
tgggattgtaagctgg

SEQ ID NO: 526053 - DNA, 16 bp, R. norvegicus
tgggatttctgttgtt

SEQ ID NO: 526054 - DNA, 16 bp, R. norvegicus
tgggcaaagctagagc

SEQ ID NO: 526055 - DNA, 41 bp, R. norvegicus
tgggcaaatggttggaactggaaaatatcatcctgagtgag

SEQ ID NO: 526056 - DNA, 16 bp, R. norvegicus
tgggcaaattccaaac

SEQ ID NO: 526057 - DNA, 16 bp, R. norvegicus
tgggcaatgccatcct

SEQ ID NO: 526058 - DNA, 16 bp, R. norvegicus
tgggcacacacataca

SEQ ID NO: 526059 - DNA, 16 bp, R. norvegicus
tgggcacagatgtgtg

SEQ ID NO: 526060 - DNA, 16 bp, R. norvegicus
tgggcacatacacaca

SEQ ID NO: 526061 - DNA, 16 bp, R. norvegicus
tgggcacccatgggag

SEQ ID NO: 526062 - DNA, 16 bp, R. norvegicus
tgggcactgggaatca

SEQ ID NO: 526063 - DNA, 16 bp, R. norvegicus
tgggcagaaactgcct

SEQ ID NO: 526064 - DNA, 16 bp, R. norvegicus
tgggcagaagaaacat

SEQ ID NO: 526065 - DNA, 16 bp, R. norvegicus
tgggcagaagtggcaa

SEQ ID NO: 526066 - DNA, 16 bp, R. norvegicus
tgggcagattttctgc

SEQ ID NO: 526067 - DNA, 16 bp, R. norvegicus
tgggcagcaagcactt

SEQ ID NO: 526068 - DNA, 23 bp, R. norvegicus
tgggcagcaccccacgagcgaac

SEQ ID NO: 526069 - DNA, 16 bp, R. norvegicus
tgggcagcagcaggag

SEQ ID NO: 526070 - DNA, 16 bp, R. norvegicus
tgggcagccttctcta

SEQ ID NO: 526071 - DNA, 16 bp, R. norvegicus
tgggcagctctgggga

SEQ ID NO: 526072 - DNA, 16 bp, R. norvegicus
tgggcaggaggtcctg

SEQ ID NO: 526073 - DNA, 16 bp, R. norvegicus
tgggcagggaagggag

SEQ ID NO: 526074 - DNA, 16 bp, R. norvegicus
tgggcagggcagggca

SEQ ID NO: 526075 - DNA, 16 bp, R. norvegicus
tgggcagggtggcaca

SEQ ID NO: 526076 - DNA, 16 bp, R. norvegicus
tgggcaggtgaggaag

SEQ ID NO: 526077 - DNA, 16 bp, R. norvegicus
tgggcagtgccacccc

SEQ ID NO: 526078 - DNA, 16 bp, R. norvegicus
tgggcagtgctggtgg

SEQ ID NO: 526079 - DNA, 16 bp, R. norvegicus
tgggcagtggatggag

SEQ ID NO: 526080 - DNA, 16 bp, R. norvegicus
tgggcagtgtgtgtgt

SEQ ID NO: 526081 - DNA, 17 bp, R. norvegicus
tgggcatatacccaaac

SEQ ID NO: 526082 - DNA, 16 bp, R. norvegicus
tgggcatcaaacccag

SEQ ID NO: 526083 - DNA, 16 bp, R. norvegicus
tgggcatcactgggag

SEQ ID NO: 526084 - DNA, 16 bp, R. norvegicus
tgggcatcactttctt

SEQ ID NO: 526085 - DNA, 16 bp, R. norvegicus
tgggcatcccttcctg

SEQ ID NO: 526086 - DNA, 16 bp, R. norvegicus
tgggcatctccttctt

SEQ ID NO: 526087 - DNA, 19 bp, R. norvegicus
tgggcatcttttgggtata

SEQ ID NO: 526088 - DNA, 16 bp, R. norvegicus
tgggcatgggctttaa

SEQ ID NO: 526089 - DNA, 17 bp, R. norvegicus
tgggcatgggtgggcag

SEQ ID NO: 526090 - DNA, 16 bp, R. norvegicus
tgggcatggtggtaca

SEQ ID NO: 526091 - DNA, 16 bp, R. norvegicus
tgggcatggtggtgcc

SEQ ID NO: 526092 - DNA, 16 bp, R. norvegicus
tgggcatgtggctcag

SEQ ID NO: 526093 - DNA, 16 bp, R. norvegicus
tgggcattccttctgc

SEQ ID NO: 526094 - DNA, 16 bp, R. norvegicus
tgggcattctgtcatt

SEQ ID NO: 526095 - DNA, 16 bp, R. norvegicus
tgggcattttttggtt

SEQ ID NO: 526096 - DNA, 16 bp, R. norvegicus
tgggccaccatggaat

SEQ ID NO: 526097 - DNA, 16 bp, R. norvegicus
tgggccacgccttctg

SEQ ID NO: 526098 - DNA, 16 bp, R. norvegicus
tgggccacttcctaac

SEQ ID NO: 526099 - DNA, 16 bp, R. norvegicus
tgggccagagatgtgg

SEQ ID NO: 526100 - DNA, 16 bp, R. norvegicus
tgggccagccagggct

SEQ ID NO: 526101 - DNA, 16 bp, R. norvegicus
tgggccagcctgggct

SEQ ID NO: 526102 - DNA, 16 bp, R. norvegicus
tgggccagctgtgggg

SEQ ID NO: 526103 - DNA, 16 bp, R. norvegicus
tgggccagggatctgg

SEQ ID NO: 526104 - DNA, 16 bp, R. norvegicus
tgggccaggtccacac

SEQ ID NO: 526105 - DNA, 16 bp, R. norvegicus
tgggccagtaagatgg

SEQ ID NO: 526106 - DNA, 16 bp, R. norvegicus
tgggccagtagccttt

SEQ ID NO: 526107 - DNA, 16 bp, R. norvegicus
tgggccagtcactgaa

SEQ ID NO: 526108 - DNA, 16 bp, R. norvegicus
tgggccagtcactggg

SEQ ID NO: 526109 - DNA, 16 bp, R. norvegicus
tgggccagtgagatgg

SEQ ID NO: 526110 - DNA, 16 bp, R. norvegicus
tgggcccatgccaagg

SEQ ID NO: 526111 - DNA, 28 bp, R. norvegicus
tgggccctcccccacgggaacccagagg

SEQ ID NO: 526112 - DNA, 16 bp, R. norvegicus
tgggccctcccccagg

SEQ ID NO: 526113 - DNA, 16 bp, R. norvegicus
tgggccctggagaaaa

SEQ ID NO: 526114 - DNA, 16 bp, R. norvegicus
tgggccgggatcagca

SEQ ID NO: 526115 - DNA, 16 bp, R. norvegicus
tgggcctcagtggaag

SEQ ID NO: 526116 - DNA, 16 bp, R. norvegicus
tgggcctcagtttccc

SEQ ID NO: 526117 - DNA, 16 bp, R. norvegicus
tgggcctctctttctt

SEQ ID NO: 526118 - DNA, 16 bp, R. norvegicus
tgggcctctgggcatg

SEQ ID NO: 526119 - DNA, 16 bp, R. norvegicus
tgggcctggagagatg

SEQ ID NO: 526120 - DNA, 16 bp, R. norvegicus
tgggcctggcttaagc

SEQ ID NO: 526121 - DNA, 16 bp, R. norvegicus
tgggcctggggagatg

SEQ ID NO: 526122 - DNA, 16 bp, R. norvegicus
tgggcctggtttgagc

SEQ ID NO: 526123 - DNA, 16 bp, R. norvegicus
tgggcctgtgaacctg

SEQ ID NO: 526124 - DNA, 16 bp, R. norvegicus
tgggcctgtgtcctgt

SEQ ID NO: 526125 - DNA, 16 bp, R. norvegicus
tgggccttaagtcaaa

SEQ ID NO: 526126 - DNA, 16 bp, R. norvegicus
tgggcgtggtggcaca

SEQ ID NO: 526127 - DNA, 16 bp, R. norvegicus
tgggctacaagagacc

SEQ ID NO: 526128 - DNA, 16 bp, R. norvegicus
tgggctacacagcaaa

SEQ ID NO: 526129 - DNA, 16 bp, R. norvegicus
tgggctacacagtgac

SEQ ID NO: 526130 - DNA, 16 bp, R. norvegicus
tgggctacagagcaaa

SEQ ID NO: 526131 - DNA, 16 bp, R. norvegicus
tgggctacatgagacc

SEQ ID NO: 526132 - DNA, 16 bp, R. norvegicus
tgggctatataagaaa

SEQ ID NO: 526133 - DNA, 16 bp, R. norvegicus
tgggctatctactgag

SEQ ID NO: 526134 - DNA, 16 bp, R. norvegicus
tgggctccgatgatga

SEQ ID NO: 526135 - DNA, 16 bp, R. norvegicus
tgggctcttcccagca

SEQ ID NO: 526136 - DNA, 16 bp, R. norvegicus
tgggctgaaaaagaaa

SEQ ID NO: 526137 - DNA, 16 bp, R. norvegicus
tgggctgaagagatgg

SEQ ID NO: 526138 - DNA, 16 bp, R. norvegicus
tgggctgacatctgtg

SEQ ID NO: 526139 - DNA, 16 bp, R. norvegicus
tgggctgagaaagaaa

SEQ ID NO: 526140 - DNA, 16 bp, R. norvegicus
tgggctgctgctggca

SEQ ID NO: 526141 - DNA, 16 bp, R. norvegicus
tgggctggaagggagg

SEQ ID NO: 526142 - DNA, 16 bp, R. norvegicus
tgggctggaccctccc

SEQ ID NO: 526143 - DNA, 16 bp, R. norvegicus
tgggctggacctaggc

SEQ ID NO: 526144 - DNA, 16 bp, R. norvegicus
tgggctggagagatgg

SEQ ID NO: 526145 - DNA, 16 bp, R. norvegicus
tgggctggagagctgg

SEQ ID NO: 526146 - DNA, 17 bp, R. norvegicus
tgggctggatccccaga

SEQ ID NO: 526147 - DNA, 16 bp, R. norvegicus
tgggctggcatttgtg

SEQ ID NO: 526148 - DNA, 16 bp, R. norvegicus
tgggctggcctagaac

SEQ ID NO: 526149 - DNA, 16 bp, R. norvegicus
tgggctgggagatggc

SEQ ID NO: 526150 - DNA, 16 bp, R. norvegicus
tgggctgggcacaggg

SEQ ID NO: 526151 - DNA, 16 bp, R. norvegicus
tgggctgggccctcac

SEQ ID NO: 526152 - DNA, 16 bp, R. norvegicus
tgggctgggctgggca

SEQ ID NO: 526153 - DNA, 16 bp, R. norvegicus
tgggctgggtccccag

SEQ ID NO: 526154 - DNA, 16 bp, R. norvegicus
tgggctggtggttctg

SEQ ID NO: 526155 - DNA, 16 bp, R. norvegicus
tgggctggttgtcctg

SEQ ID NO: 526156 - DNA, 16 bp, R. norvegicus
tgggcttcccctcccc

SEQ ID NO: 526157 - DNA, 16 bp, R. norvegicus
tgggcttggtggctgt

SEQ ID NO: 526158 - DNA, 16 bp, R. norvegicus
tgggcttgtaacctgg

SEQ ID NO: 526159 - DNA, 16 bp, R. norvegicus
tgggctttaacaccct

SEQ ID NO: 526160 - DNA, 16 bp, R. norvegicus
tgggctttaagaccct

SEQ ID NO: 526161 - DNA, 16 bp, R. norvegicus
tgggctttgagaccct

SEQ ID NO: 526162 - DNA, 16 bp, R. norvegicus
tgggctttgaggtcct

SEQ ID NO: 526163 - DNA, 17 bp, R. norvegicus
tgggctttgctggatcc

SEQ ID NO: 526164 - DNA, 25 bp, R. norvegicus
tggggaaaaaacgccccgggagaga

SEQ ID NO: 526165 - DNA, 16 bp, R. norvegicus
tggggaaactgaagca

SEQ ID NO: 526166 - DNA, 16 bp, R. norvegicus
tggggaaactgaggaa

SEQ ID NO: 526167 - DNA, 16 bp, R. norvegicus
tggggaaaggattgag

SEQ ID NO: 526168 - DNA, 16 bp, R. norvegicus
tggggaaatagctcag

SEQ ID NO: 526169 - DNA, 16 bp, R. norvegicus
tggggaaatggctcag

SEQ ID NO: 526170 - DNA, 16 bp, R. norvegicus
tggggaacaccctcat

SEQ ID NO: 526171 - DNA, 16 bp, R. norvegicus
tggggaacagaggcag

SEQ ID NO: 526172 - DNA, 16 bp, R. norvegicus
tggggaactggtggta

SEQ ID NO: 526173 - DNA, 16 bp, R. norvegicus
tggggaactgtgggta

SEQ ID NO: 526174 - DNA, 16 bp, R. norvegicus
tggggaagagagcaga

SEQ ID NO: 526175 - DNA, 16 bp, R. norvegicus
tggggaagagtctaga

SEQ ID NO: 526176 - DNA, 16 bp, R. norvegicus
tggggaagcagagagg

SEQ ID NO: 526177 - DNA, 16 bp, R. norvegicus
tggggaagctggggct

SEQ ID NO: 526178 - DNA, 16 bp, R. norvegicus
tggggaatatttcctg

SEQ ID NO: 526179 - DNA, 16 bp, R. norvegicus
tggggaatgaaggatt

SEQ ID NO: 526180 - DNA, 16 bp, R. norvegicus
tggggacagagacaga

SEQ ID NO: 526181 - DNA, 16 bp, R. norvegicus
tggggacatccttgtg

SEQ ID NO: 526182 - DNA, 16 bp, R. norvegicus
tggggacatggatcag

SEQ ID NO: 526183 - DNA, 16 bp, R. norvegicus
tggggaccaagccttc

SEQ ID NO: 526184 - DNA, 17 bp, R. norvegicus
tggggacccaacccagg

SEQ ID NO: 526185 - DNA, 16 bp, R. norvegicus
tggggacccagttctc

SEQ ID NO: 526186 - DNA, 16 bp, R. norvegicus
tggggacccctgagcc

SEQ ID NO: 526187 - DNA, 16 bp, R. norvegicus
tggggaccctgtcctc

SEQ ID NO: 526188 - DNA, 16 bp, R. norvegicus
tggggactctgttctc

SEQ ID NO: 526189 - DNA, 24 bp, R. norvegicus
tggggacttagctcagtggtagag

SEQ ID NO: 526190 - DNA, 16 bp, R. norvegicus
tggggagaaaagggac

SEQ ID NO: 526191 - DNA, 16 bp, R. norvegicus
tggggagaaaagggct

SEQ ID NO: 526192 - DNA, 16 bp, R. norvegicus
tggggagaaagggttt

SEQ ID NO: 526193 - DNA, 16 bp, R. norvegicus
tggggagagagacaga

SEQ ID NO: 526194 - DNA, 16 bp, R. norvegicus
tggggagagggctcag

SEQ ID NO: 526195 - DNA, 16 bp, R. norvegicus
tggggagatggcacag

SEQ ID NO: 526196 - DNA, 16 bp, R. norvegicus
tggggagatggctcag

SEQ ID NO: 526197 - DNA, 16 bp, R. norvegicus
tggggagcaagccaga

SEQ ID NO: 526198 - DNA, 16 bp, R. norvegicus
tggggagccagagccc

SEQ ID NO: 526199 - DNA, 16 bp, R. norvegicus
tggggagccatgaaga

SEQ ID NO: 526200 - DNA, 17 bp, R. norvegicus
tggggagcgaacccagg

SEQ ID NO: 526201 - DNA, 16 bp, R. norvegicus
tggggagcttccccag

SEQ ID NO: 526202 - DNA, 16 bp, R. norvegicus
tggggaggactgtgga

SEQ ID NO: 526203 - DNA, 16 bp, R. norvegicus
tggggaggatgcggag

SEQ ID NO: 526204 - DNA, 16 bp, R. norvegicus
tggggaggcagaagca

SEQ ID NO: 526205 - DNA, 16 bp, R. norvegicus
tggggaggcagaagta

SEQ ID NO: 526206 - DNA, 16 bp, R. norvegicus
tggggaggcagctcag

SEQ ID NO: 526207 - DNA, 16 bp, R. norvegicus
tggggaggcaggaaag

SEQ ID NO: 526208 - DNA, 16 bp, R. norvegicus
tggggaggcaggggca

SEQ ID NO: 526209 - DNA, 16 bp, R. norvegicus
tggggaggcctggcag

SEQ ID NO: 526210 - DNA, 16 bp, R. norvegicus
tggggaggctggagag

SEQ ID NO: 526211 - DNA, 16 bp, R. norvegicus
tggggaggggaacacc

SEQ ID NO: 526212 - DNA, 16 bp, R. norvegicus
tggggaggtggcccag

SEQ ID NO: 526213 - DNA, 16 bp, R. norvegicus
tggggagttagctcag

SEQ ID NO: 526214 - DNA, 16 bp, R. norvegicus
tggggatacagcccat

SEQ ID NO: 526215 - DNA, 16 bp, R. norvegicus
tggggatcaaacacag

SEQ ID NO: 526216 - DNA, 16 bp, R. norvegicus
tggggatgctgggact

SEQ ID NO: 526217 - DNA, 16 bp, R. norvegicus
tggggatggggcagag

SEQ ID NO: 526218 - DNA, 16 bp, R. norvegicus
tggggatgtgagacta

SEQ ID NO: 526219 - DNA, 16 bp, R. norvegicus
tggggattgaacccag

SEQ ID NO: 526220 - DNA, 16 bp, R. norvegicus
tggggattgaaccttg

SEQ ID NO: 526221 - DNA, 16 bp, R. norvegicus
tggggattgcattgat

SEQ ID NO: 526222 - DNA, 24 bp, R. norvegicus
tggggatttagctcagtggtagag

SEQ ID NO: 526223 - DNA, 16 bp, R. norvegicus
tggggatttgagtcca

SEQ ID NO: 526224 - DNA, 16 bp, R. norvegicus
tggggcaacaccctca

SEQ ID NO: 526225 - DNA, 16 bp, R. norvegicus
tggggcacagccctgg

SEQ ID NO: 526226 - DNA, 16 bp, R. norvegicus
tggggcagacactgaa

SEQ ID NO: 526227 - DNA, 16 bp, R. norvegicus
tggggcagcccagaac

SEQ ID NO: 526228 - DNA, 16 bp, R. norvegicus
tggggcaggagtgggt

SEQ ID NO: 526229 - DNA, 16 bp, R. norvegicus
tggggcaggcactgaa

SEQ ID NO: 526230 - DNA, 16 bp, R. norvegicus
tggggcagtctgtgga

SEQ ID NO: 526231 - DNA, 16 bp, R. norvegicus
tggggcagtttctgga

SEQ ID NO: 526232 - DNA, 16 bp, R. norvegicus
tggggcattcacaaaa

SEQ ID NO: 526233 - DNA, 16 bp, R. norvegicus
tggggcattttccagc

SEQ ID NO: 526234 - DNA, 16 bp, R. norvegicus
tggggccacatgtggg

SEQ ID NO: 526235 - DNA, 16 bp, R. norvegicus
tggggccagaagaggg

SEQ ID NO: 526236 - DNA, 16 bp, R. norvegicus
tggggcccagtgtcct

SEQ ID NO: 526237 - DNA, 16 bp, R. norvegicus
tggggcctcctgtctc

SEQ ID NO: 526238 - DNA, 16 bp, R. norvegicus
tggggcctgaactcag

SEQ ID NO: 526239 - DNA, 16 bp, R. norvegicus
tggggcggagcctaga

SEQ ID NO: 526240 - DNA, 16 bp, R. norvegicus
tggggctcacagcctc

SEQ ID NO: 526241 - DNA, 16 bp, R. norvegicus
tggggctccctggcca

SEQ ID NO: 526242 - DNA, 16 bp, R. norvegicus
tggggctcctgcagct

SEQ ID NO: 526243 - DNA, 16 bp, R. norvegicus
tggggctcgctggcca

SEQ ID NO: 526244 - DNA, 16 bp, R. norvegicus
tggggctgaggctggg

SEQ ID NO: 526245 - DNA, 16 bp, R. norvegicus
tggggctgcaagcccc

SEQ ID NO: 526246 - DNA, 16 bp, R. norvegicus
tggggctgcagagatg

SEQ ID NO: 526247 - DNA, 16 bp, R. norvegicus
tggggctgctggggct

SEQ ID NO: 526248 - DNA, 16 bp, R. norvegicus
tggggctggaaagatg

SEQ ID NO: 526249 - DNA, 16 bp, R. norvegicus
tggggctggaggagct

SEQ ID NO: 526250 - DNA, 16 bp, R. norvegicus
tggggctggagggatg

SEQ ID NO: 526251 - DNA, 16 bp, R. norvegicus
tggggctggcttacag

SEQ ID NO: 526252 - DNA, 16 bp, R. norvegicus
tggggctgggactggg

SEQ ID NO: 526253 - DNA, 16 bp, R. norvegicus
tggggctgggaggaga

SEQ ID NO: 526254 - DNA, 16 bp, R. norvegicus
tggggctgggatgttg

SEQ ID NO: 526255 - DNA, 16 bp, R. norvegicus
tggggctggtagctgg

SEQ ID NO: 526256 - DNA, 16 bp, R. norvegicus
tgggggaaggactgag

SEQ ID NO: 526257 - DNA, 16 bp, R. norvegicus
tgggggaattaccatc

SEQ ID NO: 526258 - DNA, 16 bp, R. norvegicus
tgggggacagagagtt

SEQ ID NO: 526259 - DNA, 16 bp, R. norvegicus
tgggggagctggagag

SEQ ID NO: 526260 - DNA, 16 bp, R. norvegicus
tgggggatggggaact

SEQ ID NO: 526261 - DNA, 16 bp, R. norvegicus
tgggggcatcaagcct

SEQ ID NO: 526262 - DNA, 16 bp, R. norvegicus
tgggggccagcagaaa

SEQ ID NO: 526263 - DNA, 18 bp, R. norvegicus
tgggggctcgtccgggat

SEQ ID NO: 526264 - DNA, 17 bp, R. norvegicus
tgggggctggagagatg

SEQ ID NO: 526265 - DNA, 16 bp, R. norvegicus
tgggggctgggaattg

SEQ ID NO: 526266 - DNA, 16 bp, R. norvegicus
tggggggaatacctgt

SEQ ID NO: 526267 - DNA, 16 bp, R. norvegicus
tggggggttatggaca

SEQ ID NO: 526268 - DNA, 16 bp, R. norvegicus
tgggggtaccccaacc

SEQ ID NO: 526269 - DNA, 16 bp, R. norvegicus
tgggggtggacttgga

SEQ ID NO: 526270 - DNA, 16 bp, R. norvegicus
tgggggtggactttga

SEQ ID NO: 526271 - DNA, 16 bp, R. norvegicus
tgggggtggggctcag

SEQ ID NO: 526272 - DNA, 16 bp, R. norvegicus
tggggtatgccagcca

SEQ ID NO: 526273 - DNA, 16 bp, R. norvegicus
tggggtcacaggtgtg

SEQ ID NO: 526274 - DNA, 16 bp, R. norvegicus
tggggtccctgggctc

SEQ ID NO: 526275 - DNA, 16 bp, R. norvegicus
tggggtcctctgcaag

SEQ ID NO: 526276 - DNA, 16 bp, R. norvegicus
tggggtctctctccca

SEQ ID NO: 526277 - DNA, 16 bp, R. norvegicus
tggggtgaagaattcc

SEQ ID NO: 526278 - DNA, 16 bp, R. norvegicus
tggggtgtggttcagt

SEQ ID NO: 526279 - DNA, 16 bp, R. norvegicus
tggggttaaaaaaaaa

SEQ ID NO: 526280 - DNA, 16 bp, R. norvegicus
tggggttccctgagct

SEQ ID NO: 526281 - DNA, 16 bp, R. norvegicus
tggggttcttgcctgg

SEQ ID NO: 526282 - DNA, 17 bp, R. norvegicus
tggggtttgcattgaat

SEQ ID NO: 526283 - DNA, 16 bp, R. norvegicus
tggggtttttttcccc

SEQ ID NO: 526284 - DNA, 16 bp, R. norvegicus
tgggtaaaatgcttgc

SEQ ID NO: 526285 - DNA, 16 bp, R. norvegicus
tgggtaaagaaaatgt

SEQ ID NO: 526286 - DNA, 16 bp, R. norvegicus
tgggtaacttgagctt

SEQ ID NO: 526287 - DNA, 16 bp, R. norvegicus
tgggtaatttgagctt

SEQ ID NO: 526288 - DNA, 16 bp, R. norvegicus
tgggtacagagagcta

SEQ ID NO: 526289 - DNA, 17 bp, R. norvegicus
tgggtacagagagctgt

SEQ ID NO: 526290 - DNA, 16 bp, R. norvegicus
tgggtaccaggcatgc

SEQ ID NO: 526291 - DNA, 16 bp, R. norvegicus
tgggtagaaagattgt

SEQ ID NO: 526292 - DNA, 16 bp, R. norvegicus
tgggtagagagctgga

SEQ ID NO: 526293 - DNA, 31 bp, R. norvegicus
tgggtagcaccccacgagcgaacttgagcct

SEQ ID NO: 526294 - DNA, 16 bp, R. norvegicus
tgggtagcagaggcag

SEQ ID NO: 526295 - DNA, 30 bp, R. norvegicus
tgggtatatgcccaagagaggtatagctgc

SEQ ID NO: 526296 - DNA, 32 bp, R. norvegicus
tgggtatatgcccaagagaggtatagctggac

SEQ ID NO: 526297 - DNA, 65 bp, R. norvegicus
tgggtatatgcccaagagaggtatagctggatccttaggcagttcaatgtccaattttctgagga

SEQ ID NO: 526298 - DNA, 17 bp, R. norvegicus
tgggtatatgcccaagg

SEQ ID NO: 526299 - DNA, 16 bp, R. norvegicus
tgggtatctgggtcct

SEQ ID NO: 526300 - DNA, 16 bp, R. norvegicus
tgggtattcccccatc

SEQ ID NO: 526301 - DNA, 16 bp, R. norvegicus
tgggtcacaccttctg

SEQ ID NO: 526302 - DNA, 20 bp, R. norvegicus
tgggtcactctggatggttt

SEQ ID NO: 526303 - DNA, 16 bp, R. norvegicus
tgggtcagaaaagaaa

SEQ ID NO: 526304 - DNA, 16 bp, R. norvegicus
tgggtcagcctgggct

SEQ ID NO: 526305 - DNA, 16 bp, R. norvegicus
tgggtcagcttgtccc

SEQ ID NO: 526306 - DNA, 17 bp, R. norvegicus
tgggtcagggactgccc

SEQ ID NO: 526307 - DNA, 16 bp, R. norvegicus
tgggtcagtccatgta

SEQ ID NO: 526308 - DNA, 16 bp, R. norvegicus
tgggtcatccttctct

SEQ ID NO: 526309 - DNA, 16 bp, R. norvegicus
tgggtcattttcttga

SEQ ID NO: 526310 - DNA, 16 bp, R. norvegicus
tgggtccccagctctg

SEQ ID NO: 526311 - DNA, 16 bp, R. norvegicus
tgggtccctccatgtg

SEQ ID NO: 526312 - DNA, 17 bp, R. norvegicus
tgggtcctcaggtagta

SEQ ID NO: 526313 - DNA, 16 bp, R. norvegicus
tgggtcctctcatcct

SEQ ID NO: 526314 - DNA, 16 bp, R. norvegicus
tgggtcctctgcaaaa

SEQ ID NO: 526315 - DNA, 16 bp, R. norvegicus
tgggtcctctgggaga

SEQ ID NO: 526316 - DNA, 16 bp, R. norvegicus
tgggtcctgagaattg

SEQ ID NO: 526317 - DNA, 16 bp, R. norvegicus
tgggtcctgggatcaa

SEQ ID NO: 526318 - DNA, 16 bp, R. norvegicus
tgggtctcagaagaga

SEQ ID NO: 526319 - DNA, 16 bp, R. norvegicus
tgggtctgaggatttg

SEQ ID NO: 526320 - DNA, 18 bp, R. norvegicus
tgggtctgtgtcttgagt

SEQ ID NO: 526321 - DNA, 16 bp, R. norvegicus
tgggtctgtgtgtgtc

SEQ ID NO: 526322 - DNA, 16 bp, R. norvegicus
tgggtcttctggaaga

SEQ ID NO: 526323 - DNA, 16 bp, R. norvegicus
tgggtgacagttcaca

SEQ ID NO: 526324 - DNA, 16 bp, R. norvegicus
tgggtgagactgagaa

SEQ ID NO: 526325 - DNA, 16 bp, R. norvegicus
tgggtgcagagccagc

SEQ ID NO: 526326 - DNA, 16 bp, R. norvegicus
tgggtgcaggaaactg

SEQ ID NO: 526327 - DNA, 16 bp, R. norvegicus
tgggtgctcttaaccg

SEQ ID NO: 526328 - DNA, 16 bp, R. norvegicus
tgggtgctggaaactg

SEQ ID NO: 526329 - DNA, 16 bp, R. norvegicus
tgggtgctggagactg

SEQ ID NO: 526330 - DNA, 16 bp, R. norvegicus
tgggtgctgggatctg

SEQ ID NO: 526331 - DNA, 16 bp, R. norvegicus
tgggtgctggggactc

SEQ ID NO: 526332 - DNA, 16 bp, R. norvegicus
tgggtgctggggactt

SEQ ID NO: 526333 - DNA, 16 bp, R. norvegicus
tgggtgctgtgaacca

SEQ ID NO: 526334 - DNA, 16 bp, R. norvegicus
tgggtggatgctggga

SEQ ID NO: 526335 - DNA, 16 bp, R. norvegicus
tgggtggcatcattcc

SEQ ID NO: 526336 - DNA, 16 bp, R. norvegicus
tgggtggccttgaact

SEQ ID NO: 526337 - DNA, 16 bp, R. norvegicus
tgggtggctccatccc

SEQ ID NO: 526338 - DNA, 16 bp, R. norvegicus
tgggtgggaaaccagg

SEQ ID NO: 526339 - DNA, 16 bp, R. norvegicus
tgggtggggcagcacc

SEQ ID NO: 526340 - DNA, 16 bp, R. norvegicus
tgggtggtctgtggca

SEQ ID NO: 526341 - DNA, 16 bp, R. norvegicus
tgggtggtgggctgga

SEQ ID NO: 526342 - DNA, 16 bp, R. norvegicus
tgggtgtccccatccc

SEQ ID NO: 526343 - DNA, 16 bp, R. norvegicus
tgggtgtcctgctcta

SEQ ID NO: 526344 - DNA, 16 bp, R. norvegicus
tgggtgtggtgctgca

SEQ ID NO: 526345 - DNA, 16 bp, R. norvegicus
tgggtgtggtggctta

SEQ ID NO: 526346 - DNA, 16 bp, R. norvegicus
tgggtgtgtcagagct

SEQ ID NO: 526347 - DNA, 16 bp, R. norvegicus
tgggtgttccgctccc

SEQ ID NO: 526348 - DNA, 16 bp, R. norvegicus
tgggtgttgggaatta

SEQ ID NO: 526349 - DNA, 16 bp, R. norvegicus
tgggttaatagccact

SEQ ID NO: 526350 - DNA, 16 bp, R. norvegicus
tgggttatatcactca

SEQ ID NO: 526351 - DNA, 16 bp, R. norvegicus
tgggttatttgctttt

SEQ ID NO: 526352 - DNA, 16 bp, R. norvegicus
tgggttcaaagccagc

SEQ ID NO: 526353 - DNA, 16 bp, R. norvegicus
tgggttcaatcctcag

SEQ ID NO: 526354 - DNA, 16 bp, R. norvegicus
tgggttcacaaacagg

SEQ ID NO: 526355 - DNA, 16 bp, R. norvegicus
tgggttcagggaactg

SEQ ID NO: 526356 - DNA, 16 bp, R. norvegicus
tgggttcagggcagaa

SEQ ID NO: 526357 - DNA, 16 bp, R. norvegicus
tgggttcagtccttag

SEQ ID NO: 526358 - DNA, 16 bp, R. norvegicus
tgggttcagtgcacaa

SEQ ID NO: 526359 - DNA, 16 bp, R. norvegicus
tgggttcagttcccag

SEQ ID NO: 526360 - DNA, 16 bp, R. norvegicus
tgggttcatagaagga

SEQ ID NO: 526361 - DNA, 27 bp, R. norvegicus
tgggttcatttctgggtcttcaattct

SEQ ID NO: 526362 - DNA, 16 bp, R. norvegicus
tgggttccagagatca

SEQ ID NO: 526363 - DNA, 16 bp, R. norvegicus
tgggttccagctcaag

SEQ ID NO: 526364 - DNA, 16 bp, R. norvegicus
tgggttccttccagtt

SEQ ID NO: 526365 - DNA, 16 bp, R. norvegicus
tgggttcgttccagct

SEQ ID NO: 526366 - DNA, 16 bp, R. norvegicus
tgggttctctggaaga

SEQ ID NO: 526367 - DNA, 16 bp, R. norvegicus
tgggttctgagaatca

SEQ ID NO: 526368 - DNA, 16 bp, R. norvegicus
tgggttctgatgatgt

SEQ ID NO: 526369 - DNA, 16 bp, R. norvegicus
tgggttctgggattaa

SEQ ID NO: 526370 - DNA, 16 bp, R. norvegicus
tgggttgcataagaaa

SEQ ID NO: 526371 - DNA, 16 bp, R. norvegicus
tgggtttgatcccagc

SEQ ID NO: 526372 - DNA, 16 bp, R. norvegicus
tgggttttcatatatt

SEQ ID NO: 526373 - DNA, 16 bp, R. norvegicus
tgggtttttttcccct

SEQ ID NO: 526374 - DNA, 16 bp, R. norvegicus
tggtaaaattctgcac

SEQ ID NO: 526375 - DNA, 16 bp, R. norvegicus
tggtaaagtgtttgct

SEQ ID NO: 526376 - DNA, 16 bp, R. norvegicus
tggtacagacctttaa

SEQ ID NO: 526377 - DNA, 30 bp, R. norvegicus
tggtacatctacacaatggaatattaccca

SEQ ID NO: 526378 - DNA, 43 bp, R. norvegicus
tggtacatctacgcaatggaatattactcagctatcaaaaaca

SEQ ID NO: 526379 - DNA, 17 bp, R. norvegicus
tggtacatctccacaat

SEQ ID NO: 526380 - DNA, 16 bp, R. norvegicus
tggtacattctggaag

SEQ ID NO: 526381 - DNA, 16 bp, R. norvegicus
tggtaccatccacaat

SEQ ID NO: 526382 - DNA, 16 bp, R. norvegicus
tggtactgagctcaca

SEQ ID NO: 526383 - DNA, 16 bp, R. norvegicus
tggtactgccaaggct

SEQ ID NO: 526384 - DNA, 16 bp, R. norvegicus
tggtactggaattaca

SEQ ID NO: 526385 - DNA, 16 bp, R. norvegicus
tggtactggttttgaa

SEQ ID NO: 526386 - DNA, 16 bp, R. norvegicus
tggtagaaagcttgcc

SEQ ID NO: 526387 - DNA, 16 bp, R. norvegicus
tggtagaacctctcag

SEQ ID NO: 526388 - DNA, 16 bp, R. norvegicus
tggtagaaggaaagaa

SEQ ID NO: 526389 - DNA, 16 bp, R. norvegicus
tggtagaaggagggaa

SEQ ID NO: 526390 - DNA, 16 bp, R. norvegicus
tggtagagggagagaa

SEQ ID NO: 526391 - DNA, 16 bp, R. norvegicus
tggtagatgtcttcat

SEQ ID NO: 526392 - DNA, 16 bp, R. norvegicus
tggtagcacatgtctg

SEQ ID NO: 526393 - DNA, 16 bp, R. norvegicus
tggtagcagcagcagc

SEQ ID NO: 526394 - DNA, 16 bp, R. norvegicus
tggtagcgcgcttgcc

SEQ ID NO: 526395 - DNA, 16 bp, R. norvegicus
tggtaggagaggccct

SEQ ID NO: 526396 - DNA, 16 bp, R. norvegicus
tggtaggcagaggcag

SEQ ID NO: 526397 - DNA, 16 bp, R. norvegicus
tggtagtatacttaag

SEQ ID NO: 526398 - DNA, 16 bp, R. norvegicus
tggtagtgcatacctt

SEQ ID NO: 526399 - DNA, 16 bp, R. norvegicus
tggtagtgcatgcctt

SEQ ID NO: 526400 - DNA, 16 bp, R. norvegicus
tggtatattcagggct

SEQ ID NO: 526401 - DNA, 16 bp, R. norvegicus
tggtatcctgggtttt

SEQ ID NO: 526402 - DNA, 16 bp, R. norvegicus
tggtatgaagtcttct

SEQ ID NO: 526403 - DNA, 16 bp, R. norvegicus
tggtatgagctcttct

SEQ ID NO: 526404 - DNA, 17 bp, R. norvegicus
tggtatgcactcattgg

SEQ ID NO: 526405 - DNA, 16 bp, R. norvegicus
tggtattgatgactgc

SEQ ID NO: 526406 - DNA, 19 bp, R. norvegicus
tggtcaaaatgccccaggt

SEQ ID NO: 526407 - DNA, 16 bp, R. norvegicus
tggtcaacctgtctgt

SEQ ID NO: 526408 - DNA, 16 bp, R. norvegicus
tggtcaagaagaaata

SEQ ID NO: 526409 - DNA, 16 bp, R. norvegicus
tggtcaagtaagaaat

SEQ ID NO: 526410 - DNA, 16 bp, R. norvegicus
tggtcaatgaagaaat

SEQ ID NO: 526411 - DNA, 16 bp, R. norvegicus
tggtcaattttgggaa

SEQ ID NO: 526412 - DNA, 16 bp, R. norvegicus
tggtcactatgcctca

SEQ ID NO: 526413 - DNA, 16 bp, R. norvegicus
tggtcactggagaaaa

SEQ ID NO: 526414 - DNA, 16 bp, R. norvegicus
tggtcagaagaagaaa

SEQ ID NO: 526415 - DNA, 16 bp, R. norvegicus
tggtcagaagaagcag

SEQ ID NO: 526416 - DNA, 16 bp, R. norvegicus
tggtcagaagttctct

SEQ ID NO: 526417 - DNA, 16 bp, R. norvegicus
tggtcaggagtttgca

SEQ ID NO: 526418 - DNA, 16 bp, R. norvegicus
tggtcaggcactggca

SEQ ID NO: 526419 - DNA, 16 bp, R. norvegicus
tggtcagttgctggca

SEQ ID NO: 526420 - DNA, 17 bp, R. norvegicus
tggtcagttttggagaa

SEQ ID NO: 526421 - DNA, 16 bp, R. norvegicus
tggtcatcgtgtctct

SEQ ID NO: 526422 - DNA, 16 bp, R. norvegicus
tggtcatggtcatggt

SEQ ID NO: 526423 - DNA, 16 bp, R. norvegicus
tggtcatggtggtggt

SEQ ID NO: 526424 - DNA, 16 bp, R. norvegicus
tggtcattgagttgga

SEQ ID NO: 526425 - DNA, 16 bp, R. norvegicus
tggtccaaagaagcaa

SEQ ID NO: 526426 - DNA, 19 bp, R. norvegicus
tggtccaggtgtgtcagtt

SEQ ID NO: 526427 - DNA, 16 bp, R. norvegicus
tggtccatctacacaa

SEQ ID NO: 526428 - DNA, 16 bp, R. norvegicus
tggtccatgggaagtg

SEQ ID NO: 526429 - DNA, 16 bp, R. norvegicus
tggtccccagcaccac

SEQ ID NO: 526430 - DNA, 16 bp, R. norvegicus
tggtccctggatgttc

SEQ ID NO: 526431 - DNA, 16 bp, R. norvegicus
tggtcctcactgtagc

SEQ ID NO: 526432 - DNA, 16 bp, R. norvegicus
tggtcctcaggcagct

SEQ ID NO: 526433 - DNA, 16 bp, R. norvegicus
tggtcctcagtgtagc

SEQ ID NO: 526434 - DNA, 16 bp, R. norvegicus
tggtcctcctacagga

SEQ ID NO: 526435 - DNA, 16 bp, R. norvegicus
tggtcctctgcaagaa

SEQ ID NO: 526436 - DNA, 16 bp, R. norvegicus
tggtcctctggaagaa

SEQ ID NO: 526437 - DNA, 16 bp, R. norvegicus
tggtcctgggaaagct

SEQ ID NO: 526438 - DNA, 16 bp, R. norvegicus
tggtcctgggcatttt

SEQ ID NO: 526439 - DNA, 16 bp, R. norvegicus
tggtcctgggctctgt

SEQ ID NO: 526440 - DNA, 16 bp, R. norvegicus
tggtcctgggctcttt

SEQ ID NO: 526441 - DNA, 16 bp, R. norvegicus
tggtcctgggttctct

SEQ ID NO: 526442 - DNA, 16 bp, R. norvegicus
tggtcctggtgtctgt

SEQ ID NO: 526443 - DNA, 16 bp, R. norvegicus
tggtcctgtggaggcc

SEQ ID NO: 526444 - DNA, 16 bp, R. norvegicus
tggtccttccaaggct

SEQ ID NO: 526445 - DNA, 16 bp, R. norvegicus
tggtccttcgagctgg

SEQ ID NO: 526446 - DNA, 16 bp, R. norvegicus
tggtccttgttgccat

SEQ ID NO: 526447 - DNA, 16 bp, R. norvegicus
tggtcgtgagctacca

SEQ ID NO: 526448 - DNA, 16 bp, R. norvegicus
tggtctaattgctctg

SEQ ID NO: 526449 - DNA, 16 bp, R. norvegicus
tggtctacacagtgac

SEQ ID NO: 526450 - DNA, 16 bp, R. norvegicus
tggtctacagagcaaa

SEQ ID NO: 526451 - DNA, 16 bp, R. norvegicus
tggtctacagagtgaa

SEQ ID NO: 526452 - DNA, 16 bp, R. norvegicus
tggtctacctagtgag

SEQ ID NO: 526453 - DNA, 16 bp, R. norvegicus
tggtctactatgttca

SEQ ID NO: 526454 - DNA, 17 bp, R. norvegicus
tggtctactgtctgagg

SEQ ID NO: 526455 - DNA, 56 bp, R. norvegicus
tggtctatctgtctgtctctgtaccaataccatgcagtttttatcactattgctct

SEQ ID NO: 526456 - DNA, 16 bp, R. norvegicus
tggtctcaggcctgaa

SEQ ID NO: 526457 - DNA, 16 bp, R. norvegicus
tggtctccagctggtg

SEQ ID NO: 526458 - DNA, 16 bp, R. norvegicus
tggtctccatccactc

SEQ ID NO: 526459 - DNA, 16 bp, R. norvegicus
tggtctccatggacac

SEQ ID NO: 526460 - DNA, 16 bp, R. norvegicus
tggtctccattttctg

SEQ ID NO: 526461 - DNA, 16 bp, R. norvegicus
tggtctcccttcttct

SEQ ID NO: 526462 - DNA, 16 bp, R. norvegicus
tggtctcggtctggtc

SEQ ID NO: 526463 - DNA, 16 bp, R. norvegicus
tggtctctcttcacag

SEQ ID NO: 526464 - DNA, 16 bp, R. norvegicus
tggtctctgaggtgtg

SEQ ID NO: 526465 - DNA, 16 bp, R. norvegicus
tggtctctgcaggcac

SEQ ID NO: 526466 - DNA, 16 bp, R. norvegicus
tggtctctgtggtctc

SEQ ID NO: 526467 - DNA, 16 bp, R. norvegicus
tggtctctgttgagaa

SEQ ID NO: 526468 - DNA, 16 bp, R. norvegicus
tggtctctttcagcat

SEQ ID NO: 526469 - DNA, 16 bp, R. norvegicus
tggtctctttcctagg

SEQ ID NO: 526470 - DNA, 16 bp, R. norvegicus
tggtctgaagaagcaa

SEQ ID NO: 526471 - DNA, 16 bp, R. norvegicus
tggtctgctctcttcc

SEQ ID NO: 526472 - DNA, 16 bp, R. norvegicus
tggtctgtaggttgta

SEQ ID NO: 526473 - DNA, 16 bp, R. norvegicus
tggtctgtgagtttta

SEQ ID NO: 526474 - DNA, 16 bp, R. norvegicus
tggtctgtgctgctgc

SEQ ID NO: 526475 - DNA, 16 bp, R. norvegicus
tggtcttcaacaacaa

SEQ ID NO: 526476 - DNA, 16 bp, R. norvegicus
tggtcttcaatgacaa

SEQ ID NO: 526477 - DNA, 16 bp, R. norvegicus
tggtcttcatgcagat

SEQ ID NO: 526478 - DNA, 16 bp, R. norvegicus
tggtcttcctgcttct

SEQ ID NO: 526479 - DNA, 16 bp, R. norvegicus
tggtcttctgcaagag

SEQ ID NO: 526480 - DNA, 16 bp, R. norvegicus
tggtcttcttcttgag

SEQ ID NO: 526481 - DNA, 16 bp, R. norvegicus
tggtcttgttaaagta

SEQ ID NO: 526482 - DNA, 16 bp, R. norvegicus
tggtcttttgttcctg

SEQ ID NO: 526483 - DNA, 16 bp, R. norvegicus
tggtgaaaaggctcgt

SEQ ID NO: 526484 - DNA, 16 bp, R. norvegicus
tggtgaaaggagaaaa

SEQ ID NO: 526485 - DNA, 16 bp, R. norvegicus
tggtgaacaccagagg

SEQ ID NO: 526486 - DNA, 16 bp, R. norvegicus
tggtgaagaatgtggc

SEQ ID NO: 526487 - DNA, 16 bp, R. norvegicus
tggtgaagtcaagaca

SEQ ID NO: 526488 - DNA, 16 bp, R. norvegicus
tggtgaatgaatgaat

SEQ ID NO: 526489 - DNA, 16 bp, R. norvegicus
tggtgacacttgggag

SEQ ID NO: 526490 - DNA, 16 bp, R. norvegicus
tggtgacagtggtggt

SEQ ID NO: 526491 - DNA, 16 bp, R. norvegicus
tggtgacggtggtggt

SEQ ID NO: 526492 - DNA, 16 bp, R. norvegicus
tggtgagaaaacaaga

SEQ ID NO: 526493 - DNA, 16 bp, R. norvegicus
tggtgagaaggctcag

SEQ ID NO: 526494 - DNA, 16 bp, R. norvegicus
tggtgagaagtgtggt

SEQ ID NO: 526495 - DNA, 16 bp, R. norvegicus
tggtgagagagagacc

SEQ ID NO: 526496 - DNA, 16 bp, R. norvegicus
tggtgagccatctctc

SEQ ID NO: 526497 - DNA, 16 bp, R. norvegicus
tggtgaggaaggtaag

SEQ ID NO: 526498 - DNA, 16 bp, R. norvegicus
tggtgaggacatggag

SEQ ID NO: 526499 - DNA, 16 bp, R. norvegicus
tggtgaggtcctggcc

SEQ ID NO: 526500 - DNA, 19 bp, R. norvegicus
tggtgaggtttccactcac

SEQ ID NO: 526501 - DNA, 16 bp, R. norvegicus
tggtgatagtgatggt

SEQ ID NO: 526502 - DNA, 16 bp, R. norvegicus
tggtgatgaacagcca

SEQ ID NO: 526503 - DNA, 16 bp, R. norvegicus
tggtgatgacgatgat

SEQ ID NO: 526504 - DNA, 16 bp, R. norvegicus
tggtgatgatgatgaa

SEQ ID NO: 526505 - DNA, 16 bp, R. norvegicus
tggtgatgatgatggt

SEQ ID NO: 526506 - DNA, 16 bp, R. norvegicus
tggtgatgatgatgtg

SEQ ID NO: 526507 - DNA, 16 bp, R. norvegicus
tggtgatgatgctgat

SEQ ID NO: 526508 - DNA, 16 bp, R. norvegicus
tggtgatgcaggcctt

SEQ ID NO: 526509 - DNA, 16 bp, R. norvegicus
tggtgatggagaagga

SEQ ID NO: 526510 - DNA, 16 bp, R. norvegicus
tggtgatggtgatggc

SEQ ID NO: 526511 - DNA, 16 bp, R. norvegicus
tggtgatggtggcagt

SEQ ID NO: 526512 - DNA, 16 bp, R. norvegicus
tggtgatgtacacctt

SEQ ID NO: 526513 - DNA, 16 bp, R. norvegicus
tggtgattgatgtggg

SEQ ID NO: 526514 - DNA, 16 bp, R. norvegicus
tggtgatttcccagaa

SEQ ID NO: 526515 - DNA, 16 bp, R. norvegicus
tggtgattttctcaaa

SEQ ID NO: 526516 - DNA, 16 bp, R. norvegicus
tggtgcacagacagac

SEQ ID NO: 526517 - DNA, 16 bp, R. norvegicus
tggtgcaccagagaca

SEQ ID NO: 526518 - DNA, 16 bp, R. norvegicus
tggtgcacccctttaa

SEQ ID NO: 526519 - DNA, 16 bp, R. norvegicus
tggtgcacgcctttaa

SEQ ID NO: 526520 - DNA, 16 bp, R. norvegicus
tggtgcagaggccatg

SEQ ID NO: 526521 - DNA, 16 bp, R. norvegicus
tggtgcaggaggaact

SEQ ID NO: 526522 - DNA, 16 bp, R. norvegicus
tggtgcaggcctttga

SEQ ID NO: 526523 - DNA, 16 bp, R. norvegicus
tggtgcagtctctgga

SEQ ID NO: 526524 - DNA, 16 bp, R. norvegicus
tggtgcatacctttaa

SEQ ID NO: 526525 - DNA, 16 bp, R. norvegicus
tggtgcatgcctgtaa

SEQ ID NO: 526526 - DNA, 16 bp, R. norvegicus
tggtgccaaccctggg

SEQ ID NO: 526527 - DNA, 16 bp, R. norvegicus
tggtgccagactggtg

SEQ ID NO: 526528 - DNA, 16 bp, R. norvegicus
tggtgccgaaacccgg

SEQ ID NO: 526529 - DNA, 16 bp, R. norvegicus
tggtgctagagcagta

SEQ ID NO: 526530 - DNA, 16 bp, R. norvegicus
tggtgctagaggagcc

SEQ ID NO: 526531 - DNA, 16 bp, R. norvegicus
tggtgctagaggtcct

SEQ ID NO: 526532 - DNA, 16 bp, R. norvegicus
tggtgctgaagaagga

SEQ ID NO: 526533 - DNA, 16 bp, R. norvegicus
tggtgctgaagctaca

SEQ ID NO: 526534 - DNA, 16 bp, R. norvegicus
tggtgctgatgctgat

SEQ ID NO: 526535 - DNA, 16 bp, R. norvegicus
tggtgctgatggtggt

SEQ ID NO: 526536 - DNA, 16 bp, R. norvegicus
tggtgctgcagaagga

SEQ ID NO: 526537 - DNA, 16 bp, R. norvegicus
tggtgctgccaaggct

SEQ ID NO: 526538 - DNA, 16 bp, R. norvegicus
tggtgctgccaaggtt

SEQ ID NO: 526539 - DNA, 16 bp, R. norvegicus
tggtgctgcctgccag

SEQ ID NO: 526540 - DNA, 16 bp, R. norvegicus
tggtgctgctgctgct

SEQ ID NO: 526541 - DNA, 16 bp, R. norvegicus
tggtgctgctgctggt

SEQ ID NO: 526542 - DNA, 16 bp, R. norvegicus
tggtgctggaaaagga

SEQ ID NO: 526543 - DNA, 16 bp, R. norvegicus
tggtgctggagaaaga

SEQ ID NO: 526544 - DNA, 16 bp, R. norvegicus
tggtgctggagaagaa

SEQ ID NO: 526545 - DNA, 16 bp, R. norvegicus
tggtgctggagagaga

SEQ ID NO: 526546 - DNA, 16 bp, R. norvegicus
tggtgctggagcagga

SEQ ID NO: 526547 - DNA, 16 bp, R. norvegicus
tggtgctggaggactt

SEQ ID NO: 526548 - DNA, 16 bp, R. norvegicus
tggtgctggaggagcc

SEQ ID NO: 526549 - DNA, 16 bp, R. norvegicus
tggtgctggaggagga

SEQ ID NO: 526550 - DNA, 16 bp, R. norvegicus
tggtgctggcctcctc

SEQ ID NO: 526551 - DNA, 16 bp, R. norvegicus
tggtgctgggatggtg

SEQ ID NO: 526552 - DNA, 16 bp, R. norvegicus
tggtgctggggaagga

SEQ ID NO: 526553 - DNA, 16 bp, R. norvegicus
tggtgctggttaaact

SEQ ID NO: 526554 - DNA, 16 bp, R. norvegicus
tggtgctgtgaaggct

SEQ ID NO: 526555 - DNA, 16 bp, R. norvegicus
tggtgctgttcctggg

SEQ ID NO: 526556 - DNA, 16 bp, R. norvegicus
tggtgcttatcacagc

SEQ ID NO: 526557 - DNA, 16 bp, R. norvegicus
tggtgcttttctctct

SEQ ID NO: 526558 - DNA, 16 bp, R. norvegicus
tggtggaacttttggg

SEQ ID NO: 526559 - DNA, 16 bp, R. norvegicus
tggtggaaggagaaaa

SEQ ID NO: 526560 - DNA, 16 bp, R. norvegicus
tggtggaaggagacaa

SEQ ID NO: 526561 - DNA, 16 bp, R. norvegicus
tggtggagacactggg

SEQ ID NO: 526562 - DNA, 16 bp, R. norvegicus
tggtggagcaaaggca

SEQ ID NO: 526563 - DNA, 16 bp, R. norvegicus
tggtggaggagaaagt

SEQ ID NO: 526564 - DNA, 16 bp, R. norvegicus
tggtggaggcaggagg

SEQ ID NO: 526565 - DNA, 16 bp, R. norvegicus
tggtggatacagtaac

SEQ ID NO: 526566 - DNA, 16 bp, R. norvegicus
tggtggatgatgtctt

SEQ ID NO: 526567 - DNA, 16 bp, R. norvegicus
tggtggatgtatgtat

SEQ ID NO: 526568 - DNA, 16 bp, R. norvegicus
tggtggatttaatgaa

SEQ ID NO: 526569 - DNA, 16 bp, R. norvegicus
tggtggcaacctgtct

SEQ ID NO: 526570 - DNA, 16 bp, R. norvegicus
tggtggcacacacctt

SEQ ID NO: 526571 - DNA, 16 bp, R. norvegicus
tggtggcacacagctt

SEQ ID NO: 526572 - DNA, 16 bp, R. norvegicus
tggtggcacataccta

SEQ ID NO: 526573 - DNA, 16 bp, R. norvegicus
tggtggcacccacctt

SEQ ID NO: 526574 - DNA, 16 bp, R. norvegicus
tggtggcactgtttgg

SEQ ID NO: 526575 - DNA, 16 bp, R. norvegicus
tggtggcagcctatat

SEQ ID NO: 526576 - DNA, 16 bp, R. norvegicus
tggtggcaggaacagg

SEQ ID NO: 526577 - DNA, 16 bp, R. norvegicus
tggtggcatgtgtctg

SEQ ID NO: 526578 - DNA, 16 bp, R. norvegicus
tggtggccaaagctgt

SEQ ID NO: 526579 - DNA, 16 bp, R. norvegicus
tggtggccatgccttt

SEQ ID NO: 526580 - DNA, 16 bp, R. norvegicus
tggtggctcacaacaa

SEQ ID NO: 526581 - DNA, 16 bp, R. norvegicus
tggtggctcctgcctg

SEQ ID NO: 526582 - DNA, 16 bp, R. norvegicus
tggtggctgccgccgc

SEQ ID NO: 526583 - DNA, 16 bp, R. norvegicus
tggtggctgccgctgc

SEQ ID NO: 526584 - DNA, 16 bp, R. norvegicus
tggtggctgctgggag

SEQ ID NO: 526585 - DNA, 16 bp, R. norvegicus
tggtggctgcttatgg

SEQ ID NO: 526586 - DNA, 16 bp, R. norvegicus
tggtggctgtatgcat

SEQ ID NO: 526587 - DNA, 16 bp, R. norvegicus
tggtggcttcctcctc

SEQ ID NO: 526588 - DNA, 16 bp, R. norvegicus
tggtggctttggtggc

SEQ ID NO: 526589 - DNA, 16 bp, R. norvegicus
tggtgggaaaactgga

SEQ ID NO: 526590 - DNA, 16 bp, R. norvegicus
tggtgggaagagaaaa

SEQ ID NO: 526591 - DNA, 16 bp, R. norvegicus
tggtgggaatacaaac

SEQ ID NO: 526592 - DNA, 16 bp, R. norvegicus
tggtgggaatgtaaat

SEQ ID NO: 526593 - DNA, 17 bp, R. norvegicus
tggtgggattgcaagct

SEQ ID NO: 526594 - DNA, 17 bp, R. norvegicus
tggtgggattgcacact

SEQ ID NO: 526595 - DNA, 16 bp, R. norvegicus
tggtgggatttcaaac

SEQ ID NO: 526596 - DNA, 16 bp, R. norvegicus
tggtgggcagtggtgg

SEQ ID NO: 526597 - DNA, 16 bp, R. norvegicus
tggtggggacagaatg

SEQ ID NO: 526598 - DNA, 16 bp, R. norvegicus
tggtggggcagtttct

SEQ ID NO: 526599 - DNA, 16 bp, R. norvegicus
tggtggggctggggat

SEQ ID NO: 526600 - DNA, 16 bp, R. norvegicus
tggtgggtgaactggg

SEQ ID NO: 526601 - DNA, 16 bp, R. norvegicus
tggtggtaacagaccc

SEQ ID NO: 526602 - DNA, 16 bp, R. norvegicus
tggtggtagaattggg

SEQ ID NO: 526603 - DNA, 16 bp, R. norvegicus
tggtggtagtgatggt

SEQ ID NO: 526604 - DNA, 16 bp, R. norvegicus
tggtggtcaagataaa

SEQ ID NO: 526605 - DNA, 16 bp, R. norvegicus
tggtggtcagaagaca

SEQ ID NO: 526606 - DNA, 16 bp, R. norvegicus
tggtggtcattgctga

SEQ ID NO: 526607 - DNA, 16 bp, R. norvegicus
tggtggtcctggcttc

SEQ ID NO: 526608 - DNA, 16 bp, R. norvegicus
tggtggtgaatgcctt

SEQ ID NO: 526609 - DNA, 16 bp, R. norvegicus
tggtggtgatgatgac

SEQ ID NO: 526610 - DNA, 16 bp, R. norvegicus
tggtggtgatggtgat

SEQ ID NO: 526611 - DNA, 16 bp, R. norvegicus
tggtggtgcctgcctg

SEQ ID NO: 526612 - DNA, 16 bp, R. norvegicus
tggtggtgctcacctg

SEQ ID NO: 526613 - DNA, 16 bp, R. norvegicus
tggtggtgctgatggt

SEQ ID NO: 526614 - DNA, 16 bp, R. norvegicus
tggtggtgctgctgct

SEQ ID NO: 526615 - DNA, 16 bp, R. norvegicus
tggtggtggagaagga

SEQ ID NO: 526616 - DNA, 16 bp, R. norvegicus
tggtggtggcagtggc

SEQ ID NO: 526617 - DNA, 16 bp, R. norvegicus
tggtggtggtcctggt

SEQ ID NO: 526618 - DNA, 16 bp, R. norvegicus
tggtggtggtggcagc

SEQ ID NO: 526619 - DNA, 16 bp, R. norvegicus
tggtggtggtggtgac

SEQ ID NO: 526620 - DNA, 16 bp, R. norvegicus
tggtggttagcttctt

SEQ ID NO: 526621 - DNA, 16 bp, R. norvegicus
tggtggttcagtctcc

SEQ ID NO: 526622 - DNA, 16 bp, R. norvegicus
tggtggttcagtgtct

SEQ ID NO: 526623 - DNA, 16 bp, R. norvegicus
tggtggttcctcagga

SEQ ID NO: 526624 - DNA, 16 bp, R. norvegicus
tggtggttgccatttt

SEQ ID NO: 526625 - DNA, 16 bp, R. norvegicus
tggtggtttagtccct

SEQ ID NO: 526626 - DNA, 16 bp, R. norvegicus
tggtggtttcgtccct

SEQ ID NO: 526627 - DNA, 16 bp, R. norvegicus
tggtgtacctgaagac

SEQ ID NO: 526628 - DNA, 16 bp, R. norvegicus
tggtgtagatgtacca

SEQ ID NO: 526629 - DNA, 16 bp, R. norvegicus
tggtgtcccagtccct

SEQ ID NO: 526630 - DNA, 16 bp, R. norvegicus
tggtgtccccctccct

SEQ ID NO: 526631 - DNA, 16 bp, R. norvegicus
tggtgtccctgctggt

SEQ ID NO: 526632 - DNA, 16 bp, R. norvegicus
tggtgtctgaggaggc

SEQ ID NO: 526633 - DNA, 16 bp, R. norvegicus
tggtgtctggatgtgc

SEQ ID NO: 526634 - DNA, 16 bp, R. norvegicus
tggtgtctgggaccct

SEQ ID NO: 526635 - DNA, 16 bp, R. norvegicus
tggtgtctgtgtaccc

SEQ ID NO: 526636 - DNA, 16 bp, R. norvegicus
tggtgtcttcctcagt

SEQ ID NO: 526637 - DNA, 16 bp, R. norvegicus
tggtgtgcatgtggag

SEQ ID NO: 526638 - DNA, 16 bp, R. norvegicus
tggtgtgtgctctcag

SEQ ID NO: 526639 - DNA, 16 bp, R. norvegicus
tggtgtgtttgaagag

SEQ ID NO: 526640 - DNA, 16 bp, R. norvegicus
tggtgtgtttggctat

SEQ ID NO: 526641 - DNA, 16 bp, R. norvegicus
tggtgttatcttgttc

SEQ ID NO: 526642 - DNA, 16 bp, R. norvegicus
tggtgttctgttcagc

SEQ ID NO: 526643 - DNA, 16 bp, R. norvegicus
tggtgtttaaaaaaaa

SEQ ID NO: 526644 - DNA, 16 bp, R. norvegicus
tggtgtttacatttct

SEQ ID NO: 526645 - DNA, 16 bp, R. norvegicus
tggtgtttatgtttct

SEQ ID NO: 526646 - DNA, 16 bp, R. norvegicus
tggtgtttcatcccag

SEQ ID NO: 526647 - DNA, 16 bp, R. norvegicus
tggtgtttcttcacag

SEQ ID NO: 526648 - DNA, 16 bp, R. norvegicus
tggtgttttctctgag

SEQ ID NO: 526649 - DNA, 19 bp, R. norvegicus
tggttaagagcacccgact

SEQ ID NO: 526650 - DNA, 16 bp, R. norvegicus
tggttaagagcactaa

SEQ ID NO: 526651 - DNA, 16 bp, R. norvegicus
tggttaagagcactgg

SEQ ID NO: 526652 - DNA, 16 bp, R. norvegicus
tggttaatattgtcaa

SEQ ID NO: 526653 - DNA, 16 bp, R. norvegicus
tggttaattttaagtg

SEQ ID NO: 526654 - DNA, 16 bp, R. norvegicus
tggttaccaccaagat

SEQ ID NO: 526655 - DNA, 16 bp, R. norvegicus
tggttagagtcacacc

SEQ ID NO: 526656 - DNA, 16 bp, R. norvegicus
tggttagagtcacagc

SEQ ID NO: 526657 - DNA, 16 bp, R. norvegicus
tggttagctgaaagca

SEQ ID NO: 526658 - DNA, 16 bp, R. norvegicus
tggttagttacctctc

SEQ ID NO: 526659 - DNA, 16 bp, R. norvegicus
tggttataataaataa

SEQ ID NO: 526660 - DNA, 16 bp, R. norvegicus
tggttatcttgttcag

SEQ ID NO: 526661 - DNA, 19 bp, R. norvegicus
tggttatggagatttccta

SEQ ID NO: 526662 - DNA, 16 bp, R. norvegicus
tggttattctgtattt

SEQ ID NO: 526663 - DNA, 16 bp, R. norvegicus
tggttcaacttccatg

SEQ ID NO: 526664 - DNA, 16 bp, R. norvegicus
tggttcaacttgaggt

SEQ ID NO: 526665 - DNA, 16 bp, R. norvegicus
tggttcaatacacaga

SEQ ID NO: 526666 - DNA, 16 bp, R. norvegicus
tggttcagagacaggc

SEQ ID NO: 526667 - DNA, 16 bp, R. norvegicus
tggttcagcaagtaaa

SEQ ID NO: 526668 - DNA, 16 bp, R. norvegicus
tggttcagcagctaag

SEQ ID NO: 526669 - DNA, 16 bp, R. norvegicus
tggttcaggaaatttt

SEQ ID NO: 526670 - DNA, 16 bp, R. norvegicus
tggttcaggctggcct

SEQ ID NO: 526671 - DNA, 16 bp, R. norvegicus
tggttcagtctctgag

SEQ ID NO: 526672 - DNA, 16 bp, R. norvegicus
tggttcagtggctaag

SEQ ID NO: 526673 - DNA, 16 bp, R. norvegicus
tggttcagtgggtaag

SEQ ID NO: 526674 - DNA, 16 bp, R. norvegicus
tggttcatgcctgtaa

SEQ ID NO: 526675 - DNA, 16 bp, R. norvegicus
tggttccaaggctcaa

SEQ ID NO: 526676 - DNA, 16 bp, R. norvegicus
tggttcccagcactca

SEQ ID NO: 526677 - DNA, 16 bp, R. norvegicus
tggttcccagcatcca

SEQ ID NO: 526678 - DNA, 16 bp, R. norvegicus
tggttcctcagaaaat

SEQ ID NO: 526679 - DNA, 26 bp, R. norvegicus
tggttcgggtccctggagtcattcct

SEQ ID NO: 526680 - DNA, 16 bp, R. norvegicus
tggttctataagaaag

SEQ ID NO: 526681 - DNA, 16 bp, R. norvegicus
tggttctctggtggaa

SEQ ID NO: 526682 - DNA, 16 bp, R. norvegicus
tggttctcttgattct

SEQ ID NO: 526683 - DNA, 16 bp, R. norvegicus
tggttctgatgttttg

SEQ ID NO: 526684 - DNA, 16 bp, R. norvegicus
tggttctggtctgtgc

SEQ ID NO: 526685 - DNA, 16 bp, R. norvegicus
tggttctgttctttta

SEQ ID NO: 526686 - DNA, 16 bp, R. norvegicus
tggttctttaagaaaa

SEQ ID NO: 526687 - DNA, 16 bp, R. norvegicus
tggttctttgagaaga

SEQ ID NO: 526688 - DNA, 16 bp, R. norvegicus
tggttcttttagaaaa

SEQ ID NO: 526689 - DNA, 16 bp, R. norvegicus
tggttcttttttaaaa

SEQ ID NO: 526690 - DNA, 16 bp, R. norvegicus
tggttgaaggagagaa

SEQ ID NO: 526691 - DNA, 17 bp, R. norvegicus
tggttgaattagggaaa

SEQ ID NO: 526692 - DNA, 16 bp, R. norvegicus
tggttgaattcagctc

SEQ ID NO: 526693 - DNA, 16 bp, R. norvegicus
tggttgacctagaact

SEQ ID NO: 526694 - DNA, 16 bp, R. norvegicus
tggttgagaaggaaga

SEQ ID NO: 526695 - DNA, 16 bp, R. norvegicus
tggttgagttagggaa

SEQ ID NO: 526696 - DNA, 16 bp, R. norvegicus
tggttgccatggaaac

SEQ ID NO: 526697 - DNA, 17 bp, R. norvegicus
tggttgccattgttgtt

SEQ ID NO: 526698 - DNA, 16 bp, R. norvegicus
tggttgccattttgta

SEQ ID NO: 526699 - DNA, 16 bp, R. norvegicus
tggttgcctcccagaa

SEQ ID NO: 526700 - DNA, 16 bp, R. norvegicus
tggttgctcctgctga

SEQ ID NO: 526701 - DNA, 16 bp, R. norvegicus
tggttgctgggaactc

SEQ ID NO: 526702 - DNA, 23 bp, R. norvegicus
tggttgctgggatttgaactcag

SEQ ID NO: 526703 - DNA, 16 bp, R. norvegicus
tggttgctggttgctg

SEQ ID NO: 526704 - DNA, 16 bp, R. norvegicus
tggttgctgtcctcac

SEQ ID NO: 526705 - DNA, 16 bp, R. norvegicus
tggttgctgttttgac

SEQ ID NO: 526706 - DNA, 16 bp, R. norvegicus
tggttggaggaagtgt

SEQ ID NO: 526707 - DNA, 16 bp, R. norvegicus
tggttggcattgttat

SEQ ID NO: 526708 - DNA, 16 bp, R. norvegicus
tggttgggggtcagca

SEQ ID NO: 526709 - DNA, 16 bp, R. norvegicus
tggttggtgatccatt

SEQ ID NO: 526710 - DNA, 16 bp, R. norvegicus
tggttggtgctttagt

SEQ ID NO: 526711 - DNA, 16 bp, R. norvegicus
tggttggtggtttaga

SEQ ID NO: 526712 - DNA, 16 bp, R. norvegicus
tggttggttactccta

SEQ ID NO: 526713 - DNA, 16 bp, R. norvegicus
tggttgtaccagtcgg

SEQ ID NO: 526714 - DNA, 16 bp, R. norvegicus
tggttgtagcttcagt

SEQ ID NO: 526715 - DNA, 16 bp, R. norvegicus
tggttgtgagctccca

SEQ ID NO: 526716 - DNA, 16 bp, R. norvegicus
tggttgtgctttcctg

SEQ ID NO: 526717 - DNA, 16 bp, R. norvegicus
tggttgtggtgtctct

SEQ ID NO: 526718 - DNA, 16 bp, R. norvegicus
tggttgttccaccagc

SEQ ID NO: 526719 - DNA, 16 bp, R. norvegicus
tggtttacatagcaag

SEQ ID NO: 526720 - DNA, 16 bp, R. norvegicus
tggtttactatatgga

SEQ ID NO: 526721 - DNA, 16 bp, R. norvegicus
tggtttcacagcactg

SEQ ID NO: 526722 - DNA, 16 bp, R. norvegicus
tggtttcagttcccag

SEQ ID NO: 526723 - DNA, 16 bp, R. norvegicus
tggtttcccaggcgta

SEQ ID NO: 526724 - DNA, 16 bp, R. norvegicus
tggtttctcagaaagg

SEQ ID NO: 526725 - DNA, 16 bp, R. norvegicus
tggtttctctgtctct

SEQ ID NO: 526726 - DNA, 16 bp, R. norvegicus
tggtttctgcctacac

SEQ ID NO: 526727 - DNA, 16 bp, R. norvegicus
tggtttctgctggatt

SEQ ID NO: 526728 - DNA, 16 bp, R. norvegicus
tggtttctggagggga

SEQ ID NO: 526729 - DNA, 16 bp, R. norvegicus
tggtttcttttataag

SEQ ID NO: 526730 - DNA, 16 bp, R. norvegicus
tggtttgaagaagcaa

SEQ ID NO: 526731 - DNA, 16 bp, R. norvegicus
tggtttgcagagtgag

SEQ ID NO: 526732 - DNA, 16 bp, R. norvegicus
tggtttgctcagtctg

SEQ ID NO: 526733 - DNA, 16 bp, R. norvegicus
tggtttgctgctgcca

SEQ ID NO: 526734 - DNA, 16 bp, R. norvegicus
tggtttgctggtggca

SEQ ID NO: 526735 - DNA, 16 bp, R. norvegicus
tggtttgctgtctatg

SEQ ID NO: 526736 - DNA, 16 bp, R. norvegicus
tggtttgctttgctct

SEQ ID NO: 526737 - DNA, 16 bp, R. norvegicus
tggtttggcctgagag

SEQ ID NO: 526738 - DNA, 16 bp, R. norvegicus
tggtttggtgctggca

SEQ ID NO: 526739 - DNA, 16 bp, R. norvegicus
tggtttggttcagttt

SEQ ID NO: 526740 - DNA, 16 bp, R. norvegicus
tggtttggtttgactt

SEQ ID NO: 526741 - DNA, 16 bp, R. norvegicus
tggtttgtggttcagt

SEQ ID NO: 526742 - DNA, 16 bp, R. norvegicus
tggttttaaatgtata

SEQ ID NO: 526743 - DNA, 16 bp, R. norvegicus
tggttttatttttcca

SEQ ID NO: 526744 - DNA, 16 bp, R. norvegicus
tggttttcaatatcca

SEQ ID NO: 526745 - DNA, 16 bp, R. norvegicus
tggttttcattgttgt

SEQ ID NO: 526746 - DNA, 16 bp, R. norvegicus
tggttttccatccata

SEQ ID NO: 526747 - DNA, 16 bp, R. norvegicus
tggttttctctttcca

SEQ ID NO: 526748 - DNA, 16 bp, R. norvegicus
tggttttctgtatgtt

SEQ ID NO: 526749 - DNA, 16 bp, R. norvegicus
tggttttcttcttcta

SEQ ID NO: 526750 - DNA, 16 bp, R. norvegicus
tggttttgaggtttca

SEQ ID NO: 526751 - DNA, 16 bp, R. norvegicus
tggtttttaatctttg

SEQ ID NO: 526752 - DNA, 29 bp, R. norvegicus
tggtttttcctctctacaggtcttcagct

SEQ ID NO: 526753 - DNA, 16 bp, R. norvegicus
tgtaaaaataagcaca

SEQ ID NO: 526754 - DNA, 16 bp, R. norvegicus
tgtaaaagaaatgcag

SEQ ID NO: 526755 - DNA, 16 bp, R. norvegicus
tgtaaaagcagcaagt

SEQ ID NO: 526756 - DNA, 16 bp, R. norvegicus
tgtaaaatctggagga

SEQ ID NO: 526757 - DNA, 16 bp, R. norvegicus
tgtaaaatgtaaaaag

SEQ ID NO: 526758 - DNA, 16 bp, R. norvegicus
tgtaaacaaagtgata

SEQ ID NO: 526759 - DNA, 16 bp, R. norvegicus
tgtaaacacacacata

SEQ ID NO: 526760 - DNA, 16 bp, R. norvegicus
tgtaaacatgtgtgtg

SEQ ID NO: 526761 - DNA, 16 bp, R. norvegicus
tgtaaagactgtggga

SEQ ID NO: 526762 - DNA, 16 bp, R. norvegicus
tgtaaaggatgtcatt

SEQ ID NO: 526763 - DNA, 16 bp, R. norvegicus
tgtaaagtgaataaat

SEQ ID NO: 526764 - DNA, 16 bp, R. norvegicus
tgtaaataaagcttta

SEQ ID NO: 526765 - DNA, 16 bp, R. norvegicus
tgtaaataaatattca

SEQ ID NO: 526766 - DNA, 16 bp, R. norvegicus
tgtaaatatgttttct

SEQ ID NO: 526767 - DNA, 16 bp, R. norvegicus
tgtaaatgtatgtatg

SEQ ID NO: 526768 - DNA, 16 bp, R. norvegicus
tgtaaatgtggttttg

SEQ ID NO: 526769 - DNA, 16 bp, R. norvegicus
tgtaacagaggatggt

SEQ ID NO: 526770 - DNA, 16 bp, R. norvegicus
tgtaacatgttttata

SEQ ID NO: 526771 - DNA, 17 bp, R. norvegicus
tgtaaccaaagactcac

SEQ ID NO: 526772 - DNA, 16 bp, R. norvegicus
tgtaaccatgacaccc

SEQ ID NO: 526773 - DNA, 16 bp, R. norvegicus
tgtaaccctggctttc

SEQ ID NO: 526774 - DNA, 16 bp, R. norvegicus
tgtaacctcagtgctg

SEQ ID NO: 526775 - DNA, 16 bp, R. norvegicus
tgtaactccagtccca

SEQ ID NO: 526776 - DNA, 16 bp, R. norvegicus
tgtaactctagctcca

SEQ ID NO: 526777 - DNA, 16 bp, R. norvegicus
tgtaacttcagctctg

SEQ ID NO: 526778 - DNA, 16 bp, R. norvegicus
tgtaagaaagcaagct

SEQ ID NO: 526779 - DNA, 16 bp, R. norvegicus
tgtaagaggaaataaa

SEQ ID NO: 526780 - DNA, 16 bp, R. norvegicus
tgtaagaggcagaggg

SEQ ID NO: 526781 - DNA, 16 bp, R. norvegicus
tgtaagagtgaaaatc

SEQ ID NO: 526782 - DNA, 16 bp, R. norvegicus
tgtaagctgaaataaa

SEQ ID NO: 526783 - DNA, 16 bp, R. norvegicus
tgtaagtcaaaagaca

SEQ ID NO: 526784 - DNA, 16 bp, R. norvegicus
tgtaataaaatactct

SEQ ID NO: 526785 - DNA, 16 bp, R. norvegicus
tgtaataaggaatagg

SEQ ID NO: 526786 - DNA, 16 bp, R. norvegicus
tgtaatacatcttgag

SEQ ID NO: 526787 - DNA, 16 bp, R. norvegicus
tgtaatatcaaataaa

SEQ ID NO: 526788 - DNA, 16 bp, R. norvegicus
tgtaatatcatttata

SEQ ID NO: 526789 - DNA, 16 bp, R. norvegicus
tgtaattccagccttg

SEQ ID NO: 526790 - DNA, 16 bp, R. norvegicus
tgtaattccagttgca

SEQ ID NO: 526791 - DNA, 16 bp, R. norvegicus
tgtaattctagttcca

SEQ ID NO: 526792 - DNA, 16 bp, R. norvegicus
tgtaatttttaaaggg

SEQ ID NO: 526793 - DNA, 16 bp, R. norvegicus
tgtacaaaaataaata

SEQ ID NO: 526794 - DNA, 16 bp, R. norvegicus
tgtacaaactcaagtc

SEQ ID NO: 526795 - DNA, 16 bp, R. norvegicus
tgtacaaatatacagg

SEQ ID NO: 526796 - DNA, 16 bp, R. norvegicus
tgtacaaatattaaaa

SEQ ID NO: 526797 - DNA, 16 bp, R. norvegicus
tgtacaaatgtgtgtg

SEQ ID NO: 526798 - DNA, 16 bp, R. norvegicus
tgtacaacattttctg

SEQ ID NO: 526799 - DNA, 16 bp, R. norvegicus
tgtacacatacatgta

SEQ ID NO: 526800 - DNA, 16 bp, R. norvegicus
tgtacacatgtacaaa

SEQ ID NO: 526801 - DNA, 16 bp, R. norvegicus
tgtacagacacacaga

SEQ ID NO: 526802 - DNA, 16 bp, R. norvegicus
tgtacagagaactgtg

SEQ ID NO: 526803 - DNA, 16 bp, R. norvegicus
tgtacagagacagaca

SEQ ID NO: 526804 - DNA, 16 bp, R. norvegicus
tgtacagagacaggtt

SEQ ID NO: 526805 - DNA, 16 bp, R. norvegicus
tgtacagagcaataag

SEQ ID NO: 526806 - DNA, 16 bp, R. norvegicus
tgtacagggtgatcag

SEQ ID NO: 526807 - DNA, 16 bp, R. norvegicus
tgtacataaataaaat

SEQ ID NO: 526808 - DNA, 16 bp, R. norvegicus
tgtacataatgtattt

SEQ ID NO: 526809 - DNA, 16 bp, R. norvegicus
tgtacatacatacaca

SEQ ID NO: 526810 - DNA, 17 bp, R. norvegicus
tgtacatacatctcaga

SEQ ID NO: 526811 - DNA, 16 bp, R. norvegicus
tgtacatacatttata

SEQ ID NO: 526812 - DNA, 16 bp, R. norvegicus
tgtacataggaaaaac

SEQ ID NO: 526813 - DNA, 16 bp, R. norvegicus
tgtacatatatatttt

SEQ ID NO: 526814 - DNA, 16 bp, R. norvegicus
tgtacatatgtatgta

SEQ ID NO: 526815 - DNA, 16 bp, R. norvegicus
tgtacatatgtgtgtg

SEQ ID NO: 526816 - DNA, 16 bp, R. norvegicus
tgtacatatttataaa

SEQ ID NO: 526817 - DNA, 16 bp, R. norvegicus
tgtacatctcctccat

SEQ ID NO: 526818 - DNA, 16 bp, R. norvegicus
tgtacatgcacacaca

SEQ ID NO: 526819 - DNA, 16 bp, R. norvegicus
tgtacatggtgcacag

SEQ ID NO: 526820 - DNA, 16 bp, R. norvegicus
tgtacatgtgcatata

SEQ ID NO: 526821 - DNA, 16 bp, R. norvegicus
tgtacatgtgtatatg

SEQ ID NO: 526822 - DNA, 16 bp, R. norvegicus
tgtacatgtgtctgtg

SEQ ID NO: 526823 - DNA, 16 bp, R. norvegicus
tgtacatgtttgtaca

SEQ ID NO: 526824 - DNA, 16 bp, R. norvegicus
tgtacatgtttgtatg

SEQ ID NO: 526825 - DNA, 16 bp, R. norvegicus
tgtacattcattttca

SEQ ID NO: 526826 - DNA, 16 bp, R. norvegicus
tgtacattctgctggt

SEQ ID NO: 526827 - DNA, 16 bp, R. norvegicus
tgtaccacatgcacac

SEQ ID NO: 526828 - DNA, 18 bp, R. norvegicus
tgtaccaccaatgagaat

SEQ ID NO: 526829 - DNA, 16 bp, R. norvegicus
tgtaccaccacgccca

SEQ ID NO: 526830 - DNA, 16 bp, R. norvegicus
tgtaccaccttttctg

SEQ ID NO: 526831 - DNA, 16 bp, R. norvegicus
tgtaccactatgcctg

SEQ ID NO: 526832 - DNA, 19 bp, R. norvegicus
tgtaccagagtgctggtgg

SEQ ID NO: 526833 - DNA, 16 bp, R. norvegicus
tgtaccccaggctggc

SEQ ID NO: 526834 - DNA, 17 bp, R. norvegicus
tgtaccccatcttttaa

SEQ ID NO: 526835 - DNA, 16 bp, R. norvegicus
tgtacctgcctgtctc

SEQ ID NO: 526836 - DNA, 17 bp, R. norvegicus
tgtacctggtgctgctg

SEQ ID NO: 526837 - DNA, 16 bp, R. norvegicus
tgtacctgtgactgtg

SEQ ID NO: 526838 - DNA, 16 bp, R. norvegicus
tgtacctgtgtgtgtc

SEQ ID NO: 526839 - DNA, 16 bp, R. norvegicus
tgtactaaacccatct

SEQ ID NO: 526840 - DNA, 16 bp, R. norvegicus
tgtactacaaagcaat

SEQ ID NO: 526841 - DNA, 16 bp, R. norvegicus
tgtactatgcctgcct

SEQ ID NO: 526842 - DNA, 16 bp, R. norvegicus
tgtactcatatgcatt

SEQ ID NO: 526843 - DNA, 16 bp, R. norvegicus
tgtactccacttttta

SEQ ID NO: 526844 - DNA, 16 bp, R. norvegicus
tgtactctttggattg

SEQ ID NO: 526845 - DNA, 16 bp, R. norvegicus
tgtacttaagcaaccc

SEQ ID NO: 526846 - DNA, 16 bp, R. norvegicus
tgtacttcctccagca

SEQ ID NO: 526847 - DNA, 16 bp, R. norvegicus
tgtacttcttagcatc

SEQ ID NO: 526848 - DNA, 16 bp, R. norvegicus
tgtacttcttggcttc

SEQ ID NO: 526849 - DNA, 16 bp, R. norvegicus
tgtacttgagttttgt

SEQ ID NO: 526850 - DNA, 16 bp, R. norvegicus
tgtactttaaaaaaat

SEQ ID NO: 526851 - DNA, 16 bp, R. norvegicus
tgtactttttaaaata

SEQ ID NO: 526852 - DNA, 16 bp, R. norvegicus
tgtactttttcctctc

SEQ ID NO: 526853 - DNA, 16 bp, R. norvegicus
tgtagaaaaatatttt

SEQ ID NO: 526854 - DNA, 16 bp, R. norvegicus
tgtagaccagactggc

SEQ ID NO: 526855 - DNA, 16 bp, R. norvegicus
tgtagaccaggatgac

SEQ ID NO: 526856 - DNA, 16 bp, R. norvegicus
tgtagaccgggctggc

SEQ ID NO: 526857 - DNA, 16 bp, R. norvegicus
tgtagactgggctggc

SEQ ID NO: 526858 - DNA, 16 bp, R. norvegicus
tgtagagctctcagtt

SEQ ID NO: 526859 - DNA, 16 bp, R. norvegicus
tgtagagctcttggct

SEQ ID NO: 526860 - DNA, 16 bp, R. norvegicus
tgtagagctggagaga

SEQ ID NO: 526861 - DNA, 16 bp, R. norvegicus
tgtagaggaagggtac

SEQ ID NO: 526862 - DNA, 16 bp, R. norvegicus
tgtagatatctgttaa

SEQ ID NO: 526863 - DNA, 16 bp, R. norvegicus
tgtagatcaggctggc

SEQ ID NO: 526864 - DNA, 16 bp, R. norvegicus
tgtagatcagtggtag

SEQ ID NO: 526865 - DNA, 16 bp, R. norvegicus
tgtagatgaggctggc

SEQ ID NO: 526866 - DNA, 16 bp, R. norvegicus
tgtagattagaataaa

SEQ ID NO: 526867 - DNA, 16 bp, R. norvegicus
tgtagcaatatgtaag

SEQ ID NO: 526868 - DNA, 69 bp, R. norvegicus
tgtagcaatgaatatcctagtaagagcaccagtggaaggggaagccctgggtcctgctaagactgaacc

SEQ ID NO: 526869 - DNA, 16 bp, R. norvegicus
tgtagcagaatgccag

SEQ ID NO: 526870 - DNA, 16 bp, R. norvegicus
tgtagcagacgtgcag

SEQ ID NO: 526871 - DNA, 16 bp, R. norvegicus
tgtagcagaggagggc

SEQ ID NO: 526872 - DNA, 16 bp, R. norvegicus
tgtagccaggacttca

SEQ ID NO: 526873 - DNA, 16 bp, R. norvegicus
tgtagccatccagttt

SEQ ID NO: 526874 - DNA, 28 bp, R. norvegicus
tgtagccatcgtgaccgtgaactccaca

SEQ ID NO: 526875 - DNA, 16 bp, R. norvegicus
tgtagcccaggatggc

SEQ ID NO: 526876 - DNA, 16 bp, R. norvegicus
tgtagccctggaactc

SEQ ID NO: 526877 - DNA, 16 bp, R. norvegicus
tgtagccctggatggc

SEQ ID NO: 526878 - DNA, 16 bp, R. norvegicus
tgtagccctggctacc

SEQ ID NO: 526879 - DNA, 16 bp, R. norvegicus
tgtagccctggctgcc

SEQ ID NO: 526880 - DNA, 16 bp, R. norvegicus
tgtagccctggctggc

SEQ ID NO: 526881 - DNA, 16 bp, R. norvegicus
tgtagctcaggctggc

SEQ ID NO: 526882 - DNA, 16 bp, R. norvegicus
tgtagctcaggctggt

SEQ ID NO: 526883 - DNA, 16 bp, R. norvegicus
tgtagctcagtggcag

SEQ ID NO: 526884 - DNA, 16 bp, R. norvegicus
tgtagctctcttcaga

SEQ ID NO: 526885 - DNA, 16 bp, R. norvegicus
tgtagctctggctggc

SEQ ID NO: 526886 - DNA, 16 bp, R. norvegicus
tgtagctgaagatgac

SEQ ID NO: 526887 - DNA, 16 bp, R. norvegicus
tgtagctgtattcaga

SEQ ID NO: 526888 - DNA, 16 bp, R. norvegicus
tgtagctgtcttcaga

SEQ ID NO: 526889 - DNA, 16 bp, R. norvegicus
tgtagcttcagctcca

SEQ ID NO: 526890 - DNA, 16 bp, R. norvegicus
tgtaggaaagtctgta

SEQ ID NO: 526891 - DNA, 16 bp, R. norvegicus
tgtaggcaaaataccc

SEQ ID NO: 526892 - DNA, 16 bp, R. norvegicus
tgtaggcaggatacat

SEQ ID NO: 526893 - DNA, 16 bp, R. norvegicus
tgtaggcataaatttt

SEQ ID NO: 526894 - DNA, 17 bp, R. norvegicus
tgtaggcttcttgtatg

SEQ ID NO: 526895 - DNA, 16 bp, R. norvegicus
tgtagggagaccctgt

SEQ ID NO: 526896 - DNA, 16 bp, R. norvegicus
tgtagggagctgcgac

SEQ ID NO: 526897 - DNA, 16 bp, R. norvegicus
tgtagggcgccctcca

SEQ ID NO: 526898 - DNA, 16 bp, R. norvegicus
tgtagtcaaggtgaca

SEQ ID NO: 526899 - DNA, 16 bp, R. norvegicus
tgtagtcctggctttc

SEQ ID NO: 526900 - DNA, 16 bp, R. norvegicus
tgtagtctgtgttttt

SEQ ID NO: 526901 - DNA, 16 bp, R. norvegicus
tgtagtggaatgtcag

SEQ ID NO: 526902 - DNA, 16 bp, R. norvegicus
tgtagttcagactggc

SEQ ID NO: 526903 - DNA, 16 bp, R. norvegicus
tgtagtttggtcttca

SEQ ID NO: 526904 - DNA, 37 bp, R. norvegicus
tgtagtttttcctctctacaggtcttcagctgttcct

SEQ ID NO: 526905 - DNA, 16 bp, R. norvegicus
tgtataaaagaaggct

SEQ ID NO: 526906 - DNA, 16 bp, R. norvegicus
tgtataaatgtgtgtg

SEQ ID NO: 526907 - DNA, 16 bp, R. norvegicus
tgtataagtacattgt

SEQ ID NO: 526908 - DNA, 16 bp, R. norvegicus
tgtataatatatacat

SEQ ID NO: 526909 - DNA, 16 bp, R. norvegicus
tgtataatgtcacaga

SEQ ID NO: 526910 - DNA, 16 bp, R. norvegicus
tgtatacacaaataca

SEQ ID NO: 526911 - DNA, 17 bp, R. norvegicus
tgtatacacacacacac

SEQ ID NO: 526912 - DNA, 16 bp, R. norvegicus
tgtatacacctttaat

SEQ ID NO: 526913 - DNA, 16 bp, R. norvegicus
tgtatacatgtctgtg

SEQ ID NO: 526914 - DNA, 16 bp, R. norvegicus
tgtatacattggatat

SEQ ID NO: 526915 - DNA, 16 bp, R. norvegicus
tgtatactgcctggtt

SEQ ID NO: 526916 - DNA, 16 bp, R. norvegicus
tgtatagaccaggttg

SEQ ID NO: 526917 - DNA, 16 bp, R. norvegicus
tgtatagctggatcct

SEQ ID NO: 526918 - DNA, 16 bp, R. norvegicus
tgtatagtcttttttg

SEQ ID NO: 526919 - DNA, 16 bp, R. norvegicus
tgtatataaaatgtgt

SEQ ID NO: 526920 - DNA, 16 bp, R. norvegicus
tgtatatatacatata

SEQ ID NO: 526921 - DNA, 16 bp, R. norvegicus
tgtatatatatatgta

SEQ ID NO: 526922 - DNA, 16 bp, R. norvegicus
tgtatatatatgtgaa

SEQ ID NO: 526923 - DNA, 16 bp, R. norvegicus
tgtatatatgtatgat

SEQ ID NO: 526924 - DNA, 16 bp, R. norvegicus
tgtatatatgtttaaa

SEQ ID NO: 526925 - DNA, 16 bp, R. norvegicus
tgtatatattatggct

SEQ ID NO: 526926 - DNA, 16 bp, R. norvegicus
tgtatatatttctgtg

SEQ ID NO: 526927 - DNA, 16 bp, R. norvegicus
tgtatatatttgtgtg

SEQ ID NO: 526928 - DNA, 16 bp, R. norvegicus
tgtatatgaatgtttt

SEQ ID NO: 526929 - DNA, 16 bp, R. norvegicus
tgtatatgtgccaggg

SEQ ID NO: 526930 - DNA, 16 bp, R. norvegicus
tgtatatgtgtaaata

SEQ ID NO: 526931 - DNA, 16 bp, R. norvegicus
tgtatatgtgtatatg

SEQ ID NO: 526932 - DNA, 16 bp, R. norvegicus
tgtatatgtgtatgtg

SEQ ID NO: 526933 - DNA, 16 bp, R. norvegicus
tgtatattaaaccatc

SEQ ID NO: 526934 - DNA, 16 bp, R. norvegicus
tgtatattcatataca

SEQ ID NO: 526935 - DNA, 16 bp, R. norvegicus
tgtatatttgtgtatg

SEQ ID NO: 526936 - DNA, 16 bp, R. norvegicus
tgtatcagatgtagga

SEQ ID NO: 526937 - DNA, 16 bp, R. norvegicus
tgtatcagctgacatc

SEQ ID NO: 526938 - DNA, 16 bp, R. norvegicus
tgtatcagtttcttct

SEQ ID NO: 526939 - DNA, 16 bp, R. norvegicus
tgtatccagtgtgtta

SEQ ID NO: 526940 - DNA, 16 bp, R. norvegicus
tgtatccattcctctt

SEQ ID NO: 526941 - DNA, 16 bp, R. norvegicus
tgtatccccctgatct

SEQ ID NO: 526942 - DNA, 16 bp, R. norvegicus
tgtatcctctctgtgt

SEQ ID NO: 526943 - DNA, 16 bp, R. norvegicus
tgtatctagcaaaact

SEQ ID NO: 526944 - DNA, 16 bp, R. norvegicus
tgtatctggttttatg

SEQ ID NO: 526945 - DNA, 17 bp, R. norvegicus
tgtatctgtatctgtat

SEQ ID NO: 526946 - DNA, 16 bp, R. norvegicus
tgtatcttctacacct

SEQ ID NO: 526947 - DNA, 16 bp, R. norvegicus
tgtatgaatatacata

SEQ ID NO: 526948 - DNA, 16 bp, R. norvegicus
tgtatgaatgtatgta

SEQ ID NO: 526949 - DNA, 16 bp, R. norvegicus
tgtatgacaagatctt

SEQ ID NO: 526950 - DNA, 16 bp, R. norvegicus
tgtatgacattctcaa

SEQ ID NO: 526951 - DNA, 16 bp, R. norvegicus
tgtatgagtgtgtgca

SEQ ID NO: 526952 - DNA, 16 bp, R. norvegicus
tgtatgagtgttcccc

SEQ ID NO: 526953 - DNA, 16 bp, R. norvegicus
tgtatgcatgcatgca

SEQ ID NO: 526954 - DNA, 16 bp, R. norvegicus
tgtatgcatgtataca

SEQ ID NO: 526955 - DNA, 16 bp, R. norvegicus
tgtatgcatgtatgaa

SEQ ID NO: 526956 - DNA, 16 bp, R. norvegicus
tgtatgcctggtgtgg

SEQ ID NO: 526957 - DNA, 16 bp, R. norvegicus
tgtatgcctgtgtatg

SEQ ID NO: 526958 - DNA, 16 bp, R. norvegicus
tgtatggttttgttca

SEQ ID NO: 526959 - DNA, 16 bp, R. norvegicus
tgtatgtacatgcatg

SEQ ID NO: 526960 - DNA, 16 bp, R. norvegicus
tgtatgtatataaaat

SEQ ID NO: 526961 - DNA, 16 bp, R. norvegicus
tgtatgtatatagtgt

SEQ ID NO: 526962 - DNA, 17 bp, R. norvegicus
tgtatgtatatatatat

SEQ ID NO: 526963 - DNA, 16 bp, R. norvegicus
tgtatgtatatgagta

SEQ ID NO: 526964 - DNA, 16 bp, R. norvegicus
tgtatgtatgcacatg

SEQ ID NO: 526965 - DNA, 17 bp, R. norvegicus
tgtatgtatgtatgtat

SEQ ID NO: 526966 - DNA, 16 bp, R. norvegicus
tgtatgtatgttttca

SEQ ID NO: 526967 - DNA, 16 bp, R. norvegicus
tgtatgtctgtatata

SEQ ID NO: 526968 - DNA, 16 bp, R. norvegicus
tgtatgtctgtatatg

SEQ ID NO: 526969 - DNA, 16 bp, R. norvegicus
tgtatgtctgtgcatc

SEQ ID NO: 526970 - DNA, 16 bp, R. norvegicus
tgtatgtgatatgtgt

SEQ ID NO: 526971 - DNA, 16 bp, R. norvegicus
tgtatgtgatgtgtgt

SEQ ID NO: 526972 - DNA, 16 bp, R. norvegicus
tgtatgtgcacgcatg

SEQ ID NO: 526973 - DNA, 16 bp, R. norvegicus
tgtatgtgcatacgtg

SEQ ID NO: 526974 - DNA, 16 bp, R. norvegicus
tgtatgtgggatttct

SEQ ID NO: 526975 - DNA, 16 bp, R. norvegicus
tgtatgtgggcatgtg

SEQ ID NO: 526976 - DNA, 16 bp, R. norvegicus
tgtatgtgtacatata

SEQ ID NO: 526977 - DNA, 16 bp, R. norvegicus
tgtatgtgtatgcatg

SEQ ID NO: 526978 - DNA, 16 bp, R. norvegicus
tgtatgtgtctctgtg

SEQ ID NO: 526979 - DNA, 16 bp, R. norvegicus
tgtatgtgtgctgtgt

SEQ ID NO: 526980 - DNA, 16 bp, R. norvegicus
tgtatgtgtgtgtatg

SEQ ID NO: 526981 - DNA, 16 bp, R. norvegicus
tgtatgtgtgtgtgta

SEQ ID NO: 526982 - DNA, 16 bp, R. norvegicus
tgtatgtgtgtgtgtc

SEQ ID NO: 526983 - DNA, 16 bp, R. norvegicus
tgtatgtgtttcttgt

SEQ ID NO: 526984 - DNA, 16 bp, R. norvegicus
tgtatgttctggatga

SEQ ID NO: 526985 - DNA, 16 bp, R. norvegicus
tgtatgttgaacattt

SEQ ID NO: 526986 - DNA, 16 bp, R. norvegicus
tgtatgttggagtatc

SEQ ID NO: 526987 - DNA, 16 bp, R. norvegicus
tgtattaaatatgtaa

SEQ ID NO: 526988 - DNA, 16 bp, R. norvegicus
tgtattacaccaggaa

SEQ ID NO: 526989 - DNA, 16 bp, R. norvegicus
tgtattagttactttt

SEQ ID NO: 526990 - DNA, 16 bp, R. norvegicus
tgtattagttggggtt

SEQ ID NO: 526991 - DNA, 16 bp, R. norvegicus
tgtattatatgtatgt

SEQ ID NO: 526992 - DNA, 16 bp, R. norvegicus
tgtattcatatatgta

SEQ ID NO: 526993 - DNA, 16 bp, R. norvegicus
tgtattccatggctta

SEQ ID NO: 526994 - DNA, 16 bp, R. norvegicus
tgtatttacttccttt

SEQ ID NO: 526995 - DNA, 16 bp, R. norvegicus
tgtatttatgtatgta

SEQ ID NO: 526996 - DNA, 16 bp, R. norvegicus
tgtatttcacatgctc

SEQ ID NO: 526997 - DNA, 16 bp, R. norvegicus
tgtatttcctgtacat

SEQ ID NO: 526998 - DNA, 16 bp, R. norvegicus
tgtatttctctgtctc

SEQ ID NO: 526999 - DNA, 16 bp, R. norvegicus
tgtatttcttcctgtg

SEQ ID NO: 527000 - DNA, 16 bp, R. norvegicus
tgtatttcttcctttg

SEQ ID NO: 527001 - DNA, 16 bp, R. norvegicus
tgtatttctttacctt

SEQ ID NO: 527002 - DNA, 16 bp, R. norvegicus
tgtatttctttactta

SEQ ID NO: 527003 - DNA, 16 bp, R. norvegicus
tgtatttgacatggtc

SEQ ID NO: 527004 - DNA, 16 bp, R. norvegicus
tgtatttgatcatatt

SEQ ID NO: 527005 - DNA, 16 bp, R. norvegicus
tgtatttgccatattc

SEQ ID NO: 527006 - DNA, 16 bp, R. norvegicus
tgtatttggagcagag

SEQ ID NO: 527007 - DNA, 16 bp, R. norvegicus
tgtatttgtttaaaaa

SEQ ID NO: 527008 - DNA, 18 bp, R. norvegicus
tgtattttgatgctaatt

SEQ ID NO: 527009 - DNA, 16 bp, R. norvegicus
tgtattttgttggtaa

SEQ ID NO: 527010 - DNA, 16 bp, R. norvegicus
tgtatttttaagaaaa

SEQ ID NO: 527011 - DNA, 16 bp, R. norvegicus
tgtatttttgagacag

SEQ ID NO: 527012 - DNA, 16 bp, R. norvegicus
tgtattttttcctctc

SEQ ID NO: 527013 - DNA, 16 bp, R. norvegicus
tgtcaaaacctgtaaa

SEQ ID NO: 527014 - DNA, 16 bp, R. norvegicus
tgtcaaacaaaacaaa

SEQ ID NO: 527015 - DNA, 16 bp, R. norvegicus
tgtcaaatctttcttt

SEQ ID NO: 527016 - DNA, 18 bp, R. norvegicus
tgtcaacaagcacttctt

SEQ ID NO: 527017 - DNA, 16 bp, R. norvegicus
tgtcaacagacaccat

SEQ ID NO: 527018 - DNA, 16 bp, R. norvegicus
tgtcaacatcagccta

SEQ ID NO: 527019 - DNA, 16 bp, R. norvegicus
tgtcaacttgaaacaa

SEQ ID NO: 527020 - DNA, 16 bp, R. norvegicus
tgtcaacttgacacaa

SEQ ID NO: 527021 - DNA, 16 bp, R. norvegicus
tgtcaacttgactgaa

SEQ ID NO: 527022 - DNA, 16 bp, R. norvegicus
tgtcaagcctgacaac

SEQ ID NO: 527023 - DNA, 17 bp, R. norvegicus
tgtcaaggtcttttcca

SEQ ID NO: 527024 - DNA, 16 bp, R. norvegicus
tgtcaataagacaaaa

SEQ ID NO: 527025 - DNA, 16 bp, R. norvegicus
tgtcaatccatgagca

SEQ ID NO: 527026 - DNA, 16 bp, R. norvegicus
tgtcaattctggatct

SEQ ID NO: 527027 - DNA, 16 bp, R. norvegicus
tgtcacaacaatgaga

SEQ ID NO: 527028 - DNA, 16 bp, R. norvegicus
tgtcacagaagccaga

SEQ ID NO: 527029 - DNA, 16 bp, R. norvegicus
tgtcacagcacttcaa

SEQ ID NO: 527030 - DNA, 16 bp, R. norvegicus
tgtcacagtgcacatg

SEQ ID NO: 527031 - DNA, 16 bp, R. norvegicus
tgtcacagtgtgtgtg

SEQ ID NO: 527032 - DNA, 16 bp, R. norvegicus
tgtcaccacacccagc

SEQ ID NO: 527033 - DNA, 16 bp, R. norvegicus
tgtcaccacccacaat

SEQ ID NO: 527034 - DNA, 16 bp, R. norvegicus
tgtcaccatgcacaaa

SEQ ID NO: 527035 - DNA, 16 bp, R. norvegicus
tgtcaccctcctcctc

SEQ ID NO: 527036 - DNA, 16 bp, R. norvegicus
tgtcacctgagatttt

SEQ ID NO: 527037 - DNA, 16 bp, R. norvegicus
tgtcactcacacacac

SEQ ID NO: 527038 - DNA, 16 bp, R. norvegicus
tgtcactccagctcca

SEQ ID NO: 527039 - DNA, 16 bp, R. norvegicus
tgtcactccagctctg

SEQ ID NO: 527040 - DNA, 16 bp, R. norvegicus
tgtcactctcttcaga

SEQ ID NO: 527041 - DNA, 16 bp, R. norvegicus
tgtcactgcagagccc

SEQ ID NO: 527042 - DNA, 16 bp, R. norvegicus
tgtcactgctgctcac

SEQ ID NO: 527043 - DNA, 16 bp, R. norvegicus
tgtcactgctgttgct

SEQ ID NO: 527044 - DNA, 16 bp, R. norvegicus
tgtcactgtctctctc

SEQ ID NO: 527045 - DNA, 16 bp, R. norvegicus
tgtcactgtcttcaga

SEQ ID NO: 527046 - DNA, 16 bp, R. norvegicus
tgtcactgtggaggtg

SEQ ID NO: 527047 - DNA, 16 bp, R. norvegicus
tgtcactgtggatgtg

SEQ ID NO: 527048 - DNA, 16 bp, R. norvegicus
tgtcactgtggggtag

SEQ ID NO: 527049 - DNA, 16 bp, R. norvegicus
tgtcagaaacagggtt

SEQ ID NO: 527050 - DNA, 16 bp, R. norvegicus
tgtcagaaaccctgga

SEQ ID NO: 527051 - DNA, 30 bp, R. norvegicus
tgtcagaaaccgaacgtagtgagaggttgg

SEQ ID NO: 527052 - DNA, 16 bp, R. norvegicus
tgtcagaagacagtga

SEQ ID NO: 527053 - DNA, 16 bp, R. norvegicus
tgtcagaagccatcta

SEQ ID NO: 527054 - DNA, 16 bp, R. norvegicus
tgtcagacagacagac

SEQ ID NO: 527055 - DNA, 16 bp, R. norvegicus
tgtcagactctgacag

SEQ ID NO: 527056 - DNA, 16 bp, R. norvegicus
tgtcagactgatttcc

SEQ ID NO: 527057 - DNA, 16 bp, R. norvegicus
tgtcagagcccctgga

SEQ ID NO: 527058 - DNA, 17 bp, R. norvegicus
tgtcagagccttactga

SEQ ID NO: 527059 - DNA, 16 bp, R. norvegicus
tgtcagaggatggcct

SEQ ID NO: 527060 - DNA, 16 bp, R. norvegicus
tgtcagagtctgacaa

SEQ ID NO: 527061 - DNA, 16 bp, R. norvegicus
tgtcagagtttttgac

SEQ ID NO: 527062 - DNA, 16 bp, R. norvegicus
tgtcagatcccttgga

SEQ ID NO: 527063 - DNA, 16 bp, R. norvegicus
tgtcagattccctgga

SEQ ID NO: 527064 - DNA, 16 bp, R. norvegicus
tgtcagcagatgggat

SEQ ID NO: 527065 - DNA, 16 bp, R. norvegicus
tgtcagcctctgctgt

SEQ ID NO: 527066 - DNA, 16 bp, R. norvegicus
tgtcagccttggcagc

SEQ ID NO: 527067 - DNA, 16 bp, R. norvegicus
tgtcagctcctggcag

SEQ ID NO: 527068 - DNA, 16 bp, R. norvegicus
tgtcagctgatacaga

SEQ ID NO: 527069 - DNA, 16 bp, R. norvegicus
tgtcagctgccatgtg

SEQ ID NO: 527070 - DNA, 16 bp, R. norvegicus
tgtcaggaatgtgggc

SEQ ID NO: 527071 - DNA, 16 bp, R. norvegicus
tgtcaggaattggtgc

SEQ ID NO: 527072 - DNA, 16 bp, R. norvegicus
tgtcaggagcagacat

SEQ ID NO: 527073 - DNA, 16 bp, R. norvegicus
tgtcaggctctggcaa

SEQ ID NO: 527074 - DNA, 16 bp, R. norvegicus
tgtcaggctctggctg

SEQ ID NO: 527075 - DNA, 16 bp, R. norvegicus
tgtcagtgctcctgga

SEQ ID NO: 527076 - DNA, 16 bp, R. norvegicus
tgtcagtgtgtcccac

SEQ ID NO: 527077 - DNA, 16 bp, R. norvegicus
tgtcagtgtttgtgtg

SEQ ID NO: 527078 - DNA, 16 bp, R. norvegicus
tgtcagttcagtctct

SEQ ID NO: 527079 - DNA, 16 bp, R. norvegicus
tgtcataaaagctgta

SEQ ID NO: 527080 - DNA, 16 bp, R. norvegicus
tgtcatacagattttt

SEQ ID NO: 527081 - DNA, 16 bp, R. norvegicus
tgtcatcaatggacag

SEQ ID NO: 527082 - DNA, 16 bp, R. norvegicus
tgtcatcagaaaagct

SEQ ID NO: 527083 - DNA, 16 bp, R. norvegicus
tgtcatcagtgacctt

SEQ ID NO: 527084 - DNA, 17 bp, R. norvegicus
tgtcatcatcggagccc

SEQ ID NO: 527085 - DNA, 16 bp, R. norvegicus
tgtcatcatgcacttc

SEQ ID NO: 527086 - DNA, 16 bp, R. norvegicus
tgtcatccctgtgggg

SEQ ID NO: 527087 - DNA, 19 bp, R. norvegicus
tgtcatcctcccatggtca

SEQ ID NO: 527088 - DNA, 16 bp, R. norvegicus
tgtcatccttccctct

SEQ ID NO: 527089 - DNA, 16 bp, R. norvegicus
tgtcatcgtcatcatc

SEQ ID NO: 527090 - DNA, 16 bp, R. norvegicus
tgtcatctgtctgtct

SEQ ID NO: 527091 - DNA, 16 bp, R. norvegicus
tgtcatctgtgttttt

SEQ ID NO: 527092 - DNA, 16 bp, R. norvegicus
tgtcatcttgcagtct

SEQ ID NO: 527093 - DNA, 16 bp, R. norvegicus
tgtcatgcccagaaga

SEQ ID NO: 527094 - DNA, 16 bp, R. norvegicus
tgtcattagtacaaaa

SEQ ID NO: 527095 - DNA, 16 bp, R. norvegicus
tgtcattcccctacac

SEQ ID NO: 527096 - DNA, 16 bp, R. norvegicus
tgtcattgtcatcatc

SEQ ID NO: 527097 - DNA, 16 bp, R. norvegicus
tgtcattgttgttgtt

SEQ ID NO: 527098 - DNA, 16 bp, R. norvegicus
tgtcattttcttcagt

SEQ ID NO: 527099 - DNA, 16 bp, R. norvegicus
tgtcattttttaaaaa

SEQ ID NO: 527100 - DNA, 16 bp, R. norvegicus
tgtccaacaatcccat

SEQ ID NO: 527101 - DNA, 16 bp, R. norvegicus
tgtccaagcagacaga

SEQ ID NO: 527102 - DNA, 16 bp, R. norvegicus
tgtccaaggagagaca

SEQ ID NO: 527103 - DNA, 16 bp, R. norvegicus
tgtccactctggactc

SEQ ID NO: 527104 - DNA, 16 bp, R. norvegicus
tgtccactgaggccag

SEQ ID NO: 527105 - DNA, 16 bp, R. norvegicus
tgtccactgtgggtgg

SEQ ID NO: 527106 - DNA, 16 bp, R. norvegicus
tgtccagaaaattgtc

SEQ ID NO: 527107 - DNA, 37 bp, R. norvegicus
tgtccagaattaattgaagcacttcttcattctcgaa

SEQ ID NO: 527108 - DNA, 16 bp, R. norvegicus
tgtccagactgtggag

SEQ ID NO: 527109 - DNA, 16 bp, R. norvegicus
tgtccagcaaggccat

SEQ ID NO: 527110 - DNA, 16 bp, R. norvegicus
tgtccagcatcagtgg

SEQ ID NO: 527111 - DNA, 23 bp, R. norvegicus
tgtccaggaaaccatcttgcaac

SEQ ID NO: 527112 - DNA, 29 bp, R. norvegicus
tgtccaggaaaccatcttgcaactggctg

SEQ ID NO: 527113 - DNA, 16 bp, R. norvegicus
tgtccaggaaattttc

SEQ ID NO: 527114 - DNA, 16 bp, R. norvegicus
tgtccaggaaattttt

SEQ ID NO: 527115 - DNA, 16 bp, R. norvegicus
tgtccaggatcttgtg

SEQ ID NO: 527116 - DNA, 16 bp, R. norvegicus
tgtccagggcacaggc

SEQ ID NO: 527117 - DNA, 16 bp, R. norvegicus
tgtccagtgagctcca

SEQ ID NO: 527118 - DNA, 16 bp, R. norvegicus
tgtccataaacataaa

SEQ ID NO: 527119 - DNA, 16 bp, R. norvegicus
tgtccatccttccatc

SEQ ID NO: 527120 - DNA, 16 bp, R. norvegicus
tgtccatggaggccag

SEQ ID NO: 527121 - DNA, 16 bp, R. norvegicus
tgtccatgtgtgcatg

SEQ ID NO: 527122 - DNA, 16 bp, R. norvegicus
tgtccatttcttccag

SEQ ID NO: 527123 - DNA, 16 bp, R. norvegicus
tgtccatttgttgggt

SEQ ID NO: 527124 - DNA, 17 bp, R. norvegicus
tgtcccaatctcaccag

SEQ ID NO: 527125 - DNA, 16 bp, R. norvegicus
tgtcccaccaaagcaa

SEQ ID NO: 527126 - DNA, 16 bp, R. norvegicus
tgtcccaccacaccca

SEQ ID NO: 527127 - DNA, 16 bp, R. norvegicus
tgtcccagactgctct

SEQ ID NO: 527128 - DNA, 16 bp, R. norvegicus
tgtcccagctgccaca

SEQ ID NO: 527129 - DNA, 16 bp, R. norvegicus
tgtcccaggtctctgg

SEQ ID NO: 527130 - DNA, 16 bp, R. norvegicus
tgtcccagttagggtt

SEQ ID NO: 527131 - DNA, 16 bp, R. norvegicus
tgtccccacttcctgt

SEQ ID NO: 527132 - DNA, 16 bp, R. norvegicus
tgtccccatcccaccc

SEQ ID NO: 527133 - DNA, 16 bp, R. norvegicus
tgtccccatctgacag

SEQ ID NO: 527134 - DNA, 16 bp, R. norvegicus
tgtcccccacaggctt

SEQ ID NO: 527135 - DNA, 20 bp, R. norvegicus
tgtccccgccagcggggacc

SEQ ID NO: 527136 - DNA, 16 bp, R. norvegicus
tgtcccctccccatcc

SEQ ID NO: 527137 - DNA, 17 bp, R. norvegicus
tgtcccgaggccaccag

SEQ ID NO: 527138 - DNA, 16 bp, R. norvegicus
tgtccctcctgtgggc

SEQ ID NO: 527139 - DNA, 16 bp, R. norvegicus
tgtccctctgtccaca

SEQ ID NO: 527140 - DNA, 16 bp, R. norvegicus
tgtccctctgtccctg

SEQ ID NO: 527141 - DNA, 16 bp, R. norvegicus
tgtccctctgtctctc

SEQ ID NO: 527142 - DNA, 16 bp, R. norvegicus
tgtccctgagcctgtt

SEQ ID NO: 527143 - DNA, 16 bp, R. norvegicus
tgtccctgtgctcagt

SEQ ID NO: 527144 - DNA, 16 bp, R. norvegicus
tgtccctgtgtgtctg

SEQ ID NO: 527145 - DNA, 16 bp, R. norvegicus
tgtccctttatttcct

SEQ ID NO: 527146 - DNA, 16 bp, R. norvegicus
tgtccgagggcatgct

SEQ ID NO: 527147 - DNA, 16 bp, R. norvegicus
tgtccgtctgtctgcc

SEQ ID NO: 527148 - DNA, 16 bp, R. norvegicus
tgtcctaacatcagtg

SEQ ID NO: 527149 - DNA, 16 bp, R. norvegicus
tgtcctacagagagca

SEQ ID NO: 527150 - DNA, 16 bp, R. norvegicus
tgtcctagaactcact

SEQ ID NO: 527151 - DNA, 16 bp, R. norvegicus
tgtcctagagccttcc

SEQ ID NO: 527152 - DNA, 16 bp, R. norvegicus
tgtcctatgccttaca

SEQ ID NO: 527153 - DNA, 16 bp, R. norvegicus
tgtcctcagtgcccag

SEQ ID NO: 527154 - DNA, 16 bp, R. norvegicus
tgtcctcccagaggac

SEQ ID NO: 527155 - DNA, 16 bp, R. norvegicus
tgtcctcccccagcat

SEQ ID NO: 527156 - DNA, 16 bp, R. norvegicus
tgtcctcctaaagcat

SEQ ID NO: 527157 - DNA, 16 bp, R. norvegicus
tgtcctctaacctcca

SEQ ID NO: 527158 - DNA, 16 bp, R. norvegicus
tgtcctctcacctcca

SEQ ID NO: 527159 - DNA, 16 bp, R. norvegicus
tgtcctctgacctcca

SEQ ID NO: 527160 - DNA, 16 bp, R. norvegicus
tgtcctctgaccttaa

SEQ ID NO: 527161 - DNA, 16 bp, R. norvegicus
tgtcctctgacttcca

SEQ ID NO: 527162 - DNA, 16 bp, R. norvegicus
tgtcctctgacttctg

SEQ ID NO: 527163 - DNA, 16 bp, R. norvegicus
tgtcctctggcctctg

SEQ ID NO: 527164 - DNA, 16 bp, R. norvegicus
tgtcctctggcttcca

SEQ ID NO: 527165 - DNA, 16 bp, R. norvegicus
tgtcctcttctggctt

SEQ ID NO: 527166 - DNA, 16 bp, R. norvegicus
tgtcctcttctggtgt

SEQ ID NO: 527167 - DNA, 16 bp, R. norvegicus
tgtcctcttctgtcct

SEQ ID NO: 527168 - DNA, 16 bp, R. norvegicus
tgtcctgacttctttc

SEQ ID NO: 527169 - DNA, 16 bp, R. norvegicus
tgtcctgaggacttca

SEQ ID NO: 527170 - DNA, 16 bp, R. norvegicus
tgtcctgcctgcagag

SEQ ID NO: 527171 - DNA, 16 bp, R. norvegicus
tgtcctgctgggtttc

SEQ ID NO: 527172 - DNA, 16 bp, R. norvegicus
tgtcctggaacctact

SEQ ID NO: 527173 - DNA, 16 bp, R. norvegicus
tgtcctggaactcact

SEQ ID NO: 527174 - DNA, 16 bp, R. norvegicus
tgtcctggaactggag

SEQ ID NO: 527175 - DNA, 16 bp, R. norvegicus
tgtcctggaacttaca

SEQ ID NO: 527176 - DNA, 16 bp, R. norvegicus
tgtcctggaacttgct

SEQ ID NO: 527177 - DNA, 16 bp, R. norvegicus
tgtcctggacctcact

SEQ ID NO: 527178 - DNA, 16 bp, R. norvegicus
tgtcctggagctagct

SEQ ID NO: 527179 - DNA, 16 bp, R. norvegicus
tgtcctggagctcagt

SEQ ID NO: 527180 - DNA, 16 bp, R. norvegicus
tgtcctggagctcatt

SEQ ID NO: 527181 - DNA, 16 bp, R. norvegicus
tgtcctggagctctct

SEQ ID NO: 527182 - DNA, 16 bp, R. norvegicus
tgtcctggatttcctg

SEQ ID NO: 527183 - DNA, 16 bp, R. norvegicus
tgtcctggcttccttt

SEQ ID NO: 527184 - DNA, 16 bp, R. norvegicus
tgtcctggtttgcttt

SEQ ID NO: 527185 - DNA, 16 bp, R. norvegicus
tgtcctgtatttcatt

SEQ ID NO: 527186 - DNA, 16 bp, R. norvegicus
tgtcctgtttctgtgg

SEQ ID NO: 527187 - DNA, 16 bp, R. norvegicus
tgtccttatcccttca

SEQ ID NO: 527188 - DNA, 16 bp, R. norvegicus
tgtccttattggagga

SEQ ID NO: 527189 - DNA, 16 bp, R. norvegicus
tgtccttccagaggac

SEQ ID NO: 527190 - DNA, 16 bp, R. norvegicus
tgtccttccctgtctc

SEQ ID NO: 527191 - DNA, 16 bp, R. norvegicus
tgtccttcctcacctg

SEQ ID NO: 527192 - DNA, 16 bp, R. norvegicus
tgtccttcctcatcac

SEQ ID NO: 527193 - DNA, 16 bp, R. norvegicus
tgtccttcctcatttt

SEQ ID NO: 527194 - DNA, 16 bp, R. norvegicus
tgtccttcctctgggc

SEQ ID NO: 527195 - DNA, 16 bp, R. norvegicus
tgtccttctgtgattg

SEQ ID NO: 527196 - DNA, 16 bp, R. norvegicus
tgtccttgaactcaca

SEQ ID NO: 527197 - DNA, 16 bp, R. norvegicus
tgtccttggaggtcag

SEQ ID NO: 527198 - DNA, 16 bp, R. norvegicus
tgtccttgtctgaaga

SEQ ID NO: 527199 - DNA, 17 bp, R. norvegicus
tgtcctttataagactt

SEQ ID NO: 527200 - DNA, 16 bp, R. norvegicus
tgtcctttcaggttcc

SEQ ID NO: 527201 - DNA, 16 bp, R. norvegicus
tgtcctttgacctcct

SEQ ID NO: 527202 - DNA, 16 bp, R. norvegicus
tgtcctttgatgagag

SEQ ID NO: 527203 - DNA, 16 bp, R. norvegicus
tgtccttttctgaaga

SEQ ID NO: 527204 - DNA, 16 bp, R. norvegicus
tgtcgaacatttcttt

SEQ ID NO: 527205 - DNA, 16 bp, R. norvegicus
tgtcgagatggctcag

SEQ ID NO: 527206 - DNA, 19 bp, R. norvegicus
tgtcggcgccagcaccgac

SEQ ID NO: 527207 - DNA, 16 bp, R. norvegicus
tgtcggtctgtctgtc

SEQ ID NO: 527208 - DNA, 16 bp, R. norvegicus
tgtctaaaaataaagt

SEQ ID NO: 527209 - DNA, 16 bp, R. norvegicus
tgtctaccatctatct

SEQ ID NO: 527210 - DNA, 16 bp, R. norvegicus
tgtctacctgcctgcc

SEQ ID NO: 527211 - DNA, 16 bp, R. norvegicus
tgtctactgttcttca

SEQ ID NO: 527212 - DNA, 16 bp, R. norvegicus
tgtctagaagacactg

SEQ ID NO: 527213 - DNA, 16 bp, R. norvegicus
tgtctaggagaatcca

SEQ ID NO: 527214 - DNA, 16 bp, R. norvegicus
tgtctataaccccagc

SEQ ID NO: 527215 - DNA, 16 bp, R. norvegicus
tgtctatatgtatatg

SEQ ID NO: 527216 - DNA, 16 bp, R. norvegicus
tgtctatgtctcctga

SEQ ID NO: 527217 - DNA, 16 bp, R. norvegicus
tgtctatttattgggg

SEQ ID NO: 527218 - DNA, 16 bp, R. norvegicus
tgtctcaaaaaagaaa

SEQ ID NO: 527219 - DNA, 16 bp, R. norvegicus
tgtctcaaaacaaaac

SEQ ID NO: 527220 - DNA, 16 bp, R. norvegicus
tgtctcaaagaaaata

SEQ ID NO: 527221 - DNA, 16 bp, R. norvegicus
tgtctcaaaggaaaac

SEQ ID NO: 527222 - DNA, 16 bp, R. norvegicus
tgtctcaagaaaaaaa

SEQ ID NO: 527223 - DNA, 16 bp, R. norvegicus
tgtctcaagaaacaaa

SEQ ID NO: 527224 - DNA, 16 bp, R. norvegicus
tgtctcaagaaaccaa

SEQ ID NO: 527225 - DNA, 16 bp, R. norvegicus
tgtctcaagaagaaaa

SEQ ID NO: 527226 - DNA, 16 bp, R. norvegicus
tgtctcaatatttcct

SEQ ID NO: 527227 - DNA, 16 bp, R. norvegicus
tgtctcactgaacctg

SEQ ID NO: 527228 - DNA, 16 bp, R. norvegicus
tgtctcagaaaaaaga

SEQ ID NO: 527229 - DNA, 16 bp, R. norvegicus
tgtctcagaaaaagaa

SEQ ID NO: 527230 - DNA, 16 bp, R. norvegicus
tgtctcagaaaataaa

SEQ ID NO: 527231 - DNA, 16 bp, R. norvegicus
tgtctcagaataaaaa

SEQ ID NO: 527232 - DNA, 16 bp, R. norvegicus
tgtctcagatgcagag

SEQ ID NO: 527233 - DNA, 16 bp, R. norvegicus
tgtctcaggaaaacaa

SEQ ID NO: 527234 - DNA, 16 bp, R. norvegicus
tgtctcaggagagatg

SEQ ID NO: 527235 - DNA, 16 bp, R. norvegicus
tgtctcaggagcaggg

SEQ ID NO: 527236 - DNA, 16 bp, R. norvegicus
tgtctcaggtcaggag

SEQ ID NO: 527237 - DNA, 16 bp, R. norvegicus
tgtctcagtcagctac

SEQ ID NO: 527238 - DNA, 16 bp, R. norvegicus
tgtctcagtcatctgc

SEQ ID NO: 527239 - DNA, 16 bp, R. norvegicus
tgtctccaaaaaaaaa

SEQ ID NO: 527240 - DNA, 16 bp, R. norvegicus
tgtctccaccacctga

SEQ ID NO: 527241 - DNA, 16 bp, R. norvegicus
tgtctccacccccacc

SEQ ID NO: 527242 - DNA, 16 bp, R. norvegicus
tgtctccaccgcctga

SEQ ID NO: 527243 - DNA, 16 bp, R. norvegicus
tgtctccaggagacca

SEQ ID NO: 527244 - DNA, 16 bp, R. norvegicus
tgtctccaggttattc

SEQ ID NO: 527245 - DNA, 16 bp, R. norvegicus
tgtctccatcccagcc

SEQ ID NO: 527246 - DNA, 16 bp, R. norvegicus
tgtctcccaagagctg

SEQ ID NO: 527247 - DNA, 16 bp, R. norvegicus
tgtctcccaagaggct

SEQ ID NO: 527248 - DNA, 16 bp, R. norvegicus
tgtctcccaggtgctg

SEQ ID NO: 527249 - DNA, 16 bp, R. norvegicus
tgtctccctgcagtcc

SEQ ID NO: 527250 - DNA, 17 bp, R. norvegicus
tgtctccctgtggtcta

SEQ ID NO: 527251 - DNA, 16 bp, R. norvegicus
tgtctcctaagaatca

SEQ ID NO: 527252 - DNA, 16 bp, R. norvegicus
tgtctcctacaatcct

SEQ ID NO: 527253 - DNA, 16 bp, R. norvegicus
tgtctcctaccaagga

SEQ ID NO: 527254 - DNA, 16 bp, R. norvegicus
tgtctcctgagacgct

SEQ ID NO: 527255 - DNA, 16 bp, R. norvegicus
tgtctcctgagaggct

SEQ ID NO: 527256 - DNA, 16 bp, R. norvegicus
tgtctcctgtctatgg

SEQ ID NO: 527257 - DNA, 16 bp, R. norvegicus
tgtctcctgtgaggct

SEQ ID NO: 527258 - DNA, 16 bp, R. norvegicus
tgtctccttatttcct

SEQ ID NO: 527259 - DNA, 16 bp, R. norvegicus
tgtctctatctgtgtg

SEQ ID NO: 527260 - DNA, 16 bp, R. norvegicus
tgtctctcaagagaca

SEQ ID NO: 527261 - DNA, 16 bp, R. norvegicus
tgtctctcactggcct

SEQ ID NO: 527262 - DNA, 16 bp, R. norvegicus
tgtctctccctgtctc

SEQ ID NO: 527263 - DNA, 16 bp, R. norvegicus
tgtctctccctttctg

SEQ ID NO: 527264 - DNA, 16 bp, R. norvegicus
tgtctctcctctgtct

SEQ ID NO: 527265 - DNA, 16 bp, R. norvegicus
tgtctctctacctctg

SEQ ID NO: 527266 - DNA, 16 bp, R. norvegicus
tgtctctctatccatc

SEQ ID NO: 527267 - DNA, 16 bp, R. norvegicus
tgtctctctcagggaa

SEQ ID NO: 527268 - DNA, 16 bp, R. norvegicus
tgtctctctgactctg

SEQ ID NO: 527269 - DNA, 16 bp, R. norvegicus
tgtctctctgtctgtc

SEQ ID NO: 527270 - DNA, 16 bp, R. norvegicus
tgtctctctgtgtgtg

SEQ ID NO: 527271 - DNA, 16 bp, R. norvegicus
tgtctctgactgtctc

SEQ ID NO: 527272 - DNA, 16 bp, R. norvegicus
tgtctctgactttttt

SEQ ID NO: 527273 - DNA, 16 bp, R. norvegicus
tgtctctgaggtgttt

SEQ ID NO: 527274 - DNA, 16 bp, R. norvegicus
tgtctctgcacagcaa

SEQ ID NO: 527275 - DNA, 16 bp, R. norvegicus
tgtctctgccccaccc

SEQ ID NO: 527276 - DNA, 16 bp, R. norvegicus
tgtctctgcctctcaa

SEQ ID NO: 527277 - DNA, 16 bp, R. norvegicus
tgtctctgcctttctg

SEQ ID NO: 527278 - DNA, 16 bp, R. norvegicus
tgtctctgcttctgtg

SEQ ID NO: 527279 - DNA, 16 bp, R. norvegicus
tgtctctggatagaga

SEQ ID NO: 527280 - DNA, 16 bp, R. norvegicus
tgtctctggatgacct

SEQ ID NO: 527281 - DNA, 16 bp, R. norvegicus
tgtctctgggaatctc

SEQ ID NO: 527282 - DNA, 16 bp, R. norvegicus
tgtctctgtacttcct

SEQ ID NO: 527283 - DNA, 16 bp, R. norvegicus
tgtctctgtataaata

SEQ ID NO: 527284 - DNA, 16 bp, R. norvegicus
tgtctctgtatattca

SEQ ID NO: 527285 - DNA, 16 bp, R. norvegicus
tgtctctgtcactcca

SEQ ID NO: 527286 - DNA, 17 bp, R. norvegicus
tgtctctgtctctgtct

SEQ ID NO: 527287 - DNA, 16 bp, R. norvegicus
tgtctctgtgccatct

SEQ ID NO: 527288 - DNA, 16 bp, R. norvegicus
tgtctctgtgcctgtg

SEQ ID NO: 527289 - DNA, 16 bp, R. norvegicus
tgtctctgtgtatgtg

SEQ ID NO: 527290 - DNA, 17 bp, R. norvegicus
tgtctctgtgtctctgt

SEQ ID NO: 527291 - DNA, 16 bp, R. norvegicus
tgtctctgtgtgtgag

SEQ ID NO: 527292 - DNA, 16 bp, R. norvegicus
tgtctctgtgtttctg

SEQ ID NO: 527293 - DNA, 16 bp, R. norvegicus
tgtctcttactttggt

SEQ ID NO: 527294 - DNA, 16 bp, R. norvegicus
tgtctcttcacaacag

SEQ ID NO: 527295 - DNA, 16 bp, R. norvegicus
tgtctcttcctcctca

SEQ ID NO: 527296 - DNA, 16 bp, R. norvegicus
tgtctcttgggagaga

SEQ ID NO: 527297 - DNA, 16 bp, R. norvegicus
tgtctctttttaaaaa

SEQ ID NO: 527298 - DNA, 16 bp, R. norvegicus
tgtctgaaaccatgct

SEQ ID NO: 527299 - DNA, 16 bp, R. norvegicus
tgtctgaagaatctgc

SEQ ID NO: 527300 - DNA, 16 bp, R. norvegicus
tgtctgaagacagcat

SEQ ID NO: 527301 - DNA, 16 bp, R. norvegicus
tgtctgaagacattga

SEQ ID NO: 527302 - DNA, 16 bp, R. norvegicus
tgtctgaagagaatga

SEQ ID NO: 527303 - DNA, 16 bp, R. norvegicus
tgtctgaagagactga

SEQ ID NO: 527304 - DNA, 16 bp, R. norvegicus
tgtctgaagatagcaa

SEQ ID NO: 527305 - DNA, 16 bp, R. norvegicus
tgtctgactctctgtc

SEQ ID NO: 527306 - DNA, 17 bp, R. norvegicus
tgtctgagatctgtaca

SEQ ID NO: 527307 - DNA, 16 bp, R. norvegicus
tgtctgaggacagcca

SEQ ID NO: 527308 - DNA, 16 bp, R. norvegicus
tgtctgaggaggccag

SEQ ID NO: 527309 - DNA, 16 bp, R. norvegicus
tgtctgagtgttttgc

SEQ ID NO: 527310 - DNA, 16 bp, R. norvegicus
tgtctgagttacctca

SEQ ID NO: 527311 - DNA, 16 bp, R. norvegicus
tgtctgatgtcaaagt

SEQ ID NO: 527312 - DNA, 16 bp, R. norvegicus
tgtctgcaaaaagaaa

SEQ ID NO: 527313 - DNA, 16 bp, R. norvegicus
tgtctgcctctctaaa

SEQ ID NO: 527314 - DNA, 16 bp, R. norvegicus
tgtctgcctggaagct

SEQ ID NO: 527315 - DNA, 16 bp, R. norvegicus
tgtctgcctggactct

SEQ ID NO: 527316 - DNA, 16 bp, R. norvegicus
tgtctgcctgtctgtc

SEQ ID NO: 527317 - DNA, 16 bp, R. norvegicus
tgtctgcctgtttgtc

SEQ ID NO: 527318 - DNA, 16 bp, R. norvegicus
tgtctgcctttggaac

SEQ ID NO: 527319 - DNA, 16 bp, R. norvegicus
tgtctgctcctctgaa

SEQ ID NO: 527320 - DNA, 16 bp, R. norvegicus
tgtctgcttctgcttc

SEQ ID NO: 527321 - DNA, 16 bp, R. norvegicus
tgtctgcttgcttgct

SEQ ID NO: 527322 - DNA, 16 bp, R. norvegicus
tgtctggaggtcagag

SEQ ID NO: 527323 - DNA, 16 bp, R. norvegicus
tgtctggccacagtgg

SEQ ID NO: 527324 - DNA, 16 bp, R. norvegicus
tgtctgggaagccaga

SEQ ID NO: 527325 - DNA, 16 bp, R. norvegicus
tgtctgggaatctggt

SEQ ID NO: 527326 - DNA, 16 bp, R. norvegicus
tgtctgggagcagtga

SEQ ID NO: 527327 - DNA, 16 bp, R. norvegicus
tgtctgggagctccca

SEQ ID NO: 527328 - DNA, 16 bp, R. norvegicus
tgtctggtatcattgc

SEQ ID NO: 527329 - DNA, 16 bp, R. norvegicus
tgtctggtgcccatgg

SEQ ID NO: 527330 - DNA, 16 bp, R. norvegicus
tgtctggtgtgaggtg

SEQ ID NO: 527331 - DNA, 16 bp, R. norvegicus
tgtctgtatatttgtg

SEQ ID NO: 527332 - DNA, 16 bp, R. norvegicus
tgtctgtatctccagt

SEQ ID NO: 527333 - DNA, 16 bp, R. norvegicus
tgtctgtcatcaatag

SEQ ID NO: 527334 - DNA, 16 bp, R. norvegicus
tgtctgtcatcccagc

SEQ ID NO: 527335 - DNA, 16 bp, R. norvegicus
tgtctgtccatctgtc

SEQ ID NO: 527336 - DNA, 16 bp, R. norvegicus
tgtctgtctatctttc

SEQ ID NO: 527337 - DNA, 16 bp, R. norvegicus
tgtctgtctctctccc

SEQ ID NO: 527338 - DNA, 16 bp, R. norvegicus
tgtctgtctgtcagcc

SEQ ID NO: 527339 - DNA, 16 bp, R. norvegicus
tgtctgtctgtccatc

SEQ ID NO: 527340 - DNA, 16 bp, R. norvegicus
tgtctgtctgtcccca

SEQ ID NO: 527341 - DNA, 16 bp, R. norvegicus
tgtctgtctgtctgca

SEQ ID NO: 527342 - DNA, 17 bp, R. norvegicus
tgtctgtctgtctgtct

SEQ ID NO: 527343 - DNA, 16 bp, R. norvegicus
tgtctgtctgtgtggt

SEQ ID NO: 527344 - DNA, 16 bp, R. norvegicus
tgtctgtctgtttgct

SEQ ID NO: 527345 - DNA, 16 bp, R. norvegicus
tgtctgtctttctgtg

SEQ ID NO: 527346 - DNA, 16 bp, R. norvegicus
tgtctgtctttgcctc

SEQ ID NO: 527347 - DNA, 16 bp, R. norvegicus
tgtctgtgactgctgt

SEQ ID NO: 527348 - DNA, 16 bp, R. norvegicus
tgtctgtgactgtgtg

SEQ ID NO: 527349 - DNA, 16 bp, R. norvegicus
tgtctgtgagagactg

SEQ ID NO: 527350 - DNA, 16 bp, R. norvegicus
tgtctgtgagcatctg

SEQ ID NO: 527351 - DNA, 16 bp, R. norvegicus
tgtctgtgatggctgt

SEQ ID NO: 527352 - DNA, 16 bp, R. norvegicus
tgtctgtggaagccag

SEQ ID NO: 527353 - DNA, 16 bp, R. norvegicus
tgtctgtggttgagaa

SEQ ID NO: 527354 - DNA, 16 bp, R. norvegicus
tgtctgtgtgagtgag

SEQ ID NO: 527355 - DNA, 16 bp, R. norvegicus
tgtctgtgtgcgcgtg

SEQ ID NO: 527356 - DNA, 16 bp, R. norvegicus
tgtctgtgtggagtgc

SEQ ID NO: 527357 - DNA, 16 bp, R. norvegicus
tgtctgtgtgtataag

SEQ ID NO: 527358 - DNA, 16 bp, R. norvegicus
tgtctgtgtgtgtctc

SEQ ID NO: 527359 - DNA, 16 bp, R. norvegicus
tgtctgtgtgtttgca

SEQ ID NO: 527360 - DNA, 16 bp, R. norvegicus
tgtctgtgttatatgt

SEQ ID NO: 527361 - DNA, 16 bp, R. norvegicus
tgtctgtgtttgatga

SEQ ID NO: 527362 - DNA, 16 bp, R. norvegicus
tgtctgtgtttggtga

SEQ ID NO: 527363 - DNA, 16 bp, R. norvegicus
tgtctgtgtttgtgag

SEQ ID NO: 527364 - DNA, 16 bp, R. norvegicus
tgtctgtgttttccaa

SEQ ID NO: 527365 - DNA, 16 bp, R. norvegicus
tgtctgttctcagcaa

SEQ ID NO: 527366 - DNA, 16 bp, R. norvegicus
tgtctgtttgtctctg

SEQ ID NO: 527367 - DNA, 16 bp, R. norvegicus
tgtctgttttcatgcc

SEQ ID NO: 527368 - DNA, 16 bp, R. norvegicus
tgtctgtttttgtacc

SEQ ID NO: 527369 - DNA, 16 bp, R. norvegicus
tgtcttaaaaatgaaa

SEQ ID NO: 527370 - DNA, 16 bp, R. norvegicus
tgtcttaaaaattaaa

SEQ ID NO: 527371 - DNA, 16 bp, R. norvegicus
tgtcttaaaaccatgg

SEQ ID NO: 527372 - DNA, 16 bp, R. norvegicus
tgtcttactaagtctt

SEQ ID NO: 527373 - DNA, 16 bp, R. norvegicus
tgtcttactgactatg

SEQ ID NO: 527374 - DNA, 16 bp, R. norvegicus
tgtcttagagtttcta

SEQ ID NO: 527375 - DNA, 16 bp, R. norvegicus
tgtcttagccagggtt

SEQ ID NO: 527376 - DNA, 16 bp, R. norvegicus
tgtcttcaaaaagaaa

SEQ ID NO: 527377 - DNA, 16 bp, R. norvegicus
tgtcttcaataacaaa

SEQ ID NO: 527378 - DNA, 16 bp, R. norvegicus
tgtcttcagacacttc

SEQ ID NO: 527379 - DNA, 16 bp, R. norvegicus
tgtcttcagatacaga

SEQ ID NO: 527380 - DNA, 16 bp, R. norvegicus
tgtcttcatatacacc

SEQ ID NO: 527381 - DNA, 16 bp, R. norvegicus
tgtcttcatcaaatcc

SEQ ID NO: 527382 - DNA, 16 bp, R. norvegicus
tgtcttcatgtatgtc

SEQ ID NO: 527383 - DNA, 16 bp, R. norvegicus
tgtcttccagaagctt

SEQ ID NO: 527384 - DNA, 16 bp, R. norvegicus
tgtcttccaggaagct

SEQ ID NO: 527385 - DNA, 16 bp, R. norvegicus
tgtcttcctctgcctc

SEQ ID NO: 527386 - DNA, 16 bp, R. norvegicus
tgtcttctaggctcca

SEQ ID NO: 527387 - DNA, 16 bp, R. norvegicus
tgtcttctctgccctg

SEQ ID NO: 527388 - DNA, 16 bp, R. norvegicus
tgtcttctgagctcca

SEQ ID NO: 527389 - DNA, 16 bp, R. norvegicus
tgtcttctgaggacag

SEQ ID NO: 527390 - DNA, 16 bp, R. norvegicus
tgtcttctgatcttca

SEQ ID NO: 527391 - DNA, 16 bp, R. norvegicus
tgtcttctgcaggcag

SEQ ID NO: 527392 - DNA, 16 bp, R. norvegicus
tgtcttctgctctgca

SEQ ID NO: 527393 - DNA, 16 bp, R. norvegicus
tgtcttctggacatga

SEQ ID NO: 527394 - DNA, 16 bp, R. norvegicus
tgtcttgaaaaacaaa

SEQ ID NO: 527395 - DNA, 16 bp, R. norvegicus
tgtcttgaaaattgtc

SEQ ID NO: 527396 - DNA, 16 bp, R. norvegicus
tgtcttggaaaaaaaa

SEQ ID NO: 527397 - DNA, 16 bp, R. norvegicus
tgtcttgtctgtctct

SEQ ID NO: 527398 - DNA, 16 bp, R. norvegicus
tgtctttaaaaaatat

SEQ ID NO: 527399 - DNA, 16 bp, R. norvegicus
tgtctttatgcaggtg

SEQ ID NO: 527400 - DNA, 16 bp, R. norvegicus
tgtctttcctcagtgg

SEQ ID NO: 527401 - DNA, 16 bp, R. norvegicus
tgtctttctgctgaag

SEQ ID NO: 527402 - DNA, 16 bp, R. norvegicus
tgtctttggatgtgat

SEQ ID NO: 527403 - DNA, 16 bp, R. norvegicus
tgtctttgtcactgtg

SEQ ID NO: 527404 - DNA, 16 bp, R. norvegicus
tgtctttgtctctgag

SEQ ID NO: 527405 - DNA, 16 bp, R. norvegicus
tgtctttgtctgtgtc

SEQ ID NO: 527406 - DNA, 16 bp, R. norvegicus
tgtctttgtggtagga

SEQ ID NO: 527407 - DNA, 19 bp, R. norvegicus
tgtctttgttatatgttgg

SEQ ID NO: 527408 - DNA, 16 bp, R. norvegicus
tgtctttgttgtatgt

SEQ ID NO: 527409 - DNA, 16 bp, R. norvegicus
tgtcttttcacagaaa

SEQ ID NO: 527410 - DNA, 16 bp, R. norvegicus
tgtcttttgttctcag

SEQ ID NO: 527411 - DNA, 17 bp, R. norvegicus
tgtctttttattgggga

SEQ ID NO: 527412 - DNA, 16 bp, R. norvegicus
tgtgaaaacatcagca

SEQ ID NO: 527413 - DNA, 16 bp, R. norvegicus
tgtgaaaagcaagtcc

SEQ ID NO: 527414 - DNA, 16 bp, R. norvegicus
tgtgaaagcttgtttc

SEQ ID NO: 527415 - DNA, 16 bp, R. norvegicus
tgtgaaagtgtaagct

SEQ ID NO: 527416 - DNA, 16 bp, R. norvegicus
tgtgaaatccatgtac

SEQ ID NO: 527417 - DNA, 16 bp, R. norvegicus
tgtgaacacgctgcac

SEQ ID NO: 527418 - DNA, 16 bp, R. norvegicus
tgtgaacatgcacaca

SEQ ID NO: 527419 - DNA, 16 bp, R. norvegicus
tgtgaacatggtggag

SEQ ID NO: 527420 - DNA, 16 bp, R. norvegicus
tgtgaagaagaagaag

SEQ ID NO: 527421 - DNA, 16 bp, R. norvegicus
tgtgaagaccaggctg

SEQ ID NO: 527422 - DNA, 16 bp, R. norvegicus
tgtgaagagaaaccat

SEQ ID NO: 527423 - DNA, 16 bp, R. norvegicus
tgtgaagagtgttgtt

SEQ ID NO: 527424 - DNA, 16 bp, R. norvegicus
tgtgaagcaggaatta

SEQ ID NO: 527425 - DNA, 16 bp, R. norvegicus
tgtgaagctcactgtg

SEQ ID NO: 527426 - DNA, 16 bp, R. norvegicus
tgtgaagctgctgaca

SEQ ID NO: 527427 - DNA, 16 bp, R. norvegicus
tgtgaaggccccatag

SEQ ID NO: 527428 - DNA, 16 bp, R. norvegicus
tgtgaagggcatcatt

SEQ ID NO: 527429 - DNA, 16 bp, R. norvegicus
tgtgaagggtatcatt

SEQ ID NO: 527430 - DNA, 16 bp, R. norvegicus
tgtgaagggtgacatt

SEQ ID NO: 527431 - DNA, 16 bp, R. norvegicus
tgtgaagggtgttgtc

SEQ ID NO: 527432 - DNA, 16 bp, R. norvegicus
tgtgaaggttgtcatt

SEQ ID NO: 527433 - DNA, 16 bp, R. norvegicus
tgtgaagtggatgttg

SEQ ID NO: 527434 - DNA, 16 bp, R. norvegicus
tgtgaagtgtccttcc

SEQ ID NO: 527435 - DNA, 16 bp, R. norvegicus
tgtgaatcttcactct

SEQ ID NO: 527436 - DNA, 16 bp, R. norvegicus
tgtgaatgagtgtgag

SEQ ID NO: 527437 - DNA, 16 bp, R. norvegicus
tgtgaatgcatgtgta

SEQ ID NO: 527438 - DNA, 16 bp, R. norvegicus
tgtgaatgccaagaag

SEQ ID NO: 527439 - DNA, 16 bp, R. norvegicus
tgtgaatgtgggtgtg

SEQ ID NO: 527440 - DNA, 16 bp, R. norvegicus
tgtgaatgtgtgcatg

SEQ ID NO: 527441 - DNA, 16 bp, R. norvegicus
tgtgaatgtttcagtc

SEQ ID NO: 527442 - DNA, 16 bp, R. norvegicus
tgtgaattgccatgtg

SEQ ID NO: 527443 - DNA, 16 bp, R. norvegicus
tgtgaattgtatattg

SEQ ID NO: 527444 - DNA, 16 bp, R. norvegicus
tgtgaatttcatgaag

SEQ ID NO: 527445 - DNA, 16 bp, R. norvegicus
tgtgaatttgaagcca

SEQ ID NO: 527446 - DNA, 16 bp, R. norvegicus
tgtgaatttttcctta

SEQ ID NO: 527447 - DNA, 16 bp, R. norvegicus
tgtgacaaacatttac

SEQ ID NO: 527448 - DNA, 16 bp, R. norvegicus
tgtgacaaatgcttta

SEQ ID NO: 527449 - DNA, 16 bp, R. norvegicus
tgtgacaagtgcttta

SEQ ID NO: 527450 - DNA, 16 bp, R. norvegicus
tgtgacagacagacag

SEQ ID NO: 527451 - DNA, 16 bp, R. norvegicus
tgtgacagagacagac

SEQ ID NO: 527452 - DNA, 16 bp, R. norvegicus
tgtgacagtgtgtgtg

SEQ ID NO: 527453 - DNA, 16 bp, R. norvegicus
tgtgacatctccccta

SEQ ID NO: 527454 - DNA, 16 bp, R. norvegicus
tgtgacatctgggatg

SEQ ID NO: 527455 - DNA, 16 bp, R. norvegicus
tgtgaccatggcaact

SEQ ID NO: 527456 - DNA, 16 bp, R. norvegicus
tgtgacccaagtgctg

SEQ ID NO: 527457 - DNA, 16 bp, R. norvegicus
tgtgaccccagcacta

SEQ ID NO: 527458 - DNA, 16 bp, R. norvegicus
tgtgaccccagtgctg

SEQ ID NO: 527459 - DNA, 16 bp, R. norvegicus
tgtgaccccataggaa

SEQ ID NO: 527460 - DNA, 16 bp, R. norvegicus
tgtgaccctcagtgac

SEQ ID NO: 527461 - DNA, 16 bp, R. norvegicus
tgtgacctgagagttg

SEQ ID NO: 527462 - DNA, 16 bp, R. norvegicus
tgtgaccttgaacaaa

SEQ ID NO: 527463 - DNA, 16 bp, R. norvegicus
tgtgaccttgtttgag

SEQ ID NO: 527464 - DNA, 16 bp, R. norvegicus
tgtgactataaccaag

SEQ ID NO: 527465 - DNA, 16 bp, R. norvegicus
tgtgactatgtgtgtg

SEQ ID NO: 527466 - DNA, 16 bp, R. norvegicus
tgtgactcctgcctca

SEQ ID NO: 527467 - DNA, 16 bp, R. norvegicus
tgtgactctggagaac

SEQ ID NO: 527468 - DNA, 16 bp, R. norvegicus
tgtgactgcatcctag

SEQ ID NO: 527469 - DNA, 16 bp, R. norvegicus
tgtgactgtctgtgtg

SEQ ID NO: 527470 - DNA, 16 bp, R. norvegicus
tgtgactgtgactgtg

SEQ ID NO: 527471 - DNA, 16 bp, R. norvegicus
tgtgactgtgcatgtg

SEQ ID NO: 527472 - DNA, 16 bp, R. norvegicus
tgtgactgtgtgtacc

SEQ ID NO: 527473 - DNA, 16 bp, R. norvegicus
tgtgactgtgtgtgtg

SEQ ID NO: 527474 - DNA, 16 bp, R. norvegicus
tgtgacttcaaggcca

SEQ ID NO: 527475 - DNA, 16 bp, R. norvegicus
tgtgagaacacacaca

SEQ ID NO: 527476 - DNA, 17 bp, R. norvegicus
tgtgagaacatgaactt

SEQ ID NO: 527477 - DNA, 16 bp, R. norvegicus
tgtgagaattttattg

SEQ ID NO: 527478 - DNA, 16 bp, R. norvegicus
tgtgagacagccattg

SEQ ID NO: 527479 - DNA, 16 bp, R. norvegicus
tgtgagagacacacag

SEQ ID NO: 527480 - DNA, 16 bp, R. norvegicus
tgtgagagagagacag

SEQ ID NO: 527481 - DNA, 16 bp, R. norvegicus
tgtgagagagagtgag

SEQ ID NO: 527482 - DNA, 16 bp, R. norvegicus
tgtgagagcatgtgtg

SEQ ID NO: 527483 - DNA, 16 bp, R. norvegicus
tgtgagagctgtgcag

SEQ ID NO: 527484 - DNA, 16 bp, R. norvegicus
tgtgagcaaaagtggt

SEQ ID NO: 527485 - DNA, 16 bp, R. norvegicus
tgtgagcacaaggata

SEQ ID NO: 527486 - DNA, 16 bp, R. norvegicus
tgtgagcatgtgagag

SEQ ID NO: 527487 - DNA, 16 bp, R. norvegicus
tgtgagccaacatgta

SEQ ID NO: 527488 - DNA, 16 bp, R. norvegicus
tgtgagccaccctgta

SEQ ID NO: 527489 - DNA, 16 bp, R. norvegicus
tgtgagccacctgacc

SEQ ID NO: 527490 - DNA, 16 bp, R. norvegicus
tgtgagccagccccag

SEQ ID NO: 527491 - DNA, 16 bp, R. norvegicus
tgtgagcccctgtgag

SEQ ID NO: 527492 - DNA, 16 bp, R. norvegicus
tgtgagcctctgtgtt

SEQ ID NO: 527493 - DNA, 16 bp, R. norvegicus
tgtgagcctggccttt

SEQ ID NO: 527494 - DNA, 16 bp, R. norvegicus
tgtgagcctgtaatct

SEQ ID NO: 527495 - DNA, 16 bp, R. norvegicus
tgtgagctcaaggcca

SEQ ID NO: 527496 - DNA, 16 bp, R. norvegicus
tgtgagctgccagatg

SEQ ID NO: 527497 - DNA, 16 bp, R. norvegicus
tgtgagctgccatgtg

SEQ ID NO: 527498 - DNA, 16 bp, R. norvegicus
tgtgagctgccctgtg

SEQ ID NO: 527499 - DNA, 16 bp, R. norvegicus
tgtgaggaaattcaaa

SEQ ID NO: 527500 - DNA, 31 bp, R. norvegicus
tgtgaggaatgctgctgtgcactgactgtgt

SEQ ID NO: 527501 - DNA, 16 bp, R. norvegicus
tgtgaggacagctcct

SEQ ID NO: 527502 - DNA, 16 bp, R. norvegicus
tgtgaggagcaatgtg

SEQ ID NO: 527503 - DNA, 16 bp, R. norvegicus
tgtgaggagggaggct

SEQ ID NO: 527504 - DNA, 16 bp, R. norvegicus
tgtgaggcagaggcca

SEQ ID NO: 527505 - DNA, 16 bp, R. norvegicus
tgtgaggccagcctgg

SEQ ID NO: 527506 - DNA, 16 bp, R. norvegicus
tgtgaggccctgggct

SEQ ID NO: 527507 - DNA, 16 bp, R. norvegicus
tgtgagggagaagaaa

SEQ ID NO: 527508 - DNA, 16 bp, R. norvegicus
tgtgagggcttgatgc

SEQ ID NO: 527509 - DNA, 16 bp, R. norvegicus
tgtgagggtgttgaat

SEQ ID NO: 527510 - DNA, 16 bp, R. norvegicus
tgtgagtcagaggcca

SEQ ID NO: 527511 - DNA, 16 bp, R. norvegicus
tgtgagtctcagggat

SEQ ID NO: 527512 - DNA, 16 bp, R. norvegicus
tgtgagtgcacgtgtg

SEQ ID NO: 527513 - DNA, 16 bp, R. norvegicus
tgtgagtgccacagtg

SEQ ID NO: 527514 - DNA, 16 bp, R. norvegicus
tgtgagtgtccatgtg

SEQ ID NO: 527515 - DNA, 16 bp, R. norvegicus
tgtgagtgtctgtgtg

SEQ ID NO: 527516 - DNA, 16 bp, R. norvegicus
tgtgagtgtgaatgtg

SEQ ID NO: 527517 - DNA, 16 bp, R. norvegicus
tgtgagtgtgactgtg

SEQ ID NO: 527518 - DNA, 16 bp, R. norvegicus
tgtgagtgtgcgtgtg

SEQ ID NO: 527519 - DNA, 16 bp, R. norvegicus
tgtgagtgtgtgagtg

SEQ ID NO: 527520 - DNA, 16 bp, R. norvegicus
tgtgagtgtgtgcatg

SEQ ID NO: 527521 - DNA, 16 bp, R. norvegicus
tgtgagttcaagacca

SEQ ID NO: 527522 - DNA, 16 bp, R. norvegicus
tgtgagttcaaggcca

SEQ ID NO: 527523 - DNA, 16 bp, R. norvegicus
tgtgagttcatatgca

SEQ ID NO: 527524 - DNA, 16 bp, R. norvegicus
tgtgagttccaagaca

SEQ ID NO: 527525 - DNA, 16 bp, R. norvegicus
tgtgagtttcagtcct

SEQ ID NO: 527526 - DNA, 16 bp, R. norvegicus
tgtgagttttcatttc

SEQ ID NO: 527527 - DNA, 16 bp, R. norvegicus
tgtgatatgtgtgtgc

SEQ ID NO: 527528 - DNA, 16 bp, R. norvegicus
tgtgatctgctttttg

SEQ ID NO: 527529 - DNA, 16 bp, R. norvegicus
tgtgatgaaaccccat

SEQ ID NO: 527530 - DNA, 16 bp, R. norvegicus
tgtgatgaaggattct

SEQ ID NO: 527531 - DNA, 16 bp, R. norvegicus
tgtgatgtaactgctc

SEQ ID NO: 527532 - DNA, 16 bp, R. norvegicus
tgtgatgtctgtgtgt

SEQ ID NO: 527533 - DNA, 16 bp, R. norvegicus
tgtgatgtcttcagca

SEQ ID NO: 527534 - DNA, 16 bp, R. norvegicus
tgtgattctaaccaaa

SEQ ID NO: 527535 - DNA, 16 bp, R. norvegicus
tgtgattctaaccaag

SEQ ID NO: 527536 - DNA, 16 bp, R. norvegicus
tgtgattcttttaaga

SEQ ID NO: 527537 - DNA, 16 bp, R. norvegicus
tgtgattgggcagtgg

SEQ ID NO: 527538 - DNA, 16 bp, R. norvegicus
tgtgattgttggggag

SEQ ID NO: 527539 - DNA, 16 bp, R. norvegicus
tgtgattttaaaagaa

SEQ ID NO: 527540 - DNA, 16 bp, R. norvegicus
tgtgattttcttcctt

SEQ ID NO: 527541 - DNA, 16 bp, R. norvegicus
tgtgatttttatggag

SEQ ID NO: 527542 - DNA, 16 bp, R. norvegicus
tgtgcaaatgcatgtg

SEQ ID NO: 527543 - DNA, 16 bp, R. norvegicus
tgtgcaacacacacac

SEQ ID NO: 527544 - DNA, 16 bp, R. norvegicus
tgtgcaagcctgagga

SEQ ID NO: 527545 - DNA, 16 bp, R. norvegicus
tgtgcaaggccctgag

SEQ ID NO: 527546 - DNA, 16 bp, R. norvegicus
tgtgcaaggccctggg

SEQ ID NO: 527547 - DNA, 16 bp, R. norvegicus
tgtgcaagtatgtgtg

SEQ ID NO: 527548 - DNA, 16 bp, R. norvegicus
tgtgcaatgcctgtgg

SEQ ID NO: 527549 - DNA, 16 bp, R. norvegicus
tgtgcacacacaacac

SEQ ID NO: 527550 - DNA, 16 bp, R. norvegicus
tgtgcacacacaagtg

SEQ ID NO: 527551 - DNA, 16 bp, R. norvegicus
tgtgcacacacacaca

SEQ ID NO: 527552 - DNA, 16 bp, R. norvegicus
tgtgcacacacatcca

SEQ ID NO: 527553 - DNA, 16 bp, R. norvegicus
tgtgcacagagtgctc

SEQ ID NO: 527554 - DNA, 16 bp, R. norvegicus
tgtgcacagatgcaca

SEQ ID NO: 527555 - DNA, 16 bp, R. norvegicus
tgtgcacatgcgcaca

SEQ ID NO: 527556 - DNA, 16 bp, R. norvegicus
tgtgcacatgtatgtg

SEQ ID NO: 527557 - DNA, 16 bp, R. norvegicus
tgtgcacatgtgcatg

SEQ ID NO: 527558 - DNA, 16 bp, R. norvegicus
tgtgcacatgtgtttt

SEQ ID NO: 527559 - DNA, 16 bp, R. norvegicus
tgtgcaccaaggatga

SEQ ID NO: 527560 - DNA, 16 bp, R. norvegicus
tgtgcaccacatgtgt

SEQ ID NO: 527561 - DNA, 16 bp, R. norvegicus
tgtgcaccaccacacc

SEQ ID NO: 527562 - DNA, 16 bp, R. norvegicus
tgtgcaccaggctggc

SEQ ID NO: 527563 - DNA, 16 bp, R. norvegicus
tgtgcaccagggtccc

SEQ ID NO: 527564 - DNA, 16 bp, R. norvegicus
tgtgcacctgcacaca

SEQ ID NO: 527565 - DNA, 16 bp, R. norvegicus
tgtgcacctgtgtgtg

SEQ ID NO: 527566 - DNA, 16 bp, R. norvegicus
tgtgcacgtgtgtgca

SEQ ID NO: 527567 - DNA, 16 bp, R. norvegicus
tgtgcacgtgtgtgcc

SEQ ID NO: 527568 - DNA, 16 bp, R. norvegicus
tgtgcactgcatgtgt

SEQ ID NO: 527569 - DNA, 16 bp, R. norvegicus
tgtgcagacacatgtg

SEQ ID NO: 527570 - DNA, 16 bp, R. norvegicus
tgtgcagacagacatg

SEQ ID NO: 527571 - DNA, 16 bp, R. norvegicus
tgtgcagacaggagga

SEQ ID NO: 527572 - DNA, 16 bp, R. norvegicus
tgtgcagaggccagag

SEQ ID NO: 527573 - DNA, 16 bp, R. norvegicus
tgtgcagatgtgcatg

SEQ ID NO: 527574 - DNA, 16 bp, R. norvegicus
tgtgcagcaggctctg

SEQ ID NO: 527575 - DNA, 16 bp, R. norvegicus
tgtgcaggagacagag

SEQ ID NO: 527576 - DNA, 16 bp, R. norvegicus
tgtgcaggcacacatg

SEQ ID NO: 527577 - DNA, 16 bp, R. norvegicus
tgtgcaggcctggccc

SEQ ID NO: 527578 - DNA, 16 bp, R. norvegicus
tgtgcagggggcccag

SEQ ID NO: 527579 - DNA, 16 bp, R. norvegicus
tgtgcaggtgaggcca

SEQ ID NO: 527580 - DNA, 16 bp, R. norvegicus
tgtgcaggtgcatgtg

SEQ ID NO: 527581 - DNA, 16 bp, R. norvegicus
tgtgcaggtgcctgtg

SEQ ID NO: 527582 - DNA, 16 bp, R. norvegicus
tgtgcagtgcctgtgg

SEQ ID NO: 527583 - DNA, 16 bp, R. norvegicus
tgtgcagtgtgaggga

SEQ ID NO: 527584 - DNA, 16 bp, R. norvegicus
tgtgcagtgtgtgagg

SEQ ID NO: 527585 - DNA, 16 bp, R. norvegicus
tgtgcatatgatgtat

SEQ ID NO: 527586 - DNA, 16 bp, R. norvegicus
tgtgcatatgtctgta

SEQ ID NO: 527587 - DNA, 16 bp, R. norvegicus
tgtgcatgatgtgtgt

SEQ ID NO: 527588 - DNA, 16 bp, R. norvegicus
tgtgcatgcagtgctc

SEQ ID NO: 527589 - DNA, 16 bp, R. norvegicus
tgtgcatgctgggcaa

SEQ ID NO: 527590 - DNA, 16 bp, R. norvegicus
tgtgcatgctgggtaa

SEQ ID NO: 527591 - DNA, 16 bp, R. norvegicus
tgtgcatgctgtgtgt

SEQ ID NO: 527592 - DNA, 16 bp, R. norvegicus
tgtgcatggaggtcag

SEQ ID NO: 527593 - DNA, 16 bp, R. norvegicus
tgtgcatggatgtgtg

SEQ ID NO: 527594 - DNA, 16 bp, R. norvegicus
tgtgcatggctgtgtg

SEQ ID NO: 527595 - DNA, 16 bp, R. norvegicus
tgtgcatgtacacaca

SEQ ID NO: 527596 - DNA, 16 bp, R. norvegicus
tgtgcatgtatgtgag

SEQ ID NO: 527597 - DNA, 16 bp, R. norvegicus
tgtgcatgtctgtgca

SEQ ID NO: 527598 - DNA, 16 bp, R. norvegicus
tgtgcatgtgaataca

SEQ ID NO: 527599 - DNA, 16 bp, R. norvegicus
tgtgcatgtgcacaga

SEQ ID NO: 527600 - DNA, 16 bp, R. norvegicus
tgtgcatgtgcctgtg

SEQ ID NO: 527601 - DNA, 16 bp, R. norvegicus
tgtgcatgtgggcatg

SEQ ID NO: 527602 - DNA, 16 bp, R. norvegicus
tgtgcatgtgtgagag

SEQ ID NO: 527603 - DNA, 16 bp, R. norvegicus
tgtgcatgtgtgtact

SEQ ID NO: 527604 - DNA, 16 bp, R. norvegicus
tgtgcattcatgtgtg

SEQ ID NO: 527605 - DNA, 16 bp, R. norvegicus
tgtgcattgcatgtgt

SEQ ID NO: 527606 - DNA, 16 bp, R. norvegicus
tgtgcatttatgtgta

SEQ ID NO: 527607 - DNA, 16 bp, R. norvegicus
tgtgcatttggtggag

SEQ ID NO: 527608 - DNA, 16 bp, R. norvegicus
tgtgccaagcactgtg

SEQ ID NO: 527609 - DNA, 16 bp, R. norvegicus
tgtgccaaggctgagg

SEQ ID NO: 527610 - DNA, 16 bp, R. norvegicus
tgtgccaccacagcca

SEQ ID NO: 527611 - DNA, 16 bp, R. norvegicus
tgtgccaccacctcct

SEQ ID NO: 527612 - DNA, 16 bp, R. norvegicus
tgtgccaccatgccta

SEQ ID NO: 527613 - DNA, 16 bp, R. norvegicus
tgtgccacccccaccc

SEQ ID NO: 527614 - DNA, 16 bp, R. norvegicus
tgtgccaccccttctg

SEQ ID NO: 527615 - DNA, 16 bp, R. norvegicus
tgtgccactacacctg

SEQ ID NO: 527616 - DNA, 16 bp, R. norvegicus
tgtgccactatgccca

SEQ ID NO: 527617 - DNA, 16 bp, R. norvegicus
tgtgccactgtgccca

SEQ ID NO: 527618 - DNA, 16 bp, R. norvegicus
tgtgccagtgtgtgtg

SEQ ID NO: 527619 - DNA, 16 bp, R. norvegicus
tgtgccatgaattcct

SEQ ID NO: 527620 - DNA, 16 bp, R. norvegicus
tgtgcccatgtatgtg

SEQ ID NO: 527621 - DNA, 17 bp, R. norvegicus
tgtgcccgcaggtacct

SEQ ID NO: 527622 - DNA, 16 bp, R. norvegicus
tgtgccctgatatttt

SEQ ID NO: 527623 - DNA, 16 bp, R. norvegicus
tgtgccctgtgtgtga

SEQ ID NO: 527624 - DNA, 16 bp, R. norvegicus
tgtgcccttgaagaga

SEQ ID NO: 527625 - DNA, 20 bp, R. norvegicus
tgtgcctacttggattcctg

SEQ ID NO: 527626 - DNA, 16 bp, R. norvegicus
tgtgcctagttttatt

SEQ ID NO: 527627 - DNA, 16 bp, R. norvegicus
tgtgcctcagtttctc

SEQ ID NO: 527628 - DNA, 16 bp, R. norvegicus
tgtgcctcccaagtgc

SEQ ID NO: 527629 - DNA, 16 bp, R. norvegicus
tgtgcctctctgaagg

SEQ ID NO: 527630 - DNA, 16 bp, R. norvegicus
tgtgcctctgcctcct

SEQ ID NO: 527631 - DNA, 16 bp, R. norvegicus
tgtgcctgagcctgag

SEQ ID NO: 527632 - DNA, 16 bp, R. norvegicus
tgtgcctggaactgac

SEQ ID NO: 527633 - DNA, 16 bp, R. norvegicus
tgtgcctggcttattt

SEQ ID NO: 527634 - DNA, 16 bp, R. norvegicus
tgtgcctgtgagcctg

SEQ ID NO: 527635 - DNA, 16 bp, R. norvegicus
tgtgcctgtgcctgtg

SEQ ID NO: 527636 - DNA, 16 bp, R. norvegicus
tgtgcctgtggaagcc

SEQ ID NO: 527637 - DNA, 16 bp, R. norvegicus
tgtgcctgtggctgtg

SEQ ID NO: 527638 - DNA, 16 bp, R. norvegicus
tgtgcctgtgtacaca

SEQ ID NO: 527639 - DNA, 16 bp, R. norvegicus
tgtgcctgtgtatata

SEQ ID NO: 527640 - DNA, 16 bp, R. norvegicus
tgtgcctgtgtatgtc

SEQ ID NO: 527641 - DNA, 16 bp, R. norvegicus
tgtgcctgtgtgtgcc

SEQ ID NO: 527642 - DNA, 16 bp, R. norvegicus
tgtgcctgtgtgtgtg

SEQ ID NO: 527643 - DNA, 16 bp, R. norvegicus
tgtgcctttgttttca

SEQ ID NO: 527644 - DNA, 16 bp, R. norvegicus
tgtgcgcacgcacaca

SEQ ID NO: 527645 - DNA, 16 bp, R. norvegicus
tgtgcgcatgcatgtg

SEQ ID NO: 527646 - DNA, 16 bp, R. norvegicus
tgtgcgcatgtgcaag

SEQ ID NO: 527647 - DNA, 16 bp, R. norvegicus
tgtgcggcagcaggag

SEQ ID NO: 527648 - DNA, 16 bp, R. norvegicus
tgtgcgtgcgcgcgtg

SEQ ID NO: 527649 - DNA, 16 bp, R. norvegicus
tgtgcgtgcgtgtgag

SEQ ID NO: 527650 - DNA, 16 bp, R. norvegicus
tgtgcgtgcgtgtgtg

SEQ ID NO: 527651 - DNA, 16 bp, R. norvegicus
tgtgcgtgtgcgtgtg

SEQ ID NO: 527652 - DNA, 16 bp, R. norvegicus
tgtgcgtgtgtgtagt

SEQ ID NO: 527653 - DNA, 16 bp, R. norvegicus
tgtgctaaccacagtg

SEQ ID NO: 527654 - DNA, 16 bp, R. norvegicus
tgtgctcacatgtgtg

SEQ ID NO: 527655 - DNA, 16 bp, R. norvegicus
tgtgctcatgtgcaca

SEQ ID NO: 527656 - DNA, 16 bp, R. norvegicus
tgtgctcccaccttga

SEQ ID NO: 527657 - DNA, 16 bp, R. norvegicus
tgtgctcctcagtgct

SEQ ID NO: 527658 - DNA, 16 bp, R. norvegicus
tgtgctctccagcatt

SEQ ID NO: 527659 - DNA, 16 bp, R. norvegicus
tgtgctcttccagagg

SEQ ID NO: 527660 - DNA, 16 bp, R. norvegicus
tgtgctcttggattca

SEQ ID NO: 527661 - DNA, 16 bp, R. norvegicus
tgtgctgagaaagaaa

SEQ ID NO: 527662 - DNA, 16 bp, R. norvegicus
tgtgctggaaatcaaa

SEQ ID NO: 527663 - DNA, 16 bp, R. norvegicus
tgtgctggaaattgaa

SEQ ID NO: 527664 - DNA, 16 bp, R. norvegicus
tgtgctgggcatggtg

SEQ ID NO: 527665 - DNA, 16 bp, R. norvegicus
tgtgctgggctgggct

SEQ ID NO: 527666 - DNA, 16 bp, R. norvegicus
tgtgctggtgcacacc

SEQ ID NO: 527667 - DNA, 16 bp, R. norvegicus
tgtgctggtttgaatg

SEQ ID NO: 527668 - DNA, 16 bp, R. norvegicus
tgtgctgtacactgtg

SEQ ID NO: 527669 - DNA, 16 bp, R. norvegicus
tgtgctgtcccttcct

SEQ ID NO: 527670 - DNA, 26 bp, R. norvegicus
tgtgctgtgaggaatgctgctgtgca

SEQ ID NO: 527671 - DNA, 16 bp, R. norvegicus
tgtgctgtgcactgtg

SEQ ID NO: 527672 - DNA, 16 bp, R. norvegicus
tgtgctgtgcagtgct

SEQ ID NO: 527673 - DNA, 16 bp, R. norvegicus
tgtgctgtgctctgtg

SEQ ID NO: 527674 - DNA, 16 bp, R. norvegicus
tgtgctgtgctgggct

SEQ ID NO: 527675 - DNA, 16 bp, R. norvegicus
tgtgctgtggctggac

SEQ ID NO: 527676 - DNA, 16 bp, R. norvegicus
tgtgctgtgtgctgtg

SEQ ID NO: 527677 - DNA, 16 bp, R. norvegicus
tgtgctgtgtgtgtct

SEQ ID NO: 527678 - DNA, 16 bp, R. norvegicus
tgtgcttcacctgtgc

SEQ ID NO: 527679 - DNA, 16 bp, R. norvegicus
tgtgcttgctgggaat

SEQ ID NO: 527680 - DNA, 16 bp, R. norvegicus
tgtgcttgctgtcttt

SEQ ID NO: 527681 - DNA, 16 bp, R. norvegicus
tgtgcttgtatgtgtg

SEQ ID NO: 527682 - DNA, 16 bp, R. norvegicus
tgtgcttgtctcttgc

SEQ ID NO: 527683 - DNA, 16 bp, R. norvegicus
tgtgcttgtgtatgtg

SEQ ID NO: 527684 - DNA, 16 bp, R. norvegicus
tgtgcttgtgtgtatg

SEQ ID NO: 527685 - DNA, 16 bp, R. norvegicus
tgtgctttcattttaa

SEQ ID NO: 527686 - DNA, 16 bp, R. norvegicus
tgtgcttttattttca

SEQ ID NO: 527687 - DNA, 17 bp, R. norvegicus
tgtggaaagccgtgata

SEQ ID NO: 527688 - DNA, 16 bp, R. norvegicus
tgtggaacagttggag

SEQ ID NO: 527689 - DNA, 16 bp, R. norvegicus
tgtggaacagtttgaa

SEQ ID NO: 527690 - DNA, 16 bp, R. norvegicus
tgtggaactgtgggag

SEQ ID NO: 527691 - DNA, 16 bp, R. norvegicus
tgtggaagacagaaga

SEQ ID NO: 527692 - DNA, 16 bp, R. norvegicus
tgtggaagaggaagag

SEQ ID NO: 527693 - DNA, 16 bp, R. norvegicus
tgtggaagaggaggta

SEQ ID NO: 527694 - DNA, 16 bp, R. norvegicus
tgtggaagagttggag

SEQ ID NO: 527695 - DNA, 16 bp, R. norvegicus
tgtggaagagttgggg

SEQ ID NO: 527696 - DNA, 16 bp, R. norvegicus
tgtggaagccaggaga

SEQ ID NO: 527697 - DNA, 16 bp, R. norvegicus
tgtggaagctgccacc

SEQ ID NO: 527698 - DNA, 16 bp, R. norvegicus
tgtggaaggccaggat

SEQ ID NO: 527699 - DNA, 16 bp, R. norvegicus
tgtggaagtcaaagaa

SEQ ID NO: 527700 - DNA, 16 bp, R. norvegicus
tgtggaagtcagagga

SEQ ID NO: 527701 - DNA, 16 bp, R. norvegicus
tgtggaagtcagatga

SEQ ID NO: 527702 - DNA, 16 bp, R. norvegicus
tgtggaagtcagttct

SEQ ID NO: 527703 - DNA, 16 bp, R. norvegicus
tgtggaagtggaagcc

SEQ ID NO: 527704 - DNA, 16 bp, R. norvegicus
tgtggaatctgttccc

SEQ ID NO: 527705 - DNA, 16 bp, R. norvegicus
tgtggaattgtttgaa

SEQ ID NO: 527706 - DNA, 16 bp, R. norvegicus
tgtggacaaagaggaa

SEQ ID NO: 527707 - DNA, 16 bp, R. norvegicus
tgtggacaagcaggac

SEQ ID NO: 527708 - DNA, 16 bp, R. norvegicus
tgtggacatgtgtgtg

SEQ ID NO: 527709 - DNA, 16 bp, R. norvegicus
tgtggacattcttcct

SEQ ID NO: 527710 - DNA, 16 bp, R. norvegicus
tgtggaccaccatgcc

SEQ ID NO: 527711 - DNA, 16 bp, R. norvegicus
tgtggaccaggctagc

SEQ ID NO: 527712 - DNA, 16 bp, R. norvegicus
tgtggacctgagttca

SEQ ID NO: 527713 - DNA, 16 bp, R. norvegicus
tgtggactgaagacca

SEQ ID NO: 527714 - DNA, 16 bp, R. norvegicus
tgtggactgagcaact

SEQ ID NO: 527715 - DNA, 16 bp, R. norvegicus
tgtggactgcattttc

SEQ ID NO: 527716 - DNA, 16 bp, R. norvegicus
tgtggacttaggagtg

SEQ ID NO: 527717 - DNA, 16 bp, R. norvegicus
tgtggagaaacaggaa

SEQ ID NO: 527718 - DNA, 16 bp, R. norvegicus
tgtggagaaagaataa

SEQ ID NO: 527719 - DNA, 16 bp, R. norvegicus
tgtggagaaagagaaa

SEQ ID NO: 527720 - DNA, 16 bp, R. norvegicus
tgtggagaaagaggga

SEQ ID NO: 527721 - DNA, 16 bp, R. norvegicus
tgtggagaaagatgaa

SEQ ID NO: 527722 - DNA, 16 bp, R. norvegicus
tgtggagaaaggagaa

SEQ ID NO: 527723 - DNA, 16 bp, R. norvegicus
tgtggagaagagactg

SEQ ID NO: 527724 - DNA, 16 bp, R. norvegicus
tgtggagacagaggaa

SEQ ID NO: 527725 - DNA, 16 bp, R. norvegicus
tgtggagaccagaaga

SEQ ID NO: 527726 - DNA, 16 bp, R. norvegicus
tgtggagaccagagat

SEQ ID NO: 527727 - DNA, 16 bp, R. norvegicus
tgtggagagagacaga

SEQ ID NO: 527728 - DNA, 16 bp, R. norvegicus
tgtggagagctcttgg

SEQ ID NO: 527729 - DNA, 16 bp, R. norvegicus
tgtggagatcagagac

SEQ ID NO: 527730 - DNA, 16 bp, R. norvegicus
tgtggagcaagaggaa

SEQ ID NO: 527731 - DNA, 16 bp, R. norvegicus
tgtggagcagagtctg

SEQ ID NO: 527732 - DNA, 16 bp, R. norvegicus
tgtggagcattttctt

SEQ ID NO: 527733 - DNA, 16 bp, R. norvegicus
tgtggagcccaggctg

SEQ ID NO: 527734 - DNA, 16 bp, R. norvegicus
tgtggagcctctgtgg

SEQ ID NO: 527735 - DNA, 16 bp, R. norvegicus
tgtggagctggagaga

SEQ ID NO: 527736 - DNA, 16 bp, R. norvegicus
tgtggaggaagaggaa

SEQ ID NO: 527737 - DNA, 16 bp, R. norvegicus
tgtggaggatgaggaa

SEQ ID NO: 527738 - DNA, 16 bp, R. norvegicus
tgtggaggatgtggag

SEQ ID NO: 527739 - DNA, 16 bp, R. norvegicus
tgtggaggcatttcct

SEQ ID NO: 527740 - DNA, 16 bp, R. norvegicus
tgtggaggccatggag

SEQ ID NO: 527741 - DNA, 16 bp, R. norvegicus
tgtggaggcctttgat

SEQ ID NO: 527742 - DNA, 16 bp, R. norvegicus
tgtggaggctggaggt

SEQ ID NO: 527743 - DNA, 16 bp, R. norvegicus
tgtggaggggaaaccg

SEQ ID NO: 527744 - DNA, 16 bp, R. norvegicus
tgtggaggtcagagaa

SEQ ID NO: 527745 - DNA, 16 bp, R. norvegicus
tgtggaggtcagagag

SEQ ID NO: 527746 - DNA, 16 bp, R. norvegicus
tgtggaggtcagagga

SEQ ID NO: 527747 - DNA, 16 bp, R. norvegicus
tgtggaggtcagcaga

SEQ ID NO: 527748 - DNA, 16 bp, R. norvegicus
tgtggaggtcatagga

SEQ ID NO: 527749 - DNA, 16 bp, R. norvegicus
tgtggaggtcctggat

SEQ ID NO: 527750 - DNA, 16 bp, R. norvegicus
tgtggaggtgagagaa

SEQ ID NO: 527751 - DNA, 16 bp, R. norvegicus
tgtggaggttacctgt

SEQ ID NO: 527752 - DNA, 16 bp, R. norvegicus
tgtggagtctgttctc

SEQ ID NO: 527753 - DNA, 16 bp, R. norvegicus
tgtggagttcaatgtg

SEQ ID NO: 527754 - DNA, 16 bp, R. norvegicus
tgtggagttcagagga

SEQ ID NO: 527755 - DNA, 16 bp, R. norvegicus
tgtggagttgattgtg

SEQ ID NO: 527756 - DNA, 16 bp, R. norvegicus
tgtggatacaagcttc

SEQ ID NO: 527757 - DNA, 16 bp, R. norvegicus
tgtggatatgtgtgtg

SEQ ID NO: 527758 - DNA, 16 bp, R. norvegicus
tgtggatcccaaacaa

SEQ ID NO: 527759 - DNA, 16 bp, R. norvegicus
tgtggatcccagacat

SEQ ID NO: 527760 - DNA, 16 bp, R. norvegicus
tgtggatgaagatgta

SEQ ID NO: 527761 - DNA, 16 bp, R. norvegicus
tgtggatgagagtgtt

SEQ ID NO: 527762 - DNA, 16 bp, R. norvegicus
tgtggatgagtgtgtg

SEQ ID NO: 527763 - DNA, 16 bp, R. norvegicus
tgtggatgatttctat

SEQ ID NO: 527764 - DNA, 16 bp, R. norvegicus
tgtggatgccaagaag

SEQ ID NO: 527765 - DNA, 16 bp, R. norvegicus
tgtggatgccaagaat

SEQ ID NO: 527766 - DNA, 16 bp, R. norvegicus
tgtggatgctggaaat

SEQ ID NO: 527767 - DNA, 16 bp, R. norvegicus
tgtggatgcttcaggc

SEQ ID NO: 527768 - DNA, 16 bp, R. norvegicus
tgtggatgcttcattc

SEQ ID NO: 527769 - DNA, 16 bp, R. norvegicus
tgtggatgctttactc

SEQ ID NO: 527770 - DNA, 16 bp, R. norvegicus
tgtggatgtagctcag

SEQ ID NO: 527771 - DNA, 16 bp, R. norvegicus
tgtggatgtgatgtga

SEQ ID NO: 527772 - DNA, 16 bp, R. norvegicus
tgtggatgtggatgtg

SEQ ID NO: 527773 - DNA, 16 bp, R. norvegicus
tgtggatgtgtaagct

SEQ ID NO: 527774 - DNA, 16 bp, R. norvegicus
tgtggatgtgtacagt

SEQ ID NO: 527775 - DNA, 16 bp, R. norvegicus
tgtggattgcatcttg

SEQ ID NO: 527776 - DNA, 16 bp, R. norvegicus
tgtggattgtatattg

SEQ ID NO: 527777 - DNA, 16 bp, R. norvegicus
tgtggatttatttctg

SEQ ID NO: 527778 - DNA, 16 bp, R. norvegicus
tgtggatttctgatat

SEQ ID NO: 527779 - DNA, 16 bp, R. norvegicus
tgtggcaaatgcttta

SEQ ID NO: 527780 - DNA, 16 bp, R. norvegicus
tgtggcaagcacttca

SEQ ID NO: 527781 - DNA, 16 bp, R. norvegicus
tgtggcagaagatggc

SEQ ID NO: 527782 - DNA, 16 bp, R. norvegicus
tgtggcagagcagatg

SEQ ID NO: 527783 - DNA, 16 bp, R. norvegicus
tgtggcagaggatggt

SEQ ID NO: 527784 - DNA, 16 bp, R. norvegicus
tgtggcaggaagcatg

SEQ ID NO: 527785 - DNA, 16 bp, R. norvegicus
tgtggcatggtgggca

SEQ ID NO: 527786 - DNA, 16 bp, R. norvegicus
tgtggcattgttggaa

SEQ ID NO: 527787 - DNA, 16 bp, R. norvegicus
tgtggccaaggtcaag

SEQ ID NO: 527788 - DNA, 16 bp, R. norvegicus
tgtggccacactgaat

SEQ ID NO: 527789 - DNA, 16 bp, R. norvegicus
tgtggccagcaacttc

SEQ ID NO: 527790 - DNA, 16 bp, R. norvegicus
tgtggccagtctggat

SEQ ID NO: 527791 - DNA, 16 bp, R. norvegicus
tgtggccctggctggc

SEQ ID NO: 527792 - DNA, 16 bp, R. norvegicus
tgtggccctgtgggag

SEQ ID NO: 527793 - DNA, 16 bp, R. norvegicus
tgtggccctgttgggg

SEQ ID NO: 527794 - DNA, 16 bp, R. norvegicus
tgtggcctcctcacct

SEQ ID NO: 527795 - DNA, 16 bp, R. norvegicus
tgtggcctctgcaggc

SEQ ID NO: 527796 - DNA, 16 bp, R. norvegicus
tgtggcctgtggattg

SEQ ID NO: 527797 - DNA, 16 bp, R. norvegicus
tgtggccttcctggag

SEQ ID NO: 527798 - DNA, 16 bp, R. norvegicus
tgtggccttgatggag

SEQ ID NO: 527799 - DNA, 16 bp, R. norvegicus
tgtggccttgctggag

SEQ ID NO: 527800 - DNA, 16 bp, R. norvegicus
tgtggccttggtttct

SEQ ID NO: 527801 - DNA, 16 bp, R. norvegicus
tgtggccttgtagaag

SEQ ID NO: 527802 - DNA, 16 bp, R. norvegicus
tgtggccttgtgggaa

SEQ ID NO: 527803 - DNA, 16 bp, R. norvegicus
tgtggccttgttgagt

SEQ ID NO: 527804 - DNA, 16 bp, R. norvegicus
tgtggctacacacaca

SEQ ID NO: 527805 - DNA, 16 bp, R. norvegicus
tgtggctaggcagcca

SEQ ID NO: 527806 - DNA, 16 bp, R. norvegicus
tgtggctccagttcca

SEQ ID NO: 527807 - DNA, 16 bp, R. norvegicus
tgtggctgaagccatg

SEQ ID NO: 527808 - DNA, 16 bp, R. norvegicus
tgtggctgaggatgac

SEQ ID NO: 527809 - DNA, 16 bp, R. norvegicus
tgtggctgaggctggc

SEQ ID NO: 527810 - DNA, 16 bp, R. norvegicus
tgtggctgctgagaat

SEQ ID NO: 527811 - DNA, 16 bp, R. norvegicus
tgtggctgctgctgct

SEQ ID NO: 527812 - DNA, 16 bp, R. norvegicus
tgtggctggagccagg

SEQ ID NO: 527813 - DNA, 16 bp, R. norvegicus
tgtggctggctgtggc

SEQ ID NO: 527814 - DNA, 16 bp, R. norvegicus
tgtggctggcttggtg

SEQ ID NO: 527815 - DNA, 16 bp, R. norvegicus
tgtggctgggagtgca

SEQ ID NO: 527816 - DNA, 16 bp, R. norvegicus
tgtggctgtcttcttt

SEQ ID NO: 527817 - DNA, 16 bp, R. norvegicus
tgtggctgtgaagaga

SEQ ID NO: 527818 - DNA, 17 bp, R. norvegicus
tgtggctgtgctctggt

SEQ ID NO: 527819 - DNA, 16 bp, R. norvegicus
tgtggctgtggctgtg

SEQ ID NO: 527820 - DNA, 16 bp, R. norvegicus
tgtggctgtgtggctg

SEQ ID NO: 527821 - DNA, 16 bp, R. norvegicus
tgtggctgtgttggag

SEQ ID NO: 527822 - DNA, 16 bp, R. norvegicus
tgtggcttcaaagaag

SEQ ID NO: 527823 - DNA, 16 bp, R. norvegicus
tgtgggaagacccagt

SEQ ID NO: 527824 - DNA, 16 bp, R. norvegicus
tgtgggaagccacagg

SEQ ID NO: 527825 - DNA, 16 bp, R. norvegicus
tgtgggacagagaaca

SEQ ID NO: 527826 - DNA, 16 bp, R. norvegicus
tgtgggacaggatgga

SEQ ID NO: 527827 - DNA, 16 bp, R. norvegicus
tgtgggactcctaaga

SEQ ID NO: 527828 - DNA, 16 bp, R. norvegicus
tgtgggactgtgtctt

SEQ ID NO: 527829 - DNA, 16 bp, R. norvegicus
tgtgggagccaccagg

SEQ ID NO: 527830 - DNA, 16 bp, R. norvegicus
tgtgggaggaccagca

SEQ ID NO: 527831 - DNA, 16 bp, R. norvegicus
tgtgggaggcaccatc

SEQ ID NO: 527832 - DNA, 16 bp, R. norvegicus
tgtgggaggcagagac

SEQ ID NO: 527833 - DNA, 16 bp, R. norvegicus
tgtgggagggagagct

SEQ ID NO: 527834 - DNA, 16 bp, R. norvegicus
tgtgggagggcacagc

SEQ ID NO: 527835 - DNA, 16 bp, R. norvegicus
tgtgggagtggccaac

SEQ ID NO: 527836 - DNA, 16 bp, R. norvegicus
tgtgggatctcttacc

SEQ ID NO: 527837 - DNA, 16 bp, R. norvegicus
tgtgggatgtggaaca

SEQ ID NO: 527838 - DNA, 16 bp, R. norvegicus
tgtgggcaatcctgag

SEQ ID NO: 527839 - DNA, 16 bp, R. norvegicus
tgtgggcacatgtgca

SEQ ID NO: 527840 - DNA, 16 bp, R. norvegicus
tgtgggcacatgtgtg

SEQ ID NO: 527841 - DNA, 16 bp, R. norvegicus
tgtgggcagcaaccag

SEQ ID NO: 527842 - DNA, 16 bp, R. norvegicus
tgtgggcagggatggg

SEQ ID NO: 527843 - DNA, 16 bp, R. norvegicus
tgtgggcatggagaac

SEQ ID NO: 527844 - DNA, 16 bp, R. norvegicus
tgtgggccaagtgtag

SEQ ID NO: 527845 - DNA, 16 bp, R. norvegicus
tgtgggccaggctctg

SEQ ID NO: 527846 - DNA, 16 bp, R. norvegicus
tgtgggccagtgagat

SEQ ID NO: 527847 - DNA, 40 bp, R. norvegicus
tgtgggctattgccagatcctggccagtacccatgccagt

SEQ ID NO: 527848 - DNA, 16 bp, R. norvegicus
tgtgggctctgaggat

SEQ ID NO: 527849 - DNA, 16 bp, R. norvegicus
tgtgggctggtggtcc

SEQ ID NO: 527850 - DNA, 16 bp, R. norvegicus
tgtgggcttcctgttg

SEQ ID NO: 527851 - DNA, 16 bp, R. norvegicus
tgtggggaaagaagaa

SEQ ID NO: 527852 - DNA, 16 bp, R. norvegicus
tgtggggcagcctctg

SEQ ID NO: 527853 - DNA, 16 bp, R. norvegicus
tgtggggcagctggtc

SEQ ID NO: 527854 - DNA, 16 bp, R. norvegicus
tgtgggggaggctctg

SEQ ID NO: 527855 - DNA, 16 bp, R. norvegicus
tgtgggggctgggaac

SEQ ID NO: 527856 - DNA, 16 bp, R. norvegicus
tgtgggtattttgcct

SEQ ID NO: 527857 - DNA, 16 bp, R. norvegicus
tgtgggtcccaggaat

SEQ ID NO: 527858 - DNA, 16 bp, R. norvegicus
tgtgggtcctgggagt

SEQ ID NO: 527859 - DNA, 16 bp, R. norvegicus
tgtgggtcctggggat

SEQ ID NO: 527860 - DNA, 16 bp, R. norvegicus
tgtgggtctcacatct

SEQ ID NO: 527861 - DNA, 16 bp, R. norvegicus
tgtgggtctcgacccc

SEQ ID NO: 527862 - DNA, 16 bp, R. norvegicus
tgtgggtgacaccatt

SEQ ID NO: 527863 - DNA, 16 bp, R. norvegicus
tgtgggtgagctggcc

SEQ ID NO: 527864 - DNA, 16 bp, R. norvegicus
tgtgggtgatgccatt

SEQ ID NO: 527865 - DNA, 16 bp, R. norvegicus
tgtgggtgcaggagag

SEQ ID NO: 527866 - DNA, 16 bp, R. norvegicus
tgtgggtgcatatgtg

SEQ ID NO: 527867 - DNA, 16 bp, R. norvegicus
tgtgggtgctgagaac

SEQ ID NO: 527868 - DNA, 16 bp, R. norvegicus
tgtgggtgctggaatc

SEQ ID NO: 527869 - DNA, 16 bp, R. norvegicus
tgtgggtgctgggaat

SEQ ID NO: 527870 - DNA, 16 bp, R. norvegicus
tgtgggtggagccacc

SEQ ID NO: 527871 - DNA, 16 bp, R. norvegicus
tgtgggtgtctgtctg

SEQ ID NO: 527872 - DNA, 16 bp, R. norvegicus
tgtgggtgtgggctta

SEQ ID NO: 527873 - DNA, 16 bp, R. norvegicus
tgtgggtgtgtctatg

SEQ ID NO: 527874 - DNA, 16 bp, R. norvegicus
tgtgggttctagggat

SEQ ID NO: 527875 - DNA, 16 bp, R. norvegicus
tgtgggtttgtgcatg

SEQ ID NO: 527876 - DNA, 16 bp, R. norvegicus
tgtggtacatctactc

SEQ ID NO: 527877 - DNA, 16 bp, R. norvegicus
tgtggtatgtatgtgt

SEQ ID NO: 527878 - DNA, 16 bp, R. norvegicus
tgtggtatgtgtgcat

SEQ ID NO: 527879 - DNA, 16 bp, R. norvegicus
tgtggtatgtgtgtac

SEQ ID NO: 527880 - DNA, 16 bp, R. norvegicus
tgtggtcctcagcacc

SEQ ID NO: 527881 - DNA, 16 bp, R. norvegicus
tgtggtctaacttctt

SEQ ID NO: 527882 - DNA, 16 bp, R. norvegicus
tgtggtctacacagtg

SEQ ID NO: 527883 - DNA, 16 bp, R. norvegicus
tgtggtctccatggca

SEQ ID NO: 527884 - DNA, 16 bp, R. norvegicus
tgtggtctctgcctca

SEQ ID NO: 527885 - DNA, 16 bp, R. norvegicus
tgtggtctgtggaatg

SEQ ID NO: 527886 - DNA, 16 bp, R. norvegicus
tgtggtctgtggcttg

SEQ ID NO: 527887 - DNA, 16 bp, R. norvegicus
tgtggtcttggattca

SEQ ID NO: 527888 - DNA, 16 bp, R. norvegicus
tgtggtgacctccagc

SEQ ID NO: 527889 - DNA, 16 bp, R. norvegicus
tgtggtgcacaggcat

SEQ ID NO: 527890 - DNA, 16 bp, R. norvegicus
tgtggtgcacatgcat

SEQ ID NO: 527891 - DNA, 16 bp, R. norvegicus
tgtggtgcatgtacat

SEQ ID NO: 527892 - DNA, 16 bp, R. norvegicus
tgtggtgctgatgctg

SEQ ID NO: 527893 - DNA, 16 bp, R. norvegicus
tgtggtgctgggaatg

SEQ ID NO: 527894 - DNA, 16 bp, R. norvegicus
tgtggtgcttcagaac

SEQ ID NO: 527895 - DNA, 16 bp, R. norvegicus
tgtggtggaagcaaag

SEQ ID NO: 527896 - DNA, 16 bp, R. norvegicus
tgtggtggattatgtt

SEQ ID NO: 527897 - DNA, 16 bp, R. norvegicus
tgtggtggcagagaca

SEQ ID NO: 527898 - DNA, 16 bp, R. norvegicus
tgtggtggcccagacc

SEQ ID NO: 527899 - DNA, 16 bp, R. norvegicus
tgtggtggctcaggcc

SEQ ID NO: 527900 - DNA, 16 bp, R. norvegicus
tgtggtggctcatgcc

SEQ ID NO: 527901 - DNA, 16 bp, R. norvegicus
tgtggtggctgctgct

SEQ ID NO: 527902 - DNA, 16 bp, R. norvegicus
tgtggtggctggagac

SEQ ID NO: 527903 - DNA, 16 bp, R. norvegicus
tgtggtggtccttgat

SEQ ID NO: 527904 - DNA, 16 bp, R. norvegicus
tgtggtgtatgtggta

SEQ ID NO: 527905 - DNA, 16 bp, R. norvegicus
tgtggtgtcttcagag

SEQ ID NO: 527906 - DNA, 16 bp, R. norvegicus
tgtggtgtcttcaggg

SEQ ID NO: 527907 - DNA, 16 bp, R. norvegicus
tgtggtgtgcacacac

SEQ ID NO: 527908 - DNA, 16 bp, R. norvegicus
tgtggtgtgcatgtat

SEQ ID NO: 527909 - DNA, 16 bp, R. norvegicus
tgtggtgttttccttc

SEQ ID NO: 527910 - DNA, 17 bp, R. norvegicus
tgtggttattcttttga

SEQ ID NO: 527911 - DNA, 16 bp, R. norvegicus
tgtggttcatttacaa

SEQ ID NO: 527912 - DNA, 16 bp, R. norvegicus
tgtggttcctgggctt

SEQ ID NO: 527913 - DNA, 16 bp, R. norvegicus
tgtggttgctggaatt

SEQ ID NO: 527914 - DNA, 16 bp, R. norvegicus
tgtggtttcatttctg

SEQ ID NO: 527915 - DNA, 16 bp, R. norvegicus
tgtggttttattggag

SEQ ID NO: 527916 - DNA, 16 bp, R. norvegicus
tgtggttttctataat

SEQ ID NO: 527917 - DNA, 16 bp, R. norvegicus
tgtggttttgttctta

SEQ ID NO: 527918 - DNA, 16 bp, R. norvegicus
tgtggtttttcaagaa

SEQ ID NO: 527919 - DNA, 16 bp, R. norvegicus
tgtgtaaacaaactca

SEQ ID NO: 527920 - DNA, 16 bp, R. norvegicus
tgtgtaaagttgacaa

SEQ ID NO: 527921 - DNA, 16 bp, R. norvegicus
tgtgtaaatatataat

SEQ ID NO: 527922 - DNA, 16 bp, R. norvegicus
tgtgtaaatatgtata

SEQ ID NO: 527923 - DNA, 16 bp, R. norvegicus
tgtgtaaatatgtgtg

SEQ ID NO: 527924 - DNA, 16 bp, R. norvegicus
tgtgtaatgattttaa

SEQ ID NO: 527925 - DNA, 16 bp, R. norvegicus
tgtgtacacacacgtg

SEQ ID NO: 527926 - DNA, 16 bp, R. norvegicus
tgtgtacacacagaca

SEQ ID NO: 527927 - DNA, 16 bp, R. norvegicus
tgtgtacacacccaca

SEQ ID NO: 527928 - DNA, 16 bp, R. norvegicus
tgtgtacacatgtgga

SEQ ID NO: 527929 - DNA, 16 bp, R. norvegicus
tgtgtacacctgcatg

SEQ ID NO: 527930 - DNA, 16 bp, R. norvegicus
tgtgtacagtgtggct

SEQ ID NO: 527931 - DNA, 16 bp, R. norvegicus
tgtgtacatatatatt

SEQ ID NO: 527932 - DNA, 16 bp, R. norvegicus
tgtgtacatgtctatg

SEQ ID NO: 527933 - DNA, 16 bp, R. norvegicus
tgtgtacatgtgtggg

SEQ ID NO: 527934 - DNA, 16 bp, R. norvegicus
tgtgtacatgttcatg

SEQ ID NO: 527935 - DNA, 16 bp, R. norvegicus
tgtgtaccatgtacat

SEQ ID NO: 527936 - DNA, 16 bp, R. norvegicus
tgtgtacctctgtgtg

SEQ ID NO: 527937 - DNA, 16 bp, R. norvegicus
tgtgtacctggtgcct

SEQ ID NO: 527938 - DNA, 16 bp, R. norvegicus
tgtgtactcctggctg

SEQ ID NO: 527939 - DNA, 16 bp, R. norvegicus
tgtgtactctttgctt

SEQ ID NO: 527940 - DNA, 16 bp, R. norvegicus
tgtgtagcccttgctg

SEQ ID NO: 527941 - DNA, 16 bp, R. norvegicus
tgtgtagctcaggctg

SEQ ID NO: 527942 - DNA, 16 bp, R. norvegicus
tgtgtagctgtggctg

SEQ ID NO: 527943 - DNA, 16 bp, R. norvegicus
tgtgtagctgtgtgtg

SEQ ID NO: 527944 - DNA, 16 bp, R. norvegicus
tgtgtagtcatggctg

SEQ ID NO: 527945 - DNA, 16 bp, R. norvegicus
tgtgtagtccaggctg

SEQ ID NO: 527946 - DNA, 16 bp, R. norvegicus
tgtgtagtcctggcta

SEQ ID NO: 527947 - DNA, 16 bp, R. norvegicus
tgtgtataaatattta

SEQ ID NO: 527948 - DNA, 16 bp, R. norvegicus
tgtgtataagtgtgtg

SEQ ID NO: 527949 - DNA, 16 bp, R. norvegicus
tgtgtataattttaaa

SEQ ID NO: 527950 - DNA, 16 bp, R. norvegicus
tgtgtatacacacaca

SEQ ID NO: 527951 - DNA, 16 bp, R. norvegicus
tgtgtatacttgtgtg

SEQ ID NO: 527952 - DNA, 16 bp, R. norvegicus
tgtgtatagatagata

SEQ ID NO: 527953 - DNA, 16 bp, R. norvegicus
tgtgtatatacatata

SEQ ID NO: 527954 - DNA, 16 bp, R. norvegicus
tgtgtatatatgatgt

SEQ ID NO: 527955 - DNA, 16 bp, R. norvegicus
tgtgtatatttatatg

SEQ ID NO: 527956 - DNA, 16 bp, R. norvegicus
tgtgtatatttgtata

SEQ ID NO: 527957 - DNA, 16 bp, R. norvegicus
tgtgtatattttaaaa

SEQ ID NO: 527958 - DNA, 16 bp, R. norvegicus
tgtgtatctcaggaga

SEQ ID NO: 527959 - DNA, 16 bp, R. norvegicus
tgtgtatctggagcca

SEQ ID NO: 527960 - DNA, 16 bp, R. norvegicus
tgtgtatctgtgtgtg

SEQ ID NO: 527961 - DNA, 16 bp, R. norvegicus
tgtgtatgaatgtgtg

SEQ ID NO: 527962 - DNA, 16 bp, R. norvegicus
tgtgtatgacatgtgt

SEQ ID NO: 527963 - DNA, 16 bp, R. norvegicus
tgtgtatgagagagag

SEQ ID NO: 527964 - DNA, 16 bp, R. norvegicus
tgtgtatgagtgtata

SEQ ID NO: 527965 - DNA, 16 bp, R. norvegicus
tgtgtatgagtgttca

SEQ ID NO: 527966 - DNA, 16 bp, R. norvegicus
tgtgtatgatatatat

SEQ ID NO: 527967 - DNA, 16 bp, R. norvegicus
tgtgtatgcatatgca

SEQ ID NO: 527968 - DNA, 16 bp, R. norvegicus
tgtgtatgcatgcgtg

SEQ ID NO: 527969 - DNA, 16 bp, R. norvegicus
tgtgtatgcatgtttg

SEQ ID NO: 527970 - DNA, 16 bp, R. norvegicus
tgtgtatgcgcatgca

SEQ ID NO: 527971 - DNA, 16 bp, R. norvegicus
tgtgtatggatgtgta

SEQ ID NO: 527972 - DNA, 16 bp, R. norvegicus
tgtgtatgggtgcatg

SEQ ID NO: 527973 - DNA, 16 bp, R. norvegicus
tgtgtatgtaatatgt

SEQ ID NO: 527974 - DNA, 16 bp, R. norvegicus
tgtgtatgtatatata

SEQ ID NO: 527975 - DNA, 16 bp, R. norvegicus
tgtgtatgtctgtgga

SEQ ID NO: 527976 - DNA, 16 bp, R. norvegicus
tgtgtatgtctgtgtg

SEQ ID NO: 527977 - DNA, 16 bp, R. norvegicus
tgtgtatgtgcaccat

SEQ ID NO: 527978 - DNA, 16 bp, R. norvegicus
tgtgtatgtgcaggta

SEQ ID NO: 527979 - DNA, 16 bp, R. norvegicus
tgtgtatgtgcctgtg

SEQ ID NO: 527980 - DNA, 16 bp, R. norvegicus
tgtgtatgtgcgtatg

SEQ ID NO: 527981 - DNA, 16 bp, R. norvegicus
tgtgtatgtgggagtg

SEQ ID NO: 527982 - DNA, 16 bp, R. norvegicus
tgtgtatgtgtatgta

SEQ ID NO: 527983 - DNA, 16 bp, R. norvegicus
tgtgtatgtgtccatg

SEQ ID NO: 527984 - DNA, 16 bp, R. norvegicus
tgtgtatgtgtgtccc

SEQ ID NO: 527985 - DNA, 16 bp, R. norvegicus
tgtgtatgtgtgtgca

SEQ ID NO: 527986 - DNA, 16 bp, R. norvegicus
tgtgtatgtgtgtgta

SEQ ID NO: 527987 - DNA, 16 bp, R. norvegicus
tgtgtatgtgttttcc

SEQ ID NO: 527988 - DNA, 16 bp, R. norvegicus
tgtgtatgtttctttg

SEQ ID NO: 527989 - DNA, 16 bp, R. norvegicus
tgtgtatgtttgcatg

SEQ ID NO: 527990 - DNA, 16 bp, R. norvegicus
tgtgtatttatatatg

SEQ ID NO: 527991 - DNA, 16 bp, R. norvegicus
tgtgtatttctttgtg

SEQ ID NO: 527992 - DNA, 16 bp, R. norvegicus
tgtgtatttgtacatg

SEQ ID NO: 527993 - DNA, 16 bp, R. norvegicus
tgtgtcaacattttct

SEQ ID NO: 527994 - DNA, 16 bp, R. norvegicus
tgtgtcaagtggacaa

SEQ ID NO: 527995 - DNA, 16 bp, R. norvegicus
tgtgtcacagcctcct

SEQ ID NO: 527996 - DNA, 16 bp, R. norvegicus
tgtgtcacgtgtgtgt

SEQ ID NO: 527997 - DNA, 16 bp, R. norvegicus
tgtgtcactgggatgg

SEQ ID NO: 527998 - DNA, 16 bp, R. norvegicus
tgtgtcactgtgggcg

SEQ ID NO: 527999 - DNA, 16 bp, R. norvegicus
tgtgtcagaaacttgt

SEQ ID NO: 528000 - DNA, 16 bp, R. norvegicus
tgtgtcagccctcctg

SEQ ID NO: 528001 - DNA, 16 bp, R. norvegicus
tgtgtcaggaattttt

SEQ ID NO: 528002 - DNA, 17 bp, R. norvegicus
tgtgtcaggaggtgttt

SEQ ID NO: 528003 - DNA, 16 bp, R. norvegicus
tgtgtcagtctgtctg

SEQ ID NO: 528004 - DNA, 16 bp, R. norvegicus
tgtgtcagtgctccag

SEQ ID NO: 528005 - DNA, 16 bp, R. norvegicus
tgtgtcagtgtctgtg

SEQ ID NO: 528006 - DNA, 16 bp, R. norvegicus
tgtgtcatgagtgctg

SEQ ID NO: 528007 - DNA, 16 bp, R. norvegicus
tgtgtcatggattctg

SEQ ID NO: 528008 - DNA, 16 bp, R. norvegicus
tgtgtcatgtgtgtga

SEQ ID NO: 528009 - DNA, 16 bp, R. norvegicus
tgtgtcattgttgtat

SEQ ID NO: 528010 - DNA, 16 bp, R. norvegicus
tgtgtccaccaggcag

SEQ ID NO: 528011 - DNA, 16 bp, R. norvegicus
tgtgtccagagggctt

SEQ ID NO: 528012 - DNA, 16 bp, R. norvegicus
tgtgtccatgtgcaca

SEQ ID NO: 528013 - DNA, 16 bp, R. norvegicus
tgtgtcccgtcccact

SEQ ID NO: 528014 - DNA, 16 bp, R. norvegicus
tgtgtccctgtctccc

SEQ ID NO: 528015 - DNA, 16 bp, R. norvegicus
tgtgtccctgtctgtg

SEQ ID NO: 528016 - DNA, 16 bp, R. norvegicus
tgtgtccgaagacagt

SEQ ID NO: 528017 - DNA, 16 bp, R. norvegicus
tgtgtcctctgaaaga

SEQ ID NO: 528018 - DNA, 16 bp, R. norvegicus
tgtgtcctctgtgaag

SEQ ID NO: 528019 - DNA, 16 bp, R. norvegicus
tgtgtcctgagggctc

SEQ ID NO: 528020 - DNA, 16 bp, R. norvegicus
tgtgtcctgagggttc

SEQ ID NO: 528021 - DNA, 16 bp, R. norvegicus
tgtgtcctggctgctg

SEQ ID NO: 528022 - DNA, 16 bp, R. norvegicus
tgtgtcctgtcccacc

SEQ ID NO: 528023 - DNA, 16 bp, R. norvegicus
tgtgtccttgttctat

SEQ ID NO: 528024 - DNA, 16 bp, R. norvegicus
tgtgtccttgttggaa

SEQ ID NO: 528025 - DNA, 16 bp, R. norvegicus
tgtgtccttgttttat

SEQ ID NO: 528026 - DNA, 16 bp, R. norvegicus
tgtgtcctttaaaaaa

SEQ ID NO: 528027 - DNA, 16 bp, R. norvegicus
tgtgtctatgactcct

SEQ ID NO: 528028 - DNA, 16 bp, R. norvegicus
tgtgtctatggctcct

SEQ ID NO: 528029 - DNA, 16 bp, R. norvegicus
tgtgtctcaagacagc

SEQ ID NO: 528030 - DNA, 22 bp, R. norvegicus
tgtgtctctcaggagagatcta

SEQ ID NO: 528031 - DNA, 16 bp, R. norvegicus
tgtgtctctccagaga

SEQ ID NO: 528032 - DNA, 16 bp, R. norvegicus
tgtgtctctccctctg

SEQ ID NO: 528033 - DNA, 16 bp, R. norvegicus
tgtgtctctgtgtgtg

SEQ ID NO: 528034 - DNA, 16 bp, R. norvegicus
tgtgtctgaagaaaac

SEQ ID NO: 528035 - DNA, 18 bp, R. norvegicus
tgtgtctgaagacagctg

SEQ ID NO: 528036 - DNA, 16 bp, R. norvegicus
tgtgtctgaagataac

SEQ ID NO: 528037 - DNA, 16 bp, R. norvegicus
tgtgtctgagaaggga

SEQ ID NO: 528038 - DNA, 16 bp, R. norvegicus
tgtgtctgcctcagca

SEQ ID NO: 528039 - DNA, 16 bp, R. norvegicus
tgtgtctgcctcccaa

SEQ ID NO: 528040 - DNA, 16 bp, R. norvegicus
tgtgtctgctgctgct

SEQ ID NO: 528041 - DNA, 16 bp, R. norvegicus
tgtgtctgctgtgtct

SEQ ID NO: 528042 - DNA, 16 bp, R. norvegicus
tgtgtctggtgcccat

SEQ ID NO: 528043 - DNA, 16 bp, R. norvegicus
tgtgtctgtcaggaga

SEQ ID NO: 528044 - DNA, 16 bp, R. norvegicus
tgtgtctgtccctctg

SEQ ID NO: 528045 - DNA, 16 bp, R. norvegicus
tgtgtctgtccttctg

SEQ ID NO: 528046 - DNA, 16 bp, R. norvegicus
tgtgtctgtctgtgca

SEQ ID NO: 528047 - DNA, 16 bp, R. norvegicus
tgtgtctgtctgtgtg

SEQ ID NO: 528048 - DNA, 16 bp, R. norvegicus
tgtgtctgtcttcaga

SEQ ID NO: 528049 - DNA, 16 bp, R. norvegicus
tgtgtctgtcttctgt

SEQ ID NO: 528050 - DNA, 16 bp, R. norvegicus
tgtgtctgtgctgtgt

SEQ ID NO: 528051 - DNA, 16 bp, R. norvegicus
tgtgtctgtgcttgtg

SEQ ID NO: 528052 - DNA, 17 bp, R. norvegicus
tgtgtctgtgtctgtgt

SEQ ID NO: 528053 - DNA, 16 bp, R. norvegicus
tgtgtctgtgtctttc

SEQ ID NO: 528054 - DNA, 16 bp, R. norvegicus
tgtgtctgtgtgtaat

SEQ ID NO: 528055 - DNA, 16 bp, R. norvegicus
tgtgtctgtgtgtctg

SEQ ID NO: 528056 - DNA, 16 bp, R. norvegicus
tgtgtctgtgtgttat

SEQ ID NO: 528057 - DNA, 16 bp, R. norvegicus
tgtgtctgttctctct

SEQ ID NO: 528058 - DNA, 16 bp, R. norvegicus
tgtgtctgtttatgta

SEQ ID NO: 528059 - DNA, 16 bp, R. norvegicus
tgtgtcttccagcttc

SEQ ID NO: 528060 - DNA, 16 bp, R. norvegicus
tgtgtgaaaatgtgtg

SEQ ID NO: 528061 - DNA, 16 bp, R. norvegicus
tgtgtgaagtcacagg

SEQ ID NO: 528062 - DNA, 16 bp, R. norvegicus
tgtgtgaatgtatgag

SEQ ID NO: 528063 - DNA, 16 bp, R. norvegicus
tgtgtgaatgtgcatg

SEQ ID NO: 528064 - DNA, 16 bp, R. norvegicus
tgtgtgaatgtgcttg

SEQ ID NO: 528065 - DNA, 16 bp, R. norvegicus
tgtgtgacagtgtgtg

SEQ ID NO: 528066 - DNA, 16 bp, R. norvegicus
tgtgtgacatatatat

SEQ ID NO: 528067 - DNA, 16 bp, R. norvegicus
tgtgtgacatgtgtga

SEQ ID NO: 528068 - DNA, 16 bp, R. norvegicus
tgtgtgaccttgggaa

SEQ ID NO: 528069 - DNA, 16 bp, R. norvegicus
tgtgtgagagagtgtg

SEQ ID NO: 528070 - DNA, 16 bp, R. norvegicus
tgtgtgagcacctgtg

SEQ ID NO: 528071 - DNA, 16 bp, R. norvegicus
tgtgtgagcatgtgtg

SEQ ID NO: 528072 - DNA, 16 bp, R. norvegicus
tgtgtgagcatttgtg

SEQ ID NO: 528073 - DNA, 16 bp, R. norvegicus
tgtgtgagcgtgtgtg

SEQ ID NO: 528074 - DNA, 16 bp, R. norvegicus
tgtgtgagtatctgtg

SEQ ID NO: 528075 - DNA, 16 bp, R. norvegicus
tgtgtgagtctctctg

SEQ ID NO: 528076 - DNA, 16 bp, R. norvegicus
tgtgtgagtgtgagtg

SEQ ID NO: 528077 - DNA, 16 bp, R. norvegicus
tgtgtgatgggaggaa

SEQ ID NO: 528078 - DNA, 16 bp, R. norvegicus
tgtgtgcaattgtgtg

SEQ ID NO: 528079 - DNA, 16 bp, R. norvegicus
tgtgtgcacaaataca

SEQ ID NO: 528080 - DNA, 16 bp, R. norvegicus
tgtgtgcacacacgca

SEQ ID NO: 528081 - DNA, 16 bp, R. norvegicus
tgtgtgcacacgtgtg

SEQ ID NO: 528082 - DNA, 16 bp, R. norvegicus
tgtgtgcacactgtgt

SEQ ID NO: 528083 - DNA, 16 bp, R. norvegicus
tgtgtgcacatacctg

SEQ ID NO: 528084 - DNA, 16 bp, R. norvegicus
tgtgtgcacatatgca

SEQ ID NO: 528085 - DNA, 16 bp, R. norvegicus
tgtgtgcacatatgtg

SEQ ID NO: 528086 - DNA, 16 bp, R. norvegicus
tgtgtgcacatgcaca

SEQ ID NO: 528087 - DNA, 16 bp, R. norvegicus
tgtgtgcacatgtgtg

SEQ ID NO: 528088 - DNA, 16 bp, R. norvegicus
tgtgtgcaccacatgt

SEQ ID NO: 528089 - DNA, 16 bp, R. norvegicus
tgtgtgcacctgtgca

SEQ ID NO: 528090 - DNA, 16 bp, R. norvegicus
tgtgtgcactgtatgt

SEQ ID NO: 528091 - DNA, 16 bp, R. norvegicus
tgtgtgcagcagatct

SEQ ID NO: 528092 - DNA, 16 bp, R. norvegicus
tgtgtgcaggtgtgta

SEQ ID NO: 528093 - DNA, 16 bp, R. norvegicus
tgtgtgcatatgcttg

SEQ ID NO: 528094 - DNA, 16 bp, R. norvegicus
tgtgtgcatgcaggtg

SEQ ID NO: 528095 - DNA, 16 bp, R. norvegicus
tgtgtgcatgcttatg

SEQ ID NO: 528096 - DNA, 16 bp, R. norvegicus
tgtgtgcatggacatg

SEQ ID NO: 528097 - DNA, 16 bp, R. norvegicus
tgtgtgcatggtgtgg

SEQ ID NO: 528098 - DNA, 16 bp, R. norvegicus
tgtgtgcatgtgtaca

SEQ ID NO: 528099 - DNA, 16 bp, R. norvegicus
tgtgtgcatgtgtatg

SEQ ID NO: 528100 - DNA, 16 bp, R. norvegicus
tgtgtgcatgtttgtg

SEQ ID NO: 528101 - DNA, 16 bp, R. norvegicus
tgtgtgcatttgtgta

SEQ ID NO: 528102 - DNA, 16 bp, R. norvegicus
tgtgtgccaccactac

SEQ ID NO: 528103 - DNA, 16 bp, R. norvegicus
tgtgtgccactgtgtc

SEQ ID NO: 528104 - DNA, 16 bp, R. norvegicus
tgtgtgccagaagagg

SEQ ID NO: 528105 - DNA, 16 bp, R. norvegicus
tgtgtgccatcatgcc

SEQ ID NO: 528106 - DNA, 16 bp, R. norvegicus
tgtgtgccatgtgtgt

SEQ ID NO: 528107 - DNA, 16 bp, R. norvegicus
tgtgtgcctcagtttc

SEQ ID NO: 528108 - DNA, 16 bp, R. norvegicus
tgtgtgcctctgcctc

SEQ ID NO: 528109 - DNA, 16 bp, R. norvegicus
tgtgtgcctggtacct

SEQ ID NO: 528110 - DNA, 16 bp, R. norvegicus
tgtgtgcctggtgtcc

SEQ ID NO: 528111 - DNA, 16 bp, R. norvegicus
tgtgtgcgtgcgtgca

SEQ ID NO: 528112 - DNA, 16 bp, R. norvegicus
tgtgtgcgtgtatata

SEQ ID NO: 528113 - DNA, 16 bp, R. norvegicus
tgtgtgcgtgtctgtg

SEQ ID NO: 528114 - DNA, 16 bp, R. norvegicus
tgtgtgcgtgtgcgcg

SEQ ID NO: 528115 - DNA, 16 bp, R. norvegicus
tgtgtgctcttcttct

SEQ ID NO: 528116 - DNA, 16 bp, R. norvegicus
tgtgtgctgctgctgc

SEQ ID NO: 528117 - DNA, 16 bp, R. norvegicus
tgtgtgctgggagctg

SEQ ID NO: 528118 - DNA, 16 bp, R. norvegicus
tgtgtgctgtatgtgt

SEQ ID NO: 528119 - DNA, 16 bp, R. norvegicus
tgtgtgctttcactct

SEQ ID NO: 528120 - DNA, 16 bp, R. norvegicus
tgtgtgcttttatgtg

SEQ ID NO: 528121 - DNA, 16 bp, R. norvegicus
tgtgtggaagccagaa

SEQ ID NO: 528122 - DNA, 16 bp, R. norvegicus
tgtgtggacagagggg

SEQ ID NO: 528123 - DNA, 16 bp, R. norvegicus
tgtgtggatatatatg

SEQ ID NO: 528124 - DNA, 16 bp, R. norvegicus
tgtgtggatgtatgtg

SEQ ID NO: 528125 - DNA, 16 bp, R. norvegicus
tgtgtggatgtggatg

SEQ ID NO: 528126 - DNA, 16 bp, R. norvegicus
tgtgtggcaagtactt

SEQ ID NO: 528127 - DNA, 16 bp, R. norvegicus
tgtgtggcaagtgcct

SEQ ID NO: 528128 - DNA, 16 bp, R. norvegicus
tgtgtggcaagtgctt

SEQ ID NO: 528129 - DNA, 16 bp, R. norvegicus
tgtgtggcccaggctg

SEQ ID NO: 528130 - DNA, 16 bp, R. norvegicus
tgtgtggccctggctg

SEQ ID NO: 528131 - DNA, 16 bp, R. norvegicus
tgtgtggctgtggctg

SEQ ID NO: 528132 - DNA, 16 bp, R. norvegicus
tgtgtgggcacacatg

SEQ ID NO: 528133 - DNA, 16 bp, R. norvegicus
tgtgtgggggtgcaca

SEQ ID NO: 528134 - DNA, 16 bp, R. norvegicus
tgtgtgggtgctttgc

SEQ ID NO: 528135 - DNA, 16 bp, R. norvegicus
tgtgtgggtgtgcatg

SEQ ID NO: 528136 - DNA, 16 bp, R. norvegicus
tgtgtggtgctggaga

SEQ ID NO: 528137 - DNA, 16 bp, R. norvegicus
tgtgtggtggactgtg

SEQ ID NO: 528138 - DNA, 16 bp, R. norvegicus
tgtgtggtgtctgctg

SEQ ID NO: 528139 - DNA, 16 bp, R. norvegicus
tgtgtggtgtgagtat

SEQ ID NO: 528140 - DNA, 16 bp, R. norvegicus
tgtgtggtgtgtatac

SEQ ID NO: 528141 - DNA, 16 bp, R. norvegicus
tgtgtggtgtgtctct

SEQ ID NO: 528142 - DNA, 16 bp, R. norvegicus
tgtgtggtttttcctc

SEQ ID NO: 528143 - DNA, 16 bp, R. norvegicus
tgtgtgtaaatacatg

SEQ ID NO: 528144 - DNA, 16 bp, R. norvegicus
tgtgtgtaaatgcaca

SEQ ID NO: 528145 - DNA, 16 bp, R. norvegicus
tgtgtgtaaatgtgtg

SEQ ID NO: 528146 - DNA, 16 bp, R. norvegicus
tgtgtgtacaagtgca

SEQ ID NO: 528147 - DNA, 16 bp, R. norvegicus
tgtgtgtacatgcaca

SEQ ID NO: 528148 - DNA, 16 bp, R. norvegicus
tgtgtgtaccacatgc

SEQ ID NO: 528149 - DNA, 16 bp, R. norvegicus
tgtgtgtacctgtgtg

SEQ ID NO: 528150 - DNA, 16 bp, R. norvegicus
tgtgtgtacgtatata

SEQ ID NO: 528151 - DNA, 16 bp, R. norvegicus
tgtgtgtaggagagag

SEQ ID NO: 528152 - DNA, 16 bp, R. norvegicus
tgtgtgtagtatgcat

SEQ ID NO: 528153 - DNA, 16 bp, R. norvegicus
tgtgtgtataaacata

SEQ ID NO: 528154 - DNA, 16 bp, R. norvegicus
tgtgtgtataggtgca

SEQ ID NO: 528155 - DNA, 16 bp, R. norvegicus
tgtgtgtatataaata

SEQ ID NO: 528156 - DNA, 16 bp, R. norvegicus
tgtgtgtatatgtgtg

SEQ ID NO: 528157 - DNA, 16 bp, R. norvegicus
tgtgtgtatcacatgt

SEQ ID NO: 528158 - DNA, 16 bp, R. norvegicus
tgtgtgtatgagtgtg

SEQ ID NO: 528159 - DNA, 16 bp, R. norvegicus
tgtgtgtatgcatggg

SEQ ID NO: 528160 - DNA, 16 bp, R. norvegicus
tgtgtgtatggatgca

SEQ ID NO: 528161 - DNA, 16 bp, R. norvegicus
tgtgtgtatgtacagt

SEQ ID NO: 528162 - DNA, 16 bp, R. norvegicus
tgtgtgtatgtatatg

SEQ ID NO: 528163 - DNA, 16 bp, R. norvegicus
tgtgtgtatgtatggg

SEQ ID NO: 528164 - DNA, 16 bp, R. norvegicus
tgtgtgtatgtatgta

SEQ ID NO: 528165 - DNA, 16 bp, R. norvegicus
tgtgtgtatgtggagg

SEQ ID NO: 528166 - DNA, 16 bp, R. norvegicus
tgtgtgtcaacactcc

SEQ ID NO: 528167 - DNA, 16 bp, R. norvegicus
tgtgtgtcacatatgt

SEQ ID NO: 528168 - DNA, 16 bp, R. norvegicus
tgtgtgtcactgtgcc

SEQ ID NO: 528169 - DNA, 16 bp, R. norvegicus
tgtgtgtcaggactgc

SEQ ID NO: 528170 - DNA, 16 bp, R. norvegicus
tgtgtgtcaggagtgt

SEQ ID NO: 528171 - DNA, 16 bp, R. norvegicus
tgtgtgtcctgtgtgt

SEQ ID NO: 528172 - DNA, 16 bp, R. norvegicus
tgtgtgtctacatgca

SEQ ID NO: 528173 - DNA, 16 bp, R. norvegicus
tgtgtgtctacgtgtg

SEQ ID NO: 528174 - DNA, 16 bp, R. norvegicus
tgtgtgtctgcatttg

SEQ ID NO: 528175 - DNA, 16 bp, R. norvegicus
tgtgtgtctgcctgcc

SEQ ID NO: 528176 - DNA, 16 bp, R. norvegicus
tgtgtgtctggtgtct

SEQ ID NO: 528177 - DNA, 16 bp, R. norvegicus
tgtgtgtctgtatatg

SEQ ID NO: 528178 - DNA, 17 bp, R. norvegicus
tgtgtgtctgtctgtct

SEQ ID NO: 528179 - DNA, 16 bp, R. norvegicus
tgtgtgtctgtgcatc

SEQ ID NO: 528180 - DNA, 16 bp, R. norvegicus
tgtgtgtctgtgtatc

SEQ ID NO: 528181 - DNA, 16 bp, R. norvegicus
tgtgtgtctgtgtgca

SEQ ID NO: 528182 - DNA, 17 bp, R. norvegicus
tgtgtgtctgtgtgtct

SEQ ID NO: 528183 - DNA, 16 bp, R. norvegicus
tgtgtgtcttcctctc

SEQ ID NO: 528184 - DNA, 16 bp, R. norvegicus
tgtgtgtgaaagagag

SEQ ID NO: 528185 - DNA, 16 bp, R. norvegicus
tgtgtgtgaagattgt

SEQ ID NO: 528186 - DNA, 16 bp, R. norvegicus
tgtgtgtgaatgtgta

SEQ ID NO: 528187 - DNA, 16 bp, R. norvegicus
tgtgtgtgaatgttca

SEQ ID NO: 528188 - DNA, 16 bp, R. norvegicus
tgtgtgtgactcttcc

SEQ ID NO: 528189 - DNA, 16 bp, R. norvegicus
tgtgtgtgactgtgtg

SEQ ID NO: 528190 - DNA, 16 bp, R. norvegicus
tgtgtgtgagacagtg

SEQ ID NO: 528191 - DNA, 16 bp, R. norvegicus
tgtgtgtgagagggag

SEQ ID NO: 528192 - DNA, 16 bp, R. norvegicus
tgtgtgtgagtctatg

SEQ ID NO: 528193 - DNA, 16 bp, R. norvegicus
tgtgtgtgagtgagag

SEQ ID NO: 528194 - DNA, 16 bp, R. norvegicus
tgtgtgtgagtgtgta

SEQ ID NO: 528195 - DNA, 16 bp, R. norvegicus
tgtgtgtgcaagagca

SEQ ID NO: 528196 - DNA, 16 bp, R. norvegicus
tgtgtgtgcacaagca

SEQ ID NO: 528197 - DNA, 16 bp, R. norvegicus
tgtgtgtgcacagaca

SEQ ID NO: 528198 - DNA, 16 bp, R. norvegicus
tgtgtgtgcacagtgc

SEQ ID NO: 528199 - DNA, 16 bp, R. norvegicus
tgtgtgtgcaccagtg

SEQ ID NO: 528200 - DNA, 16 bp, R. norvegicus
tgtgtgtgcactcata

SEQ ID NO: 528201 - DNA, 16 bp, R. norvegicus
tgtgtgtgcaggtgct

SEQ ID NO: 528202 - DNA, 16 bp, R. norvegicus
tgtgtgtgcagtgtct

SEQ ID NO: 528203 - DNA, 16 bp, R. norvegicus
tgtgtgtgcatgcatg

SEQ ID NO: 528204 - DNA, 16 bp, R. norvegicus
tgtgtgtgcatgcgtg

SEQ ID NO: 528205 - DNA, 16 bp, R. norvegicus
tgtgtgtgcatgggag

SEQ ID NO: 528206 - DNA, 16 bp, R. norvegicus
tgtgtgtgcatgtgtg

SEQ ID NO: 528207 - DNA, 16 bp, R. norvegicus
tgtgtgtgccacagtg

SEQ ID NO: 528208 - DNA, 16 bp, R. norvegicus
tgtgtgtgcctatgca

SEQ ID NO: 528209 - DNA, 16 bp, R. norvegicus
tgtgtgtgcctctctg

SEQ ID NO: 528210 - DNA, 16 bp, R. norvegicus
tgtgtgtgcctctgtg

SEQ ID NO: 528211 - DNA, 16 bp, R. norvegicus
tgtgtgtgcctgtctg

SEQ ID NO: 528212 - DNA, 16 bp, R. norvegicus
tgtgtgtgcgcgcacg

SEQ ID NO: 528213 - DNA, 16 bp, R. norvegicus
tgtgtgtgcgtgtaca

SEQ ID NO: 528214 - DNA, 16 bp, R. norvegicus
tgtgtgtgcgtgtgag

SEQ ID NO: 528215 - DNA, 16 bp, R. norvegicus
tgtgtgtgcgtgtgca

SEQ ID NO: 528216 - DNA, 16 bp, R. norvegicus
tgtgtgtgctgtgctg

SEQ ID NO: 528217 - DNA, 16 bp, R. norvegicus
tgtgtgtgctgtggca

SEQ ID NO: 528218 - DNA, 16 bp, R. norvegicus
tgtgtgtggaggccag

SEQ ID NO: 528219 - DNA, 16 bp, R. norvegicus
tgtgtgtggagggcag

SEQ ID NO: 528220 - DNA, 16 bp, R. norvegicus
tgtgtgtggatgtata

SEQ ID NO: 528221 - DNA, 16 bp, R. norvegicus
tgtgtgtggcacacac

SEQ ID NO: 528222 - DNA, 16 bp, R. norvegicus
tgtgtgtggtatatgt

SEQ ID NO: 528223 - DNA, 16 bp, R. norvegicus
tgtgtgtgtaaaatgc

SEQ ID NO: 528224 - DNA, 16 bp, R. norvegicus
tgtgtgtgtaatgaat

SEQ ID NO: 528225 - DNA, 16 bp, R. norvegicus
tgtgtgtgtacaactt

SEQ ID NO: 528226 - DNA, 16 bp, R. norvegicus
tgtgtgtgtacagagg

SEQ ID NO: 528227 - DNA, 16 bp, R. norvegicus
tgtgtgtgtacatcag

SEQ ID NO: 528228 - DNA, 16 bp, R. norvegicus
tgtgtgtgtacatttc

SEQ ID NO: 528229 - DNA, 16 bp, R. norvegicus
tgtgtgtgtacgcgtg

SEQ ID NO: 528230 - DNA, 16 bp, R. norvegicus
tgtgtgtgtactaatg

SEQ ID NO: 528231 - DNA, 16 bp, R. norvegicus
tgtgtgtgtagcacat

SEQ ID NO: 528232 - DNA, 16 bp, R. norvegicus
tgtgtgtgtagggggc

SEQ ID NO: 528233 - DNA, 16 bp, R. norvegicus
tgtgtgtgtatgagca

SEQ ID NO: 528234 - DNA, 16 bp, R. norvegicus
tgtgtgtgtatgtgcg

SEQ ID NO: 528235 - DNA, 16 bp, R. norvegicus
tgtgtgtgtcaacttg

SEQ ID NO: 528236 - DNA, 16 bp, R. norvegicus
tgtgtgtgtcatgtgc

SEQ ID NO: 528237 - DNA, 16 bp, R. norvegicus
tgtgtgtgtccatcct

SEQ ID NO: 528238 - DNA, 16 bp, R. norvegicus
tgtgtgtgtccctgta

SEQ ID NO: 528239 - DNA, 16 bp, R. norvegicus
tgtgtgtgtctatgtg

SEQ ID NO: 528240 - DNA, 16 bp, R. norvegicus
tgtgtgtgtctggtgc

SEQ ID NO: 528241 - DNA, 16 bp, R. norvegicus
tgtgtgtgtctgtctg

SEQ ID NO: 528242 - DNA, 16 bp, R. norvegicus
tgtgtgtgtgaagttc

SEQ ID NO: 528243 - DNA, 16 bp, R. norvegicus
tgtgtgtgtgaatgaa

SEQ ID NO: 528244 - DNA, 16 bp, R. norvegicus
tgtgtgtgtgacactg

SEQ ID NO: 528245 - DNA, 16 bp, R. norvegicus
tgtgtgtgtgagaaga

SEQ ID NO: 528246 - DNA, 16 bp, R. norvegicus
tgtgtgtgtgagatgt

SEQ ID NO: 528247 - DNA, 16 bp, R. norvegicus
tgtgtgtgtgatcttg

SEQ ID NO: 528248 - DNA, 16 bp, R. norvegicus
tgtgtgtgtgcaatgt

SEQ ID NO: 528249 - DNA, 16 bp, R. norvegicus
tgtgtgtgtgcacaca

SEQ ID NO: 528250 - DNA, 16 bp, R. norvegicus
tgtgtgtgtgcagagg

SEQ ID NO: 528251 - DNA, 16 bp, R. norvegicus
tgtgtgtgtgcaggaa

SEQ ID NO: 528252 - DNA, 16 bp, R. norvegicus
tgtgtgtgtgcatgct

SEQ ID NO: 528253 - DNA, 16 bp, R. norvegicus
tgtgtgtgtgccctgt

SEQ ID NO: 528254 - DNA, 16 bp, R. norvegicus
tgtgtgtgtgcctgtg

SEQ ID NO: 528255 - DNA, 16 bp, R. norvegicus
tgtgtgtgtgccttgt

SEQ ID NO: 528256 - DNA, 16 bp, R. norvegicus
tgtgtgtgtgcgcgca

SEQ ID NO: 528257 - DNA, 16 bp, R. norvegicus
tgtgtgtgtgcgctct

SEQ ID NO: 528258 - DNA, 16 bp, R. norvegicus
tgtgtgtgtgctcatt

SEQ ID NO: 528259 - DNA, 16 bp, R. norvegicus
tgtgtgtgtggagaag

SEQ ID NO: 528260 - DNA, 16 bp, R. norvegicus
tgtgtgtgtggcaggg

SEQ ID NO: 528261 - DNA, 16 bp, R. norvegicus
tgtgtgtgtggcagtg

SEQ ID NO: 528262 - DNA, 16 bp, R. norvegicus
tgtgtgtgtgggtgca

SEQ ID NO: 528263 - DNA, 16 bp, R. norvegicus
tgtgtgtgtgtaggca

SEQ ID NO: 528264 - DNA, 16 bp, R. norvegicus
tgtgtgtgtgtataag

SEQ ID NO: 528265 - DNA, 16 bp, R. norvegicus
tgtgtgtgtgtataca

SEQ ID NO: 528266 - DNA, 16 bp, R. norvegicus
tgtgtgtgtgtatcat

SEQ ID NO: 528267 - DNA, 16 bp, R. norvegicus
tgtgtgtgtgtctgcc

SEQ ID NO: 528268 - DNA, 16 bp, R. norvegicus
tgtgtgtgtgtgaaga

SEQ ID NO: 528269 - DNA, 16 bp, R. norvegicus
tgtgtgtgtgtgaatg

SEQ ID NO: 528270 - DNA, 16 bp, R. norvegicus
tgtgtgtgtgtgattc

SEQ ID NO: 528271 - DNA, 16 bp, R. norvegicus
tgtgtgtgtgtgcgca

SEQ ID NO: 528272 - DNA, 16 bp, R. norvegicus
tgtgtgtgtgtgtccg

SEQ ID NO: 528273 - DNA, 16 bp, R. norvegicus
tgtgtgtgtgttacat

SEQ ID NO: 528274 - DNA, 16 bp, R. norvegicus
tgtgtgtgtgttcaca

SEQ ID NO: 528275 - DNA, 16 bp, R. norvegicus
tgtgtgtgtgtttaca

SEQ ID NO: 528276 - DNA, 16 bp, R. norvegicus
tgtgtgtgtgtttcaa

SEQ ID NO: 528277 - DNA, 16 bp, R. norvegicus
tgtgtgtgtgttttca

SEQ ID NO: 528278 - DNA, 16 bp, R. norvegicus
tgtgtgtgttcagaga

SEQ ID NO: 528279 - DNA, 16 bp, R. norvegicus
tgtgtgtgttcatgaa

SEQ ID NO: 528280 - DNA, 16 bp, R. norvegicus
tgtgtgtgttgagaaa

SEQ ID NO: 528281 - DNA, 16 bp, R. norvegicus
tgtgtgtgttgctgag

SEQ ID NO: 528282 - DNA, 16 bp, R. norvegicus
tgtgtgtgtttacaga

SEQ ID NO: 528283 - DNA, 16 bp, R. norvegicus
tgtgtgtgtttgcagt

SEQ ID NO: 528284 - DNA, 16 bp, R. norvegicus
tgtgtgtgtttgtaca

SEQ ID NO: 528285 - DNA, 16 bp, R. norvegicus
tgtgtgttcaggtgtg

SEQ ID NO: 528286 - DNA, 16 bp, R. norvegicus
tgtgtgttcatgtgcc

SEQ ID NO: 528287 - DNA, 16 bp, R. norvegicus
tgtgtgttcctgtgta

SEQ ID NO: 528288 - DNA, 16 bp, R. norvegicus
tgtgtgttctgtatgt

SEQ ID NO: 528289 - DNA, 16 bp, R. norvegicus
tgtgtgtttatttgaa

SEQ ID NO: 528290 - DNA, 16 bp, R. norvegicus
tgtgtgtttgcacgtg

SEQ ID NO: 528291 - DNA, 16 bp, R. norvegicus
tgtgtgttttcatgtt

SEQ ID NO: 528292 - DNA, 16 bp, R. norvegicus
tgtgtgtttttaaaaa

SEQ ID NO: 528293 - DNA, 16 bp, R. norvegicus
tgtgttactgtggagg

SEQ ID NO: 528294 - DNA, 16 bp, R. norvegicus
tgtgttcaagtacaaa

SEQ ID NO: 528295 - DNA, 16 bp, R. norvegicus
tgtgttcacacacaca

SEQ ID NO: 528296 - DNA, 16 bp, R. norvegicus
tgtgttcacagcagct

SEQ ID NO: 528297 - DNA, 16 bp, R. norvegicus
tgtgttcacctgtgtg

SEQ ID NO: 528298 - DNA, 16 bp, R. norvegicus
tgtgttcagaaacttg

SEQ ID NO: 528299 - DNA, 16 bp, R. norvegicus
tgtgttcatggtgtgt

SEQ ID NO: 528300 - DNA, 16 bp, R. norvegicus
tgtgttccaaggtctc

SEQ ID NO: 528301 - DNA, 16 bp, R. norvegicus
tgtgttcctggaattc

SEQ ID NO: 528302 - DNA, 16 bp, R. norvegicus
tgtgttcctggattca

SEQ ID NO: 528303 - DNA, 16 bp, R. norvegicus
tgtgttcctgtgtatg

SEQ ID NO: 528304 - DNA, 16 bp, R. norvegicus
tgtgttctatgcatct

SEQ ID NO: 528305 - DNA, 16 bp, R. norvegicus
tgtgttctctgtgctg

SEQ ID NO: 528306 - DNA, 16 bp, R. norvegicus
tgtgttctgtacattt

SEQ ID NO: 528307 - DNA, 16 bp, R. norvegicus
tgtgttctgtgcatca

SEQ ID NO: 528308 - DNA, 16 bp, R. norvegicus
tgtgttctgtgtatat

SEQ ID NO: 528309 - DNA, 16 bp, R. norvegicus
tgtgttcttggattca

SEQ ID NO: 528310 - DNA, 16 bp, R. norvegicus
tgtgttctttaaaaaa

SEQ ID NO: 528311 - DNA, 16 bp, R. norvegicus
tgtgttctttcctgat

SEQ ID NO: 528312 - DNA, 16 bp, R. norvegicus
tgtgttctttgcatgg

SEQ ID NO: 528313 - DNA, 16 bp, R. norvegicus
tgtgttgctgtgtgag

SEQ ID NO: 528314 - DNA, 16 bp, R. norvegicus
tgtgttgggctggaga

SEQ ID NO: 528315 - DNA, 16 bp, R. norvegicus
tgtgttgggtgcctca

SEQ ID NO: 528316 - DNA, 16 bp, R. norvegicus
tgtgttgtgtgcatgc

SEQ ID NO: 528317 - DNA, 16 bp, R. norvegicus
tgtgtttatctctgtg

SEQ ID NO: 528318 - DNA, 16 bp, R. norvegicus
tgtgtttatgtgcatg

SEQ ID NO: 528319 - DNA, 16 bp, R. norvegicus
tgtgtttcacaaagga

SEQ ID NO: 528320 - DNA, 16 bp, R. norvegicus
tgtgtttcagatgcag

SEQ ID NO: 528321 - DNA, 16 bp, R. norvegicus
tgtgtttcctcttcaa

SEQ ID NO: 528322 - DNA, 16 bp, R. norvegicus
tgtgtttcctctttta

SEQ ID NO: 528323 - DNA, 16 bp, R. norvegicus
tgtgtttcctgatggt

SEQ ID NO: 528324 - DNA, 33 bp, R. norvegicus
tgtgtttgaaatcatgaaactgtttgctttgtt

SEQ ID NO: 528325 - DNA, 16 bp, R. norvegicus
tgtgtttgaagacagt

SEQ ID NO: 528326 - DNA, 16 bp, R. norvegicus
tgtgtttgaatttgta

SEQ ID NO: 528327 - DNA, 16 bp, R. norvegicus
tgtgtttgactgtgtg

SEQ ID NO: 528328 - DNA, 16 bp, R. norvegicus
tgtgtttgagacagga

SEQ ID NO: 528329 - DNA, 16 bp, R. norvegicus
tgtgtttgagatgctg

SEQ ID NO: 528330 - DNA, 16 bp, R. norvegicus
tgtgtttgaggacagc

SEQ ID NO: 528331 - DNA, 16 bp, R. norvegicus
tgtgtttgcatgtgca

SEQ ID NO: 528332 - DNA, 16 bp, R. norvegicus
tgtgtttgcatgtgtg

SEQ ID NO: 528333 - DNA, 16 bp, R. norvegicus
tgtgtttggaggccag

SEQ ID NO: 528334 - DNA, 16 bp, R. norvegicus
tgtgtttggtggctgc

SEQ ID NO: 528335 - DNA, 16 bp, R. norvegicus
tgtgtttgtatgtctc

SEQ ID NO: 528336 - DNA, 16 bp, R. norvegicus
tgtgtttgtctctctc

SEQ ID NO: 528337 - DNA, 16 bp, R. norvegicus
tgtgtttgtctgtgca

SEQ ID NO: 528338 - DNA, 16 bp, R. norvegicus
tgtgtttgtgcctgtg

SEQ ID NO: 528339 - DNA, 16 bp, R. norvegicus
tgtgtttgtgtctata

SEQ ID NO: 528340 - DNA, 16 bp, R. norvegicus
tgtgtttgtgtgcatg

SEQ ID NO: 528341 - DNA, 16 bp, R. norvegicus
tgtgtttgtgtgggca

SEQ ID NO: 528342 - DNA, 16 bp, R. norvegicus
tgtgtttgtgtgtgcc

SEQ ID NO: 528343 - DNA, 16 bp, R. norvegicus
tgtgtttgttttccag

SEQ ID NO: 528344 - DNA, 16 bp, R. norvegicus
tgtgttttaaagaaac

SEQ ID NO: 528345 - DNA, 16 bp, R. norvegicus
tgtgttttacaaattc

SEQ ID NO: 528346 - DNA, 16 bp, R. norvegicus
tgtgttttcctacatt

SEQ ID NO: 528347 - DNA, 16 bp, R. norvegicus
tgtgttttcctgtatt

SEQ ID NO: 528348 - DNA, 16 bp, R. norvegicus
tgtgttttcttgggca

SEQ ID NO: 528349 - DNA, 16 bp, R. norvegicus
tgtgttttcttttgaa

SEQ ID NO: 528350 - DNA, 16 bp, R. norvegicus
tgtgtttttctggatt

SEQ ID NO: 528351 - DNA, 16 bp, R. norvegicus
tgtgttttttgtgact

SEQ ID NO: 528352 - DNA, 16 bp, R. norvegicus
tgttaaagtgtgtgtg

SEQ ID NO: 528353 - DNA, 16 bp, R. norvegicus
tgttaagagattttaa

SEQ ID NO: 528354 - DNA, 16 bp, R. norvegicus
tgttaattcagagttt

SEQ ID NO: 528355 - DNA, 16 bp, R. norvegicus
tgttaattctaccaat

SEQ ID NO: 528356 - DNA, 17 bp, R. norvegicus
tgttacaagggaaactt

SEQ ID NO: 528357 - DNA, 16 bp, R. norvegicus
tgttacagcttttatg

SEQ ID NO: 528358 - DNA, 16 bp, R. norvegicus
tgttacatttttaaat

SEQ ID NO: 528359 - DNA, 16 bp, R. norvegicus
tgttaccaccaaagac

SEQ ID NO: 528360 - DNA, 16 bp, R. norvegicus
tgttacctctgctctc

SEQ ID NO: 528361 - DNA, 16 bp, R. norvegicus
tgttaccttgtcttgc

SEQ ID NO: 528362 - DNA, 16 bp, R. norvegicus
tgttactcgacctttt

SEQ ID NO: 528363 - DNA, 16 bp, R. norvegicus
tgttactcttccagag

SEQ ID NO: 528364 - DNA, 16 bp, R. norvegicus
tgttactgagagtaat

SEQ ID NO: 528365 - DNA, 16 bp, R. norvegicus
tgttactgctgctgtt

SEQ ID NO: 528366 - DNA, 16 bp, R. norvegicus
tgttacttttaaaaca

SEQ ID NO: 528367 - DNA, 16 bp, R. norvegicus
tgttaggtatttcagc

SEQ ID NO: 528368 - DNA, 16 bp, R. norvegicus
tgttaggttttaaatc

SEQ ID NO: 528369 - DNA, 16 bp, R. norvegicus
tgttagtttcattgtt

SEQ ID NO: 528370 - DNA, 16 bp, R. norvegicus
tgttatggtttgcata

SEQ ID NO: 528371 - DNA, 16 bp, R. norvegicus
tgttattccagatgag

SEQ ID NO: 528372 - DNA, 16 bp, R. norvegicus
tgttattccctttccc

SEQ ID NO: 528373 - DNA, 16 bp, R. norvegicus
tgttattgaaaaccag

SEQ ID NO: 528374 - DNA, 16 bp, R. norvegicus
tgttcaaggacaaagt

SEQ ID NO: 528375 - DNA, 16 bp, R. norvegicus
tgttcaaggtcatcct

SEQ ID NO: 528376 - DNA, 16 bp, R. norvegicus
tgttcaataaatattt

SEQ ID NO: 528377 - DNA, 16 bp, R. norvegicus
tgttcacagcattaaa

SEQ ID NO: 528378 - DNA, 16 bp, R. norvegicus
tgttcacatacataaa

SEQ ID NO: 528379 - DNA, 16 bp, R. norvegicus
tgttcactttccatgt

SEQ ID NO: 528380 - DNA, 16 bp, R. norvegicus
tgttcagaattgtttt

SEQ ID NO: 528381 - DNA, 16 bp, R. norvegicus
tgttcagagcagcctt

SEQ ID NO: 528382 - DNA, 37 bp, R. norvegicus
tgttcagagctaaacaaagaattcacagctgaggaat

SEQ ID NO: 528383 - DNA, 16 bp, R. norvegicus
tgttcagattgtgact

SEQ ID NO: 528384 - DNA, 16 bp, R. norvegicus
tgttcaggaaattctt

SEQ ID NO: 528385 - DNA, 16 bp, R. norvegicus
tgttcaggaacttgtc

SEQ ID NO: 528386 - DNA, 16 bp, R. norvegicus
tgttcagtgtgtgtgt

SEQ ID NO: 528387 - DNA, 16 bp, R. norvegicus
tgttcagtttccacat

SEQ ID NO: 528388 - DNA, 16 bp, R. norvegicus
tgttcataaaataaaa

SEQ ID NO: 528389 - DNA, 16 bp, R. norvegicus
tgttcatagtggcttt

SEQ ID NO: 528390 - DNA, 16 bp, R. norvegicus
tgttcatcacaaaagg

SEQ ID NO: 528391 - DNA, 23 bp, R. norvegicus
tgttcatcctcagacttctgttt

SEQ ID NO: 528392 - DNA, 16 bp, R. norvegicus
tgttcatgtgcacatg

SEQ ID NO: 528393 - DNA, 16 bp, R. norvegicus
tgttcatgtgtgtgcg

SEQ ID NO: 528394 - DNA, 16 bp, R. norvegicus
tgttcatttccttttc

SEQ ID NO: 528395 - DNA, 16 bp, R. norvegicus
tgttccaccaggatct

SEQ ID NO: 528396 - DNA, 16 bp, R. norvegicus
tgttccactatgttca

SEQ ID NO: 528397 - DNA, 16 bp, R. norvegicus
tgttccagaaaagaat

SEQ ID NO: 528398 - DNA, 16 bp, R. norvegicus
tgttccagaaaagcct

SEQ ID NO: 528399 - DNA, 16 bp, R. norvegicus
tgttcccccacccatc

SEQ ID NO: 528400 - DNA, 16 bp, R. norvegicus
tgttcccccaccccca

SEQ ID NO: 528401 - DNA, 16 bp, R. norvegicus
tgttccccctccacaa

SEQ ID NO: 528402 - DNA, 16 bp, R. norvegicus
tgttccctcacccatc

SEQ ID NO: 528403 - DNA, 16 bp, R. norvegicus
tgttccctctgcctct

SEQ ID NO: 528404 - DNA, 21 bp, R. norvegicus
tgttcctacccccaatgtatc

SEQ ID NO: 528405 - DNA, 16 bp, R. norvegicus
tgttcctcaggagcca

SEQ ID NO: 528406 - DNA, 16 bp, R. norvegicus
tgttcctcaggagctg

SEQ ID NO: 528407 - DNA, 16 bp, R. norvegicus
tgttcctctttcttca

SEQ ID NO: 528408 - DNA, 16 bp, R. norvegicus
tgttcctgcagaggac

SEQ ID NO: 528409 - DNA, 16 bp, R. norvegicus
tgttcctgcctccctt

SEQ ID NO: 528410 - DNA, 16 bp, R. norvegicus
tgttcctggcttcctt

SEQ ID NO: 528411 - DNA, 16 bp, R. norvegicus
tgttcctgtaggcctg

SEQ ID NO: 528412 - DNA, 16 bp, R. norvegicus
tgttcctgtctgtgga

SEQ ID NO: 528413 - DNA, 16 bp, R. norvegicus
tgttcctgtgagcctg

SEQ ID NO: 528414 - DNA, 16 bp, R. norvegicus
tgttcctgttcctgtt

SEQ ID NO: 528415 - DNA, 16 bp, R. norvegicus
tgttcctgttggcctg

SEQ ID NO: 528416 - DNA, 16 bp, R. norvegicus
tgttccttgacctttt

SEQ ID NO: 528417 - DNA, 16 bp, R. norvegicus
tgttcctttagcagaa

SEQ ID NO: 528418 - DNA, 16 bp, R. norvegicus
tgttcctttctccaca

SEQ ID NO: 528419 - DNA, 16 bp, R. norvegicus
tgttcgagattcttcc

SEQ ID NO: 528420 - DNA, 16 bp, R. norvegicus
tgttctacagctttca

SEQ ID NO: 528421 - DNA, 16 bp, R. norvegicus
tgttctagaactttca

SEQ ID NO: 528422 - DNA, 16 bp, R. norvegicus
tgttctagaattttct

SEQ ID NO: 528423 - DNA, 17 bp, R. norvegicus
tgttctagccttggtga

SEQ ID NO: 528424 - DNA, 16 bp, R. norvegicus
tgttctcagaaaacac

SEQ ID NO: 528425 - DNA, 16 bp, R. norvegicus
tgttctcagacacacc

SEQ ID NO: 528426 - DNA, 16 bp, R. norvegicus
tgttctcccagctcct

SEQ ID NO: 528427 - DNA, 16 bp, R. norvegicus
tgttctctctcattct

SEQ ID NO: 528428 - DNA, 16 bp, R. norvegicus
tgttctctctctgtgt

SEQ ID NO: 528429 - DNA, 16 bp, R. norvegicus
tgttctctctgtgtgt

SEQ ID NO: 528430 - DNA, 16 bp, R. norvegicus
tgttctctgtgaattt

SEQ ID NO: 528431 - DNA, 16 bp, R. norvegicus
tgttctgaaatccttg

SEQ ID NO: 528432 - DNA, 16 bp, R. norvegicus
tgttctgcctggaaca

SEQ ID NO: 528433 - DNA, 16 bp, R. norvegicus
tgttctggcagaggac

SEQ ID NO: 528434 - DNA, 16 bp, R. norvegicus
tgttctggctatgtct

SEQ ID NO: 528435 - DNA, 16 bp, R. norvegicus
tgttctgtagactagg

SEQ ID NO: 528436 - DNA, 16 bp, R. norvegicus
tgttctgtatgtgtgt

SEQ ID NO: 528437 - DNA, 16 bp, R. norvegicus
tgttctgttcatgaaa

SEQ ID NO: 528438 - DNA, 16 bp, R. norvegicus
tgttctgttggtgatg

SEQ ID NO: 528439 - DNA, 16 bp, R. norvegicus
tgttctgttttttaaa

SEQ ID NO: 528440 - DNA, 16 bp, R. norvegicus
tgttcttaagactcta

SEQ ID NO: 528441 - DNA, 16 bp, R. norvegicus
tgttcttccaaagaac

SEQ ID NO: 528442 - DNA, 16 bp, R. norvegicus
tgttcttccccatctc

SEQ ID NO: 528443 - DNA, 16 bp, R. norvegicus
tgttcttcctaaggag

SEQ ID NO: 528444 - DNA, 16 bp, R. norvegicus
tgttcttcctctcagc

SEQ ID NO: 528445 - DNA, 16 bp, R. norvegicus
tgttcttcgcagcctt

SEQ ID NO: 528446 - DNA, 16 bp, R. norvegicus
tgttcttctattagtt

SEQ ID NO: 528447 - DNA, 16 bp, R. norvegicus
tgttcttctggtgtcc

SEQ ID NO: 528448 - DNA, 16 bp, R. norvegicus
tgttcttctgtgtctg

SEQ ID NO: 528449 - DNA, 16 bp, R. norvegicus
tgttcttgctgctgct

SEQ ID NO: 528450 - DNA, 16 bp, R. norvegicus
tgttcttggtgatcac

SEQ ID NO: 528451 - DNA, 16 bp, R. norvegicus
tgttctttcaagatct

SEQ ID NO: 528452 - DNA, 16 bp, R. norvegicus
tgttctttcagaggac

SEQ ID NO: 528453 - DNA, 16 bp, R. norvegicus
tgttctttcccacttt

SEQ ID NO: 528454 - DNA, 16 bp, R. norvegicus
tgttctttgtccactg

SEQ ID NO: 528455 - DNA, 16 bp, R. norvegicus
tgttcttttgtgcctg

SEQ ID NO: 528456 - DNA, 16 bp, R. norvegicus
tgttctttttatgggg

SEQ ID NO: 528457 - DNA, 16 bp, R. norvegicus
tgttgaacaattcttt

SEQ ID NO: 528458 - DNA, 16 bp, R. norvegicus
tgttgaacacttcttt

SEQ ID NO: 528459 - DNA, 16 bp, R. norvegicus
tgttgaagaaagtgtg

SEQ ID NO: 528460 - DNA, 16 bp, R. norvegicus
tgttgaagacaccaca

SEQ ID NO: 528461 - DNA, 16 bp, R. norvegicus
tgttgaagactcccac

SEQ ID NO: 528462 - DNA, 16 bp, R. norvegicus
tgttgaaggacatctg

SEQ ID NO: 528463 - DNA, 16 bp, R. norvegicus
tgttgaaggattcaga

SEQ ID NO: 528464 - DNA, 16 bp, R. norvegicus
tgttgaagggcacctg

SEQ ID NO: 528465 - DNA, 16 bp, R. norvegicus
tgttgaagttttctat

SEQ ID NO: 528466 - DNA, 16 bp, R. norvegicus
tgttgaatccaataat

SEQ ID NO: 528467 - DNA, 16 bp, R. norvegicus
tgttgaatttctcaaa

SEQ ID NO: 528468 - DNA, 16 bp, R. norvegicus
tgttgaattttgtaaa

SEQ ID NO: 528469 - DNA, 16 bp, R. norvegicus
tgttgaccagactggc

SEQ ID NO: 528470 - DNA, 16 bp, R. norvegicus
tgttgacctctgacct

SEQ ID NO: 528471 - DNA, 16 bp, R. norvegicus
tgttgacctgttttct

SEQ ID NO: 528472 - DNA, 16 bp, R. norvegicus
tgttgactttaagaca

SEQ ID NO: 528473 - DNA, 16 bp, R. norvegicus
tgttgagaaagagaaa

SEQ ID NO: 528474 - DNA, 16 bp, R. norvegicus
tgttgagaataccagt

SEQ ID NO: 528475 - DNA, 16 bp, R. norvegicus
tgttgagaatagcttt

SEQ ID NO: 528476 - DNA, 16 bp, R. norvegicus
tgttgagccatctctc

SEQ ID NO: 528477 - DNA, 16 bp, R. norvegicus
tgttgagccttctctc

SEQ ID NO: 528478 - DNA, 16 bp, R. norvegicus
tgttgaggatgtggag

SEQ ID NO: 528479 - DNA, 16 bp, R. norvegicus
tgttgagggcatctgg

SEQ ID NO: 528480 - DNA, 16 bp, R. norvegicus
tgttgaggtatccagg

SEQ ID NO: 528481 - DNA, 16 bp, R. norvegicus
tgttgaggtggaagtg

SEQ ID NO: 528482 - DNA, 16 bp, R. norvegicus
tgttgagtttgaggcc

SEQ ID NO: 528483 - DNA, 16 bp, R. norvegicus
tgttgatgaatatgaa

SEQ ID NO: 528484 - DNA, 16 bp, R. norvegicus
tgttgatgctgctgct

SEQ ID NO: 528485 - DNA, 16 bp, R. norvegicus
tgttgatgctgctgtt

SEQ ID NO: 528486 - DNA, 16 bp, R. norvegicus
tgttgatgttgagaga

SEQ ID NO: 528487 - DNA, 16 bp, R. norvegicus
tgttgatgttgctgtt

SEQ ID NO: 528488 - DNA, 16 bp, R. norvegicus
tgttgatgttttctat

SEQ ID NO: 528489 - DNA, 16 bp, R. norvegicus
tgttgatttctgttat

SEQ ID NO: 528490 - DNA, 16 bp, R. norvegicus
tgttgcagctggtgag

SEQ ID NO: 528491 - DNA, 16 bp, R. norvegicus
tgttgcagtcaacaaa

SEQ ID NO: 528492 - DNA, 16 bp, R. norvegicus
tgttgcatgcctttaa

SEQ ID NO: 528493 - DNA, 16 bp, R. norvegicus
tgttgccaagatgttt

SEQ ID NO: 528494 - DNA, 16 bp, R. norvegicus
tgttgccaggcaactg

SEQ ID NO: 528495 - DNA, 16 bp, R. norvegicus
tgttgccatgatctgt

SEQ ID NO: 528496 - DNA, 16 bp, R. norvegicus
tgttgccctgcaacac

SEQ ID NO: 528497 - DNA, 16 bp, R. norvegicus
tgttgctaacctgact

SEQ ID NO: 528498 - DNA, 16 bp, R. norvegicus
tgttgctactgctgtt

SEQ ID NO: 528499 - DNA, 16 bp, R. norvegicus
tgttgctactgttatg

SEQ ID NO: 528500 - DNA, 16 bp, R. norvegicus
tgttgctattgctgtt

SEQ ID NO: 528501 - DNA, 16 bp, R. norvegicus
tgttgctattgttgtt

SEQ ID NO: 528502 - DNA, 16 bp, R. norvegicus
tgttgctctctctctc

SEQ ID NO: 528503 - DNA, 16 bp, R. norvegicus
tgttgctcttcctatg

SEQ ID NO: 528504 - DNA, 16 bp, R. norvegicus
tgttgctgccctgtgt

SEQ ID NO: 528505 - DNA, 16 bp, R. norvegicus
tgttgctgctactgct

SEQ ID NO: 528506 - DNA, 16 bp, R. norvegicus
tgttgctgctgctact

SEQ ID NO: 528507 - DNA, 16 bp, R. norvegicus
tgttgctgctgctgct

SEQ ID NO: 528508 - DNA, 16 bp, R. norvegicus
tgttgctgctgctggt

SEQ ID NO: 528509 - DNA, 16 bp, R. norvegicus
tgttgctgctgctgtg

SEQ ID NO: 528510 - DNA, 16 bp, R. norvegicus
tgttgctgctgctgtt

SEQ ID NO: 528511 - DNA, 16 bp, R. norvegicus
tgttgctgctgcttct

SEQ ID NO: 528512 - DNA, 17 bp, R. norvegicus
tgttgctgctgttgctg

SEQ ID NO: 528513 - DNA, 16 bp, R. norvegicus
tgttgctgctgttggt

SEQ ID NO: 528514 - DNA, 16 bp, R. norvegicus
tgttgctgcttctgct

SEQ ID NO: 528515 - DNA, 22 bp, R. norvegicus
tgttgctgctttccttcaagaa

SEQ ID NO: 528516 - DNA, 16 bp, R. norvegicus
tgttgctgtaataaaa

SEQ ID NO: 528517 - DNA, 16 bp, R. norvegicus
tgttgctgttactgct

SEQ ID NO: 528518 - DNA, 16 bp, R. norvegicus
tgttgctgttttgaga

SEQ ID NO: 528519 - DNA, 16 bp, R. norvegicus
tgttgcttatgagctt

SEQ ID NO: 528520 - DNA, 18 bp, R. norvegicus
tgttgcttctatgtagac

SEQ ID NO: 528521 - DNA, 16 bp, R. norvegicus
tgttgcttctccagct

SEQ ID NO: 528522 - DNA, 16 bp, R. norvegicus
tgttgcttctgctgct

SEQ ID NO: 528523 - DNA, 16 bp, R. norvegicus
tgttgcttttctcaaa

SEQ ID NO: 528524 - DNA, 16 bp, R. norvegicus
tgttggaagatgcttc

SEQ ID NO: 528525 - DNA, 16 bp, R. norvegicus
tgttggagaaagtgtg

SEQ ID NO: 528526 - DNA, 16 bp, R. norvegicus
tgttggagaatcattt

SEQ ID NO: 528527 - DNA, 16 bp, R. norvegicus
tgttggagaatctttt

SEQ ID NO: 528528 - DNA, 16 bp, R. norvegicus
tgttggagcatcagtc

SEQ ID NO: 528529 - DNA, 16 bp, R. norvegicus
tgttggagcatctttt

SEQ ID NO: 528530 - DNA, 16 bp, R. norvegicus
tgttggagcctctgga

SEQ ID NO: 528531 - DNA, 16 bp, R. norvegicus
tgttggaggaatcaga

SEQ ID NO: 528532 - DNA, 16 bp, R. norvegicus
tgttggaggagatgtg

SEQ ID NO: 528533 - DNA, 16 bp, R. norvegicus
tgttggcaactggttt

SEQ ID NO: 528534 - DNA, 16 bp, R. norvegicus
tgttggccaggaaact

SEQ ID NO: 528535 - DNA, 16 bp, R. norvegicus
tgttggctgtgagcat

SEQ ID NO: 528536 - DNA, 19 bp, R. norvegicus
tgttgggagcaatgccctt

SEQ ID NO: 528537 - DNA, 19 bp, R. norvegicus
tgttgggagcgatgccctt

SEQ ID NO: 528538 - DNA, 16 bp, R. norvegicus
tgttgggcaccactgg

SEQ ID NO: 528539 - DNA, 16 bp, R. norvegicus
tgttgggcaccgatgg

SEQ ID NO: 528540 - DNA, 16 bp, R. norvegicus
tgttgggggaagggca

SEQ ID NO: 528541 - DNA, 16 bp, R. norvegicus
tgttggggtccaggag

SEQ ID NO: 528542 - DNA, 16 bp, R. norvegicus
tgttggtatcaggaat

SEQ ID NO: 528543 - DNA, 16 bp, R. norvegicus
tgttggtctgtctgtc

SEQ ID NO: 528544 - DNA, 16 bp, R. norvegicus
tgttggtcttcctgca

SEQ ID NO: 528545 - DNA, 16 bp, R. norvegicus
tgttggtcttccttct

SEQ ID NO: 528546 - DNA, 16 bp, R. norvegicus
tgttggtgaaattgca

SEQ ID NO: 528547 - DNA, 16 bp, R. norvegicus
tgttggtgattcttgc

SEQ ID NO: 528548 - DNA, 16 bp, R. norvegicus
tgttggtgctcctgga

SEQ ID NO: 528549 - DNA, 16 bp, R. norvegicus
tgttggtgggattgga

SEQ ID NO: 528550 - DNA, 16 bp, R. norvegicus
tgttggttctgttgat

SEQ ID NO: 528551 - DNA, 17 bp, R. norvegicus
tgttggttgatagccaa

SEQ ID NO: 528552 - DNA, 16 bp, R. norvegicus
tgttggttgccctttt

SEQ ID NO: 528553 - DNA, 17 bp, R. norvegicus
tgttgtagagggaggaa

SEQ ID NO: 528554 - DNA, 16 bp, R. norvegicus
tgttgtagattctttg

SEQ ID NO: 528555 - DNA, 16 bp, R. norvegicus
tgttgtataaatatct

SEQ ID NO: 528556 - DNA, 16 bp, R. norvegicus
tgttgtcaactgagtt

SEQ ID NO: 528557 - DNA, 17 bp, R. norvegicus
tgttgtcacctgagttt

SEQ ID NO: 528558 - DNA, 16 bp, R. norvegicus
tgttgtcctgtgtttc

SEQ ID NO: 528559 - DNA, 16 bp, R. norvegicus
tgttgtccttaaaaga

SEQ ID NO: 528560 - DNA, 16 bp, R. norvegicus
tgttgtctagatcctt

SEQ ID NO: 528561 - DNA, 16 bp, R. norvegicus
tgttgtggttcatagg

SEQ ID NO: 528562 - DNA, 16 bp, R. norvegicus
tgttgtggtttgaatg

SEQ ID NO: 528563 - DNA, 16 bp, R. norvegicus
tgttgtggtttgccct

SEQ ID NO: 528564 - DNA, 16 bp, R. norvegicus
tgttgtgtaacagttt

SEQ ID NO: 528565 - DNA, 16 bp, R. norvegicus
tgttgtgtcagtgttt

SEQ ID NO: 528566 - DNA, 16 bp, R. norvegicus
tgttgttactgaagac

SEQ ID NO: 528567 - DNA, 16 bp, R. norvegicus
tgttgttctgcctatg

SEQ ID NO: 528568 - DNA, 16 bp, R. norvegicus
tgttgttgctactgtt

SEQ ID NO: 528569 - DNA, 16 bp, R. norvegicus
tgttgttgctgctact

SEQ ID NO: 528570 - DNA, 16 bp, R. norvegicus
tgttgttgctgctgct

SEQ ID NO: 528571 - DNA, 16 bp, R. norvegicus
tgttgttgggacccag

SEQ ID NO: 528572 - DNA, 16 bp, R. norvegicus
tgttgttgttgaagtc

SEQ ID NO: 528573 - DNA, 16 bp, R. norvegicus
tgtttaaaaagagaac

SEQ ID NO: 528574 - DNA, 16 bp, R. norvegicus
tgtttaaaaatgtaaa

SEQ ID NO: 528575 - DNA, 16 bp, R. norvegicus
tgtttaaaataaaagt

SEQ ID NO: 528576 - DNA, 16 bp, R. norvegicus
tgtttaacttccatgt

SEQ ID NO: 528577 - DNA, 16 bp, R. norvegicus
tgtttaagggcatctc

SEQ ID NO: 528578 - DNA, 16 bp, R. norvegicus
tgtttaatatcagtta

SEQ ID NO: 528579 - DNA, 16 bp, R. norvegicus
tgtttacatcccaaat

SEQ ID NO: 528580 - DNA, 16 bp, R. norvegicus
tgtttacatgatctgt

SEQ ID NO: 528581 - DNA, 19 bp, R. norvegicus
tgtttaccaggctatgact

SEQ ID NO: 528582 - DNA, 16 bp, R. norvegicus
tgtttactgacaggag

SEQ ID NO: 528583 - DNA, 16 bp, R. norvegicus
tgtttactgggagaat

SEQ ID NO: 528584 - DNA, 16 bp, R. norvegicus
tgtttagagcagagac

SEQ ID NO: 528585 - DNA, 16 bp, R. norvegicus
tgtttagtgtctgttt

SEQ ID NO: 528586 - DNA, 16 bp, R. norvegicus
tgtttatcagctttgg

SEQ ID NO: 528587 - DNA, 17 bp, R. norvegicus
tgtttatcctttgagta

SEQ ID NO: 528588 - DNA, 16 bp, R. norvegicus
tgtttatgggcatttt

SEQ ID NO: 528589 - DNA, 16 bp, R. norvegicus
tgtttatgtgtgtata

SEQ ID NO: 528590 - DNA, 16 bp, R. norvegicus
tgtttatgtgtgtgcg

SEQ ID NO: 528591 - DNA, 16 bp, R. norvegicus
tgtttatttcctgcct

SEQ ID NO: 528592 - DNA, 16 bp, R. norvegicus
tgtttattttctggtc

SEQ ID NO: 528593 - DNA, 16 bp, R. norvegicus
tgtttcaaaacaaaat

SEQ ID NO: 528594 - DNA, 16 bp, R. norvegicus
tgtttcaattctgtgg

SEQ ID NO: 528595 - DNA, 16 bp, R. norvegicus
tgtttcagagagagag

SEQ ID NO: 528596 - DNA, 16 bp, R. norvegicus
tgtttcagttctttaa

SEQ ID NO: 528597 - DNA, 16 bp, R. norvegicus
tgtttcatcacaacaa

SEQ ID NO: 528598 - DNA, 16 bp, R. norvegicus
tgtttcatcacagtaa

SEQ ID NO: 528599 - DNA, 16 bp, R. norvegicus
tgtttccaaaacaaaa

SEQ ID NO: 528600 - DNA, 16 bp, R. norvegicus
tgtttccagcttttgg

SEQ ID NO: 528601 - DNA, 16 bp, R. norvegicus
tgtttccaggcaaaca

SEQ ID NO: 528602 - DNA, 16 bp, R. norvegicus
tgtttccatggcaacc

SEQ ID NO: 528603 - DNA, 16 bp, R. norvegicus
tgtttccatttttaaa

SEQ ID NO: 528604 - DNA, 16 bp, R. norvegicus
tgtttcccagtctgaa

SEQ ID NO: 528605 - DNA, 16 bp, R. norvegicus
tgtttcccattctgtc

SEQ ID NO: 528606 - DNA, 16 bp, R. norvegicus
tgtttcctgagaggct

SEQ ID NO: 528607 - DNA, 16 bp, R. norvegicus
tgtttcctgtgggcag

SEQ ID NO: 528608 - DNA, 16 bp, R. norvegicus
tgtttcctgttggcag

SEQ ID NO: 528609 - DNA, 16 bp, R. norvegicus
tgtttcctgtttctgg

SEQ ID NO: 528610 - DNA, 16 bp, R. norvegicus
tgtttccttcatgttc

SEQ ID NO: 528611 - DNA, 16 bp, R. norvegicus
tgtttccttgttgtcc

SEQ ID NO: 528612 - DNA, 17 bp, R. norvegicus
tgtttctatggtccttt

SEQ ID NO: 528613 - DNA, 16 bp, R. norvegicus
tgtttctcagccagtc

SEQ ID NO: 528614 - DNA, 16 bp, R. norvegicus
tgtttctcagccatct

SEQ ID NO: 528615 - DNA, 16 bp, R. norvegicus
tgtttctcagccgttc

SEQ ID NO: 528616 - DNA, 16 bp, R. norvegicus
tgtttctcagtcattc

SEQ ID NO: 528617 - DNA, 16 bp, R. norvegicus
tgtttctcattgttta

SEQ ID NO: 528618 - DNA, 16 bp, R. norvegicus
tgtttctctagagaac

SEQ ID NO: 528619 - DNA, 16 bp, R. norvegicus
tgtttctctatgtgtg

SEQ ID NO: 528620 - DNA, 16 bp, R. norvegicus
tgtttctctgtgtctg

SEQ ID NO: 528621 - DNA, 16 bp, R. norvegicus
tgtttctcttttgtaa

SEQ ID NO: 528622 - DNA, 16 bp, R. norvegicus
tgtttctgagataggg

SEQ ID NO: 528623 - DNA, 16 bp, R. norvegicus
tgtttctgccaccatg

SEQ ID NO: 528624 - DNA, 16 bp, R. norvegicus
tgtttctgctgctgct

SEQ ID NO: 528625 - DNA, 16 bp, R. norvegicus
tgtttctgctgctgtg

SEQ ID NO: 528626 - DNA, 16 bp, R. norvegicus
tgtttctgtatctgtt

SEQ ID NO: 528627 - DNA, 16 bp, R. norvegicus
tgtttctgtatttcct

SEQ ID NO: 528628 - DNA, 16 bp, R. norvegicus
tgtttctgtgccaata

SEQ ID NO: 528629 - DNA, 16 bp, R. norvegicus
tgtttctgtgcctgtg

SEQ ID NO: 528630 - DNA, 16 bp, R. norvegicus
tgtttcttcacagaaa

SEQ ID NO: 528631 - DNA, 16 bp, R. norvegicus
tgtttcttcctctgtg

SEQ ID NO: 528632 - DNA, 16 bp, R. norvegicus
tgtttcttctttgaac

SEQ ID NO: 528633 - DNA, 17 bp, R. norvegicus
tgtttctttctacaggc

SEQ ID NO: 528634 - DNA, 16 bp, R. norvegicus
tgtttcttttaaagaa

SEQ ID NO: 528635 - DNA, 16 bp, R. norvegicus
tgtttgaaagaaaaag

SEQ ID NO: 528636 - DNA, 16 bp, R. norvegicus
tgtttgaatgcttggc

SEQ ID NO: 528637 - DNA, 16 bp, R. norvegicus
tgtttgagattataat

SEQ ID NO: 528638 - DNA, 16 bp, R. norvegicus
tgtttgattttgtcaa

SEQ ID NO: 528639 - DNA, 16 bp, R. norvegicus
tgtttgccatcccctg

SEQ ID NO: 528640 - DNA, 16 bp, R. norvegicus
tgtttgccccagcaaa

SEQ ID NO: 528641 - DNA, 16 bp, R. norvegicus
tgtttgccctgggttc

SEQ ID NO: 528642 - DNA, 16 bp, R. norvegicus
tgtttgcctctgtgtg

SEQ ID NO: 528643 - DNA, 16 bp, R. norvegicus
tgtttgccttgcaagc

SEQ ID NO: 528644 - DNA, 16 bp, R. norvegicus
tgtttgctgcacaagc

SEQ ID NO: 528645 - DNA, 16 bp, R. norvegicus
tgtttgcttcaggaaa

SEQ ID NO: 528646 - DNA, 16 bp, R. norvegicus
tgtttgcttctgtcat

SEQ ID NO: 528647 - DNA, 16 bp, R. norvegicus
tgtttgcttgtttatg

SEQ ID NO: 528648 - DNA, 16 bp, R. norvegicus
tgtttgctttgttcat

SEQ ID NO: 528649 - DNA, 16 bp, R. norvegicus
tgtttggagacagggt

SEQ ID NO: 528650 - DNA, 16 bp, R. norvegicus
tgtttggagggtataa

SEQ ID NO: 528651 - DNA, 16 bp, R. norvegicus
tgtttgggaaggatta

SEQ ID NO: 528652 - DNA, 16 bp, R. norvegicus
tgtttggttcctgctt

SEQ ID NO: 528653 - DNA, 16 bp, R. norvegicus
tgtttggtttgagaca

SEQ ID NO: 528654 - DNA, 16 bp, R. norvegicus
tgtttgtaagcacatc

SEQ ID NO: 528655 - DNA, 16 bp, R. norvegicus
tgtttgtacatatgta

SEQ ID NO: 528656 - DNA, 16 bp, R. norvegicus
tgtttgtatatacatg

SEQ ID NO: 528657 - DNA, 16 bp, R. norvegicus
tgtttgtatctgtctg

SEQ ID NO: 528658 - DNA, 16 bp, R. norvegicus
tgtttgtcctttgagt

SEQ ID NO: 528659 - DNA, 16 bp, R. norvegicus
tgtttgtctctggtgc

SEQ ID NO: 528660 - DNA, 16 bp, R. norvegicus
tgtttgtctgtctgct

SEQ ID NO: 528661 - DNA, 16 bp, R. norvegicus
tgtttgtgcatgtatg

SEQ ID NO: 528662 - DNA, 16 bp, R. norvegicus
tgtttgtgtctctctc

SEQ ID NO: 528663 - DNA, 16 bp, R. norvegicus
tgtttgtgtggctatc

SEQ ID NO: 528664 - DNA, 16 bp, R. norvegicus
tgtttgtgtgtttcat

SEQ ID NO: 528665 - DNA, 16 bp, R. norvegicus
tgtttgttgaatgaat

SEQ ID NO: 528666 - DNA, 16 bp, R. norvegicus
tgtttgtttagagtta

SEQ ID NO: 528667 - DNA, 16 bp, R. norvegicus
tgtttgtttcagacag

SEQ ID NO: 528668 - DNA, 16 bp, R. norvegicus
tgtttgttttcttaag

SEQ ID NO: 528669 - DNA, 16 bp, R. norvegicus
tgtttgtttttaagag

SEQ ID NO: 528670 - DNA, 16 bp, R. norvegicus
tgtttgtttttacaaa

SEQ ID NO: 528671 - DNA, 16 bp, R. norvegicus
tgtttgtttttcctga

SEQ ID NO: 528672 - DNA, 16 bp, R. norvegicus
tgttttaaaaaatgtt

SEQ ID NO: 528673 - DNA, 16 bp, R. norvegicus
tgttttaaaagataaa

SEQ ID NO: 528674 - DNA, 16 bp, R. norvegicus
tgttttaaaagttaaa

SEQ ID NO: 528675 - DNA, 16 bp, R. norvegicus
tgttttaaaataaaca

SEQ ID NO: 528676 - DNA, 16 bp, R. norvegicus
tgttttaaaattgtgt

SEQ ID NO: 528677 - DNA, 16 bp, R. norvegicus
tgttttaaacagcttt

SEQ ID NO: 528678 - DNA, 16 bp, R. norvegicus
tgttttaaataagaaa

SEQ ID NO: 528679 - DNA, 16 bp, R. norvegicus
tgttttaaatttcaaa

SEQ ID NO: 528680 - DNA, 16 bp, R. norvegicus
tgttttaaattttgcc

SEQ ID NO: 528681 - DNA, 16 bp, R. norvegicus
tgttttaatttttgcc

SEQ ID NO: 528682 - DNA, 16 bp, R. norvegicus
tgttttacagcctttt

SEQ ID NO: 528683 - DNA, 16 bp, R. norvegicus
tgttttaccttcatgt

SEQ ID NO: 528684 - DNA, 16 bp, R. norvegicus
tgttttagaaaaaaat

SEQ ID NO: 528685 - DNA, 16 bp, R. norvegicus
tgttttagctgtcctg

SEQ ID NO: 528686 - DNA, 16 bp, R. norvegicus
tgttttaggatgaaaa

SEQ ID NO: 528687 - DNA, 16 bp, R. norvegicus
tgttttataaaacaaa

SEQ ID NO: 528688 - DNA, 16 bp, R. norvegicus
tgttttataaacaaaa

SEQ ID NO: 528689 - DNA, 16 bp, R. norvegicus
tgttttatcacaggaa

SEQ ID NO: 528690 - DNA, 16 bp, R. norvegicus
tgttttatgtgcattg

SEQ ID NO: 528691 - DNA, 16 bp, R. norvegicus
tgttttatttcataaa

SEQ ID NO: 528692 - DNA, 16 bp, R. norvegicus
tgttttcaaatatttt

SEQ ID NO: 528693 - DNA, 16 bp, R. norvegicus
tgttttcagcttctgg

SEQ ID NO: 528694 - DNA, 16 bp, R. norvegicus
tgttttcattaattaa

SEQ ID NO: 528695 - DNA, 16 bp, R. norvegicus
tgttttcattgctact

SEQ ID NO: 528696 - DNA, 16 bp, R. norvegicus
tgttttcattgttact

SEQ ID NO: 528697 - DNA, 16 bp, R. norvegicus
tgttttcatttttgag

SEQ ID NO: 528698 - DNA, 16 bp, R. norvegicus
tgttttccatggcttt

SEQ ID NO: 528699 - DNA, 16 bp, R. norvegicus
tgttttcctcaatgag

SEQ ID NO: 528700 - DNA, 17 bp, R. norvegicus
tgttttcctgcgtttct

SEQ ID NO: 528701 - DNA, 17 bp, R. norvegicus
tgttttcctggagttct

SEQ ID NO: 528702 - DNA, 16 bp, R. norvegicus
tgttttcctttacaag

SEQ ID NO: 528703 - DNA, 16 bp, R. norvegicus
tgttttcctttatatg

SEQ ID NO: 528704 - DNA, 16 bp, R. norvegicus
tgttttcctttttgag

SEQ ID NO: 528705 - DNA, 16 bp, R. norvegicus
tgttttctccaatgga

SEQ ID NO: 528706 - DNA, 16 bp, R. norvegicus
tgttttctgtaattct

SEQ ID NO: 528707 - DNA, 16 bp, R. norvegicus
tgttttcttcaggaaa

SEQ ID NO: 528708 - DNA, 16 bp, R. norvegicus
tgttttctttaaaaaa

SEQ ID NO: 528709 - DNA, 16 bp, R. norvegicus
tgttttctttaaatgt

SEQ ID NO: 528710 - DNA, 16 bp, R. norvegicus
tgttttgaaataaaaa

SEQ ID NO: 528711 - DNA, 16 bp, R. norvegicus
tgttttgagacagaga

SEQ ID NO: 528712 - DNA, 16 bp, R. norvegicus
tgttttgagataagat

SEQ ID NO: 528713 - DNA, 16 bp, R. norvegicus
tgttttgagtctttct

SEQ ID NO: 528714 - DNA, 16 bp, R. norvegicus
tgttttgatcatattt

SEQ ID NO: 528715 - DNA, 16 bp, R. norvegicus
tgttttgatgctaatt

SEQ ID NO: 528716 - DNA, 16 bp, R. norvegicus
tgttttgctgggagaa

SEQ ID NO: 528717 - DNA, 16 bp, R. norvegicus
tgttttgctttaaaat

SEQ ID NO: 528718 - DNA, 16 bp, R. norvegicus
tgttttggagacagtg

SEQ ID NO: 528719 - DNA, 17 bp, R. norvegicus
tgttttggataatgatt

SEQ ID NO: 528720 - DNA, 17 bp, R. norvegicus
tgttttggcatattcaa

SEQ ID NO: 528721 - DNA, 16 bp, R. norvegicus
tgttttgtctgcattt

SEQ ID NO: 528722 - DNA, 16 bp, R. norvegicus
tgttttgtgcatttgt

SEQ ID NO: 528723 - DNA, 16 bp, R. norvegicus
tgttttgtggatacag

SEQ ID NO: 528724 - DNA, 16 bp, R. norvegicus
tgttttgtttcttcca

SEQ ID NO: 528725 - DNA, 16 bp, R. norvegicus
tgttttgttttaaaga

SEQ ID NO: 528726 - DNA, 16 bp, R. norvegicus
tgttttgttttacaag

SEQ ID NO: 528727 - DNA, 16 bp, R. norvegicus
tgttttgtttttaaac

SEQ ID NO: 528728 - DNA, 16 bp, R. norvegicus
tgtttttaaagaaaca

SEQ ID NO: 528729 - DNA, 16 bp, R. norvegicus
tgtttttataaaacaa

SEQ ID NO: 528730 - DNA, 16 bp, R. norvegicus
tgtttttatagtaaaa

SEQ ID NO: 528731 - DNA, 16 bp, R. norvegicus
tgtttttatgcagttt

SEQ ID NO: 528732 - DNA, 16 bp, R. norvegicus
tgtttttattactgta

SEQ ID NO: 528733 - DNA, 16 bp, R. norvegicus
tgtttttcaaaataaa

SEQ ID NO: 528734 - DNA, 16 bp, R. norvegicus
tgtttttccacaggat

SEQ ID NO: 528735 - DNA, 16 bp, R. norvegicus
tgtttttccggagctg

SEQ ID NO: 528736 - DNA, 16 bp, R. norvegicus
tgtttttctttataag

SEQ ID NO: 528737 - DNA, 16 bp, R. norvegicus
tgtttttgaaaactat

SEQ ID NO: 528738 - DNA, 16 bp, R. norvegicus
tgtttttggatgaaat

SEQ ID NO: 528739 - DNA, 16 bp, R. norvegicus
tgttttttaaaaagta

SEQ ID NO: 528740 - DNA, 16 bp, R. norvegicus
tgttttttaaacaaaa

SEQ ID NO: 528741 - DNA, 16 bp, R. norvegicus
ttaaaaaaaatagttc

SEQ ID NO: 528742 - DNA, 16 bp, R. norvegicus
ttaaaaaaaatgactt

SEQ ID NO: 528743 - DNA, 16 bp, R. norvegicus
ttaaaaaaaatggttt

SEQ ID NO: 528744 - DNA, 16 bp, R. norvegicus
ttaaaaaaatcatagt

SEQ ID NO: 528745 - DNA, 16 bp, R. norvegicus
ttaaaaaaatctttgt

SEQ ID NO: 528746 - DNA, 16 bp, R. norvegicus
ttaaaaaaattgcatt

SEQ ID NO: 528747 - DNA, 16 bp, R. norvegicus
ttaaaaaagaattcaa

SEQ ID NO: 528748 - DNA, 16 bp, R. norvegicus
ttaaaaaataaatctg

SEQ ID NO: 528749 - DNA, 16 bp, R. norvegicus
ttaaaaaatccatttt

SEQ ID NO: 528750 - DNA, 16 bp, R. norvegicus
ttaaaaaatgaaatca

SEQ ID NO: 528751 - DNA, 16 bp, R. norvegicus
ttaaaaaatgttcaac

SEQ ID NO: 528752 - DNA, 16 bp, R. norvegicus
ttaaaaaatttgagat

SEQ ID NO: 528753 - DNA, 16 bp, R. norvegicus
ttaaaaacaaaacctt

SEQ ID NO: 528754 - DNA, 16 bp, R. norvegicus
ttaaaaacaaaatgac

SEQ ID NO: 528755 - DNA, 16 bp, R. norvegicus
ttaaaaacaagaatat

SEQ ID NO: 528756 - DNA, 16 bp, R. norvegicus
ttaaaaacaaggatat

SEQ ID NO: 528757 - DNA, 16 bp, R. norvegicus
ttaaaaacaatgtttt

SEQ ID NO: 528758 - DNA, 16 bp, R. norvegicus
ttaaaaacattttctt

SEQ ID NO: 528759 - DNA, 16 bp, R. norvegicus
ttaaaaacccttatta

SEQ ID NO: 528760 - DNA, 16 bp, R. norvegicus
ttaaaaagagactgta

SEQ ID NO: 528761 - DNA, 16 bp, R. norvegicus
ttaaaaaggaacgttt

SEQ ID NO: 528762 - DNA, 16 bp, R. norvegicus
ttaaaaaggacataaa

SEQ ID NO: 528763 - DNA, 16 bp, R. norvegicus
ttaaaaatatgaaaca

SEQ ID NO: 528764 - DNA, 16 bp, R. norvegicus
ttaaaaatatggtttt

SEQ ID NO: 528765 - DNA, 16 bp, R. norvegicus
ttaaaaatatgtatga

SEQ ID NO: 528766 - DNA, 16 bp, R. norvegicus
ttaaaaatattttctg

SEQ ID NO: 528767 - DNA, 16 bp, R. norvegicus
ttaaaaatgagaacat

SEQ ID NO: 528768 - DNA, 16 bp, R. norvegicus
ttaaaaatgaggatat

SEQ ID NO: 528769 - DNA, 16 bp, R. norvegicus
ttaaaaatgcaataaa

SEQ ID NO: 528770 - DNA, 16 bp, R. norvegicus
ttaaaaatgcatttaa

SEQ ID NO: 528771 - DNA, 16 bp, R. norvegicus
ttaaaaatgtttagtt

SEQ ID NO: 528772 - DNA, 16 bp, R. norvegicus
ttaaaaatgtttctga

SEQ ID NO: 528773 - DNA, 16 bp, R. norvegicus
ttaaaaattgctcttt

SEQ ID NO: 528774 - DNA, 16 bp, R. norvegicus
ttaaaacacatttttt

SEQ ID NO: 528775 - DNA, 16 bp, R. norvegicus
ttaaaacagtaaaaat

SEQ ID NO: 528776 - DNA, 16 bp, R. norvegicus
ttaaaacatttaagaa

SEQ ID NO: 528777 - DNA, 16 bp, R. norvegicus
ttaaaactaaaatgaa

SEQ ID NO: 528778 - DNA, 16 bp, R. norvegicus
ttaaaagaagttgaaa

SEQ ID NO: 528779 - DNA, 16 bp, R. norvegicus
ttaaaagaatgaattt

SEQ ID NO: 528780 - DNA, 16 bp, R. norvegicus
ttaaaagaatgtattt

SEQ ID NO: 528781 - DNA, 16 bp, R. norvegicus
ttaaaagcaagcaagc

SEQ ID NO: 528782 - DNA, 16 bp, R. norvegicus
ttaaaagcacatctca

SEQ ID NO: 528783 - DNA, 16 bp, R. norvegicus
ttaaaagcagtaatgg

SEQ ID NO: 528784 - DNA, 16 bp, R. norvegicus
ttaaaagctttattta

SEQ ID NO: 528785 - DNA, 16 bp, R. norvegicus
ttaaaagtattgaaga

SEQ ID NO: 528786 - DNA, 17 bp, R. norvegicus
ttaaaagttctaagata

SEQ ID NO: 528787 - DNA, 16 bp, R. norvegicus
ttaaaatacttctatg

SEQ ID NO: 528788 - DNA, 16 bp, R. norvegicus
ttaaaatatatttctg

SEQ ID NO: 528789 - DNA, 16 bp, R. norvegicus
ttaaaatcaaatttga

SEQ ID NO: 528790 - DNA, 16 bp, R. norvegicus
ttaaaatggtttttaa

SEQ ID NO: 528791 - DNA, 16 bp, R. norvegicus
ttaaaatttttgagaa

SEQ ID NO: 528792 - DNA, 21 bp, R. norvegicus
ttaaacaacaggtagataata

SEQ ID NO: 528793 - DNA, 16 bp, R. norvegicus
ttaaacaggaaacaca

SEQ ID NO: 528794 - DNA, 16 bp, R. norvegicus
ttaaacattttaaaag

SEQ ID NO: 528795 - DNA, 16 bp, R. norvegicus
ttaaacattttccttt

SEQ ID NO: 528796 - DNA, 16 bp, R. norvegicus
ttaaacattttgtttt

SEQ ID NO: 528797 - DNA, 16 bp, R. norvegicus
ttaaaccttaaatctg

SEQ ID NO: 528798 - DNA, 16 bp, R. norvegicus
ttaaactatatggaga

SEQ ID NO: 528799 - DNA, 16 bp, R. norvegicus
ttaaactcagaacctc

SEQ ID NO: 528800 - DNA, 16 bp, R. norvegicus
ttaaactgaaaagctt

SEQ ID NO: 528801 - DNA, 16 bp, R. norvegicus
ttaaagaaaatgcaaa

SEQ ID NO: 528802 - DNA, 16 bp, R. norvegicus
ttaaagaaatacagca

SEQ ID NO: 528803 - DNA, 16 bp, R. norvegicus
ttaaagaaatacagga

SEQ ID NO: 528804 - DNA, 16 bp, R. norvegicus
ttaaagaagagttaat

SEQ ID NO: 528805 - DNA, 16 bp, R. norvegicus
ttaaagaagtgaagca

SEQ ID NO: 528806 - DNA, 16 bp, R. norvegicus
ttaaagagatttattt

SEQ ID NO: 528807 - DNA, 16 bp, R. norvegicus
ttaaagaggaaaaaca

SEQ ID NO: 528808 - DNA, 16 bp, R. norvegicus
ttaaagagttgcagca

SEQ ID NO: 528809 - DNA, 16 bp, R. norvegicus
ttaaagataatggaaa

SEQ ID NO: 528810 - DNA, 16 bp, R. norvegicus
ttaaagatgtgtgctg

SEQ ID NO: 528811 - DNA, 16 bp, R. norvegicus
ttaaagccaggattct

SEQ ID NO: 528812 - DNA, 16 bp, R. norvegicus
ttaaagcccataccca

SEQ ID NO: 528813 - DNA, 16 bp, R. norvegicus
ttaaagcccatgccca

SEQ ID NO: 528814 - DNA, 16 bp, R. norvegicus
ttaaagctgtgtacca

SEQ ID NO: 528815 - DNA, 16 bp, R. norvegicus
ttaaaggaatcagaga

SEQ ID NO: 528816 - DNA, 16 bp, R. norvegicus
ttaaaggcatgcacca

SEQ ID NO: 528817 - DNA, 16 bp, R. norvegicus
ttaaaggcatgtgtca

SEQ ID NO: 528818 - DNA, 19 bp, R. norvegicus
ttaaaggcattgaccttgg

SEQ ID NO: 528819 - DNA, 16 bp, R. norvegicus
ttaaaggcgtgtgcca

SEQ ID NO: 528820 - DNA, 16 bp, R. norvegicus
ttaaaggctgcaccac

SEQ ID NO: 528821 - DNA, 16 bp, R. norvegicus
ttaaaggtgagcacca

SEQ ID NO: 528822 - DNA, 16 bp, R. norvegicus
ttaaaggtgtacacta

SEQ ID NO: 528823 - DNA, 16 bp, R. norvegicus
ttaaaggtgtgggcca

SEQ ID NO: 528824 - DNA, 16 bp, R. norvegicus
ttaaagtatttttaag

SEQ ID NO: 528825 - DNA, 16 bp, R. norvegicus
ttaaagtcttccatca

SEQ ID NO: 528826 - DNA, 16 bp, R. norvegicus
ttaaagtgtgtgtgtg

SEQ ID NO: 528827 - DNA, 16 bp, R. norvegicus
ttaaagtgtttgaatt

SEQ ID NO: 528828 - DNA, 16 bp, R. norvegicus
ttaaataaagagacat

SEQ ID NO: 528829 - DNA, 16 bp, R. norvegicus
ttaaatatacagaaat

SEQ ID NO: 528830 - DNA, 16 bp, R. norvegicus
ttaaatattcagaaaa

SEQ ID NO: 528831 - DNA, 86 bp, R. norvegicus
ttaaatcaggaacagataaaccagttaaacaaccccataactcctaaggaaatagaagcagtcattaaaggtctcccaaccaaaag

SEQ ID NO: 528832 - DNA, 71 bp, R. norvegicus
ttaaatcaggaacagataaaccagttaaacaaccccataactcctaaggaaatagaagcagtcattaaagt

SEQ ID NO: 528833 - DNA, 16 bp, R. norvegicus
ttaaatctaaatcttg

SEQ ID NO: 528834 - DNA, 16 bp, R. norvegicus
ttaaatgaggaaaaag

SEQ ID NO: 528835 - DNA, 16 bp, R. norvegicus
ttaaatgaggaaatag

SEQ ID NO: 528836 - DNA, 16 bp, R. norvegicus
ttaaatgagttgtata

SEQ ID NO: 528837 - DNA, 16 bp, R. norvegicus
ttaaatgctttaacat

SEQ ID NO: 528838 - DNA, 16 bp, R. norvegicus
ttaaatgcttttattt

SEQ ID NO: 528839 - DNA, 16 bp, R. norvegicus
ttaaatggaaagaaat

SEQ ID NO: 528840 - DNA, 16 bp, R. norvegicus
ttaaatggagataaac

SEQ ID NO: 528841 - DNA, 16 bp, R. norvegicus
ttaaatggggagaagg

SEQ ID NO: 528842 - DNA, 16 bp, R. norvegicus
ttaaatggtgtgtgtg

SEQ ID NO: 528843 - DNA, 16 bp, R. norvegicus
ttaaatgtcttctttt

SEQ ID NO: 528844 - DNA, 16 bp, R. norvegicus
ttaaatgttgtctttg

SEQ ID NO: 528845 - DNA, 16 bp, R. norvegicus
ttaaatgtttacattt

SEQ ID NO: 528846 - DNA, 16 bp, R. norvegicus
ttaaatgtttctcttt

SEQ ID NO: 528847 - DNA, 16 bp, R. norvegicus
ttaaattccaggaaat

SEQ ID NO: 528848 - DNA, 16 bp, R. norvegicus
ttaacaaaatcaggaa

SEQ ID NO: 528849 - DNA, 16 bp, R. norvegicus
ttaacaaaatctgaaa

SEQ ID NO: 528850 - DNA, 16 bp, R. norvegicus
ttaacaaagaaaatgt

SEQ ID NO: 528851 - DNA, 16 bp, R. norvegicus
ttaacaaagatggaga

SEQ ID NO: 528852 - DNA, 16 bp, R. norvegicus
ttaacaagccaaaggg

SEQ ID NO: 528853 - DNA, 16 bp, R. norvegicus
ttaacaccagagagaa

SEQ ID NO: 528854 - DNA, 16 bp, R. norvegicus
ttaacaccctgtacaa

SEQ ID NO: 528855 - DNA, 16 bp, R. norvegicus
ttaacagagatggaga

SEQ ID NO: 528856 - DNA, 16 bp, R. norvegicus
ttaacagatggttgtg

SEQ ID NO: 528857 - DNA, 16 bp, R. norvegicus
ttaacatcagcttcca

SEQ ID NO: 528858 - DNA, 16 bp, R. norvegicus
ttaacatggtgctggc

SEQ ID NO: 528859 - DNA, 16 bp, R. norvegicus
ttaaccaaccagatcc

SEQ ID NO: 528860 - DNA, 16 bp, R. norvegicus
ttaacctctgaaccat

SEQ ID NO: 528861 - DNA, 16 bp, R. norvegicus
ttaacctctgagctgt

SEQ ID NO: 528862 - DNA, 16 bp, R. norvegicus
ttaacctgaaaaacaa

SEQ ID NO: 528863 - DNA, 16 bp, R. norvegicus
ttaacctgtgtgaagg

SEQ ID NO: 528864 - DNA, 16 bp, R. norvegicus
ttaaccttctttctcc

SEQ ID NO: 528865 - DNA, 16 bp, R. norvegicus
ttaactctctggagtc

SEQ ID NO: 528866 - DNA, 16 bp, R. norvegicus
ttaactgtcaacctga

SEQ ID NO: 528867 - DNA, 16 bp, R. norvegicus
ttaacttctaaaaagt

SEQ ID NO: 528868 - DNA, 16 bp, R. norvegicus
ttaagaaaaatatcct

SEQ ID NO: 528869 - DNA, 16 bp, R. norvegicus
ttaagaaaatgcctct

SEQ ID NO: 528870 - DNA, 16 bp, R. norvegicus
ttaagaaaatgccttg

SEQ ID NO: 528871 - DNA, 16 bp, R. norvegicus
ttaagaaaatgtttta

SEQ ID NO: 528872 - DNA, 16 bp, R. norvegicus
ttaagaacacttgctg

SEQ ID NO: 528873 - DNA, 16 bp, R. norvegicus
ttaagaacactttctg

SEQ ID NO: 528874 - DNA, 16 bp, R. norvegicus
ttaagaaggacaaaaa

SEQ ID NO: 528875 - DNA, 16 bp, R. norvegicus
ttaagaattgcaatgt

SEQ ID NO: 528876 - DNA, 16 bp, R. norvegicus
ttaagaattgtttttg

SEQ ID NO: 528877 - DNA, 16 bp, R. norvegicus
ttaagacagatttgca

SEQ ID NO: 528878 - DNA, 18 bp, R. norvegicus
ttaagagagcatgtcaga

SEQ ID NO: 528879 - DNA, 16 bp, R. norvegicus
ttaagagcacccactg

SEQ ID NO: 528880 - DNA, 16 bp, R. norvegicus
ttaagagcactcactg

SEQ ID NO: 528881 - DNA, 16 bp, R. norvegicus
ttaagagcactgagtg

SEQ ID NO: 528882 - DNA, 16 bp, R. norvegicus
ttaagagcattggcta

SEQ ID NO: 528883 - DNA, 16 bp, R. norvegicus
ttaagaggaaattcaa

SEQ ID NO: 528884 - DNA, 16 bp, R. norvegicus
ttaagattccatgctg

SEQ ID NO: 528885 - DNA, 16 bp, R. norvegicus
ttaagccatctcttca

SEQ ID NO: 528886 - DNA, 16 bp, R. norvegicus
ttaagctctgtacccc

SEQ ID NO: 528887 - DNA, 16 bp, R. norvegicus
ttaaggaaatgacacc

SEQ ID NO: 528888 - DNA, 16 bp, R. norvegicus
ttaaggaacaagcaag

SEQ ID NO: 528889 - DNA, 16 bp, R. norvegicus
ttaaggatattgaaca

SEQ ID NO: 528890 - DNA, 17 bp, R. norvegicus
ttaaggccaagtgagaa

SEQ ID NO: 528891 - DNA, 16 bp, R. norvegicus
ttaaggctggacttca

SEQ ID NO: 528892 - DNA, 16 bp, R. norvegicus
ttaaggggggaaaaaa

SEQ ID NO: 528893 - DNA, 16 bp, R. norvegicus
ttaaggtcattttctt

SEQ ID NO: 528894 - DNA, 16 bp, R. norvegicus
ttaaggtcttctactt

SEQ ID NO: 528895 - DNA, 16 bp, R. norvegicus
ttaagtccttttggtt

SEQ ID NO: 528896 - DNA, 16 bp, R. norvegicus
ttaagtctctgattta

SEQ ID NO: 528897 - DNA, 16 bp, R. norvegicus
ttaagtcttctttgaa

SEQ ID NO: 528898 - DNA, 16 bp, R. norvegicus
ttaagtcttggcagga

SEQ ID NO: 528899 - DNA, 16 bp, R. norvegicus
ttaagttttctgtaca

SEQ ID NO: 528900 - DNA, 16 bp, R. norvegicus
ttaataaacagtcaca

SEQ ID NO: 528901 - DNA, 16 bp, R. norvegicus
ttaataaagctcaaaa

SEQ ID NO: 528902 - DNA, 16 bp, R. norvegicus
ttaataattttcttgg

SEQ ID NO: 528903 - DNA, 16 bp, R. norvegicus
ttaataggtccagaag

SEQ ID NO: 528904 - DNA, 16 bp, R. norvegicus
ttaatatacagaaaaa

SEQ ID NO: 528905 - DNA, 16 bp, R. norvegicus
ttaatatataaatctg

SEQ ID NO: 528906 - DNA, 16 bp, R. norvegicus
ttaatatatacaaaga

SEQ ID NO: 528907 - DNA, 16 bp, R. norvegicus
ttaatattatatccag

SEQ ID NO: 528908 - DNA, 16 bp, R. norvegicus
ttaatattcttgcttt

SEQ ID NO: 528909 - DNA, 16 bp, R. norvegicus
ttaatattgaaagata

SEQ ID NO: 528910 - DNA, 16 bp, R. norvegicus
ttaatattgatggaaa

SEQ ID NO: 528911 - DNA, 16 bp, R. norvegicus
ttaatatttgaaatgt

SEQ ID NO: 528912 - DNA, 16 bp, R. norvegicus
ttaatattttgaaatg

SEQ ID NO: 528913 - DNA, 16 bp, R. norvegicus
ttaatcaaaatgaagg

SEQ ID NO: 528914 - DNA, 16 bp, R. norvegicus
ttaatcctagctcttg

SEQ ID NO: 528915 - DNA, 16 bp, R. norvegicus
ttaatctcagctctca

SEQ ID NO: 528916 - DNA, 16 bp, R. norvegicus
ttaatcttcttttaca

SEQ ID NO: 528917 - DNA, 16 bp, R. norvegicus
ttaatgaaaaactatt

SEQ ID NO: 528918 - DNA, 16 bp, R. norvegicus
ttaatgaaaatggaga

SEQ ID NO: 528919 - DNA, 16 bp, R. norvegicus
ttaatgaacaattaca

SEQ ID NO: 528920 - DNA, 16 bp, R. norvegicus
ttaatgaagatggaaa

SEQ ID NO: 528921 - DNA, 16 bp, R. norvegicus
ttaatgacctggtgac

SEQ ID NO: 528922 - DNA, 16 bp, R. norvegicus
ttaatgatactctatt

SEQ ID NO: 528923 - DNA, 16 bp, R. norvegicus
ttaatgatttttttcc

SEQ ID NO: 528924 - DNA, 16 bp, R. norvegicus
ttaatgccagcattca

SEQ ID NO: 528925 - DNA, 16 bp, R. norvegicus
ttaatgccagtgaagg

SEQ ID NO: 528926 - DNA, 16 bp, R. norvegicus
ttaatgcctctgggaa

SEQ ID NO: 528927 - DNA, 16 bp, R. norvegicus
ttaatggaaatgaaga

SEQ ID NO: 528928 - DNA, 16 bp, R. norvegicus
ttaatgtttttcttaa

SEQ ID NO: 528929 - DNA, 18 bp, R. norvegicus
ttaattcaatacagtcca

SEQ ID NO: 528930 - DNA, 16 bp, R. norvegicus
ttaattccaagtggat

SEQ ID NO: 528931 - DNA, 16 bp, R. norvegicus
ttaattccagaccctc

SEQ ID NO: 528932 - DNA, 16 bp, R. norvegicus
ttaattgtcaacctga

SEQ ID NO: 528933 - DNA, 16 bp, R. norvegicus
ttaatttaaaactaca

SEQ ID NO: 528934 - DNA, 16 bp, R. norvegicus
ttaatttcagctctga

SEQ ID NO: 528935 - DNA, 16 bp, R. norvegicus
ttaatttctgctctga

SEQ ID NO: 528936 - DNA, 16 bp, R. norvegicus
ttaatttggaataaca

SEQ ID NO: 528937 - DNA, 16 bp, R. norvegicus
ttaattttaaagtgaa

SEQ ID NO: 528938 - DNA, 16 bp, R. norvegicus
ttaattttcaaaatgt

SEQ ID NO: 528939 - DNA, 16 bp, R. norvegicus
ttaatttttaaaaggt

SEQ ID NO: 528940 - DNA, 16 bp, R. norvegicus
ttacaaaaattgattt

SEQ ID NO: 528941 - DNA, 16 bp, R. norvegicus
ttacaaaagaaaactt

SEQ ID NO: 528942 - DNA, 16 bp, R. norvegicus
ttacaaaagaaagtat

SEQ ID NO: 528943 - DNA, 16 bp, R. norvegicus
ttacaaacaatgactt

SEQ ID NO: 528944 - DNA, 16 bp, R. norvegicus
ttacaaacattttaaa

SEQ ID NO: 528945 - DNA, 16 bp, R. norvegicus
ttacaaagaactcaag

SEQ ID NO: 528946 - DNA, 16 bp, R. norvegicus
ttacaaagagcaattt

SEQ ID NO: 528947 - DNA, 16 bp, R. norvegicus
ttacaaaggaaaatat

SEQ ID NO: 528948 - DNA, 16 bp, R. norvegicus
ttacaaatgagaaaaa

SEQ ID NO: 528949 - DNA, 16 bp, R. norvegicus
ttacaacaactctctc

SEQ ID NO: 528950 - DNA, 16 bp, R. norvegicus
ttacaagcacaaagac

SEQ ID NO: 528951 - DNA, 16 bp, R. norvegicus
ttacaaggctcaggaa

SEQ ID NO: 528952 - DNA, 16 bp, R. norvegicus
ttacaataaaatgttt

SEQ ID NO: 528953 - DNA, 16 bp, R. norvegicus
ttacaatgatggattt

SEQ ID NO: 528954 - DNA, 16 bp, R. norvegicus
ttacacaacagagtac

SEQ ID NO: 528955 - DNA, 16 bp, R. norvegicus
ttacacaacatctttc

SEQ ID NO: 528956 - DNA, 16 bp, R. norvegicus
ttacacaattgagtat

SEQ ID NO: 528957 - DNA, 16 bp, R. norvegicus
ttacacacatacacac

SEQ ID NO: 528958 - DNA, 16 bp, R. norvegicus
ttacacacctttaatc

SEQ ID NO: 528959 - DNA, 16 bp, R. norvegicus
ttacacagggaaggca

SEQ ID NO: 528960 - DNA, 16 bp, R. norvegicus
ttacacattaccaaat

SEQ ID NO: 528961 - DNA, 16 bp, R. norvegicus
ttacaccagccagttc

SEQ ID NO: 528962 - DNA, 17 bp, R. norvegicus
ttacacgttcagaggtt

SEQ ID NO: 528963 - DNA, 16 bp, R. norvegicus
ttacacttccaggtaa

SEQ ID NO: 528964 - DNA, 16 bp, R. norvegicus
ttacagaagttatgaa

SEQ ID NO: 528965 - DNA, 16 bp, R. norvegicus
ttacagacagctgtga

SEQ ID NO: 528966 - DNA, 16 bp, R. norvegicus
ttacagagaacccaag

SEQ ID NO: 528967 - DNA, 16 bp, R. norvegicus
ttacagagacccacct

SEQ ID NO: 528968 - DNA, 16 bp, R. norvegicus
ttacagagagaacaag

SEQ ID NO: 528969 - DNA, 16 bp, R. norvegicus
ttacagaggacctggg

SEQ ID NO: 528970 - DNA, 16 bp, R. norvegicus
ttacagatgactgtaa

SEQ ID NO: 528971 - DNA, 16 bp, R. norvegicus
ttacagatggctgtga

SEQ ID NO: 528972 - DNA, 16 bp, R. norvegicus
ttacagcaacagagaa

SEQ ID NO: 528973 - DNA, 16 bp, R. norvegicus
ttacaggaaatacaaa

SEQ ID NO: 528974 - DNA, 16 bp, R. norvegicus
ttacaggacagccagg

SEQ ID NO: 528975 - DNA, 16 bp, R. norvegicus
ttacaggtatgcacca

SEQ ID NO: 528976 - DNA, 16 bp, R. norvegicus
ttacaggttgttatga

SEQ ID NO: 528977 - DNA, 16 bp, R. norvegicus
ttacagtgaatctggg

SEQ ID NO: 528978 - DNA, 16 bp, R. norvegicus
ttacagtgctgggact

SEQ ID NO: 528979 - DNA, 16 bp, R. norvegicus
ttacagttgtgtagct

SEQ ID NO: 528980 - DNA, 16 bp, R. norvegicus
ttacagttttgtggcc

SEQ ID NO: 528981 - DNA, 16 bp, R. norvegicus
ttacatagttgagaaa

SEQ ID NO: 528982 - DNA, 16 bp, R. norvegicus
ttacatatgtgcagag

SEQ ID NO: 528983 - DNA, 16 bp, R. norvegicus
ttacatatttattttg

SEQ ID NO: 528984 - DNA, 16 bp, R. norvegicus
ttacatattttacata

SEQ ID NO: 528985 - DNA, 18 bp, R. norvegicus
ttacatctacacaatgga

SEQ ID NO: 528986 - DNA, 16 bp, R. norvegicus
ttacatggaaaacaga

SEQ ID NO: 528987 - DNA, 16 bp, R. norvegicus
ttacattgatggattt

SEQ ID NO: 528988 - DNA, 16 bp, R. norvegicus
ttacattgctgtgaag

SEQ ID NO: 528989 - DNA, 16 bp, R. norvegicus
ttacatttatggattc

SEQ ID NO: 528990 - DNA, 16 bp, R. norvegicus
ttacatttatttatgt

SEQ ID NO: 528991 - DNA, 16 bp, R. norvegicus
ttacatttcaaatgtt

SEQ ID NO: 528992 - DNA, 16 bp, R. norvegicus
ttaccaaaagcagtct

SEQ ID NO: 528993 - DNA, 16 bp, R. norvegicus
ttaccaatgaagactt

SEQ ID NO: 528994 - DNA, 16 bp, R. norvegicus
ttaccacaagttgagc

SEQ ID NO: 528995 - DNA, 16 bp, R. norvegicus
ttaccacagcaacaga

SEQ ID NO: 528996 - DNA, 16 bp, R. norvegicus
ttaccaccaccaccat

SEQ ID NO: 528997 - DNA, 16 bp, R. norvegicus
ttaccaccctgctgtc

SEQ ID NO: 528998 - DNA, 16 bp, R. norvegicus
ttaccacctccacgat

SEQ ID NO: 528999 - DNA, 16 bp, R. norvegicus
ttaccactgagccatt

SEQ ID NO: 529000 - DNA, 16 bp, R. norvegicus
ttaccagagactgtga

SEQ ID NO: 529001 - DNA, 17 bp, R. norvegicus
ttaccattctacaattt

SEQ ID NO: 529002 - DNA, 16 bp, R. norvegicus
ttacccaagatgccta

SEQ ID NO: 529003 - DNA, 16 bp, R. norvegicus
ttacccactgaactat

SEQ ID NO: 529004 - DNA, 16 bp, R. norvegicus
ttacccattcttcagt

SEQ ID NO: 529005 - DNA, 16 bp, R. norvegicus
ttaccctttggtggat

SEQ ID NO: 529006 - DNA, 16 bp, R. norvegicus
ttacctcacacagaat

SEQ ID NO: 529007 - DNA, 16 bp, R. norvegicus
ttacctcatcaggatg

SEQ ID NO: 529008 - DNA, 16 bp, R. norvegicus
ttacctctgctctcag

SEQ ID NO: 529009 - DNA, 16 bp, R. norvegicus
ttacctctgttgtcct

SEQ ID NO: 529010 - DNA, 16 bp, R. norvegicus
ttacctctttctctgt

SEQ ID NO: 529011 - DNA, 16 bp, R. norvegicus
ttacctgagaacccag

SEQ ID NO: 529012 - DNA, 16 bp, R. norvegicus
ttacctgcacacacac

SEQ ID NO: 529013 - DNA, 16 bp, R. norvegicus
ttacctggaaggatct

SEQ ID NO: 529014 - DNA, 16 bp, R. norvegicus
ttacctgtggtcccca

SEQ ID NO: 529015 - DNA, 16 bp, R. norvegicus
ttacctttgctctcag

SEQ ID NO: 529016 - DNA, 16 bp, R. norvegicus
ttacctttgcttccac

SEQ ID NO: 529017 - DNA, 16 bp, R. norvegicus
ttacctttgtgtgtgt

SEQ ID NO: 529018 - DNA, 16 bp, R. norvegicus
ttactaaagctcaaag

SEQ ID NO: 529019 - DNA, 16 bp, R. norvegicus
ttactaaagctccaaa

SEQ ID NO: 529020 - DNA, 16 bp, R. norvegicus
ttactaatcaagaaaa

SEQ ID NO: 529021 - DNA, 16 bp, R. norvegicus
ttactacctatgaggt

SEQ ID NO: 529022 - DNA, 16 bp, R. norvegicus
ttactatagctctgta

SEQ ID NO: 529023 - DNA, 16 bp, R. norvegicus
ttactatgtttaggaa

SEQ ID NO: 529024 - DNA, 16 bp, R. norvegicus
ttactcaagatgatat

SEQ ID NO: 529025 - DNA, 16 bp, R. norvegicus
ttactcactgataagt

SEQ ID NO: 529026 - DNA, 16 bp, R. norvegicus
ttactctctcaagttc

SEQ ID NO: 529027 - DNA, 16 bp, R. norvegicus
ttactctgtatctgag

SEQ ID NO: 529028 - DNA, 16 bp, R. norvegicus
ttactcttctgttgct

SEQ ID NO: 529029 - DNA, 16 bp, R. norvegicus
ttactgaaaaacaaaa

SEQ ID NO: 529030 - DNA, 16 bp, R. norvegicus
ttactgaagtgtaaga

SEQ ID NO: 529031 - DNA, 16 bp, R. norvegicus
ttactgaagttcaaag

SEQ ID NO: 529032 - DNA, 16 bp, R. norvegicus
ttactgaggctgtgga

SEQ ID NO: 529033 - DNA, 55 bp, R. norvegicus
ttactgcctcggcattggccttgtcaaattcagtacagacaacccaaactatcaa

SEQ ID NO: 529034 - DNA, 16 bp, R. norvegicus
ttactgctgctgctgc

SEQ ID NO: 529035 - DNA, 16 bp, R. norvegicus
ttactggggctgggga

SEQ ID NO: 529036 - DNA, 16 bp, R. norvegicus
ttactggggttactta

SEQ ID NO: 529037 - DNA, 16 bp, R. norvegicus
ttacttatgtatttat

SEQ ID NO: 529038 - DNA, 16 bp, R. norvegicus
ttacttcattcaggat

SEQ ID NO: 529039 - DNA, 16 bp, R. norvegicus
ttacttgaaccataca

SEQ ID NO: 529040 - DNA, 16 bp, R. norvegicus
ttacttgctttgttaa

SEQ ID NO: 529041 - DNA, 16 bp, R. norvegicus
ttacttggagcagaaa

SEQ ID NO: 529042 - DNA, 16 bp, R. norvegicus
ttacttgggttctggg

SEQ ID NO: 529043 - DNA, 16 bp, R. norvegicus
ttacttgtgtgtatat

SEQ ID NO: 529044 - DNA, 16 bp, R. norvegicus
ttactttcactgtgtc

SEQ ID NO: 529045 - DNA, 16 bp, R. norvegicus
ttactttgaaaataaa

SEQ ID NO: 529046 - DNA, 16 bp, R. norvegicus
ttacttttctgttcct

SEQ ID NO: 529047 - DNA, 16 bp, R. norvegicus
ttacttttcttggata

SEQ ID NO: 529048 - DNA, 16 bp, R. norvegicus
ttacttttgctgtgat

SEQ ID NO: 529049 - DNA, 16 bp, R. norvegicus
ttactttttaaaaaca

SEQ ID NO: 529050 - DNA, 16 bp, R. norvegicus
ttagaaaaaaaaatct

SEQ ID NO: 529051 - DNA, 16 bp, R. norvegicus
ttagaaaagaacagac

SEQ ID NO: 529052 - DNA, 16 bp, R. norvegicus
ttagaaaatatcatcc

SEQ ID NO: 529053 - DNA, 16 bp, R. norvegicus
ttagaaaattgttcat

SEQ ID NO: 529054 - DNA, 16 bp, R. norvegicus
ttagaaaggactggaa

SEQ ID NO: 529055 - DNA, 16 bp, R. norvegicus
ttagaaaggctgagaa

SEQ ID NO: 529056 - DNA, 18 bp, R. norvegicus
ttagaaagtctttcagga

SEQ ID NO: 529057 - DNA, 17 bp, R. norvegicus
ttagaaatgctacagga

SEQ ID NO: 529058 - DNA, 16 bp, R. norvegicus
ttagaacccagttctc

SEQ ID NO: 529059 - DNA, 16 bp, R. norvegicus
ttagaagagaaagtgg

SEQ ID NO: 529060 - DNA, 16 bp, R. norvegicus
ttagaagagaggctga

SEQ ID NO: 529061 - DNA, 16 bp, R. norvegicus
ttagaagatgaaaaga

SEQ ID NO: 529062 - DNA, 16 bp, R. norvegicus
ttagaagtttaaaatt

SEQ ID NO: 529063 - DNA, 16 bp, R. norvegicus
ttagaatcctcatgtt

SEQ ID NO: 529064 - DNA, 16 bp, R. norvegicus
ttagacagtaacaatt

SEQ ID NO: 529065 - DNA, 16 bp, R. norvegicus
ttagactcagaggagg

SEQ ID NO: 529066 - DNA, 16 bp, R. norvegicus
ttagacttggtggcaa

SEQ ID NO: 529067 - DNA, 16 bp, R. norvegicus
ttagagaaaaacagga

SEQ ID NO: 529068 - DNA, 16 bp, R. norvegicus
ttagagacagggtctc

SEQ ID NO: 529069 - DNA, 16 bp, R. norvegicus
ttagagaggaaaaaca

SEQ ID NO: 529070 - DNA, 16 bp, R. norvegicus
ttagagatttgaagtt

SEQ ID NO: 529071 - DNA, 16 bp, R. norvegicus
ttagagcagaagccat

SEQ ID NO: 529072 - DNA, 18 bp, R. norvegicus
ttagaggagttacaggac

SEQ ID NO: 529073 - DNA, 16 bp, R. norvegicus
ttagagggcagcctgg

SEQ ID NO: 529074 - DNA, 16 bp, R. norvegicus
ttagagtccatgatca

SEQ ID NO: 529075 - DNA, 16 bp, R. norvegicus
ttagatatgggctttg

SEQ ID NO: 529076 - DNA, 16 bp, R. norvegicus
ttagatgatgttatta

SEQ ID NO: 529077 - DNA, 16 bp, R. norvegicus
ttagatgtatttcttt

SEQ ID NO: 529078 - DNA, 16 bp, R. norvegicus
ttagattttgaaaaat

SEQ ID NO: 529079 - DNA, 16 bp, R. norvegicus
ttagcaaattgttctg

SEQ ID NO: 529080 - DNA, 16 bp, R. norvegicus
ttagcaagcaaacagg

SEQ ID NO: 529081 - DNA, 16 bp, R. norvegicus
ttagcaattagggaaa

SEQ ID NO: 529082 - DNA, 16 bp, R. norvegicus
ttagcaggacccagga

SEQ ID NO: 529083 - DNA, 16 bp, R. norvegicus
ttagcatggagagctc

SEQ ID NO: 529084 - DNA, 17 bp, R. norvegicus
ttagcattgttgtacat

SEQ ID NO: 529085 - DNA, 16 bp, R. norvegicus
ttagccaaaatataca

SEQ ID NO: 529086 - DNA, 16 bp, R. norvegicus
ttagcccaaaagctca

SEQ ID NO: 529087 - DNA, 16 bp, R. norvegicus
ttagcccaggctggtc

SEQ ID NO: 529088 - DNA, 16 bp, R. norvegicus
ttagccctaaatggga

SEQ ID NO: 529089 - DNA, 16 bp, R. norvegicus
ttagcctttgaaaatg

SEQ ID NO: 529090 - DNA, 16 bp, R. norvegicus
ttagctcaaccaggaa

SEQ ID NO: 529091 - DNA, 16 bp, R. norvegicus
ttagctcagcagaaga

SEQ ID NO: 529092 - DNA, 16 bp, R. norvegicus
ttagctctgagcccca

SEQ ID NO: 529093 - DNA, 16 bp, R. norvegicus
ttagctggtgtgtgtg

SEQ ID NO: 529094 - DNA, 16 bp, R. norvegicus
ttagcttctgtttcca

SEQ ID NO: 529095 - DNA, 16 bp, R. norvegicus
ttaggaaatgtggcct

SEQ ID NO: 529096 - DNA, 16 bp, R. norvegicus
ttaggaaggattagaa

SEQ ID NO: 529097 - DNA, 16 bp, R. norvegicus
ttaggaataaagctgc

SEQ ID NO: 529098 - DNA, 16 bp, R. norvegicus
ttaggaatgagagttc

SEQ ID NO: 529099 - DNA, 23 bp, R. norvegicus
ttaggacaggtcagagggtcctt

SEQ ID NO: 529100 - DNA, 22 bp, R. norvegicus
ttaggaccaattataatgacag

SEQ ID NO: 529101 - DNA, 24 bp, R. norvegicus
ttaggagcatggaagctggaagca

SEQ ID NO: 529102 - DNA, 16 bp, R. norvegicus
ttaggagcattgactg

SEQ ID NO: 529103 - DNA, 16 bp, R. norvegicus
ttaggaggcgtggcct

SEQ ID NO: 529104 - DNA, 16 bp, R. norvegicus
ttaggaggtgtggtct

SEQ ID NO: 529105 - DNA, 16 bp, R. norvegicus
ttagggaaaaactgga

SEQ ID NO: 529106 - DNA, 23 bp, R. norvegicus
ttagggaaagaccttgattttgc

SEQ ID NO: 529107 - DNA, 16 bp, R. norvegicus
ttagggaaagactgga

SEQ ID NO: 529108 - DNA, 16 bp, R. norvegicus
ttagggaacttttctt

SEQ ID NO: 529109 - DNA, 16 bp, R. norvegicus
ttaggtacatctcagc

SEQ ID NO: 529110 - DNA, 16 bp, R. norvegicus
ttaggtgcatcctctc

SEQ ID NO: 529111 - DNA, 16 bp, R. norvegicus
ttaggttcagtgagag

SEQ ID NO: 529112 - DNA, 16 bp, R. norvegicus
ttaggtttctattgct

SEQ ID NO: 529113 - DNA, 16 bp, R. norvegicus
ttaggtttgggtcaga

SEQ ID NO: 529114 - DNA, 24 bp, R. norvegicus
ttagtaagagcaccagtggaaggg

SEQ ID NO: 529115 - DNA, 16 bp, R. norvegicus
ttagtacagttcctca

SEQ ID NO: 529116 - DNA, 16 bp, R. norvegicus
ttagtcagggttccct

SEQ ID NO: 529117 - DNA, 16 bp, R. norvegicus
ttagtcttcaacccca

SEQ ID NO: 529118 - DNA, 16 bp, R. norvegicus
ttagtgctccatctgt

SEQ ID NO: 529119 - DNA, 16 bp, R. norvegicus
ttagtgctgtcaaggc

SEQ ID NO: 529120 - DNA, 16 bp, R. norvegicus
ttagtgtgagtgtgtg

SEQ ID NO: 529121 - DNA, 16 bp, R. norvegicus
ttagttgactcttttg

SEQ ID NO: 529122 - DNA, 16 bp, R. norvegicus
ttagttgatactgttc

SEQ ID NO: 529123 - DNA, 16 bp, R. norvegicus
ttagtttcttgcactt

SEQ ID NO: 529124 - DNA, 16 bp, R. norvegicus
ttagttttaaaaagaa

SEQ ID NO: 529125 - DNA, 17 bp, R. norvegicus
ttagttttgtcatggaa

SEQ ID NO: 529126 - DNA, 16 bp, R. norvegicus
ttagtttttaagacag

SEQ ID NO: 529127 - DNA, 16 bp, R. norvegicus
ttataaacaaactgaa

SEQ ID NO: 529128 - DNA, 16 bp, R. norvegicus
ttataaacaagactgc

SEQ ID NO: 529129 - DNA, 16 bp, R. norvegicus
ttataaaccaggctgg

SEQ ID NO: 529130 - DNA, 16 bp, R. norvegicus
ttataaagaagaaagg

SEQ ID NO: 529131 - DNA, 16 bp, R. norvegicus
ttataaagagcaattt

SEQ ID NO: 529132 - DNA, 16 bp, R. norvegicus
ttataactgtgatttt

SEQ ID NO: 529133 - DNA, 16 bp, R. norvegicus
ttataataaagtgttt

SEQ ID NO: 529134 - DNA, 16 bp, R. norvegicus
ttataatgatgatgat

SEQ ID NO: 529135 - DNA, 16 bp, R. norvegicus
ttatacatacatacat

SEQ ID NO: 529136 - DNA, 16 bp, R. norvegicus
ttatactacagagcaa

SEQ ID NO: 529137 - DNA, 16 bp, R. norvegicus
ttatactctctccaaa

SEQ ID NO: 529138 - DNA, 16 bp, R. norvegicus
ttatactttctactgt

SEQ ID NO: 529139 - DNA, 16 bp, R. norvegicus
ttatagaagagttggg

SEQ ID NO: 529140 - DNA, 16 bp, R. norvegicus
ttatagaagctttaca

SEQ ID NO: 529141 - DNA, 16 bp, R. norvegicus
ttatagatgaagaaat

SEQ ID NO: 529142 - DNA, 16 bp, R. norvegicus
ttatagatgtaggaca

SEQ ID NO: 529143 - DNA, 16 bp, R. norvegicus
ttatatacaataaatg

SEQ ID NO: 529144 - DNA, 16 bp, R. norvegicus
ttatatatgtacatat

SEQ ID NO: 529145 - DNA, 16 bp, R. norvegicus
ttatatatgttggata

SEQ ID NO: 529146 - DNA, 16 bp, R. norvegicus
ttatatatttttacag

SEQ ID NO: 529147 - DNA, 16 bp, R. norvegicus
ttatatcagtatcaat

SEQ ID NO: 529148 - DNA, 16 bp, R. norvegicus
ttatatcatatcaatt

SEQ ID NO: 529149 - DNA, 16 bp, R. norvegicus
ttatatccagacactt

SEQ ID NO: 529150 - DNA, 16 bp, R. norvegicus
ttatatctatgataat

SEQ ID NO: 529151 - DNA, 16 bp, R. norvegicus
ttatatgagtgtgtgt

SEQ ID NO: 529152 - DNA, 16 bp, R. norvegicus
ttatatggacaatttt

SEQ ID NO: 529153 - DNA, 16 bp, R. norvegicus
ttatatgtatacattt

SEQ ID NO: 529154 - DNA, 16 bp, R. norvegicus
ttatatgttcttgtta

SEQ ID NO: 529155 - DNA, 16 bp, R. norvegicus
ttatatgttgaagaat

SEQ ID NO: 529156 - DNA, 16 bp, R. norvegicus
ttatattatatgggac

SEQ ID NO: 529157 - DNA, 16 bp, R. norvegicus
ttatattatttatggc

SEQ ID NO: 529158 - DNA, 16 bp, R. norvegicus
ttatattgctgtgaag

SEQ ID NO: 529159 - DNA, 16 bp, R. norvegicus
ttatatttaggaatgt

SEQ ID NO: 529160 - DNA, 16 bp, R. norvegicus
ttatcaaccctacatc

SEQ ID NO: 529161 - DNA, 16 bp, R. norvegicus
ttatcaactgtagaag

SEQ ID NO: 529162 - DNA, 17 bp, R. norvegicus
ttatcaatcagatttat

SEQ ID NO: 529163 - DNA, 17 bp, R. norvegicus
ttatcaccatgtacaaa

SEQ ID NO: 529164 - DNA, 16 bp, R. norvegicus
ttatcagtcttaagag

SEQ ID NO: 529165 - DNA, 16 bp, R. norvegicus
ttatcagtgattgcat

SEQ ID NO: 529166 - DNA, 16 bp, R. norvegicus
ttatcataaagatctt

SEQ ID NO: 529167 - DNA, 16 bp, R. norvegicus
ttatcatacagttctt

SEQ ID NO: 529168 - DNA, 16 bp, R. norvegicus
ttatcatcatgtcagg

SEQ ID NO: 529169 - DNA, 16 bp, R. norvegicus
ttatcatcttgtacaa

SEQ ID NO: 529170 - DNA, 16 bp, R. norvegicus
ttatccagagactgcc

SEQ ID NO: 529171 - DNA, 16 bp, R. norvegicus
ttatccccattttaca

SEQ ID NO: 529172 - DNA, 16 bp, R. norvegicus
ttatctatttgtctgt

SEQ ID NO: 529173 - DNA, 16 bp, R. norvegicus
ttatctctctgtgcat

SEQ ID NO: 529174 - DNA, 16 bp, R. norvegicus
ttatctggcattactg

SEQ ID NO: 529175 - DNA, 16 bp, R. norvegicus
ttatctggtagaattt

SEQ ID NO: 529176 - DNA, 16 bp, R. norvegicus
ttatctggtctgtttc

SEQ ID NO: 529177 - DNA, 16 bp, R. norvegicus
ttatcttcatcaatct

SEQ ID NO: 529178 - DNA, 16 bp, R. norvegicus
ttatcttcttgtacaa

SEQ ID NO: 529179 - DNA, 17 bp, R. norvegicus
ttatctttatggtctgt

SEQ ID NO: 529180 - DNA, 16 bp, R. norvegicus
ttatcttttttgatga

SEQ ID NO: 529181 - DNA, 16 bp, R. norvegicus
ttatgaaatagcaatg

SEQ ID NO: 529182 - DNA, 16 bp, R. norvegicus
ttatgaaattggtagg

SEQ ID NO: 529183 - DNA, 16 bp, R. norvegicus
ttatgaacaaaatgaa

SEQ ID NO: 529184 - DNA, 16 bp, R. norvegicus
ttatgaacacagtgga

SEQ ID NO: 529185 - DNA, 16 bp, R. norvegicus
ttatgaaggaaaatat

SEQ ID NO: 529186 - DNA, 16 bp, R. norvegicus
ttatgaagtaggaatg

SEQ ID NO: 529187 - DNA, 16 bp, R. norvegicus
ttatgaatatgataga

SEQ ID NO: 529188 - DNA, 16 bp, R. norvegicus
ttatgaatatttcaca

SEQ ID NO: 529189 - DNA, 16 bp, R. norvegicus
ttatgaattttgtagg

SEQ ID NO: 529190 - DNA, 16 bp, R. norvegicus
ttatgacatcccattt

SEQ ID NO: 529191 - DNA, 16 bp, R. norvegicus
ttatgaccaaatatat

SEQ ID NO: 529192 - DNA, 16 bp, R. norvegicus
ttatgactaatatcta

SEQ ID NO: 529193 - DNA, 16 bp, R. norvegicus
ttatgactattatgaa

SEQ ID NO: 529194 - DNA, 16 bp, R. norvegicus
ttatgagaaagagatt

SEQ ID NO: 529195 - DNA, 16 bp, R. norvegicus
ttatgagcagagtcaa

SEQ ID NO: 529196 - DNA, 16 bp, R. norvegicus
ttatgagtattttgcc

SEQ ID NO: 529197 - DNA, 16 bp, R. norvegicus
ttatgagttctttgta

SEQ ID NO: 529198 - DNA, 16 bp, R. norvegicus
ttatgatgatggagga

SEQ ID NO: 529199 - DNA, 16 bp, R. norvegicus
ttatgatgttccattt

SEQ ID NO: 529200 - DNA, 16 bp, R. norvegicus
ttatgcccaggagagg

SEQ ID NO: 529201 - DNA, 16 bp, R. norvegicus
ttatggaaaagctgga

SEQ ID NO: 529202 - DNA, 16 bp, R. norvegicus
ttatggagatattttc

SEQ ID NO: 529203 - DNA, 16 bp, R. norvegicus
ttatggatgttcttaa

SEQ ID NO: 529204 - DNA, 16 bp, R. norvegicus
ttatggctacacaatc

SEQ ID NO: 529205 - DNA, 16 bp, R. norvegicus
ttatggctgtacaatc

SEQ ID NO: 529206 - DNA, 16 bp, R. norvegicus
ttatgtacagaaaact

SEQ ID NO: 529207 - DNA, 16 bp, R. norvegicus
ttatgtactcactaat

SEQ ID NO: 529208 - DNA, 32 bp, R. norvegicus
ttatgtagataagactggacttgtagaagaca

SEQ ID NO: 529209 - DNA, 16 bp, R. norvegicus
ttatgtatgtgcatgt

SEQ ID NO: 529210 - DNA, 16 bp, R. norvegicus
ttatgtattcattttc

SEQ ID NO: 529211 - DNA, 16 bp, R. norvegicus
ttatgtatttgaatgt

SEQ ID NO: 529212 - DNA, 16 bp, R. norvegicus
ttatgtatttgcattt

SEQ ID NO: 529213 - DNA, 16 bp, R. norvegicus
ttatgtcaaggtgaca

SEQ ID NO: 529214 - DNA, 16 bp, R. norvegicus
ttatgtctgtgtacca

SEQ ID NO: 529215 - DNA, 16 bp, R. norvegicus
ttatgtgaagggagga

SEQ ID NO: 529216 - DNA, 16 bp, R. norvegicus
ttatgtgacaggtgga

SEQ ID NO: 529217 - DNA, 16 bp, R. norvegicus
ttatgtgggcattctt

SEQ ID NO: 529218 - DNA, 16 bp, R. norvegicus
ttatgtgtatgaatat

SEQ ID NO: 529219 - DNA, 16 bp, R. norvegicus
ttatgtgtcaatttga

SEQ ID NO: 529220 - DNA, 16 bp, R. norvegicus
ttatgtgtctctcttc

SEQ ID NO: 529221 - DNA, 16 bp, R. norvegicus
ttatgtgtctgtgtgt

SEQ ID NO: 529222 - DNA, 16 bp, R. norvegicus
ttatgtgtgtgcatat

SEQ ID NO: 529223 - DNA, 16 bp, R. norvegicus
ttatgttaaaacagtg

SEQ ID NO: 529224 - DNA, 16 bp, R. norvegicus
ttatgttaattgatgt

SEQ ID NO: 529225 - DNA, 31 bp, R. norvegicus
ttatgttctgttttcaccgttttcgctgtta

SEQ ID NO: 529226 - DNA, 16 bp, R. norvegicus
ttatgttgtggtttgc

SEQ ID NO: 529227 - DNA, 16 bp, R. norvegicus
ttatgtttctctccat

SEQ ID NO: 529228 - DNA, 16 bp, R. norvegicus
ttatgtttctgtggct

SEQ ID NO: 529229 - DNA, 16 bp, R. norvegicus
ttatgttttcaaatgt

SEQ ID NO: 529230 - DNA, 16 bp, R. norvegicus
ttatgttttcctgaaa

SEQ ID NO: 529231 - DNA, 16 bp, R. norvegicus
ttatgtttttgtggct

SEQ ID NO: 529232 - DNA, 16 bp, R. norvegicus
ttattaaaacaacaac

SEQ ID NO: 529233 - DNA, 16 bp, R. norvegicus
ttattaaaacaatgac

SEQ ID NO: 529234 - DNA, 16 bp, R. norvegicus
ttattaaagtagattt

SEQ ID NO: 529235 - DNA, 17 bp, R. norvegicus
ttattataaataaggct

SEQ ID NO: 529236 - DNA, 16 bp, R. norvegicus
ttattattattactgc

SEQ ID NO: 529237 - DNA, 16 bp, R. norvegicus
ttattcaatagagttc

SEQ ID NO: 529238 - DNA, 16 bp, R. norvegicus
ttattcatgttacatc

SEQ ID NO: 529239 - DNA, 16 bp, R. norvegicus
ttattccaaatgactt

SEQ ID NO: 529240 - DNA, 25 bp, R. norvegicus
ttattccaagggaggagtcagtctc

SEQ ID NO: 529241 - DNA, 16 bp, R. norvegicus
ttattccacaaaattg

SEQ ID NO: 529242 - DNA, 16 bp, R. norvegicus
ttattccagtcagaat

SEQ ID NO: 529243 - DNA, 17 bp, R. norvegicus
ttattccatatgaattt

SEQ ID NO: 529244 - DNA, 16 bp, R. norvegicus
ttattctcaaaacagt

SEQ ID NO: 529245 - DNA, 16 bp, R. norvegicus
ttattctctgcatttt

SEQ ID NO: 529246 - DNA, 16 bp, R. norvegicus
ttattctcttaaaaat

SEQ ID NO: 529247 - DNA, 16 bp, R. norvegicus
ttattgaagaacagct

SEQ ID NO: 529248 - DNA, 16 bp, R. norvegicus
ttattgaagatgcttc

SEQ ID NO: 529249 - DNA, 16 bp, R. norvegicus
ttattgaagtataatt

SEQ ID NO: 529250 - DNA, 16 bp, R. norvegicus
ttattgagtatctttt

SEQ ID NO: 529251 - DNA, 16 bp, R. norvegicus
ttattgataatgatgt

SEQ ID NO: 529252 - DNA, 16 bp, R. norvegicus
ttattgatattgaaga

SEQ ID NO: 529253 - DNA, 16 bp, R. norvegicus
ttattgatgccaagaa

SEQ ID NO: 529254 - DNA, 17 bp, R. norvegicus
ttattgcaggaacacct

SEQ ID NO: 529255 - DNA, 16 bp, R. norvegicus
ttattgcccctgaaaa

SEQ ID NO: 529256 - DNA, 16 bp, R. norvegicus
ttattgctactcttct

SEQ ID NO: 529257 - DNA, 16 bp, R. norvegicus
ttattggagacaagtt

SEQ ID NO: 529258 - DNA, 16 bp, R. norvegicus
ttattggatgagaagg

SEQ ID NO: 529259 - DNA, 16 bp, R. norvegicus
ttattgggcttactta

SEQ ID NO: 529260 - DNA, 16 bp, R. norvegicus
ttattggttggccttt

SEQ ID NO: 529261 - DNA, 16 bp, R. norvegicus
ttattgttactgttgt

SEQ ID NO: 529262 - DNA, 16 bp, R. norvegicus
ttatttaaaaacatgt

SEQ ID NO: 529263 - DNA, 16 bp, R. norvegicus
ttatttaagttttcct

SEQ ID NO: 529264 - DNA, 16 bp, R. norvegicus
ttatttaatgtatgaa

SEQ ID NO: 529265 - DNA, 16 bp, R. norvegicus
ttatttacatttgaaa

SEQ ID NO: 529266 - DNA, 16 bp, R. norvegicus
ttatttataatagccc

SEQ ID NO: 529267 - DNA, 16 bp, R. norvegicus
ttatttatccattcat

SEQ ID NO: 529268 - DNA, 16 bp, R. norvegicus
ttatttatgtatttac

SEQ ID NO: 529269 - DNA, 16 bp, R. norvegicus
ttatttattcactttg

SEQ ID NO: 529270 - DNA, 16 bp, R. norvegicus
ttatttattgacattt

SEQ ID NO: 529271 - DNA, 16 bp, R. norvegicus
ttatttattgcttcta

SEQ ID NO: 529272 - DNA, 16 bp, R. norvegicus
ttatttattttcctgc

SEQ ID NO: 529273 - DNA, 16 bp, R. norvegicus
ttatttattttggagc

SEQ ID NO: 529274 - DNA, 16 bp, R. norvegicus
ttatttattttgtgca

SEQ ID NO: 529275 - DNA, 16 bp, R. norvegicus
ttatttcatcttacaa

SEQ ID NO: 529276 - DNA, 16 bp, R. norvegicus
ttatttcctgtcatct

SEQ ID NO: 529277 - DNA, 16 bp, R. norvegicus
ttatttcctttcaaat

SEQ ID NO: 529278 - DNA, 16 bp, R. norvegicus
ttatttctcagcctgt

SEQ ID NO: 529279 - DNA, 16 bp, R. norvegicus
ttatttctgattttaa

SEQ ID NO: 529280 - DNA, 16 bp, R. norvegicus
ttatttctggttcttc

SEQ ID NO: 529281 - DNA, 16 bp, R. norvegicus
ttatttctgttgctac

SEQ ID NO: 529282 - DNA, 16 bp, R. norvegicus
ttatttcttccctgat

SEQ ID NO: 529283 - DNA, 16 bp, R. norvegicus
ttatttcttcttctga

SEQ ID NO: 529284 - DNA, 16 bp, R. norvegicus
ttatttcttctttgaa

SEQ ID NO: 529285 - DNA, 16 bp, R. norvegicus
ttatttctttcttgaa

SEQ ID NO: 529286 - DNA, 16 bp, R. norvegicus
ttatttgatccttgga

SEQ ID NO: 529287 - DNA, 16 bp, R. norvegicus
ttatttggaaaaacaa

SEQ ID NO: 529288 - DNA, 16 bp, R. norvegicus
ttatttggcttatatt

SEQ ID NO: 529289 - DNA, 16 bp, R. norvegicus
ttatttggcttctttg

SEQ ID NO: 529290 - DNA, 16 bp, R. norvegicus
ttatttggttctttgg

SEQ ID NO: 529291 - DNA, 16 bp, R. norvegicus
ttatttggtttttcaa

SEQ ID NO: 529292 - DNA, 16 bp, R. norvegicus
ttatttgtaatagaca

SEQ ID NO: 529293 - DNA, 16 bp, R. norvegicus
ttattttaaaaagtca

SEQ ID NO: 529294 - DNA, 16 bp, R. norvegicus
ttattttacttttgaa

SEQ ID NO: 529295 - DNA, 16 bp, R. norvegicus
ttattttagtgggatt

SEQ ID NO: 529296 - DNA, 16 bp, R. norvegicus
ttattttagttctgag

SEQ ID NO: 529297 - DNA, 16 bp, R. norvegicus
ttattttatgtacatg

SEQ ID NO: 529298 - DNA, 16 bp, R. norvegicus
ttattttatgtagatg

SEQ ID NO: 529299 - DNA, 16 bp, R. norvegicus
ttattttatttctgag

SEQ ID NO: 529300 - DNA, 16 bp, R. norvegicus
ttattttcaataaaag

SEQ ID NO: 529301 - DNA, 16 bp, R. norvegicus
ttattttcattgctat

SEQ ID NO: 529302 - DNA, 16 bp, R. norvegicus
ttattttctctctgtg

SEQ ID NO: 529303 - DNA, 16 bp, R. norvegicus
ttattttctctttaag

SEQ ID NO: 529304 - DNA, 16 bp, R. norvegicus
ttattttgaagcaaat

SEQ ID NO: 529305 - DNA, 16 bp, R. norvegicus
ttattttgccatgttt

SEQ ID NO: 529306 - DNA, 16 bp, R. norvegicus
ttattttggatcacag

SEQ ID NO: 529307 - DNA, 16 bp, R. norvegicus
ttattttgtatgcatg

SEQ ID NO: 529308 - DNA, 16 bp, R. norvegicus
ttatttttaaatgctt

SEQ ID NO: 529309 - DNA, 16 bp, R. norvegicus
ttatttttcaaaacat

SEQ ID NO: 529310 - DNA, 16 bp, R. norvegicus
ttatttttcagattat

SEQ ID NO: 529311 - DNA, 16 bp, R. norvegicus
ttatttttggaaaaaa

SEQ ID NO: 529312 - DNA, 16 bp, R. norvegicus
ttattttttacactcc

SEQ ID NO: 529313 - DNA, 16 bp, R. norvegicus
ttcaaaaacatatttg

SEQ ID NO: 529314 - DNA, 16 bp, R. norvegicus
ttcaaaaaggaatgcc

SEQ ID NO: 529315 - DNA, 16 bp, R. norvegicus
ttcaaaaataaatatg

SEQ ID NO: 529316 - DNA, 16 bp, R. norvegicus
ttcaaaaattatcaga

SEQ ID NO: 529317 - DNA, 16 bp, R. norvegicus
ttcaaaacaatagaaa

SEQ ID NO: 529318 - DNA, 16 bp, R. norvegicus
ttcaaaacacaagaca

SEQ ID NO: 529319 - DNA, 16 bp, R. norvegicus
ttcaaaaccagcctca

SEQ ID NO: 529320 - DNA, 16 bp, R. norvegicus
ttcaaaagcatcagaa

SEQ ID NO: 529321 - DNA, 16 bp, R. norvegicus
ttcaaaaggaaaaaga

SEQ ID NO: 529322 - DNA, 16 bp, R. norvegicus
ttcaaaaggaaaaatg

SEQ ID NO: 529323 - DNA, 16 bp, R. norvegicus
ttcaaaaggaagaaaa

SEQ ID NO: 529324 - DNA, 16 bp, R. norvegicus
ttcaaaataaaatgtt

SEQ ID NO: 529325 - DNA, 16 bp, R. norvegicus
ttcaaaatgttcttca

SEQ ID NO: 529326 - DNA, 16 bp, R. norvegicus
ttcaaaattgttttaa

SEQ ID NO: 529327 - DNA, 16 bp, R. norvegicus
ttcaaacacagcagaa

SEQ ID NO: 529328 - DNA, 16 bp, R. norvegicus
ttcaaacatgatatca

SEQ ID NO: 529329 - DNA, 16 bp, R. norvegicus
ttcaaacccagcctgg

SEQ ID NO: 529330 - DNA, 16 bp, R. norvegicus
ttcaaactcttctccc

SEQ ID NO: 529331 - DNA, 16 bp, R. norvegicus
ttcaaagaaaaaattt

SEQ ID NO: 529332 - DNA, 16 bp, R. norvegicus
ttcaaagaaaagctaa

SEQ ID NO: 529333 - DNA, 16 bp, R. norvegicus
ttcaaagaaaatgaag

SEQ ID NO: 529334 - DNA, 16 bp, R. norvegicus
ttcaaagaaagaattg

SEQ ID NO: 529335 - DNA, 16 bp, R. norvegicus
ttcaaagaacactgga

SEQ ID NO: 529336 - DNA, 16 bp, R. norvegicus
ttcaaagaagaactaa

SEQ ID NO: 529337 - DNA, 16 bp, R. norvegicus
ttcaaagacttcagag

SEQ ID NO: 529338 - DNA, 16 bp, R. norvegicus
ttcaaagagaaagaaa

SEQ ID NO: 529339 - DNA, 16 bp, R. norvegicus
ttcaaagcaggaaaat

SEQ ID NO: 529340 - DNA, 16 bp, R. norvegicus
ttcaaagctcttcccc

SEQ ID NO: 529341 - DNA, 16 bp, R. norvegicus
ttcaaagctgcaggat

SEQ ID NO: 529342 - DNA, 16 bp, R. norvegicus
ttcaaagtaatttaaa

SEQ ID NO: 529343 - DNA, 16 bp, R. norvegicus
ttcaaagtcagcctga

SEQ ID NO: 529344 - DNA, 16 bp, R. norvegicus
ttcaaagtcagccttg

SEQ ID NO: 529345 - DNA, 16 bp, R. norvegicus
ttcaaagtcatctttg

SEQ ID NO: 529346 - DNA, 16 bp, R. norvegicus
ttcaaatatctgaaaa

SEQ ID NO: 529347 - DNA, 16 bp, R. norvegicus
ttcaaatatttgaaga

SEQ ID NO: 529348 - DNA, 16 bp, R. norvegicus
ttcaaatgtgttttta

SEQ ID NO: 529349 - DNA, 16 bp, R. norvegicus
ttcaaattcaaattca

SEQ ID NO: 529350 - DNA, 16 bp, R. norvegicus
ttcaaattcatagcct

SEQ ID NO: 529351 - DNA, 16 bp, R. norvegicus
ttcaaattctcttctg

SEQ ID NO: 529352 - DNA, 16 bp, R. norvegicus
ttcaacaaaaagttat

SEQ ID NO: 529353 - DNA, 16 bp, R. norvegicus
ttcaacaaaaatatag

SEQ ID NO: 529354 - DNA, 16 bp, R. norvegicus
ttcaacaaaattgaaa

SEQ ID NO: 529355 - DNA, 16 bp, R. norvegicus
ttcaacaaagaaagaa

SEQ ID NO: 529356 - DNA, 16 bp, R. norvegicus
ttcaacaaagccacac

SEQ ID NO: 529357 - DNA, 16 bp, R. norvegicus
ttcaacaaagtagctg

SEQ ID NO: 529358 - DNA, 16 bp, R. norvegicus
ttcaacaaatatttac

SEQ ID NO: 529359 - DNA, 67 bp, R. norvegicus
ttcaacagaggaatggatacagaaaatgtggtacatctacacaatggaatattactcagctctcaaa

SEQ ID NO: 529360 - DNA, 16 bp, R. norvegicus
ttcaacagtaaaagaa

SEQ ID NO: 529361 - DNA, 16 bp, R. norvegicus
ttcaacatatgaaaat

SEQ ID NO: 529362 - DNA, 16 bp, R. norvegicus
ttcaacatgaaagcaa

SEQ ID NO: 529363 - DNA, 16 bp, R. norvegicus
ttcaaccctacacaaa

SEQ ID NO: 529364 - DNA, 16 bp, R. norvegicus
ttcaacctaaaacaaa

SEQ ID NO: 529365 - DNA, 16 bp, R. norvegicus
ttcaactaaaagtcaa

SEQ ID NO: 529366 - DNA, 16 bp, R. norvegicus
ttcaactcccaaaggg

SEQ ID NO: 529367 - DNA, 16 bp, R. norvegicus
ttcaactggaggccaa

SEQ ID NO: 529368 - DNA, 16 bp, R. norvegicus
ttcaacttcctctttc

SEQ ID NO: 529369 - DNA, 16 bp, R. norvegicus
ttcaagaaaatttccc

SEQ ID NO: 529370 - DNA, 16 bp, R. norvegicus
ttcaagaaacaagctg

SEQ ID NO: 529371 - DNA, 16 bp, R. norvegicus
ttcaagaaagaggtga

SEQ ID NO: 529372 - DNA, 16 bp, R. norvegicus
ttcaagaagaagaaag

SEQ ID NO: 529373 - DNA, 16 bp, R. norvegicus
ttcaagaatacatcaa

SEQ ID NO: 529374 - DNA, 16 bp, R. norvegicus
ttcaagacaggttttt

SEQ ID NO: 529375 - DNA, 16 bp, R. norvegicus
ttcaagaccagcctga

SEQ ID NO: 529376 - DNA, 16 bp, R. norvegicus
ttcaagaccatcctgg

SEQ ID NO: 529377 - DNA, 16 bp, R. norvegicus
ttcaagaccatcttca

SEQ ID NO: 529378 - DNA, 16 bp, R. norvegicus
ttcaagataatttatt

SEQ ID NO: 529379 - DNA, 16 bp, R. norvegicus
ttcaagccccaggacc

SEQ ID NO: 529380 - DNA, 16 bp, R. norvegicus
ttcaagcctctaaaga

SEQ ID NO: 529381 - DNA, 16 bp, R. norvegicus
ttcaagctgctgacat

SEQ ID NO: 529382 - DNA, 17 bp, R. norvegicus
ttcaagcttttgggcta

SEQ ID NO: 529383 - DNA, 16 bp, R. norvegicus
ttcaaggaagaaaaat

SEQ ID NO: 529384 - DNA, 16 bp, R. norvegicus
ttcaaggagctgaagg

SEQ ID NO: 529385 - DNA, 17 bp, R. norvegicus
ttcaaggagttagacag

SEQ ID NO: 529386 - DNA, 16 bp, R. norvegicus
ttcaaggcaagtctgg

SEQ ID NO: 529387 - DNA, 16 bp, R. norvegicus
ttcaaggccaacctaa

SEQ ID NO: 529388 - DNA, 16 bp, R. norvegicus
ttcaaggccagccagg

SEQ ID NO: 529389 - DNA, 16 bp, R. norvegicus
ttcaaggccagcttga

SEQ ID NO: 529390 - DNA, 16 bp, R. norvegicus
ttcaaggccatctttg

SEQ ID NO: 529391 - DNA, 16 bp, R. norvegicus
ttcaaggccattcttg

SEQ ID NO: 529392 - DNA, 16 bp, R. norvegicus
ttcaaggcctacctgg

SEQ ID NO: 529393 - DNA, 16 bp, R. norvegicus
ttcaaggctagccaga

SEQ ID NO: 529394 - DNA, 16 bp, R. norvegicus
ttcaaggggctgggga

SEQ ID NO: 529395 - DNA, 16 bp, R. norvegicus
ttcaaggtcagcctgc

SEQ ID NO: 529396 - DNA, 16 bp, R. norvegicus
ttcaaggtcagcctgt

SEQ ID NO: 529397 - DNA, 16 bp, R. norvegicus
ttcaaggtcagtctga

SEQ ID NO: 529398 - DNA, 16 bp, R. norvegicus
ttcaaggtcatctggg

SEQ ID NO: 529399 - DNA, 16 bp, R. norvegicus
ttcaaggtcatcttct

SEQ ID NO: 529400 - DNA, 16 bp, R. norvegicus
ttcaaggtctctggct

SEQ ID NO: 529401 - DNA, 16 bp, R. norvegicus
ttcaaggtctcttctg

SEQ ID NO: 529402 - DNA, 16 bp, R. norvegicus
ttcaaggttagcctgg

SEQ ID NO: 529403 - DNA, 16 bp, R. norvegicus
ttcaaggttgaacatc

SEQ ID NO: 529404 - DNA, 16 bp, R. norvegicus
ttcaagtgtctaaaga

SEQ ID NO: 529405 - DNA, 16 bp, R. norvegicus
ttcaagttcaaggcca

SEQ ID NO: 529406 - DNA, 16 bp, R. norvegicus
ttcaagttgttggtca

SEQ ID NO: 529407 - DNA, 16 bp, R. norvegicus
ttcaagtttctgtcca

SEQ ID NO: 529408 - DNA, 16 bp, R. norvegicus
ttcaagtttctttcta

SEQ ID NO: 529409 - DNA, 16 bp, R. norvegicus
ttcaataaatggttct

SEQ ID NO: 529410 - DNA, 16 bp, R. norvegicus
ttcaatacaagaagtt

SEQ ID NO: 529411 - DNA, 17 bp, R. norvegicus
ttcaatagaagtttatt

SEQ ID NO: 529412 - DNA, 16 bp, R. norvegicus
ttcaatatatttcttg

SEQ ID NO: 529413 - DNA, 16 bp, R. norvegicus
ttcaatattcctcagg

SEQ ID NO: 529414 - DNA, 17 bp, R. norvegicus
ttcaatcctttctctaa

SEQ ID NO: 529415 - DNA, 16 bp, R. norvegicus
ttcaatctccagaacc

SEQ ID NO: 529416 - DNA, 16 bp, R. norvegicus
ttcaatctctgaagaa

SEQ ID NO: 529417 - DNA, 16 bp, R. norvegicus
ttcaatgactgtttct

SEQ ID NO: 529418 - DNA, 16 bp, R. norvegicus
ttcaatggctttctgt

SEQ ID NO: 529419 - DNA, 16 bp, R. norvegicus
ttcaattcaatcccca

SEQ ID NO: 529420 - DNA, 16 bp, R. norvegicus
ttcaattcattcattc

SEQ ID NO: 529421 - DNA, 16 bp, R. norvegicus
ttcaattcccagaacc

SEQ ID NO: 529422 - DNA, 16 bp, R. norvegicus
ttcaattcctgggacc

SEQ ID NO: 529423 - DNA, 16 bp, R. norvegicus
ttcaatttctttgttc

SEQ ID NO: 529424 - DNA, 16 bp, R. norvegicus
ttcacaaaacttgaaa

SEQ ID NO: 529425 - DNA, 16 bp, R. norvegicus
ttcacaaaataaagaa

SEQ ID NO: 529426 - DNA, 16 bp, R. norvegicus
ttcacaaagtttttaa

SEQ ID NO: 529427 - DNA, 27 bp, R. norvegicus
ttcacaaagtttttaagtgttcttcct

SEQ ID NO: 529428 - DNA, 16 bp, R. norvegicus
ttcacaaccgtctgta

SEQ ID NO: 529429 - DNA, 16 bp, R. norvegicus
ttcacaactgcctgta

SEQ ID NO: 529430 - DNA, 16 bp, R. norvegicus
ttcacaactgtctgta

SEQ ID NO: 529431 - DNA, 16 bp, R. norvegicus
ttcacacacatgcaaa

SEQ ID NO: 529432 - DNA, 16 bp, R. norvegicus
ttcacacactgagcca

SEQ ID NO: 529433 - DNA, 16 bp, R. norvegicus
ttcacacagcagcctc

SEQ ID NO: 529434 - DNA, 16 bp, R. norvegicus
ttcacaccagtgagaa

SEQ ID NO: 529435 - DNA, 16 bp, R. norvegicus
ttcacacctgaggaat

SEQ ID NO: 529436 - DNA, 16 bp, R. norvegicus
ttcacagaaaacaaaa

SEQ ID NO: 529437 - DNA, 16 bp, R. norvegicus
ttcacagaaaaggaaa

SEQ ID NO: 529438 - DNA, 16 bp, R. norvegicus
ttcacagaactcaaaa

SEQ ID NO: 529439 - DNA, 16 bp, R. norvegicus
ttcacagacaaggaaa

SEQ ID NO: 529440 - DNA, 16 bp, R. norvegicus
ttcacagagacccacc

SEQ ID NO: 529441 - DNA, 16 bp, R. norvegicus
ttcacagaggagaaaa

SEQ ID NO: 529442 - DNA, 16 bp, R. norvegicus
ttcacagaggaggaaa

SEQ ID NO: 529443 - DNA, 16 bp, R. norvegicus
ttcacagatgaggaaa

SEQ ID NO: 529444 - DNA, 16 bp, R. norvegicus
ttcacagctgaggact

SEQ ID NO: 529445 - DNA, 16 bp, R. norvegicus
ttcacagctgctgctg

SEQ ID NO: 529446 - DNA, 16 bp, R. norvegicus
ttcacaggaaattcaa

SEQ ID NO: 529447 - DNA, 16 bp, R. norvegicus
ttcacaggagaaaata

SEQ ID NO: 529448 - DNA, 16 bp, R. norvegicus
ttcacaggagtgtctg

SEQ ID NO: 529449 - DNA, 16 bp, R. norvegicus
ttcacaggggcagaca

SEQ ID NO: 529450 - DNA, 16 bp, R. norvegicus
ttcacatacataaaat

SEQ ID NO: 529451 - DNA, 16 bp, R. norvegicus
ttcacatctatgaaac

SEQ ID NO: 529452 - DNA, 16 bp, R. norvegicus
ttcacattcatcaaag

SEQ ID NO: 529453 - DNA, 16 bp, R. norvegicus
ttcacattcttcatta

SEQ ID NO: 529454 - DNA, 16 bp, R. norvegicus
ttcacattttaaaaaa

SEQ ID NO: 529455 - DNA, 16 bp, R. norvegicus
ttcaccaacagcctct

SEQ ID NO: 529456 - DNA, 16 bp, R. norvegicus
ttcaccaagctggact

SEQ ID NO: 529457 - DNA, 16 bp, R. norvegicus
ttcaccaatagcctct

SEQ ID NO: 529458 - DNA, 16 bp, R. norvegicus
ttcaccacacagactt

SEQ ID NO: 529459 - DNA, 16 bp, R. norvegicus
ttcaccaggcagctct

SEQ ID NO: 529460 - DNA, 16 bp, R. norvegicus
ttcacccaggaggagt

SEQ ID NO: 529461 - DNA, 16 bp, R. norvegicus
ttcaccccaaaacaaa

SEQ ID NO: 529462 - DNA, 16 bp, R. norvegicus
ttcacccctatgttct

SEQ ID NO: 529463 - DNA, 19 bp, R. norvegicus
ttcacctaattctgaaatc

SEQ ID NO: 529464 - DNA, 16 bp, R. norvegicus
ttcacctctctctgct

SEQ ID NO: 529465 - DNA, 16 bp, R. norvegicus
ttcacctctgtatttg

SEQ ID NO: 529466 - DNA, 16 bp, R. norvegicus
ttcactaaccttacat

SEQ ID NO: 529467 - DNA, 16 bp, R. norvegicus
ttcactatgttcatag

SEQ ID NO: 529468 - DNA, 17 bp, R. norvegicus
ttcactatttgcagatg

SEQ ID NO: 529469 - DNA, 16 bp, R. norvegicus
ttcactgtgtctcttt

SEQ ID NO: 529470 - DNA, 16 bp, R. norvegicus
ttcactgtgtctgttt

SEQ ID NO: 529471 - DNA, 17 bp, R. norvegicus
ttcacttccataccatt

SEQ ID NO: 529472 - DNA, 16 bp, R. norvegicus
ttcacttcctaacaac

SEQ ID NO: 529473 - DNA, 16 bp, R. norvegicus
ttcactttaaaattaa

SEQ ID NO: 529474 - DNA, 16 bp, R. norvegicus
ttcactttacatccat

SEQ ID NO: 529475 - DNA, 16 bp, R. norvegicus
ttcactttttaaaata

SEQ ID NO: 529476 - DNA, 16 bp, R. norvegicus
ttcagaaaaaaaaatg

SEQ ID NO: 529477 - DNA, 16 bp, R. norvegicus
ttcagaaaaacatgat

SEQ ID NO: 529478 - DNA, 16 bp, R. norvegicus
ttcagaaaaaggaaaa

SEQ ID NO: 529479 - DNA, 16 bp, R. norvegicus
ttcagaaaaataaata

SEQ ID NO: 529480 - DNA, 16 bp, R. norvegicus
ttcagaaaagaacaga

SEQ ID NO: 529481 - DNA, 16 bp, R. norvegicus
ttcagaaaataaaaca

SEQ ID NO: 529482 - DNA, 16 bp, R. norvegicus
ttcagaaaatatttta

SEQ ID NO: 529483 - DNA, 17 bp, R. norvegicus
ttcagaaaatcatcaga

SEQ ID NO: 529484 - DNA, 16 bp, R. norvegicus
ttcagaaaatggagag

SEQ ID NO: 529485 - DNA, 16 bp, R. norvegicus
ttcagaaaatggtgct

SEQ ID NO: 529486 - DNA, 16 bp, R. norvegicus
ttcagaaaattttccc

SEQ ID NO: 529487 - DNA, 16 bp, R. norvegicus
ttcagaaactgaagca

SEQ ID NO: 529488 - DNA, 16 bp, R. norvegicus
ttcagaaagaaccaga

SEQ ID NO: 529489 - DNA, 17 bp, R. norvegicus
ttcagaaagtcattgtt

SEQ ID NO: 529490 - DNA, 16 bp, R. norvegicus
ttcagaaagttcttgc

SEQ ID NO: 529491 - DNA, 16 bp, R. norvegicus
ttcagaaagttctttc

SEQ ID NO: 529492 - DNA, 16 bp, R. norvegicus
ttcagaaatccacctg

SEQ ID NO: 529493 - DNA, 16 bp, R. norvegicus
ttcagaacacaggata

SEQ ID NO: 529494 - DNA, 16 bp, R. norvegicus
ttcagaagaggaaggc

SEQ ID NO: 529495 - DNA, 17 bp, R. norvegicus
ttcagaagatggaaaga

SEQ ID NO: 529496 - DNA, 16 bp, R. norvegicus
ttcagaagttaagagc

SEQ ID NO: 529497 - DNA, 16 bp, R. norvegicus
ttcagaatatttaaaa

SEQ ID NO: 529498 - DNA, 16 bp, R. norvegicus
ttcagaatgctgacca

SEQ ID NO: 529499 - DNA, 16 bp, R. norvegicus
ttcagacaagaacaat

SEQ ID NO: 529500 - DNA, 16 bp, R. norvegicus
ttcagacacaacagga

SEQ ID NO: 529501 - DNA, 16 bp, R. norvegicus
ttcagaccattatcat

SEQ ID NO: 529502 - DNA, 16 bp, R. norvegicus
ttcagacccactccca

SEQ ID NO: 529503 - DNA, 16 bp, R. norvegicus
ttcagaccctaagaga

SEQ ID NO: 529504 - DNA, 16 bp, R. norvegicus
ttcagactcagagatc

SEQ ID NO: 529505 - DNA, 16 bp, R. norvegicus
ttcagactctgagaac

SEQ ID NO: 529506 - DNA, 16 bp, R. norvegicus
ttcagagaaagaggaa

SEQ ID NO: 529507 - DNA, 16 bp, R. norvegicus
ttcagagactgccaca

SEQ ID NO: 529508 - DNA, 16 bp, R. norvegicus
ttcagagagagaaaga

SEQ ID NO: 529509 - DNA, 16 bp, R. norvegicus
ttcagagcacccacct

SEQ ID NO: 529510 - DNA, 16 bp, R. norvegicus
ttcagagccagcccca

SEQ ID NO: 529511 - DNA, 16 bp, R. norvegicus
ttcagagccagcctgg

SEQ ID NO: 529512 - DNA, 16 bp, R. norvegicus
ttcagagcctgcacca

SEQ ID NO: 529513 - DNA, 16 bp, R. norvegicus
ttcagagcctgcctca

SEQ ID NO: 529514 - DNA, 16 bp, R. norvegicus
ttcagagcctggccca

SEQ ID NO: 529515 - DNA, 16 bp, R. norvegicus
ttcagagcctgttcca

SEQ ID NO: 529516 - DNA, 16 bp, R. norvegicus
ttcagagctaaacgaa

SEQ ID NO: 529517 - DNA, 16 bp, R. norvegicus
ttcagagctctcctgg

SEQ ID NO: 529518 - DNA, 16 bp, R. norvegicus
ttcagagctgccccac

SEQ ID NO: 529519 - DNA, 16 bp, R. norvegicus
ttcagaggaaagatta

SEQ ID NO: 529520 - DNA, 16 bp, R. norvegicus
ttcagaggattgaagt

SEQ ID NO: 529521 - DNA, 16 bp, R. norvegicus
ttcagaggcagagaca

SEQ ID NO: 529522 - DNA, 16 bp, R. norvegicus
ttcagagggacagaca

SEQ ID NO: 529523 - DNA, 16 bp, R. norvegicus
ttcagagtcttgatgt

SEQ ID NO: 529524 - DNA, 16 bp, R. norvegicus
ttcagagtgagtttca

SEQ ID NO: 529525 - DNA, 16 bp, R. norvegicus
ttcagagttaaacagc

SEQ ID NO: 529526 - DNA, 16 bp, R. norvegicus
ttcagatccttcagtc

SEQ ID NO: 529527 - DNA, 16 bp, R. norvegicus
ttcagatgaagatgtg

SEQ ID NO: 529528 - DNA, 16 bp, R. norvegicus
ttcagatgacagcaga

SEQ ID NO: 529529 - DNA, 16 bp, R. norvegicus
ttcagatgccaagaag

SEQ ID NO: 529530 - DNA, 16 bp, R. norvegicus
ttcagatgcttcagtc

SEQ ID NO: 529531 - DNA, 16 bp, R. norvegicus
ttcagatgtaccagaa

SEQ ID NO: 529532 - DNA, 16 bp, R. norvegicus
ttcagattctgttgtt

SEQ ID NO: 529533 - DNA, 16 bp, R. norvegicus
ttcagattggaatcct

SEQ ID NO: 529534 - DNA, 16 bp, R. norvegicus
ttcagcaaaagaaaaa

SEQ ID NO: 529535 - DNA, 16 bp, R. norvegicus
ttcagcaaagtaactg

SEQ ID NO: 529536 - DNA, 16 bp, R. norvegicus
ttcagcaaagtgactg

SEQ ID NO: 529537 - DNA, 16 bp, R. norvegicus
ttcagcaaatggtact

SEQ ID NO: 529538 - DNA, 16 bp, R. norvegicus
ttcagcaaatggtgca

SEQ ID NO: 529539 - DNA, 16 bp, R. norvegicus
ttcagcaaggtggctg

SEQ ID NO: 529540 - DNA, 16 bp, R. norvegicus
ttcagcagcagcagca

SEQ ID NO: 529541 - DNA, 16 bp, R. norvegicus
ttcagccagcacctga

SEQ ID NO: 529542 - DNA, 16 bp, R. norvegicus
ttcagcctctgaaact

SEQ ID NO: 529543 - DNA, 16 bp, R. norvegicus
ttcagcctctgagagc

SEQ ID NO: 529544 - DNA, 16 bp, R. norvegicus
ttcagcctctgctcta

SEQ ID NO: 529545 - DNA, 16 bp, R. norvegicus
ttcagcctgctctctt

SEQ ID NO: 529546 - DNA, 16 bp, R. norvegicus
ttcagcctgcttcctt

SEQ ID NO: 529547 - DNA, 16 bp, R. norvegicus
ttcagccttctggccc

SEQ ID NO: 529548 - DNA, 16 bp, R. norvegicus
ttcagccttctggcct

SEQ ID NO: 529549 - DNA, 16 bp, R. norvegicus
ttcagctatgagtttg

SEQ ID NO: 529550 - DNA, 16 bp, R. norvegicus
ttcagctattaaaata

SEQ ID NO: 529551 - DNA, 16 bp, R. norvegicus
ttcagctcagctgttc

SEQ ID NO: 529552 - DNA, 16 bp, R. norvegicus
ttcagctccaggcaca

SEQ ID NO: 529553 - DNA, 16 bp, R. norvegicus
ttcagctcctcatggt

SEQ ID NO: 529554 - DNA, 16 bp, R. norvegicus
ttcagctctctcccca

SEQ ID NO: 529555 - DNA, 16 bp, R. norvegicus
ttcagctctgcagcct

SEQ ID NO: 529556 - DNA, 16 bp, R. norvegicus
ttcagctgctggcaat

SEQ ID NO: 529557 - DNA, 16 bp, R. norvegicus
ttcagctgcttgatgg

SEQ ID NO: 529558 - DNA, 16 bp, R. norvegicus
ttcagctggaggtcag

SEQ ID NO: 529559 - DNA, 16 bp, R. norvegicus
ttcagctgtccctgtg

SEQ ID NO: 529560 - DNA, 16 bp, R. norvegicus
ttcagctgttcctctg

SEQ ID NO: 529561 - DNA, 16 bp, R. norvegicus
ttcagcttctttaagt

SEQ ID NO: 529562 - DNA, 16 bp, R. norvegicus
ttcagcttctttgtca

SEQ ID NO: 529563 - DNA, 16 bp, R. norvegicus
ttcagcttgaggtcag

SEQ ID NO: 529564 - DNA, 16 bp, R. norvegicus
ttcagcttttaaaaac

SEQ ID NO: 529565 - DNA, 16 bp, R. norvegicus
ttcagcttttaaaaat

SEQ ID NO: 529566 - DNA, 16 bp, R. norvegicus
ttcaggaaattttcct

SEQ ID NO: 529567 - DNA, 16 bp, R. norvegicus
ttcaggaagaaggaag

SEQ ID NO: 529568 - DNA, 16 bp, R. norvegicus
ttcaggaagcagaggc

SEQ ID NO: 529569 - DNA, 16 bp, R. norvegicus
ttcaggacagccagga

SEQ ID NO: 529570 - DNA, 16 bp, R. norvegicus
ttcaggagacagctgt

SEQ ID NO: 529571 - DNA, 16 bp, R. norvegicus
ttcaggagagagagag

SEQ ID NO: 529572 - DNA, 16 bp, R. norvegicus
ttcaggattattttag

SEQ ID NO: 529573 - DNA, 16 bp, R. norvegicus
ttcaggctccatatct

SEQ ID NO: 529574 - DNA, 16 bp, R. norvegicus
ttcagggacagtggga

SEQ ID NO: 529575 - DNA, 16 bp, R. norvegicus
ttcagggaggcagaca

SEQ ID NO: 529576 - DNA, 16 bp, R. norvegicus
ttcagggataaagtca

SEQ ID NO: 529577 - DNA, 16 bp, R. norvegicus
ttcagggcagccaggg

SEQ ID NO: 529578 - DNA, 16 bp, R. norvegicus
ttcagggtctccaaag

SEQ ID NO: 529579 - DNA, 16 bp, R. norvegicus
ttcagggtctctgggg

SEQ ID NO: 529580 - DNA, 16 bp, R. norvegicus
ttcagggttgcctggc

SEQ ID NO: 529581 - DNA, 16 bp, R. norvegicus
ttcaggtcaggtagaa

SEQ ID NO: 529582 - DNA, 16 bp, R. norvegicus
ttcaggtcatcagact

SEQ ID NO: 529583 - DNA, 17 bp, R. norvegicus
ttcaggtgacagcagat

SEQ ID NO: 529584 - DNA, 16 bp, R. norvegicus
ttcaggtgctcctggc

SEQ ID NO: 529585 - DNA, 16 bp, R. norvegicus
ttcagtacattatcat

SEQ ID NO: 529586 - DNA, 16 bp, R. norvegicus
ttcagtatgtgcatgt

SEQ ID NO: 529587 - DNA, 16 bp, R. norvegicus
ttcagtcagaagccaa

SEQ ID NO: 529588 - DNA, 16 bp, R. norvegicus
ttcagtcagaggagat

SEQ ID NO: 529589 - DNA, 16 bp, R. norvegicus
ttcagtcagttatggg

SEQ ID NO: 529590 - DNA, 16 bp, R. norvegicus
ttcagtccccagcacc

SEQ ID NO: 529591 - DNA, 16 bp, R. norvegicus
ttcagtccctgcccca

SEQ ID NO: 529592 - DNA, 16 bp, R. norvegicus
ttcagtcccttctcca

SEQ ID NO: 529593 - DNA, 16 bp, R. norvegicus
ttcagtcctcaggacc

SEQ ID NO: 529594 - DNA, 16 bp, R. norvegicus
ttcagtcctgtctcta

SEQ ID NO: 529595 - DNA, 16 bp, R. norvegicus
ttcagtccttcctctg

SEQ ID NO: 529596 - DNA, 16 bp, R. norvegicus
ttcagtccttgcccta

SEQ ID NO: 529597 - DNA, 16 bp, R. norvegicus
ttcagtctctgctcca

SEQ ID NO: 529598 - DNA, 16 bp, R. norvegicus
ttcagtctctgtttta

SEQ ID NO: 529599 - DNA, 16 bp, R. norvegicus
ttcagtcttggctgga

SEQ ID NO: 529600 - DNA, 16 bp, R. norvegicus
ttcagtgacaaagaca

SEQ ID NO: 529601 - DNA, 16 bp, R. norvegicus
ttcagtgacatacttc

SEQ ID NO: 529602 - DNA, 16 bp, R. norvegicus
ttcagtgacttcccaa

SEQ ID NO: 529603 - DNA, 16 bp, R. norvegicus
ttcagtgatggccagg

SEQ ID NO: 529604 - DNA, 20 bp, R. norvegicus
ttcagtgcagaattctatca

SEQ ID NO: 529605 - DNA, 16 bp, R. norvegicus
ttcagtgcaggtcagc

SEQ ID NO: 529606 - DNA, 16 bp, R. norvegicus
ttcagtgctgaattct

SEQ ID NO: 529607 - DNA, 16 bp, R. norvegicus
ttcagtggcatggggc

SEQ ID NO: 529608 - DNA, 16 bp, R. norvegicus
ttcagtgtgtgctttg

SEQ ID NO: 529609 - DNA, 16 bp, R. norvegicus
ttcagttattaaaaat

SEQ ID NO: 529610 - DNA, 16 bp, R. norvegicus
ttcagttcaatgattg

SEQ ID NO: 529611 - DNA, 16 bp, R. norvegicus
ttcagttcacagcacc

SEQ ID NO: 529612 - DNA, 16 bp, R. norvegicus
ttcagttcagtggttt

SEQ ID NO: 529613 - DNA, 16 bp, R. norvegicus
ttcagttcccagctca

SEQ ID NO: 529614 - DNA, 16 bp, R. norvegicus
ttcagttcctaacacc

SEQ ID NO: 529615 - DNA, 16 bp, R. norvegicus
ttcagttcctgaatct

SEQ ID NO: 529616 - DNA, 16 bp, R. norvegicus
ttcagttcctgcttcc

SEQ ID NO: 529617 - DNA, 16 bp, R. norvegicus
ttcagttccttcacct

SEQ ID NO: 529618 - DNA, 16 bp, R. norvegicus
ttcagttctcagctct

SEQ ID NO: 529619 - DNA, 16 bp, R. norvegicus
ttcagttcttctcaga

SEQ ID NO: 529620 - DNA, 16 bp, R. norvegicus
ttcagtttcagtttca

SEQ ID NO: 529621 - DNA, 16 bp, R. norvegicus
ttcagtttccagtacc

SEQ ID NO: 529622 - DNA, 16 bp, R. norvegicus
ttcagtttcttctcca

SEQ ID NO: 529623 - DNA, 16 bp, R. norvegicus
ttcagtttctttcctc

SEQ ID NO: 529624 - DNA, 16 bp, R. norvegicus
ttcagtttgcagcacc

SEQ ID NO: 529625 - DNA, 16 bp, R. norvegicus
ttcagtttgttgacct

SEQ ID NO: 529626 - DNA, 16 bp, R. norvegicus
ttcagtttgtttatgt

SEQ ID NO: 529627 - DNA, 16 bp, R. norvegicus
ttcataaaacaaacct

SEQ ID NO: 529628 - DNA, 16 bp, R. norvegicus
ttcataatagccagaa

SEQ ID NO: 529629 - DNA, 16 bp, R. norvegicus
ttcatacacataaagt

SEQ ID NO: 529630 - DNA, 16 bp, R. norvegicus
ttcatacatgcatata

SEQ ID NO: 529631 - DNA, 16 bp, R. norvegicus
ttcatacatgtgcaca

SEQ ID NO: 529632 - DNA, 16 bp, R. norvegicus
ttcatagggaattcca

SEQ ID NO: 529633 - DNA, 16 bp, R. norvegicus
ttcatagggaattcct

SEQ ID NO: 529634 - DNA, 16 bp, R. norvegicus
ttcatatacatgtgtg

SEQ ID NO: 529635 - DNA, 16 bp, R. norvegicus
ttcatatatatgaata

SEQ ID NO: 529636 - DNA, 16 bp, R. norvegicus
ttcatatgggatctca

SEQ ID NO: 529637 - DNA, 16 bp, R. norvegicus
ttcatattcatcacag

SEQ ID NO: 529638 - DNA, 17 bp, R. norvegicus
ttcatcaatgttgtcta

SEQ ID NO: 529639 - DNA, 16 bp, R. norvegicus
ttcatcacagcagcag

SEQ ID NO: 529640 - DNA, 16 bp, R. norvegicus
ttcatcaccaccacca

SEQ ID NO: 529641 - DNA, 16 bp, R. norvegicus
ttcatcacccaaggaa

SEQ ID NO: 529642 - DNA, 17 bp, R. norvegicus
ttcatcagaaggctgct

SEQ ID NO: 529643 - DNA, 16 bp, R. norvegicus
ttcatcagggctgact

SEQ ID NO: 529644 - DNA, 16 bp, R. norvegicus
ttcatcatcatcatca

SEQ ID NO: 529645 - DNA, 16 bp, R. norvegicus
ttcatcatggaaggaa

SEQ ID NO: 529646 - DNA, 16 bp, R. norvegicus
ttcatccctactggct

SEQ ID NO: 529647 - DNA, 16 bp, R. norvegicus
ttcatctcagggatgt

SEQ ID NO: 529648 - DNA, 16 bp, R. norvegicus
ttcatctcagtcaaca

SEQ ID NO: 529649 - DNA, 16 bp, R. norvegicus
ttcatctctgggtctt

SEQ ID NO: 529650 - DNA, 16 bp, R. norvegicus
ttcatctggaaaacct

SEQ ID NO: 529651 - DNA, 16 bp, R. norvegicus
ttcatctggaacaaca

SEQ ID NO: 529652 - DNA, 16 bp, R. norvegicus
ttcatctgtccatctg

SEQ ID NO: 529653 - DNA, 16 bp, R. norvegicus
ttcatcttcatcttca

SEQ ID NO: 529654 - DNA, 16 bp, R. norvegicus
ttcatcttgatggatt

SEQ ID NO: 529655 - DNA, 16 bp, R. norvegicus
ttcatctttctgcttc

SEQ ID NO: 529656 - DNA, 16 bp, R. norvegicus
ttcatcttttaaaaat

SEQ ID NO: 529657 - DNA, 16 bp, R. norvegicus
ttcatgaaaatcatag

SEQ ID NO: 529658 - DNA, 16 bp, R. norvegicus
ttcatgaaattcataa

SEQ ID NO: 529659 - DNA, 16 bp, R. norvegicus
ttcatgaaattttcag

SEQ ID NO: 529660 - DNA, 23 bp, R. norvegicus
ttcatgataaaagtcctggaaaa

SEQ ID NO: 529661 - DNA, 16 bp, R. norvegicus
ttcatgatctcttctt

SEQ ID NO: 529662 - DNA, 16 bp, R. norvegicus
ttcatgatgccatttt

SEQ ID NO: 529663 - DNA, 16 bp, R. norvegicus
ttcatggaaaaaaaaa

SEQ ID NO: 529664 - DNA, 16 bp, R. norvegicus
ttcatggatacaccag

SEQ ID NO: 529665 - DNA, 32 bp, R. norvegicus
ttcatggtactttctccaaaattgaccatata

SEQ ID NO: 529666 - DNA, 16 bp, R. norvegicus
ttcatggtggtggtgg

SEQ ID NO: 529667 - DNA, 16 bp, R. norvegicus
ttcatgtatagttttt

SEQ ID NO: 529668 - DNA, 16 bp, R. norvegicus
ttcatgtatttaaaaa

SEQ ID NO: 529669 - DNA, 16 bp, R. norvegicus
ttcatgtcttccttga

SEQ ID NO: 529670 - DNA, 16 bp, R. norvegicus
ttcatgtgtgtgagca

SEQ ID NO: 529671 - DNA, 16 bp, R. norvegicus
ttcatgttccttctct

SEQ ID NO: 529672 - DNA, 16 bp, R. norvegicus
ttcatgttgtctgtaa

SEQ ID NO: 529673 - DNA, 16 bp, R. norvegicus
ttcatgtttctctcca

SEQ ID NO: 529674 - DNA, 16 bp, R. norvegicus
ttcattatccatccat

SEQ ID NO: 529675 - DNA, 16 bp, R. norvegicus
ttcattcatgagcact

SEQ ID NO: 529676 - DNA, 16 bp, R. norvegicus
ttcattcattcattca

SEQ ID NO: 529677 - DNA, 16 bp, R. norvegicus
ttcattcatttactta

SEQ ID NO: 529678 - DNA, 16 bp, R. norvegicus
ttcattcccagcacct

SEQ ID NO: 529679 - DNA, 16 bp, R. norvegicus
ttcattccccacttct

SEQ ID NO: 529680 - DNA, 16 bp, R. norvegicus
ttcattcgttcattca

SEQ ID NO: 529681 - DNA, 16 bp, R. norvegicus
ttcattctaaaacaaa

SEQ ID NO: 529682 - DNA, 16 bp, R. norvegicus
ttcattctcctgggcc

SEQ ID NO: 529683 - DNA, 16 bp, R. norvegicus
ttcattctgtttctgt

SEQ ID NO: 529684 - DNA, 16 bp, R. norvegicus
ttcattgagttattta

SEQ ID NO: 529685 - DNA, 16 bp, R. norvegicus
ttcattggtaaaatca

SEQ ID NO: 529686 - DNA, 16 bp, R. norvegicus
ttcattgtcagcttga

SEQ ID NO: 529687 - DNA, 16 bp, R. norvegicus
ttcattgtgccccata

SEQ ID NO: 529688 - DNA, 16 bp, R. norvegicus
ttcatttaaaaaagaa

SEQ ID NO: 529689 - DNA, 16 bp, R. norvegicus
ttcatttacacaggga

SEQ ID NO: 529690 - DNA, 16 bp, R. norvegicus
ttcatttatgatttcc

SEQ ID NO: 529691 - DNA, 16 bp, R. norvegicus
ttcatttccatttcaa

SEQ ID NO: 529692 - DNA, 16 bp, R. norvegicus
ttcatttgcatttaaa

SEQ ID NO: 529693 - DNA, 16 bp, R. norvegicus
ttcatttggaaaaaaa

SEQ ID NO: 529694 - DNA, 16 bp, R. norvegicus
ttcatttggaagaaca

SEQ ID NO: 529695 - DNA, 16 bp, R. norvegicus
ttcatttggaatcaca

SEQ ID NO: 529696 - DNA, 16 bp, R. norvegicus
ttcattttcactaaat

SEQ ID NO: 529697 - DNA, 16 bp, R. norvegicus
ttcattttccttcaaa

SEQ ID NO: 529698 - DNA, 16 bp, R. norvegicus
ttcattttctttagaa

SEQ ID NO: 529699 - DNA, 16 bp, R. norvegicus
ttcattttgaagaagg

SEQ ID NO: 529700 - DNA, 16 bp, R. norvegicus
ttcattttgtagacca

SEQ ID NO: 529701 - DNA, 16 bp, R. norvegicus
ttcatttttaaagatt

SEQ ID NO: 529702 - DNA, 17 bp, R. norvegicus
ttcatttttcctacccc

SEQ ID NO: 529703 - DNA, 16 bp, R. norvegicus
ttcatttttgagacaa

SEQ ID NO: 529704 - DNA, 16 bp, R. norvegicus
ttccaaaaagaaaaag

SEQ ID NO: 529705 - DNA, 17 bp, R. norvegicus
ttccaaaacctcatcaa

SEQ ID NO: 529706 - DNA, 16 bp, R. norvegicus
ttccaaaagacccagg

SEQ ID NO: 529707 - DNA, 16 bp, R. norvegicus
ttccaaaattaaatca

SEQ ID NO: 529708 - DNA, 16 bp, R. norvegicus
ttccaaacatttgcct

SEQ ID NO: 529709 - DNA, 16 bp, R. norvegicus
ttccaaaggaaagaaa

SEQ ID NO: 529710 - DNA, 16 bp, R. norvegicus
ttccaaagggaaaaaa

SEQ ID NO: 529711 - DNA, 16 bp, R. norvegicus
ttccaaattcaaagtc

SEQ ID NO: 529712 - DNA, 16 bp, R. norvegicus
ttccaactcaattatt

SEQ ID NO: 529713 - DNA, 16 bp, R. norvegicus
ttccaactcaattctt

SEQ ID NO: 529714 - DNA, 16 bp, R. norvegicus
ttccaagaaaacacaa

SEQ ID NO: 529715 - DNA, 16 bp, R. norvegicus
ttccaagactgaaccc

SEQ ID NO: 529716 - DNA, 16 bp, R. norvegicus
ttccaagccagccaaa

SEQ ID NO: 529717 - DNA, 16 bp, R. norvegicus
ttccaagccagcctgg

SEQ ID NO: 529718 - DNA, 16 bp, R. norvegicus
ttccaagccagcttgg

SEQ ID NO: 529719 - DNA, 16 bp, R. norvegicus
ttccaaggtttttttt

SEQ ID NO: 529720 - DNA, 16 bp, R. norvegicus
ttccaagttgctttgg

SEQ ID NO: 529721 - DNA, 16 bp, R. norvegicus
ttccaataaagcttta

SEQ ID NO: 529722 - DNA, 16 bp, R. norvegicus
ttccaatttgtaccct

SEQ ID NO: 529723 - DNA, 16 bp, R. norvegicus
ttccaattttttaaaa

SEQ ID NO: 529724 - DNA, 16 bp, R. norvegicus
ttccacaaaagaaaaa

SEQ ID NO: 529725 - DNA, 16 bp, R. norvegicus
ttccacaaagacactt

SEQ ID NO: 529726 - DNA, 16 bp, R. norvegicus
ttccacaacaaaacca

SEQ ID NO: 529727 - DNA, 23 bp, R. norvegicus
ttccacactgcagaggccccaag

SEQ ID NO: 529728 - DNA, 20 bp, R. norvegicus
ttccacactgctgttcatca

SEQ ID NO: 529729 - DNA, 16 bp, R. norvegicus
ttccacagatgcctgg

SEQ ID NO: 529730 - DNA, 16 bp, R. norvegicus
ttccacatcactgctc

SEQ ID NO: 529731 - DNA, 16 bp, R. norvegicus
ttccacatcactgttc

SEQ ID NO: 529732 - DNA, 16 bp, R. norvegicus
ttccacatcccatacc

SEQ ID NO: 529733 - DNA, 16 bp, R. norvegicus
ttccacatgtatgtgg

SEQ ID NO: 529734 - DNA, 16 bp, R. norvegicus
ttccacattgaaaaca

SEQ ID NO: 529735 - DNA, 16 bp, R. norvegicus
ttccaccacagcaagc

SEQ ID NO: 529736 - DNA, 16 bp, R. norvegicus
ttccaccagcaatgaa

SEQ ID NO: 529737 - DNA, 16 bp, R. norvegicus
ttccacctctaccaac

SEQ ID NO: 529738 - DNA, 16 bp, R. norvegicus
ttccacgtggaaaggt

SEQ ID NO: 529739 - DNA, 16 bp, R. norvegicus
ttccactacctctgct

SEQ ID NO: 529740 - DNA, 17 bp, R. norvegicus
ttccactgccccaagga

SEQ ID NO: 529741 - DNA, 16 bp, R. norvegicus
ttccactggtgctcgt

SEQ ID NO: 529742 - DNA, 17 bp, R. norvegicus
ttccactggtgctgtta

SEQ ID NO: 529743 - DNA, 28 bp, R. norvegicus
ttccactgtaggagcactacaactgtct

SEQ ID NO: 529744 - DNA, 16 bp, R. norvegicus
ttccactgtcccaagg

SEQ ID NO: 529745 - DNA, 16 bp, R. norvegicus
ttccacttcccggttt

SEQ ID NO: 529746 - DNA, 16 bp, R. norvegicus
ttccacttgatgccct

SEQ ID NO: 529747 - DNA, 16 bp, R. norvegicus
ttccacttgggagaga

SEQ ID NO: 529748 - DNA, 16 bp, R. norvegicus
ttccagaaaacagaaa

SEQ ID NO: 529749 - DNA, 16 bp, R. norvegicus
ttccagaaagaaaaaa

SEQ ID NO: 529750 - DNA, 16 bp, R. norvegicus
ttccagaaagaaacaa

SEQ ID NO: 529751 - DNA, 16 bp, R. norvegicus
ttccagaacaaccaga

SEQ ID NO: 529752 - DNA, 16 bp, R. norvegicus
ttccagaacagccatg

SEQ ID NO: 529753 - DNA, 16 bp, R. norvegicus
ttccagaacagctaag

SEQ ID NO: 529754 - DNA, 16 bp, R. norvegicus
ttccagaacattccat

SEQ ID NO: 529755 - DNA, 16 bp, R. norvegicus
ttccagaacccacata

SEQ ID NO: 529756 - DNA, 16 bp, R. norvegicus
ttccagaagacccaag

SEQ ID NO: 529757 - DNA, 17 bp, R. norvegicus
ttccagaagaggtgctg

SEQ ID NO: 529758 - DNA, 16 bp, R. norvegicus
ttccagaagcttttca

SEQ ID NO: 529759 - DNA, 16 bp, R. norvegicus
ttccagaagttctgag

SEQ ID NO: 529760 - DNA, 16 bp, R. norvegicus
ttccagaatgttcttt

SEQ ID NO: 529761 - DNA, 16 bp, R. norvegicus
ttccagacactgcaga

SEQ ID NO: 529762 - DNA, 16 bp, R. norvegicus
ttccagacagccagga

SEQ ID NO: 529763 - DNA, 16 bp, R. norvegicus
ttccagaccaaccagg

SEQ ID NO: 529764 - DNA, 16 bp, R. norvegicus
ttccagaccaacctgg

SEQ ID NO: 529765 - DNA, 16 bp, R. norvegicus
ttccagaccagcctga

SEQ ID NO: 529766 - DNA, 16 bp, R. norvegicus
ttccagactcttcccc

SEQ ID NO: 529767 - DNA, 19 bp, R. norvegicus
ttccagactgatttccaga

SEQ ID NO: 529768 - DNA, 16 bp, R. norvegicus
ttccagagaccctgag

SEQ ID NO: 529769 - DNA, 16 bp, R. norvegicus
ttccagagagatttaa

SEQ ID NO: 529770 - DNA, 16 bp, R. norvegicus
ttccagagatcttgag

SEQ ID NO: 529771 - DNA, 16 bp, R. norvegicus
ttccagagctggagag

SEQ ID NO: 529772 - DNA, 16 bp, R. norvegicus
ttccagaggacctgcg

SEQ ID NO: 529773 - DNA, 16 bp, R. norvegicus
ttccagaggacttggg

SEQ ID NO: 529774 - DNA, 16 bp, R. norvegicus
ttccagaggatctgaa

SEQ ID NO: 529775 - DNA, 16 bp, R. norvegicus
ttccagaggccccagg

SEQ ID NO: 529776 - DNA, 16 bp, R. norvegicus
ttccagaggtctgagt

SEQ ID NO: 529777 - DNA, 16 bp, R. norvegicus
ttccagaggtcttggg

SEQ ID NO: 529778 - DNA, 16 bp, R. norvegicus
ttccagatcagcctgg

SEQ ID NO: 529779 - DNA, 16 bp, R. norvegicus
ttccagatctttccaa

SEQ ID NO: 529780 - DNA, 16 bp, R. norvegicus
ttccagatgccaagaa

SEQ ID NO: 529781 - DNA, 16 bp, R. norvegicus
ttccagatgcttctgg

SEQ ID NO: 529782 - DNA, 16 bp, R. norvegicus
ttccagatgggttcag

SEQ ID NO: 529783 - DNA, 16 bp, R. norvegicus
ttccagattctggtta

SEQ ID NO: 529784 - DNA, 16 bp, R. norvegicus
ttccagcacttgagaa

SEQ ID NO: 529785 - DNA, 16 bp, R. norvegicus
ttccagcactttggag

SEQ ID NO: 529786 - DNA, 16 bp, R. norvegicus
ttccagcagaggcagg

SEQ ID NO: 529787 - DNA, 16 bp, R. norvegicus
ttccagcagcagcagc

SEQ ID NO: 529788 - DNA, 16 bp, R. norvegicus
ttccagcatccacatc

SEQ ID NO: 529789 - DNA, 16 bp, R. norvegicus
ttccagcatttgggaa

SEQ ID NO: 529790 - DNA, 16 bp, R. norvegicus
ttccagccattgtgtc

SEQ ID NO: 529791 - DNA, 16 bp, R. norvegicus
ttccagcccagccagg

SEQ ID NO: 529792 - DNA, 16 bp, R. norvegicus
ttccagccttttactg

SEQ ID NO: 529793 - DNA, 16 bp, R. norvegicus
ttccagccttttgctc

SEQ ID NO: 529794 - DNA, 16 bp, R. norvegicus
ttccagctacagatga

SEQ ID NO: 529795 - DNA, 16 bp, R. norvegicus
ttccagctgcatatgt

SEQ ID NO: 529796 - DNA, 16 bp, R. norvegicus
ttccagctgctgcagg

SEQ ID NO: 529797 - DNA, 16 bp, R. norvegicus
ttccagctgctggcta

SEQ ID NO: 529798 - DNA, 16 bp, R. norvegicus
ttccaggaaaagaaaa

SEQ ID NO: 529799 - DNA, 16 bp, R. norvegicus
ttccaggaaagcaaga

SEQ ID NO: 529800 - DNA, 17 bp, R. norvegicus
ttccaggaaatcataaa

SEQ ID NO: 529801 - DNA, 16 bp, R. norvegicus
ttccaggaagacacaa

SEQ ID NO: 529802 - DNA, 16 bp, R. norvegicus
ttccaggaagcacagt

SEQ ID NO: 529803 - DNA, 16 bp, R. norvegicus
ttccaggaagtttcta

SEQ ID NO: 529804 - DNA, 16 bp, R. norvegicus
ttccaggaatcccagg

SEQ ID NO: 529805 - DNA, 16 bp, R. norvegicus
ttccaggacaaaaaca

SEQ ID NO: 529806 - DNA, 16 bp, R. norvegicus
ttccaggacaaccagg

SEQ ID NO: 529807 - DNA, 16 bp, R. norvegicus
ttccaggacagacaga

SEQ ID NO: 529808 - DNA, 16 bp, R. norvegicus
ttccaggacagccaga

SEQ ID NO: 529809 - DNA, 16 bp, R. norvegicus
ttccaggacagcccag

SEQ ID NO: 529810 - DNA, 16 bp, R. norvegicus
ttccaggacagcctgg

SEQ ID NO: 529811 - DNA, 16 bp, R. norvegicus
ttccaggacccaatgg

SEQ ID NO: 529812 - DNA, 16 bp, R. norvegicus
ttccaggactgccagg

SEQ ID NO: 529813 - DNA, 16 bp, R. norvegicus
ttccaggactttgatc

SEQ ID NO: 529814 - DNA, 16 bp, R. norvegicus
ttccaggagacccagg

SEQ ID NO: 529815 - DNA, 16 bp, R. norvegicus
ttccaggagagtcagg

SEQ ID NO: 529816 - DNA, 16 bp, R. norvegicus
ttccaggagcttctgt

SEQ ID NO: 529817 - DNA, 16 bp, R. norvegicus
ttccaggatacccagg

SEQ ID NO: 529818 - DNA, 16 bp, R. norvegicus
ttccaggatttaaaaa

SEQ ID NO: 529819 - DNA, 16 bp, R. norvegicus
ttccaggcaagcctgg

SEQ ID NO: 529820 - DNA, 16 bp, R. norvegicus
ttccaggccaaccaga

SEQ ID NO: 529821 - DNA, 16 bp, R. norvegicus
ttccaggccagccatg

SEQ ID NO: 529822 - DNA, 16 bp, R. norvegicus
ttccaggccagcccag

SEQ ID NO: 529823 - DNA, 16 bp, R. norvegicus
ttccaggccagtgagg

SEQ ID NO: 529824 - DNA, 16 bp, R. norvegicus
ttccaggccagtttgg

SEQ ID NO: 529825 - DNA, 16 bp, R. norvegicus
ttccaggccatcctgg

SEQ ID NO: 529826 - DNA, 16 bp, R. norvegicus
ttccaggcctgcctgg

SEQ ID NO: 529827 - DNA, 16 bp, R. norvegicus
ttccaggctagcccag

SEQ ID NO: 529828 - DNA, 16 bp, R. norvegicus
ttccaggctggcctgg

SEQ ID NO: 529829 - DNA, 16 bp, R. norvegicus
ttccagggatcgaact

SEQ ID NO: 529830 - DNA, 16 bp, R. norvegicus
ttccagggcagtcagg

SEQ ID NO: 529831 - DNA, 16 bp, R. norvegicus
ttccaggggatccaat

SEQ ID NO: 529832 - DNA, 16 bp, R. norvegicus
ttccaggtccctccct

SEQ ID NO: 529833 - DNA, 16 bp, R. norvegicus
ttccaggtttcccttc

SEQ ID NO: 529834 - DNA, 16 bp, R. norvegicus
ttccagtaccaggtat

SEQ ID NO: 529835 - DNA, 16 bp, R. norvegicus
ttccagtaccatgaat

SEQ ID NO: 529836 - DNA, 16 bp, R. norvegicus
ttccagtcctggcttc

SEQ ID NO: 529837 - DNA, 16 bp, R. norvegicus
ttccagtctcttcctc

SEQ ID NO: 529838 - DNA, 16 bp, R. norvegicus
ttccagtctcttgagg

SEQ ID NO: 529839 - DNA, 16 bp, R. norvegicus
ttccagtgatgccaga

SEQ ID NO: 529840 - DNA, 16 bp, R. norvegicus
ttccagtggaaggagg

SEQ ID NO: 529841 - DNA, 16 bp, R. norvegicus
ttccagtgtgatgggg

SEQ ID NO: 529842 - DNA, 16 bp, R. norvegicus
ttccagtgtttctgtt

SEQ ID NO: 529843 - DNA, 16 bp, R. norvegicus
ttccagttcactctct

SEQ ID NO: 529844 - DNA, 16 bp, R. norvegicus
ttccagttccagaaga

SEQ ID NO: 529845 - DNA, 16 bp, R. norvegicus
ttccagtttcaggaga

SEQ ID NO: 529846 - DNA, 16 bp, R. norvegicus
ttccagtttcctgagg

SEQ ID NO: 529847 - DNA, 16 bp, R. norvegicus
ttccagttttcctgga

SEQ ID NO: 529848 - DNA, 16 bp, R. norvegicus
ttccagttttgttcag

SEQ ID NO: 529849 - DNA, 16 bp, R. norvegicus
ttccataatttctttc

SEQ ID NO: 529850 - DNA, 16 bp, R. norvegicus
ttccataccagcaaaa

SEQ ID NO: 529851 - DNA, 16 bp, R. norvegicus
ttccatattcctcagt

SEQ ID NO: 529852 - DNA, 16 bp, R. norvegicus
ttccatcactgtgaca

SEQ ID NO: 529853 - DNA, 16 bp, R. norvegicus
ttccatcagctgctgg

SEQ ID NO: 529854 - DNA, 16 bp, R. norvegicus
ttccatcagtttctgg

SEQ ID NO: 529855 - DNA, 16 bp, R. norvegicus
ttccatccatgtgcct

SEQ ID NO: 529856 - DNA, 16 bp, R. norvegicus
ttccatcccagacccc

SEQ ID NO: 529857 - DNA, 16 bp, R. norvegicus
ttccatgaaaaaaaaa

SEQ ID NO: 529858 - DNA, 16 bp, R. norvegicus
ttccatgacagaagaa

SEQ ID NO: 529859 - DNA, 16 bp, R. norvegicus
ttccatgctcatggtt

SEQ ID NO: 529860 - DNA, 16 bp, R. norvegicus
ttccatgggtatgtgg

SEQ ID NO: 529861 - DNA, 16 bp, R. norvegicus
ttccatgtttcccctc

SEQ ID NO: 529862 - DNA, 16 bp, R. norvegicus
ttccattcatttggct

SEQ ID NO: 529863 - DNA, 16 bp, R. norvegicus
ttccattcccagcatc

SEQ ID NO: 529864 - DNA, 16 bp, R. norvegicus
ttccattggtgatgct

SEQ ID NO: 529865 - DNA, 19 bp, R. norvegicus
ttccattgttggtgggatt

SEQ ID NO: 529866 - DNA, 16 bp, R. norvegicus
ttccatttcatttctg

SEQ ID NO: 529867 - DNA, 16 bp, R. norvegicus
ttccattttctgagaa

SEQ ID NO: 529868 - DNA, 16 bp, R. norvegicus
ttccattttctggctg

SEQ ID NO: 529869 - DNA, 16 bp, R. norvegicus
ttccattttgttttaa

SEQ ID NO: 529870 - DNA, 16 bp, R. norvegicus
ttcccaaaagatgccc

SEQ ID NO: 529871 - DNA, 16 bp, R. norvegicus
ttcccaaacagtttca

SEQ ID NO: 529872 - DNA, 17 bp, R. norvegicus
ttcccaaatccctatga

SEQ ID NO: 529873 - DNA, 16 bp, R. norvegicus
ttcccaaatgctggaa

SEQ ID NO: 529874 - DNA, 16 bp, R. norvegicus
ttcccaacagtgggga

SEQ ID NO: 529875 - DNA, 16 bp, R. norvegicus
ttcccaaccaaaaaga

SEQ ID NO: 529876 - DNA, 16 bp, R. norvegicus
ttcccaactgctggga

SEQ ID NO: 529877 - DNA, 16 bp, R. norvegicus
ttcccaaggactggag

SEQ ID NO: 529878 - DNA, 16 bp, R. norvegicus
ttcccaaggcaggtcg

SEQ ID NO: 529879 - DNA, 16 bp, R. norvegicus
ttcccaagtactggaa

SEQ ID NO: 529880 - DNA, 16 bp, R. norvegicus
ttcccaagtgctggga

SEQ ID NO: 529881 - DNA, 16 bp, R. norvegicus
ttcccaagttctcagg

SEQ ID NO: 529882 - DNA, 16 bp, R. norvegicus
ttcccaatctgtaagt

SEQ ID NO: 529883 - DNA, 16 bp, R. norvegicus
ttcccaatggccagga

SEQ ID NO: 529884 - DNA, 16 bp, R. norvegicus
ttcccacagctctctg

SEQ ID NO: 529885 - DNA, 16 bp, R. norvegicus
ttcccactgaggacag

SEQ ID NO: 529886 - DNA, 16 bp, R. norvegicus
ttcccactgatgcctg

SEQ ID NO: 529887 - DNA, 16 bp, R. norvegicus
ttcccagaacccacag

SEQ ID NO: 529888 - DNA, 16 bp, R. norvegicus
ttcccagaacccactt

SEQ ID NO: 529889 - DNA, 16 bp, R. norvegicus
ttcccagaacccatgt

SEQ ID NO: 529890 - DNA, 16 bp, R. norvegicus
ttcccagaagaccttt

SEQ ID NO: 529891 - DNA, 16 bp, R. norvegicus
ttcccagaagccatgt

SEQ ID NO: 529892 - DNA, 16 bp, R. norvegicus
ttcccagaatgcactg

SEQ ID NO: 529893 - DNA, 16 bp, R. norvegicus
ttcccagaattctctc

SEQ ID NO: 529894 - DNA, 16 bp, R. norvegicus
ttcccagagttccttt

SEQ ID NO: 529895 - DNA, 16 bp, R. norvegicus
ttcccagatcctgctg

SEQ ID NO: 529896 - DNA, 16 bp, R. norvegicus
ttcccagcaccagcat

SEQ ID NO: 529897 - DNA, 16 bp, R. norvegicus
ttcccagcacccaaat

SEQ ID NO: 529898 - DNA, 16 bp, R. norvegicus
ttcccagcacccacat

SEQ ID NO: 529899 - DNA, 16 bp, R. norvegicus
ttcccagcaccccatg

SEQ ID NO: 529900 - DNA, 16 bp, R. norvegicus
ttcccagcatccacat

SEQ ID NO: 529901 - DNA, 16 bp, R. norvegicus
ttcccagcatccattt

SEQ ID NO: 529902 - DNA, 16 bp, R. norvegicus
ttcccagcatccctca

SEQ ID NO: 529903 - DNA, 16 bp, R. norvegicus
ttcccagcatccctgt

SEQ ID NO: 529904 - DNA, 16 bp, R. norvegicus
ttcccagcatgctctg

SEQ ID NO: 529905 - DNA, 16 bp, R. norvegicus
ttcccagccaacatcc

SEQ ID NO: 529906 - DNA, 16 bp, R. norvegicus
ttcccagccagcctca

SEQ ID NO: 529907 - DNA, 16 bp, R. norvegicus
ttcccagcctccacat

SEQ ID NO: 529908 - DNA, 16 bp, R. norvegicus
ttcccagctcccacac

SEQ ID NO: 529909 - DNA, 16 bp, R. norvegicus
ttcccagctggtggca

SEQ ID NO: 529910 - DNA, 16 bp, R. norvegicus
ttcccagcttctggct

SEQ ID NO: 529911 - DNA, 16 bp, R. norvegicus
ttcccagggaggtctt

SEQ ID NO: 529912 - DNA, 16 bp, R. norvegicus
ttcccagtcttgtctg

SEQ ID NO: 529913 - DNA, 16 bp, R. norvegicus
ttcccagtgggtacca

SEQ ID NO: 529914 - DNA, 16 bp, R. norvegicus
ttcccagtgtgacagc

SEQ ID NO: 529915 - DNA, 16 bp, R. norvegicus
ttcccagtttcctctc

SEQ ID NO: 529916 - DNA, 16 bp, R. norvegicus
ttcccagtttcttctc

SEQ ID NO: 529917 - DNA, 16 bp, R. norvegicus
ttcccagttttccctc

SEQ ID NO: 529918 - DNA, 16 bp, R. norvegicus
ttcccagttttccctt

SEQ ID NO: 529919 - DNA, 16 bp, R. norvegicus
ttcccatcatgctttg

SEQ ID NO: 529920 - DNA, 16 bp, R. norvegicus
ttcccatcctttaaaa

SEQ ID NO: 529921 - DNA, 16 bp, R. norvegicus
ttcccatctgctgctg

SEQ ID NO: 529922 - DNA, 16 bp, R. norvegicus
ttcccatctgcttcag

SEQ ID NO: 529923 - DNA, 16 bp, R. norvegicus
ttcccatcttcccaag

SEQ ID NO: 529924 - DNA, 16 bp, R. norvegicus
ttcccattcaaaccac

SEQ ID NO: 529925 - DNA, 16 bp, R. norvegicus
ttccccaaactcttcc

SEQ ID NO: 529926 - DNA, 16 bp, R. norvegicus
ttccccaacctaaaaa

SEQ ID NO: 529927 - DNA, 16 bp, R. norvegicus
ttccccaagaaaaaga

SEQ ID NO: 529928 - DNA, 16 bp, R. norvegicus
ttccccaagtttcttt

SEQ ID NO: 529929 - DNA, 16 bp, R. norvegicus
ttccccaattttcttc

SEQ ID NO: 529930 - DNA, 17 bp, R. norvegicus
ttccccaccaagcagga

SEQ ID NO: 529931 - DNA, 16 bp, R. norvegicus
ttccccaccacagcaa

SEQ ID NO: 529932 - DNA, 16 bp, R. norvegicus
ttccccactgagccat

SEQ ID NO: 529933 - DNA, 16 bp, R. norvegicus
ttccccacttctgctt

SEQ ID NO: 529934 - DNA, 16 bp, R. norvegicus
ttccccagagctaagg

SEQ ID NO: 529935 - DNA, 16 bp, R. norvegicus
ttccccagctcttcca

SEQ ID NO: 529936 - DNA, 16 bp, R. norvegicus
ttccccaggtggggca

SEQ ID NO: 529937 - DNA, 16 bp, R. norvegicus
ttccccagtgcctgtg

SEQ ID NO: 529938 - DNA, 16 bp, R. norvegicus
ttccccagtgtagggg

SEQ ID NO: 529939 - DNA, 16 bp, R. norvegicus
ttccccatctttatta

SEQ ID NO: 529940 - DNA, 16 bp, R. norvegicus
ttcccccacaagttct

SEQ ID NO: 529941 - DNA, 16 bp, R. norvegicus
ttcccccagttctttt

SEQ ID NO: 529942 - DNA, 16 bp, R. norvegicus
ttccccgtttcctgtc

SEQ ID NO: 529943 - DNA, 16 bp, R. norvegicus
ttcccctacactggtg

SEQ ID NO: 529944 - DNA, 16 bp, R. norvegicus
ttcccctacccaacca

SEQ ID NO: 529945 - DNA, 16 bp, R. norvegicus
ttcccctggaattgga

SEQ ID NO: 529946 - DNA, 16 bp, R. norvegicus
ttcccctgtgcccatg

SEQ ID NO: 529947 - DNA, 16 bp, R. norvegicus
ttccccttcccaggaa

SEQ ID NO: 529948 - DNA, 16 bp, R. norvegicus
ttcccctttgaaagaa

SEQ ID NO: 529949 - DNA, 16 bp, R. norvegicus
ttcccctttgagtttg

SEQ ID NO: 529950 - DNA, 21 bp, R. norvegicus
ttcccggttgctgccacagca

SEQ ID NO: 529951 - DNA, 33 bp, R. norvegicus
ttcccggttgctgccacagcggagaggacttag

SEQ ID NO: 529952 - DNA, 16 bp, R. norvegicus
ttccctaccatgatgg

SEQ ID NO: 529953 - DNA, 16 bp, R. norvegicus
ttccctagtttctttt

SEQ ID NO: 529954 - DNA, 16 bp, R. norvegicus
ttccctcagattctgt

SEQ ID NO: 529955 - DNA, 16 bp, R. norvegicus
ttccctcaggaggaga

SEQ ID NO: 529956 - DNA, 16 bp, R. norvegicus
ttccctcccagtccac

SEQ ID NO: 529957 - DNA, 16 bp, R. norvegicus
ttccctctcctcactg

SEQ ID NO: 529958 - DNA, 16 bp, R. norvegicus
ttccctctctacacag

SEQ ID NO: 529959 - DNA, 16 bp, R. norvegicus
ttccctctctacaggt

SEQ ID NO: 529960 - DNA, 16 bp, R. norvegicus
ttccctctgacctcca

SEQ ID NO: 529961 - DNA, 16 bp, R. norvegicus
ttccctctgcctccca

SEQ ID NO: 529962 - DNA, 16 bp, R. norvegicus
ttccctctgcctcctg

SEQ ID NO: 529963 - DNA, 16 bp, R. norvegicus
ttccctctggctctta

SEQ ID NO: 529964 - DNA, 16 bp, R. norvegicus
ttccctcttcccaaat

SEQ ID NO: 529965 - DNA, 16 bp, R. norvegicus
ttccctcttcccagat

SEQ ID NO: 529966 - DNA, 16 bp, R. norvegicus
ttccctgccaagggca

SEQ ID NO: 529967 - DNA, 16 bp, R. norvegicus
ttccctgcctctgctt

SEQ ID NO: 529968 - DNA, 16 bp, R. norvegicus
ttccctggacctggag

SEQ ID NO: 529969 - DNA, 16 bp, R. norvegicus
ttccctgggcaggtgg

SEQ ID NO: 529970 - DNA, 16 bp, R. norvegicus
ttccctggggaagaat

SEQ ID NO: 529971 - DNA, 16 bp, R. norvegicus
ttccctggggaaggcc

SEQ ID NO: 529972 - DNA, 16 bp, R. norvegicus
ttccctgggtcctcaa

SEQ ID NO: 529973 - DNA, 16 bp, R. norvegicus
ttccctggtgactaaa

SEQ ID NO: 529974 - DNA, 16 bp, R. norvegicus
ttccctggtttctgtt

SEQ ID NO: 529975 - DNA, 16 bp, R. norvegicus
ttcccttatgaacata

SEQ ID NO: 529976 - DNA, 16 bp, R. norvegicus
ttcccttcaggaaaga

SEQ ID NO: 529977 - DNA, 16 bp, R. norvegicus
ttcccttcaggtccag

SEQ ID NO: 529978 - DNA, 16 bp, R. norvegicus
ttcccttccccaacca

SEQ ID NO: 529979 - DNA, 16 bp, R. norvegicus
ttcccttgcagttttt

SEQ ID NO: 529980 - DNA, 16 bp, R. norvegicus
ttcccttggtttctgt

SEQ ID NO: 529981 - DNA, 16 bp, R. norvegicus
ttccctttcccagcag

SEQ ID NO: 529982 - DNA, 16 bp, R. norvegicus
ttccctttccccggtt

SEQ ID NO: 529983 - DNA, 18 bp, R. norvegicus
ttccctttgggttcacaa

SEQ ID NO: 529984 - DNA, 16 bp, R. norvegicus
ttccctttttaaaaaa

SEQ ID NO: 529985 - DNA, 16 bp, R. norvegicus
ttccctttttaagaag

SEQ ID NO: 529986 - DNA, 16 bp, R. norvegicus
ttccggagctggggac

SEQ ID NO: 529987 - DNA, 16 bp, R. norvegicus
ttccggaggacctggg

SEQ ID NO: 529988 - DNA, 16 bp, R. norvegicus
ttccgggagcttctgt

SEQ ID NO: 529989 - DNA, 16 bp, R. norvegicus
ttcctaacccagaagc

SEQ ID NO: 529990 - DNA, 17 bp, R. norvegicus
ttcctaatagtcccaaa

SEQ ID NO: 529991 - DNA, 16 bp, R. norvegicus
ttcctacaacagcagg

SEQ ID NO: 529992 - DNA, 16 bp, R. norvegicus
ttcctagcacttacat

SEQ ID NO: 529993 - DNA, 16 bp, R. norvegicus
ttcctaggcaagcatt

SEQ ID NO: 529994 - DNA, 16 bp, R. norvegicus
ttcctatatacatttc

SEQ ID NO: 529995 - DNA, 16 bp, R. norvegicus
ttcctatggggtcacc

SEQ ID NO: 529996 - DNA, 16 bp, R. norvegicus
ttcctcaaaatgttgg

SEQ ID NO: 529997 - DNA, 16 bp, R. norvegicus
ttcctcaaattctttc

SEQ ID NO: 529998 - DNA, 16 bp, R. norvegicus
ttcctcaagatctgga

SEQ ID NO: 529999 - DNA, 16 bp, R. norvegicus
ttcctcaattgctttc

SEQ ID NO: 530000 - DNA, 16 bp, R. norvegicus
ttcctcacaccacaca

SEQ ID NO: 530001 - DNA, 16 bp, R. norvegicus
ttcctcagaaaactag

SEQ ID NO: 530002 - DNA, 16 bp, R. norvegicus
ttcctcagccatcatc

SEQ ID NO: 530003 - DNA, 16 bp, R. norvegicus
ttcctcagcctcctga

SEQ ID NO: 530004 - DNA, 16 bp, R. norvegicus
ttcctcagctatgaat

SEQ ID NO: 530005 - DNA, 21 bp, R. norvegicus
ttcctcagctgtgacttcttt

SEQ ID NO: 530006 - DNA, 16 bp, R. norvegicus
ttcctcagcttcctca

SEQ ID NO: 530007 - DNA, 17 bp, R. norvegicus
ttcctcaggaaattgga

SEQ ID NO: 530008 - DNA, 16 bp, R. norvegicus
ttcctcaggatcttct

SEQ ID NO: 530009 - DNA, 16 bp, R. norvegicus
ttcctcagtccctacc

SEQ ID NO: 530010 - DNA, 16 bp, R. norvegicus
ttcctcataaaattgg

SEQ ID NO: 530011 - DNA, 16 bp, R. norvegicus
ttcctcatcctcttca

SEQ ID NO: 530012 - DNA, 16 bp, R. norvegicus
ttcctcatcttcatct

SEQ ID NO: 530013 - DNA, 16 bp, R. norvegicus
ttcctcatgctgtgac

SEQ ID NO: 530014 - DNA, 16 bp, R. norvegicus
ttcctcattttccaca

SEQ ID NO: 530015 - DNA, 16 bp, R. norvegicus
ttcctccaagtcagtt

SEQ ID NO: 530016 - DNA, 16 bp, R. norvegicus
ttcctccaatgatgaa

SEQ ID NO: 530017 - DNA, 16 bp, R. norvegicus
ttcctccagaaaggcc

SEQ ID NO: 530018 - DNA, 16 bp, R. norvegicus
ttcctccagaatttct

SEQ ID NO: 530019 - DNA, 16 bp, R. norvegicus
ttcctccagcaagacc

SEQ ID NO: 530020 - DNA, 16 bp, R. norvegicus
ttcctccagcagctga

SEQ ID NO: 530021 - DNA, 16 bp, R. norvegicus
ttcctccattttggaa

SEQ ID NO: 530022 - DNA, 16 bp, R. norvegicus
ttcctccccaagttgt

SEQ ID NO: 530023 - DNA, 16 bp, R. norvegicus
ttcctcccttaagctg

SEQ ID NO: 530024 - DNA, 16 bp, R. norvegicus
ttcctcctcatcctca

SEQ ID NO: 530025 - DNA, 16 bp, R. norvegicus
ttcctcctcctgaggc

SEQ ID NO: 530026 - DNA, 16 bp, R. norvegicus
ttcctcctgcagcaga

SEQ ID NO: 530027 - DNA, 16 bp, R. norvegicus
ttcctcctgcaggaga

SEQ ID NO: 530028 - DNA, 16 bp, R. norvegicus
ttcctccttttaaaaa

SEQ ID NO: 530029 - DNA, 16 bp, R. norvegicus
ttcctctaaagtcaga

SEQ ID NO: 530030 - DNA, 16 bp, R. norvegicus
ttcctctaactcttcc

SEQ ID NO: 530031 - DNA, 16 bp, R. norvegicus
ttcctctacattgggg

SEQ ID NO: 530032 - DNA, 16 bp, R. norvegicus
ttcctctcctccaagt

SEQ ID NO: 530033 - DNA, 16 bp, R. norvegicus
ttcctctcctctcagt

SEQ ID NO: 530034 - DNA, 16 bp, R. norvegicus
ttcctctcctgacttc

SEQ ID NO: 530035 - DNA, 16 bp, R. norvegicus
ttcctctctaaaggct

SEQ ID NO: 530036 - DNA, 16 bp, R. norvegicus
ttcctctctgcaggct

SEQ ID NO: 530037 - DNA, 16 bp, R. norvegicus
ttcctctctgtgtcct

SEQ ID NO: 530038 - DNA, 16 bp, R. norvegicus
ttcctctgaagaccca

SEQ ID NO: 530039 - DNA, 16 bp, R. norvegicus
ttcctctgaatatgta

SEQ ID NO: 530040 - DNA, 16 bp, R. norvegicus
ttcctctgattctgtg

SEQ ID NO: 530041 - DNA, 16 bp, R. norvegicus
ttcctctgcctctgcc

SEQ ID NO: 530042 - DNA, 16 bp, R. norvegicus
ttcctctgctgagaat

SEQ ID NO: 530043 - DNA, 16 bp, R. norvegicus
ttcctctggctctgtt

SEQ ID NO: 530044 - DNA, 16 bp, R. norvegicus
ttcctctgtctctctg

SEQ ID NO: 530045 - DNA, 16 bp, R. norvegicus
ttcctctgtggtctct

SEQ ID NO: 530046 - DNA, 16 bp, R. norvegicus
ttcctcttcccaaata

SEQ ID NO: 530047 - DNA, 16 bp, R. norvegicus
ttcctcttctcagtga

SEQ ID NO: 530048 - DNA, 16 bp, R. norvegicus
ttcctcttcttgagct

SEQ ID NO: 530049 - DNA, 16 bp, R. norvegicus
ttcctcttgaacttca

SEQ ID NO: 530050 - DNA, 16 bp, R. norvegicus
ttcctcttggcacagc

SEQ ID NO: 530051 - DNA, 16 bp, R. norvegicus
ttcctcttgggcaagg

SEQ ID NO: 530052 - DNA, 16 bp, R. norvegicus
ttcctcttgggccggg

SEQ ID NO: 530053 - DNA, 16 bp, R. norvegicus
ttcctctttccccaca

SEQ ID NO: 530054 - DNA, 16 bp, R. norvegicus
ttcctcttttccaact

SEQ ID NO: 530055 - DNA, 16 bp, R. norvegicus
ttcctgaaaaagaaaa

SEQ ID NO: 530056 - DNA, 44 bp, R. norvegicus
ttcctgaacaaaacaccaatggcttatgctctaagatcaagaat

SEQ ID NO: 530057 - DNA, 16 bp, R. norvegicus
ttcctgaacctggagc

SEQ ID NO: 530058 - DNA, 18 bp, R. norvegicus
ttcctgaactaaacacca

SEQ ID NO: 530059 - DNA, 16 bp, R. norvegicus
ttcctgaagcttttga

SEQ ID NO: 530060 - DNA, 16 bp, R. norvegicus
ttcctgaatattttgg

SEQ ID NO: 530061 - DNA, 16 bp, R. norvegicus
ttcctgacctctttcc

SEQ ID NO: 530062 - DNA, 16 bp, R. norvegicus
ttcctgacctgctgga

SEQ ID NO: 530063 - DNA, 16 bp, R. norvegicus
ttcctgactccaggtt

SEQ ID NO: 530064 - DNA, 16 bp, R. norvegicus
ttcctgagaactcaga

SEQ ID NO: 530065 - DNA, 16 bp, R. norvegicus
ttcctgagacagaggg

SEQ ID NO: 530066 - DNA, 16 bp, R. norvegicus
ttcctgagaggctcag

SEQ ID NO: 530067 - DNA, 16 bp, R. norvegicus
ttcctgagaggctgtg

SEQ ID NO: 530068 - DNA, 16 bp, R. norvegicus
ttcctgaggctgcaga

SEQ ID NO: 530069 - DNA, 16 bp, R. norvegicus
ttcctgagtgctggga

SEQ ID NO: 530070 - DNA, 16 bp, R. norvegicus
ttcctgatcctcctgc

SEQ ID NO: 530071 - DNA, 16 bp, R. norvegicus
ttcctgattttgttaa

SEQ ID NO: 530072 - DNA, 16 bp, R. norvegicus
ttcctgcacaaacacc

SEQ ID NO: 530073 - DNA, 16 bp, R. norvegicus
ttcctgcagatcaaca

SEQ ID NO: 530074 - DNA, 16 bp, R. norvegicus
ttcctgcagatttcca

SEQ ID NO: 530075 - DNA, 16 bp, R. norvegicus
ttcctgcagcagaaaa

SEQ ID NO: 530076 - DNA, 16 bp, R. norvegicus
ttcctgcagcagccag

SEQ ID NO: 530077 - DNA, 16 bp, R. norvegicus
ttcctgcagtctctgc

SEQ ID NO: 530078 - DNA, 16 bp, R. norvegicus
ttcctgccaagtttct

SEQ ID NO: 530079 - DNA, 16 bp, R. norvegicus
ttcctgccatcttctc

SEQ ID NO: 530080 - DNA, 16 bp, R. norvegicus
ttcctgccatgataac

SEQ ID NO: 530081 - DNA, 16 bp, R. norvegicus
ttcctgccccagcttc

SEQ ID NO: 530082 - DNA, 16 bp, R. norvegicus
ttcctgccctgactgc

SEQ ID NO: 530083 - DNA, 16 bp, R. norvegicus
ttcctgcctcaagatc

SEQ ID NO: 530084 - DNA, 16 bp, R. norvegicus
ttcctgcctccacacc

SEQ ID NO: 530085 - DNA, 16 bp, R. norvegicus
ttcctgcctccatttc

SEQ ID NO: 530086 - DNA, 16 bp, R. norvegicus
ttcctgcctcccaagt

SEQ ID NO: 530087 - DNA, 16 bp, R. norvegicus
ttcctgcctctgtttc

SEQ ID NO: 530088 - DNA, 16 bp, R. norvegicus
ttcctgccttcatttc

SEQ ID NO: 530089 - DNA, 16 bp, R. norvegicus
ttcctgccttttgcta

SEQ ID NO: 530090 - DNA, 16 bp, R. norvegicus
ttcctgctccaccatc

SEQ ID NO: 530091 - DNA, 16 bp, R. norvegicus
ttcctgctcctgctgc

SEQ ID NO: 530092 - DNA, 16 bp, R. norvegicus
ttcctgctctgatgtc

SEQ ID NO: 530093 - DNA, 16 bp, R. norvegicus
ttcctgctctggcttc

SEQ ID NO: 530094 - DNA, 16 bp, R. norvegicus
ttcctgctgagaatgt

SEQ ID NO: 530095 - DNA, 16 bp, R. norvegicus
ttcctgctgattaagg

SEQ ID NO: 530096 - DNA, 16 bp, R. norvegicus
ttcctgctgcctgcct

SEQ ID NO: 530097 - DNA, 16 bp, R. norvegicus
ttcctgctgcctgtag

SEQ ID NO: 530098 - DNA, 16 bp, R. norvegicus
ttcctgctgctcctgg

SEQ ID NO: 530099 - DNA, 16 bp, R. norvegicus
ttcctgctgcttgctg

SEQ ID NO: 530100 - DNA, 16 bp, R. norvegicus
ttcctgcttccaagtt

SEQ ID NO: 530101 - DNA, 16 bp, R. norvegicus
ttcctgcttcctgcct

SEQ ID NO: 530102 - DNA, 16 bp, R. norvegicus
ttcctgcttggcctgg

SEQ ID NO: 530103 - DNA, 16 bp, R. norvegicus
ttcctgctttcctgtc

SEQ ID NO: 530104 - DNA, 16 bp, R. norvegicus
ttcctggaacagccac

SEQ ID NO: 530105 - DNA, 16 bp, R. norvegicus
ttcctggaacagggtg

SEQ ID NO: 530106 - DNA, 16 bp, R. norvegicus
ttcctggaagtcagag

SEQ ID NO: 530107 - DNA, 16 bp, R. norvegicus
ttcctggaatctatga

SEQ ID NO: 530108 - DNA, 16 bp, R. norvegicus
ttcctggaatgctggg

SEQ ID NO: 530109 - DNA, 16 bp, R. norvegicus
ttcctggagaagactg

SEQ ID NO: 530110 - DNA, 16 bp, R. norvegicus
ttcctggagcctccag

SEQ ID NO: 530111 - DNA, 16 bp, R. norvegicus
ttcctggagctgagga

SEQ ID NO: 530112 - DNA, 16 bp, R. norvegicus
ttcctggaggaggtgg

SEQ ID NO: 530113 - DNA, 16 bp, R. norvegicus
ttcctggatgaaagac

SEQ ID NO: 530114 - DNA, 16 bp, R. norvegicus
ttcctggatgaccagg

SEQ ID NO: 530115 - DNA, 16 bp, R. norvegicus
ttcctggcacctggga

SEQ ID NO: 530116 - DNA, 16 bp, R. norvegicus
ttcctggcactggagg

SEQ ID NO: 530117 - DNA, 16 bp, R. norvegicus
ttcctggcatctgtga

SEQ ID NO: 530118 - DNA, 16 bp, R. norvegicus
ttcctggccagcctct

SEQ ID NO: 530119 - DNA, 16 bp, R. norvegicus
ttcctggcctctgtgg

SEQ ID NO: 530120 - DNA, 16 bp, R. norvegicus
ttcctggctacaggag

SEQ ID NO: 530121 - DNA, 16 bp, R. norvegicus
ttcctggctgccttca

SEQ ID NO: 530122 - DNA, 16 bp, R. norvegicus
ttcctggctggcctgg

SEQ ID NO: 530123 - DNA, 16 bp, R. norvegicus
ttcctgggaactctgg

SEQ ID NO: 530124 - DNA, 16 bp, R. norvegicus
ttcctgggagctctga

SEQ ID NO: 530125 - DNA, 16 bp, R. norvegicus
ttcctgggcatgtacc

SEQ ID NO: 530126 - DNA, 16 bp, R. norvegicus
ttcctggggagacatg

SEQ ID NO: 530127 - DNA, 16 bp, R. norvegicus
ttcctggggcctcaag

SEQ ID NO: 530128 - DNA, 16 bp, R. norvegicus
ttcctggggctgggga

SEQ ID NO: 530129 - DNA, 16 bp, R. norvegicus
ttcctggggtccctga

SEQ ID NO: 530130 - DNA, 16 bp, R. norvegicus
ttcctggtgcccacag

SEQ ID NO: 530131 - DNA, 16 bp, R. norvegicus
ttcctggtgtcctcca

SEQ ID NO: 530132 - DNA, 16 bp, R. norvegicus
ttcctggttcctgtgg

SEQ ID NO: 530133 - DNA, 16 bp, R. norvegicus
ttcctggttgctgcag

SEQ ID NO: 530134 - DNA, 27 bp, R. norvegicus
ttcctggttgctgccgccacagagagc

SEQ ID NO: 530135 - DNA, 19 bp, R. norvegicus
ttcctggttgctgccgccg

SEQ ID NO: 530136 - DNA, 16 bp, R. norvegicus
ttcctggtttcctgtc

SEQ ID NO: 530137 - DNA, 16 bp, R. norvegicus
ttcctgtaagtttgct

SEQ ID NO: 530138 - DNA, 16 bp, R. norvegicus
ttcctgtacatttgtg

SEQ ID NO: 530139 - DNA, 16 bp, R. norvegicus
ttcctgtacccagagg

SEQ ID NO: 530140 - DNA, 16 bp, R. norvegicus
ttcctgtataccaaca

SEQ ID NO: 530141 - DNA, 16 bp, R. norvegicus
ttcctgtatctgctga

SEQ ID NO: 530142 - DNA, 16 bp, R. norvegicus
ttcctgtcaccctgca

SEQ ID NO: 530143 - DNA, 16 bp, R. norvegicus
ttcctgtcagccagca

SEQ ID NO: 530144 - DNA, 16 bp, R. norvegicus
ttcctgtcagtctgca

SEQ ID NO: 530145 - DNA, 16 bp, R. norvegicus
ttcctgtcatgatgat

SEQ ID NO: 530146 - DNA, 16 bp, R. norvegicus
ttcctgtccataaccc

SEQ ID NO: 530147 - DNA, 16 bp, R. norvegicus
ttcctgtccatcagct

SEQ ID NO: 530148 - DNA, 16 bp, R. norvegicus
ttcctgtccccacagc

SEQ ID NO: 530149 - DNA, 16 bp, R. norvegicus
ttcctgtcctgccttc

SEQ ID NO: 530150 - DNA, 16 bp, R. norvegicus
ttcctgtctcaaagaa

SEQ ID NO: 530151 - DNA, 16 bp, R. norvegicus
ttcctgtctcagtctc

SEQ ID NO: 530152 - DNA, 16 bp, R. norvegicus
ttcctgtctctgccct

SEQ ID NO: 530153 - DNA, 16 bp, R. norvegicus
ttcctgtctgcctgca

SEQ ID NO: 530154 - DNA, 16 bp, R. norvegicus
ttcctgtgaagctata

SEQ ID NO: 530155 - DNA, 16 bp, R. norvegicus
ttcctgtgcctgcctc

SEQ ID NO: 530156 - DNA, 16 bp, R. norvegicus
ttcctgtggattttca

SEQ ID NO: 530157 - DNA, 16 bp, R. norvegicus
ttcctgtgggattcct

SEQ ID NO: 530158 - DNA, 16 bp, R. norvegicus
ttcctgtgggcagcag

SEQ ID NO: 530159 - DNA, 16 bp, R. norvegicus
ttcctgtgggcctggg

SEQ ID NO: 530160 - DNA, 16 bp, R. norvegicus
ttcctgtggggttgcc

SEQ ID NO: 530161 - DNA, 16 bp, R. norvegicus
ttcctgtgtccctgtg

SEQ ID NO: 530162 - DNA, 16 bp, R. norvegicus
ttcctgtgtcctgaga

SEQ ID NO: 530163 - DNA, 16 bp, R. norvegicus
ttcctgtgtccttgga

SEQ ID NO: 530164 - DNA, 16 bp, R. norvegicus
ttcctgtgtgtgcatg

SEQ ID NO: 530165 - DNA, 16 bp, R. norvegicus
ttcctgtgtttctctg

SEQ ID NO: 530166 - DNA, 16 bp, R. norvegicus
ttcctgttactttcat

SEQ ID NO: 530167 - DNA, 16 bp, R. norvegicus
ttcctgttatagtcat

SEQ ID NO: 530168 - DNA, 16 bp, R. norvegicus
ttcctgttcttgcctc

SEQ ID NO: 530169 - DNA, 16 bp, R. norvegicus
ttcctgttttcttaca

SEQ ID NO: 530170 - DNA, 16 bp, R. norvegicus
ttccttagtgtctgtt

SEQ ID NO: 530171 - DNA, 16 bp, R. norvegicus
ttccttatctgttttg

SEQ ID NO: 530172 - DNA, 16 bp, R. norvegicus
ttccttcaacaaagcc

SEQ ID NO: 530173 - DNA, 16 bp, R. norvegicus
ttccttcacaaaacat

SEQ ID NO: 530174 - DNA, 16 bp, R. norvegicus
ttccttcacatgtttg

SEQ ID NO: 530175 - DNA, 16 bp, R. norvegicus
ttccttcaccctctgt

SEQ ID NO: 530176 - DNA, 16 bp, R. norvegicus
ttccttcagactcttc

SEQ ID NO: 530177 - DNA, 16 bp, R. norvegicus
ttccttcagtcatttc

SEQ ID NO: 530178 - DNA, 16 bp, R. norvegicus
ttccttcattcattca

SEQ ID NO: 530179 - DNA, 16 bp, R. norvegicus
ttccttccccagcacc

SEQ ID NO: 530180 - DNA, 16 bp, R. norvegicus
ttccttccttcctgag

SEQ ID NO: 530181 - DNA, 16 bp, R. norvegicus
ttccttcctttggaag

SEQ ID NO: 530182 - DNA, 16 bp, R. norvegicus
ttccttctaagaagcc

SEQ ID NO: 530183 - DNA, 16 bp, R. norvegicus
ttccttctacaaatta

SEQ ID NO: 530184 - DNA, 16 bp, R. norvegicus
ttccttctcatccaac

SEQ ID NO: 530185 - DNA, 16 bp, R. norvegicus
ttccttctccttcaat

SEQ ID NO: 530186 - DNA, 16 bp, R. norvegicus
ttccttctctaagaag

SEQ ID NO: 530187 - DNA, 16 bp, R. norvegicus
ttccttctctgtaaaa

SEQ ID NO: 530188 - DNA, 16 bp, R. norvegicus
ttccttctgcagcaga

SEQ ID NO: 530189 - DNA, 16 bp, R. norvegicus
ttccttctgcagctct

SEQ ID NO: 530190 - DNA, 16 bp, R. norvegicus
ttccttctttttaaaa

SEQ ID NO: 530191 - DNA, 16 bp, R. norvegicus
ttccttgagaatttta

SEQ ID NO: 530192 - DNA, 16 bp, R. norvegicus
ttccttgcccacctct

SEQ ID NO: 530193 - DNA, 16 bp, R. norvegicus
ttccttgctgtccagg

SEQ ID NO: 530194 - DNA, 16 bp, R. norvegicus
ttccttggaaacacag

SEQ ID NO: 530195 - DNA, 16 bp, R. norvegicus
ttccttggatgaatat

SEQ ID NO: 530196 - DNA, 16 bp, R. norvegicus
ttccttggctccttcc

SEQ ID NO: 530197 - DNA, 16 bp, R. norvegicus
ttccttgtaccttttt

SEQ ID NO: 530198 - DNA, 19 bp, R. norvegicus
ttcctttaccagcttctca

SEQ ID NO: 530199 - DNA, 16 bp, R. norvegicus
ttcctttagaagagtt

SEQ ID NO: 530200 - DNA, 18 bp, R. norvegicus
ttcctttataggacattt

SEQ ID NO: 530201 - DNA, 16 bp, R. norvegicus
ttcctttccaacttgc

SEQ ID NO: 530202 - DNA, 16 bp, R. norvegicus
ttcctttccagttttt

SEQ ID NO: 530203 - DNA, 16 bp, R. norvegicus
ttcctttctcagcttg

SEQ ID NO: 530204 - DNA, 16 bp, R. norvegicus
ttcctttctgctgctg

SEQ ID NO: 530205 - DNA, 16 bp, R. norvegicus
ttcctttgacctcttt

SEQ ID NO: 530206 - DNA, 16 bp, R. norvegicus
ttcctttggccacata

SEQ ID NO: 530207 - DNA, 16 bp, R. norvegicus
ttcctttggtgatgaa

SEQ ID NO: 530208 - DNA, 16 bp, R. norvegicus
ttcctttgttctgcta

SEQ ID NO: 530209 - DNA, 16 bp, R. norvegicus
ttccttttattaaaaa

SEQ ID NO: 530210 - DNA, 16 bp, R. norvegicus
ttccttttgttcttca

SEQ ID NO: 530211 - DNA, 16 bp, R. norvegicus
ttcctttttaagggct

SEQ ID NO: 530212 - DNA, 16 bp, R. norvegicus
ttcctttttcttcaaa

SEQ ID NO: 530213 - DNA, 16 bp, R. norvegicus
ttcctttttcttctga

SEQ ID NO: 530214 - DNA, 16 bp, R. norvegicus
ttcctttttggaggca

SEQ ID NO: 530215 - DNA, 16 bp, R. norvegicus
ttccttttttaaaaaa

SEQ ID NO: 530216 - DNA, 16 bp, R. norvegicus
ttcgaggaaaacacaa

SEQ ID NO: 530217 - DNA, 16 bp, R. norvegicus
ttcgaggtcatcctca

SEQ ID NO: 530218 - DNA, 16 bp, R. norvegicus
ttcgccaagaaactgg

SEQ ID NO: 530219 - DNA, 16 bp, R. norvegicus
ttcgcctgcctctgcc

SEQ ID NO: 530220 - DNA, 18 bp, R. norvegicus
ttcgcgaccaccccagac

SEQ ID NO: 530221 - DNA, 39 bp, R. norvegicus
ttcggagaggcagccctctcttggactttggtctggggt

SEQ ID NO: 530222 - DNA, 16 bp, R. norvegicus
ttcggagctggggatg

SEQ ID NO: 530223 - DNA, 41 bp, R. norvegicus
ttcggctgcctatttaagtataggcacggacaagtgtgctt

SEQ ID NO: 530224 - DNA, 16 bp, R. norvegicus
ttctaaaagaactgca

SEQ ID NO: 530225 - DNA, 16 bp, R. norvegicus
ttctaaagaaaatgaa

SEQ ID NO: 530226 - DNA, 16 bp, R. norvegicus
ttctaacaagaccaca

SEQ ID NO: 530227 - DNA, 16 bp, R. norvegicus
ttctaactttttacat

SEQ ID NO: 530228 - DNA, 16 bp, R. norvegicus
ttctaagaagacttta

SEQ ID NO: 530229 - DNA, 16 bp, R. norvegicus
ttctaagagggactga

SEQ ID NO: 530230 - DNA, 16 bp, R. norvegicus
ttctaaggaatcttct

SEQ ID NO: 530231 - DNA, 16 bp, R. norvegicus
ttctaagtgagattta

SEQ ID NO: 530232 - DNA, 16 bp, R. norvegicus
ttctaataaatgtgta

SEQ ID NO: 530233 - DNA, 16 bp, R. norvegicus
ttctaatacattttaa

SEQ ID NO: 530234 - DNA, 16 bp, R. norvegicus
ttctaatagtgctgct

SEQ ID NO: 530235 - DNA, 16 bp, R. norvegicus
ttctaatcctttcaaa

SEQ ID NO: 530236 - DNA, 16 bp, R. norvegicus
ttctaatcttctgact

SEQ ID NO: 530237 - DNA, 16 bp, R. norvegicus
ttctacaaaactggaa

SEQ ID NO: 530238 - DNA, 16 bp, R. norvegicus
ttctacaaagccagca

SEQ ID NO: 530239 - DNA, 16 bp, R. norvegicus
ttctacaggaattctg

SEQ ID NO: 530240 - DNA, 16 bp, R. norvegicus
ttctacaggatgctgc

SEQ ID NO: 530241 - DNA, 16 bp, R. norvegicus
ttctacagggccagtt

SEQ ID NO: 530242 - DNA, 16 bp, R. norvegicus
ttctacatcatcatct

SEQ ID NO: 530243 - DNA, 16 bp, R. norvegicus
ttctacatcttcaact

SEQ ID NO: 530244 - DNA, 16 bp, R. norvegicus
ttctacatcttcactc

SEQ ID NO: 530245 - DNA, 16 bp, R. norvegicus
ttctacatcttgacct

SEQ ID NO: 530246 - DNA, 16 bp, R. norvegicus
ttctacatcttgctcc

SEQ ID NO: 530247 - DNA, 16 bp, R. norvegicus
ttctacatctttaccc

SEQ ID NO: 530248 - DNA, 16 bp, R. norvegicus
ttctacatgctaacca

SEQ ID NO: 530249 - DNA, 16 bp, R. norvegicus
ttctacatgctgatgt

SEQ ID NO: 530250 - DNA, 16 bp, R. norvegicus
ttctacatgctgtcct

SEQ ID NO: 530251 - DNA, 16 bp, R. norvegicus
ttctacattgctgttc

SEQ ID NO: 530252 - DNA, 24 bp, R. norvegicus
ttctaccacaaattcttcaggctc

SEQ ID NO: 530253 - DNA, 16 bp, R. norvegicus
ttctaccagagaactg

SEQ ID NO: 530254 - DNA, 18 bp, R. norvegicus
ttctacctggtgaacttg

SEQ ID NO: 530255 - DNA, 16 bp, R. norvegicus
ttctacctgtgggtca

SEQ ID NO: 530256 - DNA, 16 bp, R. norvegicus
ttctacgtcttcatct

SEQ ID NO: 530257 - DNA, 16 bp, R. norvegicus
ttctactacatgctga

SEQ ID NO: 530258 - DNA, 16 bp, R. norvegicus
ttctacttctcctggg

SEQ ID NO: 530259 - DNA, 16 bp, R. norvegicus
ttctacttgtttagtt

SEQ ID NO: 530260 - DNA, 16 bp, R. norvegicus
ttctactttctggcta

SEQ ID NO: 530261 - DNA, 16 bp, R. norvegicus
ttctagaaagtcccag

SEQ ID NO: 530262 - DNA, 16 bp, R. norvegicus
ttctagaaagttttaa

SEQ ID NO: 530263 - DNA, 16 bp, R. norvegicus
ttctagaaccttctct

SEQ ID NO: 530264 - DNA, 16 bp, R. norvegicus
ttctagaagaggaagg

SEQ ID NO: 530265 - DNA, 16 bp, R. norvegicus
ttctagacagagcaat

SEQ ID NO: 530266 - DNA, 16 bp, R. norvegicus
ttctagaggacccaga

SEQ ID NO: 530267 - DNA, 16 bp, R. norvegicus
ttctagcactatgaaa

SEQ ID NO: 530268 - DNA, 16 bp, R. norvegicus
ttctagctagaacaat

SEQ ID NO: 530269 - DNA, 16 bp, R. norvegicus
ttctaggaaaagaaaa

SEQ ID NO: 530270 - DNA, 16 bp, R. norvegicus
ttctaggaaggtttga

SEQ ID NO: 530271 - DNA, 16 bp, R. norvegicus
ttctaggccagctaga

SEQ ID NO: 530272 - DNA, 16 bp, R. norvegicus
ttctaggctccagatg

SEQ ID NO: 530273 - DNA, 16 bp, R. norvegicus
ttctagggtcctgatc

SEQ ID NO: 530274 - DNA, 16 bp, R. norvegicus
ttctagggtgcagctt

SEQ ID NO: 530275 - DNA, 16 bp, R. norvegicus
ttctagtggctaccac

SEQ ID NO: 530276 - DNA, 16 bp, R. norvegicus
ttctataaaatagaaa

SEQ ID NO: 530277 - DNA, 16 bp, R. norvegicus
ttctataaatatctat

SEQ ID NO: 530278 - DNA, 16 bp, R. norvegicus
ttctataagaaagcca

SEQ ID NO: 530279 - DNA, 16 bp, R. norvegicus
ttctataagaattcct

SEQ ID NO: 530280 - DNA, 16 bp, R. norvegicus
ttctatcagaaagcag

SEQ ID NO: 530281 - DNA, 16 bp, R. norvegicus
ttctatctccacagtt

SEQ ID NO: 530282 - DNA, 16 bp, R. norvegicus
ttctatgaaggtgttt

SEQ ID NO: 530283 - DNA, 16 bp, R. norvegicus
ttctatgagtttgagg

SEQ ID NO: 530284 - DNA, 16 bp, R. norvegicus
ttctatgcagatcaga

SEQ ID NO: 530285 - DNA, 16 bp, R. norvegicus
ttctatgtagccaagg

SEQ ID NO: 530286 - DNA, 18 bp, R. norvegicus
ttctattagctaatcaaa

SEQ ID NO: 530287 - DNA, 16 bp, R. norvegicus
ttctattcagaaaaat

SEQ ID NO: 530288 - DNA, 16 bp, R. norvegicus
ttctattcaggaagtt

SEQ ID NO: 530289 - DNA, 16 bp, R. norvegicus
ttctattccacttgtc

SEQ ID NO: 530290 - DNA, 16 bp, R. norvegicus
ttctattctttctgct

SEQ ID NO: 530291 - DNA, 16 bp, R. norvegicus
ttctattgctgtggag

SEQ ID NO: 530292 - DNA, 16 bp, R. norvegicus
ttctattggtgatgct

SEQ ID NO: 530293 - DNA, 16 bp, R. norvegicus
ttctattgtgtcctag

SEQ ID NO: 530294 - DNA, 16 bp, R. norvegicus
ttctatttctgtgagg

SEQ ID NO: 530295 - DNA, 16 bp, R. norvegicus
ttctatttcttttgga

SEQ ID NO: 530296 - DNA, 16 bp, R. norvegicus
ttctattttattgact

SEQ ID NO: 530297 - DNA, 16 bp, R. norvegicus
ttctcaacatcctcac

SEQ ID NO: 530298 - DNA, 16 bp, R. norvegicus
ttctcaacctgtgggt

SEQ ID NO: 530299 - DNA, 16 bp, R. norvegicus
ttctcaacctgtggtt

SEQ ID NO: 530300 - DNA, 16 bp, R. norvegicus
ttctcaactaaagaat

SEQ ID NO: 530301 - DNA, 16 bp, R. norvegicus
ttctcaactggaagca

SEQ ID NO: 530302 - DNA, 16 bp, R. norvegicus
ttctcaagaagaaaga

SEQ ID NO: 530303 - DNA, 16 bp, R. norvegicus
ttctcaagagacagct

SEQ ID NO: 530304 - DNA, 16 bp, R. norvegicus
ttctcaatgagattca

SEQ ID NO: 530305 - DNA, 16 bp, R. norvegicus
ttctcacagtcaggag

SEQ ID NO: 530306 - DNA, 16 bp, R. norvegicus
ttctcacagttctaga

SEQ ID NO: 530307 - DNA, 16 bp, R. norvegicus
ttctcaccagagactg

SEQ ID NO: 530308 - DNA, 16 bp, R. norvegicus
ttctcacccatcaacc

SEQ ID NO: 530309 - DNA, 19 bp, R. norvegicus
ttctcactggtgtgaggtg

SEQ ID NO: 530310 - DNA, 16 bp, R. norvegicus
ttctcacttctgtcat

SEQ ID NO: 530311 - DNA, 16 bp, R. norvegicus
ttctcagaacttcatg

SEQ ID NO: 530312 - DNA, 16 bp, R. norvegicus
ttctcagagaagaagg

SEQ ID NO: 530313 - DNA, 16 bp, R. norvegicus
ttctcagagaccttgg

SEQ ID NO: 530314 - DNA, 16 bp, R. norvegicus
ttctcagagctgagga

SEQ ID NO: 530315 - DNA, 16 bp, R. norvegicus
ttctcagaggacagct

SEQ ID NO: 530316 - DNA, 16 bp, R. norvegicus
ttctcagaggaggaga

SEQ ID NO: 530317 - DNA, 16 bp, R. norvegicus
ttctcagatttctgat

SEQ ID NO: 530318 - DNA, 16 bp, R. norvegicus
ttctcagcacccaggt

SEQ ID NO: 530319 - DNA, 16 bp, R. norvegicus
ttctcagcacctcctg

SEQ ID NO: 530320 - DNA, 16 bp, R. norvegicus
ttctcagcaggaaaac

SEQ ID NO: 530321 - DNA, 16 bp, R. norvegicus
ttctcagccacttggc

SEQ ID NO: 530322 - DNA, 16 bp, R. norvegicus
ttctcagctattcggc

SEQ ID NO: 530323 - DNA, 16 bp, R. norvegicus
ttctcagctcctcctg

SEQ ID NO: 530324 - DNA, 16 bp, R. norvegicus
ttctcagctcttctga

SEQ ID NO: 530325 - DNA, 16 bp, R. norvegicus
ttctcagcttctcact

SEQ ID NO: 530326 - DNA, 16 bp, R. norvegicus
ttctcaggaaaggctg

SEQ ID NO: 530327 - DNA, 16 bp, R. norvegicus
ttctcaggaatgtctg

SEQ ID NO: 530328 - DNA, 16 bp, R. norvegicus
ttctcaggaccaaggg

SEQ ID NO: 530329 - DNA, 16 bp, R. norvegicus
ttctcaggagtatcca

SEQ ID NO: 530330 - DNA, 16 bp, R. norvegicus
ttctcagggcctgggg

SEQ ID NO: 530331 - DNA, 16 bp, R. norvegicus
ttctcagtacctgtcc

SEQ ID NO: 530332 - DNA, 16 bp, R. norvegicus
ttctcagtacttcatg

SEQ ID NO: 530333 - DNA, 16 bp, R. norvegicus
ttctcagtctatttat

SEQ ID NO: 530334 - DNA, 16 bp, R. norvegicus
ttctcagtctctctgt

SEQ ID NO: 530335 - DNA, 16 bp, R. norvegicus
ttctcagtctgctttc

SEQ ID NO: 530336 - DNA, 16 bp, R. norvegicus
ttctcagtgcccatgt

SEQ ID NO: 530337 - DNA, 71 bp, R. norvegicus
ttctcagttcagtggtttgctgctggcattcgcctctgtatttgctgtattctggctgtgtctctcaggag

SEQ ID NO: 530338 - DNA, 16 bp, R. norvegicus
ttctcatatattacat

SEQ ID NO: 530339 - DNA, 16 bp, R. norvegicus
ttctcatccaaaccat

SEQ ID NO: 530340 - DNA, 16 bp, R. norvegicus
ttctcatggccatctg

SEQ ID NO: 530341 - DNA, 16 bp, R. norvegicus
ttctcatggtgacccc

SEQ ID NO: 530342 - DNA, 16 bp, R. norvegicus
ttctcatgtgtgtgtg

SEQ ID NO: 530343 - DNA, 16 bp, R. norvegicus
ttctcatgttgtggtg

SEQ ID NO: 530344 - DNA, 16 bp, R. norvegicus
ttctcattcaaacaac

SEQ ID NO: 530345 - DNA, 16 bp, R. norvegicus
ttctcattttaaagat

SEQ ID NO: 530346 - DNA, 16 bp, R. norvegicus
ttctccaaaacagacc

SEQ ID NO: 530347 - DNA, 16 bp, R. norvegicus
ttctccaaaattgagc

SEQ ID NO: 530348 - DNA, 16 bp, R. norvegicus
ttctccaaagaagaaa

SEQ ID NO: 530349 - DNA, 16 bp, R. norvegicus
ttctccacagagaaag

SEQ ID NO: 530350 - DNA, 16 bp, R. norvegicus
ttctccacatccttac

SEQ ID NO: 530351 - DNA, 16 bp, R. norvegicus
ttctccacctgtgggt

SEQ ID NO: 530352 - DNA, 16 bp, R. norvegicus
ttctccagcaaggcca

SEQ ID NO: 530353 - DNA, 16 bp, R. norvegicus
ttctccaggctggcct

SEQ ID NO: 530354 - DNA, 16 bp, R. norvegicus
ttctccatcccctctg

SEQ ID NO: 530355 - DNA, 16 bp, R. norvegicus
ttctccatctttgtcc

SEQ ID NO: 530356 - DNA, 16 bp, R. norvegicus
ttctccatgaagttct

SEQ ID NO: 530357 - DNA, 16 bp, R. norvegicus
ttctccatgtctttct

SEQ ID NO: 530358 - DNA, 16 bp, R. norvegicus
ttctccatttccatcc

SEQ ID NO: 530359 - DNA, 16 bp, R. norvegicus
ttctcccacaaggcca

SEQ ID NO: 530360 - DNA, 16 bp, R. norvegicus
ttctcccaccaaggca

SEQ ID NO: 530361 - DNA, 16 bp, R. norvegicus
ttctcccagaaattct

SEQ ID NO: 530362 - DNA, 16 bp, R. norvegicus
ttctcccagaagtcct

SEQ ID NO: 530363 - DNA, 16 bp, R. norvegicus
ttctcccagaatttct

SEQ ID NO: 530364 - DNA, 16 bp, R. norvegicus
ttctcccagcacagca

SEQ ID NO: 530365 - DNA, 16 bp, R. norvegicus
ttctcccagcatccct

SEQ ID NO: 530366 - DNA, 16 bp, R. norvegicus
ttctcccagctcttcc

SEQ ID NO: 530367 - DNA, 16 bp, R. norvegicus
ttctcccagcttctct

SEQ ID NO: 530368 - DNA, 16 bp, R. norvegicus
ttctcccattctccca

SEQ ID NO: 530369 - DNA, 16 bp, R. norvegicus
ttctcccctttcctgg

SEQ ID NO: 530370 - DNA, 16 bp, R. norvegicus
ttctccctctgaagca

SEQ ID NO: 530371 - DNA, 16 bp, R. norvegicus
ttctcccttctaggaa

SEQ ID NO: 530372 - DNA, 16 bp, R. norvegicus
ttctcctcagacccca

SEQ ID NO: 530373 - DNA, 16 bp, R. norvegicus
ttctcctcagagaaga

SEQ ID NO: 530374 - DNA, 16 bp, R. norvegicus
ttctcctcagaggtca

SEQ ID NO: 530375 - DNA, 16 bp, R. norvegicus
ttctcctccagtgaca

SEQ ID NO: 530376 - DNA, 16 bp, R. norvegicus
ttctcctcccactggt

SEQ ID NO: 530377 - DNA, 16 bp, R. norvegicus
ttctcctctctccaaa

SEQ ID NO: 530378 - DNA, 16 bp, R. norvegicus
ttctcctctgacttct

SEQ ID NO: 530379 - DNA, 16 bp, R. norvegicus
ttctcctctgagagag

SEQ ID NO: 530380 - DNA, 16 bp, R. norvegicus
ttctcctgcctcaacc

SEQ ID NO: 530381 - DNA, 16 bp, R. norvegicus
ttctcctgcctcagct

SEQ ID NO: 530382 - DNA, 16 bp, R. norvegicus
ttctcctgcctccaca

SEQ ID NO: 530383 - DNA, 16 bp, R. norvegicus
ttctcctgcctctgcc

SEQ ID NO: 530384 - DNA, 16 bp, R. norvegicus
ttctcctgcttccacc

SEQ ID NO: 530385 - DNA, 16 bp, R. norvegicus
ttctcctggccacatg

SEQ ID NO: 530386 - DNA, 16 bp, R. norvegicus
ttctcctggctgcctt

SEQ ID NO: 530387 - DNA, 16 bp, R. norvegicus
ttctcctggtcctctg

SEQ ID NO: 530388 - DNA, 16 bp, R. norvegicus
ttctcctgtctcactt

SEQ ID NO: 530389 - DNA, 16 bp, R. norvegicus
ttctcctttgagaagg

SEQ ID NO: 530390 - DNA, 17 bp, R. norvegicus
ttctcgaatggaatcaa

SEQ ID NO: 530391 - DNA, 16 bp, R. norvegicus
ttctctaaaacttttc

SEQ ID NO: 530392 - DNA, 16 bp, R. norvegicus
ttctctaattcttcca

SEQ ID NO: 530393 - DNA, 16 bp, R. norvegicus
ttctctaatttctcca

SEQ ID NO: 530394 - DNA, 16 bp, R. norvegicus
ttctctacctgtgggt

SEQ ID NO: 530395 - DNA, 16 bp, R. norvegicus
ttctctactcaaagga

SEQ ID NO: 530396 - DNA, 16 bp, R. norvegicus
ttctctagtagaattt

SEQ ID NO: 530397 - DNA, 16 bp, R. norvegicus
ttctctatctcctcca

SEQ ID NO: 530398 - DNA, 16 bp, R. norvegicus
ttctctatgtaagaaa

SEQ ID NO: 530399 - DNA, 16 bp, R. norvegicus
ttctctatgtctttct

SEQ ID NO: 530400 - DNA, 16 bp, R. norvegicus
ttctctcaggaccctg

SEQ ID NO: 530401 - DNA, 16 bp, R. norvegicus
ttctctcagtgatgaa

SEQ ID NO: 530402 - DNA, 16 bp, R. norvegicus
ttctctcattaaacct

SEQ ID NO: 530403 - DNA, 16 bp, R. norvegicus
ttctctccagcagcca

SEQ ID NO: 530404 - DNA, 16 bp, R. norvegicus
ttctctccatccacca

SEQ ID NO: 530405 - DNA, 16 bp, R. norvegicus
ttctctcctgtagctc

SEQ ID NO: 530406 - DNA, 16 bp, R. norvegicus
ttctctccttgtattg

SEQ ID NO: 530407 - DNA, 16 bp, R. norvegicus
ttctctctcacacaca

SEQ ID NO: 530408 - DNA, 24 bp, R. norvegicus
ttctctcttacaagtcattgaaaa

SEQ ID NO: 530409 - DNA, 16 bp, R. norvegicus
ttctctcttcaacctg

SEQ ID NO: 530410 - DNA, 16 bp, R. norvegicus
ttctctcttccaaaat

SEQ ID NO: 530411 - DNA, 16 bp, R. norvegicus
ttctctgaagccacag

SEQ ID NO: 530412 - DNA, 16 bp, R. norvegicus
ttctctgacttctaca

SEQ ID NO: 530413 - DNA, 16 bp, R. norvegicus
ttctctgagcaggtgg

SEQ ID NO: 530414 - DNA, 16 bp, R. norvegicus
ttctctgaggtgctca

SEQ ID NO: 530415 - DNA, 16 bp, R. norvegicus
ttctctgcacccatat

SEQ ID NO: 530416 - DNA, 16 bp, R. norvegicus
ttctctgcctcctcca

SEQ ID NO: 530417 - DNA, 16 bp, R. norvegicus
ttctctgcctctacct

SEQ ID NO: 530418 - DNA, 16 bp, R. norvegicus
ttctctgcttcatcca

SEQ ID NO: 530419 - DNA, 16 bp, R. norvegicus
ttctctggaggaacag

SEQ ID NO: 530420 - DNA, 16 bp, R. norvegicus
ttctctggatttcctc

SEQ ID NO: 530421 - DNA, 16 bp, R. norvegicus
ttctctggcttcaact

SEQ ID NO: 530422 - DNA, 16 bp, R. norvegicus
ttctctgggacatcaa

SEQ ID NO: 530423 - DNA, 16 bp, R. norvegicus
ttctctgggtgttgca

SEQ ID NO: 530424 - DNA, 16 bp, R. norvegicus
ttctctgtatagacct

SEQ ID NO: 530425 - DNA, 16 bp, R. norvegicus
ttctctgtattgttct

SEQ ID NO: 530426 - DNA, 16 bp, R. norvegicus
ttctctgtctgtgtct

SEQ ID NO: 530427 - DNA, 16 bp, R. norvegicus
ttctctgtgacctctg

SEQ ID NO: 530428 - DNA, 16 bp, R. norvegicus
ttctcttaaacttaaa

SEQ ID NO: 530429 - DNA, 16 bp, R. norvegicus
ttctcttatgaacatt

SEQ ID NO: 530430 - DNA, 16 bp, R. norvegicus
ttctcttcaccacaga

SEQ ID NO: 530431 - DNA, 16 bp, R. norvegicus
ttctcttcagaaaaga

SEQ ID NO: 530432 - DNA, 16 bp, R. norvegicus
ttctcttctgagaagg

SEQ ID NO: 530433 - DNA, 16 bp, R. norvegicus
ttctcttctggccttc

SEQ ID NO: 530434 - DNA, 16 bp, R. norvegicus
ttctcttgttttagga

SEQ ID NO: 530435 - DNA, 16 bp, R. norvegicus
ttctctttagaaaaca

SEQ ID NO: 530436 - DNA, 16 bp, R. norvegicus
ttctctttataagagt

SEQ ID NO: 530437 - DNA, 16 bp, R. norvegicus
ttctctttctaccatg

SEQ ID NO: 530438 - DNA, 16 bp, R. norvegicus
ttctctttcttctatg

SEQ ID NO: 530439 - DNA, 16 bp, R. norvegicus
ttctctttgtatctct

SEQ ID NO: 530440 - DNA, 16 bp, R. norvegicus
ttctcttttcagctct

SEQ ID NO: 530441 - DNA, 16 bp, R. norvegicus
ttctgaaacaaacaaa

SEQ ID NO: 530442 - DNA, 16 bp, R. norvegicus
ttctgaaacctcaaaa

SEQ ID NO: 530443 - DNA, 16 bp, R. norvegicus
ttctgaaactacttta

SEQ ID NO: 530444 - DNA, 16 bp, R. norvegicus
ttctgaaagtccagct

SEQ ID NO: 530445 - DNA, 16 bp, R. norvegicus
ttctgaacaacaacaa

SEQ ID NO: 530446 - DNA, 16 bp, R. norvegicus
ttctgaacatttcttt

SEQ ID NO: 530447 - DNA, 16 bp, R. norvegicus
ttctgaagaaaaaaaa

SEQ ID NO: 530448 - DNA, 16 bp, R. norvegicus
ttctgaagaaaaagaa

SEQ ID NO: 530449 - DNA, 16 bp, R. norvegicus
ttctgaagaaaatgat

SEQ ID NO: 530450 - DNA, 16 bp, R. norvegicus
ttctgaagaggaaaca

SEQ ID NO: 530451 - DNA, 16 bp, R. norvegicus
ttctgaaggactacct

SEQ ID NO: 530452 - DNA, 16 bp, R. norvegicus
ttctgaaggtggagtt

SEQ ID NO: 530453 - DNA, 16 bp, R. norvegicus
ttctgaatatctgtgc

SEQ ID NO: 530454 - DNA, 16 bp, R. norvegicus
ttctgacactagagga

SEQ ID NO: 530455 - DNA, 16 bp, R. norvegicus
ttctgaccaaaagcaa

SEQ ID NO: 530456 - DNA, 16 bp, R. norvegicus
ttctgacccagaactg

SEQ ID NO: 530457 - DNA, 16 bp, R. norvegicus
ttctgacctctatggg

SEQ ID NO: 530458 - DNA, 16 bp, R. norvegicus
ttctgactccctcttc

SEQ ID NO: 530459 - DNA, 18 bp, R. norvegicus
ttctgactggtatgaggt

SEQ ID NO: 530460 - DNA, 16 bp, R. norvegicus
ttctgacttccacaca

SEQ ID NO: 530461 - DNA, 16 bp, R. norvegicus
ttctgacttttaattt

SEQ ID NO: 530462 - DNA, 16 bp, R. norvegicus
ttctgagaaactgtca

SEQ ID NO: 530463 - DNA, 16 bp, R. norvegicus
ttctgagaatccagct

SEQ ID NO: 530464 - DNA, 16 bp, R. norvegicus
ttctgagacagaatct

SEQ ID NO: 530465 - DNA, 16 bp, R. norvegicus
ttctgagacagagtct

SEQ ID NO: 530466 - DNA, 16 bp, R. norvegicus
ttctgagagaaaaaaa

SEQ ID NO: 530467 - DNA, 16 bp, R. norvegicus
ttctgagagcacaaag

SEQ ID NO: 530468 - DNA, 16 bp, R. norvegicus
ttctgagagcacaagg

SEQ ID NO: 530469 - DNA, 16 bp, R. norvegicus
ttctgagattttcctc

SEQ ID NO: 530470 - DNA, 16 bp, R. norvegicus
ttctgagcttcttttt

SEQ ID NO: 530471 - DNA, 16 bp, R. norvegicus
ttctgaggaaaaaaaa

SEQ ID NO: 530472 - DNA, 16 bp, R. norvegicus
ttctgaggaactgcca

SEQ ID NO: 530473 - DNA, 16 bp, R. norvegicus
ttctgaggaatgtcca

SEQ ID NO: 530474 - DNA, 16 bp, R. norvegicus
ttctgaggatccagct

SEQ ID NO: 530475 - DNA, 16 bp, R. norvegicus
ttctgaggattaaact

SEQ ID NO: 530476 - DNA, 16 bp, R. norvegicus
ttctgaggggaaaaaa

SEQ ID NO: 530477 - DNA, 16 bp, R. norvegicus
ttctgagtctgaggcc

SEQ ID NO: 530478 - DNA, 16 bp, R. norvegicus
ttctgagtttgttaat

SEQ ID NO: 530479 - DNA, 16 bp, R. norvegicus
ttctgataccatgaaa

SEQ ID NO: 530480 - DNA, 16 bp, R. norvegicus
ttctgatcctcctgct

SEQ ID NO: 530481 - DNA, 16 bp, R. norvegicus
ttctgatcttagccat

SEQ ID NO: 530482 - DNA, 16 bp, R. norvegicus
ttctgatcttcctgtt

SEQ ID NO: 530483 - DNA, 16 bp, R. norvegicus
ttctgatgactaagaa

SEQ ID NO: 530484 - DNA, 16 bp, R. norvegicus
ttctgatgtttctgaa

SEQ ID NO: 530485 - DNA, 16 bp, R. norvegicus
ttctgattttctatgt

SEQ ID NO: 530486 - DNA, 16 bp, R. norvegicus
ttctgcaaaagcagca

SEQ ID NO: 530487 - DNA, 16 bp, R. norvegicus
ttctgcaagatggcca

SEQ ID NO: 530488 - DNA, 16 bp, R. norvegicus
ttctgcaagctgtcct

SEQ ID NO: 530489 - DNA, 17 bp, R. norvegicus
ttctgcacagaccctga

SEQ ID NO: 530490 - DNA, 16 bp, R. norvegicus
ttctgcacagcctggc

SEQ ID NO: 530491 - DNA, 16 bp, R. norvegicus
ttctgcactaatccca

SEQ ID NO: 530492 - DNA, 16 bp, R. norvegicus
ttctgcactggccaga

SEQ ID NO: 530493 - DNA, 16 bp, R. norvegicus
ttctgcagaaatagct

SEQ ID NO: 530494 - DNA, 16 bp, R. norvegicus
ttctgcagaccaggct

SEQ ID NO: 530495 - DNA, 16 bp, R. norvegicus
ttctgcaggaactcag

SEQ ID NO: 530496 - DNA, 16 bp, R. norvegicus
ttctgcaggacagaga

SEQ ID NO: 530497 - DNA, 16 bp, R. norvegicus
ttctgcagttatgtct

SEQ ID NO: 530498 - DNA, 16 bp, R. norvegicus
ttctgccatggcctat

SEQ ID NO: 530499 - DNA, 16 bp, R. norvegicus
ttctgcccacttctgc

SEQ ID NO: 530500 - DNA, 16 bp, R. norvegicus
ttctgcctaatgtttg

SEQ ID NO: 530501 - DNA, 16 bp, R. norvegicus
ttctgcctcagactcc

SEQ ID NO: 530502 - DNA, 16 bp, R. norvegicus
ttctgcctcatcttct

SEQ ID NO: 530503 - DNA, 16 bp, R. norvegicus
ttctgcctccacctct

SEQ ID NO: 530504 - DNA, 16 bp, R. norvegicus
ttctgcctcccagccc

SEQ ID NO: 530505 - DNA, 16 bp, R. norvegicus
ttctgcctcctgtgat

SEQ ID NO: 530506 - DNA, 16 bp, R. norvegicus
ttctgcctgcatgcat

SEQ ID NO: 530507 - DNA, 16 bp, R. norvegicus
ttctgcctgggctgct

SEQ ID NO: 530508 - DNA, 16 bp, R. norvegicus
ttctgcctgtgccctg

SEQ ID NO: 530509 - DNA, 16 bp, R. norvegicus
ttctgcctgtgcttgg

SEQ ID NO: 530510 - DNA, 16 bp, R. norvegicus
ttctgcctgtgtcctg

SEQ ID NO: 530511 - DNA, 16 bp, R. norvegicus
ttctgccttagccttc

SEQ ID NO: 530512 - DNA, 16 bp, R. norvegicus
ttctgccttctgagtg

SEQ ID NO: 530513 - DNA, 16 bp, R. norvegicus
ttctgcctttgcttcc

SEQ ID NO: 530514 - DNA, 16 bp, R. norvegicus
ttctgctacaccatca

SEQ ID NO: 530515 - DNA, 16 bp, R. norvegicus
ttctgctagctgcctt

SEQ ID NO: 530516 - DNA, 16 bp, R. norvegicus
ttctgctatttctgac

SEQ ID NO: 530517 - DNA, 16 bp, R. norvegicus
ttctgctccatcttct

SEQ ID NO: 530518 - DNA, 16 bp, R. norvegicus
ttctgctccctacagg

SEQ ID NO: 530519 - DNA, 19 bp, R. norvegicus
ttctgctccggagattctc

SEQ ID NO: 530520 - DNA, 16 bp, R. norvegicus
ttctgctctgcagtct

SEQ ID NO: 530521 - DNA, 40 bp, R. norvegicus
ttctgctcttcctgaagatgagactacgaaccctactatt

SEQ ID NO: 530522 - DNA, 16 bp, R. norvegicus
ttctgctgcaagaaaa

SEQ ID NO: 530523 - DNA, 16 bp, R. norvegicus
ttctgctgccattcct

SEQ ID NO: 530524 - DNA, 16 bp, R. norvegicus
ttctgctgcctgagga

SEQ ID NO: 530525 - DNA, 16 bp, R. norvegicus
ttctgctgctgctgct

SEQ ID NO: 530526 - DNA, 16 bp, R. norvegicus
ttctgctgctgtgaag

SEQ ID NO: 530527 - DNA, 16 bp, R. norvegicus
ttctgctggagatggg

SEQ ID NO: 530528 - DNA, 16 bp, R. norvegicus
ttctgctggaggtgaa

SEQ ID NO: 530529 - DNA, 16 bp, R. norvegicus
ttctgcttcaagtgac

SEQ ID NO: 530530 - DNA, 16 bp, R. norvegicus
ttctgcttcaagttcc

SEQ ID NO: 530531 - DNA, 16 bp, R. norvegicus
ttctgcttcagctcct

SEQ ID NO: 530532 - DNA, 16 bp, R. norvegicus
ttctgcttcagttcct

SEQ ID NO: 530533 - DNA, 16 bp, R. norvegicus
ttctgcttcctcagtg

SEQ ID NO: 530534 - DNA, 16 bp, R. norvegicus
ttctgcttctgctgct

SEQ ID NO: 530535 - DNA, 16 bp, R. norvegicus
ttctgcttctggctat

SEQ ID NO: 530536 - DNA, 16 bp, R. norvegicus
ttctgctttacattat

SEQ ID NO: 530537 - DNA, 16 bp, R. norvegicus
ttctggaaaacagaaa

SEQ ID NO: 530538 - DNA, 16 bp, R. norvegicus
ttctggaaaacagtct

SEQ ID NO: 530539 - DNA, 16 bp, R. norvegicus
ttctggaaacttctct

SEQ ID NO: 530540 - DNA, 16 bp, R. norvegicus
ttctggaaagaaaaaa

SEQ ID NO: 530541 - DNA, 16 bp, R. norvegicus
ttctggaaagccctgg

SEQ ID NO: 530542 - DNA, 16 bp, R. norvegicus
ttctggaaatgaaaat

SEQ ID NO: 530543 - DNA, 16 bp, R. norvegicus
ttctggaactttctat

SEQ ID NO: 530544 - DNA, 16 bp, R. norvegicus
ttctggaactttctgt

SEQ ID NO: 530545 - DNA, 16 bp, R. norvegicus
ttctggaagaacagcc

SEQ ID NO: 530546 - DNA, 16 bp, R. norvegicus
ttctggaagctgggaa

SEQ ID NO: 530547 - DNA, 16 bp, R. norvegicus
ttctggaagctgtgtt

SEQ ID NO: 530548 - DNA, 16 bp, R. norvegicus
ttctggaagcttccag

SEQ ID NO: 530549 - DNA, 16 bp, R. norvegicus
ttctggaaggttctgt

SEQ ID NO: 530550 - DNA, 16 bp, R. norvegicus
ttctggaagtttcttt

SEQ ID NO: 530551 - DNA, 16 bp, R. norvegicus
ttctggactccctggc

SEQ ID NO: 530552 - DNA, 16 bp, R. norvegicus
ttctggacttcatagt

SEQ ID NO: 530553 - DNA, 16 bp, R. norvegicus
ttctggagaaagtacc

SEQ ID NO: 530554 - DNA, 16 bp, R. norvegicus
ttctggagactggctt

SEQ ID NO: 530555 - DNA, 16 bp, R. norvegicus
ttctggagacttttca

SEQ ID NO: 530556 - DNA, 16 bp, R. norvegicus
ttctggagatccagca

SEQ ID NO: 530557 - DNA, 16 bp, R. norvegicus
ttctggagctggggac

SEQ ID NO: 530558 - DNA, 16 bp, R. norvegicus
ttctggaggttcctca

SEQ ID NO: 530559 - DNA, 16 bp, R. norvegicus
ttctggagtcagttct

SEQ ID NO: 530560 - DNA, 16 bp, R. norvegicus
ttctggagttttgatt

SEQ ID NO: 530561 - DNA, 19 bp, R. norvegicus
ttctggatattataaataa

SEQ ID NO: 530562 - DNA, 16 bp, R. norvegicus
ttctggatggttttgt

SEQ ID NO: 530563 - DNA, 16 bp, R. norvegicus
ttctggcaaaacaact

SEQ ID NO: 530564 - DNA, 16 bp, R. norvegicus
ttctggcaaaccgagt

SEQ ID NO: 530565 - DNA, 16 bp, R. norvegicus
ttctggcaaagaatct

SEQ ID NO: 530566 - DNA, 16 bp, R. norvegicus
ttctggcaccataggg

SEQ ID NO: 530567 - DNA, 16 bp, R. norvegicus
ttctggcaccatgaaa

SEQ ID NO: 530568 - DNA, 16 bp, R. norvegicus
ttctggcagaacctct

SEQ ID NO: 530569 - DNA, 16 bp, R. norvegicus
ttctggcagaccagct

SEQ ID NO: 530570 - DNA, 16 bp, R. norvegicus
ttctggccctcctggc

SEQ ID NO: 530571 - DNA, 16 bp, R. norvegicus
ttctggcctccacaga

SEQ ID NO: 530572 - DNA, 16 bp, R. norvegicus
ttctggcctcccaggg

SEQ ID NO: 530573 - DNA, 16 bp, R. norvegicus
ttctggcctccttggc

SEQ ID NO: 530574 - DNA, 16 bp, R. norvegicus
ttctggcctctgagaa

SEQ ID NO: 530575 - DNA, 16 bp, R. norvegicus
ttctggcctctgcaga

SEQ ID NO: 530576 - DNA, 16 bp, R. norvegicus
ttctggcctctgggca

SEQ ID NO: 530577 - DNA, 16 bp, R. norvegicus
ttctggcctctgtcag

SEQ ID NO: 530578 - DNA, 16 bp, R. norvegicus
ttctggcctcttcagg

SEQ ID NO: 530579 - DNA, 16 bp, R. norvegicus
ttctggccttcacagg

SEQ ID NO: 530580 - DNA, 19 bp, R. norvegicus
ttctggctattataaagaa

SEQ ID NO: 530581 - DNA, 20 bp, R. norvegicus
ttctggctattataaataaa

SEQ ID NO: 530582 - DNA, 24 bp, R. norvegicus
ttctggctattataaataaggctg

SEQ ID NO: 530583 - DNA, 16 bp, R. norvegicus
ttctggctcctgagtg

SEQ ID NO: 530584 - DNA, 16 bp, R. norvegicus
ttctggctgccttcag

SEQ ID NO: 530585 - DNA, 16 bp, R. norvegicus
ttctggctgttataaa

SEQ ID NO: 530586 - DNA, 16 bp, R. norvegicus
ttctggcttccgtggg

SEQ ID NO: 530587 - DNA, 16 bp, R. norvegicus
ttctggcttctcaggc

SEQ ID NO: 530588 - DNA, 16 bp, R. norvegicus
ttctggctttcaaagt

SEQ ID NO: 530589 - DNA, 16 bp, R. norvegicus
ttctggctttcagagt

SEQ ID NO: 530590 - DNA, 16 bp, R. norvegicus
ttctggctttcatggg

SEQ ID NO: 530591 - DNA, 16 bp, R. norvegicus
ttctggcttttaaaat

SEQ ID NO: 530592 - DNA, 16 bp, R. norvegicus
ttctgggaaagaggca

SEQ ID NO: 530593 - DNA, 16 bp, R. norvegicus
ttctgggaaggaaaag

SEQ ID NO: 530594 - DNA, 16 bp, R. norvegicus
ttctgggaattcagct

SEQ ID NO: 530595 - DNA, 16 bp, R. norvegicus
ttctgggagaatcacc

SEQ ID NO: 530596 - DNA, 16 bp, R. norvegicus
ttctgggagcctctgt

SEQ ID NO: 530597 - DNA, 16 bp, R. norvegicus
ttctgggagctgaact

SEQ ID NO: 530598 - DNA, 35 bp, R. norvegicus
ttctgggagcttcagtgcaccagggttccagatgg

SEQ ID NO: 530599 - DNA, 16 bp, R. norvegicus
ttctgggatctgaact

SEQ ID NO: 530600 - DNA, 16 bp, R. norvegicus
ttctgggcacagccag

SEQ ID NO: 530601 - DNA, 16 bp, R. norvegicus
ttctgggtccctggag

SEQ ID NO: 530602 - DNA, 16 bp, R. norvegicus
ttctggtataattctg

SEQ ID NO: 530603 - DNA, 16 bp, R. norvegicus
ttctggtcctcctgct

SEQ ID NO: 530604 - DNA, 16 bp, R. norvegicus
ttctggtctctgtgga

SEQ ID NO: 530605 - DNA, 16 bp, R. norvegicus
ttctggtgtctgaaga

SEQ ID NO: 530606 - DNA, 16 bp, R. norvegicus
ttctggtgtgcctgag

SEQ ID NO: 530607 - DNA, 16 bp, R. norvegicus
ttctggtgtgcttgga

SEQ ID NO: 530608 - DNA, 16 bp, R. norvegicus
ttctggtgtgtttgga

SEQ ID NO: 530609 - DNA, 16 bp, R. norvegicus
ttctggttcctggagt

SEQ ID NO: 530610 - DNA, 16 bp, R. norvegicus
ttctggtttccatctg

SEQ ID NO: 530611 - DNA, 16 bp, R. norvegicus
ttctggtttccttgga

SEQ ID NO: 530612 - DNA, 16 bp, R. norvegicus
ttctgtaaatacctgt

SEQ ID NO: 530613 - DNA, 16 bp, R. norvegicus
ttctgtaaatatctat

SEQ ID NO: 530614 - DNA, 16 bp, R. norvegicus
ttctgtaagaaaacag

SEQ ID NO: 530615 - DNA, 16 bp, R. norvegicus
ttctgtaagaacagca

SEQ ID NO: 530616 - DNA, 24 bp, R. norvegicus
ttctgtaaggcaaaggacactgtt

SEQ ID NO: 530617 - DNA, 16 bp, R. norvegicus
ttctgtaagtcaaagg

SEQ ID NO: 530618 - DNA, 16 bp, R. norvegicus
ttctgtaccagcagag

SEQ ID NO: 530619 - DNA, 16 bp, R. norvegicus
ttctgtacctgtggag

SEQ ID NO: 530620 - DNA, 16 bp, R. norvegicus
ttctgtacttttttgg

SEQ ID NO: 530621 - DNA, 16 bp, R. norvegicus
ttctgtagaccaggct

SEQ ID NO: 530622 - DNA, 16 bp, R. norvegicus
ttctgtatctgttgag

SEQ ID NO: 530623 - DNA, 16 bp, R. norvegicus
ttctgtatgtttatgg

SEQ ID NO: 530624 - DNA, 16 bp, R. norvegicus
ttctgtattcctcagc

SEQ ID NO: 530625 - DNA, 16 bp, R. norvegicus
ttctgtattttatggc

SEQ ID NO: 530626 - DNA, 16 bp, R. norvegicus
ttctgtcaaatatttt

SEQ ID NO: 530627 - DNA, 16 bp, R. norvegicus
ttctgtcacacacaca

SEQ ID NO: 530628 - DNA, 16 bp, R. norvegicus
ttctgtccccagctct

SEQ ID NO: 530629 - DNA, 16 bp, R. norvegicus
ttctgtccccaggaga

SEQ ID NO: 530630 - DNA, 16 bp, R. norvegicus
ttctgtccctgtctct

SEQ ID NO: 530631 - DNA, 16 bp, R. norvegicus
ttctgtcctcagcacc

SEQ ID NO: 530632 - DNA, 16 bp, R. norvegicus
ttctgtcctccacagg

SEQ ID NO: 530633 - DNA, 16 bp, R. norvegicus
ttctgtcctctgtgga

SEQ ID NO: 530634 - DNA, 16 bp, R. norvegicus
ttctgtctccccagtg

SEQ ID NO: 530635 - DNA, 16 bp, R. norvegicus
ttctgtctctctgtgt

SEQ ID NO: 530636 - DNA, 17 bp, R. norvegicus
ttctgtctgtctgtctc

SEQ ID NO: 530637 - DNA, 16 bp, R. norvegicus
ttctgtctgtgccctg

SEQ ID NO: 530638 - DNA, 16 bp, R. norvegicus
ttctgtcttaggattt

SEQ ID NO: 530639 - DNA, 16 bp, R. norvegicus
ttctgtcttcagagac

SEQ ID NO: 530640 - DNA, 16 bp, R. norvegicus
ttctgtcttgacccag

SEQ ID NO: 530641 - DNA, 16 bp, R. norvegicus
ttctgtgacagtgaag

SEQ ID NO: 530642 - DNA, 16 bp, R. norvegicus
ttctgtgagtttctct

SEQ ID NO: 530643 - DNA, 16 bp, R. norvegicus
ttctgtgatattccct

SEQ ID NO: 530644 - DNA, 16 bp, R. norvegicus
ttctgtgatatttcac

SEQ ID NO: 530645 - DNA, 16 bp, R. norvegicus
ttctgtgatgaaacac

SEQ ID NO: 530646 - DNA, 16 bp, R. norvegicus
ttctgtgatgacaaaa

SEQ ID NO: 530647 - DNA, 16 bp, R. norvegicus
ttctgtgatgttccct

SEQ ID NO: 530648 - DNA, 16 bp, R. norvegicus
ttctgtgatgtttcct

SEQ ID NO: 530649 - DNA, 16 bp, R. norvegicus
ttctgtgattgaatta

SEQ ID NO: 530650 - DNA, 16 bp, R. norvegicus
ttctgtgcagccctgg

SEQ ID NO: 530651 - DNA, 16 bp, R. norvegicus
ttctgtgccctctggt

SEQ ID NO: 530652 - DNA, 16 bp, R. norvegicus
ttctgtgctgttcctg

SEQ ID NO: 530653 - DNA, 16 bp, R. norvegicus
ttctgtgggaaggctg

SEQ ID NO: 530654 - DNA, 16 bp, R. norvegicus
ttctgtgggttctggg

SEQ ID NO: 530655 - DNA, 16 bp, R. norvegicus
ttctgtggtggcccag

SEQ ID NO: 530656 - DNA, 16 bp, R. norvegicus
ttctgtggttactcca

SEQ ID NO: 530657 - DNA, 16 bp, R. norvegicus
ttctgtgtaaccctgg

SEQ ID NO: 530658 - DNA, 16 bp, R. norvegicus
ttctgtgtcaatgact

SEQ ID NO: 530659 - DNA, 16 bp, R. norvegicus
ttctgtgttcttctta

SEQ ID NO: 530660 - DNA, 16 bp, R. norvegicus
ttctgtgtttgcctct

SEQ ID NO: 530661 - DNA, 16 bp, R. norvegicus
ttctgttatgttctgt

SEQ ID NO: 530662 - DNA, 16 bp, R. norvegicus
ttctgttcagaaagtt

SEQ ID NO: 530663 - DNA, 16 bp, R. norvegicus
ttctgttcaggaaact

SEQ ID NO: 530664 - DNA, 16 bp, R. norvegicus
ttctgttcaggaaata

SEQ ID NO: 530665 - DNA, 16 bp, R. norvegicus
ttctgttcaggaagtt

SEQ ID NO: 530666 - DNA, 16 bp, R. norvegicus
ttctgttccatgatct

SEQ ID NO: 530667 - DNA, 16 bp, R. norvegicus
ttctgttcccagcacc

SEQ ID NO: 530668 - DNA, 16 bp, R. norvegicus
ttctgttcctattttg

SEQ ID NO: 530669 - DNA, 16 bp, R. norvegicus
ttctgttctgccccag

SEQ ID NO: 530670 - DNA, 16 bp, R. norvegicus
ttctgttctgcccctg

SEQ ID NO: 530671 - DNA, 16 bp, R. norvegicus
ttctgttgctgttgaa

SEQ ID NO: 530672 - DNA, 16 bp, R. norvegicus
ttctgttgcttacatt

SEQ ID NO: 530673 - DNA, 16 bp, R. norvegicus
ttctgttgcttgctgg

SEQ ID NO: 530674 - DNA, 16 bp, R. norvegicus
ttctgttgcttggctt

SEQ ID NO: 530675 - DNA, 16 bp, R. norvegicus
ttctgttggtgatgtt

SEQ ID NO: 530676 - DNA, 16 bp, R. norvegicus
ttctgttgttgatgct

SEQ ID NO: 530677 - DNA, 16 bp, R. norvegicus
ttctgtttactttctg

SEQ ID NO: 530678 - DNA, 16 bp, R. norvegicus
ttctgtttccagcacc

SEQ ID NO: 530679 - DNA, 16 bp, R. norvegicus
ttctgtttccatttct

SEQ ID NO: 530680 - DNA, 16 bp, R. norvegicus
ttctgtttcctcattt

SEQ ID NO: 530681 - DNA, 16 bp, R. norvegicus
ttctgtttctctgcat

SEQ ID NO: 530682 - DNA, 16 bp, R. norvegicus
ttctgtttctttagaa

SEQ ID NO: 530683 - DNA, 16 bp, R. norvegicus
ttctgtttgccagaat

SEQ ID NO: 530684 - DNA, 16 bp, R. norvegicus
ttctgtttgtcttcag

SEQ ID NO: 530685 - DNA, 16 bp, R. norvegicus
ttcttaaaaatgaaca

SEQ ID NO: 530686 - DNA, 16 bp, R. norvegicus
ttcttaaaagataaaa

SEQ ID NO: 530687 - DNA, 16 bp, R. norvegicus
ttcttaaaattgaagg

SEQ ID NO: 530688 - DNA, 16 bp, R. norvegicus
ttcttaaagaggaaat

SEQ ID NO: 530689 - DNA, 16 bp, R. norvegicus
ttcttaaagatttatt

SEQ ID NO: 530690 - DNA, 16 bp, R. norvegicus
ttcttaacagccttta

SEQ ID NO: 530691 - DNA, 16 bp, R. norvegicus
ttcttaacatcagcaa

SEQ ID NO: 530692 - DNA, 16 bp, R. norvegicus
ttcttaaccgctgagc

SEQ ID NO: 530693 - DNA, 16 bp, R. norvegicus
ttcttaagggatggat

SEQ ID NO: 530694 - DNA, 16 bp, R. norvegicus
ttcttacaaaccaaat

SEQ ID NO: 530695 - DNA, 16 bp, R. norvegicus
ttcttacactcaaacc

SEQ ID NO: 530696 - DNA, 16 bp, R. norvegicus
ttcttacagaatccag

SEQ ID NO: 530697 - DNA, 16 bp, R. norvegicus
ttcttactccttggag

SEQ ID NO: 530698 - DNA, 16 bp, R. norvegicus
ttcttagaagaagaaa

SEQ ID NO: 530699 - DNA, 16 bp, R. norvegicus
ttcttagaatttactg

SEQ ID NO: 530700 - DNA, 16 bp, R. norvegicus
ttcttagcatcagcaa

SEQ ID NO: 530701 - DNA, 16 bp, R. norvegicus
ttcttaggcaaatgca

SEQ ID NO: 530702 - DNA, 16 bp, R. norvegicus
ttcttagtcccaagga

SEQ ID NO: 530703 - DNA, 16 bp, R. norvegicus
ttcttagttaaaaaaa

SEQ ID NO: 530704 - DNA, 16 bp, R. norvegicus
ttcttagtttaaaaaa

SEQ ID NO: 530705 - DNA, 16 bp, R. norvegicus
ttcttataacacccag

SEQ ID NO: 530706 - DNA, 16 bp, R. norvegicus
ttcttatacaacccag

SEQ ID NO: 530707 - DNA, 16 bp, R. norvegicus
ttcttatatcaaataa

SEQ ID NO: 530708 - DNA, 16 bp, R. norvegicus
ttcttatcataaagat

SEQ ID NO: 530709 - DNA, 16 bp, R. norvegicus
ttcttatcctttgtag

SEQ ID NO: 530710 - DNA, 16 bp, R. norvegicus
ttcttatctgtaaaat

SEQ ID NO: 530711 - DNA, 16 bp, R. norvegicus
ttcttattatcaaaat

SEQ ID NO: 530712 - DNA, 16 bp, R. norvegicus
ttcttattctctgtct

SEQ ID NO: 530713 - DNA, 16 bp, R. norvegicus
ttcttcaaaaacagat

SEQ ID NO: 530714 - DNA, 16 bp, R. norvegicus
ttcttcaatctttccc

SEQ ID NO: 530715 - DNA, 16 bp, R. norvegicus
ttcttcaatgacttga

SEQ ID NO: 530716 - DNA, 16 bp, R. norvegicus
ttcttcaattccttca

SEQ ID NO: 530717 - DNA, 16 bp, R. norvegicus
ttcttcacagagaaag

SEQ ID NO: 530718 - DNA, 16 bp, R. norvegicus
ttcttcacagctcctc

SEQ ID NO: 530719 - DNA, 16 bp, R. norvegicus
ttcttcacaggcttga

SEQ ID NO: 530720 - DNA, 17 bp, R. norvegicus
ttcttcacgtctcttgt

SEQ ID NO: 530721 - DNA, 16 bp, R. norvegicus
ttcttcagaaaaaaaa

SEQ ID NO: 530722 - DNA, 16 bp, R. norvegicus
ttcttcagaatcttga

SEQ ID NO: 530723 - DNA, 16 bp, R. norvegicus
ttcttcagagacttca

SEQ ID NO: 530724 - DNA, 16 bp, R. norvegicus
ttcttcagctccagct

SEQ ID NO: 530725 - DNA, 16 bp, R. norvegicus
ttcttcagctccttca

SEQ ID NO: 530726 - DNA, 16 bp, R. norvegicus
ttcttcagcttcagaa

SEQ ID NO: 530727 - DNA, 16 bp, R. norvegicus
ttcttcagcttcttcc

SEQ ID NO: 530728 - DNA, 16 bp, R. norvegicus
ttcttcaggaaaattt

SEQ ID NO: 530729 - DNA, 16 bp, R. norvegicus
ttcttcaggccccacc

SEQ ID NO: 530730 - DNA, 16 bp, R. norvegicus
ttcttcaggcttttct

SEQ ID NO: 530731 - DNA, 16 bp, R. norvegicus
ttcttcagggacttga

SEQ ID NO: 530732 - DNA, 16 bp, R. norvegicus
ttcttcagtctttcct

SEQ ID NO: 530733 - DNA, 16 bp, R. norvegicus
ttcttcagtgtctgct

SEQ ID NO: 530734 - DNA, 16 bp, R. norvegicus
ttcttcagtgtcttaa

SEQ ID NO: 530735 - DNA, 16 bp, R. norvegicus
ttcttcagtttctgct

SEQ ID NO: 530736 - DNA, 16 bp, R. norvegicus
ttcttcataattttgt

SEQ ID NO: 530737 - DNA, 16 bp, R. norvegicus
ttcttcatagagtcag

SEQ ID NO: 530738 - DNA, 16 bp, R. norvegicus
ttcttcatcctttgtt

SEQ ID NO: 530739 - DNA, 16 bp, R. norvegicus
ttcttcatgttttaaa

SEQ ID NO: 530740 - DNA, 16 bp, R. norvegicus
ttcttcatttaaagaa

SEQ ID NO: 530741 - DNA, 16 bp, R. norvegicus
ttcttcatttctgtct

SEQ ID NO: 530742 - DNA, 16 bp, R. norvegicus
ttcttccaaactgaat

SEQ ID NO: 530743 - DNA, 16 bp, R. norvegicus
ttcttccacccatcct

SEQ ID NO: 530744 - DNA, 16 bp, R. norvegicus
ttcttccagaggactc

SEQ ID NO: 530745 - DNA, 18 bp, R. norvegicus
ttcttccagaggtcctga

SEQ ID NO: 530746 - DNA, 16 bp, R. norvegicus
ttcttccattggatgt

SEQ ID NO: 530747 - DNA, 16 bp, R. norvegicus
ttcttcccatgatcct

SEQ ID NO: 530748 - DNA, 16 bp, R. norvegicus
ttcttcccctctgaaa

SEQ ID NO: 530749 - DNA, 16 bp, R. norvegicus
ttcttccctccaaacc

SEQ ID NO: 530750 - DNA, 16 bp, R. norvegicus
ttcttccctccaaact

SEQ ID NO: 530751 - DNA, 16 bp, R. norvegicus
ttcttccctgaggaag

SEQ ID NO: 530752 - DNA, 16 bp, R. norvegicus
ttcttcctataaggtt

SEQ ID NO: 530753 - DNA, 16 bp, R. norvegicus
ttcttcctatgcagtt

SEQ ID NO: 530754 - DNA, 16 bp, R. norvegicus
ttcttcctccttctga

SEQ ID NO: 530755 - DNA, 16 bp, R. norvegicus
ttcttcctctggggtt

SEQ ID NO: 530756 - DNA, 16 bp, R. norvegicus
ttcttcctgaggacct

SEQ ID NO: 530757 - DNA, 16 bp, R. norvegicus
ttcttcctgctgtctg

SEQ ID NO: 530758 - DNA, 16 bp, R. norvegicus
ttcttcctggggcagt

SEQ ID NO: 530759 - DNA, 16 bp, R. norvegicus
ttcttcctgtggagca

SEQ ID NO: 530760 - DNA, 16 bp, R. norvegicus
ttcttccttcaccaag

SEQ ID NO: 530761 - DNA, 16 bp, R. norvegicus
ttcttcctttcaaatt

SEQ ID NO: 530762 - DNA, 16 bp, R. norvegicus
ttcttcctttctgatc

SEQ ID NO: 530763 - DNA, 16 bp, R. norvegicus
ttcttcctttgaaaat

SEQ ID NO: 530764 - DNA, 16 bp, R. norvegicus
ttcttcctttgagaaa

SEQ ID NO: 530765 - DNA, 16 bp, R. norvegicus
ttcttccttttgaatt

SEQ ID NO: 530766 - DNA, 16 bp, R. norvegicus
ttcttctactctgaac

SEQ ID NO: 530767 - DNA, 16 bp, R. norvegicus
ttcttctatgcctatg

SEQ ID NO: 530768 - DNA, 16 bp, R. norvegicus
ttcttctattgtgtga

SEQ ID NO: 530769 - DNA, 16 bp, R. norvegicus
ttcttctcagtacctt

SEQ ID NO: 530770 - DNA, 16 bp, R. norvegicus
ttcttctctaagggtg

SEQ ID NO: 530771 - DNA, 16 bp, R. norvegicus
ttcttctgacctccat

SEQ ID NO: 530772 - DNA, 16 bp, R. norvegicus
ttcttctgattctgtt

SEQ ID NO: 530773 - DNA, 16 bp, R. norvegicus
ttcttctgcctcagcc

SEQ ID NO: 530774 - DNA, 16 bp, R. norvegicus
ttcttctgcctcctga

SEQ ID NO: 530775 - DNA, 16 bp, R. norvegicus
ttcttctggcctcttc

SEQ ID NO: 530776 - DNA, 16 bp, R. norvegicus
ttcttctggtctccat

SEQ ID NO: 530777 - DNA, 16 bp, R. norvegicus
ttcttctgtggcttct

SEQ ID NO: 530778 - DNA, 16 bp, R. norvegicus
ttcttctgttttggag

SEQ ID NO: 530779 - DNA, 16 bp, R. norvegicus
ttcttctttgaatcca

SEQ ID NO: 530780 - DNA, 16 bp, R. norvegicus
ttcttgaactttctca

SEQ ID NO: 530781 - DNA, 16 bp, R. norvegicus
ttcttgagggatggat

SEQ ID NO: 530782 - DNA, 16 bp, R. norvegicus
ttcttgagttttctgt

SEQ ID NO: 530783 - DNA, 16 bp, R. norvegicus
ttcttgatgccatttc

SEQ ID NO: 530784 - DNA, 16 bp, R. norvegicus
ttcttgattgatgtgg

SEQ ID NO: 530785 - DNA, 16 bp, R. norvegicus
ttcttgcaaactaaat

SEQ ID NO: 530786 - DNA, 16 bp, R. norvegicus
ttcttgcaaaggacca

SEQ ID NO: 530787 - DNA, 16 bp, R. norvegicus
ttcttgccaagatgat

SEQ ID NO: 530788 - DNA, 16 bp, R. norvegicus
ttcttgcctctgcttc

SEQ ID NO: 530789 - DNA, 16 bp, R. norvegicus
ttcttgctgcttcctc

SEQ ID NO: 530790 - DNA, 16 bp, R. norvegicus
ttcttgctgtgacaaa

SEQ ID NO: 530791 - DNA, 16 bp, R. norvegicus
ttcttggagcagaaaa

SEQ ID NO: 530792 - DNA, 16 bp, R. norvegicus
ttcttggcatcagcaa

SEQ ID NO: 530793 - DNA, 16 bp, R. norvegicus
ttcttggctttcttta

SEQ ID NO: 530794 - DNA, 16 bp, R. norvegicus
ttcttgggaccttttg

SEQ ID NO: 530795 - DNA, 16 bp, R. norvegicus
ttcttggggctggaga

SEQ ID NO: 530796 - DNA, 16 bp, R. norvegicus
ttcttggtcatgatgg

SEQ ID NO: 530797 - DNA, 16 bp, R. norvegicus
ttcttggtggattttt

SEQ ID NO: 530798 - DNA, 16 bp, R. norvegicus
ttcttgtatatattgg

SEQ ID NO: 530799 - DNA, 16 bp, R. norvegicus
ttcttgtgggactcct

SEQ ID NO: 530800 - DNA, 16 bp, R. norvegicus
ttcttgtttttcaaga

SEQ ID NO: 530801 - DNA, 16 bp, R. norvegicus
ttctttaaaaaagaaa

SEQ ID NO: 530802 - DNA, 16 bp, R. norvegicus
ttctttaaatgaagaa

SEQ ID NO: 530803 - DNA, 16 bp, R. norvegicus
ttctttaagaaagcaa

SEQ ID NO: 530804 - DNA, 16 bp, R. norvegicus
ttctttacatcctggc

SEQ ID NO: 530805 - DNA, 16 bp, R. norvegicus
ttctttacctattatc

SEQ ID NO: 530806 - DNA, 16 bp, R. norvegicus
ttctttaggtggttct

SEQ ID NO: 530807 - DNA, 16 bp, R. norvegicus
ttctttatgggttttc

SEQ ID NO: 530808 - DNA, 16 bp, R. norvegicus
ttctttcaaactgaat

SEQ ID NO: 530809 - DNA, 16 bp, R. norvegicus
ttctttcaagttctgt

SEQ ID NO: 530810 - DNA, 16 bp, R. norvegicus
ttctttcagtcagatc

SEQ ID NO: 530811 - DNA, 16 bp, R. norvegicus
ttctttccaggatttt

SEQ ID NO: 530812 - DNA, 16 bp, R. norvegicus
ttctttccagtctctg

SEQ ID NO: 530813 - DNA, 16 bp, R. norvegicus
ttctttccttgacttt

SEQ ID NO: 530814 - DNA, 16 bp, R. norvegicus
ttctttctctgactct

SEQ ID NO: 530815 - DNA, 16 bp, R. norvegicus
ttctttctgctgcctg

SEQ ID NO: 530816 - DNA, 16 bp, R. norvegicus
ttctttctgttttaaa

SEQ ID NO: 530817 - DNA, 16 bp, R. norvegicus
ttctttcttcaaagac

SEQ ID NO: 530818 - DNA, 16 bp, R. norvegicus
ttctttcttcagagaa

SEQ ID NO: 530819 - DNA, 16 bp, R. norvegicus
ttctttcttcagtgtt

SEQ ID NO: 530820 - DNA, 16 bp, R. norvegicus
ttctttctttgaaaag

SEQ ID NO: 530821 - DNA, 16 bp, R. norvegicus
ttctttcttttcaaga

SEQ ID NO: 530822 - DNA, 16 bp, R. norvegicus
ttctttgaaaaagaaa

SEQ ID NO: 530823 - DNA, 16 bp, R. norvegicus
ttctttgaaaagaaaa

SEQ ID NO: 530824 - DNA, 16 bp, R. norvegicus
ttctttgaaattttat

SEQ ID NO: 530825 - DNA, 16 bp, R. norvegicus
ttctttgaaggtctaa

SEQ ID NO: 530826 - DNA, 16 bp, R. norvegicus
ttctttgaatatatta

SEQ ID NO: 530827 - DNA, 16 bp, R. norvegicus
ttctttgaatttcctt

SEQ ID NO: 530828 - DNA, 16 bp, R. norvegicus
ttctttgagaacttca

SEQ ID NO: 530829 - DNA, 16 bp, R. norvegicus
ttctttgagaagataa

SEQ ID NO: 530830 - DNA, 16 bp, R. norvegicus
ttctttgaggagaagg

SEQ ID NO: 530831 - DNA, 16 bp, R. norvegicus
ttctttgattccttca

SEQ ID NO: 530832 - DNA, 16 bp, R. norvegicus
ttctttgcctgcttgc

SEQ ID NO: 530833 - DNA, 16 bp, R. norvegicus
ttctttgctgtgaaga

SEQ ID NO: 530834 - DNA, 16 bp, R. norvegicus
ttctttggaccattta

SEQ ID NO: 530835 - DNA, 16 bp, R. norvegicus
ttctttgggaagtcag

SEQ ID NO: 530836 - DNA, 16 bp, R. norvegicus
ttctttgggattctgg

SEQ ID NO: 530837 - DNA, 16 bp, R. norvegicus
ttctttgggtctgtga

SEQ ID NO: 530838 - DNA, 16 bp, R. norvegicus
ttctttgtaagagttg

SEQ ID NO: 530839 - DNA, 16 bp, R. norvegicus
ttctttgtagctctgg

SEQ ID NO: 530840 - DNA, 16 bp, R. norvegicus
ttctttgtattgttcc

SEQ ID NO: 530841 - DNA, 16 bp, R. norvegicus
ttctttgtctttgaaa

SEQ ID NO: 530842 - DNA, 16 bp, R. norvegicus
ttctttgtgagtttca

SEQ ID NO: 530843 - DNA, 16 bp, R. norvegicus
ttctttgtggaggcac

SEQ ID NO: 530844 - DNA, 16 bp, R. norvegicus
ttctttgtgttggagt

SEQ ID NO: 530845 - DNA, 16 bp, R. norvegicus
ttctttgttgtcacag

SEQ ID NO: 530846 - DNA, 16 bp, R. norvegicus
ttctttgtttagccct

SEQ ID NO: 530847 - DNA, 16 bp, R. norvegicus
ttctttgttttgagca

SEQ ID NO: 530848 - DNA, 16 bp, R. norvegicus
ttcttttaaaaacata

SEQ ID NO: 530849 - DNA, 16 bp, R. norvegicus
ttcttttagaaaggaa

SEQ ID NO: 530850 - DNA, 16 bp, R. norvegicus
ttcttttatgaatatg

SEQ ID NO: 530851 - DNA, 16 bp, R. norvegicus
ttcttttcaaaataaa

SEQ ID NO: 530852 - DNA, 16 bp, R. norvegicus
ttcttttcagctcctc

SEQ ID NO: 530853 - DNA, 16 bp, R. norvegicus
ttcttttcaggacttt

SEQ ID NO: 530854 - DNA, 16 bp, R. norvegicus
ttcttttcatcttctg

SEQ ID NO: 530855 - DNA, 16 bp, R. norvegicus
ttcttttccagtcttt

SEQ ID NO: 530856 - DNA, 16 bp, R. norvegicus
ttcttttcctctgaaa

SEQ ID NO: 530857 - DNA, 16 bp, R. norvegicus
ttcttttctgattggg

SEQ ID NO: 530858 - DNA, 16 bp, R. norvegicus
ttcttttctttccaag

SEQ ID NO: 530859 - DNA, 16 bp, R. norvegicus
ttcttttctttgaaat

SEQ ID NO: 530860 - DNA, 16 bp, R. norvegicus
ttcttttgaagaaaaa

SEQ ID NO: 530861 - DNA, 16 bp, R. norvegicus
ttcttttgatgatgaa

SEQ ID NO: 530862 - DNA, 16 bp, R. norvegicus
ttcttttgcctttaat

SEQ ID NO: 530863 - DNA, 16 bp, R. norvegicus
ttcttttgggaggcac

SEQ ID NO: 530864 - DNA, 16 bp, R. norvegicus
ttctttttaaaattgt

SEQ ID NO: 530865 - DNA, 16 bp, R. norvegicus
ttctttttaaagtatt

SEQ ID NO: 530866 - DNA, 16 bp, R. norvegicus
ttctttttatggggtt

SEQ ID NO: 530867 - DNA, 16 bp, R. norvegicus
ttctttttcaaaaaca

SEQ ID NO: 530868 - DNA, 16 bp, R. norvegicus
ttctttttccaatctg

SEQ ID NO: 530869 - DNA, 16 bp, R. norvegicus
ttctttttctaaaaaa

SEQ ID NO: 530870 - DNA, 16 bp, R. norvegicus
ttctttttctttgcaa

SEQ ID NO: 530871 - DNA, 16 bp, R. norvegicus
ttctttttgagacaga

SEQ ID NO: 530872 - DNA, 16 bp, R. norvegicus
ttctttttgttctcaa

SEQ ID NO: 530873 - DNA, 16 bp, R. norvegicus
ttcttttttaaaaaca

SEQ ID NO: 530874 - DNA, 16 bp, R. norvegicus
ttcttttttgattggg

SEQ ID NO: 530875 - DNA, 16 bp, R. norvegicus
ttctttttttaaagac

SEQ ID NO: 530876 - DNA, 17 bp, R. norvegicus
ttctttttttcggagct

SEQ ID NO: 530877 - DNA, 16 bp, R. norvegicus
ttgaaaaaaaaatcca

SEQ ID NO: 530878 - DNA, 16 bp, R. norvegicus
ttgaaaaacaaaacag

SEQ ID NO: 530879 - DNA, 16 bp, R. norvegicus
ttgaaaaacagaacaa

SEQ ID NO: 530880 - DNA, 16 bp, R. norvegicus
ttgaaaaaccaaaaat

SEQ ID NO: 530881 - DNA, 16 bp, R. norvegicus
ttgaaaaagctgaagg

SEQ ID NO: 530882 - DNA, 16 bp, R. norvegicus
ttgaaaaatgaaaatg

SEQ ID NO: 530883 - DNA, 16 bp, R. norvegicus
ttgaaaaatgctgtct

SEQ ID NO: 530884 - DNA, 16 bp, R. norvegicus
ttgaaaacaaagacat

SEQ ID NO: 530885 - DNA, 16 bp, R. norvegicus
ttgaaaacaaagcaaa

SEQ ID NO: 530886 - DNA, 16 bp, R. norvegicus
ttgaaaacacacacac

SEQ ID NO: 530887 - DNA, 16 bp, R. norvegicus
ttgaaaacattgacac

SEQ ID NO: 530888 - DNA, 16 bp, R. norvegicus
ttgaaaagaaaaagac

SEQ ID NO: 530889 - DNA, 16 bp, R. norvegicus
ttgaaaagaaaaccaa

SEQ ID NO: 530890 - DNA, 16 bp, R. norvegicus
ttgaaaagatcagaaa

SEQ ID NO: 530891 - DNA, 16 bp, R. norvegicus
ttgaaaagggacagct

SEQ ID NO: 530892 - DNA, 16 bp, R. norvegicus
ttgaaaatacaaaaca

SEQ ID NO: 530893 - DNA, 16 bp, R. norvegicus
ttgaaaatatgtattt

SEQ ID NO: 530894 - DNA, 16 bp, R. norvegicus
ttgaaaatcaaaacaa

SEQ ID NO: 530895 - DNA, 16 bp, R. norvegicus
ttgaaaatgataatgg

SEQ ID NO: 530896 - DNA, 16 bp, R. norvegicus
ttgaaaatgttatctt

SEQ ID NO: 530897 - DNA, 16 bp, R. norvegicus
ttgaaaattttataca

SEQ ID NO: 530898 - DNA, 16 bp, R. norvegicus
ttgaaacctcaaaatc

SEQ ID NO: 530899 - DNA, 16 bp, R. norvegicus
ttgaaacctcacccca

SEQ ID NO: 530900 - DNA, 16 bp, R. norvegicus
ttgaaactttaaagcc

SEQ ID NO: 530901 - DNA, 16 bp, R. norvegicus
ttgaaagaaaaatact

SEQ ID NO: 530902 - DNA, 21 bp, R. norvegicus
ttgaaagaaaacacgtacacg

SEQ ID NO: 530903 - DNA, 16 bp, R. norvegicus
ttgaaagaaaggccat

SEQ ID NO: 530904 - DNA, 16 bp, R. norvegicus
ttgaaagacccctgga

SEQ ID NO: 530905 - DNA, 16 bp, R. norvegicus
ttgaaagagaacaaag

SEQ ID NO: 530906 - DNA, 16 bp, R. norvegicus
ttgaaagagcagaagg

SEQ ID NO: 530907 - DNA, 16 bp, R. norvegicus
ttgaaagagctcacca

SEQ ID NO: 530908 - DNA, 16 bp, R. norvegicus
ttgaaagagctgaaga

SEQ ID NO: 530909 - DNA, 16 bp, R. norvegicus
ttgaaagatattaaag

SEQ ID NO: 530910 - DNA, 17 bp, R. norvegicus
ttgaaaggttatgtgaa

SEQ ID NO: 530911 - DNA, 16 bp, R. norvegicus
ttgaaatctcctacaa

SEQ ID NO: 530912 - DNA, 16 bp, R. norvegicus
ttgaaatgaaaataca

SEQ ID NO: 530913 - DNA, 16 bp, R. norvegicus
ttgaaatgtacataca

SEQ ID NO: 530914 - DNA, 16 bp, R. norvegicus
ttgaaattaaaatgta

SEQ ID NO: 530915 - DNA, 16 bp, R. norvegicus
ttgaaattctatttta

SEQ ID NO: 530916 - DNA, 16 bp, R. norvegicus
ttgaaattgaaattga

SEQ ID NO: 530917 - DNA, 16 bp, R. norvegicus
ttgaaatttcaaaagc

SEQ ID NO: 530918 - DNA, 54 bp, R. norvegicus
ttgaaattttcagattccagcacttcctcctctacacataaaccaggaggggga

SEQ ID NO: 530919 - DNA, 16 bp, R. norvegicus
ttgaacaaaatgatcc

SEQ ID NO: 530920 - DNA, 16 bp, R. norvegicus
ttgaacaagcctatga

SEQ ID NO: 530921 - DNA, 16 bp, R. norvegicus
ttgaacacatggccac

SEQ ID NO: 530922 - DNA, 16 bp, R. norvegicus
ttgaacacattttaaa

SEQ ID NO: 530923 - DNA, 16 bp, R. norvegicus
ttgaacacccagaaat

SEQ ID NO: 530924 - DNA, 16 bp, R. norvegicus
ttgaacagagaacagg

SEQ ID NO: 530925 - DNA, 16 bp, R. norvegicus
ttgaacatagagaagt

SEQ ID NO: 530926 - DNA, 16 bp, R. norvegicus
ttgaacccagggtttc

SEQ ID NO: 530927 - DNA, 16 bp, R. norvegicus
ttgaacctgggttctt

SEQ ID NO: 530928 - DNA, 16 bp, R. norvegicus
ttgaactacctgaggg

SEQ ID NO: 530929 - DNA, 16 bp, R. norvegicus
ttgaactcaaagagat

SEQ ID NO: 530930 - DNA, 16 bp, R. norvegicus
ttgaactcaagagatt

SEQ ID NO: 530931 - DNA, 16 bp, R. norvegicus
ttgaactcaccaagat

SEQ ID NO: 530932 - DNA, 23 bp, R. norvegicus
ttgaactcaggacctctggaaga

SEQ ID NO: 530933 - DNA, 16 bp, R. norvegicus
ttgaactcaggacttc

SEQ ID NO: 530934 - DNA, 16 bp, R. norvegicus
ttgaactcatgacctt

SEQ ID NO: 530935 - DNA, 16 bp, R. norvegicus
ttgaactcatggaaat

SEQ ID NO: 530936 - DNA, 16 bp, R. norvegicus
ttgaactcctaatcct

SEQ ID NO: 530937 - DNA, 16 bp, R. norvegicus
ttgaactcctgacctc

SEQ ID NO: 530938 - DNA, 16 bp, R. norvegicus
ttgaactcctgattct

SEQ ID NO: 530939 - DNA, 16 bp, R. norvegicus
ttgaactggaggtcaa

SEQ ID NO: 530940 - DNA, 16 bp, R. norvegicus
ttgaacttctgatcct

SEQ ID NO: 530941 - DNA, 16 bp, R. norvegicus
ttgaacttctggtcct

SEQ ID NO: 530942 - DNA, 16 bp, R. norvegicus
ttgaacttgtttcaaa

SEQ ID NO: 530943 - DNA, 16 bp, R. norvegicus
ttgaagaaaaaggtca

SEQ ID NO: 530944 - DNA, 16 bp, R. norvegicus
ttgaagaaagaaactg

SEQ ID NO: 530945 - DNA, 16 bp, R. norvegicus
ttgaagaaagaaatca

SEQ ID NO: 530946 - DNA, 16 bp, R. norvegicus
ttgaagaaatcagaga

SEQ ID NO: 530947 - DNA, 16 bp, R. norvegicus
ttgaagaaatgttcaa

SEQ ID NO: 530948 - DNA, 16 bp, R. norvegicus
ttgaagaaattgaaga

SEQ ID NO: 530949 - DNA, 16 bp, R. norvegicus
ttgaagaacagctttt

SEQ ID NO: 530950 - DNA, 16 bp, R. norvegicus
ttgaagaaccagaaat

SEQ ID NO: 530951 - DNA, 16 bp, R. norvegicus
ttgaagaagaggaaga

SEQ ID NO: 530952 - DNA, 16 bp, R. norvegicus
ttgaagaagatggaaa

SEQ ID NO: 530953 - DNA, 16 bp, R. norvegicus
ttgaagaagccctcag

SEQ ID NO: 530954 - DNA, 16 bp, R. norvegicus
ttgaagaagctgaagg

SEQ ID NO: 530955 - DNA, 16 bp, R. norvegicus
ttgaagaagttataga

SEQ ID NO: 530956 - DNA, 16 bp, R. norvegicus
ttgaagacagtgacag

SEQ ID NO: 530957 - DNA, 16 bp, R. norvegicus
ttgaagaccaccttta

SEQ ID NO: 530958 - DNA, 16 bp, R. norvegicus
ttgaagacccagaaac

SEQ ID NO: 530959 - DNA, 16 bp, R. norvegicus
ttgaagacctggaaat

SEQ ID NO: 530960 - DNA, 16 bp, R. norvegicus
ttgaagactctgaaga

SEQ ID NO: 530961 - DNA, 38 bp, R. norvegicus
ttgaagactttacctcatgggttaccaatgctttctcc

SEQ ID NO: 530962 - DNA, 16 bp, R. norvegicus
ttgaagaggacccagg

SEQ ID NO: 530963 - DNA, 16 bp, R. norvegicus
ttgaagatattttcta

SEQ ID NO: 530964 - DNA, 16 bp, R. norvegicus
ttgaagatgactttga

SEQ ID NO: 530965 - DNA, 16 bp, R. norvegicus
ttgaagatgctttcct

SEQ ID NO: 530966 - DNA, 16 bp, R. norvegicus
ttgaagatgtttgctg

SEQ ID NO: 530967 - DNA, 16 bp, R. norvegicus
ttgaagcatttgggct

SEQ ID NO: 530968 - DNA, 16 bp, R. norvegicus
ttgaagccaagcagag

SEQ ID NO: 530969 - DNA, 16 bp, R. norvegicus
ttgaaggaaacaaata

SEQ ID NO: 530970 - DNA, 16 bp, R. norvegicus
ttgaaggaagaaagta

SEQ ID NO: 530971 - DNA, 16 bp, R. norvegicus
ttgaaggaagaggaag

SEQ ID NO: 530972 - DNA, 16 bp, R. norvegicus
ttgaaggaagcagaga

SEQ ID NO: 530973 - DNA, 16 bp, R. norvegicus
ttgaaggaagtggagg

SEQ ID NO: 530974 - DNA, 16 bp, R. norvegicus
ttgaaggaataaaaat

SEQ ID NO: 530975 - DNA, 16 bp, R. norvegicus
ttgaaggaattgaaca

SEQ ID NO: 530976 - DNA, 16 bp, R. norvegicus
ttgaaggacctgaagg

SEQ ID NO: 530977 - DNA, 16 bp, R. norvegicus
ttgaaggactatcctc

SEQ ID NO: 530978 - DNA, 16 bp, R. norvegicus
ttgaaggagaaggaag

SEQ ID NO: 530979 - DNA, 16 bp, R. norvegicus
ttgaaggagaatggcc

SEQ ID NO: 530980 - DNA, 16 bp, R. norvegicus
ttgaaggagctggagg

SEQ ID NO: 530981 - DNA, 16 bp, R. norvegicus
ttgaaggagcttgaga

SEQ ID NO: 530982 - DNA, 16 bp, R. norvegicus
ttgaaggatggggcca

SEQ ID NO: 530983 - DNA, 16 bp, R. norvegicus
ttgaagggcctctggg

SEQ ID NO: 530984 - DNA, 16 bp, R. norvegicus
ttgaagggtggggcca

SEQ ID NO: 530985 - DNA, 16 bp, R. norvegicus
ttgaaggtctggccac

SEQ ID NO: 530986 - DNA, 16 bp, R. norvegicus
ttgaagtccaacttta

SEQ ID NO: 530987 - DNA, 16 bp, R. norvegicus
ttgaagtggacacagg

SEQ ID NO: 530988 - DNA, 16 bp, R. norvegicus
ttgaagttttgtatag

SEQ ID NO: 530989 - DNA, 16 bp, R. norvegicus
ttgaatatatttactg

SEQ ID NO: 530990 - DNA, 16 bp, R. norvegicus
ttgaatatttcttata

SEQ ID NO: 530991 - DNA, 16 bp, R. norvegicus
ttgaatccattgatat

SEQ ID NO: 530992 - DNA, 16 bp, R. norvegicus
ttgaatctgaacacag

SEQ ID NO: 530993 - DNA, 16 bp, R. norvegicus
ttgaatggctgagatg

SEQ ID NO: 530994 - DNA, 16 bp, R. norvegicus
ttgaatgtgaagtgtc

SEQ ID NO: 530995 - DNA, 16 bp, R. norvegicus
ttgaattcacagagat

SEQ ID NO: 530996 - DNA, 16 bp, R. norvegicus
ttgaattcagagatcc

SEQ ID NO: 530997 - DNA, 16 bp, R. norvegicus
ttgaattcagccctga

SEQ ID NO: 530998 - DNA, 16 bp, R. norvegicus
ttgaattcccagagat

SEQ ID NO: 530999 - DNA, 16 bp, R. norvegicus
ttgaattccctatgaa

SEQ ID NO: 531000 - DNA, 16 bp, R. norvegicus
ttgaattcctggtcct

SEQ ID NO: 531001 - DNA, 16 bp, R. norvegicus
ttgaattctgccccaa

SEQ ID NO: 531002 - DNA, 16 bp, R. norvegicus
ttgaattctttctttc

SEQ ID NO: 531003 - DNA, 16 bp, R. norvegicus
ttgaatttagtcaaat

SEQ ID NO: 531004 - DNA, 16 bp, R. norvegicus
ttgaatttcaaatgtt

SEQ ID NO: 531005 - DNA, 16 bp, R. norvegicus
ttgaatttcctcaaat

SEQ ID NO: 531006 - DNA, 16 bp, R. norvegicus
ttgaattttcctgatg

SEQ ID NO: 531007 - DNA, 16 bp, R. norvegicus
ttgaattttctgagga

SEQ ID NO: 531008 - DNA, 16 bp, R. norvegicus
ttgaattttgtgcagg

SEQ ID NO: 531009 - DNA, 16 bp, R. norvegicus
ttgacacaatcatcaa

SEQ ID NO: 531010 - DNA, 16 bp, R. norvegicus
ttgacagcaaaaagat

SEQ ID NO: 531011 - DNA, 16 bp, R. norvegicus
ttgacagcacacctca

SEQ ID NO: 531012 - DNA, 16 bp, R. norvegicus
ttgacagggaagagga

SEQ ID NO: 531013 - DNA, 16 bp, R. norvegicus
ttgacagttgagttga

SEQ ID NO: 531014 - DNA, 16 bp, R. norvegicus
ttgacataaaactgga

SEQ ID NO: 531015 - DNA, 16 bp, R. norvegicus
ttgacattttttccct

SEQ ID NO: 531016 - DNA, 16 bp, R. norvegicus
ttgaccaaggagccaa

SEQ ID NO: 531017 - DNA, 16 bp, R. norvegicus
ttgaccagccagccag

SEQ ID NO: 531018 - DNA, 16 bp, R. norvegicus
ttgaccaggctgacct

SEQ ID NO: 531019 - DNA, 16 bp, R. norvegicus
ttgaccatgatgctgg

SEQ ID NO: 531020 - DNA, 16 bp, R. norvegicus
ttgaccctgagctcct

SEQ ID NO: 531021 - DNA, 16 bp, R. norvegicus
ttgacccttctggctc

SEQ ID NO: 531022 - DNA, 16 bp, R. norvegicus
ttgacctctctggttc

SEQ ID NO: 531023 - DNA, 16 bp, R. norvegicus
ttgacctcttcctttc

SEQ ID NO: 531024 - DNA, 16 bp, R. norvegicus
ttgacctgaggcagtg

SEQ ID NO: 531025 - DNA, 16 bp, R. norvegicus
ttgacctgcctctgcc

SEQ ID NO: 531026 - DNA, 16 bp, R. norvegicus
ttgacggttgtgtcaa

SEQ ID NO: 531027 - DNA, 16 bp, R. norvegicus
ttgactatgtcctcac

SEQ ID NO: 531028 - DNA, 16 bp, R. norvegicus
ttgactcaggacctct

SEQ ID NO: 531029 - DNA, 17 bp, R. norvegicus
ttgactcgaaaattgcc

SEQ ID NO: 531030 - DNA, 16 bp, R. norvegicus
ttgactgtgggattgc

SEQ ID NO: 531031 - DNA, 16 bp, R. norvegicus
ttgacttcaagcagta

SEQ ID NO: 531032 - DNA, 16 bp, R. norvegicus
ttgacttccagttgaa

SEQ ID NO: 531033 - DNA, 16 bp, R. norvegicus
ttgacttgctgtatat

SEQ ID NO: 531034 - DNA, 16 bp, R. norvegicus
ttgactttaatcacag

SEQ ID NO: 531035 - DNA, 16 bp, R. norvegicus
ttgactttctggagtc

SEQ ID NO: 531036 - DNA, 16 bp, R. norvegicus
ttgactttgggctagg

SEQ ID NO: 531037 - DNA, 16 bp, R. norvegicus
ttgagaaaatattttt

SEQ ID NO: 531038 - DNA, 17 bp, R. norvegicus
ttgagaaaatcagcaag

SEQ ID NO: 531039 - DNA, 16 bp, R. norvegicus
ttgagaaaattcctcc

SEQ ID NO: 531040 - DNA, 16 bp, R. norvegicus
ttgagaaagaagccaa

SEQ ID NO: 531041 - DNA, 16 bp, R. norvegicus
ttgagaaaggatcttt

SEQ ID NO: 531042 - DNA, 16 bp, R. norvegicus
ttgagaaagtcaacaa

SEQ ID NO: 531043 - DNA, 16 bp, R. norvegicus
ttgagaaatcaacaag

SEQ ID NO: 531044 - DNA, 16 bp, R. norvegicus
ttgagaaatcatttga

SEQ ID NO: 531045 - DNA, 16 bp, R. norvegicus
ttgagaaatttttcac

SEQ ID NO: 531046 - DNA, 16 bp, R. norvegicus
ttgagaaccacagcat

SEQ ID NO: 531047 - DNA, 16 bp, R. norvegicus
ttgagaaccactgcag

SEQ ID NO: 531048 - DNA, 16 bp, R. norvegicus
ttgagaaccactgctc

SEQ ID NO: 531049 - DNA, 16 bp, R. norvegicus
ttgagaaccactggct

SEQ ID NO: 531050 - DNA, 16 bp, R. norvegicus
ttgagaaccattgctc

SEQ ID NO: 531051 - DNA, 16 bp, R. norvegicus
ttgagaactgctgccc

SEQ ID NO: 531052 - DNA, 16 bp, R. norvegicus
ttgagaagaatctgac

SEQ ID NO: 531053 - DNA, 16 bp, R. norvegicus
ttgagaatgaactgaa

SEQ ID NO: 531054 - DNA, 16 bp, R. norvegicus
ttgagaattcatcttg

SEQ ID NO: 531055 - DNA, 16 bp, R. norvegicus
ttgagacaaggtttct

SEQ ID NO: 531056 - DNA, 16 bp, R. norvegicus
ttgagacaagttctca

SEQ ID NO: 531057 - DNA, 16 bp, R. norvegicus
ttgagacagggtcccc

SEQ ID NO: 531058 - DNA, 16 bp, R. norvegicus
ttgagacagggtctca

SEQ ID NO: 531059 - DNA, 16 bp, R. norvegicus
ttgagagagagagaga

SEQ ID NO: 531060 - DNA, 16 bp, R. norvegicus
ttgagagcagcctggg

SEQ ID NO: 531061 - DNA, 16 bp, R. norvegicus
ttgagagcagtgcaga

SEQ ID NO: 531062 - DNA, 16 bp, R. norvegicus
ttgagaggctcagcca

SEQ ID NO: 531063 - DNA, 16 bp, R. norvegicus
ttgagatcaaggatgg

SEQ ID NO: 531064 - DNA, 16 bp, R. norvegicus
ttgagatcagtgatgg

SEQ ID NO: 531065 - DNA, 16 bp, R. norvegicus
ttgagatggagtctct

SEQ ID NO: 531066 - DNA, 16 bp, R. norvegicus
ttgagattctctcttc

SEQ ID NO: 531067 - DNA, 16 bp, R. norvegicus
ttgagatttttgcagg

SEQ ID NO: 531068 - DNA, 16 bp, R. norvegicus
ttgagcaatctctcca

SEQ ID NO: 531069 - DNA, 16 bp, R. norvegicus
ttgagcccaggtcctc

SEQ ID NO: 531070 - DNA, 16 bp, R. norvegicus
ttgagcccttcagctt

SEQ ID NO: 531071 - DNA, 16 bp, R. norvegicus
ttgagctcaacaacac

SEQ ID NO: 531072 - DNA, 16 bp, R. norvegicus
ttgagctccatttgtc

SEQ ID NO: 531073 - DNA, 16 bp, R. norvegicus
ttgagctggatcccac

SEQ ID NO: 531074 - DNA, 16 bp, R. norvegicus
ttgagctggatcctac

SEQ ID NO: 531075 - DNA, 16 bp, R. norvegicus
ttgagcttgatgtggt

SEQ ID NO: 531076 - DNA, 16 bp, R. norvegicus
ttgagctttgtagaag

SEQ ID NO: 531077 - DNA, 16 bp, R. norvegicus
ttgaggaaaaggaggt

SEQ ID NO: 531078 - DNA, 16 bp, R. norvegicus
ttgaggaagatctcag

SEQ ID NO: 531079 - DNA, 16 bp, R. norvegicus
ttgaggaatatctcag

SEQ ID NO: 531080 - DNA, 16 bp, R. norvegicus
ttgaggacagcctgga

SEQ ID NO: 531081 - DNA, 16 bp, R. norvegicus
ttgaggacagggatgg

SEQ ID NO: 531082 - DNA, 16 bp, R. norvegicus
ttgaggaccactgctc

SEQ ID NO: 531083 - DNA, 16 bp, R. norvegicus
ttgaggagagagagag

SEQ ID NO: 531084 - DNA, 16 bp, R. norvegicus
ttgaggaggagggcaa

SEQ ID NO: 531085 - DNA, 16 bp, R. norvegicus
ttgaggcagctgctca

SEQ ID NO: 531086 - DNA, 16 bp, R. norvegicus
ttgaggcagggtcttt

SEQ ID NO: 531087 - DNA, 16 bp, R. norvegicus
ttgaggccagcctgca

SEQ ID NO: 531088 - DNA, 16 bp, R. norvegicus
ttgaggcctccccttg

SEQ ID NO: 531089 - DNA, 16 bp, R. norvegicus
ttgaggctcccttctc

SEQ ID NO: 531090 - DNA, 16 bp, R. norvegicus
ttgaggctctcagaga

SEQ ID NO: 531091 - DNA, 16 bp, R. norvegicus
ttgaggctgtcaggct

SEQ ID NO: 531092 - DNA, 16 bp, R. norvegicus
ttgaggtagaaatatt

SEQ ID NO: 531093 - DNA, 16 bp, R. norvegicus
ttgaggtggaagtggg

SEQ ID NO: 531094 - DNA, 16 bp, R. norvegicus
ttgagtatttcttaaa

SEQ ID NO: 531095 - DNA, 17 bp, R. norvegicus
ttgagtatttcttacat

SEQ ID NO: 531096 - DNA, 16 bp, R. norvegicus
ttgagtcttgttttgt

SEQ ID NO: 531097 - DNA, 16 bp, R. norvegicus
ttgagttcagccctga

SEQ ID NO: 531098 - DNA, 16 bp, R. norvegicus
ttgagttccaggacag

SEQ ID NO: 531099 - DNA, 16 bp, R. norvegicus
ttgagttccgggatag

SEQ ID NO: 531100 - DNA, 16 bp, R. norvegicus
ttgagttcctgcagtt

SEQ ID NO: 531101 - DNA, 16 bp, R. norvegicus
ttgagttcttgtcctg

SEQ ID NO: 531102 - DNA, 16 bp, R. norvegicus
ttgagttgtacagtca

SEQ ID NO: 531103 - DNA, 16 bp, R. norvegicus
ttgagtttcctgagat

SEQ ID NO: 531104 - DNA, 16 bp, R. norvegicus
ttgagtttctctctgt

SEQ ID NO: 531105 - DNA, 16 bp, R. norvegicus
ttgataaattacaagt

SEQ ID NO: 531106 - DNA, 16 bp, R. norvegicus
ttgataaggatataga

SEQ ID NO: 531107 - DNA, 16 bp, R. norvegicus
ttgatagaggcagacc

SEQ ID NO: 531108 - DNA, 16 bp, R. norvegicus
ttgatagatagataga

SEQ ID NO: 531109 - DNA, 16 bp, R. norvegicus
ttgatatcactgggag

SEQ ID NO: 531110 - DNA, 16 bp, R. norvegicus
ttgatattcataagag

SEQ ID NO: 531111 - DNA, 16 bp, R. norvegicus
ttgatattcctcagat

SEQ ID NO: 531112 - DNA, 16 bp, R. norvegicus
ttgatattgttattct

SEQ ID NO: 531113 - DNA, 16 bp, R. norvegicus
ttgatattttcatctc

SEQ ID NO: 531114 - DNA, 16 bp, R. norvegicus
ttgatcaggatggatg

SEQ ID NO: 531115 - DNA, 16 bp, R. norvegicus
ttgatccacctggact

SEQ ID NO: 531116 - DNA, 16 bp, R. norvegicus
ttgatcccaggactca

SEQ ID NO: 531117 - DNA, 16 bp, R. norvegicus
ttgatcctggtgaatg

SEQ ID NO: 531118 - DNA, 16 bp, R. norvegicus
ttgatctacctgtctg

SEQ ID NO: 531119 - DNA, 16 bp, R. norvegicus
ttgatctgttccagct

SEQ ID NO: 531120 - DNA, 16 bp, R. norvegicus
ttgatctttgtgagtt

SEQ ID NO: 531121 - DNA, 16 bp, R. norvegicus
ttgatcttttcaaaga

SEQ ID NO: 531122 - DNA, 16 bp, R. norvegicus
ttgatgaaaagagaca

SEQ ID NO: 531123 - DNA, 16 bp, R. norvegicus
ttgatgaaaatgctgt

SEQ ID NO: 531124 - DNA, 16 bp, R. norvegicus
ttgatgaaaccaagaa

SEQ ID NO: 531125 - DNA, 16 bp, R. norvegicus
ttgatgaactgctgga

SEQ ID NO: 531126 - DNA, 16 bp, R. norvegicus
ttgatgaagacctcag

SEQ ID NO: 531127 - DNA, 16 bp, R. norvegicus
ttgatgaagatattta

SEQ ID NO: 531128 - DNA, 16 bp, R. norvegicus
ttgatgaagccaaaaa

SEQ ID NO: 531129 - DNA, 16 bp, R. norvegicus
ttgatgaagccaagaa

SEQ ID NO: 531130 - DNA, 16 bp, R. norvegicus
ttgatgaagctaaaaa

SEQ ID NO: 531131 - DNA, 16 bp, R. norvegicus
ttgatgagagtggtgt

SEQ ID NO: 531132 - DNA, 16 bp, R. norvegicus
ttgatgaggattgcat

SEQ ID NO: 531133 - DNA, 16 bp, R. norvegicus
ttgatgagtatgaaat

SEQ ID NO: 531134 - DNA, 16 bp, R. norvegicus
ttgatgagttcttgga

SEQ ID NO: 531135 - DNA, 16 bp, R. norvegicus
ttgatgatgataatga

SEQ ID NO: 531136 - DNA, 16 bp, R. norvegicus
ttgatgatgatgatgg

SEQ ID NO: 531137 - DNA, 16 bp, R. norvegicus
ttgatgatgatgctgg

SEQ ID NO: 531138 - DNA, 16 bp, R. norvegicus
ttgatgatgtaaagaa

SEQ ID NO: 531139 - DNA, 16 bp, R. norvegicus
ttgatgccattacaaa

SEQ ID NO: 531140 - DNA, 16 bp, R. norvegicus
ttgatgccctcttctg

SEQ ID NO: 531141 - DNA, 16 bp, R. norvegicus
ttgatgccctgtcctt

SEQ ID NO: 531142 - DNA, 16 bp, R. norvegicus
ttgatgctttctatgg

SEQ ID NO: 531143 - DNA, 16 bp, R. norvegicus
ttgatggctcaggact

SEQ ID NO: 531144 - DNA, 16 bp, R. norvegicus
ttgatggtgatgatga

SEQ ID NO: 531145 - DNA, 16 bp, R. norvegicus
ttgatggttttgttca

SEQ ID NO: 531146 - DNA, 16 bp, R. norvegicus
ttgatgtagaggttct

SEQ ID NO: 531147 - DNA, 16 bp, R. norvegicus
ttgatgtcagctctga

SEQ ID NO: 531148 - DNA, 16 bp, R. norvegicus
ttgatgtgggaaggcc

SEQ ID NO: 531149 - DNA, 16 bp, R. norvegicus
ttgatgtgggttctgg

SEQ ID NO: 531150 - DNA, 16 bp, R. norvegicus
ttgattaaaaacaaaa

SEQ ID NO: 531151 - DNA, 16 bp, R. norvegicus
ttgattacattaattg

SEQ ID NO: 531152 - DNA, 16 bp, R. norvegicus
ttgattcccagcacta

SEQ ID NO: 531153 - DNA, 16 bp, R. norvegicus
ttgattcccaggagct

SEQ ID NO: 531154 - DNA, 16 bp, R. norvegicus
ttgattctaaactttt

SEQ ID NO: 531155 - DNA, 16 bp, R. norvegicus
ttgattcttaatctta

SEQ ID NO: 531156 - DNA, 16 bp, R. norvegicus
ttgattctttatctta

SEQ ID NO: 531157 - DNA, 16 bp, R. norvegicus
ttgattctttgtagag

SEQ ID NO: 531158 - DNA, 16 bp, R. norvegicus
ttgattgccaacttga

SEQ ID NO: 531159 - DNA, 16 bp, R. norvegicus
ttgattgctttttaaa

SEQ ID NO: 531160 - DNA, 16 bp, R. norvegicus
ttgattggtattttga

SEQ ID NO: 531161 - DNA, 16 bp, R. norvegicus
ttgattgtgttcttat

SEQ ID NO: 531162 - DNA, 16 bp, R. norvegicus
ttgattgtgtttccct

SEQ ID NO: 531163 - DNA, 16 bp, R. norvegicus
ttgatttattgattga

SEQ ID NO: 531164 - DNA, 16 bp, R. norvegicus
ttgatttccaaaatga

SEQ ID NO: 531165 - DNA, 16 bp, R. norvegicus
ttgattttggagaaag

SEQ ID NO: 531166 - DNA, 16 bp, R. norvegicus
ttgattttggcaaaat

SEQ ID NO: 531167 - DNA, 16 bp, R. norvegicus
ttgattttggctctga

SEQ ID NO: 531168 - DNA, 16 bp, R. norvegicus
ttgattttgttgaaga

SEQ ID NO: 531169 - DNA, 16 bp, R. norvegicus
ttgatttttgaaaaag

SEQ ID NO: 531170 - DNA, 16 bp, R. norvegicus
ttgcaaaactcttcag

SEQ ID NO: 531171 - DNA, 16 bp, R. norvegicus
ttgcaaaagagaaaaa

SEQ ID NO: 531172 - DNA, 16 bp, R. norvegicus
ttgcaaaataaaataa

SEQ ID NO: 531173 - DNA, 16 bp, R. norvegicus
ttgcaaacatcttcag

SEQ ID NO: 531174 - DNA, 16 bp, R. norvegicus
ttgcaaaccaaatgca

SEQ ID NO: 531175 - DNA, 16 bp, R. norvegicus
ttgcaaacctcttcaa

SEQ ID NO: 531176 - DNA, 16 bp, R. norvegicus
ttgcaaactccttcat

SEQ ID NO: 531177 - DNA, 17 bp, R. norvegicus
ttgcaaccccataagaa

SEQ ID NO: 531178 - DNA, 16 bp, R. norvegicus
ttgcaaccccattgga

SEQ ID NO: 531179 - DNA, 16 bp, R. norvegicus
ttgcaagaaaatggat

SEQ ID NO: 531180 - DNA, 16 bp, R. norvegicus
ttgcaagaatttattg

SEQ ID NO: 531181 - DNA, 16 bp, R. norvegicus
ttgcaagccccttcaa

SEQ ID NO: 531182 - DNA, 16 bp, R. norvegicus
ttgcaagccccttcac

SEQ ID NO: 531183 - DNA, 16 bp, R. norvegicus
ttgcacaaagcttaag

SEQ ID NO: 531184 - DNA, 16 bp, R. norvegicus
ttgcacaggacctggg

SEQ ID NO: 531185 - DNA, 16 bp, R. norvegicus
ttgcaccagtctgcaa

SEQ ID NO: 531186 - DNA, 16 bp, R. norvegicus
ttgcacccagcaggca

SEQ ID NO: 531187 - DNA, 16 bp, R. norvegicus
ttgcagaagactcagg

SEQ ID NO: 531188 - DNA, 16 bp, R. norvegicus
ttgcagaagatctggg

SEQ ID NO: 531189 - DNA, 16 bp, R. norvegicus
ttgcagaagctttaga

SEQ ID NO: 531190 - DNA, 16 bp, R. norvegicus
ttgcagactggtccaa

SEQ ID NO: 531191 - DNA, 16 bp, R. norvegicus
ttgcagagacttgatg

SEQ ID NO: 531192 - DNA, 16 bp, R. norvegicus
ttgcagagagagagag

SEQ ID NO: 531193 - DNA, 16 bp, R. norvegicus
ttgcagaggacctgag

SEQ ID NO: 531194 - DNA, 16 bp, R. norvegicus
ttgcagcagaagatcc

SEQ ID NO: 531195 - DNA, 16 bp, R. norvegicus
ttgcagcatgaggaag

SEQ ID NO: 531196 - DNA, 16 bp, R. norvegicus
ttgcaggatacagaaa

SEQ ID NO: 531197 - DNA, 16 bp, R. norvegicus
ttgcaggcatgtacca

SEQ ID NO: 531198 - DNA, 16 bp, R. norvegicus
ttgcagggcaacagca

SEQ ID NO: 531199 - DNA, 16 bp, R. norvegicus
ttgcaggggaaaaaaa

SEQ ID NO: 531200 - DNA, 16 bp, R. norvegicus
ttgcaggggacccagg

SEQ ID NO: 531201 - DNA, 16 bp, R. norvegicus
ttgcaggtgtttatca

SEQ ID NO: 531202 - DNA, 16 bp, R. norvegicus
ttgcagttttaggagg

SEQ ID NO: 531203 - DNA, 16 bp, R. norvegicus
ttgcatatgtagcaga

SEQ ID NO: 531204 - DNA, 16 bp, R. norvegicus
ttgcatccaacaaaga

SEQ ID NO: 531205 - DNA, 16 bp, R. norvegicus
ttgcatccagtggtct

SEQ ID NO: 531206 - DNA, 16 bp, R. norvegicus
ttgcatcttccttgct

SEQ ID NO: 531207 - DNA, 16 bp, R. norvegicus
ttgcatgtatgtatgt

SEQ ID NO: 531208 - DNA, 16 bp, R. norvegicus
ttgcattccctgatga

SEQ ID NO: 531209 - DNA, 16 bp, R. norvegicus
ttgcatttcactgatg

SEQ ID NO: 531210 - DNA, 16 bp, R. norvegicus
ttgcatttctatgatg

SEQ ID NO: 531211 - DNA, 16 bp, R. norvegicus
ttgccaacatccctgg

SEQ ID NO: 531212 - DNA, 16 bp, R. norvegicus
ttgccaagacaattag

SEQ ID NO: 531213 - DNA, 16 bp, R. norvegicus
ttgccaagcacaagca

SEQ ID NO: 531214 - DNA, 16 bp, R. norvegicus
ttgccacattttcttt

SEQ ID NO: 531215 - DNA, 16 bp, R. norvegicus
ttgccaccaaacctaa

SEQ ID NO: 531216 - DNA, 16 bp, R. norvegicus
ttgccagaacagccat

SEQ ID NO: 531217 - DNA, 16 bp, R. norvegicus
ttgccagacttttatt

SEQ ID NO: 531218 - DNA, 16 bp, R. norvegicus
ttgccagcacatctgt

SEQ ID NO: 531219 - DNA, 18 bp, R. norvegicus
ttgccaggccttcaacca

SEQ ID NO: 531220 - DNA, 16 bp, R. norvegicus
ttgccatagatggaga

SEQ ID NO: 531221 - DNA, 17 bp, R. norvegicus
ttgccatgaaaggcttt

SEQ ID NO: 531222 - DNA, 16 bp, R. norvegicus
ttgccatgcaagcctg

SEQ ID NO: 531223 - DNA, 16 bp, R. norvegicus
ttgccatgcagaagct

SEQ ID NO: 531224 - DNA, 16 bp, R. norvegicus
ttgccatggtcaagag

SEQ ID NO: 531225 - DNA, 16 bp, R. norvegicus
ttgccatgtagcccag

SEQ ID NO: 531226 - DNA, 16 bp, R. norvegicus
ttgccattcctctctg

SEQ ID NO: 531227 - DNA, 16 bp, R. norvegicus
ttgcccaagaggaaac

SEQ ID NO: 531228 - DNA, 16 bp, R. norvegicus
ttgcccacccctgccc

SEQ ID NO: 531229 - DNA, 16 bp, R. norvegicus
ttgcccagcctgcttt

SEQ ID NO: 531230 - DNA, 16 bp, R. norvegicus
ttgcccaggaaaacag

SEQ ID NO: 531231 - DNA, 16 bp, R. norvegicus
ttgcccaggttatcat

SEQ ID NO: 531232 - DNA, 16 bp, R. norvegicus
ttgcccccaagcctga

SEQ ID NO: 531233 - DNA, 16 bp, R. norvegicus
ttgcccgtctctggat

SEQ ID NO: 531234 - DNA, 16 bp, R. norvegicus
ttgccctaattcatct

SEQ ID NO: 531235 - DNA, 16 bp, R. norvegicus
ttgccctccccccaac

SEQ ID NO: 531236 - DNA, 16 bp, R. norvegicus
ttgccctctgacctct

SEQ ID NO: 531237 - DNA, 16 bp, R. norvegicus
ttgccctgtgtcatga

SEQ ID NO: 531238 - DNA, 16 bp, R. norvegicus
ttgcccttgcctctca

SEQ ID NO: 531239 - DNA, 16 bp, R. norvegicus
ttgcctaacaatagat

SEQ ID NO: 531240 - DNA, 16 bp, R. norvegicus
ttgcctagcatgcaca

SEQ ID NO: 531241 - DNA, 16 bp, R. norvegicus
ttgcctagcatgtaca

SEQ ID NO: 531242 - DNA, 16 bp, R. norvegicus
ttgcctatgggccaca

SEQ ID NO: 531243 - DNA, 16 bp, R. norvegicus
ttgcctcaacctccca

SEQ ID NO: 531244 - DNA, 16 bp, R. norvegicus
ttgcctcaatctcctg

SEQ ID NO: 531245 - DNA, 16 bp, R. norvegicus
ttgcctcactgcccta

SEQ ID NO: 531246 - DNA, 16 bp, R. norvegicus
ttgcctccccagtgct

SEQ ID NO: 531247 - DNA, 16 bp, R. norvegicus
ttgcctctgcctctcc

SEQ ID NO: 531248 - DNA, 16 bp, R. norvegicus
ttgcctgcagcctgat

SEQ ID NO: 531249 - DNA, 16 bp, R. norvegicus
ttgcctgcatgtatgt

SEQ ID NO: 531250 - DNA, 16 bp, R. norvegicus
ttgcctgcctgtctgt

SEQ ID NO: 531251 - DNA, 24 bp, R. norvegicus
ttgcctgctggttgttccagaaaa

SEQ ID NO: 531252 - DNA, 16 bp, R. norvegicus
ttgcctggcatgcaca

SEQ ID NO: 531253 - DNA, 16 bp, R. norvegicus
ttgcctgggcttgcct

SEQ ID NO: 531254 - DNA, 16 bp, R. norvegicus
ttgcctgtcgccatca

SEQ ID NO: 531255 - DNA, 16 bp, R. norvegicus
ttgccttcctctactc

SEQ ID NO: 531256 - DNA, 16 bp, R. norvegicus
ttgccttcctctgcct

SEQ ID NO: 531257 - DNA, 16 bp, R. norvegicus
ttgccttgaagtttct

SEQ ID NO: 531258 - DNA, 16 bp, R. norvegicus
ttgccttggttatggt

SEQ ID NO: 531259 - DNA, 16 bp, R. norvegicus
ttgccttgttcatggt

SEQ ID NO: 531260 - DNA, 16 bp, R. norvegicus
ttgcctttccttcagt

SEQ ID NO: 531261 - DNA, 16 bp, R. norvegicus
ttgctaaagcagacac

SEQ ID NO: 531262 - DNA, 16 bp, R. norvegicus
ttgctaaggccctggg

SEQ ID NO: 531263 - DNA, 16 bp, R. norvegicus
ttgctacatgcaggaa

SEQ ID NO: 531264 - DNA, 16 bp, R. norvegicus
ttgctacctataaggt

SEQ ID NO: 531265 - DNA, 16 bp, R. norvegicus
ttgctacttcacaact

SEQ ID NO: 531266 - DNA, 16 bp, R. norvegicus
ttgctactttatgact

SEQ ID NO: 531267 - DNA, 16 bp, R. norvegicus
ttgctacttttccaga

SEQ ID NO: 531268 - DNA, 26 bp, R. norvegicus
ttgctaggcaagcgctctaccactga

SEQ ID NO: 531269 - DNA, 27 bp, R. norvegicus
ttgctaggcaagtgctctaccactgag

SEQ ID NO: 531270 - DNA, 16 bp, R. norvegicus
ttgctattgctgtgat

SEQ ID NO: 531271 - DNA, 16 bp, R. norvegicus
ttgctatttttgtaac

SEQ ID NO: 531272 - DNA, 16 bp, R. norvegicus
ttgctcatccatgcag

SEQ ID NO: 531273 - DNA, 16 bp, R. norvegicus
ttgctcatcttgcttt

SEQ ID NO: 531274 - DNA, 16 bp, R. norvegicus
ttgctccagtctcctc

SEQ ID NO: 531275 - DNA, 16 bp, R. norvegicus
ttgctcctcatgactt

SEQ ID NO: 531276 - DNA, 16 bp, R. norvegicus
ttgctcctcgtggctt

SEQ ID NO: 531277 - DNA, 16 bp, R. norvegicus
ttgctcctctctaaag

SEQ ID NO: 531278 - DNA, 16 bp, R. norvegicus
ttgctcctctcttgct

SEQ ID NO: 531279 - DNA, 16 bp, R. norvegicus
ttgctctctcctcctg

SEQ ID NO: 531280 - DNA, 16 bp, R. norvegicus
ttgctctcttctatgc

SEQ ID NO: 531281 - DNA, 16 bp, R. norvegicus
ttgctctcttgccttc

SEQ ID NO: 531282 - DNA, 16 bp, R. norvegicus
ttgctctcttgctcct

SEQ ID NO: 531283 - DNA, 16 bp, R. norvegicus
ttgctctctttgcctg

SEQ ID NO: 531284 - DNA, 16 bp, R. norvegicus
ttgctctgaagaaaca

SEQ ID NO: 531285 - DNA, 16 bp, R. norvegicus
ttgctctgagatctgt

SEQ ID NO: 531286 - DNA, 16 bp, R. norvegicus
ttgctctggagaccag

SEQ ID NO: 531287 - DNA, 16 bp, R. norvegicus
ttgctctgtagacctg

SEQ ID NO: 531288 - DNA, 16 bp, R. norvegicus
ttgctcttaaccactg

SEQ ID NO: 531289 - DNA, 16 bp, R. norvegicus
ttgctcttcctatgag

SEQ ID NO: 531290 - DNA, 16 bp, R. norvegicus
ttgctcttcctgtgga

SEQ ID NO: 531291 - DNA, 16 bp, R. norvegicus
ttgctcttctggagga

SEQ ID NO: 531292 - DNA, 16 bp, R. norvegicus
ttgctcttgaagagga

SEQ ID NO: 531293 - DNA, 16 bp, R. norvegicus
ttgctcttgcagatga

SEQ ID NO: 531294 - DNA, 16 bp, R. norvegicus
ttgctgaattaaaatt

SEQ ID NO: 531295 - DNA, 16 bp, R. norvegicus
ttgctgacaagagcct

SEQ ID NO: 531296 - DNA, 16 bp, R. norvegicus
ttgctgacgctgcaga

SEQ ID NO: 531297 - DNA, 17 bp, R. norvegicus
ttgctgagaaagcattt

SEQ ID NO: 531298 - DNA, 16 bp, R. norvegicus
ttgctgagaacagaca

SEQ ID NO: 531299 - DNA, 16 bp, R. norvegicus
ttgctgatgccaaaaa

SEQ ID NO: 531300 - DNA, 16 bp, R. norvegicus
ttgctgatgccaagaa

SEQ ID NO: 531301 - DNA, 16 bp, R. norvegicus
ttgctgatgccaagga

SEQ ID NO: 531302 - DNA, 16 bp, R. norvegicus
ttgctgatgcttgtat

SEQ ID NO: 531303 - DNA, 16 bp, R. norvegicus
ttgctgattccaagaa

SEQ ID NO: 531304 - DNA, 16 bp, R. norvegicus
ttgctgcaaattgaac

SEQ ID NO: 531305 - DNA, 18 bp, R. norvegicus
ttgctgcagaaggatcct

SEQ ID NO: 531306 - DNA, 19 bp, R. norvegicus
ttgctgcagtcagtgttac

SEQ ID NO: 531307 - DNA, 16 bp, R. norvegicus
ttgctgcattctggct

SEQ ID NO: 531308 - DNA, 16 bp, R. norvegicus
ttgctgccaagcctta

SEQ ID NO: 531309 - DNA, 16 bp, R. norvegicus
ttgctgccaagtttga

SEQ ID NO: 531310 - DNA, 16 bp, R. norvegicus
ttgctgcccagcctga

SEQ ID NO: 531311 - DNA, 17 bp, R. norvegicus
ttgctgcccccctcatt

SEQ ID NO: 531312 - DNA, 16 bp, R. norvegicus
ttgctgcccctgcaga

SEQ ID NO: 531313 - DNA, 16 bp, R. norvegicus
ttgctgccgctgcaaa

SEQ ID NO: 531314 - DNA, 18 bp, R. norvegicus
ttgctgcctttagtggcc

SEQ ID NO: 531315 - DNA, 16 bp, R. norvegicus
ttgctgctcccagaca

SEQ ID NO: 531316 - DNA, 16 bp, R. norvegicus
ttgctgctcttccaga

SEQ ID NO: 531317 - DNA, 16 bp, R. norvegicus
ttgctgctgccacgga

SEQ ID NO: 531318 - DNA, 16 bp, R. norvegicus
ttgctgctgctattgt

SEQ ID NO: 531319 - DNA, 16 bp, R. norvegicus
ttgctgctgctgctgt

SEQ ID NO: 531320 - DNA, 16 bp, R. norvegicus
ttgctgctgctgttct

SEQ ID NO: 531321 - DNA, 17 bp, R. norvegicus
ttgctgctgctgttgct

SEQ ID NO: 531322 - DNA, 16 bp, R. norvegicus
ttgctgctgctgttgg

SEQ ID NO: 531323 - DNA, 16 bp, R. norvegicus
ttgctgctggaattca

SEQ ID NO: 531324 - DNA, 16 bp, R. norvegicus
ttgctgctgttccaga

SEQ ID NO: 531325 - DNA, 18 bp, R. norvegicus
ttgctgctgttgctgctg

SEQ ID NO: 531326 - DNA, 16 bp, R. norvegicus
ttgctgcttctgcagc

SEQ ID NO: 531327 - DNA, 17 bp, R. norvegicus
ttgctgcttttaatatt

SEQ ID NO: 531328 - DNA, 16 bp, R. norvegicus
ttgctggacctcacag

SEQ ID NO: 531329 - DNA, 16 bp, R. norvegicus
ttgctggagctggaac

SEQ ID NO: 531330 - DNA, 16 bp, R. norvegicus
ttgctggattaaaatt

SEQ ID NO: 531331 - DNA, 16 bp, R. norvegicus
ttgctggcatttgcct

SEQ ID NO: 531332 - DNA, 16 bp, R. norvegicus
ttgctggcctagaact

SEQ ID NO: 531333 - DNA, 16 bp, R. norvegicus
ttgctggcttgctggc

SEQ ID NO: 531334 - DNA, 16 bp, R. norvegicus
ttgctggggcaccagt

SEQ ID NO: 531335 - DNA, 16 bp, R. norvegicus
ttgctgtggccatggt

SEQ ID NO: 531336 - DNA, 16 bp, R. norvegicus
ttgctgtggtaaacac

SEQ ID NO: 531337 - DNA, 16 bp, R. norvegicus
ttgctgtggtcatggc

SEQ ID NO: 531338 - DNA, 16 bp, R. norvegicus
ttgctgtggtggaaga

SEQ ID NO: 531339 - DNA, 16 bp, R. norvegicus
ttgctgtggtggggaa

SEQ ID NO: 531340 - DNA, 16 bp, R. norvegicus
ttgctgtgtcccaggc

SEQ ID NO: 531341 - DNA, 16 bp, R. norvegicus
ttgctgtgtctgacag

SEQ ID NO: 531342 - DNA, 16 bp, R. norvegicus
ttgctgttgcccttgg

SEQ ID NO: 531343 - DNA, 16 bp, R. norvegicus
ttgctgtttttccaga

SEQ ID NO: 531344 - DNA, 16 bp, R. norvegicus
ttgctgtttttgcaga

SEQ ID NO: 531345 - DNA, 16 bp, R. norvegicus
ttgcttagcaaccaca

SEQ ID NO: 531346 - DNA, 16 bp, R. norvegicus
ttgcttagcaagcaca

SEQ ID NO: 531347 - DNA, 16 bp, R. norvegicus
ttgcttattaaaaaaa

SEQ ID NO: 531348 - DNA, 16 bp, R. norvegicus
ttgcttcagtgcatga

SEQ ID NO: 531349 - DNA, 16 bp, R. norvegicus
ttgcttcattgagaga

SEQ ID NO: 531350 - DNA, 16 bp, R. norvegicus
ttgcttcccctagctt

SEQ ID NO: 531351 - DNA, 16 bp, R. norvegicus
ttgcttccttcccttg

SEQ ID NO: 531352 - DNA, 16 bp, R. norvegicus
ttgcttctatatccat

SEQ ID NO: 531353 - DNA, 16 bp, R. norvegicus
ttgcttctggtcatgg

SEQ ID NO: 531354 - DNA, 16 bp, R. norvegicus
ttgcttcttgctgctg

SEQ ID NO: 531355 - DNA, 16 bp, R. norvegicus
ttgcttcttggtcatg

SEQ ID NO: 531356 - DNA, 16 bp, R. norvegicus
ttgcttcttttcattc

SEQ ID NO: 531357 - DNA, 16 bp, R. norvegicus
ttgcttgccctggctt

SEQ ID NO: 531358 - DNA, 16 bp, R. norvegicus
ttgcttggaaaatgtt

SEQ ID NO: 531359 - DNA, 16 bp, R. norvegicus
ttgcttggacagtgaa

SEQ ID NO: 531360 - DNA, 18 bp, R. norvegicus
ttgcttgggagcaaagaa

SEQ ID NO: 531361 - DNA, 16 bp, R. norvegicus
ttgcttggttaaactc

SEQ ID NO: 531362 - DNA, 16 bp, R. norvegicus
ttgcttgtatgtttgt

SEQ ID NO: 531363 - DNA, 16 bp, R. norvegicus
ttgctttcagaacaag

SEQ ID NO: 531364 - DNA, 16 bp, R. norvegicus
ttgctttcagttggca

SEQ ID NO: 531365 - DNA, 16 bp, R. norvegicus
ttgctttcatgttgaa

SEQ ID NO: 531366 - DNA, 16 bp, R. norvegicus
ttgctttcctggtgtc

SEQ ID NO: 531367 - DNA, 16 bp, R. norvegicus
ttgctttctattgcta

SEQ ID NO: 531368 - DNA, 16 bp, R. norvegicus
ttgctttctcaggagt

SEQ ID NO: 531369 - DNA, 16 bp, R. norvegicus
ttgctttcttctccat

SEQ ID NO: 531370 - DNA, 16 bp, R. norvegicus
ttgctttgaactttta

SEQ ID NO: 531371 - DNA, 16 bp, R. norvegicus
ttgctttgacacaaga

SEQ ID NO: 531372 - DNA, 16 bp, R. norvegicus
ttgctttggagaaaga

SEQ ID NO: 531373 - DNA, 16 bp, R. norvegicus
ttgctttggtcacagt

SEQ ID NO: 531374 - DNA, 16 bp, R. norvegicus
ttgctttggttcctgc

SEQ ID NO: 531375 - DNA, 16 bp, R. norvegicus
ttgctttgtagaccag

SEQ ID NO: 531376 - DNA, 16 bp, R. norvegicus
ttgctttgtggtcatg

SEQ ID NO: 531377 - DNA, 16 bp, R. norvegicus
ttgctttgtttgtcaa

SEQ ID NO: 531378 - DNA, 16 bp, R. norvegicus
ttgcttttaaagacag

SEQ ID NO: 531379 - DNA, 16 bp, R. norvegicus
ttgcttttgtgggaga

SEQ ID NO: 531380 - DNA, 16 bp, R. norvegicus
ttgcttttgttaagat

SEQ ID NO: 531381 - DNA, 16 bp, R. norvegicus
ttggaaaaacaagaac

SEQ ID NO: 531382 - DNA, 16 bp, R. norvegicus
ttggaaaaagattttc

SEQ ID NO: 531383 - DNA, 16 bp, R. norvegicus
ttggaaaacaaaaata

SEQ ID NO: 531384 - DNA, 16 bp, R. norvegicus
ttggaaaatatcctga

SEQ ID NO: 531385 - DNA, 16 bp, R. norvegicus
ttggaaaatatttttc

SEQ ID NO: 531386 - DNA, 16 bp, R. norvegicus
ttggaaaatgttgaga

SEQ ID NO: 531387 - DNA, 16 bp, R. norvegicus
ttggaaacaacccaaa

SEQ ID NO: 531388 - DNA, 16 bp, R. norvegicus
ttggaaagaagaaagg

SEQ ID NO: 531389 - DNA, 16 bp, R. norvegicus
ttggaaagatcaggaa

SEQ ID NO: 531390 - DNA, 16 bp, R. norvegicus
ttggaaaggaaagagt

SEQ ID NO: 531391 - DNA, 16 bp, R. norvegicus
ttggaaaggaagaagc

SEQ ID NO: 531392 - DNA, 16 bp, R. norvegicus
ttggaaagttggttgg

SEQ ID NO: 531393 - DNA, 16 bp, R. norvegicus
ttggaaatgaagaagt

SEQ ID NO: 531394 - DNA, 16 bp, R. norvegicus
ttggaaatgtaaataa

SEQ ID NO: 531395 - DNA, 16 bp, R. norvegicus
ttggaaattttaaaaa

SEQ ID NO: 531396 - DNA, 16 bp, R. norvegicus
ttggaaattttatgta

SEQ ID NO: 531397 - DNA, 16 bp, R. norvegicus
ttggaacagaagagtt

SEQ ID NO: 531398 - DNA, 16 bp, R. norvegicus
ttggaacagagctact

SEQ ID NO: 531399 - DNA, 16 bp, R. norvegicus
ttggaactgaagttat

SEQ ID NO: 531400 - DNA, 16 bp, R. norvegicus
ttggaactggaaatat

SEQ ID NO: 531401 - DNA, 16 bp, R. norvegicus
ttggaagaaagaaatt

SEQ ID NO: 531402 - DNA, 16 bp, R. norvegicus
ttggaagagcagctgg

SEQ ID NO: 531403 - DNA, 17 bp, R. norvegicus
ttggaagagcagtcagt

SEQ ID NO: 531404 - DNA, 16 bp, R. norvegicus
ttggaaggaagaggag

SEQ ID NO: 531405 - DNA, 16 bp, R. norvegicus
ttggaaggagaaatgg

SEQ ID NO: 531406 - DNA, 16 bp, R. norvegicus
ttggaaggcagagtca

SEQ ID NO: 531407 - DNA, 16 bp, R. norvegicus
ttggaagtggagaggg

SEQ ID NO: 531408 - DNA, 16 bp, R. norvegicus
ttggaataaaaccaac

SEQ ID NO: 531409 - DNA, 16 bp, R. norvegicus
ttggaatctttgctct

SEQ ID NO: 531410 - DNA, 16 bp, R. norvegicus
ttggaatgaggtcttc

SEQ ID NO: 531411 - DNA, 16 bp, R. norvegicus
ttggaattatgatggg

SEQ ID NO: 531412 - DNA, 16 bp, R. norvegicus
ttggaattcaaggccc

SEQ ID NO: 531413 - DNA, 16 bp, R. norvegicus
ttggaattgttgttca

SEQ ID NO: 531414 - DNA, 16 bp, R. norvegicus
ttggaattttacattt

SEQ ID NO: 531415 - DNA, 16 bp, R. norvegicus
ttggaatttttcttct

SEQ ID NO: 531416 - DNA, 16 bp, R. norvegicus
ttggacaaaggagcca

SEQ ID NO: 531417 - DNA, 16 bp, R. norvegicus
ttggacaagaaggaag

SEQ ID NO: 531418 - DNA, 16 bp, R. norvegicus
ttggacacactctctg

SEQ ID NO: 531419 - DNA, 16 bp, R. norvegicus
ttggacacatctgaac

SEQ ID NO: 531420 - DNA, 16 bp, R. norvegicus
ttggaccagaaatgaa

SEQ ID NO: 531421 - DNA, 16 bp, R. norvegicus
ttggaccagagaagaa

SEQ ID NO: 531422 - DNA, 16 bp, R. norvegicus
ttggaccagcccatgt

SEQ ID NO: 531423 - DNA, 16 bp, R. norvegicus
ttggaccccagtgcag

SEQ ID NO: 531424 - DNA, 16 bp, R. norvegicus
ttggacctgaaccaac

SEQ ID NO: 531425 - DNA, 20 bp, R. norvegicus
ttggactgacgactgtgttt

SEQ ID NO: 531426 - DNA, 16 bp, R. norvegicus
ttggacttttaaaatt

SEQ ID NO: 531427 - DNA, 16 bp, R. norvegicus
ttggactttttattta

SEQ ID NO: 531428 - DNA, 16 bp, R. norvegicus
ttggagaaagagaaga

SEQ ID NO: 531429 - DNA, 16 bp, R. norvegicus
ttggagaaagaggaac

SEQ ID NO: 531430 - DNA, 16 bp, R. norvegicus
ttggagaaaggaaagg

SEQ ID NO: 531431 - DNA, 16 bp, R. norvegicus
ttggagaaagtttcat

SEQ ID NO: 531432 - DNA, 16 bp, R. norvegicus
ttggagaaatggttca

SEQ ID NO: 531433 - DNA, 16 bp, R. norvegicus
ttggagaaatttcagt

SEQ ID NO: 531434 - DNA, 16 bp, R. norvegicus
ttggagaagaaaagtt

SEQ ID NO: 531435 - DNA, 16 bp, R. norvegicus
ttggagaagagtttga

SEQ ID NO: 531436 - DNA, 16 bp, R. norvegicus
ttggagaaggagctga

SEQ ID NO: 531437 - DNA, 16 bp, R. norvegicus
ttggagaatcttttga

SEQ ID NO: 531438 - DNA, 16 bp, R. norvegicus
ttggagacagaggcag

SEQ ID NO: 531439 - DNA, 16 bp, R. norvegicus
ttggagaccagcctgg

SEQ ID NO: 531440 - DNA, 16 bp, R. norvegicus
ttggagaccccaagat

SEQ ID NO: 531441 - DNA, 16 bp, R. norvegicus
ttggagacttttaatg

SEQ ID NO: 531442 - DNA, 16 bp, R. norvegicus
ttggagagatggctga

SEQ ID NO: 531443 - DNA, 16 bp, R. norvegicus
ttggagaggagtttga

SEQ ID NO: 531444 - DNA, 16 bp, R. norvegicus
ttggagatagaggttt

SEQ ID NO: 531445 - DNA, 16 bp, R. norvegicus
ttggagatatcaggaa

SEQ ID NO: 531446 - DNA, 16 bp, R. norvegicus
ttggagatctgaagac

SEQ ID NO: 531447 - DNA, 16 bp, R. norvegicus
ttggagatgccagcac

SEQ ID NO: 531448 - DNA, 16 bp, R. norvegicus
ttggagcagacactga

SEQ ID NO: 531449 - DNA, 16 bp, R. norvegicus
ttggagcagttcagtt

SEQ ID NO: 531450 - DNA, 16 bp, R. norvegicus
ttggagcatctttggg

SEQ ID NO: 531451 - DNA, 16 bp, R. norvegicus
ttggagccctgtgcct

SEQ ID NO: 531452 - DNA, 16 bp, R. norvegicus
ttggagctctcagaga

SEQ ID NO: 531453 - DNA, 16 bp, R. norvegicus
ttggagctctgggtca

SEQ ID NO: 531454 - DNA, 16 bp, R. norvegicus
ttggaggaactagaga

SEQ ID NO: 531455 - DNA, 16 bp, R. norvegicus
ttggaggaagaaaaga

SEQ ID NO: 531456 - DNA, 16 bp, R. norvegicus
ttggaggaggaagaag

SEQ ID NO: 531457 - DNA, 16 bp, R. norvegicus
ttggaggcattcagag

SEQ ID NO: 531458 - DNA, 16 bp, R. norvegicus
ttggaggctcccagag

SEQ ID NO: 531459 - DNA, 16 bp, R. norvegicus
ttggagggattgcaaa

SEQ ID NO: 531460 - DNA, 16 bp, R. norvegicus
ttggaggtctgtaggc

SEQ ID NO: 531461 - DNA, 16 bp, R. norvegicus
ttggaggtgaggtggc

SEQ ID NO: 531462 - DNA, 16 bp, R. norvegicus
ttggaggtggaggcag

SEQ ID NO: 531463 - DNA, 16 bp, R. norvegicus
ttggagtcacaccaag

SEQ ID NO: 531464 - DNA, 16 bp, R. norvegicus
ttggagtctaccttct

SEQ ID NO: 531465 - DNA, 16 bp, R. norvegicus
ttggagtctgaggcag

SEQ ID NO: 531466 - DNA, 16 bp, R. norvegicus
ttggagttgccattct

SEQ ID NO: 531467 - DNA, 16 bp, R. norvegicus
ttggagtttgcccagt

SEQ ID NO: 531468 - DNA, 16 bp, R. norvegicus
ttggagttttccatct

SEQ ID NO: 531469 - DNA, 16 bp, R. norvegicus
ttggatattttaaaga

SEQ ID NO: 531470 - DNA, 16 bp, R. norvegicus
ttggatattttcttat

SEQ ID NO: 531471 - DNA, 16 bp, R. norvegicus
ttggatattttggata

SEQ ID NO: 531472 - DNA, 16 bp, R. norvegicus
ttggatccctaggacc

SEQ ID NO: 531473 - DNA, 16 bp, R. norvegicus
ttggatcctctggaat

SEQ ID NO: 531474 - DNA, 16 bp, R. norvegicus
ttggatcctgaagaaa

SEQ ID NO: 531475 - DNA, 16 bp, R. norvegicus
ttggatgagaaggaaa

SEQ ID NO: 531476 - DNA, 16 bp, R. norvegicus
ttggatgagaaggatg

SEQ ID NO: 531477 - DNA, 16 bp, R. norvegicus
ttggatgaggaggaag

SEQ ID NO: 531478 - DNA, 16 bp, R. norvegicus
ttggattagggaaaag

SEQ ID NO: 531479 - DNA, 16 bp, R. norvegicus
ttggattatttctatc

SEQ ID NO: 531480 - DNA, 16 bp, R. norvegicus
ttggattcggtttgta

SEQ ID NO: 531481 - DNA, 16 bp, R. norvegicus
ttggattctgttggtg

SEQ ID NO: 531482 - DNA, 16 bp, R. norvegicus
ttggatttgggtgcag

SEQ ID NO: 531483 - DNA, 16 bp, R. norvegicus
ttggcaagaacaaggg

SEQ ID NO: 531484 - DNA, 16 bp, R. norvegicus
ttggcaagatgctgaa

SEQ ID NO: 531485 - DNA, 16 bp, R. norvegicus
ttggcagaaccaagga

SEQ ID NO: 531486 - DNA, 16 bp, R. norvegicus
ttggcagcacatcttc

SEQ ID NO: 531487 - DNA, 16 bp, R. norvegicus
ttggcagcagcagcag

SEQ ID NO: 531488 - DNA, 16 bp, R. norvegicus
ttggcagcagcccctg

SEQ ID NO: 531489 - DNA, 18 bp, R. norvegicus
ttggcaggattaatatat

SEQ ID NO: 531490 - DNA, 16 bp, R. norvegicus
ttggcagtggtggtgg

SEQ ID NO: 531491 - DNA, 16 bp, R. norvegicus
ttggcagtttttcaga

SEQ ID NO: 531492 - DNA, 16 bp, R. norvegicus
ttggcatatacccaaa

SEQ ID NO: 531493 - DNA, 26 bp, R. norvegicus
ttggcatctggctttctattagctaa

SEQ ID NO: 531494 - DNA, 16 bp, R. norvegicus
ttggcatggaagagag

SEQ ID NO: 531495 - DNA, 16 bp, R. norvegicus
ttggccaactactcct

SEQ ID NO: 531496 - DNA, 16 bp, R. norvegicus
ttggccactggcaact

SEQ ID NO: 531497 - DNA, 16 bp, R. norvegicus
ttggccaggaatgtga

SEQ ID NO: 531498 - DNA, 16 bp, R. norvegicus
ttggccagttattgga

SEQ ID NO: 531499 - DNA, 16 bp, R. norvegicus
ttggccatgatgtttg

SEQ ID NO: 531500 - DNA, 16 bp, R. norvegicus
ttggccatttcctcca

SEQ ID NO: 531501 - DNA, 16 bp, R. norvegicus
ttggcccagaaacccg

SEQ ID NO: 531502 - DNA, 16 bp, R. norvegicus
ttggcccaggaagtgg

SEQ ID NO: 531503 - DNA, 16 bp, R. norvegicus
ttggcctctgagggca

SEQ ID NO: 531504 - DNA, 16 bp, R. norvegicus
ttggcgaggatgcgga

SEQ ID NO: 531505 - DNA, 16 bp, R. norvegicus
ttggcgtcagcaatag

SEQ ID NO: 531506 - DNA, 16 bp, R. norvegicus
ttggctatgtcctttg

SEQ ID NO: 531507 - DNA, 16 bp, R. norvegicus
ttggctattataaata

SEQ ID NO: 531508 - DNA, 17 bp, R. norvegicus
ttggctattataaataa

SEQ ID NO: 531509 - DNA, 16 bp, R. norvegicus
ttggctattctggaac

SEQ ID NO: 531510 - DNA, 16 bp, R. norvegicus
ttggctattttcttta

SEQ ID NO: 531511 - DNA, 16 bp, R. norvegicus
ttggctcatggtttca

SEQ ID NO: 531512 - DNA, 16 bp, R. norvegicus
ttggctcccagcacca

SEQ ID NO: 531513 - DNA, 16 bp, R. norvegicus
ttggctcctgggagcc

SEQ ID NO: 531514 - DNA, 16 bp, R. norvegicus
ttggctctctggagac

SEQ ID NO: 531515 - DNA, 16 bp, R. norvegicus
ttggctctgagttctt

SEQ ID NO: 531516 - DNA, 16 bp, R. norvegicus
ttggctgctctcccag

SEQ ID NO: 531517 - DNA, 16 bp, R. norvegicus
ttggctgctctggacc

SEQ ID NO: 531518 - DNA, 16 bp, R. norvegicus
ttggctgggaaactgg

SEQ ID NO: 531519 - DNA, 16 bp, R. norvegicus
ttggctgtctggagtc

SEQ ID NO: 531520 - DNA, 16 bp, R. norvegicus
ttggctgttgccaggt

SEQ ID NO: 531521 - DNA, 16 bp, R. norvegicus
ttggcttacagttcag

SEQ ID NO: 531522 - DNA, 16 bp, R. norvegicus
ttggcttccttcagtg

SEQ ID NO: 531523 - DNA, 16 bp, R. norvegicus
ttggcttctctcagct

SEQ ID NO: 531524 - DNA, 16 bp, R. norvegicus
ttggcttctgtagttc

SEQ ID NO: 531525 - DNA, 16 bp, R. norvegicus
ttggcttcttgtatgc

SEQ ID NO: 531526 - DNA, 16 bp, R. norvegicus
ttggctttctccttcc

SEQ ID NO: 531527 - DNA, 16 bp, R. norvegicus
ttggcttttggagcct

SEQ ID NO: 531528 - DNA, 16 bp, R. norvegicus
ttgggaaactgaggca

SEQ ID NO: 531529 - DNA, 16 bp, R. norvegicus
ttgggaaacttttttt

SEQ ID NO: 531530 - DNA, 16 bp, R. norvegicus
ttgggaactaaatgaa

SEQ ID NO: 531531 - DNA, 16 bp, R. norvegicus
ttgggaactaggtagg

SEQ ID NO: 531532 - DNA, 16 bp, R. norvegicus
ttgggaagacaaaggg

SEQ ID NO: 531533 - DNA, 16 bp, R. norvegicus
ttgggaagcagaagga

SEQ ID NO: 531534 - DNA, 16 bp, R. norvegicus
ttgggaaggaaaaggt

SEQ ID NO: 531535 - DNA, 16 bp, R. norvegicus
ttgggaaggaaaggtt

SEQ ID NO: 531536 - DNA, 24 bp, R. norvegicus
ttgggaatgtctagtgactcagag

SEQ ID NO: 531537 - DNA, 16 bp, R. norvegicus
ttgggacaggatctca

SEQ ID NO: 531538 - DNA, 16 bp, R. norvegicus
ttgggacatccttgtg

SEQ ID NO: 531539 - DNA, 17 bp, R. norvegicus
ttgggacattgtcagca

SEQ ID NO: 531540 - DNA, 16 bp, R. norvegicus
ttgggactcctcctga

SEQ ID NO: 531541 - DNA, 16 bp, R. norvegicus
ttgggactggcctcca

SEQ ID NO: 531542 - DNA, 16 bp, R. norvegicus
ttgggagagagaactc

SEQ ID NO: 531543 - DNA, 16 bp, R. norvegicus
ttgggagatagaagca

SEQ ID NO: 531544 - DNA, 16 bp, R. norvegicus
ttgggagatttttggt

SEQ ID NO: 531545 - DNA, 16 bp, R. norvegicus
ttgggagcactggctg

SEQ ID NO: 531546 - DNA, 16 bp, R. norvegicus
ttgggaggcagaagca

SEQ ID NO: 531547 - DNA, 16 bp, R. norvegicus
ttgggaggctgaggta

SEQ ID NO: 531548 - DNA, 16 bp, R. norvegicus
ttgggaggtgatcagg

SEQ ID NO: 531549 - DNA, 16 bp, R. norvegicus
ttgggatgaacattgc

SEQ ID NO: 531550 - DNA, 16 bp, R. norvegicus
ttgggatgtgtatgtt

SEQ ID NO: 531551 - DNA, 16 bp, R. norvegicus
ttgggattatttgctt

SEQ ID NO: 531552 - DNA, 17 bp, R. norvegicus
ttgggcaaatatccact

SEQ ID NO: 531553 - DNA, 16 bp, R. norvegicus
ttgggcaccaatggga

SEQ ID NO: 531554 - DNA, 16 bp, R. norvegicus
ttgggcagcagttcag

SEQ ID NO: 531555 - DNA, 16 bp, R. norvegicus
ttgggcatttcaacta

SEQ ID NO: 531556 - DNA, 16 bp, R. norvegicus
ttgggcattttaatat

SEQ ID NO: 531557 - DNA, 16 bp, R. norvegicus
ttgggcctgtcattgg

SEQ ID NO: 531558 - DNA, 16 bp, R. norvegicus
ttgggcctgtccctgg

SEQ ID NO: 531559 - DNA, 16 bp, R. norvegicus
ttgggctcatatccac

SEQ ID NO: 531560 - DNA, 16 bp, R. norvegicus
ttgggctcctatgatg

SEQ ID NO: 531561 - DNA, 16 bp, R. norvegicus
ttgggctggtggtctt

SEQ ID NO: 531562 - DNA, 16 bp, R. norvegicus
ttgggctggttctact

SEQ ID NO: 531563 - DNA, 16 bp, R. norvegicus
ttggggaaagttcttt

SEQ ID NO: 531564 - DNA, 16 bp, R. norvegicus
ttggggaacatcctca

SEQ ID NO: 531565 - DNA, 16 bp, R. norvegicus
ttggggacccacttct

SEQ ID NO: 531566 - DNA, 16 bp, R. norvegicus
ttggggagctgaggcc

SEQ ID NO: 531567 - DNA, 16 bp, R. norvegicus
ttggggatcatcacaa

SEQ ID NO: 531568 - DNA, 16 bp, R. norvegicus
ttggggattgaattca

SEQ ID NO: 531569 - DNA, 16 bp, R. norvegicus
ttggggcaagtccaat

SEQ ID NO: 531570 - DNA, 16 bp, R. norvegicus
ttggggcaccagagga

SEQ ID NO: 531571 - DNA, 16 bp, R. norvegicus
ttggggcagagactga

SEQ ID NO: 531572 - DNA, 16 bp, R. norvegicus
ttggggcatctttggg

SEQ ID NO: 531573 - DNA, 16 bp, R. norvegicus
ttggggctctgtctcc

SEQ ID NO: 531574 - DNA, 16 bp, R. norvegicus
ttggggctggagagat

SEQ ID NO: 531575 - DNA, 16 bp, R. norvegicus
ttggggctgggacttt

SEQ ID NO: 531576 - DNA, 16 bp, R. norvegicus
ttgggggcattttctc

SEQ ID NO: 531577 - DNA, 16 bp, R. norvegicus
ttggggggcagggaag

SEQ ID NO: 531578 - DNA, 16 bp, R. norvegicus
ttggggggggtcacca

SEQ ID NO: 531579 - DNA, 16 bp, R. norvegicus
ttggggtcagaggaga

SEQ ID NO: 531580 - DNA, 16 bp, R. norvegicus
ttggggttcaccacaa

SEQ ID NO: 531581 - DNA, 16 bp, R. norvegicus
ttgggtatatacccaa

SEQ ID NO: 531582 - DNA, 16 bp, R. norvegicus
ttgggtcacttctcca

SEQ ID NO: 531583 - DNA, 16 bp, R. norvegicus
ttgggtcagggatgtg

SEQ ID NO: 531584 - DNA, 16 bp, R. norvegicus
ttgggtccctgcatcc

SEQ ID NO: 531585 - DNA, 16 bp, R. norvegicus
ttgggtcctggctctg

SEQ ID NO: 531586 - DNA, 16 bp, R. norvegicus
ttgggtctctcagaga

SEQ ID NO: 531587 - DNA, 16 bp, R. norvegicus
ttgggtcttttggaag

SEQ ID NO: 531588 - DNA, 16 bp, R. norvegicus
ttgggtgcagagatct

SEQ ID NO: 531589 - DNA, 16 bp, R. norvegicus
ttgggtgtcaacttga

SEQ ID NO: 531590 - DNA, 16 bp, R. norvegicus
ttgggtttccctggtt

SEQ ID NO: 531591 - DNA, 16 bp, R. norvegicus
ttgggtttctattgct

SEQ ID NO: 531592 - DNA, 16 bp, R. norvegicus
ttgggttttaatgctg

SEQ ID NO: 531593 - DNA, 16 bp, R. norvegicus
ttgggttttctgcaag

SEQ ID NO: 531594 - DNA, 16 bp, R. norvegicus
ttggtaaagagacaga

SEQ ID NO: 531595 - DNA, 16 bp, R. norvegicus
ttggtaccagggagtg

SEQ ID NO: 531596 - DNA, 16 bp, R. norvegicus
ttggtagaaccaaggg

SEQ ID NO: 531597 - DNA, 16 bp, R. norvegicus
ttggtagagtgcttgc

SEQ ID NO: 531598 - DNA, 16 bp, R. norvegicus
ttggtaggagaactgg

SEQ ID NO: 531599 - DNA, 16 bp, R. norvegicus
ttggtagggtgcttgc

SEQ ID NO: 531600 - DNA, 16 bp, R. norvegicus
ttggtattcttgttct

SEQ ID NO: 531601 - DNA, 16 bp, R. norvegicus
ttggtcaaaaaacagg

SEQ ID NO: 531602 - DNA, 16 bp, R. norvegicus
ttggtcaaaaaactgg

SEQ ID NO: 531603 - DNA, 16 bp, R. norvegicus
ttggtcaaagaaaatg

SEQ ID NO: 531604 - DNA, 16 bp, R. norvegicus
ttggtcaagaaatttc

SEQ ID NO: 531605 - DNA, 16 bp, R. norvegicus
ttggtcaaggaagaaa

SEQ ID NO: 531606 - DNA, 16 bp, R. norvegicus
ttggtcaaggaggaaa

SEQ ID NO: 531607 - DNA, 16 bp, R. norvegicus
ttggtcatgatgcttg

SEQ ID NO: 531608 - DNA, 16 bp, R. norvegicus
ttggtcatggcatctc

SEQ ID NO: 531609 - DNA, 17 bp, R. norvegicus
ttggtcctacctgtggt

SEQ ID NO: 531610 - DNA, 16 bp, R. norvegicus
ttggtcctcctcagct

SEQ ID NO: 531611 - DNA, 18 bp, R. norvegicus
ttggtcctgtgaaggctt

SEQ ID NO: 531612 - DNA, 16 bp, R. norvegicus
ttggtctggttcgagg

SEQ ID NO: 531613 - DNA, 16 bp, R. norvegicus
ttggtcttacctcttg

SEQ ID NO: 531614 - DNA, 19 bp, R. norvegicus
ttggtcttacctgtggacc

SEQ ID NO: 531615 - DNA, 28 bp, R. norvegicus
ttggtcttacctgtggtcccgaggctca

SEQ ID NO: 531616 - DNA, 28 bp, R. norvegicus
ttggtcttacctgtggtcctgaggctca

SEQ ID NO: 531617 - DNA, 16 bp, R. norvegicus
ttggtcttgagtcttc

SEQ ID NO: 531618 - DNA, 16 bp, R. norvegicus
ttggtgaagaatatgg

SEQ ID NO: 531619 - DNA, 16 bp, R. norvegicus
ttggtgaaggtgcagt

SEQ ID NO: 531620 - DNA, 16 bp, R. norvegicus
ttggtgacacttttga

SEQ ID NO: 531621 - DNA, 16 bp, R. norvegicus
ttggtgagcacctgtg

SEQ ID NO: 531622 - DNA, 16 bp, R. norvegicus
ttggtgatgcttacat

SEQ ID NO: 531623 - DNA, 16 bp, R. norvegicus
ttggtgatggtgatgg

SEQ ID NO: 531624 - DNA, 16 bp, R. norvegicus
ttggtgcccaacaggg

SEQ ID NO: 531625 - DNA, 16 bp, R. norvegicus
ttggtgctgccaaggc

SEQ ID NO: 531626 - DNA, 16 bp, R. norvegicus
ttggtgcttaagttaa

SEQ ID NO: 531627 - DNA, 24 bp, R. norvegicus
ttggtggagaacaagaaggctcag

SEQ ID NO: 531628 - DNA, 16 bp, R. norvegicus
ttggtggagggggtaa

SEQ ID NO: 531629 - DNA, 16 bp, R. norvegicus
ttggtggtcaacttga

SEQ ID NO: 531630 - DNA, 16 bp, R. norvegicus
ttggtggtcatcccat

SEQ ID NO: 531631 - DNA, 16 bp, R. norvegicus
ttggtgtacatgagga

SEQ ID NO: 531632 - DNA, 16 bp, R. norvegicus
ttggtgtccaggtttc

SEQ ID NO: 531633 - DNA, 16 bp, R. norvegicus
ttggtgtccatgtttc

SEQ ID NO: 531634 - DNA, 16 bp, R. norvegicus
ttggtgtctatatatg

SEQ ID NO: 531635 - DNA, 16 bp, R. norvegicus
ttggtgtctgaagatg

SEQ ID NO: 531636 - DNA, 16 bp, R. norvegicus
ttggtgtcttttaccc

SEQ ID NO: 531637 - DNA, 16 bp, R. norvegicus
ttggtgtgttcttgga

SEQ ID NO: 531638 - DNA, 16 bp, R. norvegicus
ttggttcaccttgcct

SEQ ID NO: 531639 - DNA, 16 bp, R. norvegicus
ttggttctcttctacc

SEQ ID NO: 531640 - DNA, 16 bp, R. norvegicus
ttggttgccgttctgt

SEQ ID NO: 531641 - DNA, 16 bp, R. norvegicus
ttggttgtcaatttga

SEQ ID NO: 531642 - DNA, 16 bp, R. norvegicus
ttggttgtgttctcct

SEQ ID NO: 531643 - DNA, 43 bp, R. norvegicus
ttggtttatatacaagtgtgcaatttctaggcttgaaagtaaa

SEQ ID NO: 531644 - DNA, 16 bp, R. norvegicus
ttggtttcatcatgga

SEQ ID NO: 531645 - DNA, 16 bp, R. norvegicus
ttggtttctttaaaag

SEQ ID NO: 531646 - DNA, 16 bp, R. norvegicus
ttggtttgacctgtgg

SEQ ID NO: 531647 - DNA, 16 bp, R. norvegicus
ttggtttgtgcatttg

SEQ ID NO: 531648 - DNA, 16 bp, R. norvegicus
ttggtttgttgccaag

SEQ ID NO: 531649 - DNA, 16 bp, R. norvegicus
ttggttttattccaag

SEQ ID NO: 531650 - DNA, 16 bp, R. norvegicus
ttggttttctatatac

SEQ ID NO: 531651 - DNA, 16 bp, R. norvegicus
ttggtttttagagaca

SEQ ID NO: 531652 - DNA, 16 bp, R. norvegicus
ttggtttttgagacag

SEQ ID NO: 531653 - DNA, 16 bp, R. norvegicus
ttgtaaaattgttttc

SEQ ID NO: 531654 - DNA, 16 bp, R. norvegicus
ttgtaaaccaccatgt

SEQ ID NO: 531655 - DNA, 16 bp, R. norvegicus
ttgtaaacgagcctga

SEQ ID NO: 531656 - DNA, 16 bp, R. norvegicus
ttgtaaagtttctttt

SEQ ID NO: 531657 - DNA, 16 bp, R. norvegicus
ttgtaaatgtaccaca

SEQ ID NO: 531658 - DNA, 16 bp, R. norvegicus
ttgtaacttttaaaaa

SEQ ID NO: 531659 - DNA, 16 bp, R. norvegicus
ttgtaagctgctgtgt

SEQ ID NO: 531660 - DNA, 16 bp, R. norvegicus
ttgtaatgtaaataag

SEQ ID NO: 531661 - DNA, 16 bp, R. norvegicus
ttgtacaagaagataa

SEQ ID NO: 531662 - DNA, 16 bp, R. norvegicus
ttgtacattatctttg

SEQ ID NO: 531663 - DNA, 16 bp, R. norvegicus
ttgtacttgtcctgat

SEQ ID NO: 531664 - DNA, 16 bp, R. norvegicus
ttgtagagtctacctc

SEQ ID NO: 531665 - DNA, 16 bp, R. norvegicus
ttgtagctgttccagg

SEQ ID NO: 531666 - DNA, 16 bp, R. norvegicus
ttgtagcttttaatat

SEQ ID NO: 531667 - DNA, 16 bp, R. norvegicus
ttgtaggacattttct

SEQ ID NO: 531668 - DNA, 16 bp, R. norvegicus
ttgtagggctgcattt

SEQ ID NO: 531669 - DNA, 16 bp, R. norvegicus
ttgtagggctggatat

SEQ ID NO: 531670 - DNA, 16 bp, R. norvegicus
ttgtatataaggctag

SEQ ID NO: 531671 - DNA, 16 bp, R. norvegicus
ttgtatatagtggata

SEQ ID NO: 531672 - DNA, 16 bp, R. norvegicus
ttgtatatatgtgtgt

SEQ ID NO: 531673 - DNA, 16 bp, R. norvegicus
ttgtatatgtatatgt

SEQ ID NO: 531674 - DNA, 16 bp, R. norvegicus
ttgtatatgtgtatat

SEQ ID NO: 531675 - DNA, 16 bp, R. norvegicus
ttgtatattctagata

SEQ ID NO: 531676 - DNA, 18 bp, R. norvegicus
ttgtatcaaggttcctga

SEQ ID NO: 531677 - DNA, 18 bp, R. norvegicus
ttgtatcacccccgagca

SEQ ID NO: 531678 - DNA, 16 bp, R. norvegicus
ttgtatcttaaagaga

SEQ ID NO: 531679 - DNA, 16 bp, R. norvegicus
ttgtatgagaaaaaaa

SEQ ID NO: 531680 - DNA, 16 bp, R. norvegicus
ttgtatgtatatgatt

SEQ ID NO: 531681 - DNA, 16 bp, R. norvegicus
ttgtatgtgtgttttc

SEQ ID NO: 531682 - DNA, 16 bp, R. norvegicus
ttgtattctctctctc

SEQ ID NO: 531683 - DNA, 18 bp, R. norvegicus
ttgtattctgttggtgat

SEQ ID NO: 531684 - DNA, 16 bp, R. norvegicus
ttgtattgttcccttt

SEQ ID NO: 531685 - DNA, 16 bp, R. norvegicus
ttgtatttctgggtct

SEQ ID NO: 531686 - DNA, 16 bp, R. norvegicus
ttgtatttggggcaga

SEQ ID NO: 531687 - DNA, 16 bp, R. norvegicus
ttgtattttcatgtat

SEQ ID NO: 531688 - DNA, 17 bp, R. norvegicus
ttgtattttgatgggga

SEQ ID NO: 531689 - DNA, 16 bp, R. norvegicus
ttgtcaaattgacaca

SEQ ID NO: 531690 - DNA, 16 bp, R. norvegicus
ttgtcaacatgtgctg

SEQ ID NO: 531691 - DNA, 16 bp, R. norvegicus
ttgtcaactggaaaac

SEQ ID NO: 531692 - DNA, 16 bp, R. norvegicus
ttgtcacagcaacaga

SEQ ID NO: 531693 - DNA, 16 bp, R. norvegicus
ttgtcacagtgacaga

SEQ ID NO: 531694 - DNA, 16 bp, R. norvegicus
ttgtcaccaccaccac

SEQ ID NO: 531695 - DNA, 16 bp, R. norvegicus
ttgtcacctgagtttt

SEQ ID NO: 531696 - DNA, 16 bp, R. norvegicus
ttgtcagagaagcttc

SEQ ID NO: 531697 - DNA, 16 bp, R. norvegicus
ttgtcagattgctctg

SEQ ID NO: 531698 - DNA, 16 bp, R. norvegicus
ttgtcaggcatcaata

SEQ ID NO: 531699 - DNA, 16 bp, R. norvegicus
ttgtcatacagacctt

SEQ ID NO: 531700 - DNA, 16 bp, R. norvegicus
ttgtcatatgctttct

SEQ ID NO: 531701 - DNA, 16 bp, R. norvegicus
ttgtcatcatcattgt

SEQ ID NO: 531702 - DNA, 16 bp, R. norvegicus
ttgtcatccagatctt

SEQ ID NO: 531703 - DNA, 17 bp, R. norvegicus
ttgtcatggaaaatctt

SEQ ID NO: 531704 - DNA, 16 bp, R. norvegicus
ttgtcatggaatatcg

SEQ ID NO: 531705 - DNA, 16 bp, R. norvegicus
ttgtcatggtaggaag

SEQ ID NO: 531706 - DNA, 16 bp, R. norvegicus
ttgtcattgtcattgt

SEQ ID NO: 531707 - DNA, 16 bp, R. norvegicus
ttgtccagtgtggtca

SEQ ID NO: 531708 - DNA, 16 bp, R. norvegicus
ttgtcccccttcctgg

SEQ ID NO: 531709 - DNA, 30 bp, R. norvegicus
ttgtcctaactgactggtactgttgtctca

SEQ ID NO: 531710 - DNA, 16 bp, R. norvegicus
ttgtcctctgactcct

SEQ ID NO: 531711 - DNA, 16 bp, R. norvegicus
ttgtcctggatgacct

SEQ ID NO: 531712 - DNA, 16 bp, R. norvegicus
ttgtcctgggtttgag

SEQ ID NO: 531713 - DNA, 16 bp, R. norvegicus
ttgtcctttctggaca

SEQ ID NO: 531714 - DNA, 16 bp, R. norvegicus
ttgtcctttgatttcc

SEQ ID NO: 531715 - DNA, 16 bp, R. norvegicus
ttgtcctttggcctct

SEQ ID NO: 531716 - DNA, 16 bp, R. norvegicus
ttgtcgattttctcaa

SEQ ID NO: 531717 - DNA, 16 bp, R. norvegicus
ttgtctatgactcctg

SEQ ID NO: 531718 - DNA, 16 bp, R. norvegicus
ttgtctccatatccta

SEQ ID NO: 531719 - DNA, 16 bp, R. norvegicus
ttgtctcctgtgtcaa

SEQ ID NO: 531720 - DNA, 16 bp, R. norvegicus
ttgtctctcccagtat

SEQ ID NO: 531721 - DNA, 16 bp, R. norvegicus
ttgtctctctgggtct

SEQ ID NO: 531722 - DNA, 16 bp, R. norvegicus
ttgtctctgacctcca

SEQ ID NO: 531723 - DNA, 16 bp, R. norvegicus
ttgtctcttatttcct

SEQ ID NO: 531724 - DNA, 26 bp, R. norvegicus
ttgtctgaagtagtcttacaaaatag

SEQ ID NO: 531725 - DNA, 16 bp, R. norvegicus
ttgtctgacctcagta

SEQ ID NO: 531726 - DNA, 16 bp, R. norvegicus
ttgtctgtgggtctct

SEQ ID NO: 531727 - DNA, 16 bp, R. norvegicus
ttgtctgtgtgagggt

SEQ ID NO: 531728 - DNA, 16 bp, R. norvegicus
ttgtcttactgtttct

SEQ ID NO: 531729 - DNA, 16 bp, R. norvegicus
ttgtcttcagcaatgg

SEQ ID NO: 531730 - DNA, 16 bp, R. norvegicus
ttgtcttctgactttc

SEQ ID NO: 531731 - DNA, 16 bp, R. norvegicus
ttgtcttggaattttg

SEQ ID NO: 531732 - DNA, 16 bp, R. norvegicus
ttgtcttgttcctggt

SEQ ID NO: 531733 - DNA, 16 bp, R. norvegicus
ttgtctttaaaaatat

SEQ ID NO: 531734 - DNA, 16 bp, R. norvegicus
ttgtctttatttaaaa

SEQ ID NO: 531735 - DNA, 16 bp, R. norvegicus
ttgtctttctgagttt

SEQ ID NO: 531736 - DNA, 16 bp, R. norvegicus
ttgtcttttttaaaat

SEQ ID NO: 531737 - DNA, 16 bp, R. norvegicus
ttgtcttttttgataa

SEQ ID NO: 531738 - DNA, 16 bp, R. norvegicus
ttgtgaaagaagtgga

SEQ ID NO: 531739 - DNA, 16 bp, R. norvegicus
ttgtgaaatgttttct

SEQ ID NO: 531740 - DNA, 16 bp, R. norvegicus
ttgtgaaccacaatgt

SEQ ID NO: 531741 - DNA, 16 bp, R. norvegicus
ttgtgaaccaccacat

SEQ ID NO: 531742 - DNA, 16 bp, R. norvegicus
ttgtgaactgtcatgt

SEQ ID NO: 531743 - DNA, 16 bp, R. norvegicus
ttgtgaagcaccatgt

SEQ ID NO: 531744 - DNA, 16 bp, R. norvegicus
ttgtgaaggaagttgt

SEQ ID NO: 531745 - DNA, 16 bp, R. norvegicus
ttgtgaagggtgtttt

SEQ ID NO: 531746 - DNA, 16 bp, R. norvegicus
ttgtgaattgctcttt

SEQ ID NO: 531747 - DNA, 16 bp, R. norvegicus
ttgtgaccaaatatat

SEQ ID NO: 531748 - DNA, 16 bp, R. norvegicus
ttgtgagagcattaca

SEQ ID NO: 531749 - DNA, 16 bp, R. norvegicus
ttgtgagagccagagg

SEQ ID NO: 531750 - DNA, 16 bp, R. norvegicus
ttgtgagtggccatgt

SEQ ID NO: 531751 - DNA, 17 bp, R. norvegicus
ttgtgatgcttgtatct

SEQ ID NO: 531752 - DNA, 16 bp, R. norvegicus
ttgtgcaagcatgagg

SEQ ID NO: 531753 - DNA, 16 bp, R. norvegicus
ttgtgcacaccaggca

SEQ ID NO: 531754 - DNA, 16 bp, R. norvegicus
ttgtgcattttgtgtt

SEQ ID NO: 531755 - DNA, 16 bp, R. norvegicus
ttgtgccaccacaccc

SEQ ID NO: 531756 - DNA, 16 bp, R. norvegicus
ttgtgccaggaatgtg

SEQ ID NO: 531757 - DNA, 16 bp, R. norvegicus
ttgtgccatcattttc

SEQ ID NO: 531758 - DNA, 16 bp, R. norvegicus
ttgtgctgcagctgga

SEQ ID NO: 531759 - DNA, 16 bp, R. norvegicus
ttgtgctgctgctgct

SEQ ID NO: 531760 - DNA, 16 bp, R. norvegicus
ttgtgctttttaaaaa

SEQ ID NO: 531761 - DNA, 16 bp, R. norvegicus
ttgtggaagaatacat

SEQ ID NO: 531762 - DNA, 16 bp, R. norvegicus
ttgtggaagagctggg

SEQ ID NO: 531763 - DNA, 16 bp, R. norvegicus
ttgtggaagagtggga

SEQ ID NO: 531764 - DNA, 17 bp, R. norvegicus
ttgtggaatattttgga

SEQ ID NO: 531765 - DNA, 16 bp, R. norvegicus
ttgtggacaaggctgg

SEQ ID NO: 531766 - DNA, 16 bp, R. norvegicus
ttgtggaccttaagct

SEQ ID NO: 531767 - DNA, 16 bp, R. norvegicus
ttgtggagaaaagggt

SEQ ID NO: 531768 - DNA, 16 bp, R. norvegicus
ttgtggagagcaacct

SEQ ID NO: 531769 - DNA, 16 bp, R. norvegicus
ttgtggagatggggga

SEQ ID NO: 531770 - DNA, 16 bp, R. norvegicus
ttgtggaggcactcag

SEQ ID NO: 531771 - DNA, 16 bp, R. norvegicus
ttgtggagttggttct

SEQ ID NO: 531772 - DNA, 16 bp, R. norvegicus
ttgtggatctgacatg

SEQ ID NO: 531773 - DNA, 16 bp, R. norvegicus
ttgtggattcttcttt

SEQ ID NO: 531774 - DNA, 16 bp, R. norvegicus
ttgtggattttctcaa

SEQ ID NO: 531775 - DNA, 17 bp, R. norvegicus
ttgtggcatagtttgga

SEQ ID NO: 531776 - DNA, 16 bp, R. norvegicus
ttgtggccatcagtca

SEQ ID NO: 531777 - DNA, 16 bp, R. norvegicus
ttgtggccttattgga

SEQ ID NO: 531778 - DNA, 16 bp, R. norvegicus
ttgtggctgggcagcc

SEQ ID NO: 531779 - DNA, 16 bp, R. norvegicus
ttgtggctgttgtgaa

SEQ ID NO: 531780 - DNA, 16 bp, R. norvegicus
ttgtgggactgaacaa

SEQ ID NO: 531781 - DNA, 16 bp, R. norvegicus
ttgtggtagtttgaat

SEQ ID NO: 531782 - DNA, 16 bp, R. norvegicus
ttgtggtccccatgct

SEQ ID NO: 531783 - DNA, 16 bp, R. norvegicus
ttgtggtggcacatgc

SEQ ID NO: 531784 - DNA, 16 bp, R. norvegicus
ttgtgtaaatgttttc

SEQ ID NO: 531785 - DNA, 16 bp, R. norvegicus
ttgtgtagacatacca

SEQ ID NO: 531786 - DNA, 40 bp, R. norvegicus
ttgtgtagtgaactatttcgtgaagtggaaggggtttaca

SEQ ID NO: 531787 - DNA, 16 bp, R. norvegicus
ttgtgtataggaaggc

SEQ ID NO: 531788 - DNA, 16 bp, R. norvegicus
ttgtgtatccattcct

SEQ ID NO: 531789 - DNA, 16 bp, R. norvegicus
ttgtgtatgtatatat

SEQ ID NO: 531790 - DNA, 16 bp, R. norvegicus
ttgtgtcaagtggaca

SEQ ID NO: 531791 - DNA, 16 bp, R. norvegicus
ttgtgtccacaagaca

SEQ ID NO: 531792 - DNA, 16 bp, R. norvegicus
ttgtgtgacaaaactt

SEQ ID NO: 531793 - DNA, 16 bp, R. norvegicus
ttgtgtgcatgtgtgt

SEQ ID NO: 531794 - DNA, 16 bp, R. norvegicus
ttgtgtgcttttctgc

SEQ ID NO: 531795 - DNA, 16 bp, R. norvegicus
ttgtgttgattttctc

SEQ ID NO: 531796 - DNA, 16 bp, R. norvegicus
ttgtgtttggggcata

SEQ ID NO: 531797 - DNA, 16 bp, R. norvegicus
ttgtgttttataagaa

SEQ ID NO: 531798 - DNA, 16 bp, R. norvegicus
ttgtgttttccaggaa

SEQ ID NO: 531799 - DNA, 16 bp, R. norvegicus
ttgtgtttttctctaa

SEQ ID NO: 531800 - DNA, 16 bp, R. norvegicus
ttgttaatgaggtgtg

SEQ ID NO: 531801 - DNA, 16 bp, R. norvegicus
ttgttactatattaat

SEQ ID NO: 531802 - DNA, 16 bp, R. norvegicus
ttgttactgttgcttt

SEQ ID NO: 531803 - DNA, 16 bp, R. norvegicus
ttgttactttggatac

SEQ ID NO: 531804 - DNA, 16 bp, R. norvegicus
ttgttagtgaagtttt

SEQ ID NO: 531805 - DNA, 16 bp, R. norvegicus
ttgttataccaaatga

SEQ ID NO: 531806 - DNA, 16 bp, R. norvegicus
ttgttattacttttcc

SEQ ID NO: 531807 - DNA, 16 bp, R. norvegicus
ttgttattccaagtga

SEQ ID NO: 531808 - DNA, 16 bp, R. norvegicus
ttgttattctgggttt

SEQ ID NO: 531809 - DNA, 16 bp, R. norvegicus
ttgttattgaagagca

SEQ ID NO: 531810 - DNA, 16 bp, R. norvegicus
ttgttattgaagatga

SEQ ID NO: 531811 - DNA, 16 bp, R. norvegicus
ttgttcaagtcttgtt

SEQ ID NO: 531812 - DNA, 16 bp, R. norvegicus
ttgttcacacacacac

SEQ ID NO: 531813 - DNA, 16 bp, R. norvegicus
ttgttcagtctttgtg

SEQ ID NO: 531814 - DNA, 16 bp, R. norvegicus
ttgttcattttcttca

SEQ ID NO: 531815 - DNA, 16 bp, R. norvegicus
ttgttcccagctggtg

SEQ ID NO: 531816 - DNA, 16 bp, R. norvegicus
ttgttcccccttctag

SEQ ID NO: 531817 - DNA, 16 bp, R. norvegicus
ttgttccccttctaaa

SEQ ID NO: 531818 - DNA, 16 bp, R. norvegicus
ttgttcctcagaaaat

SEQ ID NO: 531819 - DNA, 16 bp, R. norvegicus
ttgttcctctttctaa

SEQ ID NO: 531820 - DNA, 16 bp, R. norvegicus
ttgttcctggtttgta

SEQ ID NO: 531821 - DNA, 16 bp, R. norvegicus
ttgttcctgtctactg

SEQ ID NO: 531822 - DNA, 16 bp, R. norvegicus
ttgttcctttccaatt

SEQ ID NO: 531823 - DNA, 16 bp, R. norvegicus
ttgttctagagttttc

SEQ ID NO: 531824 - DNA, 16 bp, R. norvegicus
ttgttctcatggggtt

SEQ ID NO: 531825 - DNA, 16 bp, R. norvegicus
ttgttctctaaggaag

SEQ ID NO: 531826 - DNA, 16 bp, R. norvegicus
ttgttctctgacctct

SEQ ID NO: 531827 - DNA, 16 bp, R. norvegicus
ttgttctctggggagt

SEQ ID NO: 531828 - DNA, 17 bp, R. norvegicus
ttgttctgatgtgctct

SEQ ID NO: 531829 - DNA, 16 bp, R. norvegicus
ttgttctgctattcct

SEQ ID NO: 531830 - DNA, 16 bp, R. norvegicus
ttgttctgtagatttt

SEQ ID NO: 531831 - DNA, 16 bp, R. norvegicus
ttgttcttgagcttca

SEQ ID NO: 531832 - DNA, 16 bp, R. norvegicus
ttgttcttttcatagt

SEQ ID NO: 531833 - DNA, 16 bp, R. norvegicus
ttgttgaaaatagttt

SEQ ID NO: 531834 - DNA, 16 bp, R. norvegicus
ttgttgaagatattga

SEQ ID NO: 531835 - DNA, 16 bp, R. norvegicus
ttgttgactacaacac

SEQ ID NO: 531836 - DNA, 16 bp, R. norvegicus
ttgttgctatgacaaa

SEQ ID NO: 531837 - DNA, 16 bp, R. norvegicus
ttgttgctcttataga

SEQ ID NO: 531838 - DNA, 16 bp, R. norvegicus
ttgttgctgttattgt

SEQ ID NO: 531839 - DNA, 16 bp, R. norvegicus
ttgttgctgttttaaa

SEQ ID NO: 531840 - DNA, 16 bp, R. norvegicus
ttgttgcttcctttta

SEQ ID NO: 531841 - DNA, 16 bp, R. norvegicus
ttgttggaacttgtct

SEQ ID NO: 531842 - DNA, 16 bp, R. norvegicus
ttgttggaagaagtgt

SEQ ID NO: 531843 - DNA, 16 bp, R. norvegicus
ttgttggggggagggc

SEQ ID NO: 531844 - DNA, 16 bp, R. norvegicus
ttgttggtggtgccat

SEQ ID NO: 531845 - DNA, 16 bp, R. norvegicus
ttgttgttactattat

SEQ ID NO: 531846 - DNA, 16 bp, R. norvegicus
ttgtttaaaaggggaa

SEQ ID NO: 531847 - DNA, 16 bp, R. norvegicus
ttgtttaaagaaataa

SEQ ID NO: 531848 - DNA, 16 bp, R. norvegicus
ttgtttagctctgaat

SEQ ID NO: 531849 - DNA, 16 bp, R. norvegicus
ttgtttatttaagaca

SEQ ID NO: 531850 - DNA, 16 bp, R. norvegicus
ttgtttcaaacaaaca

SEQ ID NO: 531851 - DNA, 16 bp, R. norvegicus
ttgtttccaagatgag

SEQ ID NO: 531852 - DNA, 16 bp, R. norvegicus
ttgtttccagctcctg

SEQ ID NO: 531853 - DNA, 16 bp, R. norvegicus
ttgtttccagtctctg

SEQ ID NO: 531854 - DNA, 16 bp, R. norvegicus
ttgtttccatttcaaa

SEQ ID NO: 531855 - DNA, 16 bp, R. norvegicus
ttgtttccctcccttg

SEQ ID NO: 531856 - DNA, 16 bp, R. norvegicus
ttgtttcctaggagaa

SEQ ID NO: 531857 - DNA, 16 bp, R. norvegicus
ttgtttcctgtaattt

SEQ ID NO: 531858 - DNA, 16 bp, R. norvegicus
ttgtttctatttcata

SEQ ID NO: 531859 - DNA, 16 bp, R. norvegicus
ttgtttctattttaca

SEQ ID NO: 531860 - DNA, 16 bp, R. norvegicus
ttgtttctgtaccaat

SEQ ID NO: 531861 - DNA, 16 bp, R. norvegicus
ttgtttctgtcacctg

SEQ ID NO: 531862 - DNA, 16 bp, R. norvegicus
ttgtttctttaaaaca

SEQ ID NO: 531863 - DNA, 16 bp, R. norvegicus
ttgtttctttgaaaaa

SEQ ID NO: 531864 - DNA, 16 bp, R. norvegicus
ttgtttgagaaaatca

SEQ ID NO: 531865 - DNA, 16 bp, R. norvegicus
ttgtttgcaaatattt

SEQ ID NO: 531866 - DNA, 16 bp, R. norvegicus
ttgtttgctttttaag

SEQ ID NO: 531867 - DNA, 16 bp, R. norvegicus
ttgtttggttttctga

SEQ ID NO: 531868 - DNA, 16 bp, R. norvegicus
ttgtttgttttaaagg

SEQ ID NO: 531869 - DNA, 16 bp, R. norvegicus
ttgtttgttttaatgc

SEQ ID NO: 531870 - DNA, 16 bp, R. norvegicus
ttgtttgttttacagt

SEQ ID NO: 531871 - DNA, 16 bp, R. norvegicus
ttgtttgttttgtaca

SEQ ID NO: 531872 - DNA, 16 bp, R. norvegicus
ttgttttaaaattcat

SEQ ID NO: 531873 - DNA, 16 bp, R. norvegicus
ttgttttaatttcctc

SEQ ID NO: 531874 - DNA, 16 bp, R. norvegicus
ttgttttactttaaaa

SEQ ID NO: 531875 - DNA, 16 bp, R. norvegicus
ttgttttcctctggag

SEQ ID NO: 531876 - DNA, 16 bp, R. norvegicus
ttgttttcctttgaaa

SEQ ID NO: 531877 - DNA, 16 bp, R. norvegicus
ttgttttctgaagaga

SEQ ID NO: 531878 - DNA, 16 bp, R. norvegicus
ttgttttctgagacag

SEQ ID NO: 531879 - DNA, 16 bp, R. norvegicus
ttgttttctgcatttg

SEQ ID NO: 531880 - DNA, 16 bp, R. norvegicus
ttgttttctttaaaaa

SEQ ID NO: 531881 - DNA, 16 bp, R. norvegicus
ttgttttcttttgaga

SEQ ID NO: 531882 - DNA, 16 bp, R. norvegicus
ttgttttgaaaaataa

SEQ ID NO: 531883 - DNA, 16 bp, R. norvegicus
ttgttttgactttcat

SEQ ID NO: 531884 - DNA, 16 bp, R. norvegicus
ttgttttgtcctgtat

SEQ ID NO: 531885 - DNA, 16 bp, R. norvegicus
ttgttttgtttcctga

SEQ ID NO: 531886 - DNA, 16 bp, R. norvegicus
ttgttttgttttaaac

SEQ ID NO: 531887 - DNA, 16 bp, R. norvegicus
ttgttttgttttccaa

SEQ ID NO: 531888 - DNA, 16 bp, R. norvegicus
ttgtttttaaagaaaa

SEQ ID NO: 531889 - DNA, 16 bp, R. norvegicus
ttgtttttaaataaag

SEQ ID NO: 531890 - DNA, 16 bp, R. norvegicus
ttgtttttaacattta

SEQ ID NO: 531891 - DNA, 16 bp, R. norvegicus
ttgtttttaagagaga

SEQ ID NO: 531892 - DNA, 16 bp, R. norvegicus
ttgtttttataaaaca

SEQ ID NO: 531893 - DNA, 16 bp, R. norvegicus
ttgtttttatgtgcat

SEQ ID NO: 531894 - DNA, 16 bp, R. norvegicus
ttgttttttggagctg

SEQ ID NO: 531895 - DNA, 16 bp, R. norvegicus
tttaaaaaaaaggggg

SEQ ID NO: 531896 - DNA, 16 bp, R. norvegicus
tttaaaaaaaatcctt

SEQ ID NO: 531897 - DNA, 16 bp, R. norvegicus
tttaaaaaaaatggtg

SEQ ID NO: 531898 - DNA, 16 bp, R. norvegicus
tttaaaaaaagacaat

SEQ ID NO: 531899 - DNA, 16 bp, R. norvegicus
tttaaaaaaagagaca

SEQ ID NO: 531900 - DNA, 16 bp, R. norvegicus
tttaaaaaaatcagta

SEQ ID NO: 531901 - DNA, 16 bp, R. norvegicus
tttaaaaaacagaaca

SEQ ID NO: 531902 - DNA, 16 bp, R. norvegicus
tttaaaaaacattctt

SEQ ID NO: 531903 - DNA, 16 bp, R. norvegicus
tttaaaaaagtgttta

SEQ ID NO: 531904 - DNA, 16 bp, R. norvegicus
tttaaaaaatacagtt

SEQ ID NO: 531905 - DNA, 16 bp, R. norvegicus
tttaaaaaatacttca

SEQ ID NO: 531906 - DNA, 16 bp, R. norvegicus
tttaaaaaatattctc

SEQ ID NO: 531907 - DNA, 16 bp, R. norvegicus
tttaaaaaatcatgtt

SEQ ID NO: 531908 - DNA, 16 bp, R. norvegicus
tttaaaaaatgactta

SEQ ID NO: 531909 - DNA, 16 bp, R. norvegicus
tttaaaaaatgacttc

SEQ ID NO: 531910 - DNA, 16 bp, R. norvegicus
tttaaaaaatgcccta

SEQ ID NO: 531911 - DNA, 16 bp, R. norvegicus
tttaaaaaatgctttt

SEQ ID NO: 531912 - DNA, 16 bp, R. norvegicus
tttaaaaactaaagaa

SEQ ID NO: 531913 - DNA, 16 bp, R. norvegicus
tttaaaaagaaaagtc

SEQ ID NO: 531914 - DNA, 16 bp, R. norvegicus
tttaaaaagaaacagt

SEQ ID NO: 531915 - DNA, 16 bp, R. norvegicus
tttaaaaagaaacctg

SEQ ID NO: 531916 - DNA, 16 bp, R. norvegicus
tttaaaaagaaatgca

SEQ ID NO: 531917 - DNA, 16 bp, R. norvegicus
tttaaaaagaaatttg

SEQ ID NO: 531918 - DNA, 16 bp, R. norvegicus
tttaaaaagaagacaa

SEQ ID NO: 531919 - DNA, 16 bp, R. norvegicus
tttaaaaagacaatta

SEQ ID NO: 531920 - DNA, 16 bp, R. norvegicus
tttaaaaagacagaaa

SEQ ID NO: 531921 - DNA, 16 bp, R. norvegicus
tttaaaaagcaagaga

SEQ ID NO: 531922 - DNA, 16 bp, R. norvegicus
tttaaaaagcacagaa

SEQ ID NO: 531923 - DNA, 16 bp, R. norvegicus
tttaaaaagcagcttt

SEQ ID NO: 531924 - DNA, 16 bp, R. norvegicus
tttaaaaagctatgtt

SEQ ID NO: 531925 - DNA, 16 bp, R. norvegicus
tttaaaaagctttatt

SEQ ID NO: 531926 - DNA, 16 bp, R. norvegicus
tttaaaaaggaaaact

SEQ ID NO: 531927 - DNA, 16 bp, R. norvegicus
tttaaaaaggaaaagg

SEQ ID NO: 531928 - DNA, 16 bp, R. norvegicus
tttaaaaagggaaaat

SEQ ID NO: 531929 - DNA, 16 bp, R. norvegicus
tttaaaaagggaaaca

SEQ ID NO: 531930 - DNA, 16 bp, R. norvegicus
tttaaaaagttgttta

SEQ ID NO: 531931 - DNA, 16 bp, R. norvegicus
tttaaaaataatgtca

SEQ ID NO: 531932 - DNA, 16 bp, R. norvegicus
tttaaaaatacaagtg

SEQ ID NO: 531933 - DNA, 16 bp, R. norvegicus
tttaaaaatatgtcat

SEQ ID NO: 531934 - DNA, 16 bp, R. norvegicus
tttaaaaatcaccttt

SEQ ID NO: 531935 - DNA, 16 bp, R. norvegicus
tttaaaaatcatcaga

SEQ ID NO: 531936 - DNA, 16 bp, R. norvegicus
tttaaaaatcattttg

SEQ ID NO: 531937 - DNA, 16 bp, R. norvegicus
tttaaaaatctgattt

SEQ ID NO: 531938 - DNA, 16 bp, R. norvegicus
tttaaaaatgacaaaa

SEQ ID NO: 531939 - DNA, 16 bp, R. norvegicus
tttaaaaattaacctt

SEQ ID NO: 531940 - DNA, 16 bp, R. norvegicus
tttaaaaattctgtgt

SEQ ID NO: 531941 - DNA, 16 bp, R. norvegicus
tttaaaaccaatgaga

SEQ ID NO: 531942 - DNA, 16 bp, R. norvegicus
tttaaaactgtatttt

SEQ ID NO: 531943 - DNA, 16 bp, R. norvegicus
tttaaaactttgaaag

SEQ ID NO: 531944 - DNA, 16 bp, R. norvegicus
tttaaaagaaaacctt

SEQ ID NO: 531945 - DNA, 16 bp, R. norvegicus
tttaaaagaaagacaa

SEQ ID NO: 531946 - DNA, 16 bp, R. norvegicus
tttaaaagaaaggaag

SEQ ID NO: 531947 - DNA, 16 bp, R. norvegicus
tttaaaagaagaaatg

SEQ ID NO: 531948 - DNA, 16 bp, R. norvegicus
tttaaaagaagaacaa

SEQ ID NO: 531949 - DNA, 16 bp, R. norvegicus
tttaaaagaatgattt

SEQ ID NO: 531950 - DNA, 16 bp, R. norvegicus
tttaaaagacaaaaac

SEQ ID NO: 531951 - DNA, 16 bp, R. norvegicus
tttaaaagagagcaag

SEQ ID NO: 531952 - DNA, 16 bp, R. norvegicus
tttaaaagatttcatg

SEQ ID NO: 531953 - DNA, 16 bp, R. norvegicus
tttaaaagcattaaaa

SEQ ID NO: 531954 - DNA, 16 bp, R. norvegicus
tttaaaagcttttaaa

SEQ ID NO: 531955 - DNA, 16 bp, R. norvegicus
tttaaaaggaaatttt

SEQ ID NO: 531956 - DNA, 16 bp, R. norvegicus
tttaaaaggggaaaaa

SEQ ID NO: 531957 - DNA, 16 bp, R. norvegicus
tttaaaaggggggagg

SEQ ID NO: 531958 - DNA, 16 bp, R. norvegicus
tttaaaagtaaaactt

SEQ ID NO: 531959 - DNA, 16 bp, R. norvegicus
tttaaaagtaattgtt

SEQ ID NO: 531960 - DNA, 16 bp, R. norvegicus
tttaaaagtatcttta

SEQ ID NO: 531961 - DNA, 16 bp, R. norvegicus
tttaaaagtgaaaatt

SEQ ID NO: 531962 - DNA, 16 bp, R. norvegicus
tttaaaagttaaaaac

SEQ ID NO: 531963 - DNA, 16 bp, R. norvegicus
tttaaaataaaatgct

SEQ ID NO: 531964 - DNA, 16 bp, R. norvegicus
tttaaaataacatttc

SEQ ID NO: 531965 - DNA, 16 bp, R. norvegicus
tttaaaatagaacaaa

SEQ ID NO: 531966 - DNA, 16 bp, R. norvegicus
tttaaaatcatgaaac

SEQ ID NO: 531967 - DNA, 16 bp, R. norvegicus
tttaaaatgcataatt

SEQ ID NO: 531968 - DNA, 16 bp, R. norvegicus
tttaaaatgctttaaa

SEQ ID NO: 531969 - DNA, 16 bp, R. norvegicus
tttaaaatgcttttct

SEQ ID NO: 531970 - DNA, 16 bp, R. norvegicus
tttaaaatggaaaatt

SEQ ID NO: 531971 - DNA, 16 bp, R. norvegicus
tttaaaatgtaacttt

SEQ ID NO: 531972 - DNA, 16 bp, R. norvegicus
tttaaaatgtcttctt

SEQ ID NO: 531973 - DNA, 16 bp, R. norvegicus
tttaaaattccttttc

SEQ ID NO: 531974 - DNA, 16 bp, R. norvegicus
tttaaaatttcactct

SEQ ID NO: 531975 - DNA, 16 bp, R. norvegicus
tttaaaatttgcattt

SEQ ID NO: 531976 - DNA, 16 bp, R. norvegicus
tttaaaatttgtgtgt

SEQ ID NO: 531977 - DNA, 16 bp, R. norvegicus
tttaaacaaagcaaaa

SEQ ID NO: 531978 - DNA, 16 bp, R. norvegicus
tttaaacaaattgaaa

SEQ ID NO: 531979 - DNA, 16 bp, R. norvegicus
tttaaacaatgtcttt

SEQ ID NO: 531980 - DNA, 16 bp, R. norvegicus
tttaaacatttaaaga

SEQ ID NO: 531981 - DNA, 16 bp, R. norvegicus
tttaaactgtacagtg

SEQ ID NO: 531982 - DNA, 16 bp, R. norvegicus
tttaaacttatttttg

SEQ ID NO: 531983 - DNA, 16 bp, R. norvegicus
tttaaagaaaggaaag

SEQ ID NO: 531984 - DNA, 16 bp, R. norvegicus
tttaaagaaaggaaga

SEQ ID NO: 531985 - DNA, 16 bp, R. norvegicus
tttaaagaagacctaa

SEQ ID NO: 531986 - DNA, 16 bp, R. norvegicus
tttaaagaaggaaaga

SEQ ID NO: 531987 - DNA, 16 bp, R. norvegicus
tttaaagaaggaaatt

SEQ ID NO: 531988 - DNA, 16 bp, R. norvegicus
tttaaagaatgaattt

SEQ ID NO: 531989 - DNA, 16 bp, R. norvegicus
tttaaagacaggttct

SEQ ID NO: 531990 - DNA, 16 bp, R. norvegicus
tttaaagacataaaat

SEQ ID NO: 531991 - DNA, 16 bp, R. norvegicus
tttaaagagaaagtaa

SEQ ID NO: 531992 - DNA, 16 bp, R. norvegicus
tttaaagagagaaaag

SEQ ID NO: 531993 - DNA, 16 bp, R. norvegicus
tttaaagagattgaaa

SEQ ID NO: 531994 - DNA, 16 bp, R. norvegicus
tttaaagagttttaaa

SEQ ID NO: 531995 - DNA, 16 bp, R. norvegicus
tttaaagatgcatttt

SEQ ID NO: 531996 - DNA, 16 bp, R. norvegicus
tttaaagctttttaaa

SEQ ID NO: 531997 - DNA, 16 bp, R. norvegicus
tttaaaggaagaaact

SEQ ID NO: 531998 - DNA, 16 bp, R. norvegicus
tttaaaggaatatttt

SEQ ID NO: 531999 - DNA, 16 bp, R. norvegicus
tttaaaggaattattt

SEQ ID NO: 532000 - DNA, 16 bp, R. norvegicus
tttaaaggcaaatgga

SEQ ID NO: 532001 - DNA, 16 bp, R. norvegicus
tttaaataaaaatgca

SEQ ID NO: 532002 - DNA, 16 bp, R. norvegicus
tttaaatctaaatctt

SEQ ID NO: 532003 - DNA, 16 bp, R. norvegicus
tttaaatgaaaatctt

SEQ ID NO: 532004 - DNA, 16 bp, R. norvegicus
tttaaatgtgtttctt

SEQ ID NO: 532005 - DNA, 16 bp, R. norvegicus
tttaaattgcttatct

SEQ ID NO: 532006 - DNA, 16 bp, R. norvegicus
tttaaatttctctcca

SEQ ID NO: 532007 - DNA, 16 bp, R. norvegicus
tttaaatttggttttc

SEQ ID NO: 532008 - DNA, 16 bp, R. norvegicus
tttaaattttgagaca

SEQ ID NO: 532009 - DNA, 16 bp, R. norvegicus
tttaacaaaggagcca

SEQ ID NO: 532010 - DNA, 16 bp, R. norvegicus
tttaacaaatgtttat

SEQ ID NO: 532011 - DNA, 16 bp, R. norvegicus
tttaacactttctttg

SEQ ID NO: 532012 - DNA, 16 bp, R. norvegicus
tttaacagaaatctat

SEQ ID NO: 532013 - DNA, 16 bp, R. norvegicus
tttaacaggaaaaaaa

SEQ ID NO: 532014 - DNA, 16 bp, R. norvegicus
tttaacctctctttta

SEQ ID NO: 532015 - DNA, 16 bp, R. norvegicus
tttaactcagagatcc

SEQ ID NO: 532016 - DNA, 16 bp, R. norvegicus
tttaactcaggacctc

SEQ ID NO: 532017 - DNA, 16 bp, R. norvegicus
tttaacttctttggat

SEQ ID NO: 532018 - DNA, 16 bp, R. norvegicus
tttaacttgtaaaata

SEQ ID NO: 532019 - DNA, 16 bp, R. norvegicus
tttaacttgtttcaaa

SEQ ID NO: 532020 - DNA, 16 bp, R. norvegicus
tttaactttgatatct

SEQ ID NO: 532021 - DNA, 16 bp, R. norvegicus
tttaactttggtgcct

SEQ ID NO: 532022 - DNA, 16 bp, R. norvegicus
tttaagaaaacattta

SEQ ID NO: 532023 - DNA, 16 bp, R. norvegicus
tttaagaaacaaagaa

SEQ ID NO: 532024 - DNA, 16 bp, R. norvegicus
tttaagaagaaatttg

SEQ ID NO: 532025 - DNA, 16 bp, R. norvegicus
tttaagaagatttatt

SEQ ID NO: 532026 - DNA, 16 bp, R. norvegicus
tttaagaatcatgttc

SEQ ID NO: 532027 - DNA, 16 bp, R. norvegicus
tttaagaccctcttcc

SEQ ID NO: 532028 - DNA, 16 bp, R. norvegicus
tttaagagatttttgt

SEQ ID NO: 532029 - DNA, 16 bp, R. norvegicus
tttaagcagtgtgggg

SEQ ID NO: 532030 - DNA, 16 bp, R. norvegicus
tttaaggaaggagtga

SEQ ID NO: 532031 - DNA, 16 bp, R. norvegicus
tttaaggatttttgtg

SEQ ID NO: 532032 - DNA, 19 bp, R. norvegicus
tttaaggcaatgtctcttt

SEQ ID NO: 532033 - DNA, 16 bp, R. norvegicus
tttaaggcagggtctc

SEQ ID NO: 532034 - DNA, 16 bp, R. norvegicus
tttaaggcctgcctgg

SEQ ID NO: 532035 - DNA, 16 bp, R. norvegicus
tttaaggctttcaggt

SEQ ID NO: 532036 - DNA, 16 bp, R. norvegicus
tttaaggggaaaaaaa

SEQ ID NO: 532037 - DNA, 16 bp, R. norvegicus
tttaagggtgtgtgtg

SEQ ID NO: 532038 - DNA, 16 bp, R. norvegicus
tttaaggtcatcttct

SEQ ID NO: 532039 - DNA, 16 bp, R. norvegicus
tttaaggttagcctgg

SEQ ID NO: 532040 - DNA, 16 bp, R. norvegicus
tttaaggtttaaaaat

SEQ ID NO: 532041 - DNA, 16 bp, R. norvegicus
tttaagttcttattgt

SEQ ID NO: 532042 - DNA, 16 bp, R. norvegicus
tttaataaagcattaa

SEQ ID NO: 532043 - DNA, 16 bp, R. norvegicus
tttaataacaacaaca

SEQ ID NO: 532044 - DNA, 16 bp, R. norvegicus
tttaatagctgaggag

SEQ ID NO: 532045 - DNA, 16 bp, R. norvegicus
tttaatagtctctggt

SEQ ID NO: 532046 - DNA, 16 bp, R. norvegicus
tttaatagtctttctt

SEQ ID NO: 532047 - DNA, 16 bp, R. norvegicus
tttaatcatttaacca

SEQ ID NO: 532048 - DNA, 16 bp, R. norvegicus
tttaatccaagagcta

SEQ ID NO: 532049 - DNA, 16 bp, R. norvegicus
tttaatccagcagcat

SEQ ID NO: 532050 - DNA, 16 bp, R. norvegicus
tttaatcctagtactc

SEQ ID NO: 532051 - DNA, 16 bp, R. norvegicus
tttaatgaagatgaag

SEQ ID NO: 532052 - DNA, 16 bp, R. norvegicus
tttaatgaagatggag

SEQ ID NO: 532053 - DNA, 16 bp, R. norvegicus
tttaatgaattcattt

SEQ ID NO: 532054 - DNA, 16 bp, R. norvegicus
tttaatgactgctttt

SEQ ID NO: 532055 - DNA, 16 bp, R. norvegicus
tttaatgagagaagag

SEQ ID NO: 532056 - DNA, 16 bp, R. norvegicus
tttaatgaggaaaaag

SEQ ID NO: 532057 - DNA, 16 bp, R. norvegicus
tttaatgattcacctt

SEQ ID NO: 532058 - DNA, 16 bp, R. norvegicus
tttaatgcaaatgaag

SEQ ID NO: 532059 - DNA, 16 bp, R. norvegicus
tttaatggagttattt

SEQ ID NO: 532060 - DNA, 16 bp, R. norvegicus
tttaatgttcccttct

SEQ ID NO: 532061 - DNA, 16 bp, R. norvegicus
tttaattagcatttcc

SEQ ID NO: 532062 - DNA, 16 bp, R. norvegicus
tttaattatatttctg

SEQ ID NO: 532063 - DNA, 16 bp, R. norvegicus
tttaattcatttagca

SEQ ID NO: 532064 - DNA, 16 bp, R. norvegicus
tttaattctgtgtgtg

SEQ ID NO: 532065 - DNA, 16 bp, R. norvegicus
tttaattgttgagaat

SEQ ID NO: 532066 - DNA, 16 bp, R. norvegicus
tttaatttcctcaatt

SEQ ID NO: 532067 - DNA, 16 bp, R. norvegicus
tttaattttgaaagaa

SEQ ID NO: 532068 - DNA, 16 bp, R. norvegicus
tttaatttttctcagg

SEQ ID NO: 532069 - DNA, 16 bp, R. norvegicus
tttacaaaaagaaaat

SEQ ID NO: 532070 - DNA, 16 bp, R. norvegicus
tttacaaaagaaataa

SEQ ID NO: 532071 - DNA, 16 bp, R. norvegicus
tttacaaaggaagaaa

SEQ ID NO: 532072 - DNA, 16 bp, R. norvegicus
tttacaaaggacaaca

SEQ ID NO: 532073 - DNA, 16 bp, R. norvegicus
tttacaaatccagccc

SEQ ID NO: 532074 - DNA, 16 bp, R. norvegicus
tttacaaatgttttaa

SEQ ID NO: 532075 - DNA, 16 bp, R. norvegicus
tttacaaattcatctg

SEQ ID NO: 532076 - DNA, 16 bp, R. norvegicus
tttacaatagttacaa

SEQ ID NO: 532077 - DNA, 16 bp, R. norvegicus
tttacacaatatattt

SEQ ID NO: 532078 - DNA, 16 bp, R. norvegicus
tttacacaggccaagg

SEQ ID NO: 532079 - DNA, 16 bp, R. norvegicus
tttacacttcagatgt

SEQ ID NO: 532080 - DNA, 16 bp, R. norvegicus
tttacagatgaggaaa

SEQ ID NO: 532081 - DNA, 16 bp, R. norvegicus
tttacagatgggaaac

SEQ ID NO: 532082 - DNA, 16 bp, R. norvegicus
tttacagccacagcct

SEQ ID NO: 532083 - DNA, 16 bp, R. norvegicus
tttacaggagcagaaa

SEQ ID NO: 532084 - DNA, 16 bp, R. norvegicus
tttacagggaagagga

SEQ ID NO: 532085 - DNA, 16 bp, R. norvegicus
tttacagtttcagaag

SEQ ID NO: 532086 - DNA, 16 bp, R. norvegicus
tttacatagtgtatta

SEQ ID NO: 532087 - DNA, 16 bp, R. norvegicus
tttacatcctgatcac

SEQ ID NO: 532088 - DNA, 16 bp, R. norvegicus
tttacatctcactcac

SEQ ID NO: 532089 - DNA, 16 bp, R. norvegicus
tttacatgaaaaaaaa

SEQ ID NO: 532090 - DNA, 16 bp, R. norvegicus
tttacattaaaattca

SEQ ID NO: 532091 - DNA, 16 bp, R. norvegicus
tttacattacaaatat

SEQ ID NO: 532092 - DNA, 16 bp, R. norvegicus
tttacattccagtcat

SEQ ID NO: 532093 - DNA, 16 bp, R. norvegicus
tttacattgaagaagc

SEQ ID NO: 532094 - DNA, 16 bp, R. norvegicus
tttacattttaaaaag

SEQ ID NO: 532095 - DNA, 16 bp, R. norvegicus
tttacattttagatat

SEQ ID NO: 532096 - DNA, 16 bp, R. norvegicus
tttacattttcattgt

SEQ ID NO: 532097 - DNA, 16 bp, R. norvegicus
tttaccaaagctgcca

SEQ ID NO: 532098 - DNA, 16 bp, R. norvegicus
tttaccaactgagaca

SEQ ID NO: 532099 - DNA, 16 bp, R. norvegicus
tttaccaatcccacaa

SEQ ID NO: 532100 - DNA, 16 bp, R. norvegicus
tttaccagtttcctgt

SEQ ID NO: 532101 - DNA, 16 bp, R. norvegicus
tttacccactgatcca

SEQ ID NO: 532102 - DNA, 16 bp, R. norvegicus
tttacctaggcgggag

SEQ ID NO: 532103 - DNA, 16 bp, R. norvegicus
tttacctgcctctgcc

SEQ ID NO: 532104 - DNA, 16 bp, R. norvegicus
tttacctgctcagcca

SEQ ID NO: 532105 - DNA, 16 bp, R. norvegicus
tttacctgtgctctcc

SEQ ID NO: 532106 - DNA, 16 bp, R. norvegicus
tttacctttggtacct

SEQ ID NO: 532107 - DNA, 16 bp, R. norvegicus
tttactatgtagacca

SEQ ID NO: 532108 - DNA, 19 bp, R. norvegicus
tttactctacctgtcctga

SEQ ID NO: 532109 - DNA, 16 bp, R. norvegicus
tttactctgtattcat

SEQ ID NO: 532110 - DNA, 16 bp, R. norvegicus
tttactgaaaacaaaa

SEQ ID NO: 532111 - DNA, 16 bp, R. norvegicus
tttactgaaaatgaag

SEQ ID NO: 532112 - DNA, 22 bp, R. norvegicus
tttactgagatctccttatata

SEQ ID NO: 532113 - DNA, 16 bp, R. norvegicus
tttactgcttttaata

SEQ ID NO: 532114 - DNA, 16 bp, R. norvegicus
tttactggcccattaa

SEQ ID NO: 532115 - DNA, 16 bp, R. norvegicus
tttactgttcctttga

SEQ ID NO: 532116 - DNA, 16 bp, R. norvegicus
tttacttcctttgtta

SEQ ID NO: 532117 - DNA, 16 bp, R. norvegicus
tttacttgtattttcc

SEQ ID NO: 532118 - DNA, 16 bp, R. norvegicus
tttactttctctgcaa

SEQ ID NO: 532119 - DNA, 16 bp, R. norvegicus
tttactttgaagataa

SEQ ID NO: 532120 - DNA, 16 bp, R. norvegicus
tttacttttacatgaa

SEQ ID NO: 532121 - DNA, 16 bp, R. norvegicus
tttagaaaaacaacaa

SEQ ID NO: 532122 - DNA, 16 bp, R. norvegicus
tttagaaaaacatttt

SEQ ID NO: 532123 - DNA, 16 bp, R. norvegicus
tttagaaagaagagaa

SEQ ID NO: 532124 - DNA, 16 bp, R. norvegicus
tttagaattcagtctt

SEQ ID NO: 532125 - DNA, 16 bp, R. norvegicus
tttagacagtttatct

SEQ ID NO: 532126 - DNA, 16 bp, R. norvegicus
tttagaggtctggtgt

SEQ ID NO: 532127 - DNA, 16 bp, R. norvegicus
tttagatttcatttca

SEQ ID NO: 532128 - DNA, 16 bp, R. norvegicus
tttagcaaataaaaat

SEQ ID NO: 532129 - DNA, 16 bp, R. norvegicus
tttagcccaccaccca

SEQ ID NO: 532130 - DNA, 16 bp, R. norvegicus
tttagctcctctgtca

SEQ ID NO: 532131 - DNA, 16 bp, R. norvegicus
tttagctcctttgtta

SEQ ID NO: 532132 - DNA, 16 bp, R. norvegicus
tttagctctcccttcc

SEQ ID NO: 532133 - DNA, 16 bp, R. norvegicus
tttaggtgctgctcag

SEQ ID NO: 532134 - DNA, 16 bp, R. norvegicus
tttaggtgtttttcag

SEQ ID NO: 532135 - DNA, 16 bp, R. norvegicus
tttagtcatccttctt

SEQ ID NO: 532136 - DNA, 16 bp, R. norvegicus
tttagtccaagtggat

SEQ ID NO: 532137 - DNA, 16 bp, R. norvegicus
tttagtcctgagtctg

SEQ ID NO: 532138 - DNA, 16 bp, R. norvegicus
tttagttctgtaccct

SEQ ID NO: 532139 - DNA, 16 bp, R. norvegicus
tttagtttaatgttag

SEQ ID NO: 532140 - DNA, 16 bp, R. norvegicus
tttataaaacaaagaa

SEQ ID NO: 532141 - DNA, 16 bp, R. norvegicus
tttataaaacatttca

SEQ ID NO: 532142 - DNA, 16 bp, R. norvegicus
tttataaaataaccat

SEQ ID NO: 532143 - DNA, 16 bp, R. norvegicus
tttataaaatgcattt

SEQ ID NO: 532144 - DNA, 16 bp, R. norvegicus
tttataaagagaaaga

SEQ ID NO: 532145 - DNA, 16 bp, R. norvegicus
tttataaaggaaaaca

SEQ ID NO: 532146 - DNA, 16 bp, R. norvegicus
tttataaataaggctg

SEQ ID NO: 532147 - DNA, 16 bp, R. norvegicus
tttatacaaatgataa

SEQ ID NO: 532148 - DNA, 16 bp, R. norvegicus
tttatacaatgtaata

SEQ ID NO: 532149 - DNA, 16 bp, R. norvegicus
tttatagaagaaaaag

SEQ ID NO: 532150 - DNA, 16 bp, R. norvegicus
tttatagagacagaaa

SEQ ID NO: 532151 - DNA, 16 bp, R. norvegicus
tttatagagcaagttc

SEQ ID NO: 532152 - DNA, 16 bp, R. norvegicus
tttatagatgaggaaa

SEQ ID NO: 532153 - DNA, 16 bp, R. norvegicus
tttatagcaaccttat

SEQ ID NO: 532154 - DNA, 16 bp, R. norvegicus
tttatagtttctggcg

SEQ ID NO: 532155 - DNA, 16 bp, R. norvegicus
tttatatagtttggat

SEQ ID NO: 532156 - DNA, 16 bp, R. norvegicus
tttatatattggatca

SEQ ID NO: 532157 - DNA, 16 bp, R. norvegicus
tttatatcatcaaaac

SEQ ID NO: 532158 - DNA, 16 bp, R. norvegicus
tttatatctagtcact

SEQ ID NO: 532159 - DNA, 16 bp, R. norvegicus
tttatattatctgtgt

SEQ ID NO: 532160 - DNA, 16 bp, R. norvegicus
tttatattatctttga

SEQ ID NO: 532161 - DNA, 16 bp, R. norvegicus
tttatattcatatttg

SEQ ID NO: 532162 - DNA, 16 bp, R. norvegicus
tttatatttgagacag

SEQ ID NO: 532163 - DNA, 16 bp, R. norvegicus
tttatcaaaaagaaaa

SEQ ID NO: 532164 - DNA, 16 bp, R. norvegicus
tttatcaaatctaatc

SEQ ID NO: 532165 - DNA, 16 bp, R. norvegicus
tttatcaattagattt

SEQ ID NO: 532166 - DNA, 16 bp, R. norvegicus
tttatcacaacaacag

SEQ ID NO: 532167 - DNA, 16 bp, R. norvegicus
tttatcacagcaaaaa

SEQ ID NO: 532168 - DNA, 16 bp, R. norvegicus
tttatcacagccacag

SEQ ID NO: 532169 - DNA, 17 bp, R. norvegicus
tttatcaccctgtacaa

SEQ ID NO: 532170 - DNA, 16 bp, R. norvegicus
tttatccagtgcccat

SEQ ID NO: 532171 - DNA, 16 bp, R. norvegicus
tttatcccagagatgc

SEQ ID NO: 532172 - DNA, 16 bp, R. norvegicus
tttatccccagccact

SEQ ID NO: 532173 - DNA, 16 bp, R. norvegicus
tttatccccatatttc

SEQ ID NO: 532174 - DNA, 16 bp, R. norvegicus
tttatctatataaaac

SEQ ID NO: 532175 - DNA, 16 bp, R. norvegicus
tttatctcaggttagt

SEQ ID NO: 532176 - DNA, 16 bp, R. norvegicus
tttatctctgatgtta

SEQ ID NO: 532177 - DNA, 16 bp, R. norvegicus
tttatctggtaaagga

SEQ ID NO: 532178 - DNA, 16 bp, R. norvegicus
tttatctgtgtgtgtg

SEQ ID NO: 532179 - DNA, 33 bp, R. norvegicus
tttatgaaattcgtagacaaatggttggaactg

SEQ ID NO: 532180 - DNA, 111 bp, R. norvegicus
tttatgaaattcgtaggcaaatggttggaactggaaaatatcatcctgagtgagctaacccactcacagaaagacatacatggtatgcactcattgataagtggctattag

SEQ ID NO: 532181 - DNA, 16 bp, R. norvegicus
tttatgaatgtgagta

SEQ ID NO: 532182 - DNA, 16 bp, R. norvegicus
tttatgactattgtga

SEQ ID NO: 532183 - DNA, 16 bp, R. norvegicus
tttatgacttttaatt

SEQ ID NO: 532184 - DNA, 16 bp, R. norvegicus
tttatgagaaaagaat

SEQ ID NO: 532185 - DNA, 16 bp, R. norvegicus
tttatgaggaggtcct

SEQ ID NO: 532186 - DNA, 16 bp, R. norvegicus
tttatgcaaattaaaa

SEQ ID NO: 532187 - DNA, 18 bp, R. norvegicus
tttatgctctaagatcaa

SEQ ID NO: 532188 - DNA, 16 bp, R. norvegicus
tttatggtttggggtc

SEQ ID NO: 532189 - DNA, 17 bp, R. norvegicus
tttatgtacagcattct

SEQ ID NO: 532190 - DNA, 16 bp, R. norvegicus
tttatgtagtatgtat

SEQ ID NO: 532191 - DNA, 16 bp, R. norvegicus
tttatgtatctatata

SEQ ID NO: 532192 - DNA, 16 bp, R. norvegicus
tttatgtatgggaaac

SEQ ID NO: 532193 - DNA, 16 bp, R. norvegicus
tttatgtcaagttgat

SEQ ID NO: 532194 - DNA, 16 bp, R. norvegicus
tttatgtcatttttaa

SEQ ID NO: 532195 - DNA, 16 bp, R. norvegicus
tttatgtctgtgagta

SEQ ID NO: 532196 - DNA, 16 bp, R. norvegicus
tttatgtgtataagtg

SEQ ID NO: 532197 - DNA, 16 bp, R. norvegicus
tttatgttcatagcag

SEQ ID NO: 532198 - DNA, 16 bp, R. norvegicus
tttatgttctctctct

SEQ ID NO: 532199 - DNA, 16 bp, R. norvegicus
tttatgtttcatttaa

SEQ ID NO: 532200 - DNA, 19 bp, R. norvegicus
tttattaaattgggtattt

SEQ ID NO: 532201 - DNA, 17 bp, R. norvegicus
tttattaattggcagtg

SEQ ID NO: 532202 - DNA, 16 bp, R. norvegicus
tttattagatacattt

SEQ ID NO: 532203 - DNA, 16 bp, R. norvegicus
tttattcaagccacca

SEQ ID NO: 532204 - DNA, 16 bp, R. norvegicus
tttattcactcactca

SEQ ID NO: 532205 - DNA, 16 bp, R. norvegicus
tttattcattcatgca

SEQ ID NO: 532206 - DNA, 16 bp, R. norvegicus
tttattccagcaacag

SEQ ID NO: 532207 - DNA, 16 bp, R. norvegicus
tttattccatgtatgt

SEQ ID NO: 532208 - DNA, 16 bp, R. norvegicus
tttattcctctcctgg

SEQ ID NO: 532209 - DNA, 16 bp, R. norvegicus
tttattctgagacagg

SEQ ID NO: 532210 - DNA, 16 bp, R. norvegicus
tttattctgtagccca

SEQ ID NO: 532211 - DNA, 16 bp, R. norvegicus
tttattctgtctgtct

SEQ ID NO: 532212 - DNA, 16 bp, R. norvegicus
tttattgaaaatgaag

SEQ ID NO: 532213 - DNA, 16 bp, R. norvegicus
tttattgaaagaagat

SEQ ID NO: 532214 - DNA, 16 bp, R. norvegicus
tttattgactgagcca

SEQ ID NO: 532215 - DNA, 16 bp, R. norvegicus
tttattgatcaatcaa

SEQ ID NO: 532216 - DNA, 16 bp, R. norvegicus
tttattgatgtgaaga

SEQ ID NO: 532217 - DNA, 16 bp, R. norvegicus
tttattgattctctgt

SEQ ID NO: 532218 - DNA, 16 bp, R. norvegicus
tttattgctaaatgaa

SEQ ID NO: 532219 - DNA, 16 bp, R. norvegicus
tttattgctataaaga

SEQ ID NO: 532220 - DNA, 16 bp, R. norvegicus
tttattgctgagaaga

SEQ ID NO: 532221 - DNA, 16 bp, R. norvegicus
tttattgctgggaaga

SEQ ID NO: 532222 - DNA, 22 bp, R. norvegicus
tttattgggatgaacgttacag

SEQ ID NO: 532223 - DNA, 16 bp, R. norvegicus
tttattgtagataaaa

SEQ ID NO: 532224 - DNA, 16 bp, R. norvegicus
tttatttacaattcaa

SEQ ID NO: 532225 - DNA, 16 bp, R. norvegicus
tttatttacctaaaat

SEQ ID NO: 532226 - DNA, 20 bp, R. norvegicus
tttatttataatagccagaa

SEQ ID NO: 532227 - DNA, 16 bp, R. norvegicus
tttatttattccttga

SEQ ID NO: 532228 - DNA, 16 bp, R. norvegicus
tttatttcaaaaacaa

SEQ ID NO: 532229 - DNA, 16 bp, R. norvegicus
tttatttcctgctgtc

SEQ ID NO: 532230 - DNA, 16 bp, R. norvegicus
tttatttctgtgaaca

SEQ ID NO: 532231 - DNA, 16 bp, R. norvegicus
tttatttcttcaatgt

SEQ ID NO: 532232 - DNA, 16 bp, R. norvegicus
tttatttcttctgtga

SEQ ID NO: 532233 - DNA, 16 bp, R. norvegicus
tttatttgcatgtatg

SEQ ID NO: 532234 - DNA, 16 bp, R. norvegicus
tttatttgctcatttg

SEQ ID NO: 532235 - DNA, 16 bp, R. norvegicus
tttatttggaaaataa

SEQ ID NO: 532236 - DNA, 16 bp, R. norvegicus
tttatttggaatatga

SEQ ID NO: 532237 - DNA, 16 bp, R. norvegicus
tttatttggctcacag

SEQ ID NO: 532238 - DNA, 16 bp, R. norvegicus
tttatttgtaataaca

SEQ ID NO: 532239 - DNA, 16 bp, R. norvegicus
tttatttgtatttcaa

SEQ ID NO: 532240 - DNA, 16 bp, R. norvegicus
tttatttgtgaaataa

SEQ ID NO: 532241 - DNA, 16 bp, R. norvegicus
tttattttaaaagtca

SEQ ID NO: 532242 - DNA, 16 bp, R. norvegicus
tttattttagaaaaga

SEQ ID NO: 532243 - DNA, 16 bp, R. norvegicus
tttattttcctcagtt

SEQ ID NO: 532244 - DNA, 16 bp, R. norvegicus
tttattttctaatgaa

SEQ ID NO: 532245 - DNA, 16 bp, R. norvegicus
tttattttctccagtt

SEQ ID NO: 532246 - DNA, 16 bp, R. norvegicus
tttattttgaaaacat

SEQ ID NO: 532247 - DNA, 16 bp, R. norvegicus
tttattttgaaacatt

SEQ ID NO: 532248 - DNA, 16 bp, R. norvegicus
tttattttggctcata

SEQ ID NO: 532249 - DNA, 16 bp, R. norvegicus
tttatttttcaagaaa

SEQ ID NO: 532250 - DNA, 16 bp, R. norvegicus
tttatttttcagaaat

SEQ ID NO: 532251 - DNA, 16 bp, R. norvegicus
tttatttttccttgac

SEQ ID NO: 532252 - DNA, 16 bp, R. norvegicus
tttatttttgagacag

SEQ ID NO: 532253 - DNA, 16 bp, R. norvegicus
tttcaaaaaagaaaat

SEQ ID NO: 532254 - DNA, 16 bp, R. norvegicus
tttcaaaaaaggaaaa

SEQ ID NO: 532255 - DNA, 16 bp, R. norvegicus
tttcaaaaagcaaaac

SEQ ID NO: 532256 - DNA, 17 bp, R. norvegicus
tttcaaaaaggaacaaa

SEQ ID NO: 532257 - DNA, 16 bp, R. norvegicus
tttcaaaaataaagaa

SEQ ID NO: 532258 - DNA, 16 bp, R. norvegicus
tttcaaaaatagtttt

SEQ ID NO: 532259 - DNA, 16 bp, R. norvegicus
tttcaaaaatcaagtg

SEQ ID NO: 532260 - DNA, 16 bp, R. norvegicus
tttcaaaaatgatttt

SEQ ID NO: 532261 - DNA, 16 bp, R. norvegicus
tttcaaaacttacttt

SEQ ID NO: 532262 - DNA, 16 bp, R. norvegicus
tttcaaaagaaaaaga

SEQ ID NO: 532263 - DNA, 16 bp, R. norvegicus
tttcaaaagaaaaata

SEQ ID NO: 532264 - DNA, 16 bp, R. norvegicus
tttcaaaagaaaatga

SEQ ID NO: 532265 - DNA, 16 bp, R. norvegicus
tttcaaaaggaaaaga

SEQ ID NO: 532266 - DNA, 16 bp, R. norvegicus
tttcaaaagttatctc

SEQ ID NO: 532267 - DNA, 16 bp, R. norvegicus
tttcaaaagttatttt

SEQ ID NO: 532268 - DNA, 16 bp, R. norvegicus
tttcaaaataaaatgt

SEQ ID NO: 532269 - DNA, 16 bp, R. norvegicus
tttcaaaatacagaaa

SEQ ID NO: 532270 - DNA, 16 bp, R. norvegicus
tttcaaaatgaagaaa

SEQ ID NO: 532271 - DNA, 16 bp, R. norvegicus
tttcaaaatgatattt

SEQ ID NO: 532272 - DNA, 16 bp, R. norvegicus
tttcaaaatgtaaaaa

SEQ ID NO: 532273 - DNA, 16 bp, R. norvegicus
tttcaaaattcaaaat

SEQ ID NO: 532274 - DNA, 16 bp, R. norvegicus
tttcaaagaaaccaaa

SEQ ID NO: 532275 - DNA, 16 bp, R. norvegicus
tttcaaagaaaggaaa

SEQ ID NO: 532276 - DNA, 16 bp, R. norvegicus
tttcaaagaaatgaaa

SEQ ID NO: 532277 - DNA, 16 bp, R. norvegicus
tttcaaagataatgta

SEQ ID NO: 532278 - DNA, 16 bp, R. norvegicus
tttcaaagtctctgtt

SEQ ID NO: 532279 - DNA, 16 bp, R. norvegicus
tttcaaagttttcttt

SEQ ID NO: 532280 - DNA, 16 bp, R. norvegicus
tttcaaatatacattt

SEQ ID NO: 532281 - DNA, 16 bp, R. norvegicus
tttcaaatgtacatct

SEQ ID NO: 532282 - DNA, 16 bp, R. norvegicus
tttcaaatgtataaat

SEQ ID NO: 532283 - DNA, 16 bp, R. norvegicus
tttcaaatgtcatttt

SEQ ID NO: 532284 - DNA, 16 bp, R. norvegicus
tttcaaattgctcttt

SEQ ID NO: 532285 - DNA, 16 bp, R. norvegicus
tttcaacagaggaatg

SEQ ID NO: 532286 - DNA, 16 bp, R. norvegicus
tttcaacatatagcaa

SEQ ID NO: 532287 - DNA, 16 bp, R. norvegicus
tttcaacccaaaatgt

SEQ ID NO: 532288 - DNA, 16 bp, R. norvegicus
tttcaacctgtgggtc

SEQ ID NO: 532289 - DNA, 16 bp, R. norvegicus
tttcaagaaaacaaaa

SEQ ID NO: 532290 - DNA, 16 bp, R. norvegicus
tttcaagaaaatgaat

SEQ ID NO: 532291 - DNA, 16 bp, R. norvegicus
tttcaagacagagttt

SEQ ID NO: 532292 - DNA, 16 bp, R. norvegicus
tttcaagacagccaag

SEQ ID NO: 532293 - DNA, 16 bp, R. norvegicus
tttcaagcaaaagtta

SEQ ID NO: 532294 - DNA, 16 bp, R. norvegicus
tttcaagccagccagg

SEQ ID NO: 532295 - DNA, 16 bp, R. norvegicus
tttcaagtattttgtt

SEQ ID NO: 532296 - DNA, 16 bp, R. norvegicus
tttcaagtccaagtgg

SEQ ID NO: 532297 - DNA, 16 bp, R. norvegicus
tttcaagttcatggcc

SEQ ID NO: 532298 - DNA, 16 bp, R. norvegicus
tttcaatggtttcctt

SEQ ID NO: 532299 - DNA, 16 bp, R. norvegicus
tttcaattaaaagtaa

SEQ ID NO: 532300 - DNA, 16 bp, R. norvegicus
tttcaattgttattca

SEQ ID NO: 532301 - DNA, 16 bp, R. norvegicus
tttcacacacacaaaa

SEQ ID NO: 532302 - DNA, 16 bp, R. norvegicus
tttcacatcatgcacc

SEQ ID NO: 532303 - DNA, 16 bp, R. norvegicus
tttcacatgtatattt

SEQ ID NO: 532304 - DNA, 16 bp, R. norvegicus
tttcacatttgtgtgt

SEQ ID NO: 532305 - DNA, 16 bp, R. norvegicus
tttcaccactgagcca

SEQ ID NO: 532306 - DNA, 16 bp, R. norvegicus
tttcaccagctttctg

SEQ ID NO: 532307 - DNA, 16 bp, R. norvegicus
tttcacctgtgcccat

SEQ ID NO: 532308 - DNA, 16 bp, R. norvegicus
tttcacgtgttctgtg

SEQ ID NO: 532309 - DNA, 16 bp, R. norvegicus
tttcactaccaggtgc

SEQ ID NO: 532310 - DNA, 16 bp, R. norvegicus
tttcacttgcttagtt

SEQ ID NO: 532311 - DNA, 17 bp, R. norvegicus
tttcacttgcttggtta

SEQ ID NO: 532312 - DNA, 16 bp, R. norvegicus
tttcagaaaaagaaaa

SEQ ID NO: 532313 - DNA, 16 bp, R. norvegicus
tttcagaaaacatttt

SEQ ID NO: 532314 - DNA, 16 bp, R. norvegicus
tttcagaaaagaaaaa

SEQ ID NO: 532315 - DNA, 16 bp, R. norvegicus
tttcagaaaagcaaaa

SEQ ID NO: 532316 - DNA, 16 bp, R. norvegicus
tttcagaaaatgtttt

SEQ ID NO: 532317 - DNA, 16 bp, R. norvegicus
tttcagaaaggaagaa

SEQ ID NO: 532318 - DNA, 27 bp, R. norvegicus
tttcagaacagaagagcgcggcaagcc

SEQ ID NO: 532319 - DNA, 16 bp, R. norvegicus
tttcagaagacccagg

SEQ ID NO: 532320 - DNA, 16 bp, R. norvegicus
tttcagaagatgaaaa

SEQ ID NO: 532321 - DNA, 16 bp, R. norvegicus
tttcagaagcccaagc

SEQ ID NO: 532322 - DNA, 16 bp, R. norvegicus
tttcagaagtgtggac

SEQ ID NO: 532323 - DNA, 16 bp, R. norvegicus
tttcagaattttttct

SEQ ID NO: 532324 - DNA, 16 bp, R. norvegicus
tttcagacaccagaag

SEQ ID NO: 532325 - DNA, 16 bp, R. norvegicus
tttcagacagggtctt

SEQ ID NO: 532326 - DNA, 16 bp, R. norvegicus
tttcagacagtgtctc

SEQ ID NO: 532327 - DNA, 16 bp, R. norvegicus
tttcagactttcccca

SEQ ID NO: 532328 - DNA, 16 bp, R. norvegicus
tttcagagaggaagaa

SEQ ID NO: 532329 - DNA, 16 bp, R. norvegicus
tttcagagattcagtc

SEQ ID NO: 532330 - DNA, 16 bp, R. norvegicus
tttcagaggactgggg

SEQ ID NO: 532331 - DNA, 16 bp, R. norvegicus
tttcagatgaaaatgt

SEQ ID NO: 532332 - DNA, 16 bp, R. norvegicus
tttcagcaaaggcatc

SEQ ID NO: 532333 - DNA, 16 bp, R. norvegicus
tttcagcaagcagaca

SEQ ID NO: 532334 - DNA, 16 bp, R. norvegicus
tttcagcagaggaatg

SEQ ID NO: 532335 - DNA, 39 bp, R. norvegicus
tttcagcaggggtcaatcagccagtcgcagaggtctttc

SEQ ID NO: 532336 - DNA, 16 bp, R. norvegicus
tttcagccatgatttt

SEQ ID NO: 532337 - DNA, 16 bp, R. norvegicus
tttcagctctctgtgt

SEQ ID NO: 532338 - DNA, 16 bp, R. norvegicus
tttcagctgtccctgt

SEQ ID NO: 532339 - DNA, 16 bp, R. norvegicus
tttcaggaaaaagaaa

SEQ ID NO: 532340 - DNA, 16 bp, R. norvegicus
tttcaggaaataaaaa

SEQ ID NO: 532341 - DNA, 16 bp, R. norvegicus
tttcaggacagccaga

SEQ ID NO: 532342 - DNA, 16 bp, R. norvegicus
tttcaggccatcctgg

SEQ ID NO: 532343 - DNA, 16 bp, R. norvegicus
tttcaggctcctgtca

SEQ ID NO: 532344 - DNA, 16 bp, R. norvegicus
tttcagggacttcctg

SEQ ID NO: 532345 - DNA, 16 bp, R. norvegicus
tttcagggattttttt

SEQ ID NO: 532346 - DNA, 16 bp, R. norvegicus
tttcagggttttttgt

SEQ ID NO: 532347 - DNA, 16 bp, R. norvegicus
tttcagtatttaaaaa

SEQ ID NO: 532348 - DNA, 16 bp, R. norvegicus
tttcagtccatggtca

SEQ ID NO: 532349 - DNA, 16 bp, R. norvegicus
tttcagtcctttctga

SEQ ID NO: 532350 - DNA, 16 bp, R. norvegicus
tttcagttaaaaaaaa

SEQ ID NO: 532351 - DNA, 16 bp, R. norvegicus
tttcagttctgtgttt

SEQ ID NO: 532352 - DNA, 16 bp, R. norvegicus
tttcataaaacagaga

SEQ ID NO: 532353 - DNA, 16 bp, R. norvegicus
tttcataaatgttata

SEQ ID NO: 532354 - DNA, 16 bp, R. norvegicus
tttcatacatgcacat

SEQ ID NO: 532355 - DNA, 16 bp, R. norvegicus
tttcatcaccaaagga

SEQ ID NO: 532356 - DNA, 16 bp, R. norvegicus
tttcatcagattctgt

SEQ ID NO: 532357 - DNA, 16 bp, R. norvegicus
tttcatcctcaaacaa

SEQ ID NO: 532358 - DNA, 43 bp, R. norvegicus
tttcatcctttaaacaattcttaaccagcttccatatagcttt

SEQ ID NO: 532359 - DNA, 16 bp, R. norvegicus
tttcatcttaaaataa

SEQ ID NO: 532360 - DNA, 16 bp, R. norvegicus
tttcatcttggtggat

SEQ ID NO: 532361 - DNA, 16 bp, R. norvegicus
tttcatctttgttgat

SEQ ID NO: 532362 - DNA, 16 bp, R. norvegicus
tttcatgaagtcacta

SEQ ID NO: 532363 - DNA, 16 bp, R. norvegicus
tttcatgatgtctttg

SEQ ID NO: 532364 - DNA, 16 bp, R. norvegicus
tttcatgcagattttc

SEQ ID NO: 532365 - DNA, 16 bp, R. norvegicus
tttcatggtctctgtt

SEQ ID NO: 532366 - DNA, 16 bp, R. norvegicus
tttcatgtggtcattg

SEQ ID NO: 532367 - DNA, 16 bp, R. norvegicus
tttcatgtgttatgtg

SEQ ID NO: 532368 - DNA, 16 bp, R. norvegicus
tttcattaaaaaagaa

SEQ ID NO: 532369 - DNA, 16 bp, R. norvegicus
tttcattcagttattt

SEQ ID NO: 532370 - DNA, 16 bp, R. norvegicus
tttcattcctgatttt

SEQ ID NO: 532371 - DNA, 16 bp, R. norvegicus
tttcattgcatcccat

SEQ ID NO: 532372 - DNA, 16 bp, R. norvegicus
tttcattgctgtgaag

SEQ ID NO: 532373 - DNA, 16 bp, R. norvegicus
tttcattgttaaaaat

SEQ ID NO: 532374 - DNA, 16 bp, R. norvegicus
tttcattgttagagat

SEQ ID NO: 532375 - DNA, 16 bp, R. norvegicus
tttcatttaattctag

SEQ ID NO: 532376 - DNA, 16 bp, R. norvegicus
tttcatttagtgagct

SEQ ID NO: 532377 - DNA, 16 bp, R. norvegicus
tttcatttcagatttt

SEQ ID NO: 532378 - DNA, 16 bp, R. norvegicus
tttcatttccattttg

SEQ ID NO: 532379 - DNA, 16 bp, R. norvegicus
tttcatttctacttca

SEQ ID NO: 532380 - DNA, 16 bp, R. norvegicus
tttcatttgcatttcc

SEQ ID NO: 532381 - DNA, 16 bp, R. norvegicus
tttcatttgttctaag

SEQ ID NO: 532382 - DNA, 16 bp, R. norvegicus
tttcattttaaatgtt

SEQ ID NO: 532383 - DNA, 16 bp, R. norvegicus
tttcattttgggggct

SEQ ID NO: 532384 - DNA, 16 bp, R. norvegicus
tttcattttgtctcat

SEQ ID NO: 532385 - DNA, 16 bp, R. norvegicus
tttcattttgtttgag

SEQ ID NO: 532386 - DNA, 16 bp, R. norvegicus
tttcatttttagaaaa

SEQ ID NO: 532387 - DNA, 16 bp, R. norvegicus
tttccaaaactgacca

SEQ ID NO: 532388 - DNA, 16 bp, R. norvegicus
tttccaaaagaaaata

SEQ ID NO: 532389 - DNA, 16 bp, R. norvegicus
tttccaaaattgtggc

SEQ ID NO: 532390 - DNA, 16 bp, R. norvegicus
tttccaaacagttcca

SEQ ID NO: 532391 - DNA, 16 bp, R. norvegicus
tttccaaagaaaacat

SEQ ID NO: 532392 - DNA, 16 bp, R. norvegicus
tttccaaagaagaaaa

SEQ ID NO: 532393 - DNA, 16 bp, R. norvegicus
tttccaaagaatttag

SEQ ID NO: 532394 - DNA, 16 bp, R. norvegicus
tttccaaaggcatttt

SEQ ID NO: 532395 - DNA, 16 bp, R. norvegicus
tttccaaagtggtttt

SEQ ID NO: 532396 - DNA, 16 bp, R. norvegicus
tttccaagaagggaga

SEQ ID NO: 532397 - DNA, 16 bp, R. norvegicus
tttccaatgtggaaag

SEQ ID NO: 532398 - DNA, 16 bp, R. norvegicus
tttccacagcttttgc

SEQ ID NO: 532399 - DNA, 16 bp, R. norvegicus
tttccaccatgacaat

SEQ ID NO: 532400 - DNA, 16 bp, R. norvegicus
tttccactgctgtgat

SEQ ID NO: 532401 - DNA, 16 bp, R. norvegicus
tttccactggaactgg

SEQ ID NO: 532402 - DNA, 16 bp, R. norvegicus
tttccacttagcactg

SEQ ID NO: 532403 - DNA, 16 bp, R. norvegicus
tttccagaatgctttt

SEQ ID NO: 532404 - DNA, 21 bp, R. norvegicus
tttccagaggtcctgagttca

SEQ ID NO: 532405 - DNA, 16 bp, R. norvegicus
tttccagagtggaaac

SEQ ID NO: 532406 - DNA, 16 bp, R. norvegicus
tttccagataaatttg

SEQ ID NO: 532407 - DNA, 16 bp, R. norvegicus
tttccagcacctacat

SEQ ID NO: 532408 - DNA, 16 bp, R. norvegicus
tttccagcatccacac

SEQ ID NO: 532409 - DNA, 16 bp, R. norvegicus
tttccagcctttccct

SEQ ID NO: 532410 - DNA, 16 bp, R. norvegicus
tttccaggagaataaa

SEQ ID NO: 532411 - DNA, 16 bp, R. norvegicus
tttccaggagcccctg

SEQ ID NO: 532412 - DNA, 16 bp, R. norvegicus
tttccaggatgatgtt

SEQ ID NO: 532413 - DNA, 16 bp, R. norvegicus
tttccaggcaacaatc

SEQ ID NO: 532414 - DNA, 16 bp, R. norvegicus
tttccaggccaccatc

SEQ ID NO: 532415 - DNA, 16 bp, R. norvegicus
tttccagtaccaggaa

SEQ ID NO: 532416 - DNA, 16 bp, R. norvegicus
tttccagtgtgttggg

SEQ ID NO: 532417 - DNA, 16 bp, R. norvegicus
tttccataaaagaaaa

SEQ ID NO: 532418 - DNA, 16 bp, R. norvegicus
tttccatctgttcttt

SEQ ID NO: 532419 - DNA, 16 bp, R. norvegicus
tttccatcttcagagg

SEQ ID NO: 532420 - DNA, 16 bp, R. norvegicus
tttccatctttaaatc

SEQ ID NO: 532421 - DNA, 16 bp, R. norvegicus
tttccatgggtgctgg

SEQ ID NO: 532422 - DNA, 16 bp, R. norvegicus
tttccatggtcatggt

SEQ ID NO: 532423 - DNA, 16 bp, R. norvegicus
tttccattcactctcc

SEQ ID NO: 532424 - DNA, 16 bp, R. norvegicus
tttccattgctgtgaa

SEQ ID NO: 532425 - DNA, 16 bp, R. norvegicus
tttcccaatctattgt

SEQ ID NO: 532426 - DNA, 16 bp, R. norvegicus
tttcccagaggtcctg

SEQ ID NO: 532427 - DNA, 16 bp, R. norvegicus
tttcccagagttccta

SEQ ID NO: 532428 - DNA, 16 bp, R. norvegicus
tttcccagattccagg

SEQ ID NO: 532429 - DNA, 16 bp, R. norvegicus
tttcccagcatccctc

SEQ ID NO: 532430 - DNA, 16 bp, R. norvegicus
tttcccagcatccctt

SEQ ID NO: 532431 - DNA, 16 bp, R. norvegicus
tttcccagcattcctt

SEQ ID NO: 532432 - DNA, 17 bp, R. norvegicus
tttcccatacttcattt

SEQ ID NO: 532433 - DNA, 16 bp, R. norvegicus
tttccccaacagcagt

SEQ ID NO: 532434 - DNA, 16 bp, R. norvegicus
tttccccaacctaaag

SEQ ID NO: 532435 - DNA, 16 bp, R. norvegicus
tttccccagtgcacat

SEQ ID NO: 532436 - DNA, 16 bp, R. norvegicus
tttccccagtgtccat

SEQ ID NO: 532437 - DNA, 16 bp, R. norvegicus
tttcccccagagctgg

SEQ ID NO: 532438 - DNA, 16 bp, R. norvegicus
tttccccctttaagaa

SEQ ID NO: 532439 - DNA, 16 bp, R. norvegicus
tttcccctctggaaac

SEQ ID NO: 532440 - DNA, 16 bp, R. norvegicus
tttcccctgtgctgat

SEQ ID NO: 532441 - DNA, 16 bp, R. norvegicus
tttccccttctgagta

SEQ ID NO: 532442 - DNA, 16 bp, R. norvegicus
tttccctaactcctcc

SEQ ID NO: 532443 - DNA, 17 bp, R. norvegicus
tttccctatgactaaag

SEQ ID NO: 532444 - DNA, 16 bp, R. norvegicus
tttccctcagtttggg

SEQ ID NO: 532445 - DNA, 16 bp, R. norvegicus
tttccctgtctctctg

SEQ ID NO: 532446 - DNA, 16 bp, R. norvegicus
tttcccttcagaaaag

SEQ ID NO: 532447 - DNA, 16 bp, R. norvegicus
tttccctttgagtttg

SEQ ID NO: 532448 - DNA, 16 bp, R. norvegicus
tttcctaatcccttcc

SEQ ID NO: 532449 - DNA, 16 bp, R. norvegicus
tttcctaccatctact

SEQ ID NO: 532450 - DNA, 16 bp, R. norvegicus
tttcctatactcaaac

SEQ ID NO: 532451 - DNA, 16 bp, R. norvegicus
tttcctatgtttctct

SEQ ID NO: 532452 - DNA, 16 bp, R. norvegicus
tttcctattaaccttt

SEQ ID NO: 532453 - DNA, 16 bp, R. norvegicus
tttcctatttaaaaat

SEQ ID NO: 532454 - DNA, 16 bp, R. norvegicus
tttcctcaccaacttg

SEQ ID NO: 532455 - DNA, 16 bp, R. norvegicus
tttcctcagatcctgt

SEQ ID NO: 532456 - DNA, 16 bp, R. norvegicus
tttcctcagattctat

SEQ ID NO: 532457 - DNA, 16 bp, R. norvegicus
tttcctcagtgatgga

SEQ ID NO: 532458 - DNA, 16 bp, R. norvegicus
tttcctcagtgttttg

SEQ ID NO: 532459 - DNA, 16 bp, R. norvegicus
tttcctcatctgcaaa

SEQ ID NO: 532460 - DNA, 16 bp, R. norvegicus
tttcctccagatttcc

SEQ ID NO: 532461 - DNA, 18 bp, R. norvegicus
tttcctccccagcttgct

SEQ ID NO: 532462 - DNA, 21 bp, R. norvegicus
tttcctccctaagaggtttat

SEQ ID NO: 532463 - DNA, 16 bp, R. norvegicus
tttcctccctccagct

SEQ ID NO: 532464 - DNA, 26 bp, R. norvegicus
tttcctcccttagaggtttatgcatt

SEQ ID NO: 532465 - DNA, 16 bp, R. norvegicus
tttcctcctcaacttg

SEQ ID NO: 532466 - DNA, 16 bp, R. norvegicus
tttcctcctggctgcc

SEQ ID NO: 532467 - DNA, 16 bp, R. norvegicus
tttcctccttcctgtg

SEQ ID NO: 532468 - DNA, 16 bp, R. norvegicus
tttcctctctggaaat

SEQ ID NO: 532469 - DNA, 16 bp, R. norvegicus
tttcctctgagaaggg

SEQ ID NO: 532470 - DNA, 16 bp, R. norvegicus
tttcctctggagtcag

SEQ ID NO: 532471 - DNA, 16 bp, R. norvegicus
tttcctcttagctctg

SEQ ID NO: 532472 - DNA, 16 bp, R. norvegicus
tttcctcttaggactg

SEQ ID NO: 532473 - DNA, 16 bp, R. norvegicus
tttcctcttcaacttg

SEQ ID NO: 532474 - DNA, 16 bp, R. norvegicus
tttcctgaaaagaaaa

SEQ ID NO: 532475 - DNA, 16 bp, R. norvegicus
tttcctgaaattttca

SEQ ID NO: 532476 - DNA, 16 bp, R. norvegicus
tttcctgagcagaata

SEQ ID NO: 532477 - DNA, 16 bp, R. norvegicus
tttcctgaggacccag

SEQ ID NO: 532478 - DNA, 16 bp, R. norvegicus
tttcctgcaaatgtca

SEQ ID NO: 532479 - DNA, 16 bp, R. norvegicus
tttcctgctgcctgca

SEQ ID NO: 532480 - DNA, 16 bp, R. norvegicus
tttcctgctgtccact

SEQ ID NO: 532481 - DNA, 16 bp, R. norvegicus
tttcctggaacagcca

SEQ ID NO: 532482 - DNA, 30 bp, R. norvegicus
tttcctggaattctttcagggatttttgtg

SEQ ID NO: 532483 - DNA, 16 bp, R. norvegicus
tttcctggatactctg

SEQ ID NO: 532484 - DNA, 16 bp, R. norvegicus
tttcctggatttcctg

SEQ ID NO: 532485 - DNA, 16 bp, R. norvegicus
tttcctggccataagc

SEQ ID NO: 532486 - DNA, 16 bp, R. norvegicus
tttcctggcctgctga

SEQ ID NO: 532487 - DNA, 16 bp, R. norvegicus
tttcctgggactggag

SEQ ID NO: 532488 - DNA, 16 bp, R. norvegicus
tttcctgggattcttt

SEQ ID NO: 532489 - DNA, 16 bp, R. norvegicus
tttcctgggttttcca

SEQ ID NO: 532490 - DNA, 16 bp, R. norvegicus
tttcctgtcattcttt

SEQ ID NO: 532491 - DNA, 16 bp, R. norvegicus
tttcctgtctctgcct

SEQ ID NO: 532492 - DNA, 16 bp, R. norvegicus
tttcctgtcttgattt

SEQ ID NO: 532493 - DNA, 16 bp, R. norvegicus
tttcctgtgattctgt

SEQ ID NO: 532494 - DNA, 16 bp, R. norvegicus
tttcctgtgtcttcca

SEQ ID NO: 532495 - DNA, 16 bp, R. norvegicus
tttcctgttattcttg

SEQ ID NO: 532496 - DNA, 16 bp, R. norvegicus
tttccttaaaacaaaa

SEQ ID NO: 532497 - DNA, 16 bp, R. norvegicus
tttccttagaaatgtg

SEQ ID NO: 532498 - DNA, 16 bp, R. norvegicus
tttccttccatctctg

SEQ ID NO: 532499 - DNA, 16 bp, R. norvegicus
tttccttccattgtcc

SEQ ID NO: 532500 - DNA, 16 bp, R. norvegicus
tttccttcccaagtgg

SEQ ID NO: 532501 - DNA, 16 bp, R. norvegicus
tttccttctcagcttg

SEQ ID NO: 532502 - DNA, 16 bp, R. norvegicus
tttccttcttccagaa

SEQ ID NO: 532503 - DNA, 16 bp, R. norvegicus
tttccttgattctttg

SEQ ID NO: 532504 - DNA, 16 bp, R. norvegicus
tttccttgctgtccag

SEQ ID NO: 532505 - DNA, 16 bp, R. norvegicus
tttcctttagagagga

SEQ ID NO: 532506 - DNA, 16 bp, R. norvegicus
tttcctttcagccagt

SEQ ID NO: 532507 - DNA, 16 bp, R. norvegicus
tttcctttccagaaac

SEQ ID NO: 532508 - DNA, 16 bp, R. norvegicus
tttcctttctgtggct

SEQ ID NO: 532509 - DNA, 16 bp, R. norvegicus
tttcctttgagtttgt

SEQ ID NO: 532510 - DNA, 16 bp, R. norvegicus
tttcctttgatgaaca

SEQ ID NO: 532511 - DNA, 16 bp, R. norvegicus
tttcctttgctgtgat

SEQ ID NO: 532512 - DNA, 16 bp, R. norvegicus
tttccttttgagatag

SEQ ID NO: 532513 - DNA, 16 bp, R. norvegicus
tttcctttttaaaatc

SEQ ID NO: 532514 - DNA, 16 bp, R. norvegicus
tttcctttttgaaatt

SEQ ID NO: 532515 - DNA, 16 bp, R. norvegicus
tttcgtgcagcagaaa

SEQ ID NO: 532516 - DNA, 16 bp, R. norvegicus
tttctaaaaagaaaaa

SEQ ID NO: 532517 - DNA, 16 bp, R. norvegicus
tttctaaaagaaaaat

SEQ ID NO: 532518 - DNA, 16 bp, R. norvegicus
tttctaaaagttaaaa

SEQ ID NO: 532519 - DNA, 16 bp, R. norvegicus
tttctaaacatagtaa

SEQ ID NO: 532520 - DNA, 16 bp, R. norvegicus
tttctaaatgaaaata

SEQ ID NO: 532521 - DNA, 16 bp, R. norvegicus
tttctaacagtggcta

SEQ ID NO: 532522 - DNA, 16 bp, R. norvegicus
tttctaacccaaaaca

SEQ ID NO: 532523 - DNA, 16 bp, R. norvegicus
tttctaacttctccat

SEQ ID NO: 532524 - DNA, 16 bp, R. norvegicus
tttctaagaaagactg

SEQ ID NO: 532525 - DNA, 16 bp, R. norvegicus
tttctaagatattttt

SEQ ID NO: 532526 - DNA, 16 bp, R. norvegicus
tttctaatgagacaga

SEQ ID NO: 532527 - DNA, 16 bp, R. norvegicus
tttctacctatgaggt

SEQ ID NO: 532528 - DNA, 16 bp, R. norvegicus
tttctacctcagcctc

SEQ ID NO: 532529 - DNA, 16 bp, R. norvegicus
tttctactggccctca

SEQ ID NO: 532530 - DNA, 16 bp, R. norvegicus
tttctagaaaaaaatt

SEQ ID NO: 532531 - DNA, 16 bp, R. norvegicus
tttctagaactttcta

SEQ ID NO: 532532 - DNA, 16 bp, R. norvegicus
tttctagaatgttctt

SEQ ID NO: 532533 - DNA, 18 bp, R. norvegicus
tttctagatccatccatt

SEQ ID NO: 532534 - DNA, 16 bp, R. norvegicus
tttctagcacccatgt

SEQ ID NO: 532535 - DNA, 16 bp, R. norvegicus
tttctagctctttcta

SEQ ID NO: 532536 - DNA, 16 bp, R. norvegicus
tttctagtaactgact

SEQ ID NO: 532537 - DNA, 16 bp, R. norvegicus
tttctagttcttcctg

SEQ ID NO: 532538 - DNA, 16 bp, R. norvegicus
tttctatatcaagggt

SEQ ID NO: 532539 - DNA, 16 bp, R. norvegicus
tttctatattttggat

SEQ ID NO: 532540 - DNA, 16 bp, R. norvegicus
tttctatctctggggt

SEQ ID NO: 532541 - DNA, 16 bp, R. norvegicus
tttctattaaaaatgt

SEQ ID NO: 532542 - DNA, 16 bp, R. norvegicus
tttctattttaaaaga

SEQ ID NO: 532543 - DNA, 16 bp, R. norvegicus
tttctattttaaaagt

SEQ ID NO: 532544 - DNA, 16 bp, R. norvegicus
tttctattttgtagaa

SEQ ID NO: 532545 - DNA, 16 bp, R. norvegicus
tttctcaaagaaacca

SEQ ID NO: 532546 - DNA, 16 bp, R. norvegicus
tttctcaaagatcaag

SEQ ID NO: 532547 - DNA, 16 bp, R. norvegicus
tttctcaataaaatat

SEQ ID NO: 532548 - DNA, 16 bp, R. norvegicus
tttctcaattgatgtt

SEQ ID NO: 532549 - DNA, 16 bp, R. norvegicus
tttctcacctgctcct

SEQ ID NO: 532550 - DNA, 16 bp, R. norvegicus
tttctcactttctgtt

SEQ ID NO: 532551 - DNA, 16 bp, R. norvegicus
tttctcagaaggagaa

SEQ ID NO: 532552 - DNA, 16 bp, R. norvegicus
tttctcagaaggggaa

SEQ ID NO: 532553 - DNA, 16 bp, R. norvegicus
tttctcagacatttgg

SEQ ID NO: 532554 - DNA, 16 bp, R. norvegicus
tttctcagcatctatt

SEQ ID NO: 532555 - DNA, 16 bp, R. norvegicus
tttctcagcttgctct

SEQ ID NO: 532556 - DNA, 16 bp, R. norvegicus
tttctcaggaaattgg

SEQ ID NO: 532557 - DNA, 16 bp, R. norvegicus
tttctcagtacctcat

SEQ ID NO: 532558 - DNA, 16 bp, R. norvegicus
tttctcagtgtctgtt

SEQ ID NO: 532559 - DNA, 16 bp, R. norvegicus
tttctcagttttctct

SEQ ID NO: 532560 - DNA, 16 bp, R. norvegicus
tttctcatctatgaaa

SEQ ID NO: 532561 - DNA, 16 bp, R. norvegicus
tttctcatggctgtga

SEQ ID NO: 532562 - DNA, 16 bp, R. norvegicus
tttctcatggttcaca

SEQ ID NO: 532563 - DNA, 16 bp, R. norvegicus
tttctcattctgtagg

SEQ ID NO: 532564 - DNA, 16 bp, R. norvegicus
tttctccaacagggag

SEQ ID NO: 532565 - DNA, 16 bp, R. norvegicus
tttctccacaacctca

SEQ ID NO: 532566 - DNA, 16 bp, R. norvegicus
tttctccacctcctcg

SEQ ID NO: 532567 - DNA, 16 bp, R. norvegicus
tttctccagtgccctt

SEQ ID NO: 532568 - DNA, 16 bp, R. norvegicus
tttctccagttcttcc

SEQ ID NO: 532569 - DNA, 16 bp, R. norvegicus
tttctccatgtatgtt

SEQ ID NO: 532570 - DNA, 16 bp, R. norvegicus
tttctcccaaaatgct

SEQ ID NO: 532571 - DNA, 16 bp, R. norvegicus
tttctcccattctcag

SEQ ID NO: 532572 - DNA, 16 bp, R. norvegicus
tttctccctccaaatc

SEQ ID NO: 532573 - DNA, 16 bp, R. norvegicus
tttctccctctgtctg

SEQ ID NO: 532574 - DNA, 16 bp, R. norvegicus
tttctcccttttggaa

SEQ ID NO: 532575 - DNA, 16 bp, R. norvegicus
tttctcctgagagttg

SEQ ID NO: 532576 - DNA, 16 bp, R. norvegicus
tttctcctgcaagaaa

SEQ ID NO: 532577 - DNA, 16 bp, R. norvegicus
tttctcctggagacag

SEQ ID NO: 532578 - DNA, 16 bp, R. norvegicus
tttctcctggccctca

SEQ ID NO: 532579 - DNA, 16 bp, R. norvegicus
tttctcctgttctcag

SEQ ID NO: 532580 - DNA, 16 bp, R. norvegicus
tttctccttggaccag

SEQ ID NO: 532581 - DNA, 16 bp, R. norvegicus
tttctcctttaaaaat

SEQ ID NO: 532582 - DNA, 16 bp, R. norvegicus
tttctctaactcctcc

SEQ ID NO: 532583 - DNA, 16 bp, R. norvegicus
tttctctaaggagaaa

SEQ ID NO: 532584 - DNA, 16 bp, R. norvegicus
tttctctatctgttga

SEQ ID NO: 532585 - DNA, 16 bp, R. norvegicus
tttctctatgtttctg

SEQ ID NO: 532586 - DNA, 16 bp, R. norvegicus
tttctctcaataaaca

SEQ ID NO: 532587 - DNA, 16 bp, R. norvegicus
tttctctcagatgact

SEQ ID NO: 532588 - DNA, 16 bp, R. norvegicus
tttctctccaaagcct

SEQ ID NO: 532589 - DNA, 16 bp, R. norvegicus
tttctctccattaagt

SEQ ID NO: 532590 - DNA, 16 bp, R. norvegicus
tttctctcctgtgtgt

SEQ ID NO: 532591 - DNA, 16 bp, R. norvegicus
tttctctctgtgtgtg

SEQ ID NO: 532592 - DNA, 16 bp, R. norvegicus
tttctctcttaaaaaa

SEQ ID NO: 532593 - DNA, 16 bp, R. norvegicus
tttctctgctttctga

SEQ ID NO: 532594 - DNA, 16 bp, R. norvegicus
tttctctgggtctttg

SEQ ID NO: 532595 - DNA, 16 bp, R. norvegicus
tttctctgtatcctca

SEQ ID NO: 532596 - DNA, 16 bp, R. norvegicus
tttctctgtcactctc

SEQ ID NO: 532597 - DNA, 16 bp, R. norvegicus
tttctctgtgcctcag

SEQ ID NO: 532598 - DNA, 16 bp, R. norvegicus
tttctctgtgtagcct

SEQ ID NO: 532599 - DNA, 16 bp, R. norvegicus
tttctctgtgtctgtg

SEQ ID NO: 532600 - DNA, 16 bp, R. norvegicus
tttctcttactggcag

SEQ ID NO: 532601 - DNA, 16 bp, R. norvegicus
tttctcttcagaaaag

SEQ ID NO: 532602 - DNA, 16 bp, R. norvegicus
tttctcttcccaccat

SEQ ID NO: 532603 - DNA, 16 bp, R. norvegicus
tttctcttcccattgg

SEQ ID NO: 532604 - DNA, 16 bp, R. norvegicus
tttctcttcctccaca

SEQ ID NO: 532605 - DNA, 16 bp, R. norvegicus
tttctcttgtttaact

SEQ ID NO: 532606 - DNA, 16 bp, R. norvegicus
tttctctttccatgat

SEQ ID NO: 532607 - DNA, 16 bp, R. norvegicus
tttctctttcttagaa

SEQ ID NO: 532608 - DNA, 16 bp, R. norvegicus
tttctcttttaaaaga

SEQ ID NO: 532609 - DNA, 16 bp, R. norvegicus
tttctcttttctgtga

SEQ ID NO: 532610 - DNA, 16 bp, R. norvegicus
tttctcttttgaaaca

SEQ ID NO: 532611 - DNA, 16 bp, R. norvegicus
tttctcttttgagaaa

SEQ ID NO: 532612 - DNA, 16 bp, R. norvegicus
tttctctttttccaaa

SEQ ID NO: 532613 - DNA, 16 bp, R. norvegicus
tttctgaaaaaaaaat

SEQ ID NO: 532614 - DNA, 22 bp, R. norvegicus
tttctgaaaaaccaacatcctg

SEQ ID NO: 532615 - DNA, 16 bp, R. norvegicus
tttctgaaaaggaaat

SEQ ID NO: 532616 - DNA, 16 bp, R. norvegicus
tttctgaaaatttaaa

SEQ ID NO: 532617 - DNA, 16 bp, R. norvegicus
tttctgaactctggct

SEQ ID NO: 532618 - DNA, 16 bp, R. norvegicus
tttctgaagaagaaat

SEQ ID NO: 532619 - DNA, 16 bp, R. norvegicus
tttctgaagaggaaaa

SEQ ID NO: 532620 - DNA, 16 bp, R. norvegicus
tttctgaatgttttgt

SEQ ID NO: 532621 - DNA, 16 bp, R. norvegicus
tttctgacaatggcta

SEQ ID NO: 532622 - DNA, 16 bp, R. norvegicus
tttctgacagtggctt

SEQ ID NO: 532623 - DNA, 16 bp, R. norvegicus
tttctgacctccatgg

SEQ ID NO: 532624 - DNA, 16 bp, R. norvegicus
tttctgacctgacttc

SEQ ID NO: 532625 - DNA, 16 bp, R. norvegicus
tttctgactgggttac

SEQ ID NO: 532626 - DNA, 16 bp, R. norvegicus
tttctgacttggatct

SEQ ID NO: 532627 - DNA, 16 bp, R. norvegicus
tttctgactttttaaa

SEQ ID NO: 532628 - DNA, 16 bp, R. norvegicus
tttctgagagcacaaa

SEQ ID NO: 532629 - DNA, 16 bp, R. norvegicus
tttctgagagtgactt

SEQ ID NO: 532630 - DNA, 16 bp, R. norvegicus
tttctgagatctttga

SEQ ID NO: 532631 - DNA, 16 bp, R. norvegicus
tttctgaggaaaaaaa

SEQ ID NO: 532632 - DNA, 16 bp, R. norvegicus
tttctgagtcacttgg

SEQ ID NO: 532633 - DNA, 16 bp, R. norvegicus
tttctgagtctttgat

SEQ ID NO: 532634 - DNA, 16 bp, R. norvegicus
tttctgagttcaagat

SEQ ID NO: 532635 - DNA, 16 bp, R. norvegicus
tttctgatatttttaa

SEQ ID NO: 532636 - DNA, 16 bp, R. norvegicus
tttctgatgttcttag

SEQ ID NO: 532637 - DNA, 16 bp, R. norvegicus
tttctgattttaaaaa

SEQ ID NO: 532638 - DNA, 16 bp, R. norvegicus
tttctgcatctaagga

SEQ ID NO: 532639 - DNA, 16 bp, R. norvegicus
tttctgccatgatgat

SEQ ID NO: 532640 - DNA, 16 bp, R. norvegicus
tttctgccctgcttga

SEQ ID NO: 532641 - DNA, 16 bp, R. norvegicus
tttctgcctcattttc

SEQ ID NO: 532642 - DNA, 16 bp, R. norvegicus
tttctgcctcccaaat

SEQ ID NO: 532643 - DNA, 16 bp, R. norvegicus
tttctgcctctcaagt

SEQ ID NO: 532644 - DNA, 16 bp, R. norvegicus
tttctgctctcaggcc

SEQ ID NO: 532645 - DNA, 16 bp, R. norvegicus
tttctgctgacttcat

SEQ ID NO: 532646 - DNA, 16 bp, R. norvegicus
tttctgctgcaaaaaa

SEQ ID NO: 532647 - DNA, 16 bp, R. norvegicus
tttctgcttcagctcc

SEQ ID NO: 532648 - DNA, 16 bp, R. norvegicus
tttctgcttcatcttt

SEQ ID NO: 532649 - DNA, 16 bp, R. norvegicus
tttctgctttacatca

SEQ ID NO: 532650 - DNA, 16 bp, R. norvegicus
tttctggaaaaaaaaa

SEQ ID NO: 532651 - DNA, 16 bp, R. norvegicus
tttctggaaacatcct

SEQ ID NO: 532652 - DNA, 20 bp, R. norvegicus
tttctggaaatcagtctgga

SEQ ID NO: 532653 - DNA, 16 bp, R. norvegicus
tttctggaactttcca

SEQ ID NO: 532654 - DNA, 16 bp, R. norvegicus
tttctggaagaaaaaa

SEQ ID NO: 532655 - DNA, 16 bp, R. norvegicus
tttctggaagcagcct

SEQ ID NO: 532656 - DNA, 16 bp, R. norvegicus
tttctggaatttaatg

SEQ ID NO: 532657 - DNA, 16 bp, R. norvegicus
tttctggaattttcca

SEQ ID NO: 532658 - DNA, 16 bp, R. norvegicus
tttctggagctggagt

SEQ ID NO: 532659 - DNA, 16 bp, R. norvegicus
tttctggatatgtcat

SEQ ID NO: 532660 - DNA, 16 bp, R. norvegicus
tttctggatattttgt

SEQ ID NO: 532661 - DNA, 16 bp, R. norvegicus
tttctggatctgggtt

SEQ ID NO: 532662 - DNA, 16 bp, R. norvegicus
tttctggatttttaaa

SEQ ID NO: 532663 - DNA, 16 bp, R. norvegicus
tttctggcctctgaag

SEQ ID NO: 532664 - DNA, 16 bp, R. norvegicus
tttctgggaaacagaa

SEQ ID NO: 532665 - DNA, 16 bp, R. norvegicus
tttctgggacttgaac

SEQ ID NO: 532666 - DNA, 16 bp, R. norvegicus
tttctgggagcttcca

SEQ ID NO: 532667 - DNA, 16 bp, R. norvegicus
tttctgggagcttctg

SEQ ID NO: 532668 - DNA, 16 bp, R. norvegicus
tttctgggtctgggct

SEQ ID NO: 532669 - DNA, 16 bp, R. norvegicus
tttctgggtctttctg

SEQ ID NO: 532670 - DNA, 16 bp, R. norvegicus
tttctggtcatggtgt

SEQ ID NO: 532671 - DNA, 16 bp, R. norvegicus
tttctggtctagtcta

SEQ ID NO: 532672 - DNA, 16 bp, R. norvegicus
tttctggttccatgat

SEQ ID NO: 532673 - DNA, 16 bp, R. norvegicus
tttctgtatcccttcc

SEQ ID NO: 532674 - DNA, 16 bp, R. norvegicus
tttctgtatgcagcaa

SEQ ID NO: 532675 - DNA, 16 bp, R. norvegicus
tttctgtatttctgta

SEQ ID NO: 532676 - DNA, 16 bp, R. norvegicus
tttctgtcatttttaa

SEQ ID NO: 532677 - DNA, 16 bp, R. norvegicus
tttctgtctcctgaga

SEQ ID NO: 532678 - DNA, 16 bp, R. norvegicus
tttctgtgagtgggtt

SEQ ID NO: 532679 - DNA, 16 bp, R. norvegicus
tttctgtgagttcaag

SEQ ID NO: 532680 - DNA, 16 bp, R. norvegicus
tttctgtgatattttg

SEQ ID NO: 532681 - DNA, 16 bp, R. norvegicus
tttctgtgctctctgg

SEQ ID NO: 532682 - DNA, 16 bp, R. norvegicus
tttctgtggaggagga

SEQ ID NO: 532683 - DNA, 16 bp, R. norvegicus
tttctgtgtagccctg

SEQ ID NO: 532684 - DNA, 16 bp, R. norvegicus
tttctgtgtagctctg

SEQ ID NO: 532685 - DNA, 16 bp, R. norvegicus
tttctgtgtatatgtg

SEQ ID NO: 532686 - DNA, 16 bp, R. norvegicus
tttctgtgtctgtgaa

SEQ ID NO: 532687 - DNA, 16 bp, R. norvegicus
tttctgtgtgtgtgag

SEQ ID NO: 532688 - DNA, 16 bp, R. norvegicus
tttctgtgtttttaaa

SEQ ID NO: 532689 - DNA, 16 bp, R. norvegicus
tttctgttcatcacca

SEQ ID NO: 532690 - DNA, 16 bp, R. norvegicus
tttctgttgctatgtc

SEQ ID NO: 532691 - DNA, 16 bp, R. norvegicus
tttctgttgctgctgt

SEQ ID NO: 532692 - DNA, 16 bp, R. norvegicus
tttctgttggccatct

SEQ ID NO: 532693 - DNA, 16 bp, R. norvegicus
tttctgttttccagct

SEQ ID NO: 532694 - DNA, 16 bp, R. norvegicus
tttctgttttcttcaa

SEQ ID NO: 532695 - DNA, 16 bp, R. norvegicus
tttcttaaaatagaaa

SEQ ID NO: 532696 - DNA, 16 bp, R. norvegicus
tttcttaaagaaaata

SEQ ID NO: 532697 - DNA, 16 bp, R. norvegicus
tttcttaatgttttca

SEQ ID NO: 532698 - DNA, 16 bp, R. norvegicus
tttcttacacttaaat

SEQ ID NO: 532699 - DNA, 16 bp, R. norvegicus
tttcttacataaaaat

SEQ ID NO: 532700 - DNA, 16 bp, R. norvegicus
tttcttatagaaacca

SEQ ID NO: 532701 - DNA, 16 bp, R. norvegicus
tttcttatatatgtat

SEQ ID NO: 532702 - DNA, 16 bp, R. norvegicus
tttcttattctctgca

SEQ ID NO: 532703 - DNA, 16 bp, R. norvegicus
tttcttcaaagattta

SEQ ID NO: 532704 - DNA, 16 bp, R. norvegicus
tttcttcagaggcatg

SEQ ID NO: 532705 - DNA, 16 bp, R. norvegicus
tttcttcagtgtcttg

SEQ ID NO: 532706 - DNA, 16 bp, R. norvegicus
tttcttcatctatgtt

SEQ ID NO: 532707 - DNA, 16 bp, R. norvegicus
tttcttcatctgaaaa

SEQ ID NO: 532708 - DNA, 16 bp, R. norvegicus
tttcttcattgaccaa

SEQ ID NO: 532709 - DNA, 16 bp, R. norvegicus
tttcttcatttgcaaa

SEQ ID NO: 532710 - DNA, 16 bp, R. norvegicus
tttcttccacaagttg

SEQ ID NO: 532711 - DNA, 16 bp, R. norvegicus
tttcttccagtatttt

SEQ ID NO: 532712 - DNA, 16 bp, R. norvegicus
tttcttcccagtccca

SEQ ID NO: 532713 - DNA, 16 bp, R. norvegicus
tttcttccttaaccag

SEQ ID NO: 532714 - DNA, 16 bp, R. norvegicus
tttcttccttcagaaa

SEQ ID NO: 532715 - DNA, 16 bp, R. norvegicus
tttcttccttctcagt

SEQ ID NO: 532716 - DNA, 16 bp, R. norvegicus
tttcttctacacctat

SEQ ID NO: 532717 - DNA, 16 bp, R. norvegicus
tttcttctgacttcca

SEQ ID NO: 532718 - DNA, 16 bp, R. norvegicus
tttcttctgggacaga

SEQ ID NO: 532719 - DNA, 16 bp, R. norvegicus
tttcttctgtgatgtt

SEQ ID NO: 532720 - DNA, 16 bp, R. norvegicus
tttcttcttaaaaata

SEQ ID NO: 532721 - DNA, 16 bp, R. norvegicus
tttcttcttcagttct

SEQ ID NO: 532722 - DNA, 16 bp, R. norvegicus
tttcttcttcccagag

SEQ ID NO: 532723 - DNA, 16 bp, R. norvegicus
tttcttcttctgagaa

SEQ ID NO: 532724 - DNA, 16 bp, R. norvegicus
tttcttcttctgtcta

SEQ ID NO: 532725 - DNA, 16 bp, R. norvegicus
tttcttcttttgagaa

SEQ ID NO: 532726 - DNA, 16 bp, R. norvegicus
tttcttctttttggag

SEQ ID NO: 532727 - DNA, 16 bp, R. norvegicus
tttcttgaaaatattt

SEQ ID NO: 532728 - DNA, 16 bp, R. norvegicus
tttcttgaagcagaaa

SEQ ID NO: 532729 - DNA, 16 bp, R. norvegicus
tttcttgcaacagaaa

SEQ ID NO: 532730 - DNA, 16 bp, R. norvegicus
tttcttgctgctgtga

SEQ ID NO: 532731 - DNA, 16 bp, R. norvegicus
tttcttggaaaaaaaa

SEQ ID NO: 532732 - DNA, 16 bp, R. norvegicus
tttcttggagctggag

SEQ ID NO: 532733 - DNA, 16 bp, R. norvegicus
tttcttgggctggaga

SEQ ID NO: 532734 - DNA, 16 bp, R. norvegicus
tttcttgtagatagga

SEQ ID NO: 532735 - DNA, 16 bp, R. norvegicus
tttcttgtctataaaa

SEQ ID NO: 532736 - DNA, 16 bp, R. norvegicus
tttctttaaaaactca

SEQ ID NO: 532737 - DNA, 16 bp, R. norvegicus
tttctttaaagaaaaa

SEQ ID NO: 532738 - DNA, 16 bp, R. norvegicus
tttctttaaagtgttt

SEQ ID NO: 532739 - DNA, 16 bp, R. norvegicus
tttctttaaatgattt

SEQ ID NO: 532740 - DNA, 16 bp, R. norvegicus
tttctttaagtacttt

SEQ ID NO: 532741 - DNA, 16 bp, R. norvegicus
tttctttacgtgcttc

SEQ ID NO: 532742 - DNA, 16 bp, R. norvegicus
tttctttagctacttc

SEQ ID NO: 532743 - DNA, 16 bp, R. norvegicus
tttctttattcttcag

SEQ ID NO: 532744 - DNA, 16 bp, R. norvegicus
tttctttatttgaaaa

SEQ ID NO: 532745 - DNA, 16 bp, R. norvegicus
tttctttcaaatttgt

SEQ ID NO: 532746 - DNA, 16 bp, R. norvegicus
tttctttcagcagaaa

SEQ ID NO: 532747 - DNA, 16 bp, R. norvegicus
tttctttcagccactt

SEQ ID NO: 532748 - DNA, 16 bp, R. norvegicus
tttctttcagcctttt

SEQ ID NO: 532749 - DNA, 16 bp, R. norvegicus
tttctttcattttaga

SEQ ID NO: 532750 - DNA, 16 bp, R. norvegicus
tttctttccacagtgt

SEQ ID NO: 532751 - DNA, 16 bp, R. norvegicus
tttctttccagattgg

SEQ ID NO: 532752 - DNA, 16 bp, R. norvegicus
tttctttcctcagggt

SEQ ID NO: 532753 - DNA, 16 bp, R. norvegicus
tttctttcggagctgg

SEQ ID NO: 532754 - DNA, 16 bp, R. norvegicus
tttctttctacaaaag

SEQ ID NO: 532755 - DNA, 16 bp, R. norvegicus
tttctttctcagactg

SEQ ID NO: 532756 - DNA, 16 bp, R. norvegicus
tttctttctcagtaca

SEQ ID NO: 532757 - DNA, 16 bp, R. norvegicus
tttctttctcagtcct

SEQ ID NO: 532758 - DNA, 16 bp, R. norvegicus
tttctttctctctgat

SEQ ID NO: 532759 - DNA, 16 bp, R. norvegicus
tttctttcttgaaaga

SEQ ID NO: 532760 - DNA, 16 bp, R. norvegicus
tttctttctttgagat

SEQ ID NO: 532761 - DNA, 16 bp, R. norvegicus
tttctttctttgatga

SEQ ID NO: 532762 - DNA, 16 bp, R. norvegicus
tttctttcttttaaag

SEQ ID NO: 532763 - DNA, 16 bp, R. norvegicus
tttctttcttttgaag

SEQ ID NO: 532764 - DNA, 16 bp, R. norvegicus
tttctttgaaataatt

SEQ ID NO: 532765 - DNA, 16 bp, R. norvegicus
tttctttgacccaatt

SEQ ID NO: 532766 - DNA, 16 bp, R. norvegicus
tttctttgactattat

SEQ ID NO: 532767 - DNA, 16 bp, R. norvegicus
tttctttgatgactat

SEQ ID NO: 532768 - DNA, 16 bp, R. norvegicus
tttctttgatgtatat

SEQ ID NO: 532769 - DNA, 16 bp, R. norvegicus
tttctttggaaaatca

SEQ ID NO: 532770 - DNA, 16 bp, R. norvegicus
tttctttggaccattt

SEQ ID NO: 532771 - DNA, 16 bp, R. norvegicus
tttctttggatcattt

SEQ ID NO: 532772 - DNA, 16 bp, R. norvegicus
tttctttggtgagaga

SEQ ID NO: 532773 - DNA, 16 bp, R. norvegicus
tttctttgtcagcctg

SEQ ID NO: 532774 - DNA, 16 bp, R. norvegicus
tttctttgtgtgggaa

SEQ ID NO: 532775 - DNA, 16 bp, R. norvegicus
tttcttttaaaaagta

SEQ ID NO: 532776 - DNA, 16 bp, R. norvegicus
tttcttttaaaaccca

SEQ ID NO: 532777 - DNA, 16 bp, R. norvegicus
tttcttttaaaagaag

SEQ ID NO: 532778 - DNA, 16 bp, R. norvegicus
tttcttttaaacatga

SEQ ID NO: 532779 - DNA, 16 bp, R. norvegicus
tttcttttaaagttta

SEQ ID NO: 532780 - DNA, 16 bp, R. norvegicus
tttcttttaaatgaaa

SEQ ID NO: 532781 - DNA, 16 bp, R. norvegicus
tttcttttaagaaaaa

SEQ ID NO: 532782 - DNA, 16 bp, R. norvegicus
tttcttttagaaatgt

SEQ ID NO: 532783 - DNA, 16 bp, R. norvegicus
tttcttttagaatatt

SEQ ID NO: 532784 - DNA, 16 bp, R. norvegicus
tttcttttatcaatgt

SEQ ID NO: 532785 - DNA, 16 bp, R. norvegicus
tttcttttatggaaaa

SEQ ID NO: 532786 - DNA, 16 bp, R. norvegicus
tttcttttcaagattt

SEQ ID NO: 532787 - DNA, 16 bp, R. norvegicus
tttcttttcaggtcca

SEQ ID NO: 532788 - DNA, 16 bp, R. norvegicus
tttcttttccagaaat

SEQ ID NO: 532789 - DNA, 16 bp, R. norvegicus
tttcttttccagtgtg

SEQ ID NO: 532790 - DNA, 16 bp, R. norvegicus
tttcttttccttctga

SEQ ID NO: 532791 - DNA, 16 bp, R. norvegicus
tttcttttctcagtgt

SEQ ID NO: 532792 - DNA, 30 bp, R. norvegicus
tttcttttctggtccaatctatttggagtt

SEQ ID NO: 532793 - DNA, 16 bp, R. norvegicus
tttcttttgaaaagaa

SEQ ID NO: 532794 - DNA, 16 bp, R. norvegicus
tttcttttgaaagaaa

SEQ ID NO: 532795 - DNA, 16 bp, R. norvegicus
tttcttttggctcaca

SEQ ID NO: 532796 - DNA, 16 bp, R. norvegicus
tttcttttgtcctgat

SEQ ID NO: 532797 - DNA, 16 bp, R. norvegicus
tttctttttaaaggaa

SEQ ID NO: 532798 - DNA, 16 bp, R. norvegicus
tttctttttaaggaaa

SEQ ID NO: 532799 - DNA, 16 bp, R. norvegicus
tttctttttaagtaaa

SEQ ID NO: 532800 - DNA, 16 bp, R. norvegicus
tttctttttccagaaa

SEQ ID NO: 532801 - DNA, 16 bp, R. norvegicus
tttctttttgaaaaaa

SEQ ID NO: 532802 - DNA, 16 bp, R. norvegicus
tttctttttggagaca

SEQ ID NO: 532803 - DNA, 16 bp, R. norvegicus
tttcttttttgaaaat

SEQ ID NO: 532804 - DNA, 16 bp, R. norvegicus
tttctttttttcagag

SEQ ID NO: 532805 - DNA, 16 bp, R. norvegicus
tttgaaaaacaataaa

SEQ ID NO: 532806 - DNA, 16 bp, R. norvegicus
tttgaaaaagaacaaa

SEQ ID NO: 532807 - DNA, 16 bp, R. norvegicus
tttgaaaaataaatct

SEQ ID NO: 532808 - DNA, 16 bp, R. norvegicus
tttgaaaagattttaa

SEQ ID NO: 532809 - DNA, 16 bp, R. norvegicus
tttgaaaaggaaaaga

SEQ ID NO: 532810 - DNA, 16 bp, R. norvegicus
tttgaaaataaaacat

SEQ ID NO: 532811 - DNA, 16 bp, R. norvegicus
tttgaaaataactttt

SEQ ID NO: 532812 - DNA, 16 bp, R. norvegicus
tttgaaaataatttca

SEQ ID NO: 532813 - DNA, 16 bp, R. norvegicus
tttgaaaatcaacttt

SEQ ID NO: 532814 - DNA, 16 bp, R. norvegicus
tttgaaaatgaaacaa

SEQ ID NO: 532815 - DNA, 16 bp, R. norvegicus
tttgaaaatgcaaata

SEQ ID NO: 532816 - DNA, 16 bp, R. norvegicus
tttgaaaatgctaatt

SEQ ID NO: 532817 - DNA, 16 bp, R. norvegicus
tttgaaaatgttaaat

SEQ ID NO: 532818 - DNA, 16 bp, R. norvegicus
tttgaaaatttgtgtg

SEQ ID NO: 532819 - DNA, 16 bp, R. norvegicus
tttgaaacaggctctc

SEQ ID NO: 532820 - DNA, 16 bp, R. norvegicus
tttgaaacctcaaaag

SEQ ID NO: 532821 - DNA, 16 bp, R. norvegicus
tttgaaagaaaaggaa

SEQ ID NO: 532822 - DNA, 16 bp, R. norvegicus
tttgaaagaaaatggc

SEQ ID NO: 532823 - DNA, 16 bp, R. norvegicus
tttgaaagacagcaag

SEQ ID NO: 532824 - DNA, 16 bp, R. norvegicus
tttgaaagagaaaata

SEQ ID NO: 532825 - DNA, 16 bp, R. norvegicus
tttgaaagagaagaaa

SEQ ID NO: 532826 - DNA, 16 bp, R. norvegicus
tttgaaagatttttct

SEQ ID NO: 532827 - DNA, 17 bp, R. norvegicus
tttgaaagctgagtagt

SEQ ID NO: 532828 - DNA, 16 bp, R. norvegicus
tttgaaatagggtctc

SEQ ID NO: 532829 - DNA, 16 bp, R. norvegicus
tttgaaatatatatgt

SEQ ID NO: 532830 - DNA, 16 bp, R. norvegicus
tttgaaatcccaaagc

SEQ ID NO: 532831 - DNA, 16 bp, R. norvegicus
tttgaaatgaaaattt

SEQ ID NO: 532832 - DNA, 16 bp, R. norvegicus
tttgaaatttgaaaaa

SEQ ID NO: 532833 - DNA, 16 bp, R. norvegicus
tttgaactggactgtt

SEQ ID NO: 532834 - DNA, 16 bp, R. norvegicus
tttgaagaagacctca

SEQ ID NO: 532835 - DNA, 16 bp, R. norvegicus
tttgaagaatatattt

SEQ ID NO: 532836 - DNA, 16 bp, R. norvegicus
tttgaagaattgtttt

SEQ ID NO: 532837 - DNA, 16 bp, R. norvegicus
tttgaagatgttttct

SEQ ID NO: 532838 - DNA, 16 bp, R. norvegicus
tttgaagatttggatt

SEQ ID NO: 532839 - DNA, 16 bp, R. norvegicus
tttgaagcaagcttta

SEQ ID NO: 532840 - DNA, 16 bp, R. norvegicus
tttgaagccagccagg

SEQ ID NO: 532841 - DNA, 16 bp, R. norvegicus
tttgaaggaaaatgaa

SEQ ID NO: 532842 - DNA, 16 bp, R. norvegicus
tttgaaggaaaatgga

SEQ ID NO: 532843 - DNA, 16 bp, R. norvegicus
tttgaaggaagaaaaa

SEQ ID NO: 532844 - DNA, 16 bp, R. norvegicus
tttgaaggaatgaagg

SEQ ID NO: 532845 - DNA, 16 bp, R. norvegicus
tttgaaggaattaaaa

SEQ ID NO: 532846 - DNA, 16 bp, R. norvegicus
tttgaaggactacctc

SEQ ID NO: 532847 - DNA, 16 bp, R. norvegicus
tttgaaggagagcagg

SEQ ID NO: 532848 - DNA, 16 bp, R. norvegicus
tttgaaggcatgaggg

SEQ ID NO: 532849 - DNA, 16 bp, R. norvegicus
tttgaaggcttgatgc

SEQ ID NO: 532850 - DNA, 16 bp, R. norvegicus
tttgaagtggaaattt

SEQ ID NO: 532851 - DNA, 16 bp, R. norvegicus
tttgaagttcagaaag

SEQ ID NO: 532852 - DNA, 16 bp, R. norvegicus
tttgaagttggactaa

SEQ ID NO: 532853 - DNA, 16 bp, R. norvegicus
tttgaataagaatgat

SEQ ID NO: 532854 - DNA, 16 bp, R. norvegicus
tttgaataagagtggc

SEQ ID NO: 532855 - DNA, 16 bp, R. norvegicus
tttgaatatgcttggc

SEQ ID NO: 532856 - DNA, 16 bp, R. norvegicus
tttgaatcaaagaaat

SEQ ID NO: 532857 - DNA, 16 bp, R. norvegicus
tttgaatcagggtctc

SEQ ID NO: 532858 - DNA, 16 bp, R. norvegicus
tttgaatgagaaaggc

SEQ ID NO: 532859 - DNA, 16 bp, R. norvegicus
tttgaatggaaagacc

SEQ ID NO: 532860 - DNA, 16 bp, R. norvegicus
tttgaattcccagaac

SEQ ID NO: 532861 - DNA, 16 bp, R. norvegicus
tttgaattctgtggac

SEQ ID NO: 532862 - DNA, 16 bp, R. norvegicus
tttgaatttactctga

SEQ ID NO: 532863 - DNA, 16 bp, R. norvegicus
tttgaatttcatgaaa

SEQ ID NO: 532864 - DNA, 16 bp, R. norvegicus
tttgaattttatgagg

SEQ ID NO: 532865 - DNA, 16 bp, R. norvegicus
tttgaattttctctgt

SEQ ID NO: 532866 - DNA, 16 bp, R. norvegicus
tttgacaaaatgtaac

SEQ ID NO: 532867 - DNA, 16 bp, R. norvegicus
tttgacaaagaaggaa

SEQ ID NO: 532868 - DNA, 23 bp, R. norvegicus
tttgacaaaggagtcaaaaccat

SEQ ID NO: 532869 - DNA, 17 bp, R. norvegicus
tttgacaaggccaatgc

SEQ ID NO: 532870 - DNA, 16 bp, R. norvegicus
tttgacaagtataaag

SEQ ID NO: 532871 - DNA, 16 bp, R. norvegicus
tttgacagtgttcctt

SEQ ID NO: 532872 - DNA, 16 bp, R. norvegicus
tttgacattgaactgc

SEQ ID NO: 532873 - DNA, 16 bp, R. norvegicus
tttgacatttatttta

SEQ ID NO: 532874 - DNA, 16 bp, R. norvegicus
tttgacctggatcttg

SEQ ID NO: 532875 - DNA, 16 bp, R. norvegicus
tttgactcaacaggtg

SEQ ID NO: 532876 - DNA, 16 bp, R. norvegicus
tttgactcctttcttt

SEQ ID NO: 532877 - DNA, 16 bp, R. norvegicus
tttgactgggttgttt

SEQ ID NO: 532878 - DNA, 16 bp, R. norvegicus
tttgactgtgtgatgg

SEQ ID NO: 532879 - DNA, 16 bp, R. norvegicus
tttgactgtgtgtgtg

SEQ ID NO: 532880 - DNA, 16 bp, R. norvegicus
tttgacttcctctttt

SEQ ID NO: 532881 - DNA, 16 bp, R. norvegicus
tttgacttctcctttt

SEQ ID NO: 532882 - DNA, 16 bp, R. norvegicus
tttgactttttcctct

SEQ ID NO: 532883 - DNA, 16 bp, R. norvegicus
tttgacttttttaaaa

SEQ ID NO: 532884 - DNA, 16 bp, R. norvegicus
tttgagaaaatcagca

SEQ ID NO: 532885 - DNA, 16 bp, R. norvegicus
tttgagaaaatgaaaa

SEQ ID NO: 532886 - DNA, 16 bp, R. norvegicus
tttgagaaagagtttc

SEQ ID NO: 532887 - DNA, 16 bp, R. norvegicus
tttgagacacagtctt

SEQ ID NO: 532888 - DNA, 16 bp, R. norvegicus
tttgagacactgtctt

SEQ ID NO: 532889 - DNA, 16 bp, R. norvegicus
tttgagacaggctctt

SEQ ID NO: 532890 - DNA, 16 bp, R. norvegicus
tttgagacagtgtctc

SEQ ID NO: 532891 - DNA, 16 bp, R. norvegicus
tttgagaccattgatg

SEQ ID NO: 532892 - DNA, 16 bp, R. norvegicus
tttgagacctcaaagc

SEQ ID NO: 532893 - DNA, 16 bp, R. norvegicus
tttgagacctggtctc

SEQ ID NO: 532894 - DNA, 16 bp, R. norvegicus
tttgagatcttcttca

SEQ ID NO: 532895 - DNA, 16 bp, R. norvegicus
tttgagatttttgtct

SEQ ID NO: 532896 - DNA, 16 bp, R. norvegicus
tttgagccactgtgtg

SEQ ID NO: 532897 - DNA, 16 bp, R. norvegicus
tttgagcccagcctgg

SEQ ID NO: 532898 - DNA, 30 bp, R. norvegicus
tttgagctgaagaacaatgcccagagagca

SEQ ID NO: 532899 - DNA, 16 bp, R. norvegicus
tttgaggagaaaaaaa

SEQ ID NO: 532900 - DNA, 16 bp, R. norvegicus
tttgaggcaggctttc

SEQ ID NO: 532901 - DNA, 16 bp, R. norvegicus
tttgaggccagtctga

SEQ ID NO: 532902 - DNA, 16 bp, R. norvegicus
tttgaggctggcctgg

SEQ ID NO: 532903 - DNA, 16 bp, R. norvegicus
tttgaggggaaaaaaa

SEQ ID NO: 532904 - DNA, 16 bp, R. norvegicus
tttgaggtcagcatgg

SEQ ID NO: 532905 - DNA, 16 bp, R. norvegicus
tttgaggtttccaaat

SEQ ID NO: 532906 - DNA, 16 bp, R. norvegicus
tttgaggttttaaatg

SEQ ID NO: 532907 - DNA, 16 bp, R. norvegicus
tttgagtcagaagagc

SEQ ID NO: 532908 - DNA, 16 bp, R. norvegicus
tttgagtcagggtctt

SEQ ID NO: 532909 - DNA, 19 bp, R. norvegicus
tttgagtccgagatgctca

SEQ ID NO: 532910 - DNA, 16 bp, R. norvegicus
tttgagtcctgaaagt

SEQ ID NO: 532911 - DNA, 16 bp, R. norvegicus
tttgagtgtatatgtg

SEQ ID NO: 532912 - DNA, 16 bp, R. norvegicus
tttgagttcaaagtca

SEQ ID NO: 532913 - DNA, 16 bp, R. norvegicus
tttgagttcaaggcca

SEQ ID NO: 532914 - DNA, 16 bp, R. norvegicus
tttgagttcaattact

SEQ ID NO: 532915 - DNA, 16 bp, R. norvegicus
tttgagttccatccat

SEQ ID NO: 532916 - DNA, 16 bp, R. norvegicus
tttgataaaatcaaca

SEQ ID NO: 532917 - DNA, 16 bp, R. norvegicus
tttgataatgatgctg

SEQ ID NO: 532918 - DNA, 16 bp, R. norvegicus
tttgatagaattctgt

SEQ ID NO: 532919 - DNA, 16 bp, R. norvegicus
tttgatagctgagaaa

SEQ ID NO: 532920 - DNA, 16 bp, R. norvegicus
tttgatatgttctttg

SEQ ID NO: 532921 - DNA, 16 bp, R. norvegicus
tttgatattcctcagg

SEQ ID NO: 532922 - DNA, 16 bp, R. norvegicus
tttgatatttgaatgg

SEQ ID NO: 532923 - DNA, 16 bp, R. norvegicus
tttgatcaaaatacat

SEQ ID NO: 532924 - DNA, 33 bp, R. norvegicus
tttgatcataatgctggaggacttcaagaaaga

SEQ ID NO: 532925 - DNA, 16 bp, R. norvegicus
tttgatccacctggac

SEQ ID NO: 532926 - DNA, 16 bp, R. norvegicus
tttgatccacttggac

SEQ ID NO: 532927 - DNA, 16 bp, R. norvegicus
tttgatctccatttgt

SEQ ID NO: 532928 - DNA, 16 bp, R. norvegicus
tttgatgaaaatgaag

SEQ ID NO: 532929 - DNA, 16 bp, R. norvegicus
tttgatgaaaatgctg

SEQ ID NO: 532930 - DNA, 16 bp, R. norvegicus
tttgatgaatatcaag

SEQ ID NO: 532931 - DNA, 16 bp, R. norvegicus
tttgatgaatatgaaa

SEQ ID NO: 532932 - DNA, 16 bp, R. norvegicus
tttgatgaatatggag

SEQ ID NO: 532933 - DNA, 16 bp, R. norvegicus
tttgatgactgcatgt

SEQ ID NO: 532934 - DNA, 16 bp, R. norvegicus
tttgatgactttggtt

SEQ ID NO: 532935 - DNA, 16 bp, R. norvegicus
tttgatgagtatgaag

SEQ ID NO: 532936 - DNA, 16 bp, R. norvegicus
tttgatgagtgtgaag

SEQ ID NO: 532937 - DNA, 16 bp, R. norvegicus
tttgatgatgccatgt

SEQ ID NO: 532938 - DNA, 16 bp, R. norvegicus
tttgatgccctgtctt

SEQ ID NO: 532939 - DNA, 22 bp, R. norvegicus
tttgatgctggggctggcattg

SEQ ID NO: 532940 - DNA, 16 bp, R. norvegicus
tttgatggagattaca

SEQ ID NO: 532941 - DNA, 16 bp, R. norvegicus
tttgatggcttctact

SEQ ID NO: 532942 - DNA, 16 bp, R. norvegicus
tttgatggtttatctg

SEQ ID NO: 532943 - DNA, 16 bp, R. norvegicus
tttgatgtactcttgg

SEQ ID NO: 532944 - DNA, 18 bp, R. norvegicus
tttgatgtgatcttggat

SEQ ID NO: 532945 - DNA, 18 bp, R. norvegicus
tttgatgtgcaggtcctt

SEQ ID NO: 532946 - DNA, 18 bp, R. norvegicus
tttgatgtggagatcctt

SEQ ID NO: 532947 - DNA, 16 bp, R. norvegicus
tttgatgtggagttcc

SEQ ID NO: 532948 - DNA, 16 bp, R. norvegicus
tttgatgtggtcttgg

SEQ ID NO: 532949 - DNA, 16 bp, R. norvegicus
tttgatgttattgaag

SEQ ID NO: 532950 - DNA, 16 bp, R. norvegicus
tttgatgttttaaaag

SEQ ID NO: 532951 - DNA, 16 bp, R. norvegicus
tttgattcattttgaa

SEQ ID NO: 532952 - DNA, 16 bp, R. norvegicus
tttgattcccagcacc

SEQ ID NO: 532953 - DNA, 16 bp, R. norvegicus
tttgattcccagcagc

SEQ ID NO: 532954 - DNA, 16 bp, R. norvegicus
tttgattcccaggacc

SEQ ID NO: 532955 - DNA, 16 bp, R. norvegicus
tttgattctcagaacc

SEQ ID NO: 532956 - DNA, 16 bp, R. norvegicus
tttgattctctgaagt

SEQ ID NO: 532957 - DNA, 16 bp, R. norvegicus
tttgattcttttaaaa

SEQ ID NO: 532958 - DNA, 16 bp, R. norvegicus
tttgattgataataaa

SEQ ID NO: 532959 - DNA, 16 bp, R. norvegicus
tttgatttccagtacc

SEQ ID NO: 532960 - DNA, 19 bp, R. norvegicus
tttgatttgcatttccctg

SEQ ID NO: 532961 - DNA, 16 bp, R. norvegicus
tttgattttacaggag

SEQ ID NO: 532962 - DNA, 16 bp, R. norvegicus
tttgattttgtggaat

SEQ ID NO: 532963 - DNA, 16 bp, R. norvegicus
tttgcaaaatcatttg

SEQ ID NO: 532964 - DNA, 16 bp, R. norvegicus
tttgcaaaccccttca

SEQ ID NO: 532965 - DNA, 17 bp, R. norvegicus
tttgcaaactgctaaat

SEQ ID NO: 532966 - DNA, 16 bp, R. norvegicus
tttgcaaagcttctgt

SEQ ID NO: 532967 - DNA, 16 bp, R. norvegicus
tttgcaaatgaaaaat

SEQ ID NO: 532968 - DNA, 16 bp, R. norvegicus
tttgcaaatggctctt

SEQ ID NO: 532969 - DNA, 16 bp, R. norvegicus
tttgcaaatttctttt

SEQ ID NO: 532970 - DNA, 16 bp, R. norvegicus
tttgcaaccccatagg

SEQ ID NO: 532971 - DNA, 16 bp, R. norvegicus
tttgcaatagccagaa

SEQ ID NO: 532972 - DNA, 16 bp, R. norvegicus
tttgcagaaaaatgaa

SEQ ID NO: 532973 - DNA, 16 bp, R. norvegicus
tttgcagaaagtagag

SEQ ID NO: 532974 - DNA, 16 bp, R. norvegicus
tttgcagaggggaaaa

SEQ ID NO: 532975 - DNA, 16 bp, R. norvegicus
tttgcagatgaagaaa

SEQ ID NO: 532976 - DNA, 16 bp, R. norvegicus
tttgcagatgatataa

SEQ ID NO: 532977 - DNA, 23 bp, R. norvegicus
tttgcagatgatatgatagtgta

SEQ ID NO: 532978 - DNA, 16 bp, R. norvegicus
tttgcagcagacagag

SEQ ID NO: 532979 - DNA, 16 bp, R. norvegicus
tttgcagcatctaatg

SEQ ID NO: 532980 - DNA, 16 bp, R. norvegicus
tttgcaggcatgaaag

SEQ ID NO: 532981 - DNA, 16 bp, R. norvegicus
tttgcaggctggagag

SEQ ID NO: 532982 - DNA, 16 bp, R. norvegicus
tttgcagggaggaatg

SEQ ID NO: 532983 - DNA, 16 bp, R. norvegicus
tttgcagtctcctccc

SEQ ID NO: 532984 - DNA, 16 bp, R. norvegicus
tttgcatcagctcctg

SEQ ID NO: 532985 - DNA, 16 bp, R. norvegicus
tttgcatgcatatcca

SEQ ID NO: 532986 - DNA, 16 bp, R. norvegicus
tttgcattgaactctg

SEQ ID NO: 532987 - DNA, 16 bp, R. norvegicus
tttgcatttatattca

SEQ ID NO: 532988 - DNA, 16 bp, R. norvegicus
tttgcattttatttaa

SEQ ID NO: 532989 - DNA, 16 bp, R. norvegicus
tttgcattttctttaa

SEQ ID NO: 532990 - DNA, 16 bp, R. norvegicus
tttgccaagaagcaca

SEQ ID NO: 532991 - DNA, 16 bp, R. norvegicus
tttgccaatgaatttc

SEQ ID NO: 532992 - DNA, 16 bp, R. norvegicus
tttgccatctcttgga

SEQ ID NO: 532993 - DNA, 16 bp, R. norvegicus
tttgcccacctttgcc

SEQ ID NO: 532994 - DNA, 16 bp, R. norvegicus
tttgcccagaaaccag

SEQ ID NO: 532995 - DNA, 17 bp, R. norvegicus
tttgcccatgtcattta

SEQ ID NO: 532996 - DNA, 16 bp, R. norvegicus
tttgcctacacatatg

SEQ ID NO: 532997 - DNA, 17 bp, R. norvegicus
tttgcctagcaagcaca

SEQ ID NO: 532998 - DNA, 16 bp, R. norvegicus
tttgcctagcaagctc

SEQ ID NO: 532999 - DNA, 17 bp, R. norvegicus
tttgcctatgaacttca

SEQ ID NO: 533000 - DNA, 16 bp, R. norvegicus
tttgcctctgccttct

SEQ ID NO: 533001 - DNA, 16 bp, R. norvegicus
tttgcctctgtgtttg

SEQ ID NO: 533002 - DNA, 16 bp, R. norvegicus
tttgcctgcaaaatcc

SEQ ID NO: 533003 - DNA, 16 bp, R. norvegicus
tttgcctgcacacatg

SEQ ID NO: 533004 - DNA, 16 bp, R. norvegicus
tttgcctgcatatatg

SEQ ID NO: 533005 - DNA, 16 bp, R. norvegicus
tttgcctggaaagttg

SEQ ID NO: 533006 - DNA, 16 bp, R. norvegicus
tttgcctgtgtttatg

SEQ ID NO: 533007 - DNA, 16 bp, R. norvegicus
tttgccttctgagtgc

SEQ ID NO: 533008 - DNA, 16 bp, R. norvegicus
tttgcctttctgagtc

SEQ ID NO: 533009 - DNA, 16 bp, R. norvegicus
tttgcctttgcctttg

SEQ ID NO: 533010 - DNA, 17 bp, R. norvegicus
tttgcggtggcagcaac

SEQ ID NO: 533011 - DNA, 16 bp, R. norvegicus
tttgctaaagcaaaca

SEQ ID NO: 533012 - DNA, 16 bp, R. norvegicus
tttgctaaatggatat

SEQ ID NO: 533013 - DNA, 16 bp, R. norvegicus
tttgctaaggcaaaca

SEQ ID NO: 533014 - DNA, 16 bp, R. norvegicus
tttgctacaaatatgt

SEQ ID NO: 533015 - DNA, 16 bp, R. norvegicus
tttgctaccaagcctg

SEQ ID NO: 533016 - DNA, 16 bp, R. norvegicus
tttgctcaggaaaatt

SEQ ID NO: 533017 - DNA, 16 bp, R. norvegicus
tttgctccaggcacag

SEQ ID NO: 533018 - DNA, 17 bp, R. norvegicus
tttgctctattctggct

SEQ ID NO: 533019 - DNA, 16 bp, R. norvegicus
tttgctctcttttata

SEQ ID NO: 533020 - DNA, 16 bp, R. norvegicus
tttgctctgtgctcat

SEQ ID NO: 533021 - DNA, 16 bp, R. norvegicus
tttgctcttttctata

SEQ ID NO: 533022 - DNA, 16 bp, R. norvegicus
tttgctgaatatgaag

SEQ ID NO: 533023 - DNA, 16 bp, R. norvegicus
tttgctgaatgtgttt

SEQ ID NO: 533024 - DNA, 16 bp, R. norvegicus
tttgctgagctcatgg

SEQ ID NO: 533025 - DNA, 43 bp, R. norvegicus
tttgctgagtctgataggtttcttgaggtcttgttccgggtct

SEQ ID NO: 533026 - DNA, 16 bp, R. norvegicus
tttgctgagttcattt

SEQ ID NO: 533027 - DNA, 16 bp, R. norvegicus
tttgctgcagaaggaa

SEQ ID NO: 533028 - DNA, 16 bp, R. norvegicus
tttgctgccaagccta

SEQ ID NO: 533029 - DNA, 16 bp, R. norvegicus
tttgctgccttctact

SEQ ID NO: 533030 - DNA, 16 bp, R. norvegicus
tttgctgctagccttc

SEQ ID NO: 533031 - DNA, 16 bp, R. norvegicus
tttgctgctcttccag

SEQ ID NO: 533032 - DNA, 16 bp, R. norvegicus
tttgctgctgccattc

SEQ ID NO: 533033 - DNA, 16 bp, R. norvegicus
tttgctgctgttgctg

SEQ ID NO: 533034 - DNA, 16 bp, R. norvegicus
tttgctgggaactgaa

SEQ ID NO: 533035 - DNA, 16 bp, R. norvegicus
tttgctgggcagtggt

SEQ ID NO: 533036 - DNA, 52 bp, R. norvegicus
tttgctgtattctggctgtgtctctcaggagcgatctacatccggctcctgt

SEQ ID NO: 533037 - DNA, 18 bp, R. norvegicus
tttgctgtcaccagagtt

SEQ ID NO: 533038 - DNA, 16 bp, R. norvegicus
tttgctgtccatccag

SEQ ID NO: 533039 - DNA, 16 bp, R. norvegicus
tttgctgtgataaaat

SEQ ID NO: 533040 - DNA, 16 bp, R. norvegicus
tttgctgtgctcatgg

SEQ ID NO: 533041 - DNA, 16 bp, R. norvegicus
tttgctgttgcttctc

SEQ ID NO: 533042 - DNA, 16 bp, R. norvegicus
tttgctgtttctcctg

SEQ ID NO: 533043 - DNA, 16 bp, R. norvegicus
tttgcttaaaaaaaaa

SEQ ID NO: 533044 - DNA, 16 bp, R. norvegicus
tttgcttacttgcttg

SEQ ID NO: 533045 - DNA, 16 bp, R. norvegicus
tttgcttcagttcctg

SEQ ID NO: 533046 - DNA, 16 bp, R. norvegicus
tttgcttcatctgtct

SEQ ID NO: 533047 - DNA, 16 bp, R. norvegicus
tttgcttcccctggct

SEQ ID NO: 533048 - DNA, 16 bp, R. norvegicus
tttgcttcctgttgct

SEQ ID NO: 533049 - DNA, 16 bp, R. norvegicus
tttgcttgcttgcttg

SEQ ID NO: 533050 - DNA, 16 bp, R. norvegicus
tttgcttggaaaaaat

SEQ ID NO: 533051 - DNA, 16 bp, R. norvegicus
tttgcttgtaaaattg

SEQ ID NO: 533052 - DNA, 16 bp, R. norvegicus
tttgcttgtcttgctg

SEQ ID NO: 533053 - DNA, 16 bp, R. norvegicus
tttgctttccaaagct

SEQ ID NO: 533054 - DNA, 16 bp, R. norvegicus
tttgctttcctgggtt

SEQ ID NO: 533055 - DNA, 16 bp, R. norvegicus
tttgctttgatgggag

SEQ ID NO: 533056 - DNA, 16 bp, R. norvegicus
tttgcttttggcaaaa

SEQ ID NO: 533057 - DNA, 16 bp, R. norvegicus
tttggaaaaaagtttc

SEQ ID NO: 533058 - DNA, 16 bp, R. norvegicus
tttggaaaaagaaaag

SEQ ID NO: 533059 - DNA, 16 bp, R. norvegicus
tttggaaaagaagaag

SEQ ID NO: 533060 - DNA, 16 bp, R. norvegicus
tttggaaaagatcttc

SEQ ID NO: 533061 - DNA, 16 bp, R. norvegicus
tttggaaagcagtgga

SEQ ID NO: 533062 - DNA, 16 bp, R. norvegicus
tttggaacaacaaaaa

SEQ ID NO: 533063 - DNA, 16 bp, R. norvegicus
tttggaagaatgtgaa

SEQ ID NO: 533064 - DNA, 16 bp, R. norvegicus
tttggaagagcaacaa

SEQ ID NO: 533065 - DNA, 16 bp, R. norvegicus
tttggaataatatcca

SEQ ID NO: 533066 - DNA, 16 bp, R. norvegicus
tttggaataatgaaaa

SEQ ID NO: 533067 - DNA, 16 bp, R. norvegicus
tttggaatagcaaaaa

SEQ ID NO: 533068 - DNA, 16 bp, R. norvegicus
tttggaataggtgtgg

SEQ ID NO: 533069 - DNA, 16 bp, R. norvegicus
tttggacaaacttttt

SEQ ID NO: 533070 - DNA, 16 bp, R. norvegicus
tttggacacactctat

SEQ ID NO: 533071 - DNA, 16 bp, R. norvegicus
tttggacctgtcactg

SEQ ID NO: 533072 - DNA, 16 bp, R. norvegicus
tttggagaaaaagaaa

SEQ ID NO: 533073 - DNA, 16 bp, R. norvegicus
tttggagaaagaaatt

SEQ ID NO: 533074 - DNA, 16 bp, R. norvegicus
tttggagacaggatct

SEQ ID NO: 533075 - DNA, 16 bp, R. norvegicus
tttggagagaagaaag

SEQ ID NO: 533076 - DNA, 16 bp, R. norvegicus
tttggagagagaagaa

SEQ ID NO: 533077 - DNA, 16 bp, R. norvegicus
tttggagagcaatttt

SEQ ID NO: 533078 - DNA, 16 bp, R. norvegicus
tttggagccctgtctt

SEQ ID NO: 533079 - DNA, 16 bp, R. norvegicus
tttggagctggagacc

SEQ ID NO: 533080 - DNA, 17 bp, R. norvegicus
tttggagctggggacca

SEQ ID NO: 533081 - DNA, 16 bp, R. norvegicus
tttggagctgggggcc

SEQ ID NO: 533082 - DNA, 16 bp, R. norvegicus
tttggaggaactcaga

SEQ ID NO: 533083 - DNA, 16 bp, R. norvegicus
tttggaggaagaggag

SEQ ID NO: 533084 - DNA, 16 bp, R. norvegicus
tttggaggaatgtaga

SEQ ID NO: 533085 - DNA, 16 bp, R. norvegicus
tttggaggcactcaca

SEQ ID NO: 533086 - DNA, 16 bp, R. norvegicus
tttggaggcaggagct

SEQ ID NO: 533087 - DNA, 16 bp, R. norvegicus
tttggaggccagaaga

SEQ ID NO: 533088 - DNA, 16 bp, R. norvegicus
tttggaggctgtatat

SEQ ID NO: 533089 - DNA, 16 bp, R. norvegicus
tttggagtttgcccag

SEQ ID NO: 533090 - DNA, 16 bp, R. norvegicus
tttggagttttgtaga

SEQ ID NO: 533091 - DNA, 16 bp, R. norvegicus
tttggatatgctctct

SEQ ID NO: 533092 - DNA, 16 bp, R. norvegicus
tttggatcttaaatgt

SEQ ID NO: 533093 - DNA, 16 bp, R. norvegicus
tttggatgaagatgta

SEQ ID NO: 533094 - DNA, 16 bp, R. norvegicus
tttggatgaagtcatt

SEQ ID NO: 533095 - DNA, 16 bp, R. norvegicus
tttggatgagaatgac

SEQ ID NO: 533096 - DNA, 16 bp, R. norvegicus
tttggatgttccatgt

SEQ ID NO: 533097 - DNA, 16 bp, R. norvegicus
tttggatttaaaacca

SEQ ID NO: 533098 - DNA, 16 bp, R. norvegicus
tttggatttgaaatca

SEQ ID NO: 533099 - DNA, 16 bp, R. norvegicus
tttggcaaaatggaaa

SEQ ID NO: 533100 - DNA, 16 bp, R. norvegicus
tttggcaacagcatga

SEQ ID NO: 533101 - DNA, 16 bp, R. norvegicus
tttggcaagtttctct

SEQ ID NO: 533102 - DNA, 16 bp, R. norvegicus
tttggcagcaagtacc

SEQ ID NO: 533103 - DNA, 16 bp, R. norvegicus
tttggccatgaatccc

SEQ ID NO: 533104 - DNA, 16 bp, R. norvegicus
tttggccccacccttc

SEQ ID NO: 533105 - DNA, 16 bp, R. norvegicus
tttggccctgagtttg

SEQ ID NO: 533106 - DNA, 16 bp, R. norvegicus
tttggctcagtggtta

SEQ ID NO: 533107 - DNA, 16 bp, R. norvegicus
tttggctcccagaacc

SEQ ID NO: 533108 - DNA, 16 bp, R. norvegicus
tttggctctccctccc

SEQ ID NO: 533109 - DNA, 17 bp, R. norvegicus
tttggctgcagcaagga

SEQ ID NO: 533110 - DNA, 16 bp, R. norvegicus
tttggctgccctggaa

SEQ ID NO: 533111 - DNA, 16 bp, R. norvegicus
tttggcttacagttca

SEQ ID NO: 533112 - DNA, 16 bp, R. norvegicus
tttggcttttaaaaat

SEQ ID NO: 533113 - DNA, 16 bp, R. norvegicus
tttggctttttggata

SEQ ID NO: 533114 - DNA, 17 bp, R. norvegicus
tttggctttttggataa

SEQ ID NO: 533115 - DNA, 16 bp, R. norvegicus
tttgggaaaatatttt

SEQ ID NO: 533116 - DNA, 16 bp, R. norvegicus
tttgggaacagggagc

SEQ ID NO: 533117 - DNA, 16 bp, R. norvegicus
tttgggaagaggaaac

SEQ ID NO: 533118 - DNA, 16 bp, R. norvegicus
tttgggaaggattaag

SEQ ID NO: 533119 - DNA, 16 bp, R. norvegicus
tttgggaaggatttgg

SEQ ID NO: 533120 - DNA, 16 bp, R. norvegicus
tttgggaattggttct

SEQ ID NO: 533121 - DNA, 16 bp, R. norvegicus
tttgggactactgtga

SEQ ID NO: 533122 - DNA, 16 bp, R. norvegicus
tttgggagaaaaaaat

SEQ ID NO: 533123 - DNA, 16 bp, R. norvegicus
tttgggagaattttat

SEQ ID NO: 533124 - DNA, 16 bp, R. norvegicus
tttgggagggggaaca

SEQ ID NO: 533125 - DNA, 16 bp, R. norvegicus
tttgggctaacagcca

SEQ ID NO: 533126 - DNA, 16 bp, R. norvegicus
tttgggcttttgaaac

SEQ ID NO: 533127 - DNA, 16 bp, R. norvegicus
tttggggaagcagaag

SEQ ID NO: 533128 - DNA, 16 bp, R. norvegicus
tttggggactggagag

SEQ ID NO: 533129 - DNA, 16 bp, R. norvegicus
tttggggagagcagat

SEQ ID NO: 533130 - DNA, 16 bp, R. norvegicus
tttggggcaattccaa

SEQ ID NO: 533131 - DNA, 23 bp, R. norvegicus
tttggggcatcttttgggtatat

SEQ ID NO: 533132 - DNA, 16 bp, R. norvegicus
tttgggggactggaga

SEQ ID NO: 533133 - DNA, 16 bp, R. norvegicus
tttgggtagaaggttt

SEQ ID NO: 533134 - DNA, 16 bp, R. norvegicus
tttgggtagtggttta

SEQ ID NO: 533135 - DNA, 16 bp, R. norvegicus
tttgggtataaaatta

SEQ ID NO: 533136 - DNA, 16 bp, R. norvegicus
tttgggtctgtggact

SEQ ID NO: 533137 - DNA, 16 bp, R. norvegicus
tttggtaaagaatgtg

SEQ ID NO: 533138 - DNA, 16 bp, R. norvegicus
tttggtcacagcaatg

SEQ ID NO: 533139 - DNA, 16 bp, R. norvegicus
tttggtcttctcattg

SEQ ID NO: 533140 - DNA, 16 bp, R. norvegicus
tttggtctttcagttt

SEQ ID NO: 533141 - DNA, 16 bp, R. norvegicus
tttggtgaaccaatga

SEQ ID NO: 533142 - DNA, 16 bp, R. norvegicus
tttggtgactgcatgt

SEQ ID NO: 533143 - DNA, 16 bp, R. norvegicus
tttggtgcatttctct

SEQ ID NO: 533144 - DNA, 16 bp, R. norvegicus
tttggtggatttttaa

SEQ ID NO: 533145 - DNA, 16 bp, R. norvegicus
tttggtggctgtattt

SEQ ID NO: 533146 - DNA, 16 bp, R. norvegicus
tttggtgggagaactg

SEQ ID NO: 533147 - DNA, 16 bp, R. norvegicus
tttggtgggagaatgg

SEQ ID NO: 533148 - DNA, 16 bp, R. norvegicus
tttggtgggggaactg

SEQ ID NO: 533149 - DNA, 16 bp, R. norvegicus
tttggttatattttcc

SEQ ID NO: 533150 - DNA, 16 bp, R. norvegicus
tttggttcagtttggt

SEQ ID NO: 533151 - DNA, 16 bp, R. norvegicus
tttggttcccagcacc

SEQ ID NO: 533152 - DNA, 16 bp, R. norvegicus
tttggttcctagcacc

SEQ ID NO: 533153 - DNA, 16 bp, R. norvegicus
tttggttctcagcacc

SEQ ID NO: 533154 - DNA, 16 bp, R. norvegicus
tttggttggaagacct

SEQ ID NO: 533155 - DNA, 16 bp, R. norvegicus
tttggttgggagactc

SEQ ID NO: 533156 - DNA, 16 bp, R. norvegicus
tttggttgggagactt

SEQ ID NO: 533157 - DNA, 16 bp, R. norvegicus
tttggttgtgggtctc

SEQ ID NO: 533158 - DNA, 16 bp, R. norvegicus
tttggtttcattgaaa

SEQ ID NO: 533159 - DNA, 16 bp, R. norvegicus
tttggtttctgtatat

SEQ ID NO: 533160 - DNA, 16 bp, R. norvegicus
tttggtttctttgaaa

SEQ ID NO: 533161 - DNA, 16 bp, R. norvegicus
tttggttttcaagaat

SEQ ID NO: 533162 - DNA, 16 bp, R. norvegicus
tttggttttctacatc

SEQ ID NO: 533163 - DNA, 16 bp, R. norvegicus
tttggtttttcgagac

SEQ ID NO: 533164 - DNA, 16 bp, R. norvegicus
tttggtttttgactat

SEQ ID NO: 533165 - DNA, 16 bp, R. norvegicus
tttggttttttcatgg

SEQ ID NO: 533166 - DNA, 16 bp, R. norvegicus
tttgtaaaaacagcat

SEQ ID NO: 533167 - DNA, 16 bp, R. norvegicus
tttgtaaaggacaaca

SEQ ID NO: 533168 - DNA, 16 bp, R. norvegicus
tttgtaacaaaacaaa

SEQ ID NO: 533169 - DNA, 16 bp, R. norvegicus
tttgtaagcacaaaca

SEQ ID NO: 533170 - DNA, 16 bp, R. norvegicus
tttgtacatattttat

SEQ ID NO: 533171 - DNA, 16 bp, R. norvegicus
tttgtagaaagaaaca

SEQ ID NO: 533172 - DNA, 16 bp, R. norvegicus
tttgtagaacattcta

SEQ ID NO: 533173 - DNA, 16 bp, R. norvegicus
tttgtagaccaaactg

SEQ ID NO: 533174 - DNA, 16 bp, R. norvegicus
tttgtagaccaggctg

SEQ ID NO: 533175 - DNA, 16 bp, R. norvegicus
tttgtagaccatgctg

SEQ ID NO: 533176 - DNA, 16 bp, R. norvegicus
tttgtaggaaaataga

SEQ ID NO: 533177 - DNA, 16 bp, R. norvegicus
tttgtataaagatatt

SEQ ID NO: 533178 - DNA, 16 bp, R. norvegicus
tttgtatagataaact

SEQ ID NO: 533179 - DNA, 16 bp, R. norvegicus
tttgtatatgcttggc

SEQ ID NO: 533180 - DNA, 16 bp, R. norvegicus
tttgtatctgtttaaa

SEQ ID NO: 533181 - DNA, 16 bp, R. norvegicus
tttgtattctgatgtt

SEQ ID NO: 533182 - DNA, 16 bp, R. norvegicus
tttgtattcttgtaca

SEQ ID NO: 533183 - DNA, 16 bp, R. norvegicus
tttgtattttgaaaca

SEQ ID NO: 533184 - DNA, 16 bp, R. norvegicus
tttgtcaaaagtcagg

SEQ ID NO: 533185 - DNA, 16 bp, R. norvegicus
tttgtcaaagaagcca

SEQ ID NO: 533186 - DNA, 16 bp, R. norvegicus
tttgtcaagttctggc

SEQ ID NO: 533187 - DNA, 16 bp, R. norvegicus
tttgtcacagccacag

SEQ ID NO: 533188 - DNA, 16 bp, R. norvegicus
tttgtcacagtgacaa

SEQ ID NO: 533189 - DNA, 16 bp, R. norvegicus
tttgtcagtaaagaag

SEQ ID NO: 533190 - DNA, 16 bp, R. norvegicus
tttgtcagtgttttct

SEQ ID NO: 533191 - DNA, 16 bp, R. norvegicus
tttgtcatagcaacag

SEQ ID NO: 533192 - DNA, 16 bp, R. norvegicus
tttgtcatagcaataa

SEQ ID NO: 533193 - DNA, 21 bp, R. norvegicus
tttgtcatcacagagattttg

SEQ ID NO: 533194 - DNA, 16 bp, R. norvegicus
tttgtcatggaatata

SEQ ID NO: 533195 - DNA, 16 bp, R. norvegicus
tttgtcattaaaaaaa

SEQ ID NO: 533196 - DNA, 16 bp, R. norvegicus
tttgtccctgcatttc

SEQ ID NO: 533197 - DNA, 64 bp, R. norvegicus
tttgtcctaaccacagtgtcctttgccttacagaagctttgcagttttatgagatcccatttgt

SEQ ID NO: 533198 - DNA, 16 bp, R. norvegicus
tttgtctacatagtga

SEQ ID NO: 533199 - DNA, 16 bp, R. norvegicus
tttgtctccttgcagt

SEQ ID NO: 533200 - DNA, 16 bp, R. norvegicus
tttgtctctgagctgt

SEQ ID NO: 533201 - DNA, 16 bp, R. norvegicus
tttgtctgcatttatg

SEQ ID NO: 533202 - DNA, 16 bp, R. norvegicus
tttgtctgtagatgaa

SEQ ID NO: 533203 - DNA, 16 bp, R. norvegicus
tttgtctgtctctgtc

SEQ ID NO: 533204 - DNA, 16 bp, R. norvegicus
tttgtcttacacttcc

SEQ ID NO: 533205 - DNA, 16 bp, R. norvegicus
tttgtcttcagacaca

SEQ ID NO: 533206 - DNA, 16 bp, R. norvegicus
tttgtcttttgaaaat

SEQ ID NO: 533207 - DNA, 16 bp, R. norvegicus
tttgtgaaagaaaaaa

SEQ ID NO: 533208 - DNA, 16 bp, R. norvegicus
tttgtgacctattata

SEQ ID NO: 533209 - DNA, 16 bp, R. norvegicus
tttgtgagaattatat

SEQ ID NO: 533210 - DNA, 16 bp, R. norvegicus
tttgtgatagccagaa

SEQ ID NO: 533211 - DNA, 16 bp, R. norvegicus
tttgtgatgggtgtga

SEQ ID NO: 533212 - DNA, 16 bp, R. norvegicus
tttgtgattattgtaa

SEQ ID NO: 533213 - DNA, 16 bp, R. norvegicus
tttgtgcagcaagcac

SEQ ID NO: 533214 - DNA, 16 bp, R. norvegicus
tttgtgctcttaacca

SEQ ID NO: 533215 - DNA, 16 bp, R. norvegicus
tttgtgctgcccatgt

SEQ ID NO: 533216 - DNA, 16 bp, R. norvegicus
tttgtgctttctgtat

SEQ ID NO: 533217 - DNA, 16 bp, R. norvegicus
tttgtggaccaggctg

SEQ ID NO: 533218 - DNA, 16 bp, R. norvegicus
tttgtggagcagaagg

SEQ ID NO: 533219 - DNA, 16 bp, R. norvegicus
tttgtggctgtatgta

SEQ ID NO: 533220 - DNA, 16 bp, R. norvegicus
tttgtggtctgtgctg

SEQ ID NO: 533221 - DNA, 16 bp, R. norvegicus
tttgtgtatgtctgtg

SEQ ID NO: 533222 - DNA, 16 bp, R. norvegicus
tttgtgtcctttcatt

SEQ ID NO: 533223 - DNA, 16 bp, R. norvegicus
tttgtgtctcctctcc

SEQ ID NO: 533224 - DNA, 16 bp, R. norvegicus
tttgtgtgcttttcat

SEQ ID NO: 533225 - DNA, 16 bp, R. norvegicus
tttgtgtgtgactgtg

SEQ ID NO: 533226 - DNA, 16 bp, R. norvegicus
tttgtgtgtgagcatg

SEQ ID NO: 533227 - DNA, 47 bp, R. norvegicus
tttgtgtttttccgcagaatcaagaaaatccaatttgggtacctgag

SEQ ID NO: 533228 - DNA, 16 bp, R. norvegicus
tttgttaaaaaacaaa

SEQ ID NO: 533229 - DNA, 16 bp, R. norvegicus
tttgttaaaaatcaaa

SEQ ID NO: 533230 - DNA, 16 bp, R. norvegicus
tttgttaaagtcacac

SEQ ID NO: 533231 - DNA, 16 bp, R. norvegicus
tttgttaaatccattt

SEQ ID NO: 533232 - DNA, 16 bp, R. norvegicus
tttgttaatgcaatta

SEQ ID NO: 533233 - DNA, 16 bp, R. norvegicus
tttgttattcctcagt

SEQ ID NO: 533234 - DNA, 16 bp, R. norvegicus
tttgttcaacttgttg

SEQ ID NO: 533235 - DNA, 16 bp, R. norvegicus
tttgttcagggaattt

SEQ ID NO: 533236 - DNA, 16 bp, R. norvegicus
tttgttcagtgtttta

SEQ ID NO: 533237 - DNA, 16 bp, R. norvegicus
tttgttcccccttcca

SEQ ID NO: 533238 - DNA, 16 bp, R. norvegicus
tttgttcctgcagttc

SEQ ID NO: 533239 - DNA, 16 bp, R. norvegicus
tttgttccttcttcta

SEQ ID NO: 533240 - DNA, 16 bp, R. norvegicus
tttgttctaaagcttt

SEQ ID NO: 533241 - DNA, 16 bp, R. norvegicus
tttgttctagggatct

SEQ ID NO: 533242 - DNA, 16 bp, R. norvegicus
tttgttctcttaggat

SEQ ID NO: 533243 - DNA, 16 bp, R. norvegicus
tttgttctttgacaat

SEQ ID NO: 533244 - DNA, 16 bp, R. norvegicus
tttgttcttttgtgac

SEQ ID NO: 533245 - DNA, 16 bp, R. norvegicus
tttgttgaaaatattc

SEQ ID NO: 533246 - DNA, 16 bp, R. norvegicus
tttgttgaagacattt

SEQ ID NO: 533247 - DNA, 16 bp, R. norvegicus
tttgttgaagatgctg

SEQ ID NO: 533248 - DNA, 16 bp, R. norvegicus
tttgttgaatatgcca

SEQ ID NO: 533249 - DNA, 16 bp, R. norvegicus
tttgttgaggatattt

SEQ ID NO: 533250 - DNA, 16 bp, R. norvegicus
tttgttgccaagacca

SEQ ID NO: 533251 - DNA, 16 bp, R. norvegicus
tttgttgccaaggtaa

SEQ ID NO: 533252 - DNA, 16 bp, R. norvegicus
tttgttgctggaggtg

SEQ ID NO: 533253 - DNA, 16 bp, R. norvegicus
tttgttggaaaaaaaa

SEQ ID NO: 533254 - DNA, 16 bp, R. norvegicus
tttgttgtgactttgt

SEQ ID NO: 533255 - DNA, 16 bp, R. norvegicus
tttgttgttttaaaac

SEQ ID NO: 533256 - DNA, 16 bp, R. norvegicus
tttgtttacttttcaa

SEQ ID NO: 533257 - DNA, 16 bp, R. norvegicus
tttgtttagccctgaa

SEQ ID NO: 533258 - DNA, 16 bp, R. norvegicus
tttgtttattcattca

SEQ ID NO: 533259 - DNA, 16 bp, R. norvegicus
tttgtttcaaaacaaa

SEQ ID NO: 533260 - DNA, 16 bp, R. norvegicus
tttgtttcaaaaggtt

SEQ ID NO: 533261 - DNA, 16 bp, R. norvegicus
tttgtttcaaagaaaa

SEQ ID NO: 533262 - DNA, 16 bp, R. norvegicus
tttgtttcaagaagat

SEQ ID NO: 533263 - DNA, 16 bp, R. norvegicus
tttgtttccatatctc

SEQ ID NO: 533264 - DNA, 16 bp, R. norvegicus
tttgtttccccagtgt

SEQ ID NO: 533265 - DNA, 16 bp, R. norvegicus
tttgtttctttctcag

SEQ ID NO: 533266 - DNA, 16 bp, R. norvegicus
tttgtttgaattcctg

SEQ ID NO: 533267 - DNA, 16 bp, R. norvegicus
tttgtttgagaaaagg

SEQ ID NO: 533268 - DNA, 16 bp, R. norvegicus
tttgtttgagaaagga

SEQ ID NO: 533269 - DNA, 16 bp, R. norvegicus
tttgtttgcatgtatg

SEQ ID NO: 533270 - DNA, 16 bp, R. norvegicus
tttgtttgcatttcaa

SEQ ID NO: 533271 - DNA, 16 bp, R. norvegicus
tttgtttgctcatggc

SEQ ID NO: 533272 - DNA, 16 bp, R. norvegicus
tttgtttgttgagaca

SEQ ID NO: 533273 - DNA, 16 bp, R. norvegicus
tttgtttgtttaaaga

SEQ ID NO: 533274 - DNA, 16 bp, R. norvegicus
tttgttttaaaaggaa

SEQ ID NO: 533275 - DNA, 16 bp, R. norvegicus
tttgttttaaaattca

SEQ ID NO: 533276 - DNA, 16 bp, R. norvegicus
tttgttttagagacag

SEQ ID NO: 533277 - DNA, 16 bp, R. norvegicus
tttgttttcagaataa

SEQ ID NO: 533278 - DNA, 16 bp, R. norvegicus
tttgttttcagatgaa

SEQ ID NO: 533279 - DNA, 16 bp, R. norvegicus
tttgttttcattaaat

SEQ ID NO: 533280 - DNA, 16 bp, R. norvegicus
tttgttttctttgaaa

SEQ ID NO: 533281 - DNA, 16 bp, R. norvegicus
tttgttttgagaaaag

SEQ ID NO: 533282 - DNA, 16 bp, R. norvegicus
tttgttttgctttgag

SEQ ID NO: 533283 - DNA, 16 bp, R. norvegicus
tttgttttggggtgaa

SEQ ID NO: 533284 - DNA, 16 bp, R. norvegicus
tttgttttgtgagata

SEQ ID NO: 533285 - DNA, 16 bp, R. norvegicus
tttgtttttaaaaaga

SEQ ID NO: 533286 - DNA, 16 bp, R. norvegicus
tttgtttttaaagcag

SEQ ID NO: 533287 - DNA, 16 bp, R. norvegicus
tttgtttttaacaaag

SEQ ID NO: 533288 - DNA, 16 bp, R. norvegicus
tttgtttttaacatgg

SEQ ID NO: 533289 - DNA, 16 bp, R. norvegicus
tttgtttttaaggaat

SEQ ID NO: 533290 - DNA, 16 bp, R. norvegicus
tttgtttttctgaaag

SEQ ID NO: 533291 - DNA, 16 bp, R. norvegicus
tttgtttttgagaaag

SEQ ID NO: 533292 - DNA, 16 bp, R. norvegicus
tttgtttttggagctg

SEQ ID NO: 533293 - DNA, 16 bp, R. norvegicus
tttgttttttgagaca

SEQ ID NO: 533294 - DNA, 16 bp, R. norvegicus
ttttaaaaaaaaagtc

SEQ ID NO: 533295 - DNA, 16 bp, R. norvegicus
ttttaaaaaaagcaac

SEQ ID NO: 533296 - DNA, 16 bp, R. norvegicus
ttttaaaaaaaggaca

SEQ ID NO: 533297 - DNA, 16 bp, R. norvegicus
ttttaaaaaaagttca

SEQ ID NO: 533298 - DNA, 16 bp, R. norvegicus
ttttaaaaaactgttt

SEQ ID NO: 533299 - DNA, 16 bp, R. norvegicus
ttttaaaaaagacaag

SEQ ID NO: 533300 - DNA, 16 bp, R. norvegicus
ttttaaaaaagggaaa

SEQ ID NO: 533301 - DNA, 16 bp, R. norvegicus
ttttaaaaaattacag

SEQ ID NO: 533302 - DNA, 16 bp, R. norvegicus
ttttaaaaacaagttt

SEQ ID NO: 533303 - DNA, 16 bp, R. norvegicus
ttttaaaaacagtatt

SEQ ID NO: 533304 - DNA, 16 bp, R. norvegicus
ttttaaaaacctcaaa

SEQ ID NO: 533305 - DNA, 16 bp, R. norvegicus
ttttaaaaactaactt

SEQ ID NO: 533306 - DNA, 16 bp, R. norvegicus
ttttaaaaactacttt

SEQ ID NO: 533307 - DNA, 16 bp, R. norvegicus
ttttaaaaactgtttt

SEQ ID NO: 533308 - DNA, 16 bp, R. norvegicus
ttttaaaaagaaaaca

SEQ ID NO: 533309 - DNA, 16 bp, R. norvegicus
ttttaaaaagagaatt

SEQ ID NO: 533310 - DNA, 16 bp, R. norvegicus
ttttaaaaagaggaat

SEQ ID NO: 533311 - DNA, 16 bp, R. norvegicus
ttttaaaaagcagaga

SEQ ID NO: 533312 - DNA, 16 bp, R. norvegicus
ttttaaaaagcagttt

SEQ ID NO: 533313 - DNA, 16 bp, R. norvegicus
ttttaaaaaggaaaag

SEQ ID NO: 533314 - DNA, 16 bp, R. norvegicus
ttttaaaaaggaacaa

SEQ ID NO: 533315 - DNA, 16 bp, R. norvegicus
ttttaaaaagggaaag

SEQ ID NO: 533316 - DNA, 16 bp, R. norvegicus
ttttaaaaagtaagtt

SEQ ID NO: 533317 - DNA, 16 bp, R. norvegicus
ttttaaaaagtcaaat

SEQ ID NO: 533318 - DNA, 16 bp, R. norvegicus
ttttaaaaagtctaaa

SEQ ID NO: 533319 - DNA, 16 bp, R. norvegicus
ttttaaaaagttgaaa

SEQ ID NO: 533320 - DNA, 16 bp, R. norvegicus
ttttaaaaagttgatt

SEQ ID NO: 533321 - DNA, 16 bp, R. norvegicus
ttttaaaaagttgtta

SEQ ID NO: 533322 - DNA, 16 bp, R. norvegicus
ttttaaaaataacact

SEQ ID NO: 533323 - DNA, 16 bp, R. norvegicus
ttttaaaaatcaattc

SEQ ID NO: 533324 - DNA, 16 bp, R. norvegicus
ttttaaaaatcagttt

SEQ ID NO: 533325 - DNA, 16 bp, R. norvegicus
ttttaaaaatctactt

SEQ ID NO: 533326 - DNA, 16 bp, R. norvegicus
ttttaaaaatgaaaca

SEQ ID NO: 533327 - DNA, 16 bp, R. norvegicus
ttttaaaaatgaaact

SEQ ID NO: 533328 - DNA, 16 bp, R. norvegicus
ttttaaaaatgtagtt

SEQ ID NO: 533329 - DNA, 16 bp, R. norvegicus
ttttaaaaatgtatct

SEQ ID NO: 533330 - DNA, 16 bp, R. norvegicus
ttttaaaaattcaaag

SEQ ID NO: 533331 - DNA, 16 bp, R. norvegicus
ttttaaaacatgtctt

SEQ ID NO: 533332 - DNA, 16 bp, R. norvegicus
ttttaaaacatttatc

SEQ ID NO: 533333 - DNA, 16 bp, R. norvegicus
ttttaaaactgtattt

SEQ ID NO: 533334 - DNA, 16 bp, R. norvegicus
ttttaaaagaaagcat

SEQ ID NO: 533335 - DNA, 16 bp, R. norvegicus
ttttaaaagacaaatt

SEQ ID NO: 533336 - DNA, 16 bp, R. norvegicus
ttttaaaagagacttt

SEQ ID NO: 533337 - DNA, 16 bp, R. norvegicus
ttttaaaagatgttaa

SEQ ID NO: 533338 - DNA, 16 bp, R. norvegicus
ttttaaaagcatatat

SEQ ID NO: 533339 - DNA, 16 bp, R. norvegicus
ttttaaaagcattaaa

SEQ ID NO: 533340 - DNA, 16 bp, R. norvegicus
ttttaaaagctatttt

SEQ ID NO: 533341 - DNA, 16 bp, R. norvegicus
ttttaaaagggaaaaa

SEQ ID NO: 533342 - DNA, 16 bp, R. norvegicus
ttttaaaagtgaaaat

SEQ ID NO: 533343 - DNA, 16 bp, R. norvegicus
ttttaaaagtgaaata

SEQ ID NO: 533344 - DNA, 16 bp, R. norvegicus
ttttaaaagtgaaatt

SEQ ID NO: 533345 - DNA, 16 bp, R. norvegicus
ttttaaaagttcttaa

SEQ ID NO: 533346 - DNA, 16 bp, R. norvegicus
ttttaaaataaaagct

SEQ ID NO: 533347 - DNA, 16 bp, R. norvegicus
ttttaaaatagaaaac

SEQ ID NO: 533348 - DNA, 16 bp, R. norvegicus
ttttaaaatatgaaac

SEQ ID NO: 533349 - DNA, 16 bp, R. norvegicus
ttttaaaatatgcttt

SEQ ID NO: 533350 - DNA, 16 bp, R. norvegicus
ttttaaaatcaacttt

SEQ ID NO: 533351 - DNA, 16 bp, R. norvegicus
ttttaaaatcacaatt

SEQ ID NO: 533352 - DNA, 16 bp, R. norvegicus
ttttaaaatcatgttt

SEQ ID NO: 533353 - DNA, 16 bp, R. norvegicus
ttttaaaatgagaaac

SEQ ID NO: 533354 - DNA, 16 bp, R. norvegicus
ttttaaaatgcttttt

SEQ ID NO: 533355 - DNA, 16 bp, R. norvegicus
ttttaaaatggtttct

SEQ ID NO: 533356 - DNA, 16 bp, R. norvegicus
ttttaaaatgtgcttt

SEQ ID NO: 533357 - DNA, 16 bp, R. norvegicus
ttttaaaattactttg

SEQ ID NO: 533358 - DNA, 16 bp, R. norvegicus
ttttaaaattcagtct

SEQ ID NO: 533359 - DNA, 16 bp, R. norvegicus
ttttaaaattcccttt

SEQ ID NO: 533360 - DNA, 16 bp, R. norvegicus
ttttaaaattctgtct

SEQ ID NO: 533361 - DNA, 16 bp, R. norvegicus
ttttaaaattgcattt

SEQ ID NO: 533362 - DNA, 16 bp, R. norvegicus
ttttaaaattttctgt

SEQ ID NO: 533363 - DNA, 16 bp, R. norvegicus
ttttaaacaaaatcat

SEQ ID NO: 533364 - DNA, 16 bp, R. norvegicus
ttttaaactttaaaca

SEQ ID NO: 533365 - DNA, 16 bp, R. norvegicus
ttttaaagaaaaactt

SEQ ID NO: 533366 - DNA, 16 bp, R. norvegicus
ttttaaagaaaaagtg

SEQ ID NO: 533367 - DNA, 16 bp, R. norvegicus
ttttaaagaaaagcaa

SEQ ID NO: 533368 - DNA, 16 bp, R. norvegicus
ttttaaagaaaatcat

SEQ ID NO: 533369 - DNA, 16 bp, R. norvegicus
ttttaaagaaaccaaa

SEQ ID NO: 533370 - DNA, 16 bp, R. norvegicus
ttttaaagaagagaaa

SEQ ID NO: 533371 - DNA, 16 bp, R. norvegicus
ttttaaagaaggaaag

SEQ ID NO: 533372 - DNA, 16 bp, R. norvegicus
ttttaaagaaggcatg

SEQ ID NO: 533373 - DNA, 16 bp, R. norvegicus
ttttaaagacaaaaac

SEQ ID NO: 533374 - DNA, 16 bp, R. norvegicus
ttttaaagagaagttt

SEQ ID NO: 533375 - DNA, 16 bp, R. norvegicus
ttttaaagcatatttt

SEQ ID NO: 533376 - DNA, 16 bp, R. norvegicus
ttttaaaggaagattt

SEQ ID NO: 533377 - DNA, 16 bp, R. norvegicus
ttttaaagtgagtttt

SEQ ID NO: 533378 - DNA, 16 bp, R. norvegicus
ttttaaagtttgaaaa

SEQ ID NO: 533379 - DNA, 16 bp, R. norvegicus
ttttaaataaatgaga

SEQ ID NO: 533380 - DNA, 16 bp, R. norvegicus
ttttaaataacagaat

SEQ ID NO: 533381 - DNA, 16 bp, R. norvegicus
ttttaaatgagaattt

SEQ ID NO: 533382 - DNA, 16 bp, R. norvegicus
ttttaaatgtaaagaa

SEQ ID NO: 533383 - DNA, 16 bp, R. norvegicus
ttttaaatgtaaatga

SEQ ID NO: 533384 - DNA, 16 bp, R. norvegicus
ttttaaatgtttcaaa

SEQ ID NO: 533385 - DNA, 16 bp, R. norvegicus
ttttaaattccttcaa

SEQ ID NO: 533386 - DNA, 16 bp, R. norvegicus
ttttaaatttcagatt

SEQ ID NO: 533387 - DNA, 16 bp, R. norvegicus
ttttaaatttccaaat

SEQ ID NO: 533388 - DNA, 16 bp, R. norvegicus
ttttaacttttagaaa

SEQ ID NO: 533389 - DNA, 16 bp, R. norvegicus
ttttaagaaatcaaaa

SEQ ID NO: 533390 - DNA, 16 bp, R. norvegicus
ttttaagaaatgaaat

SEQ ID NO: 533391 - DNA, 16 bp, R. norvegicus
ttttaagaagcactga

SEQ ID NO: 533392 - DNA, 16 bp, R. norvegicus
ttttaagactttattt

SEQ ID NO: 533393 - DNA, 16 bp, R. norvegicus
ttttaagagagagaga

SEQ ID NO: 533394 - DNA, 16 bp, R. norvegicus
ttttaagatgaaattt

SEQ ID NO: 533395 - DNA, 16 bp, R. norvegicus
ttttaagcattttatt

SEQ ID NO: 533396 - DNA, 16 bp, R. norvegicus
ttttaagcctaaaatc

SEQ ID NO: 533397 - DNA, 16 bp, R. norvegicus
ttttaaggaaaatatt

SEQ ID NO: 533398 - DNA, 16 bp, R. norvegicus
ttttaataaaatggaa

SEQ ID NO: 533399 - DNA, 16 bp, R. norvegicus
ttttaataagatccag

SEQ ID NO: 533400 - DNA, 16 bp, R. norvegicus
ttttaataagcaaata

SEQ ID NO: 533401 - DNA, 16 bp, R. norvegicus
ttttaatcactgcttc

SEQ ID NO: 533402 - DNA, 16 bp, R. norvegicus
ttttaatcccagcact

SEQ ID NO: 533403 - DNA, 16 bp, R. norvegicus
ttttaatctgaaaaaa

SEQ ID NO: 533404 - DNA, 16 bp, R. norvegicus
ttttaatgagaaattt

SEQ ID NO: 533405 - DNA, 16 bp, R. norvegicus
ttttaatgctttaaaa

SEQ ID NO: 533406 - DNA, 16 bp, R. norvegicus
ttttaatgggattgct

SEQ ID NO: 533407 - DNA, 16 bp, R. norvegicus
ttttaatgggattgtt

SEQ ID NO: 533408 - DNA, 16 bp, R. norvegicus
ttttaattcagtttta

SEQ ID NO: 533409 - DNA, 16 bp, R. norvegicus
ttttaatttcaaaaca

SEQ ID NO: 533410 - DNA, 16 bp, R. norvegicus
ttttaattttctgaga

SEQ ID NO: 533411 - DNA, 16 bp, R. norvegicus
ttttacaaaaatgttt

SEQ ID NO: 533412 - DNA, 16 bp, R. norvegicus
ttttacaaaagaaaaa

SEQ ID NO: 533413 - DNA, 16 bp, R. norvegicus
ttttacaaataaactt

SEQ ID NO: 533414 - DNA, 16 bp, R. norvegicus
ttttacaaattaaatg

SEQ ID NO: 533415 - DNA, 16 bp, R. norvegicus
ttttacaacaacaagt

SEQ ID NO: 533416 - DNA, 16 bp, R. norvegicus
ttttacaacaacagaa

SEQ ID NO: 533417 - DNA, 16 bp, R. norvegicus
ttttacaacaacatat

SEQ ID NO: 533418 - DNA, 16 bp, R. norvegicus
ttttacaacaacattt

SEQ ID NO: 533419 - DNA, 16 bp, R. norvegicus
ttttacacagtgcaca

SEQ ID NO: 533420 - DNA, 16 bp, R. norvegicus
ttttacacatttaaaa

SEQ ID NO: 533421 - DNA, 16 bp, R. norvegicus
ttttacagaaacaggt

SEQ ID NO: 533422 - DNA, 16 bp, R. norvegicus
ttttacagaggaagaa

SEQ ID NO: 533423 - DNA, 16 bp, R. norvegicus
ttttacagatgaaaaa

SEQ ID NO: 533424 - DNA, 16 bp, R. norvegicus
ttttacagcaacagaa

SEQ ID NO: 533425 - DNA, 16 bp, R. norvegicus
ttttacagtattaatc

SEQ ID NO: 533426 - DNA, 16 bp, R. norvegicus
ttttacatatatgagt

SEQ ID NO: 533427 - DNA, 16 bp, R. norvegicus
ttttaccaaaagggat

SEQ ID NO: 533428 - DNA, 16 bp, R. norvegicus
ttttacgtgggtgctg

SEQ ID NO: 533429 - DNA, 16 bp, R. norvegicus
ttttactatgttaagg

SEQ ID NO: 533430 - DNA, 16 bp, R. norvegicus
ttttactcaggctagc

SEQ ID NO: 533431 - DNA, 16 bp, R. norvegicus
ttttactgtgggatgg

SEQ ID NO: 533432 - DNA, 16 bp, R. norvegicus
ttttacttgaaaattg

SEQ ID NO: 533433 - DNA, 16 bp, R. norvegicus
ttttactttgtaaaat

SEQ ID NO: 533434 - DNA, 16 bp, R. norvegicus
ttttacttttattgga

SEQ ID NO: 533435 - DNA, 16 bp, R. norvegicus
ttttactttttgaaaa

SEQ ID NO: 533436 - DNA, 16 bp, R. norvegicus
ttttagaaaaagaaga

SEQ ID NO: 533437 - DNA, 16 bp, R. norvegicus
ttttagaaaaggaaaa

SEQ ID NO: 533438 - DNA, 16 bp, R. norvegicus
ttttagaaaatcaaaa

SEQ ID NO: 533439 - DNA, 16 bp, R. norvegicus
ttttagaacaaaaaga

SEQ ID NO: 533440 - DNA, 16 bp, R. norvegicus
ttttagaagttatcag

SEQ ID NO: 533441 - DNA, 16 bp, R. norvegicus
ttttagaagttattaa

SEQ ID NO: 533442 - DNA, 16 bp, R. norvegicus
ttttagaatgaaatgt

SEQ ID NO: 533443 - DNA, 16 bp, R. norvegicus
ttttagaatttcttct

SEQ ID NO: 533444 - DNA, 16 bp, R. norvegicus
ttttagatacaggggc

SEQ ID NO: 533445 - DNA, 16 bp, R. norvegicus
ttttaggaaacatgga

SEQ ID NO: 533446 - DNA, 16 bp, R. norvegicus
ttttaggaaggagtgg

SEQ ID NO: 533447 - DNA, 16 bp, R. norvegicus
ttttaggatagaattt

SEQ ID NO: 533448 - DNA, 16 bp, R. norvegicus
ttttagggaaaaaatg

SEQ ID NO: 533449 - DNA, 56 bp, R. norvegicus
ttttaggtagcattagtactgataaaatgcctacagagactgaggaggagttacca

SEQ ID NO: 533450 - DNA, 16 bp, R. norvegicus
ttttagtgactgcttc

SEQ ID NO: 533451 - DNA, 16 bp, R. norvegicus
ttttagtgcagaattt

SEQ ID NO: 533452 - DNA, 17 bp, R. norvegicus
ttttagtgctggatttg

SEQ ID NO: 533453 - DNA, 16 bp, R. norvegicus
ttttataagagttgcc

SEQ ID NO: 533454 - DNA, 16 bp, R. norvegicus
ttttatagaactcagg

SEQ ID NO: 533455 - DNA, 16 bp, R. norvegicus
ttttatagacaaatac

SEQ ID NO: 533456 - DNA, 16 bp, R. norvegicus
ttttataggatgggaa

SEQ ID NO: 533457 - DNA, 16 bp, R. norvegicus
ttttatatgcatatgt

SEQ ID NO: 533458 - DNA, 16 bp, R. norvegicus
ttttatattctgtaat

SEQ ID NO: 533459 - DNA, 16 bp, R. norvegicus
ttttatcaaaagcaat

SEQ ID NO: 533460 - DNA, 16 bp, R. norvegicus
ttttatcacaataaaa

SEQ ID NO: 533461 - DNA, 16 bp, R. norvegicus
ttttatcactatggct

SEQ ID NO: 533462 - DNA, 16 bp, R. norvegicus
ttttatcagaatattt

SEQ ID NO: 533463 - DNA, 16 bp, R. norvegicus
ttttatcagactttca

SEQ ID NO: 533464 - DNA, 16 bp, R. norvegicus
ttttatcatagcaact

SEQ ID NO: 533465 - DNA, 16 bp, R. norvegicus
ttttatcatgaaaggg

SEQ ID NO: 533466 - DNA, 16 bp, R. norvegicus
ttttatccatggattc

SEQ ID NO: 533467 - DNA, 16 bp, R. norvegicus
ttttatccccagccac

SEQ ID NO: 533468 - DNA, 16 bp, R. norvegicus
ttttatctgtaaaatg

SEQ ID NO: 533469 - DNA, 16 bp, R. norvegicus
ttttatctttgctgcc

SEQ ID NO: 533470 - DNA, 16 bp, R. norvegicus
ttttatcttttgaaaa

SEQ ID NO: 533471 - DNA, 16 bp, R. norvegicus
ttttatgaaaaattga

SEQ ID NO: 533472 - DNA, 16 bp, R. norvegicus
ttttatgaatgtgagt

SEQ ID NO: 533473 - DNA, 16 bp, R. norvegicus
ttttatgactgggggt

SEQ ID NO: 533474 - DNA, 16 bp, R. norvegicus
ttttatgagaaaaata

SEQ ID NO: 533475 - DNA, 16 bp, R. norvegicus
ttttatgatacattat

SEQ ID NO: 533476 - DNA, 16 bp, R. norvegicus
ttttatggaagagttg

SEQ ID NO: 533477 - DNA, 16 bp, R. norvegicus
ttttatggctcagcta

SEQ ID NO: 533478 - DNA, 16 bp, R. norvegicus
ttttatggttggggag

SEQ ID NO: 533479 - DNA, 16 bp, R. norvegicus
ttttatgtaacatttt

SEQ ID NO: 533480 - DNA, 16 bp, R. norvegicus
ttttatgtatgtgaga

SEQ ID NO: 533481 - DNA, 16 bp, R. norvegicus
ttttatgtcaacttga

SEQ ID NO: 533482 - DNA, 16 bp, R. norvegicus
ttttatgtggagttcc

SEQ ID NO: 533483 - DNA, 16 bp, R. norvegicus
ttttatgtgggtactg

SEQ ID NO: 533484 - DNA, 16 bp, R. norvegicus
ttttatgtgtacgagt

SEQ ID NO: 533485 - DNA, 16 bp, R. norvegicus
ttttatgtgtgtgtgc

SEQ ID NO: 533486 - DNA, 16 bp, R. norvegicus
ttttatgtgttcttgg

SEQ ID NO: 533487 - DNA, 16 bp, R. norvegicus
ttttatgttgctgtga

SEQ ID NO: 533488 - DNA, 16 bp, R. norvegicus
ttttattaacttgtgt

SEQ ID NO: 533489 - DNA, 16 bp, R. norvegicus
ttttattatgatgatg

SEQ ID NO: 533490 - DNA, 16 bp, R. norvegicus
ttttattatgctatgt

SEQ ID NO: 533491 - DNA, 16 bp, R. norvegicus
ttttattctttcagaa

SEQ ID NO: 533492 - DNA, 16 bp, R. norvegicus
ttttattgctgtaata

SEQ ID NO: 533493 - DNA, 16 bp, R. norvegicus
ttttattggactaaaa

SEQ ID NO: 533494 - DNA, 16 bp, R. norvegicus
ttttattggggaatta

SEQ ID NO: 533495 - DNA, 16 bp, R. norvegicus
ttttatttataggagt

SEQ ID NO: 533496 - DNA, 16 bp, R. norvegicus
ttttatttcagaaaat

SEQ ID NO: 533497 - DNA, 16 bp, R. norvegicus
ttttatttcagaataa

SEQ ID NO: 533498 - DNA, 16 bp, R. norvegicus
ttttatttctacttgg

SEQ ID NO: 533499 - DNA, 16 bp, R. norvegicus
ttttatttctgagaca

SEQ ID NO: 533500 - DNA, 16 bp, R. norvegicus
ttttatttctgagtct

SEQ ID NO: 533501 - DNA, 16 bp, R. norvegicus
ttttatttgcctgata

SEQ ID NO: 533502 - DNA, 16 bp, R. norvegicus
ttttatttgggaacta

SEQ ID NO: 533503 - DNA, 16 bp, R. norvegicus
ttttattttacaagtt

SEQ ID NO: 533504 - DNA, 16 bp, R. norvegicus
ttttattttcagtaaa

SEQ ID NO: 533505 - DNA, 16 bp, R. norvegicus
ttttattttctaaaga

SEQ ID NO: 533506 - DNA, 16 bp, R. norvegicus
ttttattttctaagat

SEQ ID NO: 533507 - DNA, 16 bp, R. norvegicus
ttttattttgccatgt

SEQ ID NO: 533508 - DNA, 16 bp, R. norvegicus
ttttatttttaatgca

SEQ ID NO: 533509 - DNA, 16 bp, R. norvegicus
ttttatttttcccaag

SEQ ID NO: 533510 - DNA, 16 bp, R. norvegicus
ttttattttttccaga

SEQ ID NO: 533511 - DNA, 16 bp, R. norvegicus
ttttcaaaaaatgtct

SEQ ID NO: 533512 - DNA, 16 bp, R. norvegicus
ttttcaaaaagaagaa

SEQ ID NO: 533513 - DNA, 16 bp, R. norvegicus
ttttcaaaaatgtatt

SEQ ID NO: 533514 - DNA, 16 bp, R. norvegicus
ttttcaaaaattaagt

SEQ ID NO: 533515 - DNA, 16 bp, R. norvegicus
ttttcaaaaatttcaa

SEQ ID NO: 533516 - DNA, 16 bp, R. norvegicus
ttttcaaaacacaaag

SEQ ID NO: 533517 - DNA, 16 bp, R. norvegicus
ttttcaaaagaaacaa

SEQ ID NO: 533518 - DNA, 16 bp, R. norvegicus
ttttcaaaagaaattt

SEQ ID NO: 533519 - DNA, 16 bp, R. norvegicus
ttttcaaaagcagact

SEQ ID NO: 533520 - DNA, 16 bp, R. norvegicus
ttttcaaaagtgaaaa

SEQ ID NO: 533521 - DNA, 16 bp, R. norvegicus
ttttcaaaattgtatt

SEQ ID NO: 533522 - DNA, 16 bp, R. norvegicus
ttttcaaacagggtct

SEQ ID NO: 533523 - DNA, 16 bp, R. norvegicus
ttttcaaagaaaaatt

SEQ ID NO: 533524 - DNA, 16 bp, R. norvegicus
ttttcaaagaaacaaa

SEQ ID NO: 533525 - DNA, 16 bp, R. norvegicus
ttttcaaagaatattt

SEQ ID NO: 533526 - DNA, 16 bp, R. norvegicus
ttttcaaagagctggg

SEQ ID NO: 533527 - DNA, 16 bp, R. norvegicus
ttttcaacctgtggat

SEQ ID NO: 533528 - DNA, 16 bp, R. norvegicus
ttttcaagatatatac

SEQ ID NO: 533529 - DNA, 16 bp, R. norvegicus
ttttcaaggaaaaaaa

SEQ ID NO: 533530 - DNA, 16 bp, R. norvegicus
ttttcaaggctgacca

SEQ ID NO: 533531 - DNA, 16 bp, R. norvegicus
ttttcaataaaaaaga

SEQ ID NO: 533532 - DNA, 16 bp, R. norvegicus
ttttcaattcctttac

SEQ ID NO: 533533 - DNA, 16 bp, R. norvegicus
ttttcaccaaaatatc

SEQ ID NO: 533534 - DNA, 16 bp, R. norvegicus
ttttcagaaaacattt

SEQ ID NO: 533535 - DNA, 16 bp, R. norvegicus
ttttcagaaaagaaaa

SEQ ID NO: 533536 - DNA, 16 bp, R. norvegicus
ttttcagaaacatttt

SEQ ID NO: 533537 - DNA, 16 bp, R. norvegicus
ttttcagaaactgaat

SEQ ID NO: 533538 - DNA, 16 bp, R. norvegicus
ttttcagaagaggaaa

SEQ ID NO: 533539 - DNA, 16 bp, R. norvegicus
ttttcagaatttattt

SEQ ID NO: 533540 - DNA, 31 bp, R. norvegicus
ttttcagagagtgccaccaaggctttactga

SEQ ID NO: 533541 - DNA, 16 bp, R. norvegicus
ttttcagagggaaaac

SEQ ID NO: 533542 - DNA, 16 bp, R. norvegicus
ttttcagagggtacat

SEQ ID NO: 533543 - DNA, 16 bp, R. norvegicus
ttttcagatgaatttg

SEQ ID NO: 533544 - DNA, 17 bp, R. norvegicus
ttttcagctttagtagt

SEQ ID NO: 533545 - DNA, 16 bp, R. norvegicus
ttttcagtttcctgag

SEQ ID NO: 533546 - DNA, 16 bp, R. norvegicus
ttttcatagcaataaa

SEQ ID NO: 533547 - DNA, 16 bp, R. norvegicus
ttttcatcatagcaat

SEQ ID NO: 533548 - DNA, 16 bp, R. norvegicus
ttttcatgatttcatt

SEQ ID NO: 533549 - DNA, 16 bp, R. norvegicus
ttttcatgtatgtgag

SEQ ID NO: 533550 - DNA, 16 bp, R. norvegicus
ttttcatgtgcttatt

SEQ ID NO: 533551 - DNA, 16 bp, R. norvegicus
ttttcatgtgttctgt

SEQ ID NO: 533552 - DNA, 16 bp, R. norvegicus
ttttcattattgctct

SEQ ID NO: 533553 - DNA, 16 bp, R. norvegicus
ttttcattcaattcta

SEQ ID NO: 533554 - DNA, 16 bp, R. norvegicus
ttttcattcattctgt

SEQ ID NO: 533555 - DNA, 16 bp, R. norvegicus
ttttcattgctgcttc

SEQ ID NO: 533556 - DNA, 16 bp, R. norvegicus
ttttcatttccctgaa

SEQ ID NO: 533557 - DNA, 16 bp, R. norvegicus
ttttcatttctgatgt

SEQ ID NO: 533558 - DNA, 16 bp, R. norvegicus
ttttcatttgattata

SEQ ID NO: 533559 - DNA, 16 bp, R. norvegicus
ttttcatttgtttaaa

SEQ ID NO: 533560 - DNA, 16 bp, R. norvegicus
ttttcattttccaaat

SEQ ID NO: 533561 - DNA, 16 bp, R. norvegicus
ttttcatttttagaaa

SEQ ID NO: 533562 - DNA, 16 bp, R. norvegicus
ttttccaaaaattaaa

SEQ ID NO: 533563 - DNA, 16 bp, R. norvegicus
ttttccaagacagagt

SEQ ID NO: 533564 - DNA, 16 bp, R. norvegicus
ttttccaagcaaatgg

SEQ ID NO: 533565 - DNA, 17 bp, R. norvegicus
ttttccacctggtcaac

SEQ ID NO: 533566 - DNA, 16 bp, R. norvegicus
ttttccactggagtta

SEQ ID NO: 533567 - DNA, 16 bp, R. norvegicus
ttttccagaggacctg

SEQ ID NO: 533568 - DNA, 16 bp, R. norvegicus
ttttccagatgaacag

SEQ ID NO: 533569 - DNA, 16 bp, R. norvegicus
ttttccagatttattt

SEQ ID NO: 533570 - DNA, 16 bp, R. norvegicus
ttttccagctttttac

SEQ ID NO: 533571 - DNA, 16 bp, R. norvegicus
ttttccaggcagggtt

SEQ ID NO: 533572 - DNA, 16 bp, R. norvegicus
ttttccagtctttctt

SEQ ID NO: 533573 - DNA, 16 bp, R. norvegicus
ttttccagtgacatca

SEQ ID NO: 533574 - DNA, 16 bp, R. norvegicus
ttttccagtgaccatg

SEQ ID NO: 533575 - DNA, 17 bp, R. norvegicus
ttttccagtgcccatat

SEQ ID NO: 533576 - DNA, 16 bp, R. norvegicus
ttttccagttcccttc

SEQ ID NO: 533577 - DNA, 16 bp, R. norvegicus
ttttccattgtgtttg

SEQ ID NO: 533578 - DNA, 16 bp, R. norvegicus
ttttccattttatggt

SEQ ID NO: 533579 - DNA, 16 bp, R. norvegicus
ttttcccagagctggg

SEQ ID NO: 533580 - DNA, 16 bp, R. norvegicus
ttttcccagtttcctg

SEQ ID NO: 533581 - DNA, 16 bp, R. norvegicus
ttttccccaatctttc

SEQ ID NO: 533582 - DNA, 25 bp, R. norvegicus
ttttcccctgcaagaaacctgcctg

SEQ ID NO: 533583 - DNA, 16 bp, R. norvegicus
ttttcccctgcaggaa

SEQ ID NO: 533584 - DNA, 16 bp, R. norvegicus
ttttccccttgcagct

SEQ ID NO: 533585 - DNA, 16 bp, R. norvegicus
ttttccctcaaggagt

SEQ ID NO: 533586 - DNA, 16 bp, R. norvegicus
ttttccctctgatgtg

SEQ ID NO: 533587 - DNA, 16 bp, R. norvegicus
ttttccctgcagttct

SEQ ID NO: 533588 - DNA, 16 bp, R. norvegicus
ttttccctggagaaga

SEQ ID NO: 533589 - DNA, 16 bp, R. norvegicus
ttttccctttttaaaa

SEQ ID NO: 533590 - DNA, 16 bp, R. norvegicus
ttttccgttgatgaat

SEQ ID NO: 533591 - DNA, 16 bp, R. norvegicus
ttttcctaaaataaat

SEQ ID NO: 533592 - DNA, 16 bp, R. norvegicus
ttttcctcagtgccca

SEQ ID NO: 533593 - DNA, 16 bp, R. norvegicus
ttttcctcattaaaga

SEQ ID NO: 533594 - DNA, 16 bp, R. norvegicus
ttttcctccggagctg

SEQ ID NO: 533595 - DNA, 16 bp, R. norvegicus
ttttcctctgaccttc

SEQ ID NO: 533596 - DNA, 16 bp, R. norvegicus
ttttcctctgggtttc

SEQ ID NO: 533597 - DNA, 16 bp, R. norvegicus
ttttcctcttaacatt

SEQ ID NO: 533598 - DNA, 16 bp, R. norvegicus
ttttcctcttaccaca

SEQ ID NO: 533599 - DNA, 16 bp, R. norvegicus
ttttcctcttttaaaa

SEQ ID NO: 533600 - DNA, 16 bp, R. norvegicus
ttttcctgaagagaac

SEQ ID NO: 533601 - DNA, 16 bp, R. norvegicus
ttttcctgaatttctc

SEQ ID NO: 533602 - DNA, 16 bp, R. norvegicus
ttttcctgcctctgtc

SEQ ID NO: 533603 - DNA, 16 bp, R. norvegicus
ttttcctggaactctt

SEQ ID NO: 533604 - DNA, 16 bp, R. norvegicus
ttttcctggcattctt

SEQ ID NO: 533605 - DNA, 16 bp, R. norvegicus
ttttccttaaaaacaa

SEQ ID NO: 533606 - DNA, 16 bp, R. norvegicus
ttttccttatgaatat

SEQ ID NO: 533607 - DNA, 16 bp, R. norvegicus
ttttccttcccagaat

SEQ ID NO: 533608 - DNA, 16 bp, R. norvegicus
ttttccttgaatattt

SEQ ID NO: 533609 - DNA, 16 bp, R. norvegicus
ttttcctttcaaaatt

SEQ ID NO: 533610 - DNA, 16 bp, R. norvegicus
ttttcctttcttgatc

SEQ ID NO: 533611 - DNA, 16 bp, R. norvegicus
ttttcctttgaaaatt

SEQ ID NO: 533612 - DNA, 16 bp, R. norvegicus
ttttcctttgagaaaa

SEQ ID NO: 533613 - DNA, 16 bp, R. norvegicus
ttttcctttgccagtg

SEQ ID NO: 533614 - DNA, 16 bp, R. norvegicus
ttttccttttaaagaa

SEQ ID NO: 533615 - DNA, 16 bp, R. norvegicus
ttttcggaggtgggga

SEQ ID NO: 533616 - DNA, 16 bp, R. norvegicus
ttttcgtcatccttct

SEQ ID NO: 533617 - DNA, 16 bp, R. norvegicus
ttttctaaagaaaaca

SEQ ID NO: 533618 - DNA, 16 bp, R. norvegicus
ttttctaaagtatttt

SEQ ID NO: 533619 - DNA, 16 bp, R. norvegicus
ttttctaagcaaatag

SEQ ID NO: 533620 - DNA, 16 bp, R. norvegicus
ttttctaagtttaaaa

SEQ ID NO: 533621 - DNA, 16 bp, R. norvegicus
ttttctaagttttcta

SEQ ID NO: 533622 - DNA, 16 bp, R. norvegicus
ttttctacaaatggtg

SEQ ID NO: 533623 - DNA, 16 bp, R. norvegicus
ttttctatatgctgac

SEQ ID NO: 533624 - DNA, 16 bp, R. norvegicus
ttttctatattaatcc

SEQ ID NO: 533625 - DNA, 16 bp, R. norvegicus
ttttctatgatatctt

SEQ ID NO: 533626 - DNA, 16 bp, R. norvegicus
ttttctatgtatgtat

SEQ ID NO: 533627 - DNA, 16 bp, R. norvegicus
ttttctattgtgataa

SEQ ID NO: 533628 - DNA, 16 bp, R. norvegicus
ttttctatttttcaga

SEQ ID NO: 533629 - DNA, 16 bp, R. norvegicus
ttttctcactgctgtg

SEQ ID NO: 533630 - DNA, 19 bp, R. norvegicus
ttttctcacttggccttaa

SEQ ID NO: 533631 - DNA, 16 bp, R. norvegicus
ttttctcagagctggg

SEQ ID NO: 533632 - DNA, 16 bp, R. norvegicus
ttttctcagcttctca

SEQ ID NO: 533633 - DNA, 16 bp, R. norvegicus
ttttctcagtacctca

SEQ ID NO: 533634 - DNA, 16 bp, R. norvegicus
ttttctcagtgatgga

SEQ ID NO: 533635 - DNA, 16 bp, R. norvegicus
ttttctcatctctgaa

SEQ ID NO: 533636 - DNA, 16 bp, R. norvegicus
ttttctcatctgtgaa

SEQ ID NO: 533637 - DNA, 16 bp, R. norvegicus
ttttctcattttgaaa

SEQ ID NO: 533638 - DNA, 16 bp, R. norvegicus
ttttctccatctgtgg

SEQ ID NO: 533639 - DNA, 16 bp, R. norvegicus
ttttctccatctttgt

SEQ ID NO: 533640 - DNA, 16 bp, R. norvegicus
ttttctccccaagttg

SEQ ID NO: 533641 - DNA, 16 bp, R. norvegicus
ttttctccctccaaat

SEQ ID NO: 533642 - DNA, 16 bp, R. norvegicus
ttttctcctgtgagta

SEQ ID NO: 533643 - DNA, 16 bp, R. norvegicus
ttttctcctgtgccca

SEQ ID NO: 533644 - DNA, 16 bp, R. norvegicus
ttttctcttccaccat

SEQ ID NO: 533645 - DNA, 16 bp, R. norvegicus
ttttctctttgtaaaa

SEQ ID NO: 533646 - DNA, 16 bp, R. norvegicus
ttttctgaaaaagaaa

SEQ ID NO: 533647 - DNA, 16 bp, R. norvegicus
ttttctgaaaacattt

SEQ ID NO: 533648 - DNA, 16 bp, R. norvegicus
ttttctgaaagaacca

SEQ ID NO: 533649 - DNA, 16 bp, R. norvegicus
ttttctgaaatgaaat

SEQ ID NO: 533650 - DNA, 16 bp, R. norvegicus
ttttctgaacagaaaa

SEQ ID NO: 533651 - DNA, 16 bp, R. norvegicus
ttttctgaagaaaaag

SEQ ID NO: 533652 - DNA, 16 bp, R. norvegicus
ttttctgagacagagt

SEQ ID NO: 533653 - DNA, 16 bp, R. norvegicus
ttttctgagcagaaca

SEQ ID NO: 533654 - DNA, 16 bp, R. norvegicus
ttttctgaggaaccta

SEQ ID NO: 533655 - DNA, 16 bp, R. norvegicus
ttttctgaggaactcc

SEQ ID NO: 533656 - DNA, 16 bp, R. norvegicus
ttttctgatttctctg

SEQ ID NO: 533657 - DNA, 16 bp, R. norvegicus
ttttctgcattttact

SEQ ID NO: 533658 - DNA, 16 bp, R. norvegicus
ttttctgcattttgat

SEQ ID NO: 533659 - DNA, 16 bp, R. norvegicus
ttttctgccaggagtt

SEQ ID NO: 533660 - DNA, 16 bp, R. norvegicus
ttttctgcttctttaa

SEQ ID NO: 533661 - DNA, 16 bp, R. norvegicus
ttttctggaaaaaaaa

SEQ ID NO: 533662 - DNA, 16 bp, R. norvegicus
ttttctggaaagattt

SEQ ID NO: 533663 - DNA, 16 bp, R. norvegicus
ttttctggaacaacca

SEQ ID NO: 533664 - DNA, 16 bp, R. norvegicus
ttttctggaatatttt

SEQ ID NO: 533665 - DNA, 18 bp, R. norvegicus
ttttctggagctggggac

SEQ ID NO: 533666 - DNA, 16 bp, R. norvegicus
ttttctgggggaaaaa

SEQ ID NO: 533667 - DNA, 16 bp, R. norvegicus
ttttctgggtcttcaa

SEQ ID NO: 533668 - DNA, 16 bp, R. norvegicus
ttttctggtgtgtatg

SEQ ID NO: 533669 - DNA, 16 bp, R. norvegicus
ttttctggttcaatct

SEQ ID NO: 533670 - DNA, 16 bp, R. norvegicus
ttttctgtaatagttt

SEQ ID NO: 533671 - DNA, 16 bp, R. norvegicus
ttttctgtaggagctt

SEQ ID NO: 533672 - DNA, 39 bp, R. norvegicus
ttttctgtatccattcctctgttgaagggcatctgggta

SEQ ID NO: 533673 - DNA, 16 bp, R. norvegicus
ttttctgtccctgaga

SEQ ID NO: 533674 - DNA, 16 bp, R. norvegicus
ttttctgtcttctact

SEQ ID NO: 533675 - DNA, 16 bp, R. norvegicus
ttttctgtggtatctt

SEQ ID NO: 533676 - DNA, 16 bp, R. norvegicus
ttttctgttgctttga

SEQ ID NO: 533677 - DNA, 16 bp, R. norvegicus
ttttctgtttttcaga

SEQ ID NO: 533678 - DNA, 16 bp, R. norvegicus
ttttcttaaaaatcaa

SEQ ID NO: 533679 - DNA, 16 bp, R. norvegicus
ttttcttaaaaatgaa

SEQ ID NO: 533680 - DNA, 16 bp, R. norvegicus
ttttcttaagagaaag

SEQ ID NO: 533681 - DNA, 16 bp, R. norvegicus
ttttcttaatcacaaa

SEQ ID NO: 533682 - DNA, 16 bp, R. norvegicus
ttttcttacaaacttg

SEQ ID NO: 533683 - DNA, 16 bp, R. norvegicus
ttttcttagaaaaaaa

SEQ ID NO: 533684 - DNA, 16 bp, R. norvegicus
ttttcttcagaaaata

SEQ ID NO: 533685 - DNA, 16 bp, R. norvegicus
ttttcttcagaccatt

SEQ ID NO: 533686 - DNA, 16 bp, R. norvegicus
ttttcttcataaaata

SEQ ID NO: 533687 - DNA, 16 bp, R. norvegicus
ttttcttcattaaaaa

SEQ ID NO: 533688 - DNA, 16 bp, R. norvegicus
ttttcttcctcagtct

SEQ ID NO: 533689 - DNA, 16 bp, R. norvegicus
ttttcttcctttaaaa

SEQ ID NO: 533690 - DNA, 16 bp, R. norvegicus
ttttcttctaagatga

SEQ ID NO: 533691 - DNA, 16 bp, R. norvegicus
ttttcttctagagttt

SEQ ID NO: 533692 - DNA, 16 bp, R. norvegicus
ttttcttcttgagaaa

SEQ ID NO: 533693 - DNA, 16 bp, R. norvegicus
ttttcttgaagctttt

SEQ ID NO: 533694 - DNA, 16 bp, R. norvegicus
ttttcttgaagtcctc

SEQ ID NO: 533695 - DNA, 16 bp, R. norvegicus
ttttcttgatgagggg

SEQ ID NO: 533696 - DNA, 16 bp, R. norvegicus
ttttcttgattggatc

SEQ ID NO: 533697 - DNA, 16 bp, R. norvegicus
ttttcttggaaatttg

SEQ ID NO: 533698 - DNA, 16 bp, R. norvegicus
ttttcttgtcactgtg

SEQ ID NO: 533699 - DNA, 16 bp, R. norvegicus
ttttcttgtctgattg

SEQ ID NO: 533700 - DNA, 16 bp, R. norvegicus
ttttcttgttattaaa

SEQ ID NO: 533701 - DNA, 16 bp, R. norvegicus
ttttcttgttttgaaa

SEQ ID NO: 533702 - DNA, 16 bp, R. norvegicus
ttttctttaaggatgt

SEQ ID NO: 533703 - DNA, 16 bp, R. norvegicus
ttttctttatgaatat

SEQ ID NO: 533704 - DNA, 16 bp, R. norvegicus
ttttctttatgcagtc

SEQ ID NO: 533705 - DNA, 16 bp, R. norvegicus
ttttctttcaagaaaa

SEQ ID NO: 533706 - DNA, 16 bp, R. norvegicus
ttttctttcccagttt

SEQ ID NO: 533707 - DNA, 16 bp, R. norvegicus
ttttctttccttcaaa

SEQ ID NO: 533708 - DNA, 16 bp, R. norvegicus
ttttctttctggaatt

SEQ ID NO: 533709 - DNA, 16 bp, R. norvegicus
ttttctttcttcatga

SEQ ID NO: 533710 - DNA, 16 bp, R. norvegicus
ttttctttcttccaga

SEQ ID NO: 533711 - DNA, 16 bp, R. norvegicus
ttttctttcttgaaat

SEQ ID NO: 533712 - DNA, 16 bp, R. norvegicus
ttttctttgagtgtgt

SEQ ID NO: 533713 - DNA, 16 bp, R. norvegicus
ttttctttgccttaca

SEQ ID NO: 533714 - DNA, 16 bp, R. norvegicus
ttttcttttagaaaat

SEQ ID NO: 533715 - DNA, 16 bp, R. norvegicus
ttttcttttatggaaa

SEQ ID NO: 533716 - DNA, 16 bp, R. norvegicus
ttttcttttctaagaa

SEQ ID NO: 533717 - DNA, 16 bp, R. norvegicus
ttttcttttctcagct

SEQ ID NO: 533718 - DNA, 16 bp, R. norvegicus
ttttcttttgaaaaca

SEQ ID NO: 533719 - DNA, 16 bp, R. norvegicus
ttttcttttgaaagaa

SEQ ID NO: 533720 - DNA, 16 bp, R. norvegicus
ttttcttttgaagaaa

SEQ ID NO: 533721 - DNA, 16 bp, R. norvegicus
ttttcttttgaggaca

SEQ ID NO: 533722 - DNA, 16 bp, R. norvegicus
ttttctttttaaagta

SEQ ID NO: 533723 - DNA, 16 bp, R. norvegicus
ttttctttttgaaact

SEQ ID NO: 533724 - DNA, 16 bp, R. norvegicus
ttttctttttgataac

SEQ ID NO: 533725 - DNA, 16 bp, R. norvegicus
ttttgaaaaacagaaa

SEQ ID NO: 533726 - DNA, 16 bp, R. norvegicus
ttttgaaaaacatttt

SEQ ID NO: 533727 - DNA, 16 bp, R. norvegicus
ttttgaaaaagaactt

SEQ ID NO: 533728 - DNA, 16 bp, R. norvegicus
ttttgaaaaagaatat

SEQ ID NO: 533729 - DNA, 16 bp, R. norvegicus
ttttgaaaaatgccac

SEQ ID NO: 533730 - DNA, 16 bp, R. norvegicus
ttttgaaaaggataaa

SEQ ID NO: 533731 - DNA, 16 bp, R. norvegicus
ttttgaaaataaagta

SEQ ID NO: 533732 - DNA, 16 bp, R. norvegicus
ttttgaaaatcttttt

SEQ ID NO: 533733 - DNA, 16 bp, R. norvegicus
ttttgaaaatgctttt

SEQ ID NO: 533734 - DNA, 16 bp, R. norvegicus
ttttgaaaattatgtg

SEQ ID NO: 533735 - DNA, 16 bp, R. norvegicus
ttttgaaacaagattt

SEQ ID NO: 533736 - DNA, 16 bp, R. norvegicus
ttttgaaacagtctca

SEQ ID NO: 533737 - DNA, 16 bp, R. norvegicus
ttttgaaacagtctct

SEQ ID NO: 533738 - DNA, 16 bp, R. norvegicus
ttttgaaacatgaagg

SEQ ID NO: 533739 - DNA, 16 bp, R. norvegicus
ttttgaaactttaaag

SEQ ID NO: 533740 - DNA, 16 bp, R. norvegicus
ttttgaaagaaaacaa

SEQ ID NO: 533741 - DNA, 16 bp, R. norvegicus
ttttgaaatgcatttt

SEQ ID NO: 533742 - DNA, 16 bp, R. norvegicus
ttttgaacaaaaaaaa

SEQ ID NO: 533743 - DNA, 16 bp, R. norvegicus
ttttgaacatttgttt

SEQ ID NO: 533744 - DNA, 16 bp, R. norvegicus
ttttgaagaaaacaaa

SEQ ID NO: 533745 - DNA, 16 bp, R. norvegicus
ttttgaagaaattaaa

SEQ ID NO: 533746 - DNA, 16 bp, R. norvegicus
ttttgaagaattggat

SEQ ID NO: 533747 - DNA, 16 bp, R. norvegicus
ttttgaagatttactt

SEQ ID NO: 533748 - DNA, 16 bp, R. norvegicus
ttttgaagtgctcttg

SEQ ID NO: 533749 - DNA, 16 bp, R. norvegicus
ttttgacaaactttta

SEQ ID NO: 533750 - DNA, 16 bp, R. norvegicus
ttttgactttgggatg

SEQ ID NO: 533751 - DNA, 16 bp, R. norvegicus
ttttgagaaagaattt

SEQ ID NO: 533752 - DNA, 16 bp, R. norvegicus
ttttgagaattctcca

SEQ ID NO: 533753 - DNA, 16 bp, R. norvegicus
ttttgagacaaggtct

SEQ ID NO: 533754 - DNA, 16 bp, R. norvegicus
ttttgagacacaatct

SEQ ID NO: 533755 - DNA, 16 bp, R. norvegicus
ttttgagacagagtct

SEQ ID NO: 533756 - DNA, 16 bp, R. norvegicus
ttttgagacagagttt

SEQ ID NO: 533757 - DNA, 16 bp, R. norvegicus
ttttgagacagatctt

SEQ ID NO: 533758 - DNA, 16 bp, R. norvegicus
ttttgagacaggatct

SEQ ID NO: 533759 - DNA, 16 bp, R. norvegicus
ttttgagacaggctct

SEQ ID NO: 533760 - DNA, 16 bp, R. norvegicus
ttttgagacagggcct

SEQ ID NO: 533761 - DNA, 16 bp, R. norvegicus
ttttgagacagggtat

SEQ ID NO: 533762 - DNA, 16 bp, R. norvegicus
ttttgagacagggtct

SEQ ID NO: 533763 - DNA, 16 bp, R. norvegicus
ttttgagacagggttt

SEQ ID NO: 533764 - DNA, 16 bp, R. norvegicus
ttttgagacagtatct

SEQ ID NO: 533765 - DNA, 16 bp, R. norvegicus
ttttgagacagtgttt

SEQ ID NO: 533766 - DNA, 16 bp, R. norvegicus
ttttgagacattgtct

SEQ ID NO: 533767 - DNA, 16 bp, R. norvegicus
ttttgagacgggatct

SEQ ID NO: 533768 - DNA, 16 bp, R. norvegicus
ttttgagaggctctgc

SEQ ID NO: 533769 - DNA, 16 bp, R. norvegicus
ttttgagatagggtct

SEQ ID NO: 533770 - DNA, 16 bp, R. norvegicus
ttttgagatggggtct

SEQ ID NO: 533771 - DNA, 16 bp, R. norvegicus
ttttgagatggtgtct

SEQ ID NO: 533772 - DNA, 16 bp, R. norvegicus
ttttgagcagatctct

SEQ ID NO: 533773 - DNA, 16 bp, R. norvegicus
ttttgagcttcctgtg

SEQ ID NO: 533774 - DNA, 16 bp, R. norvegicus
ttttgaggactctctg

SEQ ID NO: 533775 - DNA, 16 bp, R. norvegicus
ttttgaggagcctcca

SEQ ID NO: 533776 - DNA, 16 bp, R. norvegicus
ttttgagtcagtgtct

SEQ ID NO: 533777 - DNA, 16 bp, R. norvegicus
ttttgagttctttgca

SEQ ID NO: 533778 - DNA, 16 bp, R. norvegicus
ttttgagtttctctcc

SEQ ID NO: 533779 - DNA, 16 bp, R. norvegicus
ttttgataaagaaacc

SEQ ID NO: 533780 - DNA, 17 bp, R. norvegicus
ttttgatcttagtcatt

SEQ ID NO: 533781 - DNA, 16 bp, R. norvegicus
ttttgatgaatgagaa

SEQ ID NO: 533782 - DNA, 16 bp, R. norvegicus
ttttgatgataattcc

SEQ ID NO: 533783 - DNA, 16 bp, R. norvegicus
ttttgatgatgaactg

SEQ ID NO: 533784 - DNA, 16 bp, R. norvegicus
ttttgatgatgatgat

SEQ ID NO: 533785 - DNA, 16 bp, R. norvegicus
ttttgatgttggctac

SEQ ID NO: 533786 - DNA, 16 bp, R. norvegicus
ttttgatgttggcttt

SEQ ID NO: 533787 - DNA, 16 bp, R. norvegicus
ttttgattagcatttt

SEQ ID NO: 533788 - DNA, 16 bp, R. norvegicus
ttttgattgtgaagat

SEQ ID NO: 533789 - DNA, 16 bp, R. norvegicus
ttttgatttcttaaaa

SEQ ID NO: 533790 - DNA, 16 bp, R. norvegicus
ttttgatttgcatctc

SEQ ID NO: 533791 - DNA, 16 bp, R. norvegicus
ttttgatttgcctttc

SEQ ID NO: 533792 - DNA, 16 bp, R. norvegicus
ttttgattttgtggct

SEQ ID NO: 533793 - DNA, 16 bp, R. norvegicus
ttttgcaaaagaaaaa

SEQ ID NO: 533794 - DNA, 16 bp, R. norvegicus
ttttgcagaggatctg

SEQ ID NO: 533795 - DNA, 16 bp, R. norvegicus
ttttgcatcaatattc

SEQ ID NO: 533796 - DNA, 16 bp, R. norvegicus
ttttgcatgtgtgtat

SEQ ID NO: 533797 - DNA, 16 bp, R. norvegicus
ttttgcattatgatgt

SEQ ID NO: 533798 - DNA, 16 bp, R. norvegicus
ttttgcattttaaatt

SEQ ID NO: 533799 - DNA, 16 bp, R. norvegicus
ttttgccatagcaaca

SEQ ID NO: 533800 - DNA, 16 bp, R. norvegicus
ttttgcctgtatatgt

SEQ ID NO: 533801 - DNA, 16 bp, R. norvegicus
ttttgcctttaaatag

SEQ ID NO: 533802 - DNA, 16 bp, R. norvegicus
ttttgctgaagcagac

SEQ ID NO: 533803 - DNA, 16 bp, R. norvegicus
ttttgctgcctacaag

SEQ ID NO: 533804 - DNA, 16 bp, R. norvegicus
ttttgctgctacttca

SEQ ID NO: 533805 - DNA, 16 bp, R. norvegicus
ttttgctgggacaaac

SEQ ID NO: 533806 - DNA, 16 bp, R. norvegicus
ttttgctggtatggaa

SEQ ID NO: 533807 - DNA, 16 bp, R. norvegicus
ttttgctttgtcttaa

SEQ ID NO: 533808 - DNA, 16 bp, R. norvegicus
ttttggaaaaacaaaa

SEQ ID NO: 533809 - DNA, 16 bp, R. norvegicus
ttttggaagagaaaat

SEQ ID NO: 533810 - DNA, 16 bp, R. norvegicus
ttttggagaaggtact

SEQ ID NO: 533811 - DNA, 16 bp, R. norvegicus
ttttggagacagtctt

SEQ ID NO: 533812 - DNA, 16 bp, R. norvegicus
ttttggagacagtttc

SEQ ID NO: 533813 - DNA, 16 bp, R. norvegicus
ttttggagagcccatg

SEQ ID NO: 533814 - DNA, 16 bp, R. norvegicus
ttttggagtatgtgtg

SEQ ID NO: 533815 - DNA, 16 bp, R. norvegicus
ttttggagtcacttaa

SEQ ID NO: 533816 - DNA, 17 bp, R. norvegicus
ttttggagtgatcctct

SEQ ID NO: 533817 - DNA, 16 bp, R. norvegicus
ttttggagttttcctt

SEQ ID NO: 533818 - DNA, 16 bp, R. norvegicus
ttttggatcaaaagtt

SEQ ID NO: 533819 - DNA, 16 bp, R. norvegicus
ttttggatgatgatgg

SEQ ID NO: 533820 - DNA, 16 bp, R. norvegicus
ttttggatggaatgtt

SEQ ID NO: 533821 - DNA, 16 bp, R. norvegicus
ttttggatttcctctg

SEQ ID NO: 533822 - DNA, 16 bp, R. norvegicus
ttttggcaaagaatct

SEQ ID NO: 533823 - DNA, 16 bp, R. norvegicus
ttttggccctgaaaaa

SEQ ID NO: 533824 - DNA, 16 bp, R. norvegicus
ttttggctaatattca

SEQ ID NO: 533825 - DNA, 16 bp, R. norvegicus
ttttggctcctttgtg

SEQ ID NO: 533826 - DNA, 16 bp, R. norvegicus
ttttggctgtgtctct

SEQ ID NO: 533827 - DNA, 16 bp, R. norvegicus
ttttgggacagggtct

SEQ ID NO: 533828 - DNA, 16 bp, R. norvegicus
ttttgggcctctcaga

SEQ ID NO: 533829 - DNA, 16 bp, R. norvegicus
ttttggggtcacttga

SEQ ID NO: 533830 - DNA, 16 bp, R. norvegicus
ttttggggtctcgagc

SEQ ID NO: 533831 - DNA, 28 bp, R. norvegicus
ttttgggtatatgcccaagagaggtatt

SEQ ID NO: 533832 - DNA, 16 bp, R. norvegicus
ttttggtatataccca

SEQ ID NO: 533833 - DNA, 16 bp, R. norvegicus
ttttggtgaaaaatgt

SEQ ID NO: 533834 - DNA, 16 bp, R. norvegicus
ttttggttcagttgat

SEQ ID NO: 533835 - DNA, 16 bp, R. norvegicus
ttttggttccagaggg

SEQ ID NO: 533836 - DNA, 16 bp, R. norvegicus
ttttgtaaagtttctt

SEQ ID NO: 533837 - DNA, 16 bp, R. norvegicus
ttttgtaactgattat

SEQ ID NO: 533838 - DNA, 16 bp, R. norvegicus
ttttgtacatttttaa

SEQ ID NO: 533839 - DNA, 16 bp, R. norvegicus
ttttgtacttttaaaa

SEQ ID NO: 533840 - DNA, 16 bp, R. norvegicus
ttttgtagatgaagaa

SEQ ID NO: 533841 - DNA, 16 bp, R. norvegicus
ttttgtatattttcaa

SEQ ID NO: 533842 - DNA, 16 bp, R. norvegicus
ttttgtatttccatat

SEQ ID NO: 533843 - DNA, 16 bp, R. norvegicus
ttttgtcaaagccttt

SEQ ID NO: 533844 - DNA, 16 bp, R. norvegicus
ttttgtcatagaatat

SEQ ID NO: 533845 - DNA, 42 bp, R. norvegicus
ttttgtcctaaccaccgtgtcctttgccttacagaagctttg

SEQ ID NO: 533846 - DNA, 16 bp, R. norvegicus
ttttgtctcctctggt

SEQ ID NO: 533847 - DNA, 16 bp, R. norvegicus
ttttgtctctgggagc

SEQ ID NO: 533848 - DNA, 16 bp, R. norvegicus
ttttgtctgctcttgg

SEQ ID NO: 533849 - DNA, 16 bp, R. norvegicus
ttttgtcttctttaaa

SEQ ID NO: 533850 - DNA, 16 bp, R. norvegicus
ttttgtcttggaatat

SEQ ID NO: 533851 - DNA, 16 bp, R. norvegicus
ttttgtctttgagaca

SEQ ID NO: 533852 - DNA, 16 bp, R. norvegicus
ttttgtgaagtcattg

SEQ ID NO: 533853 - DNA, 16 bp, R. norvegicus
ttttgtgaatgattat

SEQ ID NO: 533854 - DNA, 16 bp, R. norvegicus
ttttgtgaatttcaca

SEQ ID NO: 533855 - DNA, 16 bp, R. norvegicus
ttttgtgactcctctt

SEQ ID NO: 533856 - DNA, 16 bp, R. norvegicus
ttttgtgactgtgtta

SEQ ID NO: 533857 - DNA, 16 bp, R. norvegicus
ttttgtggctctcttc

SEQ ID NO: 533858 - DNA, 16 bp, R. norvegicus
ttttgtgtctggcttc

SEQ ID NO: 533859 - DNA, 16 bp, R. norvegicus
ttttgttaactttgag

SEQ ID NO: 533860 - DNA, 16 bp, R. norvegicus
ttttgttaaggaaatt

SEQ ID NO: 533861 - DNA, 16 bp, R. norvegicus
ttttgttacagcagca

SEQ ID NO: 533862 - DNA, 16 bp, R. norvegicus
ttttgttagatattag

SEQ ID NO: 533863 - DNA, 16 bp, R. norvegicus
ttttgttcaggaaaat

SEQ ID NO: 533864 - DNA, 16 bp, R. norvegicus
ttttgttcaggagatt

SEQ ID NO: 533865 - DNA, 16 bp, R. norvegicus
ttttgttccaccttct

SEQ ID NO: 533866 - DNA, 16 bp, R. norvegicus
ttttgttccactttct

SEQ ID NO: 533867 - DNA, 16 bp, R. norvegicus
ttttgttcttacagtt

SEQ ID NO: 533868 - DNA, 16 bp, R. norvegicus
ttttgttgaaaataat

SEQ ID NO: 533869 - DNA, 16 bp, R. norvegicus
ttttgttgaagaatgt

SEQ ID NO: 533870 - DNA, 16 bp, R. norvegicus
ttttgttgaataaagg

SEQ ID NO: 533871 - DNA, 16 bp, R. norvegicus
ttttgttggatatagt

SEQ ID NO: 533872 - DNA, 16 bp, R. norvegicus
ttttgttgtcaagatg

SEQ ID NO: 533873 - DNA, 16 bp, R. norvegicus
ttttgttgtctcattg

SEQ ID NO: 533874 - DNA, 16 bp, R. norvegicus
ttttgttgttattcca

SEQ ID NO: 533875 - DNA, 16 bp, R. norvegicus
ttttgtttaacatgat

SEQ ID NO: 533876 - DNA, 16 bp, R. norvegicus
ttttgtttcattgcaa

SEQ ID NO: 533877 - DNA, 16 bp, R. norvegicus
ttttgtttctttaaag

SEQ ID NO: 533878 - DNA, 16 bp, R. norvegicus
ttttgtttctttgaaa

SEQ ID NO: 533879 - DNA, 16 bp, R. norvegicus
ttttgtttggaagaat

SEQ ID NO: 533880 - DNA, 16 bp, R. norvegicus
ttttgtttggagaaat

SEQ ID NO: 533881 - DNA, 16 bp, R. norvegicus
ttttgttttagagaaa

SEQ ID NO: 533882 - DNA, 16 bp, R. norvegicus
ttttgttttctaaatg

SEQ ID NO: 533883 - DNA, 16 bp, R. norvegicus
ttttgttttgaaacat

SEQ ID NO: 533884 - DNA, 16 bp, R. norvegicus
ttttgtttttccagag

SEQ ID NO: 533885 - DNA, 16 bp, R. norvegicus
ttttgtttttctgaag

SEQ ID NO: 533886 - DNA, 16 bp, R. norvegicus
tttttaaaaaaattcc

SEQ ID NO: 533887 - DNA, 16 bp, R. norvegicus
tttttaaaaaacccaa

SEQ ID NO: 533888 - DNA, 16 bp, R. norvegicus
tttttaaaaaaccttt

SEQ ID NO: 533889 - DNA, 16 bp, R. norvegicus
tttttaaaaaagaagt

SEQ ID NO: 533890 - DNA, 16 bp, R. norvegicus
tttttaaaaaagccag

SEQ ID NO: 533891 - DNA, 16 bp, R. norvegicus
tttttaaaaaagcctt

SEQ ID NO: 533892 - DNA, 16 bp, R. norvegicus
tttttaaaaaaggaac

SEQ ID NO: 533893 - DNA, 16 bp, R. norvegicus
tttttaaaaaaggaag

SEQ ID NO: 533894 - DNA, 16 bp, R. norvegicus
tttttaaaaaatctga

SEQ ID NO: 533895 - DNA, 16 bp, R. norvegicus
tttttaaaaaatgttg

SEQ ID NO: 533896 - DNA, 16 bp, R. norvegicus
tttttaaaaacaagaa

SEQ ID NO: 533897 - DNA, 16 bp, R. norvegicus
tttttaaaaactcaag

SEQ ID NO: 533898 - DNA, 16 bp, R. norvegicus
tttttaaaaacttaca

SEQ ID NO: 533899 - DNA, 16 bp, R. norvegicus
tttttaaaaagccaaa

SEQ ID NO: 533900 - DNA, 16 bp, R. norvegicus
tttttaaaaaggaaat

SEQ ID NO: 533901 - DNA, 16 bp, R. norvegicus
tttttaaaaaggtgtt

SEQ ID NO: 533902 - DNA, 16 bp, R. norvegicus
tttttaaaaaggttat

SEQ ID NO: 533903 - DNA, 16 bp, R. norvegicus
tttttaaaaagtgaat

SEQ ID NO: 533904 - DNA, 16 bp, R. norvegicus
tttttaaaaagtgaca

SEQ ID NO: 533905 - DNA, 16 bp, R. norvegicus
tttttaaaaagtgtaa

SEQ ID NO: 533906 - DNA, 16 bp, R. norvegicus
tttttaaaaagtgtgt

SEQ ID NO: 533907 - DNA, 16 bp, R. norvegicus
tttttaaaaagtgttc

SEQ ID NO: 533908 - DNA, 16 bp, R. norvegicus
tttttaaaaatcagct

SEQ ID NO: 533909 - DNA, 16 bp, R. norvegicus
tttttaaaaatcatgt

SEQ ID NO: 533910 - DNA, 16 bp, R. norvegicus
tttttaaaaatgggaa

SEQ ID NO: 533911 - DNA, 16 bp, R. norvegicus
tttttaaaaattgcat

SEQ ID NO: 533912 - DNA, 16 bp, R. norvegicus
tttttaaaacttcagt

SEQ ID NO: 533913 - DNA, 16 bp, R. norvegicus
tttttaaaacttgaaa

SEQ ID NO: 533914 - DNA, 16 bp, R. norvegicus
tttttaaaagaacaga

SEQ ID NO: 533915 - DNA, 16 bp, R. norvegicus
tttttaaaagaagcat

SEQ ID NO: 533916 - DNA, 16 bp, R. norvegicus
tttttaaaagacaaaa

SEQ ID NO: 533917 - DNA, 16 bp, R. norvegicus
tttttaaaagaccatt

SEQ ID NO: 533918 - DNA, 16 bp, R. norvegicus
tttttaaaagcaaaac

SEQ ID NO: 533919 - DNA, 16 bp, R. norvegicus
tttttaaaagcaaaat

SEQ ID NO: 533920 - DNA, 16 bp, R. norvegicus
tttttaaaagcatttt

SEQ ID NO: 533921 - DNA, 16 bp, R. norvegicus
tttttaaaatagagaa

SEQ ID NO: 533922 - DNA, 16 bp, R. norvegicus
tttttaaaataggaaa

SEQ ID NO: 533923 - DNA, 16 bp, R. norvegicus
tttttaaaattactgt

SEQ ID NO: 533924 - DNA, 16 bp, R. norvegicus
tttttaaacatgattt

SEQ ID NO: 533925 - DNA, 16 bp, R. norvegicus
tttttaaacattgttt

SEQ ID NO: 533926 - DNA, 16 bp, R. norvegicus
tttttaaaccagaaat

SEQ ID NO: 533927 - DNA, 16 bp, R. norvegicus
tttttaaactttcaaa

SEQ ID NO: 533928 - DNA, 16 bp, R. norvegicus
tttttaaagaaaaact

SEQ ID NO: 533929 - DNA, 16 bp, R. norvegicus
tttttaaagaaaacaa

SEQ ID NO: 533930 - DNA, 16 bp, R. norvegicus
tttttaaagaaaagct

SEQ ID NO: 533931 - DNA, 16 bp, R. norvegicus
tttttaaagaaagcat

SEQ ID NO: 533932 - DNA, 16 bp, R. norvegicus
tttttaaagaaagttg

SEQ ID NO: 533933 - DNA, 16 bp, R. norvegicus
tttttaaagaaatgat

SEQ ID NO: 533934 - DNA, 16 bp, R. norvegicus
tttttaaagaaatgtt

SEQ ID NO: 533935 - DNA, 16 bp, R. norvegicus
tttttaaagaacaata

SEQ ID NO: 533936 - DNA, 16 bp, R. norvegicus
tttttaaagaagaaat

SEQ ID NO: 533937 - DNA, 16 bp, R. norvegicus
tttttaaagacaaaaa

SEQ ID NO: 533938 - DNA, 16 bp, R. norvegicus
tttttaaagatttcct

SEQ ID NO: 533939 - DNA, 16 bp, R. norvegicus
tttttaaagcttttat

SEQ ID NO: 533940 - DNA, 16 bp, R. norvegicus
tttttaaaggaggaaa

SEQ ID NO: 533941 - DNA, 16 bp, R. norvegicus
tttttaaaggcaaaaa

SEQ ID NO: 533942 - DNA, 16 bp, R. norvegicus
tttttaaataacaaag

SEQ ID NO: 533943 - DNA, 16 bp, R. norvegicus
tttttaaatctgaaaa

SEQ ID NO: 533944 - DNA, 16 bp, R. norvegicus
tttttaaatgaatgtg

SEQ ID NO: 533945 - DNA, 16 bp, R. norvegicus
tttttaaattgtttca

SEQ ID NO: 533946 - DNA, 16 bp, R. norvegicus
tttttaactctatgaa

SEQ ID NO: 533947 - DNA, 16 bp, R. norvegicus
tttttaagaaaaacaa

SEQ ID NO: 533948 - DNA, 16 bp, R. norvegicus
tttttaagaaagattt

SEQ ID NO: 533949 - DNA, 16 bp, R. norvegicus
tttttaagagctgaat

SEQ ID NO: 533950 - DNA, 16 bp, R. norvegicus
tttttaagattcattt

SEQ ID NO: 533951 - DNA, 16 bp, R. norvegicus
tttttaagattccttc

SEQ ID NO: 533952 - DNA, 16 bp, R. norvegicus
tttttaagtaagaaaa

SEQ ID NO: 533953 - DNA, 16 bp, R. norvegicus
tttttaatgactactt

SEQ ID NO: 533954 - DNA, 16 bp, R. norvegicus
tttttaatggaaacaa

SEQ ID NO: 533955 - DNA, 16 bp, R. norvegicus
tttttaattgagaaaa

SEQ ID NO: 533956 - DNA, 16 bp, R. norvegicus
tttttaattttacaag

SEQ ID NO: 533957 - DNA, 16 bp, R. norvegicus
tttttacaacaacaaa

SEQ ID NO: 533958 - DNA, 16 bp, R. norvegicus
tttttacaatgttaat

SEQ ID NO: 533959 - DNA, 16 bp, R. norvegicus
tttttacatggccttg

SEQ ID NO: 533960 - DNA, 16 bp, R. norvegicus
tttttaccacaacaca

SEQ ID NO: 533961 - DNA, 16 bp, R. norvegicus
tttttaccacagcaac

SEQ ID NO: 533962 - DNA, 16 bp, R. norvegicus
tttttactctgtgtgt

SEQ ID NO: 533963 - DNA, 16 bp, R. norvegicus
tttttactgtaaaaat

SEQ ID NO: 533964 - DNA, 16 bp, R. norvegicus
tttttacttttgaaat

SEQ ID NO: 533965 - DNA, 16 bp, R. norvegicus
tttttagaagaaagaa

SEQ ID NO: 533966 - DNA, 16 bp, R. norvegicus
tttttagataggatct

SEQ ID NO: 533967 - DNA, 16 bp, R. norvegicus
tttttagcctgtttat

SEQ ID NO: 533968 - DNA, 16 bp, R. norvegicus
tttttaggcagggtct

SEQ ID NO: 533969 - DNA, 16 bp, R. norvegicus
tttttatagtgtccca

SEQ ID NO: 533970 - DNA, 16 bp, R. norvegicus
tttttatatgaagttg

SEQ ID NO: 533971 - DNA, 16 bp, R. norvegicus
tttttattgggcagtt

SEQ ID NO: 533972 - DNA, 16 bp, R. norvegicus
tttttatttacttgag

SEQ ID NO: 533973 - DNA, 16 bp, R. norvegicus
tttttatttcaaaaca

SEQ ID NO: 533974 - DNA, 16 bp, R. norvegicus
tttttatttgaaagaa

SEQ ID NO: 533975 - DNA, 16 bp, R. norvegicus
tttttatttggagaca

SEQ ID NO: 533976 - DNA, 16 bp, R. norvegicus
tttttcaaaaaaagaa

SEQ ID NO: 533977 - DNA, 16 bp, R. norvegicus
tttttcaaaacccact

SEQ ID NO: 533978 - DNA, 16 bp, R. norvegicus
tttttcaaaaggaaaa

SEQ ID NO: 533979 - DNA, 16 bp, R. norvegicus
tttttcaaaatagaaa

SEQ ID NO: 533980 - DNA, 16 bp, R. norvegicus
tttttcaaaggctttt

SEQ ID NO: 533981 - DNA, 16 bp, R. norvegicus
tttttcaatgttttaa

SEQ ID NO: 533982 - DNA, 16 bp, R. norvegicus
tttttcagaaaaagaa

SEQ ID NO: 533983 - DNA, 16 bp, R. norvegicus
tttttcagaggaccca

SEQ ID NO: 533984 - DNA, 16 bp, R. norvegicus
tttttcagatggcata

SEQ ID NO: 533985 - DNA, 16 bp, R. norvegicus
tttttcagggaatgtt

SEQ ID NO: 533986 - DNA, 16 bp, R. norvegicus
tttttcatagaatatc

SEQ ID NO: 533987 - DNA, 16 bp, R. norvegicus
tttttcatctgtgttg

SEQ ID NO: 533988 - DNA, 16 bp, R. norvegicus
tttttcatttctagaa

SEQ ID NO: 533989 - DNA, 16 bp, R. norvegicus
tttttccaaaagaaaa

SEQ ID NO: 533990 - DNA, 16 bp, R. norvegicus
tttttccagagctgag

SEQ ID NO: 533991 - DNA, 16 bp, R. norvegicus
tttttccagtgtatat

SEQ ID NO: 533992 - DNA, 16 bp, R. norvegicus
tttttccattgtgtat

SEQ ID NO: 533993 - DNA, 16 bp, R. norvegicus
tttttccccactgttt

SEQ ID NO: 533994 - DNA, 16 bp, R. norvegicus
tttttcccctttaaaa

SEQ ID NO: 533995 - DNA, 16 bp, R. norvegicus
tttttccccttttaaa

SEQ ID NO: 533996 - DNA, 16 bp, R. norvegicus
tttttcctcatttaaa

SEQ ID NO: 533997 - DNA, 16 bp, R. norvegicus
tttttcctctctgcag

SEQ ID NO: 533998 - DNA, 16 bp, R. norvegicus
tttttcctgtctactg

SEQ ID NO: 533999 - DNA, 16 bp, R. norvegicus
tttttccttaaaataa

SEQ ID NO: 534000 - DNA, 16 bp, R. norvegicus
tttttccttccagttt

SEQ ID NO: 534001 - DNA, 16 bp, R. norvegicus
tttttccttctgtgag

SEQ ID NO: 534002 - DNA, 16 bp, R. norvegicus
tttttcctttgataag

SEQ ID NO: 534003 - DNA, 16 bp, R. norvegicus
tttttcctttggaaaa

SEQ ID NO: 534004 - DNA, 16 bp, R. norvegicus
tttttctaaaagaaac

SEQ ID NO: 534005 - DNA, 16 bp, R. norvegicus
tttttctaaatatgaa

SEQ ID NO: 534006 - DNA, 16 bp, R. norvegicus
tttttctaactctgtg

SEQ ID NO: 534007 - DNA, 16 bp, R. norvegicus
tttttctacttggttg

SEQ ID NO: 534008 - DNA, 16 bp, R. norvegicus
tttttctattgctgtg

SEQ ID NO: 534009 - DNA, 16 bp, R. norvegicus
tttttctattttagaa

SEQ ID NO: 534010 - DNA, 16 bp, R. norvegicus
tttttctcagccattt

SEQ ID NO: 534011 - DNA, 16 bp, R. norvegicus
tttttctccttcagtt

SEQ ID NO: 534012 - DNA, 16 bp, R. norvegicus
tttttctctgattggg

SEQ ID NO: 534013 - DNA, 16 bp, R. norvegicus
tttttctgccttttac

SEQ ID NO: 534014 - DNA, 16 bp, R. norvegicus
tttttctggaatattt

SEQ ID NO: 534015 - DNA, 16 bp, R. norvegicus
tttttctgtgatttgg

SEQ ID NO: 534016 - DNA, 16 bp, R. norvegicus
tttttctgtgtggccc

SEQ ID NO: 534017 - DNA, 16 bp, R. norvegicus
tttttctgttaaaaat

SEQ ID NO: 534018 - DNA, 16 bp, R. norvegicus
tttttctgtttctaaa

SEQ ID NO: 534019 - DNA, 16 bp, R. norvegicus
tttttcttaaaaaaga

SEQ ID NO: 534020 - DNA, 16 bp, R. norvegicus
tttttcttaaagacaa

SEQ ID NO: 534021 - DNA, 16 bp, R. norvegicus
tttttcttaatgaaaa

SEQ ID NO: 534022 - DNA, 16 bp, R. norvegicus
tttttcttaattagtg

SEQ ID NO: 534023 - DNA, 16 bp, R. norvegicus
tttttcttcggagctg

SEQ ID NO: 534024 - DNA, 16 bp, R. norvegicus
tttttcttgaagaaaa

SEQ ID NO: 534025 - DNA, 16 bp, R. norvegicus
tttttcttgttagagg

SEQ ID NO: 534026 - DNA, 16 bp, R. norvegicus
tttttctttcaaatgt

SEQ ID NO: 534027 - DNA, 16 bp, R. norvegicus
tttttctttcatgaat

SEQ ID NO: 534028 - DNA, 16 bp, R. norvegicus
tttttctttcccaagt

SEQ ID NO: 534029 - DNA, 16 bp, R. norvegicus
tttttctttcttagaa

SEQ ID NO: 534030 - DNA, 16 bp, R. norvegicus
tttttcttttactgga

SEQ ID NO: 534031 - DNA, 16 bp, R. norvegicus
tttttcttttagagaa

SEQ ID NO: 534032 - DNA, 16 bp, R. norvegicus
tttttctttttaaaga

SEQ ID NO: 534033 - DNA, 16 bp, R. norvegicus
tttttgaaaaagaaag

SEQ ID NO: 534034 - DNA, 16 bp, R. norvegicus
tttttgaaaggagaaa

SEQ ID NO: 534035 - DNA, 16 bp, R. norvegicus
tttttgaagaaaatat

SEQ ID NO: 534036 - DNA, 16 bp, R. norvegicus
tttttgaatctcctct

SEQ ID NO: 534037 - DNA, 16 bp, R. norvegicus
tttttgacaaagaaga

SEQ ID NO: 534038 - DNA, 16 bp, R. norvegicus
tttttgacattttaat

SEQ ID NO: 534039 - DNA, 16 bp, R. norvegicus
tttttgagacaggttt

SEQ ID NO: 534040 - DNA, 16 bp, R. norvegicus
tttttgatcttagaac

SEQ ID NO: 534041 - DNA, 16 bp, R. norvegicus
tttttgctttaaaaaa

SEQ ID NO: 534042 - DNA, 16 bp, R. norvegicus
tttttggaaaatctct

SEQ ID NO: 534043 - DNA, 16 bp, R. norvegicus
tttttggaaacagggt

SEQ ID NO: 534044 - DNA, 16 bp, R. norvegicus
tttttggaccctgcat

SEQ ID NO: 534045 - DNA, 16 bp, R. norvegicus
tttttggagacaaagt

SEQ ID NO: 534046 - DNA, 16 bp, R. norvegicus
tttttggaggttcttt

SEQ ID NO: 534047 - DNA, 16 bp, R. norvegicus
tttttggagttgggga

SEQ ID NO: 534048 - DNA, 16 bp, R. norvegicus
tttttggatgacttca

SEQ ID NO: 534049 - DNA, 16 bp, R. norvegicus
tttttgggacaaggtc

SEQ ID NO: 534050 - DNA, 16 bp, R. norvegicus
tttttgggcctctcag

SEQ ID NO: 534051 - DNA, 16 bp, R. norvegicus
tttttgtcatggtgtt

SEQ ID NO: 534052 - DNA, 16 bp, R. norvegicus
tttttgtctttataaa

SEQ ID NO: 534053 - DNA, 16 bp, R. norvegicus
tttttgtgaagagaca

SEQ ID NO: 534054 - DNA, 16 bp, R. norvegicus
tttttgtgattcctgt

SEQ ID NO: 534055 - DNA, 16 bp, R. norvegicus
tttttgtgtatgaatg

SEQ ID NO: 534056 - DNA, 16 bp, R. norvegicus
tttttgtgtgcatttg

SEQ ID NO: 534057 - DNA, 16 bp, R. norvegicus
tttttgttcctgaagt

SEQ ID NO: 534058 - DNA, 16 bp, R. norvegicus
tttttgtttctactca

SEQ ID NO: 534059 - DNA, 16 bp, R. norvegicus
tttttgttttaaacag

SEQ ID NO: 534060 - DNA, 16 bp, R. norvegicus
ttttttaaaaaagaga

SEQ ID NO: 534061 - DNA, 16 bp, R. norvegicus
ttttttaaaaagactt

SEQ ID NO: 534062 - DNA, 16 bp, R. norvegicus
ttttttaaaaggacaa

SEQ ID NO: 534063 - DNA, 16 bp, R. norvegicus
ttttttaaaaggagaa

SEQ ID NO: 534064 - DNA, 16 bp, R. norvegicus
ttttttaaacaaatga

SEQ ID NO: 534065 - DNA, 16 bp, R. norvegicus
ttttttaaagaagaag

SEQ ID NO: 534066 - DNA, 16 bp, R. norvegicus
ttttttaaagacaaaa

SEQ ID NO: 534067 - DNA, 16 bp, R. norvegicus
ttttttaaagttgctt

SEQ ID NO: 534068 - DNA, 16 bp, R. norvegicus
ttttttaaatagttct

SEQ ID NO: 534069 - DNA, 16 bp, R. norvegicus
ttttttaacagaaaaa

SEQ ID NO: 534070 - DNA, 16 bp, R. norvegicus
ttttttaagagaaaga

SEQ ID NO: 534071 - DNA, 16 bp, R. norvegicus
ttttttaaggaagaaa

SEQ ID NO: 534072 - DNA, 16 bp, R. norvegicus
ttttttaagtgaaaaa

SEQ ID NO: 534073 - DNA, 16 bp, R. norvegicus
ttttttaatggaaaaa

SEQ ID NO: 534074 - DNA, 16 bp, R. norvegicus
ttttttaatttgcaaa

SEQ ID NO: 534075 - DNA, 16 bp, R. norvegicus
ttttttacaaaagaaa

SEQ ID NO: 534076 - DNA, 16 bp, R. norvegicus
ttttttacaatccagt

SEQ ID NO: 534077 - DNA, 16 bp, R. norvegicus
ttttttacagtacagt

SEQ ID NO: 534078 - DNA, 16 bp, R. norvegicus
ttttttactggatatt

SEQ ID NO: 534079 - DNA, 16 bp, R. norvegicus
ttttttataaaacaca

SEQ ID NO: 534080 - DNA, 16 bp, R. norvegicus
ttttttatcttagcca

SEQ ID NO: 534081 - DNA, 16 bp, R. norvegicus
ttttttcatggaatat

SEQ ID NO: 534082 - DNA, 16 bp, R. norvegicus
ttttttccaacataat

SEQ ID NO: 534083 - DNA, 16 bp, R. norvegicus
ttttttccccagaaaa

SEQ ID NO: 534084 - DNA, 16 bp, R. norvegicus
ttttttcccccttgga

SEQ ID NO: 534085 - DNA, 16 bp, R. norvegicus
ttttttccctgaagtt

SEQ ID NO: 534086 - DNA, 16 bp, R. norvegicus
ttttttccctgcagtt

SEQ ID NO: 534087 - DNA, 16 bp, R. norvegicus
ttttttcctttcaaaa

SEQ ID NO: 534088 - DNA, 16 bp, R. norvegicus
ttttttcggagctggc

SEQ ID NO: 534089 - DNA, 16 bp, R. norvegicus
ttttttctagagattt

SEQ ID NO: 534090 - DNA, 16 bp, R. norvegicus
ttttttctcaattaca

SEQ ID NO: 534091 - DNA, 16 bp, R. norvegicus
ttttttcttaaagaaa

SEQ ID NO: 534092 - DNA, 16 bp, R. norvegicus
ttttttcttaatgaca

SEQ ID NO: 534093 - DNA, 16 bp, R. norvegicus
ttttttcttgaaaaaa

SEQ ID NO: 534094 - DNA, 16 bp, R. norvegicus
ttttttcttgaaaaat

SEQ ID NO: 534095 - DNA, 16 bp, R. norvegicus
ttttttctttccagaa

SEQ ID NO: 534096 - DNA, 16 bp, R. norvegicus
ttttttctttcctgga

SEQ ID NO: 534097 - DNA, 16 bp, R. norvegicus
ttttttctttctcagc

SEQ ID NO: 534098 - DNA, 16 bp, R. norvegicus
ttttttcttttaagaa

SEQ ID NO: 534099 - DNA, 16 bp, R. norvegicus
ttttttcttttgaaag

SEQ ID NO: 534100 - DNA, 16 bp, R. norvegicus
ttttttgagaccaagt

SEQ ID NO: 534101 - DNA, 16 bp, R. norvegicus
ttttttgaggcagggt

SEQ ID NO: 534102 - DNA, 16 bp, R. norvegicus
ttttttgaggtagagt

SEQ ID NO: 534103 - DNA, 16 bp, R. norvegicus
ttttttgatgaccttt

SEQ ID NO: 534104 - DNA, 17 bp, R. norvegicus
ttttttgctaactttga

SEQ ID NO: 534105 - DNA, 16 bp, R. norvegicus
ttttttgtaaagaaaa

SEQ ID NO: 534106 - DNA, 16 bp, R. norvegicus
tttttttaaacatcaa

SEQ ID NO: 534107 - DNA, 16 bp, R. norvegicus
tttttttaaagaacag

SEQ ID NO: 534108 - DNA, 16 bp, R. norvegicus
tttttttaaaggcttt

SEQ ID NO: 534109 - DNA, 16 bp, R. norvegicus
tttttttaaatcaagt

SEQ ID NO: 534110 - DNA, 16 bp, R. norvegicus
tttttttaaatcagca

SEQ ID NO: 534111 - DNA, 16 bp, R. norvegicus
tttttttaaatctgga

SEQ ID NO: 534112 - DNA, 16 bp, R. norvegicus
tttttttaaatgccta

SEQ ID NO: 534113 - DNA, 16 bp, R. norvegicus
tttttttaacctgtgt

SEQ ID NO: 534114 - DNA, 16 bp, R. norvegicus
tttttttaactgaaaa

SEQ ID NO: 534115 - DNA, 16 bp, R. norvegicus
tttttttaagtctaaa

SEQ ID NO: 534116 - DNA, 18 bp, R. norvegicus
tttttttaatggagtgtg

SEQ ID NO: 534117 - DNA, 16 bp, R. norvegicus
tttttttcaaaattgt

SEQ ID NO: 534118 - DNA, 16 bp, R. norvegicus
tttttttcaatgaaaa

SEQ ID NO: 534119 - DNA, 16 bp, R. norvegicus
tttttttcataagaaa

SEQ ID NO: 534120 - DNA, 16 bp, R. norvegicus
tttttttccagaaaaa

SEQ ID NO: 534121 - DNA, 16 bp, R. norvegicus
tttttttccagaaaga

SEQ ID NO: 534122 - DNA, 16 bp, R. norvegicus
tttttttccggagctg

SEQ ID NO: 534123 - DNA, 16 bp, R. norvegicus
tttttttcctccccaa

SEQ ID NO: 534124 - DNA, 16 bp, R. norvegicus
tttttttcctgaaaca

SEQ ID NO: 534125 - DNA, 16 bp, R. norvegicus
tttttttccttcaaaa

SEQ ID NO: 534126 - DNA, 16 bp, R. norvegicus
tttttttcctttgcaa

SEQ ID NO: 534127 - DNA, 20 bp, R. norvegicus
tttttttcggagctggggac

SEQ ID NO: 534128 - DNA, 16 bp, R. norvegicus
tttttttctctctgaa

SEQ ID NO: 534129 - DNA, 16 bp, R. norvegicus
tttttttctgaaatca

SEQ ID NO: 534130 - DNA, 16 bp, R. norvegicus
tttttttctgaaatta

SEQ ID NO: 534131 - DNA, 16 bp, R. norvegicus
tttttttctgagaaaa

SEQ ID NO: 534132 - DNA, 16 bp, R. norvegicus
tttttttctgctaaaa

SEQ ID NO: 534133 - DNA, 16 bp, R. norvegicus
tttttttcttctaaga

SEQ ID NO: 534134 - DNA, 28 bp, R. norvegicus
tttttttggagctggggaccgaacccag

SEQ ID NO: 534135 - DNA, 16 bp, R. norvegicus
ttttttttaacagagg

SEQ ID NO: 534136 - DNA, 16 bp, R. norvegicus
ttttttttaaccaaaa

SEQ ID NO: 534137 - DNA, 16 bp, R. norvegicus
ttttttttaactgaag

SEQ ID NO: 534138 - DNA, 16 bp, R. norvegicus
ttttttttcagtgaat

SEQ ID NO: 534139 - DNA, 16 bp, R. norvegicus
ttttttttcattgaaa

SEQ ID NO: 534140 - DNA, 16 bp, R. norvegicus
ttttttttccagagac

SEQ ID NO: 534141 - DNA, 16 bp, R. norvegicus
ttttttttccccacac

SEQ ID NO: 534142 - DNA, 16 bp, R. norvegicus
ttttttttcccccaaa

SEQ ID NO: 534143 - DNA, 16 bp, R. norvegicus
ttttttttccctgagt

SEQ ID NO: 534144 - DNA, 31 bp, R. norvegicus
ttttttttcggagctggggaccaaacccagg

SEQ ID NO: 534145 - DNA, 16 bp, R. norvegicus
ttttttttctagaaaa

SEQ ID NO: 534146 - DNA, 16 bp, R. norvegicus
ttttttttctgaaaat

SEQ ID NO: 534147 - DNA, 16 bp, R. norvegicus
ttttttttctgacaga

SEQ ID NO: 534148 - DNA, 16 bp, R. norvegicus
ttttttttctggaaaa

SEQ ID NO: 534149 - DNA, 16 bp, R. norvegicus
ttttttttgaaacaga

SEQ ID NO: 534150 - DNA, 16 bp, R. norvegicus
ttttttttgaagaaaa

SEQ ID NO: 534151 - DNA, 16 bp, R. norvegicus
ttttttttgtctcaaa

SEQ ID NO: 534152 - DNA, 16 bp, R. norvegicus
tttttttttaagacag

SEQ ID NO: 534153 - DNA, 16 bp, R. norvegicus
tttttttttaatgcaa

SEQ ID NO: 534154 - DNA, 16 bp, R. norvegicus
tttttttttaatgcag

SEQ ID NO: 534155 - DNA, 16 bp, R. norvegicus
tttttttttcagaaga

SEQ ID NO: 534156 - DNA, 16 bp, R. norvegicus
tttttttttctcaaag

SEQ ID NO: 534157 - DNA, 16 bp, R. norvegicus
ttttttttttaaagca

SEQ ID NO: 534158 - DNA, 16 bp, G. gallus
aaaaaaaaaagccttt

SEQ ID NO: 534159 - DNA, 16 bp, G. gallus
aaaaaaaaaagtgctt

SEQ ID NO: 534160 - DNA, 16 bp, G. gallus
aaaaaaaaaagttttc

SEQ ID NO: 534161 - DNA, 16 bp, G. gallus
aaaaaaaaagcactgc

SEQ ID NO: 534162 - DNA, 16 bp, G. gallus
aaaaaaaaagcttctg

SEQ ID NO: 534163 - DNA, 16 bp, G. gallus
aaaaaaaaagcttttc

SEQ ID NO: 534164 - DNA, 16 bp, G. gallus
aaaaaaaaaggctttt

SEQ ID NO: 534165 - DNA, 16 bp, G. gallus
aaaaaaaaagtacttt

SEQ ID NO: 534166 - DNA, 16 bp, G. gallus
aaaaaaaaagtagtct

SEQ ID NO: 534167 - DNA, 16 bp, G. gallus
aaaaaaaaatactgct

SEQ ID NO: 534168 - DNA, 16 bp, G. gallus
aaaaaaaaatccagtg

SEQ ID NO: 534169 - DNA, 16 bp, G. gallus
aaaaaaaaatctgctt

SEQ ID NO: 534170 - DNA, 16 bp, G. gallus
aaaaaaaaatctggga

SEQ ID NO: 534171 - DNA, 16 bp, G. gallus
aaaaaaaaattgcttt

SEQ ID NO: 534172 - DNA, 16 bp, G. gallus
aaaaaaaacagctttg

SEQ ID NO: 534173 - DNA, 16 bp, G. gallus
aaaaaaaagaatgctt

SEQ ID NO: 534174 - DNA, 16 bp, G. gallus
aaaaaaaagcctttaa

SEQ ID NO: 534175 - DNA, 16 bp, G. gallus
aaaaaaaatcacactg

SEQ ID NO: 534176 - DNA, 16 bp, G. gallus
aaaaaaaatgctgttt

SEQ ID NO: 534177 - DNA, 16 bp, G. gallus
aaaaaaaattgttttc

SEQ ID NO: 534178 - DNA, 16 bp, G. gallus
aaaaaaacaaaccctg

SEQ ID NO: 534179 - DNA, 16 bp, G. gallus
aaaaaaacagattttt

SEQ ID NO: 534180 - DNA, 16 bp, G. gallus
aaaaaaagctttaaat

SEQ ID NO: 534181 - DNA, 16 bp, G. gallus
aaaaaaataaatctgt

SEQ ID NO: 534182 - DNA, 16 bp, G. gallus
aaaaaaatactgtttt

SEQ ID NO: 534183 - DNA, 16 bp, G. gallus
aaaaaaatcactgaat

SEQ ID NO: 534184 - DNA, 16 bp, G. gallus
aaaaaaatcacttttt

SEQ ID NO: 534185 - DNA, 16 bp, G. gallus
aaaaaaatcagtgcaa

SEQ ID NO: 534186 - DNA, 16 bp, G. gallus
aaaaaaatctgaaatt

SEQ ID NO: 534187 - DNA, 16 bp, G. gallus
aaaaaaatctgcttac

SEQ ID NO: 534188 - DNA, 16 bp, G. gallus
aaaaaaatcttcagaa

SEQ ID NO: 534189 - DNA, 16 bp, G. gallus
aaaaaaatgccttttt

SEQ ID NO: 534190 - DNA, 16 bp, G. gallus
aaaaaaatgttttcaa

SEQ ID NO: 534191 - DNA, 16 bp, G. gallus
aaaaaaatgttttcag

SEQ ID NO: 534192 - DNA, 16 bp, G. gallus
aaaaaaattgtttctt

SEQ ID NO: 534193 - DNA, 16 bp, G. gallus
aaaaaagaaatctttt

SEQ ID NO: 534194 - DNA, 16 bp, G. gallus
aaaaaagcagcagcag

SEQ ID NO: 534195 - DNA, 16 bp, G. gallus
aaaaaatgtgtatttt

SEQ ID NO: 534196 - DNA, 16 bp, G. gallus
aaaaaatgttttcctt

SEQ ID NO: 534197 - DNA, 16 bp, G. gallus
aaaaacagttattggc

SEQ ID NO: 534198 - DNA, 16 bp, G. gallus
aaaaacattttctttt

SEQ ID NO: 534199 - DNA, 16 bp, G. gallus
aaaaacatttttttct

SEQ ID NO: 534200 - DNA, 16 bp, G. gallus
aaaaaccactaagatc

SEQ ID NO: 534201 - DNA, 16 bp, G. gallus
aaaaaccttttcctta

SEQ ID NO: 534202 - DNA, 16 bp, G. gallus
aaaaactccaagagga

SEQ ID NO: 534203 - DNA, 16 bp, G. gallus
aaaaactgtttggatg

SEQ ID NO: 534204 - DNA, 16 bp, G. gallus
aaaaactgttttgttt

SEQ ID NO: 534205 - DNA, 16 bp, G. gallus
aaaaactttacagaaa

SEQ ID NO: 534206 - DNA, 16 bp, G. gallus
aaaaagaaaaatctgt

SEQ ID NO: 534207 - DNA, 16 bp, G. gallus
aaaaagaaatatttct

SEQ ID NO: 534208 - DNA, 16 bp, G. gallus
aaaaagaaatattttc

SEQ ID NO: 534209 - DNA, 16 bp, G. gallus
aaaaagcattttaaaa

SEQ ID NO: 534210 - DNA, 16 bp, G. gallus
aaaaagctattttttt

SEQ ID NO: 534211 - DNA, 16 bp, G. gallus
aaaaaggaccacaatg

SEQ ID NO: 534212 - DNA, 16 bp, G. gallus
aaaaaggaggcattac

SEQ ID NO: 534213 - DNA, 16 bp, G. gallus
aaaaagtcttttacag

SEQ ID NO: 534214 - DNA, 16 bp, G. gallus
aaaaagtgatgacatg

SEQ ID NO: 534215 - DNA, 16 bp, G. gallus
aaaaatatggatttga

SEQ ID NO: 534216 - DNA, 16 bp, G. gallus
aaaaatatttccattt

SEQ ID NO: 534217 - DNA, 16 bp, G. gallus
aaaaatattttcagaa

SEQ ID NO: 534218 - DNA, 16 bp, G. gallus
aaaaatatttttcagt

SEQ ID NO: 534219 - DNA, 16 bp, G. gallus
aaaaatgcattttaaa

SEQ ID NO: 534220 - DNA, 16 bp, G. gallus
aaaaatgctttaaaaa

SEQ ID NO: 534221 - DNA, 16 bp, G. gallus
aaaaatgtattttcct

SEQ ID NO: 534222 - DNA, 16 bp, G. gallus
aaaaatgtattttctt

SEQ ID NO: 534223 - DNA, 16 bp, G. gallus
aaaaatgtttcatttt

SEQ ID NO: 534224 - DNA, 16 bp, G. gallus
aaaaattcttctcaga

SEQ ID NO: 534225 - DNA, 16 bp, G. gallus
aaaacaaaatatttga

SEQ ID NO: 534226 - DNA, 16 bp, G. gallus
aaaacaatgctgataa

SEQ ID NO: 534227 - DNA, 16 bp, G. gallus
aaaacactatttttca

SEQ ID NO: 534228 - DNA, 16 bp, G. gallus
aaaacagaaaacattt

SEQ ID NO: 534229 - DNA, 16 bp, G. gallus
aaaacagacttttttt

SEQ ID NO: 534230 - DNA, 16 bp, G. gallus
aaaacagattttaaaa

SEQ ID NO: 534231 - DNA, 16 bp, G. gallus
aaaacagcagcagcaa

SEQ ID NO: 534232 - DNA, 16 bp, G. gallus
aaaacagcagcagcag

SEQ ID NO: 534233 - DNA, 16 bp, G. gallus
aaaacagtgctgataa

SEQ ID NO: 534234 - DNA, 16 bp, G. gallus
aaaacagtggcaatga

SEQ ID NO: 534235 - DNA, 16 bp, G. gallus
aaaacagtgttttgta

SEQ ID NO: 534236 - DNA, 16 bp, G. gallus
aaaacagttgttcaca

SEQ ID NO: 534237 - DNA, 16 bp, G. gallus
aaaactgatttttttt

SEQ ID NO: 534238 - DNA, 16 bp, G. gallus
aaaactgcacacagtg

SEQ ID NO: 534239 - DNA, 16 bp, G. gallus
aaaactggggaaaaaa

SEQ ID NO: 534240 - DNA, 16 bp, G. gallus
aaaactgtgtgtgtgt

SEQ ID NO: 534241 - DNA, 16 bp, G. gallus
aaaagaaaaacatttt

SEQ ID NO: 534242 - DNA, 16 bp, G. gallus
aaaagaaaaaggcatt

SEQ ID NO: 534243 - DNA, 16 bp, G. gallus
aaaagaaaagcatttt

SEQ ID NO: 534244 - DNA, 16 bp, G. gallus
aaaagaacctcaaaga

SEQ ID NO: 534245 - DNA, 16 bp, G. gallus
aaaagacctccaaaat

SEQ ID NO: 534246 - DNA, 16 bp, G. gallus
aaaagacctcttagat

SEQ ID NO: 534247 - DNA, 16 bp, G. gallus
aaaagactgctaagat

SEQ ID NO: 534248 - DNA, 16 bp, G. gallus
aaaagactttttcctt

SEQ ID NO: 534249 - DNA, 16 bp, G. gallus
aaaagagaggaaattt

SEQ ID NO: 534250 - DNA, 16 bp, G. gallus
aaaagaggggatattt

SEQ ID NO: 534251 - DNA, 16 bp, G. gallus
aaaagatgattttttt

SEQ ID NO: 534252 - DNA, 16 bp, G. gallus
aaaagatgtttttctt

SEQ ID NO: 534253 - DNA, 16 bp, G. gallus
aaaagcagcagcagaa

SEQ ID NO: 534254 - DNA, 16 bp, G. gallus
aaaagcatggccagca

SEQ ID NO: 534255 - DNA, 16 bp, G. gallus
aaaagccagaaactgt

SEQ ID NO: 534256 - DNA, 16 bp, G. gallus
aaaagccttttctttt

SEQ ID NO: 534257 - DNA, 16 bp, G. gallus
aaaagccttttttttt

SEQ ID NO: 534258 - DNA, 16 bp, G. gallus
aaaagcttttaaaata

SEQ ID NO: 534259 - DNA, 16 bp, G. gallus
aaaaggaaaatttgtg

SEQ ID NO: 534260 - DNA, 16 bp, G. gallus
aaaaggaaattaagtt

SEQ ID NO: 534261 - DNA, 16 bp, G. gallus
aaaaggacttcaaaga

SEQ ID NO: 534262 - DNA, 16 bp, G. gallus
aaaaggaggggaatca

SEQ ID NO: 534263 - DNA, 16 bp, G. gallus
aaaaggttctgcacca

SEQ ID NO: 534264 - DNA, 16 bp, G. gallus
aaaagtaatgctttct

SEQ ID NO: 534265 - DNA, 16 bp, G. gallus
aaaataaagatgaggt

SEQ ID NO: 534266 - DNA, 16 bp, G. gallus
aaaataaatatttctg

SEQ ID NO: 534267 - DNA, 16 bp, G. gallus
aaaataacttccttaa

SEQ ID NO: 534268 - DNA, 16 bp, G. gallus
aaaatagcattttgta

SEQ ID NO: 534269 - DNA, 16 bp, G. gallus
aaaatatttctgaaaa

SEQ ID NO: 534270 - DNA, 16 bp, G. gallus
aaaatattttaaaagc

SEQ ID NO: 534271 - DNA, 16 bp, G. gallus
aaaatatttttccatt

SEQ ID NO: 534272 - DNA, 16 bp, G. gallus
aaaatcaactctgtcc

SEQ ID NO: 534273 - DNA, 16 bp, G. gallus
aaaatcatagaatcct

SEQ ID NO: 534274 - DNA, 16 bp, G. gallus
aaaatctgcatcagtg

SEQ ID NO: 534275 - DNA, 16 bp, G. gallus
aaaatctgcatggctg

SEQ ID NO: 534276 - DNA, 16 bp, G. gallus
aaaatgcaggacctga

SEQ ID NO: 534277 - DNA, 16 bp, G. gallus
aaaatgcattttaaaa

SEQ ID NO: 534278 - DNA, 16 bp, G. gallus
aaaatgctttttaaaa

SEQ ID NO: 534279 - DNA, 16 bp, G. gallus
aaaatggaacagaata

SEQ ID NO: 534280 - DNA, 16 bp, G. gallus
aaaatggcacccactg

SEQ ID NO: 534281 - DNA, 16 bp, G. gallus
aaaatggcatttgaca

SEQ ID NO: 534282 - DNA, 16 bp, G. gallus
aaaatggccttggaag

SEQ ID NO: 534283 - DNA, 16 bp, G. gallus
aaaatggtacccactg

SEQ ID NO: 534284 - DNA, 16 bp, G. gallus
aaaatggtgtctgaca

SEQ ID NO: 534285 - DNA, 16 bp, G. gallus
aaaatgtttctttttc

SEQ ID NO: 534286 - DNA, 16 bp, G. gallus
aaaatttattctccaa

SEQ ID NO: 534287 - DNA, 16 bp, G. gallus
aaacaaaaaaagcttt

SEQ ID NO: 534288 - DNA, 16 bp, G. gallus
aaacaagagcctgcat

SEQ ID NO: 534289 - DNA, 16 bp, G. gallus
aaacaagaggcattac

SEQ ID NO: 534290 - DNA, 16 bp, G. gallus
aaacaagatgatcatt

SEQ ID NO: 534291 - DNA, 16 bp, G. gallus
aaacaatcccagttcc

SEQ ID NO: 534292 - DNA, 16 bp, G. gallus
aaacacttcttgaact

SEQ ID NO: 534293 - DNA, 16 bp, G. gallus
aaacagactttttttt

SEQ ID NO: 534294 - DNA, 16 bp, G. gallus
aaacagcggcaacgat

SEQ ID NO: 534295 - DNA, 16 bp, G. gallus
aaacaggagagggaat

SEQ ID NO: 534296 - DNA, 16 bp, G. gallus
aaacagtattattgtg

SEQ ID NO: 534297 - DNA, 16 bp, G. gallus
aaacagtcaggaacag

SEQ ID NO: 534298 - DNA, 16 bp, G. gallus
aaacatctgttttact

SEQ ID NO: 534299 - DNA, 16 bp, G. gallus
aaacatgatttttttt

SEQ ID NO: 534300 - DNA, 16 bp, G. gallus
aaacatttttttcctt

SEQ ID NO: 534301 - DNA, 16 bp, G. gallus
aaaccagatgatcatt

SEQ ID NO: 534302 - DNA, 16 bp, G. gallus
aaaccagatggtcatt

SEQ ID NO: 534303 - DNA, 16 bp, G. gallus
aaaccatttcccctca

SEQ ID NO: 534304 - DNA, 16 bp, G. gallus
aaacctgcctggacac

SEQ ID NO: 534305 - DNA, 16 bp, G. gallus
aaacctggccttgaac

SEQ ID NO: 534306 - DNA, 16 bp, G. gallus
aaactcttttacaaat

SEQ ID NO: 534307 - DNA, 16 bp, G. gallus
aaactgcacacagtac

SEQ ID NO: 534308 - DNA, 16 bp, G. gallus
aaactgcacccagtgc

SEQ ID NO: 534309 - DNA, 16 bp, G. gallus
aaactggaacacagga

SEQ ID NO: 534310 - DNA, 16 bp, G. gallus
aaactggaacatagga

SEQ ID NO: 534311 - DNA, 16 bp, G. gallus
aaactggagcatagga

SEQ ID NO: 534312 - DNA, 16 bp, G. gallus
aaactgggggaaaaaa

SEQ ID NO: 534313 - DNA, 16 bp, G. gallus
aaactgtaggaaaaaa

SEQ ID NO: 534314 - DNA, 16 bp, G. gallus
aaacttgatgatcctt

SEQ ID NO: 534315 - DNA, 16 bp, G. gallus
aaacttgctgagggca

SEQ ID NO: 534316 - DNA, 16 bp, G. gallus
aaactttccttttgtt

SEQ ID NO: 534317 - DNA, 16 bp, G. gallus
aaagaaaaaagctttt

SEQ ID NO: 534318 - DNA, 16 bp, G. gallus
aaagaaaaagcatttt

SEQ ID NO: 534319 - DNA, 16 bp, G. gallus
aaagaaaataaattct

SEQ ID NO: 534320 - DNA, 16 bp, G. gallus
aaagaaaatattttct

SEQ ID NO: 534321 - DNA, 16 bp, G. gallus
aaagaaaatgtatttt

SEQ ID NO: 534322 - DNA, 16 bp, G. gallus
aaagaaagattttttt

SEQ ID NO: 534323 - DNA, 16 bp, G. gallus
aaagaaatgtattttt

SEQ ID NO: 534324 - DNA, 16 bp, G. gallus
aaagaagaaaacattt

SEQ ID NO: 534325 - DNA, 16 bp, G. gallus
aaagaaggcattcaga

SEQ ID NO: 534326 - DNA, 16 bp, G. gallus
aaagaagtgcttcctg

SEQ ID NO: 534327 - DNA, 16 bp, G. gallus
aaagaagttcttctgc

SEQ ID NO: 534328 - DNA, 16 bp, G. gallus
aaagaatctgcttacc

SEQ ID NO: 534329 - DNA, 16 bp, G. gallus
aaagaatggcttgggt

SEQ ID NO: 534330 - DNA, 16 bp, G. gallus
aaagaattccaccaca

SEQ ID NO: 534331 - DNA, 16 bp, G. gallus
aaagacaagtcatgtt

SEQ ID NO: 534332 - DNA, 16 bp, G. gallus
aaagacagggatctcc

SEQ ID NO: 534333 - DNA, 16 bp, G. gallus
aaagaccactcagatc

SEQ ID NO: 534334 - DNA, 16 bp, G. gallus
aaagacctctcagatc

SEQ ID NO: 534335 - DNA, 16 bp, G. gallus
aaagaccttaaagacc

SEQ ID NO: 534336 - DNA, 16 bp, G. gallus
aaagacttcttttttt

SEQ ID NO: 534337 - DNA, 16 bp, G. gallus
aaagactttgccaccc

SEQ ID NO: 534338 - DNA, 16 bp, G. gallus
aaagagcacaatgaca

SEQ ID NO: 534339 - DNA, 16 bp, G. gallus
aaagagcagtcaggca

SEQ ID NO: 534340 - DNA, 16 bp, G. gallus
aaagaggggaaattta

SEQ ID NO: 534341 - DNA, 16 bp, G. gallus
aaagaggggatattta

SEQ ID NO: 534342 - DNA, 16 bp, G. gallus
aaagatcatctagttc

SEQ ID NO: 534343 - DNA, 16 bp, G. gallus
aaagatcttaaagatc

SEQ ID NO: 534344 - DNA, 16 bp, G. gallus
aaagatgtggagctct

SEQ ID NO: 534345 - DNA, 16 bp, G. gallus
aaagcaaaaatatttt

SEQ ID NO: 534346 - DNA, 16 bp, G. gallus
aaagcaattgctcacc

SEQ ID NO: 534347 - DNA, 16 bp, G. gallus
aaagcaatttttaaaa

SEQ ID NO: 534348 - DNA, 16 bp, G. gallus
aaagcagcagcagcaa

SEQ ID NO: 534349 - DNA, 16 bp, G. gallus
aaagcagctgcaggag

SEQ ID NO: 534350 - DNA, 16 bp, G. gallus
aaagcatttttcttct

SEQ ID NO: 534351 - DNA, 16 bp, G. gallus
aaagccagccatatcc

SEQ ID NO: 534352 - DNA, 16 bp, G. gallus
aaagccaggttggatg

SEQ ID NO: 534353 - DNA, 16 bp, G. gallus
aaagccattccccctt

SEQ ID NO: 534354 - DNA, 16 bp, G. gallus
aaagcccagctagaac

SEQ ID NO: 534355 - DNA, 16 bp, G. gallus
aaagctgcctgatgga

SEQ ID NO: 534356 - DNA, 16 bp, G. gallus
aaagctgctgtgtgga

SEQ ID NO: 534357 - DNA, 16 bp, G. gallus
aaagctggaaaagacc

SEQ ID NO: 534358 - DNA, 16 bp, G. gallus
aaagcttcaccaagga

SEQ ID NO: 534359 - DNA, 16 bp, G. gallus
aaagcttgctgaggaa

SEQ ID NO: 534360 - DNA, 16 bp, G. gallus
aaagctttttttcttt

SEQ ID NO: 534361 - DNA, 16 bp, G. gallus
aaaggaaaatattttt

SEQ ID NO: 534362 - DNA, 16 bp, G. gallus
aaaggaaaatggaaac

SEQ ID NO: 534363 - DNA, 19 bp, G. gallus
aaaggaccacagtgctcat

SEQ ID NO: 534364 - DNA, 16 bp, G. gallus
aaaggacctcaaggat

SEQ ID NO: 534365 - DNA, 16 bp, G. gallus
aaaggaggagagattt

SEQ ID NO: 534366 - DNA, 16 bp, G. gallus
aaaggaggtgatcctg

SEQ ID NO: 534367 - DNA, 16 bp, G. gallus
aaaggcaatgaagctg

SEQ ID NO: 534368 - DNA, 16 bp, G. gallus
aaaggcctgcatgctg

SEQ ID NO: 534369 - DNA, 17 bp, G. gallus
aaaggccttactgaaat

SEQ ID NO: 534370 - DNA, 16 bp, G. gallus
aaaggctgcaattagg

SEQ ID NO: 534371 - DNA, 16 bp, G. gallus
aaaggctgcagacaga

SEQ ID NO: 534372 - DNA, 16 bp, G. gallus
aaagggaaaaatattt

SEQ ID NO: 534373 - DNA, 16 bp, G. gallus
aaagggaaatggtttt

SEQ ID NO: 534374 - DNA, 16 bp, G. gallus
aaaggtgcttacagtg

SEQ ID NO: 534375 - DNA, 16 bp, G. gallus
aaaggtgtgtcactga

SEQ ID NO: 534376 - DNA, 16 bp, G. gallus
aaaggtgtttacagtg

SEQ ID NO: 534377 - DNA, 16 bp, G. gallus
aaagtgcaggacctgg

SEQ ID NO: 534378 - DNA, 16 bp, G. gallus
aaagtgggcacatgag

SEQ ID NO: 534379 - DNA, 16 bp, G. gallus
aaataaacaggaggca

SEQ ID NO: 534380 - DNA, 16 bp, G. gallus
aaataaataaaactgt

SEQ ID NO: 534381 - DNA, 16 bp, G. gallus
aaataaatcacatttt

SEQ ID NO: 534382 - DNA, 16 bp, G. gallus
aaataagaagcattac

SEQ ID NO: 534383 - DNA, 16 bp, G. gallus
aaataatgtctcctat

SEQ ID NO: 534384 - DNA, 16 bp, G. gallus
aaatacctgggattgc

SEQ ID NO: 534385 - DNA, 16 bp, G. gallus
aaatatgacttttttt

SEQ ID NO: 534386 - DNA, 16 bp, G. gallus
aaatatgcatatatat

SEQ ID NO: 534387 - DNA, 16 bp, G. gallus
aaatatgtatgtatat

SEQ ID NO: 534388 - DNA, 16 bp, G. gallus
aaatattggaaggctg

SEQ ID NO: 534389 - DNA, 16 bp, G. gallus
aaatattttacagtga

SEQ ID NO: 534390 - DNA, 16 bp, G. gallus
aaatattttcctttct

SEQ ID NO: 534391 - DNA, 16 bp, G. gallus
aaatatttttgttttc

SEQ ID NO: 534392 - DNA, 16 bp, G. gallus
aaatatttttttctga

SEQ ID NO: 534393 - DNA, 16 bp, G. gallus
aaatccaggaagaaaa

SEQ ID NO: 534394 - DNA, 16 bp, G. gallus
aaatccatacctctcc

SEQ ID NO: 534395 - DNA, 16 bp, G. gallus
aaatcctcagctacaa

SEQ ID NO: 534396 - DNA, 16 bp, G. gallus
aaatccttccccagtg

SEQ ID NO: 534397 - DNA, 16 bp, G. gallus
aaatgaatcacagaat

SEQ ID NO: 534398 - DNA, 16 bp, G. gallus
aaatgcaacagctgtg

SEQ ID NO: 534399 - DNA, 16 bp, G. gallus
aaatgcaagatcttgc

SEQ ID NO: 534400 - DNA, 16 bp, G. gallus
aaatgcacagctagtg

SEQ ID NO: 534401 - DNA, 16 bp, G. gallus
aaatgcattttaaaaa

SEQ ID NO: 534402 - DNA, 16 bp, G. gallus
aaatgccattttgtca

SEQ ID NO: 534403 - DNA, 16 bp, G. gallus
aaatgccttttttttt

SEQ ID NO: 534404 - DNA, 16 bp, G. gallus
aaatgctaaatctgtg

SEQ ID NO: 534405 - DNA, 16 bp, G. gallus
aaatgcttttattttt

SEQ ID NO: 534406 - DNA, 16 bp, G. gallus
aaatggaaaatatttt

SEQ ID NO: 534407 - DNA, 16 bp, G. gallus
aaatggaaatggaaat

SEQ ID NO: 534408 - DNA, 16 bp, G. gallus
aaatggatttgatgga

SEQ ID NO: 534409 - DNA, 16 bp, G. gallus
aaatggtttttaaaca

SEQ ID NO: 534410 - DNA, 16 bp, G. gallus
aaatgtggccagcagg

SEQ ID NO: 534411 - DNA, 16 bp, G. gallus
aaatgtgttttaaaat

SEQ ID NO: 534412 - DNA, 16 bp, G. gallus
aaatgtgttttcattt

SEQ ID NO: 534413 - DNA, 16 bp, G. gallus
aaatgtgtttttcttt

SEQ ID NO: 534414 - DNA, 16 bp, G. gallus
aaattccttctcagaa

SEQ ID NO: 534415 - DNA, 16 bp, G. gallus
aaattcctttatcaaa

SEQ ID NO: 534416 - DNA, 17 bp, G. gallus
aaattctcagctacaaa

SEQ ID NO: 534417 - DNA, 16 bp, G. gallus
aaattctgtactgtga

SEQ ID NO: 534418 - DNA, 16 bp, G. gallus
aaattgttcctaatat

SEQ ID NO: 534419 - DNA, 16 bp, G. gallus
aacaaagatttttttt

SEQ ID NO: 534420 - DNA, 16 bp, G. gallus
aacaacagtaacaaca

SEQ ID NO: 534421 - DNA, 16 bp, G. gallus
aacaagtttgctgatg

SEQ ID NO: 534422 - DNA, 16 bp, G. gallus
aacaataacagcaaca

SEQ ID NO: 534423 - DNA, 16 bp, G. gallus
aacacaggaagttctg

SEQ ID NO: 534424 - DNA, 16 bp, G. gallus
aacacagtcctgtgaa

SEQ ID NO: 534425 - DNA, 16 bp, G. gallus
aacacctccagggaca

SEQ ID NO: 534426 - DNA, 16 bp, G. gallus
aacacctccagggatg

SEQ ID NO: 534427 - DNA, 16 bp, G. gallus
aacactatttgataga

SEQ ID NO: 534428 - DNA, 16 bp, G. gallus
aacacttggtcttgtt

SEQ ID NO: 534429 - DNA, 16 bp, G. gallus
aacagaagcagcagca

SEQ ID NO: 534430 - DNA, 16 bp, G. gallus
aacagatagcagcaga

SEQ ID NO: 534431 - DNA, 16 bp, G. gallus
aacagcagcaatgatc

SEQ ID NO: 534432 - DNA, 16 bp, G. gallus
aacagcagcagcaaaa

SEQ ID NO: 534433 - DNA, 16 bp, G. gallus
aacagcctcagttcct

SEQ ID NO: 534434 - DNA, 16 bp, G. gallus
aacagctccatgtcct

SEQ ID NO: 534435 - DNA, 16 bp, G. gallus
aacaggaaggggaatg

SEQ ID NO: 534436 - DNA, 16 bp, G. gallus
aacaggaggagctgga

SEQ ID NO: 534437 - DNA, 16 bp, G. gallus
aacaggttgccagaga

SEQ ID NO: 534438 - DNA, 16 bp, G. gallus
aacaggttgctcaggg

SEQ ID NO: 534439 - DNA, 16 bp, G. gallus
aacagtaaaaggaaga

SEQ ID NO: 534440 - DNA, 16 bp, G. gallus
aacagttttaaactga

SEQ ID NO: 534441 - DNA, 16 bp, G. gallus
aacataggaggcatta

SEQ ID NO: 534442 - DNA, 16 bp, G. gallus
aacatcatccagtcca

SEQ ID NO: 534443 - DNA, 16 bp, G. gallus
aacatccttctctcca

SEQ ID NO: 534444 - DNA, 16 bp, G. gallus
aacatcttcatcaaca

SEQ ID NO: 534445 - DNA, 16 bp, G. gallus
aacatcttcattgatg

SEQ ID NO: 534446 - DNA, 16 bp, G. gallus
aacatctttatcaatg

SEQ ID NO: 534447 - DNA, 16 bp, G. gallus
aacatgaggaaaagct

SEQ ID NO: 534448 - DNA, 16 bp, G. gallus
aacattcagcaaacat

SEQ ID NO: 534449 - DNA, 16 bp, G. gallus
aacatttttttaaatg

SEQ ID NO: 534450 - DNA, 16 bp, G. gallus
aaccaaaagaggggag

SEQ ID NO: 534451 - DNA, 16 bp, G. gallus
aaccaattccttatcc

SEQ ID NO: 534452 - DNA, 16 bp, G. gallus
aaccagcccataaacc

SEQ ID NO: 534453 - DNA, 16 bp, G. gallus
aacccaagccattcag

SEQ ID NO: 534454 - DNA, 16 bp, G. gallus
aacccccctgctacgt

SEQ ID NO: 534455 - DNA, 16 bp, G. gallus
aacccctgctgtgggc

SEQ ID NO: 534456 - DNA, 16 bp, G. gallus
aaccctacaattctgt

SEQ ID NO: 534457 - DNA, 16 bp, G. gallus
aacctaaatctatcct

SEQ ID NO: 534458 - DNA, 16 bp, G. gallus
aacctaaatgattctg

SEQ ID NO: 534459 - DNA, 16 bp, G. gallus
aacctaatgaggttca

SEQ ID NO: 534460 - DNA, 16 bp, G. gallus
aacctcacagtaaaga

SEQ ID NO: 534461 - DNA, 16 bp, G. gallus
aacctcatcaggttcc

SEQ ID NO: 534462 - DNA, 16 bp, G. gallus
aacctcatcccattgg

SEQ ID NO: 534463 - DNA, 16 bp, G. gallus
aacctccccatttact

SEQ ID NO: 534464 - DNA, 16 bp, G. gallus
aacctctgtgggcagc

SEQ ID NO: 534465 - DNA, 16 bp, G. gallus
aacctgatggagctgt

SEQ ID NO: 534466 - DNA, 16 bp, G. gallus
aacctggtctacaggg

SEQ ID NO: 534467 - DNA, 16 bp, G. gallus
aacctgtatctgtgct

SEQ ID NO: 534468 - DNA, 16 bp, G. gallus
aacgagatgatcattg

SEQ ID NO: 534469 - DNA, 17 bp, G. gallus
aacggttttaagttgaa

SEQ ID NO: 534470 - DNA, 16 bp, G. gallus
aactaaaagagaagag

SEQ ID NO: 534471 - DNA, 16 bp, G. gallus
aactcatcaccaccat

SEQ ID NO: 534472 - DNA, 16 bp, G. gallus
aactccatcccagcca

SEQ ID NO: 534473 - DNA, 16 bp, G. gallus
aactcctgcagctgct

SEQ ID NO: 534474 - DNA, 16 bp, G. gallus
aactcctggctctgca

SEQ ID NO: 534475 - DNA, 16 bp, G. gallus
aactccttctgcatga

SEQ ID NO: 534476 - DNA, 16 bp, G. gallus
aactctggcagctcag

SEQ ID NO: 534477 - DNA, 22 bp, G. gallus
aactctttgaaagggtagataa

SEQ ID NO: 534478 - DNA, 16 bp, G. gallus
aactgcacacagtact

SEQ ID NO: 534479 - DNA, 16 bp, G. gallus
aactggaaaaaaaatg

SEQ ID NO: 534480 - DNA, 16 bp, G. gallus
aactggaagaggatag

SEQ ID NO: 534481 - DNA, 16 bp, G. gallus
aactgggtctgttcag

SEQ ID NO: 534482 - DNA, 16 bp, G. gallus
aactgtatcctgagct

SEQ ID NO: 534483 - DNA, 16 bp, G. gallus
aactgttccccctcct

SEQ ID NO: 534484 - DNA, 16 bp, G. gallus
aacttctttatatcca

SEQ ID NO: 534485 - DNA, 16 bp, G. gallus
aacttgatgatccttg

SEQ ID NO: 534486 - DNA, 16 bp, G. gallus
aacttgccatccacca

SEQ ID NO: 534487 - DNA, 16 bp, G. gallus
aactttaagctgttca

SEQ ID NO: 534488 - DNA, 16 bp, G. gallus
aagaaaaacactgagg

SEQ ID NO: 534489 - DNA, 16 bp, G. gallus
aagaaaaacagcattt

SEQ ID NO: 534490 - DNA, 16 bp, G. gallus
aagaaaaagaaatctt

SEQ ID NO: 534491 - DNA, 16 bp, G. gallus
aagaaaaagttcaaga

SEQ ID NO: 534492 - DNA, 16 bp, G. gallus
aagaaaaatgtttttt

SEQ ID NO: 534493 - DNA, 16 bp, G. gallus
aagaaaacagattttt

SEQ ID NO: 534494 - DNA, 16 bp, G. gallus
aagaaaaggttcttca

SEQ ID NO: 534495 - DNA, 16 bp, G. gallus
aagaaaatattttgtt

SEQ ID NO: 534496 - DNA, 17 bp, G. gallus
aagaaactcttttacaa

SEQ ID NO: 534497 - DNA, 16 bp, G. gallus
aagaaacttttcctaa

SEQ ID NO: 534498 - DNA, 23 bp, G. gallus
aagaaagacatcgaggccctgga

SEQ ID NO: 534499 - DNA, 16 bp, G. gallus
aagaaagatttttttt

SEQ ID NO: 534500 - DNA, 16 bp, G. gallus
aagaaaggctgaggaa

SEQ ID NO: 534501 - DNA, 16 bp, G. gallus
aagaaatgttcagatg

SEQ ID NO: 534502 - DNA, 16 bp, G. gallus
aagaaattctttgctg

SEQ ID NO: 534503 - DNA, 17 bp, G. gallus
aagaacctcctctccct

SEQ ID NO: 534504 - DNA, 16 bp, G. gallus
aagaaccttttcctaa

SEQ ID NO: 534505 - DNA, 16 bp, G. gallus
aagaacttcttcatgg

SEQ ID NO: 534506 - DNA, 16 bp, G. gallus
aagaacttcttcctaa

SEQ ID NO: 534507 - DNA, 16 bp, G. gallus
aagaagaaaaatatct

SEQ ID NO: 534508 - DNA, 16 bp, G. gallus
aagaagaaaatgcaca

SEQ ID NO: 534509 - DNA, 16 bp, G. gallus
aagaagaaattctaca

SEQ ID NO: 534510 - DNA, 16 bp, G. gallus
aagaagaggctgaggg

SEQ ID NO: 534511 - DNA, 16 bp, G. gallus
aagaagagttagaagc

SEQ ID NO: 534512 - DNA, 16 bp, G. gallus
aagaaggacatggagg

SEQ ID NO: 534513 - DNA, 16 bp, G. gallus
aagaaggcattgagaa

SEQ ID NO: 534514 - DNA, 16 bp, G. gallus
aagaaggctgtggggt

SEQ ID NO: 534515 - DNA, 16 bp, G. gallus
aagaaggtttctgaca

SEQ ID NO: 534516 - DNA, 16 bp, G. gallus
aagaagtcattgagca

SEQ ID NO: 534517 - DNA, 16 bp, G. gallus
aagaattccaccacat

SEQ ID NO: 534518 - DNA, 16 bp, G. gallus
aagaatttcttcctaa

SEQ ID NO: 534519 - DNA, 16 bp, G. gallus
aagaatttcttcctga

SEQ ID NO: 534520 - DNA, 16 bp, G. gallus
aagaatttcttctcag

SEQ ID NO: 534521 - DNA, 16 bp, G. gallus
aagacaaaaatatttt

SEQ ID NO: 534522 - DNA, 16 bp, G. gallus
aagacaaaagatttct

SEQ ID NO: 534523 - DNA, 16 bp, G. gallus
aagacaagctgaggga

SEQ ID NO: 534524 - DNA, 16 bp, G. gallus
aagacattcaagatca

SEQ ID NO: 534525 - DNA, 16 bp, G. gallus
aagaccaggttgaatg

SEQ ID NO: 534526 - DNA, 16 bp, G. gallus
aagacctccaaggtca

SEQ ID NO: 534527 - DNA, 16 bp, G. gallus
aagaccttcaagatca

SEQ ID NO: 534528 - DNA, 16 bp, G. gallus
aagactccagggagac

SEQ ID NO: 534529 - DNA, 16 bp, G. gallus
aagactctaggagatg

SEQ ID NO: 534530 - DNA, 16 bp, G. gallus
aagagaagaactacgt

SEQ ID NO: 534531 - DNA, 16 bp, G. gallus
aagagaagaagaacta

SEQ ID NO: 534532 - DNA, 16 bp, G. gallus
aagagaaggctcagag

SEQ ID NO: 534533 - DNA, 16 bp, G. gallus
aagagaaggctgcagg

SEQ ID NO: 534534 - DNA, 16 bp, G. gallus
aagagaccttaaagcc

SEQ ID NO: 534535 - DNA, 16 bp, G. gallus
aagagagaagatttag

SEQ ID NO: 534536 - DNA, 16 bp, G. gallus
aagagatcatcaagtc

SEQ ID NO: 534537 - DNA, 16 bp, G. gallus
aagagcacagtaacac

SEQ ID NO: 534538 - DNA, 16 bp, G. gallus
aagagcaggacaaggg

SEQ ID NO: 534539 - DNA, 16 bp, G. gallus
aagagctgtgtggatg

SEQ ID NO: 534540 - DNA, 16 bp, G. gallus
aagaggaggctcagga

SEQ ID NO: 534541 - DNA, 16 bp, G. gallus
aagaggaggctgaagg

SEQ ID NO: 534542 - DNA, 16 bp, G. gallus
aagagggaatggcctc

SEQ ID NO: 534543 - DNA, 16 bp, G. gallus
aagaggtgattcaaga

SEQ ID NO: 534544 - DNA, 16 bp, G. gallus
aagagtggtgaggcag

SEQ ID NO: 534545 - DNA, 16 bp, G. gallus
aagagtgtgtgtgtgt

SEQ ID NO: 534546 - DNA, 16 bp, G. gallus
aagataagccatgttc

SEQ ID NO: 534547 - DNA, 16 bp, G. gallus
aagatattaaacaaga

SEQ ID NO: 534548 - DNA, 16 bp, G. gallus
aagatattgaagagga

SEQ ID NO: 534549 - DNA, 16 bp, G. gallus
aagatatttataaaca

SEQ ID NO: 534550 - DNA, 16 bp, G. gallus
aagatcacagagcaga

SEQ ID NO: 534551 - DNA, 16 bp, G. gallus
aagatcatcaggtcca

SEQ ID NO: 534552 - DNA, 16 bp, G. gallus
aagatcatcttgtcca

SEQ ID NO: 534553 - DNA, 17 bp, G. gallus
aagatcatggaacagat

SEQ ID NO: 534554 - DNA, 16 bp, G. gallus
aagatctccaaggagg

SEQ ID NO: 534555 - DNA, 16 bp, G. gallus
aagatgcagagctgtt

SEQ ID NO: 534556 - DNA, 16 bp, G. gallus
aagatgctgaagagca

SEQ ID NO: 534557 - DNA, 16 bp, G. gallus
aagatgttgaacaaga

SEQ ID NO: 534558 - DNA, 16 bp, G. gallus
aagcaagtggaagaaa

SEQ ID NO: 534559 - DNA, 16 bp, G. gallus
aagcaatttttttttt

SEQ ID NO: 534560 - DNA, 16 bp, G. gallus
aagcacagcaataaca

SEQ ID NO: 534561 - DNA, 16 bp, G. gallus
aagcactcaaggccag

SEQ ID NO: 534562 - DNA, 16 bp, G. gallus
aagcagcactgctggc

SEQ ID NO: 534563 - DNA, 16 bp, G. gallus
aagcagcagcactgct

SEQ ID NO: 534564 - DNA, 16 bp, G. gallus
aagcagcagcagcaga

SEQ ID NO: 534565 - DNA, 16 bp, G. gallus
aagcagcaggtctctg

SEQ ID NO: 534566 - DNA, 16 bp, G. gallus
aagcagcttttttttt

SEQ ID NO: 534567 - DNA, 16 bp, G. gallus
aagcaggacctgccct

SEQ ID NO: 534568 - DNA, 16 bp, G. gallus
aagcattcaaggccag

SEQ ID NO: 534569 - DNA, 16 bp, G. gallus
aagcattcagcaagca

SEQ ID NO: 534570 - DNA, 16 bp, G. gallus
aagccaaaaggttgga

SEQ ID NO: 534571 - DNA, 16 bp, G. gallus
aagccattctgtgata

SEQ ID NO: 534572 - DNA, 16 bp, G. gallus
aagccgttctgtgatt

SEQ ID NO: 534573 - DNA, 16 bp, G. gallus
aagccttgctgaagtc

SEQ ID NO: 534574 - DNA, 16 bp, G. gallus
aagcggctcggctatc

SEQ ID NO: 534575 - DNA, 16 bp, G. gallus
aagctaaacaagccct

SEQ ID NO: 534576 - DNA, 16 bp, G. gallus
aagctgagtggtgtag

SEQ ID NO: 534577 - DNA, 16 bp, G. gallus
aagctgcagaaagcaa

SEQ ID NO: 534578 - DNA, 16 bp, G. gallus
aagctgcccagggccc

SEQ ID NO: 534579 - DNA, 16 bp, G. gallus
aagctgctttctcttt

SEQ ID NO: 534580 - DNA, 16 bp, G. gallus
aagctggagagggact

SEQ ID NO: 534581 - DNA, 16 bp, G. gallus
aagctggaggatgaaa

SEQ ID NO: 534582 - DNA, 16 bp, G. gallus
aagctggctgcccatg

SEQ ID NO: 534583 - DNA, 16 bp, G. gallus
aagctggctgggctgg

SEQ ID NO: 534584 - DNA, 16 bp, G. gallus
aagctggtgaagggac

SEQ ID NO: 534585 - DNA, 16 bp, G. gallus
aagctgtgctggctgt

SEQ ID NO: 534586 - DNA, 16 bp, G. gallus
aaggaaaaaagctgct

SEQ ID NO: 534587 - DNA, 16 bp, G. gallus
aaggaaaaggcagacg

SEQ ID NO: 534588 - DNA, 16 bp, G. gallus
aaggaacgtttggaca

SEQ ID NO: 534589 - DNA, 16 bp, G. gallus
aaggaagaagtttttt

SEQ ID NO: 534590 - DNA, 16 bp, G. gallus
aaggaaggaagattta

SEQ ID NO: 534591 - DNA, 16 bp, G. gallus
aaggacaacaaagctg

SEQ ID NO: 534592 - DNA, 16 bp, G. gallus
aaggacataaaactat

SEQ ID NO: 534593 - DNA, 16 bp, G. gallus
aaggactttttttttt

SEQ ID NO: 534594 - DNA, 16 bp, G. gallus
aaggagattgtggtga

SEQ ID NO: 534595 - DNA, 16 bp, G. gallus
aaggagcttacaagca

SEQ ID NO: 534596 - DNA, 16 bp, G. gallus
aaggaggaaagattta

SEQ ID NO: 534597 - DNA, 16 bp, G. gallus
aaggaggctgaggaga

SEQ ID NO: 534598 - DNA, 16 bp, G. gallus
aaggaggctgtggata

SEQ ID NO: 534599 - DNA, 16 bp, G. gallus
aaggagttcctgctga

SEQ ID NO: 534600 - DNA, 16 bp, G. gallus
aaggatgtggagctgt

SEQ ID NO: 534601 - DNA, 16 bp, G. gallus
aaggatgtggtgcagg

SEQ ID NO: 534602 - DNA, 16 bp, G. gallus
aaggcactggaatggg

SEQ ID NO: 534603 - DNA, 16 bp, G. gallus
aaggcattactttcag

SEQ ID NO: 534604 - DNA, 16 bp, G. gallus
aaggccacaatgatgt

SEQ ID NO: 534605 - DNA, 16 bp, G. gallus
aaggccaggctggatg

SEQ ID NO: 534606 - DNA, 16 bp, G. gallus
aaggccaggttggatg

SEQ ID NO: 534607 - DNA, 16 bp, G. gallus
aaggccatctagtcca

SEQ ID NO: 534608 - DNA, 16 bp, G. gallus
aaggccatgctggatg

SEQ ID NO: 534609 - DNA, 16 bp, G. gallus
aaggcctgggttgaaa

SEQ ID NO: 534610 - DNA, 17 bp, G. gallus
aaggcctttggctcttg

SEQ ID NO: 534611 - DNA, 16 bp, G. gallus
aaggctcctgggagac

SEQ ID NO: 534612 - DNA, 16 bp, G. gallus
aaggctggagaagacc

SEQ ID NO: 534613 - DNA, 16 bp, G. gallus
aaggctggatgtggct

SEQ ID NO: 534614 - DNA, 16 bp, G. gallus
aaggctgggctggatg

SEQ ID NO: 534615 - DNA, 17 bp, G. gallus
aaggcttgtgaagggct

SEQ ID NO: 534616 - DNA, 16 bp, G. gallus
aaggctttgcagaagt

SEQ ID NO: 534617 - DNA, 16 bp, G. gallus
aaggcttttgacatgg

SEQ ID NO: 534618 - DNA, 17 bp, G. gallus
aagggagcctataaaca

SEQ ID NO: 534619 - DNA, 16 bp, G. gallus
aagggaggttcaggtt

SEQ ID NO: 534620 - DNA, 16 bp, G. gallus
aagggcagagcaagtc

SEQ ID NO: 534621 - DNA, 16 bp, G. gallus
aagggccacaaagatg

SEQ ID NO: 534622 - DNA, 16 bp, G. gallus
aagggctccaagagga

SEQ ID NO: 534623 - DNA, 16 bp, G. gallus
aagggctgctccgaaa

SEQ ID NO: 534624 - DNA, 16 bp, G. gallus
aagggctggagccagg

SEQ ID NO: 534625 - DNA, 16 bp, G. gallus
aagggggatagctcct

SEQ ID NO: 534626 - DNA, 16 bp, G. gallus
aaggggttgttaagca

SEQ ID NO: 534627 - DNA, 16 bp, G. gallus
aagggtaatgggagga

SEQ ID NO: 534628 - DNA, 16 bp, G. gallus
aagggttgttaaacac

SEQ ID NO: 534629 - DNA, 16 bp, G. gallus
aaggtcatcgagtcca

SEQ ID NO: 534630 - DNA, 16 bp, G. gallus
aaggtcccttccaaca

SEQ ID NO: 534631 - DNA, 16 bp, G. gallus
aaggtcccttccaacc

SEQ ID NO: 534632 - DNA, 16 bp, G. gallus
aaggtcttttccaacc

SEQ ID NO: 534633 - DNA, 16 bp, G. gallus
aaggtggaatggtttt

SEQ ID NO: 534634 - DNA, 16 bp, G. gallus
aaggtgtatgaggagc

SEQ ID NO: 534635 - DNA, 16 bp, G. gallus
aaggttatggagcaga

SEQ ID NO: 534636 - DNA, 16 bp, G. gallus
aaggttggaaaagacc

SEQ ID NO: 534637 - DNA, 16 bp, G. gallus
aaggttggaaaaggcc

SEQ ID NO: 534638 - DNA, 16 bp, G. gallus
aaggttttctttcttt

SEQ ID NO: 534639 - DNA, 16 bp, G. gallus
aagtaacgcctcctgt

SEQ ID NO: 534640 - DNA, 16 bp, G. gallus
aagtaatgcctcctat

SEQ ID NO: 534641 - DNA, 16 bp, G. gallus
aagtactggaagactg

SEQ ID NO: 534642 - DNA, 16 bp, G. gallus
aagtatgtatatatat

SEQ ID NO: 534643 - DNA, 16 bp, G. gallus
aagtcatggctgtcag

SEQ ID NO: 534644 - DNA, 16 bp, G. gallus
aagtccagccatcaac

SEQ ID NO: 534645 - DNA, 16 bp, G. gallus
aagtccaggtagatga

SEQ ID NO: 534646 - DNA, 16 bp, G. gallus
aagtccttctccacag

SEQ ID NO: 534647 - DNA, 16 bp, G. gallus
aagtcttgttgccctt

SEQ ID NO: 534648 - DNA, 16 bp, G. gallus
aagtgaattccaccac

SEQ ID NO: 534649 - DNA, 16 bp, G. gallus
aagtgatgtgcactgt

SEQ ID NO: 534650 - DNA, 16 bp, G. gallus
aagtgcaaggtgttgc

SEQ ID NO: 534651 - DNA, 17 bp, G. gallus
aagtgcaaggttttgca

SEQ ID NO: 534652 - DNA, 23 bp, G. gallus
aagtgcagggttttgcacttggg

SEQ ID NO: 534653 - DNA, 16 bp, G. gallus
aagtgcatctacacca

SEQ ID NO: 534654 - DNA, 16 bp, G. gallus
aagtggcactgaggga

SEQ ID NO: 534655 - DNA, 16 bp, G. gallus
aagtgtgcatgaagca

SEQ ID NO: 534656 - DNA, 16 bp, G. gallus
aagttccctgtctttc

SEQ ID NO: 534657 - DNA, 16 bp, G. gallus
aagttcttttcagcag

SEQ ID NO: 534658 - DNA, 16 bp, G. gallus
aagttggaagggaccc

SEQ ID NO: 534659 - DNA, 16 bp, G. gallus
aagttgtggctgtcag

SEQ ID NO: 534660 - DNA, 16 bp, G. gallus
aagtttgcagacaaca

SEQ ID NO: 534661 - DNA, 16 bp, G. gallus
aagtttgctgatgatg

SEQ ID NO: 534662 - DNA, 16 bp, G. gallus
aagttttgttacttat

SEQ ID NO: 534663 - DNA, 16 bp, G. gallus
aataaaacaggaggca

SEQ ID NO: 534664 - DNA, 16 bp, G. gallus
aataaatagaaggcat

SEQ ID NO: 534665 - DNA, 16 bp, G. gallus
aataacactatttgac

SEQ ID NO: 534666 - DNA, 16 bp, G. gallus
aataactgcttttcaa

SEQ ID NO: 534667 - DNA, 16 bp, G. gallus
aatacagaatcataga

SEQ ID NO: 534668 - DNA, 16 bp, G. gallus
aatactcaaggtgcag

SEQ ID NO: 534669 - DNA, 16 bp, G. gallus
aatacttgaagggagc

SEQ ID NO: 534670 - DNA, 16 bp, G. gallus
aatacttgaagggagt

SEQ ID NO: 534671 - DNA, 16 bp, G. gallus
aatagactccccaggg

SEQ ID NO: 534672 - DNA, 16 bp, G. gallus
aatatatatgcatata

SEQ ID NO: 534673 - DNA, 16 bp, G. gallus
aatatctagtttaaat

SEQ ID NO: 534674 - DNA, 16 bp, G. gallus
aatatgatggagagtg

SEQ ID NO: 534675 - DNA, 16 bp, G. gallus
aatattcagctccata

SEQ ID NO: 534676 - DNA, 16 bp, G. gallus
aatattttcagtattt

SEQ ID NO: 534677 - DNA, 16 bp, G. gallus
aatcacagaattgcag

SEQ ID NO: 534678 - DNA, 16 bp, G. gallus
aatcactgagtccaac

SEQ ID NO: 534679 - DNA, 34 bp, G. gallus
aatcagaagcgctactggtccttgaaaaagatac

SEQ ID NO: 534680 - DNA, 28 bp, G. gallus
aatcagagtgggacatgacagcacggtt

SEQ ID NO: 534681 - DNA, 16 bp, G. gallus
aatcagctcatccatg

SEQ ID NO: 534682 - DNA, 16 bp, G. gallus
aatcatctttgtggct

SEQ ID NO: 534683 - DNA, 16 bp, G. gallus
aatcattaaagttgga

SEQ ID NO: 534684 - DNA, 16 bp, G. gallus
aatcattgaggttgga

SEQ ID NO: 534685 - DNA, 16 bp, G. gallus
aatcccatctccttca

SEQ ID NO: 534686 - DNA, 16 bp, G. gallus
aatccttaaggttgga

SEQ ID NO: 534687 - DNA, 16 bp, G. gallus
aatctcattaggttca

SEQ ID NO: 534688 - DNA, 16 bp, G. gallus
aatctgacaaaatggc

SEQ ID NO: 534689 - DNA, 16 bp, G. gallus
aatctgcatttttttt

SEQ ID NO: 534690 - DNA, 16 bp, G. gallus
aatctgtgccagtgct

SEQ ID NO: 534691 - DNA, 16 bp, G. gallus
aatgaaataaaaatct

SEQ ID NO: 534692 - DNA, 16 bp, G. gallus
aatgaagttcaacaag

SEQ ID NO: 534693 - DNA, 16 bp, G. gallus
aatgaattccaccaca

SEQ ID NO: 534694 - DNA, 16 bp, G. gallus
aatgacagaatcacag

SEQ ID NO: 534695 - DNA, 16 bp, G. gallus
aatgagaaaagaatgt

SEQ ID NO: 534696 - DNA, 16 bp, G. gallus
aatgagaaaggagaac

SEQ ID NO: 534697 - DNA, 16 bp, G. gallus
aatgatctccagaggt

SEQ ID NO: 534698 - DNA, 16 bp, G. gallus
aatgatcttgatgagg

SEQ ID NO: 534699 - DNA, 16 bp, G. gallus
aatgatgatgatgatg

SEQ ID NO: 534700 - DNA, 16 bp, G. gallus
aatgcacactgctggc

SEQ ID NO: 534701 - DNA, 16 bp, G. gallus
aatgcagcccagaaca

SEQ ID NO: 534702 - DNA, 16 bp, G. gallus
aatgcaggacccaaca

SEQ ID NO: 534703 - DNA, 16 bp, G. gallus
aatgccatcctggcct

SEQ ID NO: 534704 - DNA, 16 bp, G. gallus
aatgctagaccaggct

SEQ ID NO: 534705 - DNA, 16 bp, G. gallus
aatgctataatgtgat

SEQ ID NO: 534706 - DNA, 16 bp, G. gallus
aatgctgataacacac

SEQ ID NO: 534707 - DNA, 16 bp, G. gallus
aatgctgatttttttt

SEQ ID NO: 534708 - DNA, 16 bp, G. gallus
aatgctttatttattt

SEQ ID NO: 534709 - DNA, 16 bp, G. gallus
aatggaaacaaaaatg

SEQ ID NO: 534710 - DNA, 16 bp, G. gallus
aatggagtcacaaata

SEQ ID NO: 534711 - DNA, 16 bp, G. gallus
aatggcacccactgac

SEQ ID NO: 534712 - DNA, 16 bp, G. gallus
aatggcacctgacatg

SEQ ID NO: 534713 - DNA, 16 bp, G. gallus
aatggccaggaaacag

SEQ ID NO: 534714 - DNA, 16 bp, G. gallus
aatggcctcaagttgt

SEQ ID NO: 534715 - DNA, 16 bp, G. gallus
aatggcctggcttgaa

SEQ ID NO: 534716 - DNA, 16 bp, G. gallus
aatggccttaagttgc

SEQ ID NO: 534717 - DNA, 17 bp, G. gallus
aatggcttcaagctgca

SEQ ID NO: 534718 - DNA, 16 bp, G. gallus
aatggtatcctgggct

SEQ ID NO: 534719 - DNA, 16 bp, G. gallus
aatggtcattgtggtc

SEQ ID NO: 534720 - DNA, 16 bp, G. gallus
aatggtgatgggagga

SEQ ID NO: 534721 - DNA, 16 bp, G. gallus
aatggttgaggttgga

SEQ ID NO: 534722 - DNA, 16 bp, G. gallus
aatggttttaaaataa

SEQ ID NO: 534723 - DNA, 16 bp, G. gallus
aatgtctccagagatg

SEQ ID NO: 534724 - DNA, 16 bp, G. gallus
aatgtctgcagggatg

SEQ ID NO: 534725 - DNA, 16 bp, G. gallus
aatgttggaaaagacc

SEQ ID NO: 534726 - DNA, 16 bp, G. gallus
aattaggacagctgac

SEQ ID NO: 534727 - DNA, 16 bp, G. gallus
aattcaggttggaagg

SEQ ID NO: 534728 - DNA, 17 bp, G. gallus
aattccaccacagggcg

SEQ ID NO: 534729 - DNA, 16 bp, G. gallus
aattccatgattctat

SEQ ID NO: 534730 - DNA, 16 bp, G. gallus
aattccctcaaccttt

SEQ ID NO: 534731 - DNA, 16 bp, G. gallus
aattctatggttctgt

SEQ ID NO: 534732 - DNA, 16 bp, G. gallus
aattctcagctagaaa

SEQ ID NO: 534733 - DNA, 16 bp, G. gallus
aattctctgctacaaa

SEQ ID NO: 534734 - DNA, 16 bp, G. gallus
aattctgtgattctgt

SEQ ID NO: 534735 - DNA, 16 bp, G. gallus
aattcttccatgcaga

SEQ ID NO: 534736 - DNA, 19 bp, G. gallus
aattgccttcacctgtgct

SEQ ID NO: 534737 - DNA, 16 bp, G. gallus
aattggctggctggat

SEQ ID NO: 534738 - DNA, 16 bp, G. gallus
aattgggattgttcag

SEQ ID NO: 534739 - DNA, 16 bp, G. gallus
aatttcagaaagaaaa

SEQ ID NO: 534740 - DNA, 16 bp, G. gallus
aatttcagaggaaaaa

SEQ ID NO: 534741 - DNA, 16 bp, G. gallus
aatttcaggaaaaaaa

SEQ ID NO: 534742 - DNA, 16 bp, G. gallus
aatttcctcctaacat

SEQ ID NO: 534743 - DNA, 16 bp, G. gallus
aatttcttcttgttcc

SEQ ID NO: 534744 - DNA, 16 bp, G. gallus
aatttgatctatcaaa

SEQ ID NO: 534745 - DNA, 16 bp, G. gallus
aatttgctgagggtgc

SEQ ID NO: 534746 - DNA, 16 bp, G. gallus
aatttggaggaaaaaa

SEQ ID NO: 534747 - DNA, 16 bp, G. gallus
aatttgtgtgtgtgtg

SEQ ID NO: 534748 - DNA, 16 bp, G. gallus
aattttacatttgaaa

SEQ ID NO: 534749 - DNA, 16 bp, G. gallus
acaaaaaaaaaccctg

SEQ ID NO: 534750 - DNA, 16 bp, G. gallus
acaaaaatgatcaaag

SEQ ID NO: 534751 - DNA, 16 bp, G. gallus
acaaaaatgatccaag

SEQ ID NO: 534752 - DNA, 16 bp, G. gallus
acaaaaatgatctaag

SEQ ID NO: 534753 - DNA, 16 bp, G. gallus
acaaaaccatgacaat

SEQ ID NO: 534754 - DNA, 16 bp, G. gallus
acaaaaggaattcctg

SEQ ID NO: 534755 - DNA, 16 bp, G. gallus
acaaaatgatgtctga

SEQ ID NO: 534756 - DNA, 16 bp, G. gallus
acaaacaagaagagtt

SEQ ID NO: 534757 - DNA, 16 bp, G. gallus
acaaagaagtaatgaa

SEQ ID NO: 534758 - DNA, 16 bp, G. gallus
acaaagagcacaataa

SEQ ID NO: 534759 - DNA, 16 bp, G. gallus
acaaagatgatgaagg

SEQ ID NO: 534760 - DNA, 16 bp, G. gallus
acaaagatgatgagag

SEQ ID NO: 534761 - DNA, 16 bp, G. gallus
acaaagatgatgagga

SEQ ID NO: 534762 - DNA, 16 bp, G. gallus
acaaagatggggaagg

SEQ ID NO: 534763 - DNA, 16 bp, G. gallus
acaaagattatcagag

SEQ ID NO: 534764 - DNA, 16 bp, G. gallus
acaaagcagtttctgc

SEQ ID NO: 534765 - DNA, 16 bp, G. gallus
acaaaggcagagcaga

SEQ ID NO: 534766 - DNA, 16 bp, G. gallus
acaaaggggaaaaaat

SEQ ID NO: 534767 - DNA, 16 bp, G. gallus
acaacaaaatgtaatg

SEQ ID NO: 534768 - DNA, 16 bp, G. gallus
acaacaacaaaaactg

SEQ ID NO: 534769 - DNA, 16 bp, G. gallus
acaacagcctgcatgc

SEQ ID NO: 534770 - DNA, 16 bp, G. gallus
acaacatccaaacatt

SEQ ID NO: 534771 - DNA, 16 bp, G. gallus
acaacctctctggtca

SEQ ID NO: 534772 - DNA, 16 bp, G. gallus
acaacttcctgaaggg

SEQ ID NO: 534773 - DNA, 16 bp, G. gallus
acaagaaagaataatt

SEQ ID NO: 534774 - DNA, 16 bp, G. gallus
acaagaaagacatgga

SEQ ID NO: 534775 - DNA, 16 bp, G. gallus
acaagaaggacatcaa

SEQ ID NO: 534776 - DNA, 16 bp, G. gallus
acaagaaggacgtgga

SEQ ID NO: 534777 - DNA, 16 bp, G. gallus
acaagaaggatatgga

SEQ ID NO: 534778 - DNA, 16 bp, G. gallus
acaagaagggattcta

SEQ ID NO: 534779 - DNA, 16 bp, G. gallus
acaagcaggaggagct

SEQ ID NO: 534780 - DNA, 16 bp, G. gallus
acaagccagagtcaaa

SEQ ID NO: 534781 - DNA, 16 bp, G. gallus
acaaggacacactgct

SEQ ID NO: 534782 - DNA, 16 bp, G. gallus
acaaggaggaatggct

SEQ ID NO: 534783 - DNA, 16 bp, G. gallus
acaaggatcaccaagt

SEQ ID NO: 534784 - DNA, 16 bp, G. gallus
acaagtccaagtcctc

SEQ ID NO: 534785 - DNA, 16 bp, G. gallus
acaagttgtccagaga

SEQ ID NO: 534786 - DNA, 16 bp, G. gallus
acaatccatggaactg

SEQ ID NO: 534787 - DNA, 16 bp, G. gallus
acacacgcacacacat

SEQ ID NO: 534788 - DNA, 16 bp, G. gallus
acacagagagagagag

SEQ ID NO: 534789 - DNA, 16 bp, G. gallus
acacagcaacaacatg

SEQ ID NO: 534790 - DNA, 16 bp, G. gallus
acacagcacagagcag

SEQ ID NO: 534791 - DNA, 16 bp, G. gallus
acacagcacagcacag

SEQ ID NO: 534792 - DNA, 16 bp, G. gallus
acacatatatatgtat

SEQ ID NO: 534793 - DNA, 16 bp, G. gallus
acacatgcacacaaaa

SEQ ID NO: 534794 - DNA, 16 bp, G. gallus
acacatgcatgcacac

SEQ ID NO: 534795 - DNA, 16 bp, G. gallus
acacattgccagctca

SEQ ID NO: 534796 - DNA, 16 bp, G. gallus
acaccagaaggctgtg

SEQ ID NO: 534797 - DNA, 16 bp, G. gallus
acaccagagggatggg

SEQ ID NO: 534798 - DNA, 16 bp, G. gallus
acacctgggcacactg

SEQ ID NO: 534799 - DNA, 16 bp, G. gallus
acacctttgcttcata

SEQ ID NO: 534800 - DNA, 16 bp, G. gallus
acacgctgctggctca

SEQ ID NO: 534801 - DNA, 16 bp, G. gallus
acactattttttaaca

SEQ ID NO: 534802 - DNA, 16 bp, G. gallus
acactgaagaaaacaa

SEQ ID NO: 534803 - DNA, 16 bp, G. gallus
acactgatgttttagt

SEQ ID NO: 534804 - DNA, 16 bp, G. gallus
acactggaatgggttg

SEQ ID NO: 534805 - DNA, 16 bp, G. gallus
acagaaatactggaaa

SEQ ID NO: 534806 - DNA, 16 bp, G. gallus
acagaagcagcagcag

SEQ ID NO: 534807 - DNA, 16 bp, G. gallus
acagaaggcagcagag

SEQ ID NO: 534808 - DNA, 16 bp, G. gallus
acagaagtgagactga

SEQ ID NO: 534809 - DNA, 16 bp, G. gallus
acagaatcatggaata

SEQ ID NO: 534810 - DNA, 16 bp, G. gallus
acagaatcattatggt

SEQ ID NO: 534811 - DNA, 16 bp, G. gallus
acagaatggcttaggt

SEQ ID NO: 534812 - DNA, 16 bp, G. gallus
acagaattccaccaca

SEQ ID NO: 534813 - DNA, 16 bp, G. gallus
acagacagacagacaa

SEQ ID NO: 534814 - DNA, 16 bp, G. gallus
acagacagacagatag

SEQ ID NO: 534815 - DNA, 16 bp, G. gallus
acagactcttcagcag

SEQ ID NO: 534816 - DNA, 16 bp, G. gallus
acagactgcccaggga

SEQ ID NO: 534817 - DNA, 16 bp, G. gallus
acagacttgctgaggg

SEQ ID NO: 534818 - DNA, 16 bp, G. gallus
acagagccaaggccat

SEQ ID NO: 534819 - DNA, 16 bp, G. gallus
acagagctcagcgctg

SEQ ID NO: 534820 - DNA, 16 bp, G. gallus
acagaggatggtgaca

SEQ ID NO: 534821 - DNA, 16 bp, G. gallus
acagatagaaagagca

SEQ ID NO: 534822 - DNA, 16 bp, G. gallus
acagatgacagcagag

SEQ ID NO: 534823 - DNA, 16 bp, G. gallus
acagatggacaaggcc

SEQ ID NO: 534824 - DNA, 23 bp, G. gallus
acagatggacaaggccaggggca

SEQ ID NO: 534825 - DNA, 16 bp, G. gallus
acagatggcaacagag

SEQ ID NO: 534826 - DNA, 16 bp, G. gallus
acagatggcagcagag

SEQ ID NO: 534827 - DNA, 16 bp, G. gallus
acagcaacaaaatgca

SEQ ID NO: 534828 - DNA, 16 bp, G. gallus
acagcaacaacagcag

SEQ ID NO: 534829 - DNA, 16 bp, G. gallus
acagcaacagggcctg

SEQ ID NO: 534830 - DNA, 16 bp, G. gallus
acagcaacatgaaaga

SEQ ID NO: 534831 - DNA, 16 bp, G. gallus
acagcagagcagcaag

SEQ ID NO: 534832 - DNA, 16 bp, G. gallus
acagcagcaaaatgta

SEQ ID NO: 534833 - DNA, 16 bp, G. gallus
acagcagcagcagcaa

SEQ ID NO: 534834 - DNA, 16 bp, G. gallus
acagcagcagcagcac

SEQ ID NO: 534835 - DNA, 16 bp, G. gallus
acagcaggacaagagg

SEQ ID NO: 534836 - DNA, 16 bp, G. gallus
acagcagtgtgaaaga

SEQ ID NO: 534837 - DNA, 16 bp, G. gallus
acagccattctccctc

SEQ ID NO: 534838 - DNA, 16 bp, G. gallus
acagccccatccatcc

SEQ ID NO: 534839 - DNA, 16 bp, G. gallus
acagccccatctctct

SEQ ID NO: 534840 - DNA, 16 bp, G. gallus
acagcccttcttgtag

SEQ ID NO: 534841 - DNA, 16 bp, G. gallus
acagcctcccttcagg

SEQ ID NO: 534842 - DNA, 16 bp, G. gallus
acagcctgttccagca

SEQ ID NO: 534843 - DNA, 16 bp, G. gallus
acagcctttacctctg

SEQ ID NO: 534844 - DNA, 16 bp, G. gallus
acagcgcagagcagag

SEQ ID NO: 534845 - DNA, 16 bp, G. gallus
acagctcaggctgccc

SEQ ID NO: 534846 - DNA, 16 bp, G. gallus
acagctccaaagaaat

SEQ ID NO: 534847 - DNA, 16 bp, G. gallus
acagctccatgccatt

SEQ ID NO: 534848 - DNA, 16 bp, G. gallus
acagctctatcaggtg

SEQ ID NO: 534849 - DNA, 16 bp, G. gallus
acagctctctgggcaa

SEQ ID NO: 534850 - DNA, 16 bp, G. gallus
acagctcttgaacacc

SEQ ID NO: 534851 - DNA, 16 bp, G. gallus
acagctgctgctctga

SEQ ID NO: 534852 - DNA, 16 bp, G. gallus
acagctgctgctgctg

SEQ ID NO: 534853 - DNA, 16 bp, G. gallus
acagcttctctgggca

SEQ ID NO: 534854 - DNA, 16 bp, G. gallus
acagcttttatttttt

SEQ ID NO: 534855 - DNA, 16 bp, G. gallus
acaggaaagctgggaa

SEQ ID NO: 534856 - DNA, 16 bp, G. gallus
acaggagagacacaga

SEQ ID NO: 534857 - DNA, 16 bp, G. gallus
acaggaggagctggag

SEQ ID NO: 534858 - DNA, 16 bp, G. gallus
acaggagggccacaaa

SEQ ID NO: 534859 - DNA, 16 bp, G. gallus
acaggaggggaggcaa

SEQ ID NO: 534860 - DNA, 16 bp, G. gallus
acaggcagagccacca

SEQ ID NO: 534861 - DNA, 16 bp, G. gallus
acaggctgaggaagct

SEQ ID NO: 534862 - DNA, 16 bp, G. gallus
acaggctgctcagaga

SEQ ID NO: 534863 - DNA, 16 bp, G. gallus
acagggaggtggtgga

SEQ ID NO: 534864 - DNA, 16 bp, G. gallus
acagggatatctacag

SEQ ID NO: 534865 - DNA, 16 bp, G. gallus
acagggccctgggcag

SEQ ID NO: 534866 - DNA, 16 bp, G. gallus
acaggttgcccagaga

SEQ ID NO: 534867 - DNA, 16 bp, G. gallus
acaggttgcccaggga

SEQ ID NO: 534868 - DNA, 16 bp, G. gallus
acagtaagggtagtga

SEQ ID NO: 534869 - DNA, 16 bp, G. gallus
acagtcactaccatta

SEQ ID NO: 534870 - DNA, 16 bp, G. gallus
acagtgaagaatttct

SEQ ID NO: 534871 - DNA, 16 bp, G. gallus
acagtgaggcagtgga

SEQ ID NO: 534872 - DNA, 16 bp, G. gallus
acagtgggcatggtgg

SEQ ID NO: 534873 - DNA, 16 bp, G. gallus
acagtgttctttctgt

SEQ ID NO: 534874 - DNA, 16 bp, G. gallus
acataaaatcacagaa

SEQ ID NO: 534875 - DNA, 16 bp, G. gallus
acatacatgtatatat

SEQ ID NO: 534876 - DNA, 16 bp, G. gallus
acatactggaaagagt

SEQ ID NO: 534877 - DNA, 16 bp, G. gallus
acatagacctgttgga

SEQ ID NO: 534878 - DNA, 16 bp, G. gallus
acatcagagatggatg

SEQ ID NO: 534879 - DNA, 16 bp, G. gallus
acatcaggaaaaattt

SEQ ID NO: 534880 - DNA, 16 bp, G. gallus
acatcttcattgatga

SEQ ID NO: 534881 - DNA, 16 bp, G. gallus
acatctttattaatga

SEQ ID NO: 534882 - DNA, 16 bp, G. gallus
acatgaggaaaagctt

SEQ ID NO: 534883 - DNA, 16 bp, G. gallus
acatggaagtgtatat

SEQ ID NO: 534884 - DNA, 16 bp, G. gallus
acatggaggaaaaaaa

SEQ ID NO: 534885 - DNA, 16 bp, G. gallus
acattaggaagaattt

SEQ ID NO: 534886 - DNA, 16 bp, G. gallus
acattgatggagacca

SEQ ID NO: 534887 - DNA, 16 bp, G. gallus
accaaacagcagatgt

SEQ ID NO: 534888 - DNA, 16 bp, G. gallus
accaaactaccctaac

SEQ ID NO: 534889 - DNA, 16 bp, G. gallus
accaacctcatctcct

SEQ ID NO: 534890 - DNA, 16 bp, G. gallus
accaatatgcaaagga

SEQ ID NO: 534891 - DNA, 16 bp, G. gallus
accacatcactgggca

SEQ ID NO: 534892 - DNA, 16 bp, G. gallus
accacatcagccagtt

SEQ ID NO: 534893 - DNA, 16 bp, G. gallus
accacatccttatctc

SEQ ID NO: 534894 - DNA, 16 bp, G. gallus
accacatccttcagtg

SEQ ID NO: 534895 - DNA, 16 bp, G. gallus
accaccaatcacctca

SEQ ID NO: 534896 - DNA, 16 bp, G. gallus
accaccaccatttccc

SEQ ID NO: 534897 - DNA, 16 bp, G. gallus
accaccacccttcctt

SEQ ID NO: 534898 - DNA, 16 bp, G. gallus
accacccaaaattcaa

SEQ ID NO: 534899 - DNA, 16 bp, G. gallus
accaccctctgggtgg

SEQ ID NO: 534900 - DNA, 16 bp, G. gallus
accaccttcctgagca

SEQ ID NO: 534901 - DNA, 16 bp, G. gallus
accactcagcttggtg

SEQ ID NO: 534902 - DNA, 16 bp, G. gallus
accactctctcagaga

SEQ ID NO: 534903 - DNA, 16 bp, G. gallus
accactttttctgaga

SEQ ID NO: 534904 - DNA, 16 bp, G. gallus
accagaaagctgtgct

SEQ ID NO: 534905 - DNA, 16 bp, G. gallus
accagaaagggtggag

SEQ ID NO: 534906 - DNA, 16 bp, G. gallus
accagaagaggtttag

SEQ ID NO: 534907 - DNA, 16 bp, G. gallus
accagcccatccccac

SEQ ID NO: 534908 - DNA, 16 bp, G. gallus
accagctgcatcagga

SEQ ID NO: 534909 - DNA, 17 bp, G. gallus
accagctttgttgccct

SEQ ID NO: 534910 - DNA, 16 bp, G. gallus
accaggctgcccacag

SEQ ID NO: 534911 - DNA, 16 bp, G. gallus
accatcaactctgact

SEQ ID NO: 534912 - DNA, 16 bp, G. gallus
accatcatcatcatca

SEQ ID NO: 534913 - DNA, 16 bp, G. gallus
accatcatctgcctct

SEQ ID NO: 534914 - DNA, 16 bp, G. gallus
accatccctggcagtg

SEQ ID NO: 534915 - DNA, 16 bp, G. gallus
accatcctcccatcac

SEQ ID NO: 534916 - DNA, 16 bp, G. gallus
accatgtccctcagtg

SEQ ID NO: 534917 - DNA, 16 bp, G. gallus
accattacttctgtga

SEQ ID NO: 534918 - DNA, 16 bp, G. gallus
accattgatcacaacc

SEQ ID NO: 534919 - DNA, 16 bp, G. gallus
acccaaatcattctgt

SEQ ID NO: 534920 - DNA, 16 bp, G. gallus
acccaacctgaccctc

SEQ ID NO: 534921 - DNA, 16 bp, G. gallus
acccaagtgcaacact

SEQ ID NO: 534922 - DNA, 16 bp, G. gallus
acccacagctccagca

SEQ ID NO: 534923 - DNA, 16 bp, G. gallus
acccactgtcaccact

SEQ ID NO: 534924 - DNA, 16 bp, G. gallus
acccagaaagaataca

SEQ ID NO: 534925 - DNA, 16 bp, G. gallus
acccagcactgacccc

SEQ ID NO: 534926 - DNA, 16 bp, G. gallus
acccagggacctcagc

SEQ ID NO: 534927 - DNA, 16 bp, G. gallus
acccccaaatccttct

SEQ ID NO: 534928 - DNA, 16 bp, G. gallus
accccctgctctgtgc

SEQ ID NO: 534929 - DNA, 16 bp, G. gallus
acccgctccaacagct

SEQ ID NO: 534930 - DNA, 16 bp, G. gallus
accctcagcaagtttg

SEQ ID NO: 534931 - DNA, 16 bp, G. gallus
accctctgtgtgaaaa

SEQ ID NO: 534932 - DNA, 16 bp, G. gallus
accctgatggagctgt

SEQ ID NO: 534933 - DNA, 19 bp, G. gallus
accctgcacatagcagggg

SEQ ID NO: 534934 - DNA, 16 bp, G. gallus
accctgcacgtagcag

SEQ ID NO: 534935 - DNA, 24 bp, G. gallus
accctgtgacgcactgctgaactt

SEQ ID NO: 534936 - DNA, 16 bp, G. gallus
acccttactgtaaaaa

SEQ ID NO: 534937 - DNA, 16 bp, G. gallus
acccttataaaaagtc

SEQ ID NO: 534938 - DNA, 16 bp, G. gallus
acccttctcttctcca

SEQ ID NO: 534939 - DNA, 17 bp, G. gallus
accctttctgtaaagaa

SEQ ID NO: 534940 - DNA, 16 bp, G. gallus
accgcctcactgtgct

SEQ ID NO: 534941 - DNA, 16 bp, G. gallus
acctagacttcagtaa

SEQ ID NO: 534942 - DNA, 16 bp, G. gallus
acctcaaggatcacca

SEQ ID NO: 534943 - DNA, 16 bp, G. gallus
acctcaagtactgtgt

SEQ ID NO: 534944 - DNA, 16 bp, G. gallus
acctcaccaccctctg

SEQ ID NO: 534945 - DNA, 16 bp, G. gallus
acctcagccttctcca

SEQ ID NO: 534946 - DNA, 16 bp, G. gallus
acctcagtgattctgt

SEQ ID NO: 534947 - DNA, 16 bp, G. gallus
acctcagtgcagcctt

SEQ ID NO: 534948 - DNA, 16 bp, G. gallus
acctcatcactctcta

SEQ ID NO: 534949 - DNA, 16 bp, G. gallus
acctcatcactctctc

SEQ ID NO: 534950 - DNA, 16 bp, G. gallus
acctcattgcagcctt

SEQ ID NO: 534951 - DNA, 17 bp, G. gallus
acctcatttaagggctg

SEQ ID NO: 534952 - DNA, 16 bp, G. gallus
acctccatgggcagcc

SEQ ID NO: 534953 - DNA, 16 bp, G. gallus
acctcctcactgtgct

SEQ ID NO: 534954 - DNA, 16 bp, G. gallus
acctcctgtctcagtt

SEQ ID NO: 534955 - DNA, 16 bp, G. gallus
acctcctttcaggcag

SEQ ID NO: 534956 - DNA, 16 bp, G. gallus
acctctaagatcacca

SEQ ID NO: 534957 - DNA, 16 bp, G. gallus
acctctcctatggaga

SEQ ID NO: 534958 - DNA, 16 bp, G. gallus
acctctcctttgagga

SEQ ID NO: 534959 - DNA, 16 bp, G. gallus
acctctgctgccatac

SEQ ID NO: 534960 - DNA, 16 bp, G. gallus
acctcttctatgaaga

SEQ ID NO: 534961 - DNA, 16 bp, G. gallus
acctcttctatgagga

SEQ ID NO: 534962 - DNA, 16 bp, G. gallus
acctgaacctcccttg

SEQ ID NO: 534963 - DNA, 16 bp, G. gallus
acctgaagggaggatg

SEQ ID NO: 534964 - DNA, 16 bp, G. gallus
acctgagctccctggg

SEQ ID NO: 534965 - DNA, 16 bp, G. gallus
acctgatcaaggggag

SEQ ID NO: 534966 - DNA, 16 bp, G. gallus
acctggaccaggaagt

SEQ ID NO: 534967 - DNA, 16 bp, G. gallus
acctggacttgtgcaa

SEQ ID NO: 534968 - DNA, 16 bp, G. gallus
acctggagcactgtgt

SEQ ID NO: 534969 - DNA, 16 bp, G. gallus
acctggagcattaact

SEQ ID NO: 534970 - DNA, 16 bp, G. gallus
acctggagtgctgcat

SEQ ID NO: 534971 - DNA, 16 bp, G. gallus
acctggcacttggcct

SEQ ID NO: 534972 - DNA, 16 bp, G. gallus
acctggcagcagctca

SEQ ID NO: 534973 - DNA, 16 bp, G. gallus
acctgggaggactaca

SEQ ID NO: 534974 - DNA, 17 bp, G. gallus
acctgtccagaagagaa

SEQ ID NO: 534975 - DNA, 16 bp, G. gallus
accttaatgattctat

SEQ ID NO: 534976 - DNA, 16 bp, G. gallus
accttaccactctctc

SEQ ID NO: 534977 - DNA, 16 bp, G. gallus
accttattgctcccta

SEQ ID NO: 534978 - DNA, 16 bp, G. gallus
accttattgctctctt

SEQ ID NO: 534979 - DNA, 16 bp, G. gallus
accttctccaacagct

SEQ ID NO: 534980 - DNA, 16 bp, G. gallus
acgagagagagataag

SEQ ID NO: 534981 - DNA, 16 bp, G. gallus
acgatcacctccctgc

SEQ ID NO: 534982 - DNA, 16 bp, G. gallus
acggcaacaaaatgta

SEQ ID NO: 534983 - DNA, 16 bp, G. gallus
acgggatgtacgggac

SEQ ID NO: 534984 - DNA, 16 bp, G. gallus
acgggctgcccaggga

SEQ ID NO: 534985 - DNA, 16 bp, G. gallus
acggtgactgcaccac

SEQ ID NO: 534986 - DNA, 16 bp, G. gallus
acgtttctggagacca

SEQ ID NO: 534987 - DNA, 16 bp, G. gallus
actaagatagagaaaa

SEQ ID NO: 534988 - DNA, 16 bp, G. gallus
actactactactacta

SEQ ID NO: 534989 - DNA, 16 bp, G. gallus
actagatgaccttcag

SEQ ID NO: 534990 - DNA, 16 bp, G. gallus
actatacatatatata

SEQ ID NO: 534991 - DNA, 16 bp, G. gallus
actatgttgaaaaaga

SEQ ID NO: 534992 - DNA, 16 bp, G. gallus
actcaatgatccttgt

SEQ ID NO: 534993 - DNA, 16 bp, G. gallus
actcaatgccatcatc

SEQ ID NO: 534994 - DNA, 16 bp, G. gallus
actcagagggtgatga

SEQ ID NO: 534995 - DNA, 16 bp, G. gallus
actcatagaatcatag

SEQ ID NO: 534996 - DNA, 16 bp, G. gallus
actccaccaccttcct

SEQ ID NO: 534997 - DNA, 16 bp, G. gallus
actccaggtggggtct

SEQ ID NO: 534998 - DNA, 16 bp, G. gallus
actccattgtagaagg

SEQ ID NO: 534999 - DNA, 16 bp, G. gallus
actccccatctggatg

SEQ ID NO: 535000 - DNA, 16 bp, G. gallus
actccctgctgtgggc

SEQ ID NO: 535001 - DNA, 16 bp, G. gallus
actctctcagtaaaaa

SEQ ID NO: 535002 - DNA, 16 bp, G. gallus
actctgtcctggtgag

SEQ ID NO: 535003 - DNA, 16 bp, G. gallus
actctttcagagaaga

SEQ ID NO: 535004 - DNA, 16 bp, G. gallus
actgaagagcaagaag

SEQ ID NO: 535005 - DNA, 16 bp, G. gallus
actgaagttggaaaag

SEQ ID NO: 535006 - DNA, 16 bp, G. gallus
actgaattcctccatg

SEQ ID NO: 535007 - DNA, 16 bp, G. gallus
actgaattcctctatg

SEQ ID NO: 535008 - DNA, 16 bp, G. gallus
actgaccacagccctc

SEQ ID NO: 535009 - DNA, 16 bp, G. gallus
actgagcagggacacc

SEQ ID NO: 535010 - DNA, 16 bp, G. gallus
actgagggggaaaaaa

SEQ ID NO: 535011 - DNA, 16 bp, G. gallus
actgatgaagatatta

SEQ ID NO: 535012 - DNA, 16 bp, G. gallus
actgatgaagatgctg

SEQ ID NO: 535013 - DNA, 16 bp, G. gallus
actgatgctgtaactc

SEQ ID NO: 535014 - DNA, 16 bp, G. gallus
actgatggagctgtgg

SEQ ID NO: 535015 - DNA, 16 bp, G. gallus
actgcacaccactgaa

SEQ ID NO: 535016 - DNA, 16 bp, G. gallus
actgcagcccaggctg

SEQ ID NO: 535017 - DNA, 16 bp, G. gallus
actgcattaaaaaaaa

SEQ ID NO: 535018 - DNA, 16 bp, G. gallus
actgcattcagatgtg

SEQ ID NO: 535019 - DNA, 16 bp, G. gallus
actgcattcagctctg

SEQ ID NO: 535020 - DNA, 16 bp, G. gallus
actgccctgcaatgaa

SEQ ID NO: 535021 - DNA, 16 bp, G. gallus
actgctcagcaacaac

SEQ ID NO: 535022 - DNA, 16 bp, G. gallus
actgctctctgcagct

SEQ ID NO: 535023 - DNA, 16 bp, G. gallus
actgctgaaactcacc

SEQ ID NO: 535024 - DNA, 16 bp, G. gallus
actgctgaaatacacc

SEQ ID NO: 535025 - DNA, 16 bp, G. gallus
actgctgcctcatgtc

SEQ ID NO: 535026 - DNA, 16 bp, G. gallus
actgctgctgctgctg

SEQ ID NO: 535027 - DNA, 16 bp, G. gallus
actgcttcaggccctg

SEQ ID NO: 535028 - DNA, 16 bp, G. gallus
actgcttcctggccat

SEQ ID NO: 535029 - DNA, 16 bp, G. gallus
actggaaaagggtaga

SEQ ID NO: 535030 - DNA, 16 bp, G. gallus
actggaagaagaactc

SEQ ID NO: 535031 - DNA, 16 bp, G. gallus
actggaaggctgcagt

SEQ ID NO: 535032 - DNA, 16 bp, G. gallus
actggagaagaggagg

SEQ ID NO: 535033 - DNA, 16 bp, G. gallus
actggagagcaagaag

SEQ ID NO: 535034 - DNA, 16 bp, G. gallus
actggagagcccagaa

SEQ ID NO: 535035 - DNA, 16 bp, G. gallus
actggagcacctctcc

SEQ ID NO: 535036 - DNA, 16 bp, G. gallus
actggatgatcttcaa

SEQ ID NO: 535037 - DNA, 16 bp, G. gallus
actggccaaagagata

SEQ ID NO: 535038 - DNA, 16 bp, G. gallus
actggctgatgtggtt

SEQ ID NO: 535039 - DNA, 16 bp, G. gallus
actggctgcccaggga

SEQ ID NO: 535040 - DNA, 16 bp, G. gallus
actggctggagggctg

SEQ ID NO: 535041 - DNA, 16 bp, G. gallus
actgggaattaaagag

SEQ ID NO: 535042 - DNA, 16 bp, G. gallus
actggggaaaaaaata

SEQ ID NO: 535043 - DNA, 16 bp, G. gallus
actggtggatggcaaa

SEQ ID NO: 535044 - DNA, 16 bp, G. gallus
actgtccctggcagtg

SEQ ID NO: 535045 - DNA, 16 bp, G. gallus
actgtctatgtcactg

SEQ ID NO: 535046 - DNA, 16 bp, G. gallus
actgtctggtctccat

SEQ ID NO: 535047 - DNA, 16 bp, G. gallus
actgtgctcacagcca

SEQ ID NO: 535048 - DNA, 16 bp, G. gallus
actgtgggtttttttt

SEQ ID NO: 535049 - DNA, 16 bp, G. gallus
actgttcactgttctg

SEQ ID NO: 535050 - DNA, 16 bp, G. gallus
actgttcagtggatga

SEQ ID NO: 535051 - DNA, 16 bp, G. gallus
actgttgatatatttg

SEQ ID NO: 535052 - DNA, 16 bp, G. gallus
actgttgctgctgctg

SEQ ID NO: 535053 - DNA, 16 bp, G. gallus
actgttggccttccag

SEQ ID NO: 535054 - DNA, 16 bp, G. gallus
actgtttggtccccat

SEQ ID NO: 535055 - DNA, 16 bp, G. gallus
acttagcatttccact

SEQ ID NO: 535056 - DNA, 16 bp, G. gallus
acttatttacagaaag

SEQ ID NO: 535057 - DNA, 16 bp, G. gallus
acttcaacttccctga

SEQ ID NO: 535058 - DNA, 16 bp, G. gallus
acttcaccagactgcc

SEQ ID NO: 535059 - DNA, 16 bp, G. gallus
acttccactggtgcag

SEQ ID NO: 535060 - DNA, 16 bp, G. gallus
acttccagctagcttg

SEQ ID NO: 535061 - DNA, 16 bp, G. gallus
acttccatgtcagaca

SEQ ID NO: 535062 - DNA, 16 bp, G. gallus
acttctgtgctgtgtg

SEQ ID NO: 535063 - DNA, 16 bp, G. gallus
acttcttccttatatc

SEQ ID NO: 535064 - DNA, 16 bp, G. gallus
acttcttgaacacctc

SEQ ID NO: 535065 - DNA, 16 bp, G. gallus
acttgaaaggtgggcc

SEQ ID NO: 535066 - DNA, 16 bp, G. gallus
acttgagtcagcactg

SEQ ID NO: 535067 - DNA, 16 bp, G. gallus
acttgctgaaggtgca

SEQ ID NO: 535068 - DNA, 16 bp, G. gallus
acttgctgaatgttta

SEQ ID NO: 535069 - DNA, 16 bp, G. gallus
acttggaagaaaaaaa

SEQ ID NO: 535070 - DNA, 16 bp, G. gallus
acttggacttgttgaa

SEQ ID NO: 535071 - DNA, 16 bp, G. gallus
acttggattggaaggg

SEQ ID NO: 535072 - DNA, 16 bp, G. gallus
acttggccttgttgaa

SEQ ID NO: 535073 - DNA, 16 bp, G. gallus
acttgggaaaaaaaaa

SEQ ID NO: 535074 - DNA, 16 bp, G. gallus
acttgtggatgttcag

SEQ ID NO: 535075 - DNA, 16 bp, G. gallus
actttcctcctcagat

SEQ ID NO: 535076 - DNA, 16 bp, G. gallus
actttgaaaccatttc

SEQ ID NO: 535077 - DNA, 16 bp, G. gallus
actttgaaagtaatgc

SEQ ID NO: 535078 - DNA, 16 bp, G. gallus
actttgtgaagctact

SEQ ID NO: 535079 - DNA, 16 bp, G. gallus
acttttaaaaagaaaa

SEQ ID NO: 535080 - DNA, 16 bp, G. gallus
agaaaaaaaaatcttt

SEQ ID NO: 535081 - DNA, 16 bp, G. gallus
agaaaaaaaatgcttt

SEQ ID NO: 535082 - DNA, 16 bp, G. gallus
agaaaaacattttttt

SEQ ID NO: 535083 - DNA, 16 bp, G. gallus
agaaaaagaaaagctg

SEQ ID NO: 535084 - DNA, 16 bp, G. gallus
agaaaaagagaatcta

SEQ ID NO: 535085 - DNA, 16 bp, G. gallus
agaaaaatacatattt

SEQ ID NO: 535086 - DNA, 16 bp, G. gallus
agaaaaatattttcat

SEQ ID NO: 535087 - DNA, 16 bp, G. gallus
agaaaaatggatttga

SEQ ID NO: 535088 - DNA, 16 bp, G. gallus
agaaaaatggcaccca

SEQ ID NO: 535089 - DNA, 16 bp, G. gallus
agaaaacatttcttct

SEQ ID NO: 535090 - DNA, 16 bp, G. gallus
agaaaagaaggctctg

SEQ ID NO: 535091 - DNA, 16 bp, G. gallus
agaaaagaaggctgtg

SEQ ID NO: 535092 - DNA, 16 bp, G. gallus
agaaaagaatttcttc

SEQ ID NO: 535093 - DNA, 16 bp, G. gallus
agaaaagagactgaca

SEQ ID NO: 535094 - DNA, 16 bp, G. gallus
agaaaaggaggctgag

SEQ ID NO: 535095 - DNA, 16 bp, G. gallus
agaaaataaacatttt

SEQ ID NO: 535096 - DNA, 16 bp, G. gallus
agaaaatatttcagaa

SEQ ID NO: 535097 - DNA, 16 bp, G. gallus
agaaaatgttttattt

SEQ ID NO: 535098 - DNA, 16 bp, G. gallus
agaaaatgttttctga

SEQ ID NO: 535099 - DNA, 16 bp, G. gallus
agaaaattagaaaagc

SEQ ID NO: 535100 - DNA, 16 bp, G. gallus
agaaaattatttttct

SEQ ID NO: 535101 - DNA, 16 bp, G. gallus
agaaacaacagttcaa

SEQ ID NO: 535102 - DNA, 16 bp, G. gallus
agaaagacagacagac

SEQ ID NO: 535103 - DNA, 16 bp, G. gallus
agaaagacatggaact

SEQ ID NO: 535104 - DNA, 16 bp, G. gallus
agaaagcagcagcagc

SEQ ID NO: 535105 - DNA, 16 bp, G. gallus
agaaaggctgaaggag

SEQ ID NO: 535106 - DNA, 16 bp, G. gallus
agaaagtggtggtgaa

SEQ ID NO: 535107 - DNA, 16 bp, G. gallus
agaaatacctcaggaa

SEQ ID NO: 535108 - DNA, 16 bp, G. gallus
agaaatatgtatatat

SEQ ID NO: 535109 - DNA, 16 bp, G. gallus
agaaatgtttcctaat

SEQ ID NO: 535110 - DNA, 16 bp, G. gallus
agaacaaagggaaatg

SEQ ID NO: 535111 - DNA, 16 bp, G. gallus
agaacagaaggctctg

SEQ ID NO: 535112 - DNA, 16 bp, G. gallus
agaacagcagcaatga

SEQ ID NO: 535113 - DNA, 16 bp, G. gallus
agaacatctagtccaa

SEQ ID NO: 535114 - DNA, 16 bp, G. gallus
agaaccatggaatcat

SEQ ID NO: 535115 - DNA, 20 bp, G. gallus
agaactgccaccttggactt

SEQ ID NO: 535116 - DNA, 16 bp, G. gallus
agaactggggaaaaaa

SEQ ID NO: 535117 - DNA, 16 bp, G. gallus
agaactgtgtggatgt

SEQ ID NO: 535118 - DNA, 16 bp, G. gallus
agaagaaaaatgcttt

SEQ ID NO: 535119 - DNA, 16 bp, G. gallus
agaagaaaaggctgag

SEQ ID NO: 535120 - DNA, 16 bp, G. gallus
agaagaagaaaaatct

SEQ ID NO: 535121 - DNA, 16 bp, G. gallus
agaagaatttcttcct

SEQ ID NO: 535122 - DNA, 16 bp, G. gallus
agaagagaaggttcca

SEQ ID NO: 535123 - DNA, 16 bp, G. gallus
agaagaggagactcag

SEQ ID NO: 535124 - DNA, 16 bp, G. gallus
agaagaggaggcccag

SEQ ID NO: 535125 - DNA, 16 bp, G. gallus
agaagaggaggctcag

SEQ ID NO: 535126 - DNA, 16 bp, G. gallus
agaagaggctcagggg

SEQ ID NO: 535127 - DNA, 16 bp, G. gallus
agaagcagccctgcag

SEQ ID NO: 535128 - DNA, 16 bp, G. gallus
agaagcattaaggttg

SEQ ID NO: 535129 - DNA, 16 bp, G. gallus
agaagcatttggacag

SEQ ID NO: 535130 - DNA, 16 bp, G. gallus
agaagctggcagtcca

SEQ ID NO: 535131 - DNA, 16 bp, G. gallus
agaaggaagagatgcc

SEQ ID NO: 535132 - DNA, 16 bp, G. gallus
agaaggaaggaatgcc

SEQ ID NO: 535133 - DNA, 16 bp, G. gallus
agaaggacatggagct

SEQ ID NO: 535134 - DNA, 16 bp, G. gallus
agaaggaccagcacaa

SEQ ID NO: 535135 - DNA, 16 bp, G. gallus
agaaggagacaccaca

SEQ ID NO: 535136 - DNA, 16 bp, G. gallus
agaaggagaccccaca

SEQ ID NO: 535137 - DNA, 17 bp, G. gallus
agaaggctccagggaga

SEQ ID NO: 535138 - DNA, 16 bp, G. gallus
agaagggcaacagagc

SEQ ID NO: 535139 - DNA, 16 bp, G. gallus
agaagggctgcaggga

SEQ ID NO: 535140 - DNA, 16 bp, G. gallus
agaaggggacagactt

SEQ ID NO: 535141 - DNA, 16 bp, G. gallus
agaagtccaggaagat

SEQ ID NO: 535142 - DNA, 16 bp, G. gallus
agaagtgtttcctgat

SEQ ID NO: 535143 - DNA, 16 bp, G. gallus
agaataacagaatcat

SEQ ID NO: 535144 - DNA, 16 bp, G. gallus
agaataacagaatggc

SEQ ID NO: 535145 - DNA, 16 bp, G. gallus
agaatcaaagaatcat

SEQ ID NO: 535146 - DNA, 16 bp, G. gallus
agaatcacagaatctt

SEQ ID NO: 535147 - DNA, 16 bp, G. gallus
agaatcacggaatcat

SEQ ID NO: 535148 - DNA, 16 bp, G. gallus
agaatcatagaacatc

SEQ ID NO: 535149 - DNA, 16 bp, G. gallus
agaatcatagaatatc

SEQ ID NO: 535150 - DNA, 16 bp, G. gallus
agaatcatagaatggc

SEQ ID NO: 535151 - DNA, 16 bp, G. gallus
agaatcattaaggttt

SEQ ID NO: 535152 - DNA, 16 bp, G. gallus
agaatcattgaagttg

SEQ ID NO: 535153 - DNA, 16 bp, G. gallus
agaatccaccacagtg

SEQ ID NO: 535154 - DNA, 16 bp, G. gallus
agaatgaaaatatttt

SEQ ID NO: 535155 - DNA, 16 bp, G. gallus
agaatgacagaatcat

SEQ ID NO: 535156 - DNA, 16 bp, G. gallus
agaatggcctgggttg

SEQ ID NO: 535157 - DNA, 16 bp, G. gallus
agaatggcttgggttg

SEQ ID NO: 535158 - DNA, 16 bp, G. gallus
agaattcatagaatca

SEQ ID NO: 535159 - DNA, 16 bp, G. gallus
agacaaaaacataatg

SEQ ID NO: 535160 - DNA, 16 bp, G. gallus
agacaaaagatttctc

SEQ ID NO: 535161 - DNA, 16 bp, G. gallus
agacaggcaaaggaga

SEQ ID NO: 535162 - DNA, 16 bp, G. gallus
agacaggctgagagag

SEQ ID NO: 535163 - DNA, 16 bp, G. gallus
agaccacaaagatcat

SEQ ID NO: 535164 - DNA, 16 bp, G. gallus
agaccaccaagatcat

SEQ ID NO: 535165 - DNA, 16 bp, G. gallus
agaccactaagatcat

SEQ ID NO: 535166 - DNA, 16 bp, G. gallus
agacccctcaccagtt

SEQ ID NO: 535167 - DNA, 16 bp, G. gallus
agaccctgctaaagac

SEQ ID NO: 535168 - DNA, 16 bp, G. gallus
agacctgctcttcact

SEQ ID NO: 535169 - DNA, 16 bp, G. gallus
agactctctttttctt

SEQ ID NO: 535170 - DNA, 16 bp, G. gallus
agactgaacagtggat

SEQ ID NO: 535171 - DNA, 16 bp, G. gallus
agactgactttttaca

SEQ ID NO: 535172 - DNA, 17 bp, G. gallus
agactgagaggagatct

SEQ ID NO: 535173 - DNA, 16 bp, G. gallus
agagaaaggccacaaa

SEQ ID NO: 535174 - DNA, 16 bp, G. gallus
agagaagagcagtgaa

SEQ ID NO: 535175 - DNA, 16 bp, G. gallus
agagaagatgtggatg

SEQ ID NO: 535176 - DNA, 16 bp, G. gallus
agagaagctctgcaga

SEQ ID NO: 535177 - DNA, 16 bp, G. gallus
agagaagctgtgagtg

SEQ ID NO: 535178 - DNA, 16 bp, G. gallus
agagaaggagattcca

SEQ ID NO: 535179 - DNA, 16 bp, G. gallus
agagaaggatctgaag

SEQ ID NO: 535180 - DNA, 16 bp, G. gallus
agagaaggctctgaga

SEQ ID NO: 535181 - DNA, 16 bp, G. gallus
agagaaggcttcaggg

SEQ ID NO: 535182 - DNA, 16 bp, G. gallus
agagacatgatcaaat

SEQ ID NO: 535183 - DNA, 16 bp, G. gallus
agagaccaaacagtgg

SEQ ID NO: 535184 - DNA, 16 bp, G. gallus
agagacctcaaagccc

SEQ ID NO: 535185 - DNA, 16 bp, G. gallus
agagacctcaagagat

SEQ ID NO: 535186 - DNA, 16 bp, G. gallus
agagagagagaagctg

SEQ ID NO: 535187 - DNA, 16 bp, G. gallus
agagagagagagactg

SEQ ID NO: 535188 - DNA, 16 bp, G. gallus
agagagcagagctcag

SEQ ID NO: 535189 - DNA, 16 bp, G. gallus
agagaggcagtctgac

SEQ ID NO: 535190 - DNA, 16 bp, G. gallus
agagagtggccagcag

SEQ ID NO: 535191 - DNA, 16 bp, G. gallus
agagatgctgtggatg

SEQ ID NO: 535192 - DNA, 16 bp, G. gallus
agagcacagccctgcc

SEQ ID NO: 535193 - DNA, 16 bp, G. gallus
agagcaccagtcccaa

SEQ ID NO: 535194 - DNA, 16 bp, G. gallus
agagcagagcagaagg

SEQ ID NO: 535195 - DNA, 16 bp, G. gallus
agagcagagctcagcg

SEQ ID NO: 535196 - DNA, 16 bp, G. gallus
agagcagaggggacaa

SEQ ID NO: 535197 - DNA, 16 bp, G. gallus
agagcagcagcagcag

SEQ ID NO: 535198 - DNA, 16 bp, G. gallus
agagcagccctacaga

SEQ ID NO: 535199 - DNA, 16 bp, G. gallus
agagcagccctgcaga

SEQ ID NO: 535200 - DNA, 16 bp, G. gallus
agagcagcctgtcagt

SEQ ID NO: 535201 - DNA, 16 bp, G. gallus
agagcagctgaaggag

SEQ ID NO: 535202 - DNA, 16 bp, G. gallus
agagcagctgagggag

SEQ ID NO: 535203 - DNA, 16 bp, G. gallus
agagcaggctgcccag

SEQ ID NO: 535204 - DNA, 16 bp, G. gallus
agagccccagctccct

SEQ ID NO: 535205 - DNA, 16 bp, G. gallus
agagcggctgaaggag

SEQ ID NO: 535206 - DNA, 16 bp, G. gallus
agagctcagcgctgct

SEQ ID NO: 535207 - DNA, 16 bp, G. gallus
agagctcttgtgctct

SEQ ID NO: 535208 - DNA, 16 bp, G. gallus
agagctgagcagaggg

SEQ ID NO: 535209 - DNA, 16 bp, G. gallus
agagctggggctgctc

SEQ ID NO: 535210 - DNA, 16 bp, G. gallus
agagctgtgtggatgt

SEQ ID NO: 535211 - DNA, 16 bp, G. gallus
agagcttctctccagc

SEQ ID NO: 535212 - DNA, 16 bp, G. gallus
agaggaaaaaaaatct

SEQ ID NO: 535213 - DNA, 16 bp, G. gallus
agaggaagctgagggg

SEQ ID NO: 535214 - DNA, 16 bp, G. gallus
agaggaatctggacag

SEQ ID NO: 535215 - DNA, 16 bp, G. gallus
agaggaattcaatgac

SEQ ID NO: 535216 - DNA, 16 bp, G. gallus
agaggagaaggctctg

SEQ ID NO: 535217 - DNA, 16 bp, G. gallus
agaggcagatgttagt

SEQ ID NO: 535218 - DNA, 16 bp, G. gallus
agaggctggagagcag

SEQ ID NO: 535219 - DNA, 21 bp, G. gallus
agagggaatggcttcaagctg

SEQ ID NO: 535220 - DNA, 16 bp, G. gallus
agaggtcccagaggac

SEQ ID NO: 535221 - DNA, 16 bp, G. gallus
agaggtcccttccagc

SEQ ID NO: 535222 - DNA, 16 bp, G. gallus
agaggtgctgcagccc

SEQ ID NO: 535223 - DNA, 16 bp, G. gallus
agaggtgctggagcag

SEQ ID NO: 535224 - DNA, 16 bp, G. gallus
agaggtggagccagga

SEQ ID NO: 535225 - DNA, 16 bp, G. gallus
agaggtggtgaagtca

SEQ ID NO: 535226 - DNA, 16 bp, G. gallus
agaggttgaacctccc

SEQ ID NO: 535227 - DNA, 16 bp, G. gallus
agagtagcaaagtcct

SEQ ID NO: 535228 - DNA, 17 bp, G. gallus
agagtgctgagggaact

SEQ ID NO: 535229 - DNA, 16 bp, G. gallus
agagtggctggaaagc

SEQ ID NO: 535230 - DNA, 16 bp, G. gallus
agagtggtggtgaatg

SEQ ID NO: 535231 - DNA, 16 bp, G. gallus
agataaggatgtgatg

SEQ ID NO: 535232 - DNA, 16 bp, G. gallus
agatacaaagagtgca

SEQ ID NO: 535233 - DNA, 16 bp, G. gallus
agatatatagatatat

SEQ ID NO: 535234 - DNA, 16 bp, G. gallus
agatatggatttgaag

SEQ ID NO: 535235 - DNA, 16 bp, G. gallus
agatattcaagatcca

SEQ ID NO: 535236 - DNA, 16 bp, G. gallus
agatattgaaaggctg

SEQ ID NO: 535237 - DNA, 16 bp, G. gallus
agatcaccaagtccaa

SEQ ID NO: 535238 - DNA, 16 bp, G. gallus
agatcacctaatccaa

SEQ ID NO: 535239 - DNA, 16 bp, G. gallus
agatcagattgcccag

SEQ ID NO: 535240 - DNA, 16 bp, G. gallus
agatcagctagtccaa

SEQ ID NO: 535241 - DNA, 16 bp, G. gallus
agatcaggttgcccag

SEQ ID NO: 535242 - DNA, 16 bp, G. gallus
agatcatccaattcca

SEQ ID NO: 535243 - DNA, 16 bp, G. gallus
agatcatctagtccaa

SEQ ID NO: 535244 - DNA, 16 bp, G. gallus
agatcatctagtccta

SEQ ID NO: 535245 - DNA, 16 bp, G. gallus
agatcatctagttcca

SEQ ID NO: 535246 - DNA, 16 bp, G. gallus
agatcatgaagtccaa

SEQ ID NO: 535247 - DNA, 16 bp, G. gallus
agatcattcagtccaa

SEQ ID NO: 535248 - DNA, 16 bp, G. gallus
agatcattgagctcca

SEQ ID NO: 535249 - DNA, 16 bp, G. gallus
agatccccaagcccaa

SEQ ID NO: 535250 - DNA, 16 bp, G. gallus
agatccctgtgtacct

SEQ ID NO: 535251 - DNA, 16 bp, G. gallus
agatcctttccaaccc

SEQ ID NO: 535252 - DNA, 16 bp, G. gallus
agatctccaaggagac

SEQ ID NO: 535253 - DNA, 16 bp, G. gallus
agatctccaaggagga

SEQ ID NO: 535254 - DNA, 17 bp, G. gallus
agatctgccagctctgc

SEQ ID NO: 535255 - DNA, 16 bp, G. gallus
agatcttcaaaagctg

SEQ ID NO: 535256 - DNA, 16 bp, G. gallus
agatctttggagatgg

SEQ ID NO: 535257 - DNA, 16 bp, G. gallus
agatgagaagctggac

SEQ ID NO: 535258 - DNA, 16 bp, G. gallus
agatgaggcctcacaa

SEQ ID NO: 535259 - DNA, 16 bp, G. gallus
agatgagtggacagtg

SEQ ID NO: 535260 - DNA, 16 bp, G. gallus
agatgatcagtgggct

SEQ ID NO: 535261 - DNA, 16 bp, G. gallus
agatgatctctgaggt

SEQ ID NO: 535262 - DNA, 16 bp, G. gallus
agatgatcttggagat

SEQ ID NO: 535263 - DNA, 16 bp, G. gallus
agatgatctttgaagt

SEQ ID NO: 535264 - DNA, 16 bp, G. gallus
agatgatgaagggcct

SEQ ID NO: 535265 - DNA, 16 bp, G. gallus
agatgatgtcagttgc

SEQ ID NO: 535266 - DNA, 16 bp, G. gallus
agatgccccatccctg

SEQ ID NO: 535267 - DNA, 16 bp, G. gallus
agatgctaggaagaaa

SEQ ID NO: 535268 - DNA, 16 bp, G. gallus
agatggaggaggagct

SEQ ID NO: 535269 - DNA, 16 bp, G. gallus
agatggatcttgaata

SEQ ID NO: 535270 - DNA, 16 bp, G. gallus
agatggcagcagtggg

SEQ ID NO: 535271 - DNA, 16 bp, G. gallus
agatgggcatccctgc

SEQ ID NO: 535272 - DNA, 17 bp, G. gallus
agatgggcctaaaaaca

SEQ ID NO: 535273 - DNA, 16 bp, G. gallus
agatggggcatccaca

SEQ ID NO: 535274 - DNA, 16 bp, G. gallus
agatggtgaagagtct

SEQ ID NO: 535275 - DNA, 16 bp, G. gallus
agatgtcaggaagaaa

SEQ ID NO: 535276 - DNA, 16 bp, G. gallus
agatgtgacactgagg

SEQ ID NO: 535277 - DNA, 16 bp, G. gallus
agatgtgaggaggaaa

SEQ ID NO: 535278 - DNA, 16 bp, G. gallus
agatgttcaagaacca

SEQ ID NO: 535279 - DNA, 16 bp, G. gallus
agattcaggctggaca

SEQ ID NO: 535280 - DNA, 16 bp, G. gallus
agattggatataaaga

SEQ ID NO: 535281 - DNA, 16 bp, G. gallus
agattggatgtcagga

SEQ ID NO: 535282 - DNA, 17 bp, G. gallus
agatttaggttggatgt

SEQ ID NO: 535283 - DNA, 16 bp, G. gallus
agatttttatgagtgt

SEQ ID NO: 535284 - DNA, 16 bp, G. gallus
agcaaacaactgtgtg

SEQ ID NO: 535285 - DNA, 16 bp, G. gallus
agcaacaaaatgtagt

SEQ ID NO: 535286 - DNA, 16 bp, G. gallus
agcaacctgactgagc

SEQ ID NO: 535287 - DNA, 16 bp, G. gallus
agcaagaggaaggcta

SEQ ID NO: 535288 - DNA, 16 bp, G. gallus
agcaaggagtctttgt

SEQ ID NO: 535289 - DNA, 16 bp, G. gallus
agcaaggtcccaggct

SEQ ID NO: 535290 - DNA, 16 bp, G. gallus
agcaagtgttgatgaa

SEQ ID NO: 535291 - DNA, 16 bp, G. gallus
agcaatgaacaggagc

SEQ ID NO: 535292 - DNA, 16 bp, G. gallus
agcacaagaaagacat

SEQ ID NO: 535293 - DNA, 16 bp, G. gallus
agcacaataatactat

SEQ ID NO: 535294 - DNA, 16 bp, G. gallus
agcacacactgccagc

SEQ ID NO: 535295 - DNA, 16 bp, G. gallus
agcacagccctgccag

SEQ ID NO: 535296 - DNA, 16 bp, G. gallus
agcacagccttctgat

SEQ ID NO: 535297 - DNA, 16 bp, G. gallus
agcacagggggctgtg

SEQ ID NO: 535298 - DNA, 19 bp, G. gallus
agcacaggtgaaggcaatt

SEQ ID NO: 535299 - DNA, 17 bp, G. gallus
agcacaggtggaagcaa

SEQ ID NO: 535300 - DNA, 16 bp, G. gallus
agcaccactgaaaaga

SEQ ID NO: 535301 - DNA, 16 bp, G. gallus
agcacctcccctacaa

SEQ ID NO: 535302 - DNA, 16 bp, G. gallus
agcacctgcagggatg

SEQ ID NO: 535303 - DNA, 16 bp, G. gallus
agcactgagggacgtg

SEQ ID NO: 535304 - DNA, 16 bp, G. gallus
agcactgcatccaggc

SEQ ID NO: 535305 - DNA, 16 bp, G. gallus
agcactggcacagact

SEQ ID NO: 535306 - DNA, 16 bp, G. gallus
agcagaaaatggagga

SEQ ID NO: 535307 - DNA, 16 bp, G. gallus
agcagaaactgctttg

SEQ ID NO: 535308 - DNA, 16 bp, G. gallus
agcagagcagctgcag

SEQ ID NO: 535309 - DNA, 16 bp, G. gallus
agcagagctgcaggca

SEQ ID NO: 535310 - DNA, 16 bp, G. gallus
agcagagctgtgctgg

SEQ ID NO: 535311 - DNA, 16 bp, G. gallus
agcagaggctgacccc

SEQ ID NO: 535312 - DNA, 16 bp, G. gallus
agcagatccagaggag

SEQ ID NO: 535313 - DNA, 16 bp, G. gallus
agcagattccctacag

SEQ ID NO: 535314 - DNA, 16 bp, G. gallus
agcagcaacagcagca

SEQ ID NO: 535315 - DNA, 16 bp, G. gallus
agcagcacagcagcag

SEQ ID NO: 535316 - DNA, 16 bp, G. gallus
agcagcagaagagaga

SEQ ID NO: 535317 - DNA, 16 bp, G. gallus
agcagcagagcagcag

SEQ ID NO: 535318 - DNA, 16 bp, G. gallus
agcagcagcacagcca

SEQ ID NO: 535319 - DNA, 16 bp, G. gallus
agcagcagcactgctg

SEQ ID NO: 535320 - DNA, 16 bp, G. gallus
agcagcagcagagagg

SEQ ID NO: 535321 - DNA, 16 bp, G. gallus
agcagcagcagagcag

SEQ ID NO: 535322 - DNA, 16 bp, G. gallus
agcagcagcagagctg

SEQ ID NO: 535323 - DNA, 16 bp, G. gallus
agcagcagcagagggg

SEQ ID NO: 535324 - DNA, 16 bp, G. gallus
agcagcagcagcaaca

SEQ ID NO: 535325 - DNA, 16 bp, G. gallus
agcagcagcagcactg

SEQ ID NO: 535326 - DNA, 16 bp, G. gallus
agcagcagcagcagag

SEQ ID NO: 535327 - DNA, 16 bp, G. gallus
agcagcagcagcagca

SEQ ID NO: 535328 - DNA, 16 bp, G. gallus
agcagcagcagcagct

SEQ ID NO: 535329 - DNA, 16 bp, G. gallus
agcagcagcagcatcc

SEQ ID NO: 535330 - DNA, 16 bp, G. gallus
agcagcagcagcatct

SEQ ID NO: 535331 - DNA, 16 bp, G. gallus
agcagcagcagctgct

SEQ ID NO: 535332 - DNA, 16 bp, G. gallus
agcagcagcaggagct

SEQ ID NO: 535333 - DNA, 16 bp, G. gallus
agcagcagcagtgcag

SEQ ID NO: 535334 - DNA, 16 bp, G. gallus
agcagcagcagtgtgg

SEQ ID NO: 535335 - DNA, 16 bp, G. gallus
agcagcagctctgcag

SEQ ID NO: 535336 - DNA, 16 bp, G. gallus
agcagcaggagcagag

SEQ ID NO: 535337 - DNA, 16 bp, G. gallus
agcagcagtgacagca

SEQ ID NO: 535338 - DNA, 16 bp, G. gallus
agcagccacagatgca

SEQ ID NO: 535339 - DNA, 16 bp, G. gallus
agcagccccagccctg

SEQ ID NO: 535340 - DNA, 16 bp, G. gallus
agcagctcagctgccc

SEQ ID NO: 535341 - DNA, 17 bp, G. gallus
agcagctgaaggagctg

SEQ ID NO: 535342 - DNA, 16 bp, G. gallus
agcagctgagagaact

SEQ ID NO: 535343 - DNA, 16 bp, G. gallus
agcagctgaggcccct

SEQ ID NO: 535344 - DNA, 16 bp, G. gallus
agcagctgcccacatt

SEQ ID NO: 535345 - DNA, 16 bp, G. gallus
agcagctggagctgct

SEQ ID NO: 535346 - DNA, 16 bp, G. gallus
agcagggaggtgattg

SEQ ID NO: 535347 - DNA, 16 bp, G. gallus
agcagggatgcccatc

SEQ ID NO: 535348 - DNA, 16 bp, G. gallus
agcaggtggagggagg

SEQ ID NO: 535349 - DNA, 16 bp, G. gallus
agcaggttccctgcag

SEQ ID NO: 535350 - DNA, 16 bp, G. gallus
agcaggttgcacagga

SEQ ID NO: 535351 - DNA, 16 bp, G. gallus
agcaggttggccatga

SEQ ID NO: 535352 - DNA, 16 bp, G. gallus
agcagtctgacaaaat

SEQ ID NO: 535353 - DNA, 16 bp, G. gallus
agcagtgacaacagca

SEQ ID NO: 535354 - DNA, 16 bp, G. gallus
agcagtgatgacagtg

SEQ ID NO: 535355 - DNA, 16 bp, G. gallus
agcagtgcttacacag

SEQ ID NO: 535356 - DNA, 16 bp, G. gallus
agcagtggaagagagc

SEQ ID NO: 535357 - DNA, 16 bp, G. gallus
agcagtggcagcagca

SEQ ID NO: 535358 - DNA, 16 bp, G. gallus
agcagtggtgacagca

SEQ ID NO: 535359 - DNA, 16 bp, G. gallus
agcagtggtgacagtg

SEQ ID NO: 535360 - DNA, 16 bp, G. gallus
agcagtgtacccaggt

SEQ ID NO: 535361 - DNA, 16 bp, G. gallus
agcagtttttcttcct

SEQ ID NO: 535362 - DNA, 16 bp, G. gallus
agcatctcctgtatga

SEQ ID NO: 535363 - DNA, 16 bp, G. gallus
agcatggcttgggttg

SEQ ID NO: 535364 - DNA, 16 bp, G. gallus
agcatggtggggatgg

SEQ ID NO: 535365 - DNA, 16 bp, G. gallus
agcattaactctttaa

SEQ ID NO: 535366 - DNA, 16 bp, G. gallus
agcattgtttttctcc

SEQ ID NO: 535367 - DNA, 16 bp, G. gallus
agcatttgaaatgaaa

SEQ ID NO: 535368 - DNA, 16 bp, G. gallus
agcattttattttatt

SEQ ID NO: 535369 - DNA, 16 bp, G. gallus
agccaacagtgtgccc

SEQ ID NO: 535370 - DNA, 16 bp, G. gallus
agccaagattggcaat

SEQ ID NO: 535371 - DNA, 16 bp, G. gallus
agccaaggtcaggctg

SEQ ID NO: 535372 - DNA, 16 bp, G. gallus
agccaaggtgcagatg

SEQ ID NO: 535373 - DNA, 16 bp, G. gallus
agccagagagttgtgg

SEQ ID NO: 535374 - DNA, 16 bp, G. gallus
agccagagggctgtgg

SEQ ID NO: 535375 - DNA, 16 bp, G. gallus
agccagcaatgtgccc

SEQ ID NO: 535376 - DNA, 16 bp, G. gallus
agccagcagtgtgcac

SEQ ID NO: 535377 - DNA, 16 bp, G. gallus
agccagcagtgttccc

SEQ ID NO: 535378 - DNA, 16 bp, G. gallus
agccagcggtgtgccc

SEQ ID NO: 535379 - DNA, 16 bp, G. gallus
agccaggctccacccc

SEQ ID NO: 535380 - DNA, 16 bp, G. gallus
agccagttctttatcc

SEQ ID NO: 535381 - DNA, 16 bp, G. gallus
agccatctcagggggt

SEQ ID NO: 535382 - DNA, 16 bp, G. gallus
agcccagagaagctgt

SEQ ID NO: 535383 - DNA, 16 bp, G. gallus
agcccagctccctcag

SEQ ID NO: 535384 - DNA, 16 bp, G. gallus
agcccatgccagtgcc

SEQ ID NO: 535385 - DNA, 16 bp, G. gallus
agcccatggaggtgga

SEQ ID NO: 535386 - DNA, 16 bp, G. gallus
agcccatggcagggga

SEQ ID NO: 535387 - DNA, 16 bp, G. gallus
agccccatccaacttg

SEQ ID NO: 535388 - DNA, 16 bp, G. gallus
agccccatccagactg

SEQ ID NO: 535389 - DNA, 16 bp, G. gallus
agccccctgctgtggg

SEQ ID NO: 535390 - DNA, 16 bp, G. gallus
agccccgtccagcctg

SEQ ID NO: 535391 - DNA, 16 bp, G. gallus
agcccgcctggctgag

SEQ ID NO: 535392 - DNA, 16 bp, G. gallus
agccctgaggagaagg

SEQ ID NO: 535393 - DNA, 16 bp, G. gallus
agccctgcagagaaga

SEQ ID NO: 535394 - DNA, 16 bp, G. gallus
agccctgcccagcctg

SEQ ID NO: 535395 - DNA, 16 bp, G. gallus
agcctagatctttgga

SEQ ID NO: 535396 - DNA, 22 bp, G. gallus
agcctataaacaggaagggagt

SEQ ID NO: 535397 - DNA, 19 bp, G. gallus
agcctattccagtgcttaa

SEQ ID NO: 535398 - DNA, 16 bp, G. gallus
agcctcaccttgaaag

SEQ ID NO: 535399 - DNA, 16 bp, G. gallus
agcctcatcttctcca

SEQ ID NO: 535400 - DNA, 16 bp, G. gallus
agcctcccctggtgca

SEQ ID NO: 535401 - DNA, 16 bp, G. gallus
agcctccttttcctca

SEQ ID NO: 535402 - DNA, 16 bp, G. gallus
agcctccttttctcca

SEQ ID NO: 535403 - DNA, 16 bp, G. gallus
agcctctcttcatagg

SEQ ID NO: 535404 - DNA, 16 bp, G. gallus
agcctcttcttctcca

SEQ ID NO: 535405 - DNA, 16 bp, G. gallus
agcctgaagaagagga

SEQ ID NO: 535406 - DNA, 16 bp, G. gallus
agcctgaccttggtgc

SEQ ID NO: 535407 - DNA, 16 bp, G. gallus
agcctgactttgaatg

SEQ ID NO: 535408 - DNA, 16 bp, G. gallus
agcctgctctgctctg

SEQ ID NO: 535409 - DNA, 16 bp, G. gallus
agcctggagaacagaa

SEQ ID NO: 535410 - DNA, 16 bp, G. gallus
agcctggagaagacaa

SEQ ID NO: 535411 - DNA, 16 bp, G. gallus
agcctggggaagagga

SEQ ID NO: 535412 - DNA, 16 bp, G. gallus
agcctgttccagtgct

SEQ ID NO: 535413 - DNA, 16 bp, G. gallus
agcctgttccatgccc

SEQ ID NO: 535414 - DNA, 16 bp, G. gallus
agccttcacttctcca

SEQ ID NO: 535415 - DNA, 16 bp, G. gallus
agccttcctggacccc

SEQ ID NO: 535416 - DNA, 16 bp, G. gallus
agccttctcttctcca

SEQ ID NO: 535417 - DNA, 16 bp, G. gallus
agccttctcttcttca

SEQ ID NO: 535418 - DNA, 16 bp, G. gallus
agccttctcttttcca

SEQ ID NO: 535419 - DNA, 16 bp, G. gallus
agccttgagaaaagaa

SEQ ID NO: 535420 - DNA, 16 bp, G. gallus
agcctttcagtacctg

SEQ ID NO: 535421 - DNA, 16 bp, G. gallus
agcctttcagtgtcta

SEQ ID NO: 535422 - DNA, 16 bp, G. gallus
agcgataaggtctccc

SEQ ID NO: 535423 - DNA, 16 bp, G. gallus
agcgttattgtgctct

SEQ ID NO: 535424 - DNA, 17 bp, G. gallus
agctaccaggatcatct

SEQ ID NO: 535425 - DNA, 16 bp, G. gallus
agctcacccagttcca

SEQ ID NO: 535426 - DNA, 16 bp, G. gallus
agctcaggctgctcag

SEQ ID NO: 535427 - DNA, 16 bp, G. gallus
agctccacatccttct

SEQ ID NO: 535428 - DNA, 16 bp, G. gallus
agctcctcatccagac

SEQ ID NO: 535429 - DNA, 16 bp, G. gallus
agctcctcccagttta

SEQ ID NO: 535430 - DNA, 16 bp, G. gallus
agctctctgtctttct

SEQ ID NO: 535431 - DNA, 16 bp, G. gallus
agctctgcagagaggg

SEQ ID NO: 535432 - DNA, 16 bp, G. gallus
agctctgcatccttcc

SEQ ID NO: 535433 - DNA, 16 bp, G. gallus
agctctgcattttcac

SEQ ID NO: 535434 - DNA, 16 bp, G. gallus
agctctgctgctgctg

SEQ ID NO: 535435 - DNA, 16 bp, G. gallus
agctgaaactaagaca

SEQ ID NO: 535436 - DNA, 16 bp, G. gallus
agctgaacatgagctg

SEQ ID NO: 535437 - DNA, 16 bp, G. gallus
agctgaagcaagaagg

SEQ ID NO: 535438 - DNA, 16 bp, G. gallus
agctgagctgctgggg

SEQ ID NO: 535439 - DNA, 16 bp, G. gallus
agctgaggctgttcag

SEQ ID NO: 535440 - DNA, 16 bp, G. gallus
agctgaggggagacct

SEQ ID NO: 535441 - DNA, 16 bp, G. gallus
agctgcagaaagcaaa

SEQ ID NO: 535442 - DNA, 16 bp, G. gallus
agctgcagagagcaat

SEQ ID NO: 535443 - DNA, 16 bp, G. gallus
agctgcatccagcctg

SEQ ID NO: 535444 - DNA, 16 bp, G. gallus
agctgcccagaggagc

SEQ ID NO: 535445 - DNA, 16 bp, G. gallus
agctgccggagctcag

SEQ ID NO: 535446 - DNA, 16 bp, G. gallus
agctgctcagggaggt

SEQ ID NO: 535447 - DNA, 16 bp, G. gallus
agctgctgataatggc

SEQ ID NO: 535448 - DNA, 16 bp, G. gallus
agctgctgctgctgca

SEQ ID NO: 535449 - DNA, 16 bp, G. gallus
agctgctgctgctgct

SEQ ID NO: 535450 - DNA, 16 bp, G. gallus
agctgctggagagggt

SEQ ID NO: 535451 - DNA, 16 bp, G. gallus
agctggaactgttcag

SEQ ID NO: 535452 - DNA, 16 bp, G. gallus
agctggacttgttcag

SEQ ID NO: 535453 - DNA, 16 bp, G. gallus
agctggagaagagaag

SEQ ID NO: 535454 - DNA, 16 bp, G. gallus
agctggagctcttcag

SEQ ID NO: 535455 - DNA, 16 bp, G. gallus
agctggagctgttcag

SEQ ID NO: 535456 - DNA, 16 bp, G. gallus
agctggaggaaaaaaa

SEQ ID NO: 535457 - DNA, 16 bp, G. gallus
agctggaggaagaagg

SEQ ID NO: 535458 - DNA, 16 bp, G. gallus
agctggcagtgctggg

SEQ ID NO: 535459 - DNA, 22 bp, G. gallus
agctggctactcttcaaggatg

SEQ ID NO: 535460 - DNA, 19 bp, G. gallus
agctggctgaggtggttgc

SEQ ID NO: 535461 - DNA, 16 bp, G. gallus
agctggggagggacat

SEQ ID NO: 535462 - DNA, 16 bp, G. gallus
agctgtgaaacagtga

SEQ ID NO: 535463 - DNA, 16 bp, G. gallus
agctgtgctaaggcac

SEQ ID NO: 535464 - DNA, 16 bp, G. gallus
agctgtgggtgtcccc

SEQ ID NO: 535465 - DNA, 16 bp, G. gallus
agctgttccagtgcct

SEQ ID NO: 535466 - DNA, 16 bp, G. gallus
agctgttggagaaggt

SEQ ID NO: 535467 - DNA, 16 bp, G. gallus
agctgttggagcagat

SEQ ID NO: 535468 - DNA, 16 bp, G. gallus
agctgttggagtgggt

SEQ ID NO: 535469 - DNA, 16 bp, G. gallus
agcttcctcagccttt

SEQ ID NO: 535470 - DNA, 16 bp, G. gallus
agcttctcatccacca

SEQ ID NO: 535471 - DNA, 16 bp, G. gallus
agcttctccatgagaa

SEQ ID NO: 535472 - DNA, 16 bp, G. gallus
agcttctctgtgcagc

SEQ ID NO: 535473 - DNA, 16 bp, G. gallus
agcttctggaggagaa

SEQ ID NO: 535474 - DNA, 16 bp, G. gallus
agcttgaagaagagaa

SEQ ID NO: 535475 - DNA, 16 bp, G. gallus
agcttgcctgtgtcac

SEQ ID NO: 535476 - DNA, 16 bp, G. gallus
agcttgctgtcatctg

SEQ ID NO: 535477 - DNA, 16 bp, G. gallus
agcttggagaagagaa

SEQ ID NO: 535478 - DNA, 16 bp, G. gallus
agcttggggctgtgcc

SEQ ID NO: 535479 - DNA, 16 bp, G. gallus
agcttgggttggaagg

SEQ ID NO: 535480 - DNA, 16 bp, G. gallus
agctttcccctgcaaa

SEQ ID NO: 535481 - DNA, 16 bp, G. gallus
agctttctgccttcag

SEQ ID NO: 535482 - DNA, 16 bp, G. gallus
agcttttgaagatctc

SEQ ID NO: 535483 - DNA, 16 bp, G. gallus
agctttttgtccacca

SEQ ID NO: 535484 - DNA, 16 bp, G. gallus
aggaaaaacaacttct

SEQ ID NO: 535485 - DNA, 16 bp, G. gallus
aggaaaaactttttta

SEQ ID NO: 535486 - DNA, 16 bp, G. gallus
aggaaagatttcttct

SEQ ID NO: 535487 - DNA, 16 bp, G. gallus
aggaaaggttgaagga

SEQ ID NO: 535488 - DNA, 16 bp, G. gallus
aggaacggtgactcca

SEQ ID NO: 535489 - DNA, 16 bp, G. gallus
aggaactggctagagg

SEQ ID NO: 535490 - DNA, 16 bp, G. gallus
aggaagaaattcttca

SEQ ID NO: 535491 - DNA, 16 bp, G. gallus
aggaagaaattgttta

SEQ ID NO: 535492 - DNA, 16 bp, G. gallus
aggaagaagtttttca

SEQ ID NO: 535493 - DNA, 16 bp, G. gallus
aggaagatctgctcca

SEQ ID NO: 535494 - DNA, 16 bp, G. gallus
aggaagcacttcttta

SEQ ID NO: 535495 - DNA, 16 bp, G. gallus
aggaagcatataaaca

SEQ ID NO: 535496 - DNA, 16 bp, G. gallus
aggaagctgggattgt

SEQ ID NO: 535497 - DNA, 16 bp, G. gallus
aggaaggagacagact

SEQ ID NO: 535498 - DNA, 16 bp, G. gallus
aggaaggggaacagct

SEQ ID NO: 535499 - DNA, 16 bp, G. gallus
aggaaggttcaacctc

SEQ ID NO: 535500 - DNA, 16 bp, G. gallus
aggaatggctgtttac

SEQ ID NO: 535501 - DNA, 16 bp, G. gallus
aggacaagagaaaatg

SEQ ID NO: 535502 - DNA, 16 bp, G. gallus
aggacaagctgagaga

SEQ ID NO: 535503 - DNA, 16 bp, G. gallus
aggacaaggggaaatg

SEQ ID NO: 535504 - DNA, 16 bp, G. gallus
aggacaaggggaaatt

SEQ ID NO: 535505 - DNA, 16 bp, G. gallus
aggacaaggggcagtg

SEQ ID NO: 535506 - DNA, 16 bp, G. gallus
aggacagctgacttaa

SEQ ID NO: 535507 - DNA, 19 bp, G. gallus
aggacaggacaggacagga

SEQ ID NO: 535508 - DNA, 16 bp, G. gallus
aggaccatcaagttcc

SEQ ID NO: 535509 - DNA, 16 bp, G. gallus
aggactctgggatgca

SEQ ID NO: 535510 - DNA, 16 bp, G. gallus
aggacttcaaagatca

SEQ ID NO: 535511 - DNA, 16 bp, G. gallus
aggagaagctgagaga

SEQ ID NO: 535512 - DNA, 16 bp, G. gallus
aggagaaggctctggg

SEQ ID NO: 535513 - DNA, 17 bp, G. gallus
aggagacaggccaagga

SEQ ID NO: 535514 - DNA, 16 bp, G. gallus
aggagagctgctccag

SEQ ID NO: 535515 - DNA, 16 bp, G. gallus
aggagaggcgctccag

SEQ ID NO: 535516 - DNA, 16 bp, G. gallus
aggagaggctgaagga

SEQ ID NO: 535517 - DNA, 16 bp, G. gallus
aggagatgctccaggc

SEQ ID NO: 535518 - DNA, 16 bp, G. gallus
aggagattgtggatgc

SEQ ID NO: 535519 - DNA, 16 bp, G. gallus
aggagcagagcagagc

SEQ ID NO: 535520 - DNA, 16 bp, G. gallus
aggagcagcctcctgc

SEQ ID NO: 535521 - DNA, 16 bp, G. gallus
aggagcagctgaagaa

SEQ ID NO: 535522 - DNA, 16 bp, G. gallus
aggagcagctgaagtc

SEQ ID NO: 535523 - DNA, 16 bp, G. gallus
aggagcagctgaggaa

SEQ ID NO: 535524 - DNA, 16 bp, G. gallus
aggagcagctgaggga

SEQ ID NO: 535525 - DNA, 16 bp, G. gallus
aggagcaggaaggtga

SEQ ID NO: 535526 - DNA, 16 bp, G. gallus
aggagctcagaactgg

SEQ ID NO: 535527 - DNA, 16 bp, G. gallus
aggagctctgcagagg

SEQ ID NO: 535528 - DNA, 16 bp, G. gallus
aggagctgcaggctgc

SEQ ID NO: 535529 - DNA, 16 bp, G. gallus
aggagctggaggccat

SEQ ID NO: 535530 - DNA, 16 bp, G. gallus
aggaggaagattttca

SEQ ID NO: 535531 - DNA, 16 bp, G. gallus
aggaggaagttttcca

SEQ ID NO: 535532 - DNA, 16 bp, G. gallus
aggaggatctgctcca

SEQ ID NO: 535533 - DNA, 16 bp, G. gallus
aggaggatctgctctg

SEQ ID NO: 535534 - DNA, 16 bp, G. gallus
aggaggctgtgaatgc

SEQ ID NO: 535535 - DNA, 16 bp, G. gallus
aggaggctgtggatgc

SEQ ID NO: 535536 - DNA, 16 bp, G. gallus
aggaggctgtgggtgc

SEQ ID NO: 535537 - DNA, 16 bp, G. gallus
aggaggttgcagtgag

SEQ ID NO: 535538 - DNA, 16 bp, G. gallus
aggaggttgtggatgc

SEQ ID NO: 535539 - DNA, 16 bp, G. gallus
aggatcacctccttca

SEQ ID NO: 535540 - DNA, 16 bp, G. gallus
aggatctgttccatga

SEQ ID NO: 535541 - DNA, 16 bp, G. gallus
aggatgagaaggaatg

SEQ ID NO: 535542 - DNA, 16 bp, G. gallus
aggatgcattactttc

SEQ ID NO: 535543 - DNA, 16 bp, G. gallus
aggatgcccagggccc

SEQ ID NO: 535544 - DNA, 16 bp, G. gallus
aggatggagcacagcc

SEQ ID NO: 535545 - DNA, 16 bp, G. gallus
aggatggggccaggct

SEQ ID NO: 535546 - DNA, 16 bp, G. gallus
aggatggggctctgag

SEQ ID NO: 535547 - DNA, 16 bp, G. gallus
aggatgtcatgcagga

SEQ ID NO: 535548 - DNA, 16 bp, G. gallus
aggatgtcatgtggga

SEQ ID NO: 535549 - DNA, 16 bp, G. gallus
aggatttcttcctaat

SEQ ID NO: 535550 - DNA, 16 bp, G. gallus
aggatttcttctccca

SEQ ID NO: 535551 - DNA, 16 bp, G. gallus
aggcaatgctacaggc

SEQ ID NO: 535552 - DNA, 16 bp, G. gallus
aggcacactgctggct

SEQ ID NO: 535553 - DNA, 16 bp, G. gallus
aggcacagatgtgagg

SEQ ID NO: 535554 - DNA, 16 bp, G. gallus
aggcactggaacaagt

SEQ ID NO: 535555 - DNA, 16 bp, G. gallus
aggcactggaacaggc

SEQ ID NO: 535556 - DNA, 16 bp, G. gallus
aggcagcagaaaatgg

SEQ ID NO: 535557 - DNA, 16 bp, G. gallus
aggcagcagcagcagc

SEQ ID NO: 535558 - DNA, 16 bp, G. gallus
aggcagcccattccag

SEQ ID NO: 535559 - DNA, 16 bp, G. gallus
aggcagcctgttccaa

SEQ ID NO: 535560 - DNA, 16 bp, G. gallus
aggcaggaaaccagca

SEQ ID NO: 535561 - DNA, 16 bp, G. gallus
aggcaggcaggggcca

SEQ ID NO: 535562 - DNA, 16 bp, G. gallus
aggcagggacacctct

SEQ ID NO: 535563 - DNA, 16 bp, G. gallus
aggcaggtggtggagt

SEQ ID NO: 535564 - DNA, 16 bp, G. gallus
aggcagtggcacagac

SEQ ID NO: 535565 - DNA, 16 bp, G. gallus
aggcattatttttgga

SEQ ID NO: 535566 - DNA, 21 bp, G. gallus
aggcattcaaggccaggctgg

SEQ ID NO: 535567 - DNA, 16 bp, G. gallus
aggccaggctggaggg

SEQ ID NO: 535568 - DNA, 16 bp, G. gallus
aggccaggttggatgg

SEQ ID NO: 535569 - DNA, 16 bp, G. gallus
aggccagtggcatcct

SEQ ID NO: 535570 - DNA, 16 bp, G. gallus
aggccattccagcacc

SEQ ID NO: 535571 - DNA, 16 bp, G. gallus
aggccctggagcacat

SEQ ID NO: 535572 - DNA, 16 bp, G. gallus
aggccctggagtgtgt

SEQ ID NO: 535573 - DNA, 16 bp, G. gallus
aggccctgggcagcct

SEQ ID NO: 535574 - DNA, 16 bp, G. gallus
aggcctcacctggagt

SEQ ID NO: 535575 - DNA, 17 bp, G. gallus
aggcctctccctaagca

SEQ ID NO: 535576 - DNA, 16 bp, G. gallus
aggcctggggccccca

SEQ ID NO: 535577 - DNA, 16 bp, G. gallus
aggcctttggctctca

SEQ ID NO: 535578 - DNA, 17 bp, G. gallus
aggctcagaggagacct

SEQ ID NO: 535579 - DNA, 16 bp, G. gallus
aggctccaggagaaaa

SEQ ID NO: 535580 - DNA, 16 bp, G. gallus
aggctccccagagcag

SEQ ID NO: 535581 - DNA, 16 bp, G. gallus
aggctccgggaagacc

SEQ ID NO: 535582 - DNA, 16 bp, G. gallus
aggctctgagcaacct

SEQ ID NO: 535583 - DNA, 16 bp, G. gallus
aggctctggggacacc

SEQ ID NO: 535584 - DNA, 16 bp, G. gallus
aggctgaagagctcca

SEQ ID NO: 535585 - DNA, 16 bp, G. gallus
aggctgacccccagct

SEQ ID NO: 535586 - DNA, 16 bp, G. gallus
aggctgagcagcccca

SEQ ID NO: 535587 - DNA, 16 bp, G. gallus
aggctgagggaagacc

SEQ ID NO: 535588 - DNA, 16 bp, G. gallus
aggctgagggaggtga

SEQ ID NO: 535589 - DNA, 16 bp, G. gallus
aggctgcaagagcaca

SEQ ID NO: 535590 - DNA, 16 bp, G. gallus
aggctgcccagggcag

SEQ ID NO: 535591 - DNA, 16 bp, G. gallus
aggctgcccggggccc

SEQ ID NO: 535592 - DNA, 28 bp, G. gallus
aggctgtccagagccacatccagcctgg

SEQ ID NO: 535593 - DNA, 16 bp, G. gallus
aggctgtgtgtgtgtg

SEQ ID NO: 535594 - DNA, 16 bp, G. gallus
aggctttggggagacc

SEQ ID NO: 535595 - DNA, 17 bp, G. gallus
aggctttggggagacct

SEQ ID NO: 535596 - DNA, 16 bp, G. gallus
aggcttttgacatggt

SEQ ID NO: 535597 - DNA, 16 bp, G. gallus
agggaaaatggtttca

SEQ ID NO: 535598 - DNA, 16 bp, G. gallus
agggaacttgctttag

SEQ ID NO: 535599 - DNA, 17 bp, G. gallus
agggaagccatccagag

SEQ ID NO: 535600 - DNA, 16 bp, G. gallus
agggaagctgctttag

SEQ ID NO: 535601 - DNA, 16 bp, G. gallus
agggaaggttcaggct

SEQ ID NO: 535602 - DNA, 16 bp, G. gallus
agggacaggacatcca

SEQ ID NO: 535603 - DNA, 16 bp, G. gallus
agggacaggggctgca

SEQ ID NO: 535604 - DNA, 16 bp, G. gallus
agggacctcaaggacc

SEQ ID NO: 535605 - DNA, 16 bp, G. gallus
agggacctctggagat

SEQ ID NO: 535606 - DNA, 16 bp, G. gallus
agggaccttaaagcct

SEQ ID NO: 535607 - DNA, 16 bp, G. gallus
agggagcagagcagag

SEQ ID NO: 535608 - DNA, 16 bp, G. gallus
agggagctgagcttgt

SEQ ID NO: 535609 - DNA, 16 bp, G. gallus
agggagctggggctgt

SEQ ID NO: 535610 - DNA, 16 bp, G. gallus
agggaggaagcagcag

SEQ ID NO: 535611 - DNA, 16 bp, G. gallus
agggaggtgattgtct

SEQ ID NO: 535612 - DNA, 16 bp, G. gallus
agggaggtggtgaagt

SEQ ID NO: 535613 - DNA, 16 bp, G. gallus
agggaggtggtggagc

SEQ ID NO: 535614 - DNA, 16 bp, G. gallus
agggatgtgaaaaaca

SEQ ID NO: 535615 - DNA, 16 bp, G. gallus
agggatgtgggcatgg

SEQ ID NO: 535616 - DNA, 16 bp, G. gallus
agggcaacaaagctgg

SEQ ID NO: 535617 - DNA, 16 bp, G. gallus
agggcagaacagaggg

SEQ ID NO: 535618 - DNA, 16 bp, G. gallus
agggcagagcaagtcc

SEQ ID NO: 535619 - DNA, 16 bp, G. gallus
agggcagcagaaaaga

SEQ ID NO: 535620 - DNA, 16 bp, G. gallus
agggcagcatgagaag

SEQ ID NO: 535621 - DNA, 16 bp, G. gallus
agggcaggttggatgg

SEQ ID NO: 535622 - DNA, 16 bp, G. gallus
agggccaagaagatga

SEQ ID NO: 535623 - DNA, 16 bp, G. gallus
agggccacaaagatga

SEQ ID NO: 535624 - DNA, 16 bp, G. gallus
agggccagcccagggg

SEQ ID NO: 535625 - DNA, 16 bp, G. gallus
agggctgccacccccc

SEQ ID NO: 535626 - DNA, 16 bp, G. gallus
agggctgcccagagag

SEQ ID NO: 535627 - DNA, 16 bp, G. gallus
agggctgctccccacc

SEQ ID NO: 535628 - DNA, 16 bp, G. gallus
agggctggaaagatga

SEQ ID NO: 535629 - DNA, 16 bp, G. gallus
agggctggagcacctc

SEQ ID NO: 535630 - DNA, 16 bp, G. gallus
agggctggctgtgtcc

SEQ ID NO: 535631 - DNA, 16 bp, G. gallus
agggctgtgggcacag

SEQ ID NO: 535632 - DNA, 16 bp, G. gallus
agggcttgatccagcc

SEQ ID NO: 535633 - DNA, 17 bp, G. gallus
aggggaaacggtttcaa

SEQ ID NO: 535634 - DNA, 16 bp, G. gallus
aggggacctcaaagat

SEQ ID NO: 535635 - DNA, 16 bp, G. gallus
aggggagctcaggtgt

SEQ ID NO: 535636 - DNA, 16 bp, G. gallus
aggggaggtttaggtt

SEQ ID NO: 535637 - DNA, 16 bp, G. gallus
aggggctctgagcaac

SEQ ID NO: 535638 - DNA, 16 bp, G. gallus
agggggacaatcacct

SEQ ID NO: 535639 - DNA, 16 bp, G. gallus
agggggacagcctgct

SEQ ID NO: 535640 - DNA, 16 bp, G. gallus
aggggggttgaaactc

SEQ ID NO: 535641 - DNA, 16 bp, G. gallus
aggggtctgtcttggg

SEQ ID NO: 535642 - DNA, 17 bp, G. gallus
aggggtgaagcctggct

SEQ ID NO: 535643 - DNA, 17 bp, G. gallus
aggggtggatcctggct

SEQ ID NO: 535644 - DNA, 17 bp, G. gallus
aggggtggccagcaggg

SEQ ID NO: 535645 - DNA, 17 bp, G. gallus
aggggtggccagtaggg

SEQ ID NO: 535646 - DNA, 16 bp, G. gallus
agggtagaaaggatga

SEQ ID NO: 535647 - DNA, 16 bp, G. gallus
agggtcacaaagatga

SEQ ID NO: 535648 - DNA, 16 bp, G. gallus
agggtcatgaagatga

SEQ ID NO: 535649 - DNA, 16 bp, G. gallus
agggtctgatttctgc

SEQ ID NO: 535650 - DNA, 16 bp, G. gallus
agggtgacagagcact

SEQ ID NO: 535651 - DNA, 16 bp, G. gallus
agggtgcccagcacca

SEQ ID NO: 535652 - DNA, 16 bp, G. gallus
aggtacattgcatgca

SEQ ID NO: 535653 - DNA, 16 bp, G. gallus
aggtatccctgcctat

SEQ ID NO: 535654 - DNA, 16 bp, G. gallus
aggtcacaatgaggtc

SEQ ID NO: 535655 - DNA, 16 bp, G. gallus
aggtcaggttgcccag

SEQ ID NO: 535656 - DNA, 17 bp, G. gallus
aggtcatcaataaagat

SEQ ID NO: 535657 - DNA, 16 bp, G. gallus
aggtcccctccaacct

SEQ ID NO: 535658 - DNA, 16 bp, G. gallus
aggtccctctggatgg

SEQ ID NO: 535659 - DNA, 16 bp, G. gallus
aggtcccttccaaccc

SEQ ID NO: 535660 - DNA, 16 bp, G. gallus
aggtcccttccaacct

SEQ ID NO: 535661 - DNA, 16 bp, G. gallus
aggtcctttccaacct

SEQ ID NO: 535662 - DNA, 16 bp, G. gallus
aggtcgtgatgatgaa

SEQ ID NO: 535663 - DNA, 16 bp, G. gallus
aggtctcacctggagt

SEQ ID NO: 535664 - DNA, 16 bp, G. gallus
aggtctcctccaaccc

SEQ ID NO: 535665 - DNA, 16 bp, G. gallus
aggtctctggctgcag

SEQ ID NO: 535666 - DNA, 16 bp, G. gallus
aggtctcttccaaccc

SEQ ID NO: 535667 - DNA, 16 bp, G. gallus
aggtcttctccaacct

SEQ ID NO: 535668 - DNA, 16 bp, G. gallus
aggtctttctctgcag

SEQ ID NO: 535669 - DNA, 16 bp, G. gallus
aggtcttttccaatct

SEQ ID NO: 535670 - DNA, 16 bp, G. gallus
aggtgacctgagagtg

SEQ ID NO: 535671 - DNA, 16 bp, G. gallus
aggtgaggctgcacca

SEQ ID NO: 535672 - DNA, 16 bp, G. gallus
aggtgattgtccctct

SEQ ID NO: 535673 - DNA, 16 bp, G. gallus
aggtgattgtctccct

SEQ ID NO: 535674 - DNA, 17 bp, G. gallus
aggtgcggcctcaccag

SEQ ID NO: 535675 - DNA, 16 bp, G. gallus
aggtgctccagtcccc

SEQ ID NO: 535676 - DNA, 16 bp, G. gallus
aggtgctggagcagat

SEQ ID NO: 535677 - DNA, 16 bp, G. gallus
aggtgctggcacagct

SEQ ID NO: 535678 - DNA, 16 bp, G. gallus
aggtggccaagaaagc

SEQ ID NO: 535679 - DNA, 16 bp, G. gallus
aggtggtgtgtttcag

SEQ ID NO: 535680 - DNA, 16 bp, G. gallus
aggtgtgtgaggagca

SEQ ID NO: 535681 - DNA, 16 bp, G. gallus
aggtgttcaagaacca

SEQ ID NO: 535682 - DNA, 16 bp, G. gallus
aggtgttcctgctcca

SEQ ID NO: 535683 - DNA, 16 bp, G. gallus
aggttacacaggaaag

SEQ ID NO: 535684 - DNA, 16 bp, G. gallus
aggttacccagagaag

SEQ ID NO: 535685 - DNA, 16 bp, G. gallus
aggttcacccaggccc

SEQ ID NO: 535686 - DNA, 16 bp, G. gallus
aggttgagccttccca

SEQ ID NO: 535687 - DNA, 16 bp, G. gallus
aggttgagggaactgg

SEQ ID NO: 535688 - DNA, 16 bp, G. gallus
aggttgcccaaggaag

SEQ ID NO: 535689 - DNA, 16 bp, G. gallus
aggttgcccagagggg

SEQ ID NO: 535690 - DNA, 16 bp, G. gallus
aggttggaaaggacct

SEQ ID NO: 535691 - DNA, 16 bp, G. gallus
aggttggagaagacct

SEQ ID NO: 535692 - DNA, 16 bp, G. gallus
aggtttgcagatgaca

SEQ ID NO: 535693 - DNA, 16 bp, G. gallus
agtacagggacaggat

SEQ ID NO: 535694 - DNA, 16 bp, G. gallus
agtactggaaggccac

SEQ ID NO: 535695 - DNA, 16 bp, G. gallus
agtactgtgtacagtt

SEQ ID NO: 535696 - DNA, 16 bp, G. gallus
agtactgtgtccaagt

SEQ ID NO: 535697 - DNA, 16 bp, G. gallus
agtagaagctgaacct

SEQ ID NO: 535698 - DNA, 16 bp, G. gallus
agtcaacagtgtgccc

SEQ ID NO: 535699 - DNA, 16 bp, G. gallus
agtcagccacaggagc

SEQ ID NO: 535700 - DNA, 16 bp, G. gallus
agtcagcccttaaatg

SEQ ID NO: 535701 - DNA, 16 bp, G. gallus
agtcatggaactgggc

SEQ ID NO: 535702 - DNA, 16 bp, G. gallus
agtccaaccacaacct

SEQ ID NO: 535703 - DNA, 16 bp, G. gallus
agtccaaccatcagcc

SEQ ID NO: 535704 - DNA, 16 bp, G. gallus
agtccacacaaaagac

SEQ ID NO: 535705 - DNA, 16 bp, G. gallus
agtccagctcctggct

SEQ ID NO: 535706 - DNA, 16 bp, G. gallus
agtcccttccaacttg

SEQ ID NO: 535707 - DNA, 16 bp, G. gallus
agtcctggctaactgg

SEQ ID NO: 535708 - DNA, 16 bp, G. gallus
agtctgacacaatggc

SEQ ID NO: 535709 - DNA, 16 bp, G. gallus
agtctggaaaagagaa

SEQ ID NO: 535710 - DNA, 16 bp, G. gallus
agtctggagaagaaga

SEQ ID NO: 535711 - DNA, 16 bp, G. gallus
agtctggggaagagaa

SEQ ID NO: 535712 - DNA, 16 bp, G. gallus
agtctgtccagatccc

SEQ ID NO: 535713 - DNA, 16 bp, G. gallus
agtctgtccttgtagg

SEQ ID NO: 535714 - DNA, 16 bp, G. gallus
agtgacaacagtgaca

SEQ ID NO: 535715 - DNA, 16 bp, G. gallus
agtgacacagatgatg

SEQ ID NO: 535716 - DNA, 16 bp, G. gallus
agtgacatagatgatg

SEQ ID NO: 535717 - DNA, 16 bp, G. gallus
agtgaggcagtggatg

SEQ ID NO: 535718 - DNA, 16 bp, G. gallus
agtgatgaagaagagc

SEQ ID NO: 535719 - DNA, 16 bp, G. gallus
agtgatggggcatcca

SEQ ID NO: 535720 - DNA, 16 bp, G. gallus
agtgattggacaaggg

SEQ ID NO: 535721 - DNA, 16 bp, G. gallus
agtgcaaatgaagcaa

SEQ ID NO: 535722 - DNA, 16 bp, G. gallus
agtgcaaggtcttgca

SEQ ID NO: 535723 - DNA, 16 bp, G. gallus
agtgcacactgctgac

SEQ ID NO: 535724 - DNA, 16 bp, G. gallus
agtgcagccagcagga

SEQ ID NO: 535725 - DNA, 16 bp, G. gallus
agtgctcatccagttc

SEQ ID NO: 535726 - DNA, 16 bp, G. gallus
agtgctccatcacctg

SEQ ID NO: 535727 - DNA, 16 bp, G. gallus
agtgctgagggagctg

SEQ ID NO: 535728 - DNA, 16 bp, G. gallus
agtgctgctgctgctg

SEQ ID NO: 535729 - DNA, 16 bp, G. gallus
agtggaggttgaacct

SEQ ID NO: 535730 - DNA, 16 bp, G. gallus
agtggataaaggaaga

SEQ ID NO: 535731 - DNA, 16 bp, G. gallus
agtggatgtcagcaca

SEQ ID NO: 535732 - DNA, 16 bp, G. gallus
agtggatgtgagcaca

SEQ ID NO: 535733 - DNA, 16 bp, G. gallus
agtggatgtgagctca

SEQ ID NO: 535734 - DNA, 16 bp, G. gallus
agtggcctttcagtat

SEQ ID NO: 535735 - DNA, 16 bp, G. gallus
agtggctggaaaactg

SEQ ID NO: 535736 - DNA, 16 bp, G. gallus
agtgggaggtgttcct

SEQ ID NO: 535737 - DNA, 16 bp, G. gallus
agtgggtccagaggag

SEQ ID NO: 535738 - DNA, 16 bp, G. gallus
agtggtgactgtgttg

SEQ ID NO: 535739 - DNA, 16 bp, G. gallus
agtgtcctcagcctct

SEQ ID NO: 535740 - DNA, 16 bp, G. gallus
agtgtgaccagcaggt

SEQ ID NO: 535741 - DNA, 16 bp, G. gallus
agtgtgcccaagtggc

SEQ ID NO: 535742 - DNA, 16 bp, G. gallus
agtgtgggtgccccat

SEQ ID NO: 535743 - DNA, 16 bp, G. gallus
agtgtgtgtatatata

SEQ ID NO: 535744 - DNA, 16 bp, G. gallus
agttaaagagttaatg

SEQ ID NO: 535745 - DNA, 19 bp, G. gallus
agttcaagcaagtcctgac

SEQ ID NO: 535746 - DNA, 16 bp, G. gallus
agttccaaccctgctg

SEQ ID NO: 535747 - DNA, 17 bp, G. gallus
agttccatctgtgcctt

SEQ ID NO: 535748 - DNA, 16 bp, G. gallus
agttctccttttaaat

SEQ ID NO: 535749 - DNA, 16 bp, G. gallus
agttctgcagagaagg

SEQ ID NO: 535750 - DNA, 16 bp, G. gallus
agttcttctcccagtc

SEQ ID NO: 535751 - DNA, 16 bp, G. gallus
agttgaaagggaccct

SEQ ID NO: 535752 - DNA, 16 bp, G. gallus
agttgatgaaagattc

SEQ ID NO: 535753 - DNA, 16 bp, G. gallus
agttgattttcttcat

SEQ ID NO: 535754 - DNA, 16 bp, G. gallus
agttgcagagagcaat

SEQ ID NO: 535755 - DNA, 16 bp, G. gallus
agttggactcgatgat

SEQ ID NO: 535756 - DNA, 16 bp, G. gallus
agttgttgctgagcag

SEQ ID NO: 535757 - DNA, 16 bp, G. gallus
agtttaaaagcattcc

SEQ ID NO: 535758 - DNA, 16 bp, G. gallus
agtttcaaccccctgc

SEQ ID NO: 535759 - DNA, 16 bp, G. gallus
agtttctatggaaata

SEQ ID NO: 535760 - DNA, 16 bp, G. gallus
agtttcttaaaaaaaa

SEQ ID NO: 535761 - DNA, 16 bp, G. gallus
agtttgcagatgatgc

SEQ ID NO: 535762 - DNA, 16 bp, G. gallus
agtttgttgatgacac

SEQ ID NO: 535763 - DNA, 16 bp, G. gallus
agtttttcctcatgtt

SEQ ID NO: 535764 - DNA, 16 bp, G. gallus
ataaacagaagggaga

SEQ ID NO: 535765 - DNA, 16 bp, G. gallus
ataaagatgttgaaga

SEQ ID NO: 535766 - DNA, 16 bp, G. gallus
ataaatgaaaatgctc

SEQ ID NO: 535767 - DNA, 16 bp, G. gallus
ataaatgtgtatatat

SEQ ID NO: 535768 - DNA, 16 bp, G. gallus
ataacaaggatgttgt

SEQ ID NO: 535769 - DNA, 16 bp, G. gallus
ataacagatacaaaga

SEQ ID NO: 535770 - DNA, 16 bp, G. gallus
ataaccccatgcagca

SEQ ID NO: 535771 - DNA, 16 bp, G. gallus
ataagctgtgcttagt

SEQ ID NO: 535772 - DNA, 16 bp, G. gallus
ataaggaaaaaatctt

SEQ ID NO: 535773 - DNA, 16 bp, G. gallus
ataataaaataggagg

SEQ ID NO: 535774 - DNA, 16 bp, G. gallus
ataatcatggaatcat

SEQ ID NO: 535775 - DNA, 16 bp, G. gallus
atacacacacatacac

SEQ ID NO: 535776 - DNA, 16 bp, G. gallus
atacacacatatataa

SEQ ID NO: 535777 - DNA, 16 bp, G. gallus
atacagactggaagga

SEQ ID NO: 535778 - DNA, 16 bp, G. gallus
atacagcaacaaaatg

SEQ ID NO: 535779 - DNA, 16 bp, G. gallus
atacagggggaaaaaa

SEQ ID NO: 535780 - DNA, 16 bp, G. gallus
atacatacacacacat

SEQ ID NO: 535781 - DNA, 16 bp, G. gallus
atacatatatatgtgt

SEQ ID NO: 535782 - DNA, 16 bp, G. gallus
atacatatatgcatat

SEQ ID NO: 535783 - DNA, 16 bp, G. gallus
ataccaccaccatcca

SEQ ID NO: 535784 - DNA, 16 bp, G. gallus
atacctccaggaatgg

SEQ ID NO: 535785 - DNA, 16 bp, G. gallus
atagaacagaacagaa

SEQ ID NO: 535786 - DNA, 16 bp, G. gallus
atagaaggagatgagg

SEQ ID NO: 535787 - DNA, 19 bp, G. gallus
atagatagatagatagata

SEQ ID NO: 535788 - DNA, 16 bp, G. gallus
atagatatgtatatat

SEQ ID NO: 535789 - DNA, 16 bp, G. gallus
atagcaagaaaagaga

SEQ ID NO: 535790 - DNA, 16 bp, G. gallus
atagcattattgtgct

SEQ ID NO: 535791 - DNA, 16 bp, G. gallus
ataggatgagagagaa

SEQ ID NO: 535792 - DNA, 16 bp, G. gallus
ataggttgctctgaaa

SEQ ID NO: 535793 - DNA, 16 bp, G. gallus
atagtcaccatcatta

SEQ ID NO: 535794 - DNA, 16 bp, G. gallus
atagttctgtgattct

SEQ ID NO: 535795 - DNA, 16 bp, G. gallus
atagttttaaactgag

SEQ ID NO: 535796 - DNA, 26 bp, G. gallus
atataagctgtgtttagtagtgaata

SEQ ID NO: 535797 - DNA, 16 bp, G. gallus
atatacatatgtattt

SEQ ID NO: 535798 - DNA, 16 bp, G. gallus
atatacatgtgtatat

SEQ ID NO: 535799 - DNA, 16 bp, G. gallus
atatagtctggatttg

SEQ ID NO: 535800 - DNA, 16 bp, G. gallus
atatataagtaacaaa

SEQ ID NO: 535801 - DNA, 16 bp, G. gallus
atatatacacatatgt

SEQ ID NO: 535802 - DNA, 16 bp, G. gallus
atatatacatacacac

SEQ ID NO: 535803 - DNA, 16 bp, G. gallus
atatatacatatgtat

SEQ ID NO: 535804 - DNA, 16 bp, G. gallus
atatatatacacgtat

SEQ ID NO: 535805 - DNA, 16 bp, G. gallus
atatatatacagatat

SEQ ID NO: 535806 - DNA, 16 bp, G. gallus
atatatatatatgcac

SEQ ID NO: 535807 - DNA, 16 bp, G. gallus
atatatatatgtgtat

SEQ ID NO: 535808 - DNA, 16 bp, G. gallus
atatatatatttccat

SEQ ID NO: 535809 - DNA, 16 bp, G. gallus
atatatatgtatatgt

SEQ ID NO: 535810 - DNA, 16 bp, G. gallus
atatatatgtatgtgt

SEQ ID NO: 535811 - DNA, 16 bp, G. gallus
atatatatttttaagc

SEQ ID NO: 535812 - DNA, 16 bp, G. gallus
atatatgtatatatca

SEQ ID NO: 535813 - DNA, 16 bp, G. gallus
atatatgtatatgtgt

SEQ ID NO: 535814 - DNA, 16 bp, G. gallus
atatatgtgtatatat

SEQ ID NO: 535815 - DNA, 16 bp, G. gallus
atatatttttttccca

SEQ ID NO: 535816 - DNA, 16 bp, G. gallus
atatattttttttcag

SEQ ID NO: 535817 - DNA, 16 bp, G. gallus
atatcccaagttggaa

SEQ ID NO: 535818 - DNA, 16 bp, G. gallus
atatccctttggtcag

SEQ ID NO: 535819 - DNA, 16 bp, G. gallus
atatcctgagttggaa

SEQ ID NO: 535820 - DNA, 16 bp, G. gallus
atatctaatactagac

SEQ ID NO: 535821 - DNA, 18 bp, G. gallus
atatgcatacatatatat

SEQ ID NO: 535822 - DNA, 16 bp, G. gallus
atatgtatatacacat

SEQ ID NO: 535823 - DNA, 16 bp, G. gallus
atatgtatatatatag

SEQ ID NO: 535824 - DNA, 16 bp, G. gallus
atatgtatgtatgtat

SEQ ID NO: 535825 - DNA, 16 bp, G. gallus
atatgtgtgtgtatgt

SEQ ID NO: 535826 - DNA, 16 bp, G. gallus
atattccataccatat

SEQ ID NO: 535827 - DNA, 16 bp, G. gallus
atcaaaagaagagtgg

SEQ ID NO: 535828 - DNA, 16 bp, G. gallus
atcaaatagtgttctt

SEQ ID NO: 535829 - DNA, 16 bp, G. gallus
atcaaatccacatccc

SEQ ID NO: 535830 - DNA, 16 bp, G. gallus
atcaatgaatgtcagt

SEQ ID NO: 535831 - DNA, 16 bp, G. gallus
atcaatgacattgaca

SEQ ID NO: 535832 - DNA, 16 bp, G. gallus
atcaatgtttataaat

SEQ ID NO: 535833 - DNA, 16 bp, G. gallus
atcacaaaggttggaa

SEQ ID NO: 535834 - DNA, 16 bp, G. gallus
atcacagaatcagaga

SEQ ID NO: 535835 - DNA, 16 bp, G. gallus
atcacagaggttggaa

SEQ ID NO: 535836 - DNA, 16 bp, G. gallus
atcacagcttctctgg

SEQ ID NO: 535837 - DNA, 17 bp, G. gallus
atcacatgaggaatgag

SEQ ID NO: 535838 - DNA, 16 bp, G. gallus
atcaccaaggttggaa

SEQ ID NO: 535839 - DNA, 16 bp, G. gallus
atcagactgcccagag

SEQ ID NO: 535840 - DNA, 16 bp, G. gallus
atcagagtgctggagc

SEQ ID NO: 535841 - DNA, 16 bp, G. gallus
atcagggccaaatgac

SEQ ID NO: 535842 - DNA, 16 bp, G. gallus
atcagggtgctcagag

SEQ ID NO: 535843 - DNA, 16 bp, G. gallus
atcaggtgactttgcc

SEQ ID NO: 535844 - DNA, 16 bp, G. gallus
atcagtgacatagatg

SEQ ID NO: 535845 - DNA, 16 bp, G. gallus
atcatcaagtccaacc

SEQ ID NO: 535846 - DNA, 16 bp, G. gallus
atcatcaagttccagc

SEQ ID NO: 535847 - DNA, 16 bp, G. gallus
atcatcatcatcatca

SEQ ID NO: 535848 - DNA, 16 bp, G. gallus
atcatcatcatcatta

SEQ ID NO: 535849 - DNA, 16 bp, G. gallus
atcatctatcagtgct

SEQ ID NO: 535850 - DNA, 16 bp, G. gallus
atcatctttgaggtcc

SEQ ID NO: 535851 - DNA, 16 bp, G. gallus
atcatggaatcatttg

SEQ ID NO: 535852 - DNA, 18 bp, G. gallus
atcatggacaaaagagaa

SEQ ID NO: 535853 - DNA, 16 bp, G. gallus
atccaaaattcaaacc

SEQ ID NO: 535854 - DNA, 16 bp, G. gallus
atccaaccccagccca

SEQ ID NO: 535855 - DNA, 16 bp, G. gallus
atccaacctggcctca

SEQ ID NO: 535856 - DNA, 16 bp, G. gallus
atccaaggaatggaac

SEQ ID NO: 535857 - DNA, 16 bp, G. gallus
atccacaacctctctg

SEQ ID NO: 535858 - DNA, 16 bp, G. gallus
atccacagctcctctg

SEQ ID NO: 535859 - DNA, 16 bp, G. gallus
atccaccacagtggcg

SEQ ID NO: 535860 - DNA, 16 bp, G. gallus
atccaccacccctctg

SEQ ID NO: 535861 - DNA, 16 bp, G. gallus
atccacccttttcttg

SEQ ID NO: 535862 - DNA, 16 bp, G. gallus
atccacctcactgtcc

SEQ ID NO: 535863 - DNA, 16 bp, G. gallus
atccactggttggtct

SEQ ID NO: 535864 - DNA, 16 bp, G. gallus
atccagaaggacctgg

SEQ ID NO: 535865 - DNA, 16 bp, G. gallus
atccagagggatctgg

SEQ ID NO: 535866 - DNA, 16 bp, G. gallus
atccagttctggggcc

SEQ ID NO: 535867 - DNA, 16 bp, G. gallus
atccatcacctctctg

SEQ ID NO: 535868 - DNA, 16 bp, G. gallus
atcccaagttggaagg

SEQ ID NO: 535869 - DNA, 16 bp, G. gallus
atccccaccatgtcca

SEQ ID NO: 535870 - DNA, 16 bp, G. gallus
atccccatcctcatcc

SEQ ID NO: 535871 - DNA, 16 bp, G. gallus
atccccctgccacagg

SEQ ID NO: 535872 - DNA, 16 bp, G. gallus
atcccctcatcaaggt

SEQ ID NO: 535873 - DNA, 16 bp, G. gallus
atccctctgatcatct

SEQ ID NO: 535874 - DNA, 16 bp, G. gallus
atccctgcaggtgccc

SEQ ID NO: 535875 - DNA, 21 bp, G. gallus
atccctggaggtgttcaaggc

SEQ ID NO: 535876 - DNA, 16 bp, G. gallus
atcccttccaacccaa

SEQ ID NO: 535877 - DNA, 16 bp, G. gallus
atcctgaattggaagg

SEQ ID NO: 535878 - DNA, 16 bp, G. gallus
atcctgggctgcatca

SEQ ID NO: 535879 - DNA, 16 bp, G. gallus
atcctggtggacaaca

SEQ ID NO: 535880 - DNA, 16 bp, G. gallus
atccttcctgaagagt

SEQ ID NO: 535881 - DNA, 16 bp, G. gallus
atccttgagatccctt

SEQ ID NO: 535882 - DNA, 16 bp, G. gallus
atccttttcctctgtg

SEQ ID NO: 535883 - DNA, 16 bp, G. gallus
atcgctgggctgaggt

SEQ ID NO: 535884 - DNA, 16 bp, G. gallus
atctacaacttctctg

SEQ ID NO: 535885 - DNA, 16 bp, G. gallus
atctagcagctggcaa

SEQ ID NO: 535886 - DNA, 16 bp, G. gallus
atctagtccaaccacc

SEQ ID NO: 535887 - DNA, 16 bp, G. gallus
atctcagcagaaattc

SEQ ID NO: 535888 - DNA, 16 bp, G. gallus
atctccagagaagcag

SEQ ID NO: 535889 - DNA, 16 bp, G. gallus
atctccagaggaggag

SEQ ID NO: 535890 - DNA, 16 bp, G. gallus
atctccagcaaaatac

SEQ ID NO: 535891 - DNA, 16 bp, G. gallus
atctccagggatggtg

SEQ ID NO: 535892 - DNA, 16 bp, G. gallus
atctccatccttggag

SEQ ID NO: 535893 - DNA, 16 bp, G. gallus
atctcctctctgaaca

SEQ ID NO: 535894 - DNA, 16 bp, G. gallus
atctctcagcctttcc

SEQ ID NO: 535895 - DNA, 16 bp, G. gallus
atctctggaggtgttt

SEQ ID NO: 535896 - DNA, 16 bp, G. gallus
atctgaaggaaaaaaa

SEQ ID NO: 535897 - DNA, 16 bp, G. gallus
atctgattaatgttta

SEQ ID NO: 535898 - DNA, 16 bp, G. gallus
atctgcaccagcaaag

SEQ ID NO: 535899 - DNA, 16 bp, G. gallus
atctgctcaaaagcct

SEQ ID NO: 535900 - DNA, 16 bp, G. gallus
atctgctccatgacct

SEQ ID NO: 535901 - DNA, 16 bp, G. gallus
atctggaatgtggctt

SEQ ID NO: 535902 - DNA, 16 bp, G. gallus
atctggagtactgcgt

SEQ ID NO: 535903 - DNA, 16 bp, G. gallus
atctggtccaactcct

SEQ ID NO: 535904 - DNA, 16 bp, G. gallus
atctggtggccttctg

SEQ ID NO: 535905 - DNA, 16 bp, G. gallus
atctggtgggtggcaa

SEQ ID NO: 535906 - DNA, 16 bp, G. gallus
atctgttccagtgctt

SEQ ID NO: 535907 - DNA, 16 bp, G. gallus
atcttcaggaaaaaaa

SEQ ID NO: 535908 - DNA, 16 bp, G. gallus
atctttattgatgacc

SEQ ID NO: 535909 - DNA, 16 bp, G. gallus
atctttgtaggcaaca

SEQ ID NO: 535910 - DNA, 16 bp, G. gallus
atgaaaactttttttt

SEQ ID NO: 535911 - DNA, 16 bp, G. gallus
atgaaaggcaggttgt

SEQ ID NO: 535912 - DNA, 16 bp, G. gallus
atgaaatatttcattt

SEQ ID NO: 535913 - DNA, 16 bp, G. gallus
atgaaatattttgaaa

SEQ ID NO: 535914 - DNA, 16 bp, G. gallus
atgaacaagagcctgt

SEQ ID NO: 535915 - DNA, 16 bp, G. gallus
atgaacaagagctgca

SEQ ID NO: 535916 - DNA, 16 bp, G. gallus
atgaagaaaaaatggc

SEQ ID NO: 535917 - DNA, 16 bp, G. gallus
atgaagaaaggctgaa

SEQ ID NO: 535918 - DNA, 16 bp, G. gallus
atgaagaagagcctgc

SEQ ID NO: 535919 - DNA, 16 bp, G. gallus
atgaagatgctgaaga

SEQ ID NO: 535920 - DNA, 16 bp, G. gallus
atgaagatgttgaaga

SEQ ID NO: 535921 - DNA, 16 bp, G. gallus
atgaagcaaaggtgtg

SEQ ID NO: 535922 - DNA, 16 bp, G. gallus
atgaagctggtgaagg

SEQ ID NO: 535923 - DNA, 17 bp, G. gallus
atgaatccaccacagtg

SEQ ID NO: 535924 - DNA, 16 bp, G. gallus
atgaatgtcagtgggt

SEQ ID NO: 535925 - DNA, 16 bp, G. gallus
atgacatcacatcctc

SEQ ID NO: 535926 - DNA, 18 bp, G. gallus
atgagaaaagaatgtgga

SEQ ID NO: 535927 - DNA, 17 bp, G. gallus
atgagaagctggacatg

SEQ ID NO: 535928 - DNA, 16 bp, G. gallus
atgagaagggagaact

SEQ ID NO: 535929 - DNA, 16 bp, G. gallus
atgagatctccccaga

SEQ ID NO: 535930 - DNA, 16 bp, G. gallus
atgagccagcactgtg

SEQ ID NO: 535931 - DNA, 16 bp, G. gallus
atgagccagcagtatg

SEQ ID NO: 535932 - DNA, 16 bp, G. gallus
atgagccagcagtgtg

SEQ ID NO: 535933 - DNA, 16 bp, G. gallus
atgaggacaagcccaa

SEQ ID NO: 535934 - DNA, 16 bp, G. gallus
atgaggagcggctgag

SEQ ID NO: 535935 - DNA, 16 bp, G. gallus
atgaggaggacttgga

SEQ ID NO: 535936 - DNA, 16 bp, G. gallus
atgaggataggctgag

SEQ ID NO: 535937 - DNA, 16 bp, G. gallus
atgagggatgagcagg

SEQ ID NO: 535938 - DNA, 16 bp, G. gallus
atgagggctgggaagg

SEQ ID NO: 535939 - DNA, 16 bp, G. gallus
atgaggtctccccaga

SEQ ID NO: 535940 - DNA, 16 bp, G. gallus
atgaggtctcccctga

SEQ ID NO: 535941 - DNA, 16 bp, G. gallus
atgaggtgctggcaca

SEQ ID NO: 535942 - DNA, 16 bp, G. gallus
atgagtcagcaatgtg

SEQ ID NO: 535943 - DNA, 16 bp, G. gallus
atgatcactgtggtcc

SEQ ID NO: 535944 - DNA, 16 bp, G. gallus
atgatcctatgattct

SEQ ID NO: 535945 - DNA, 16 bp, G. gallus
atgatcttagaggtct

SEQ ID NO: 535946 - DNA, 16 bp, G. gallus
atgatctttgaggtcc

SEQ ID NO: 535947 - DNA, 16 bp, G. gallus
atgatgatgatgattt

SEQ ID NO: 535948 - DNA, 16 bp, G. gallus
atgattctatgacatt

SEQ ID NO: 535949 - DNA, 16 bp, G. gallus
atgattttattattct

SEQ ID NO: 535950 - DNA, 16 bp, G. gallus
atgcaaaggaacttct

SEQ ID NO: 535951 - DNA, 16 bp, G. gallus
atgcaagccaggatgc

SEQ ID NO: 535952 - DNA, 16 bp, G. gallus
atgcaaggttttgcac

SEQ ID NO: 535953 - DNA, 16 bp, G. gallus
atgcagaaaaaattgc

SEQ ID NO: 535954 - DNA, 16 bp, G. gallus
atgcagcagcagcagc

SEQ ID NO: 535955 - DNA, 16 bp, G. gallus
atgcagcccaagacaa

SEQ ID NO: 535956 - DNA, 16 bp, G. gallus
atgcagctctgggcag

SEQ ID NO: 535957 - DNA, 16 bp, G. gallus
atgcagcttgaagcca

SEQ ID NO: 535958 - DNA, 16 bp, G. gallus
atgcatcccaggatac

SEQ ID NO: 535959 - DNA, 16 bp, G. gallus
atgccatgcttgtaaa

SEQ ID NO: 535960 - DNA, 16 bp, G. gallus
atgcccacagccctgg

SEQ ID NO: 535961 - DNA, 16 bp, G. gallus
atgcccagccagtccc

SEQ ID NO: 535962 - DNA, 16 bp, G. gallus
atgccccctccctgga

SEQ ID NO: 535963 - DNA, 16 bp, G. gallus
atgcctccagggaagg

SEQ ID NO: 535964 - DNA, 16 bp, G. gallus
atgctgaacaagccca

SEQ ID NO: 535965 - DNA, 16 bp, G. gallus
atgctgaagagcactg

SEQ ID NO: 535966 - DNA, 16 bp, G. gallus
atgctgcccagggccc

SEQ ID NO: 535967 - DNA, 16 bp, G. gallus
atgctgctgctgctct

SEQ ID NO: 535968 - DNA, 16 bp, G. gallus
atgctgtgggccaaca

SEQ ID NO: 535969 - DNA, 16 bp, G. gallus
atgctgttcccttggg

SEQ ID NO: 535970 - DNA, 16 bp, G. gallus
atgcttctgtgattct

SEQ ID NO: 535971 - DNA, 16 bp, G. gallus
atggaaaatggaaaca

SEQ ID NO: 535972 - DNA, 16 bp, G. gallus
atggaaactacaacag

SEQ ID NO: 535973 - DNA, 16 bp, G. gallus
atggaaagtacaacag

SEQ ID NO: 535974 - DNA, 16 bp, G. gallus
atggaaagtgcagcaa

SEQ ID NO: 535975 - DNA, 16 bp, G. gallus
atggaaataaacagga

SEQ ID NO: 535976 - DNA, 16 bp, G. gallus
atggacaagggaagag

SEQ ID NO: 535977 - DNA, 16 bp, G. gallus
atggacagttggactg

SEQ ID NO: 535978 - DNA, 16 bp, G. gallus
atggagaacaaacagt

SEQ ID NO: 535979 - DNA, 16 bp, G. gallus
atggagcaccacagct

SEQ ID NO: 535980 - DNA, 16 bp, G. gallus
atggagctccaacccc

SEQ ID NO: 535981 - DNA, 16 bp, G. gallus
atggatggctacaagc

SEQ ID NO: 535982 - DNA, 16 bp, G. gallus
atggcaacaaaacata

SEQ ID NO: 535983 - DNA, 16 bp, G. gallus
atggcagcaaaggggc

SEQ ID NO: 535984 - DNA, 16 bp, G. gallus
atggcagcagagggga

SEQ ID NO: 535985 - DNA, 16 bp, G. gallus
atggcagcagaggggg

SEQ ID NO: 535986 - DNA, 16 bp, G. gallus
atggcagcagaggttg

SEQ ID NO: 535987 - DNA, 16 bp, G. gallus
atggccccaagctgcc

SEQ ID NO: 535988 - DNA, 17 bp, G. gallus
atggcctatgaggagag

SEQ ID NO: 535989 - DNA, 18 bp, G. gallus
atggcctgggttgaaaag

SEQ ID NO: 535990 - DNA, 16 bp, G. gallus
atggccttggctctgt

SEQ ID NO: 535991 - DNA, 16 bp, G. gallus
atggctggggttggaa

SEQ ID NO: 535992 - DNA, 16 bp, G. gallus
atggcttggattggaa

SEQ ID NO: 535993 - DNA, 16 bp, G. gallus
atggctttgaactaaa

SEQ ID NO: 535994 - DNA, 16 bp, G. gallus
atgggagaagaggctg

SEQ ID NO: 535995 - DNA, 16 bp, G. gallus
atgggatgccattcag

SEQ ID NO: 535996 - DNA, 16 bp, G. gallus
atgggcttcccaggga

SEQ ID NO: 535997 - DNA, 16 bp, G. gallus
atggggctctgggcag

SEQ ID NO: 535998 - DNA, 16 bp, G. gallus
atgggtgtccaacctt

SEQ ID NO: 535999 - DNA, 16 bp, G. gallus
atgggttggaagggac

SEQ ID NO: 536000 - DNA, 16 bp, G. gallus
atgggttttcctggtc

SEQ ID NO: 536001 - DNA, 16 bp, G. gallus
atggtatcctgggatg

SEQ ID NO: 536002 - DNA, 16 bp, G. gallus
atggtcccttccaact

SEQ ID NO: 536003 - DNA, 16 bp, G. gallus
atggtgattccaccac

SEQ ID NO: 536004 - DNA, 16 bp, G. gallus
atggtggcaatgttgg

SEQ ID NO: 536005 - DNA, 16 bp, G. gallus
atggtggtgactgttg

SEQ ID NO: 536006 - DNA, 16 bp, G. gallus
atggttggactggatg

SEQ ID NO: 536007 - DNA, 16 bp, G. gallus
atggtttgagttggaa

SEQ ID NO: 536008 - DNA, 16 bp, G. gallus
atggttttaaattgga

SEQ ID NO: 536009 - DNA, 16 bp, G. gallus
atgtatatgtgtatat

SEQ ID NO: 536010 - DNA, 16 bp, G. gallus
atgtatgcatatgtat

SEQ ID NO: 536011 - DNA, 16 bp, G. gallus
atgtatgcatgtatat

SEQ ID NO: 536012 - DNA, 16 bp, G. gallus
atgtatgtgtgtgtgt

SEQ ID NO: 536013 - DNA, 16 bp, G. gallus
atgtcaccactgctga

SEQ ID NO: 536014 - DNA, 16 bp, G. gallus
atgtcagacaccactt

SEQ ID NO: 536015 - DNA, 16 bp, G. gallus
atgtcccatccctgca

SEQ ID NO: 536016 - DNA, 16 bp, G. gallus
atgtcccttccaaccc

SEQ ID NO: 536017 - DNA, 16 bp, G. gallus
atgtcctgggctgcat

SEQ ID NO: 536018 - DNA, 16 bp, G. gallus
atgtctcctatttatt

SEQ ID NO: 536019 - DNA, 16 bp, G. gallus
atgtgaaagacaaacc

SEQ ID NO: 536020 - DNA, 16 bp, G. gallus
atgtgcatatatatat

SEQ ID NO: 536021 - DNA, 16 bp, G. gallus
atgtgccttaacatct

SEQ ID NO: 536022 - DNA, 16 bp, G. gallus
atgtggaagaacttct

SEQ ID NO: 536023 - DNA, 16 bp, G. gallus
atgtggacctgttgga

SEQ ID NO: 536024 - DNA, 16 bp, G. gallus
atgtgggcctggcaaa

SEQ ID NO: 536025 - DNA, 16 bp, G. gallus
atgtggtctcaccagg

SEQ ID NO: 536026 - DNA, 16 bp, G. gallus
atgtggtggaattctt

SEQ ID NO: 536027 - DNA, 16 bp, G. gallus
atgtggttgatgcccc

SEQ ID NO: 536028 - DNA, 16 bp, G. gallus
atgtgtatatatatat

SEQ ID NO: 536029 - DNA, 16 bp, G. gallus
atgtgtatgtatgtgt

SEQ ID NO: 536030 - DNA, 16 bp, G. gallus
atgtgtgtgtatatat

SEQ ID NO: 536031 - DNA, 16 bp, G. gallus
atgttggcccatgatg

SEQ ID NO: 536032 - DNA, 16 bp, G. gallus
atgtttcttgagcacc

SEQ ID NO: 536033 - DNA, 16 bp, G. gallus
attaaaaaaggagtgg

SEQ ID NO: 536034 - DNA, 16 bp, G. gallus
attaaacatctgtttt

SEQ ID NO: 536035 - DNA, 16 bp, G. gallus
attaaagagaactggc

SEQ ID NO: 536036 - DNA, 16 bp, G. gallus
attaaagttggaaaaa

SEQ ID NO: 536037 - DNA, 16 bp, G. gallus
attaaatgtggaagtt

SEQ ID NO: 536038 - DNA, 16 bp, G. gallus
attacagaatcacaga

SEQ ID NO: 536039 - DNA, 16 bp, G. gallus
attactggcaaaaatg

SEQ ID NO: 536040 - DNA, 16 bp, G. gallus
attacttttggagcaa

SEQ ID NO: 536041 - DNA, 16 bp, G. gallus
attagaccatgtaaaa

SEQ ID NO: 536042 - DNA, 16 bp, G. gallus
attagctatgcatttt

SEQ ID NO: 536043 - DNA, 16 bp, G. gallus
attagctgtgcatttt

SEQ ID NO: 536044 - DNA, 16 bp, G. gallus
attagttatgcatttt

SEQ ID NO: 536045 - DNA, 16 bp, G. gallus
attattcttttgcatc

SEQ ID NO: 536046 - DNA, 16 bp, G. gallus
attatttttggagcag

SEQ ID NO: 536047 - DNA, 16 bp, G. gallus
attcaagacccatctg

SEQ ID NO: 536048 - DNA, 16 bp, G. gallus
attcaagtccaggctg

SEQ ID NO: 536049 - DNA, 16 bp, G. gallus
attcagcaagcactga

SEQ ID NO: 536050 - DNA, 16 bp, G. gallus
attcaggctggaaaag

SEQ ID NO: 536051 - DNA, 17 bp, G. gallus
attccaccacagtggcg

SEQ ID NO: 536052 - DNA, 16 bp, G. gallus
attccattacattttt

SEQ ID NO: 536053 - DNA, 16 bp, G. gallus
attcctcttcactcaa

SEQ ID NO: 536054 - DNA, 16 bp, G. gallus
attctacaattctgtg

SEQ ID NO: 536055 - DNA, 16 bp, G. gallus
attctacaggtacatt

SEQ ID NO: 536056 - DNA, 16 bp, G. gallus
attctataattctatg

SEQ ID NO: 536057 - DNA, 16 bp, G. gallus
attctatgattctatg

SEQ ID NO: 536058 - DNA, 16 bp, G. gallus
attctatgattctgta

SEQ ID NO: 536059 - DNA, 16 bp, G. gallus
attctatgattctgtg

SEQ ID NO: 536060 - DNA, 16 bp, G. gallus
attctatgattctgtt

SEQ ID NO: 536061 - DNA, 16 bp, G. gallus
attctatggttctgtg

SEQ ID NO: 536062 - DNA, 16 bp, G. gallus
attctattctatgatt

SEQ ID NO: 536063 - DNA, 16 bp, G. gallus
attctggagaaaaaaa

SEQ ID NO: 536064 - DNA, 16 bp, G. gallus
attctgtgatcctatg

SEQ ID NO: 536065 - DNA, 16 bp, G. gallus
attctgtgattctgtg

SEQ ID NO: 536066 - DNA, 16 bp, G. gallus
attctttactcagagg

SEQ ID NO: 536067 - DNA, 16 bp, G. gallus
attctttgtatctgtt

SEQ ID NO: 536068 - DNA, 16 bp, G. gallus
attgacagtgggattg

SEQ ID NO: 536069 - DNA, 16 bp, G. gallus
attgagtacaccctca

SEQ ID NO: 536070 - DNA, 16 bp, G. gallus
attgatgaagatgttg

SEQ ID NO: 536071 - DNA, 16 bp, G. gallus
attgatgaccttgatg

SEQ ID NO: 536072 - DNA, 16 bp, G. gallus
attgctgaaaaaaaaa

SEQ ID NO: 536073 - DNA, 16 bp, G. gallus
attggtggccctgcct

SEQ ID NO: 536074 - DNA, 16 bp, G. gallus
attgtattgtattgta

SEQ ID NO: 536075 - DNA, 16 bp, G. gallus
atttaatagagcaaat

SEQ ID NO: 536076 - DNA, 16 bp, G. gallus
atttacaagaaaggga

SEQ ID NO: 536077 - DNA, 16 bp, G. gallus
atttagactagatatt

SEQ ID NO: 536078 - DNA, 16 bp, G. gallus
atttattctccaaaag

SEQ ID NO: 536079 - DNA, 16 bp, G. gallus
atttatttattttgca

SEQ ID NO: 536080 - DNA, 16 bp, G. gallus
atttcaaggaaaaaaa

SEQ ID NO: 536081 - DNA, 16 bp, G. gallus
atttcacagaatcata

SEQ ID NO: 536082 - DNA, 16 bp, G. gallus
atttcagaaaaagaaa

SEQ ID NO: 536083 - DNA, 16 bp, G. gallus
atttccatggaaaata

SEQ ID NO: 536084 - DNA, 16 bp, G. gallus
atttccatggaaacag

SEQ ID NO: 536085 - DNA, 16 bp, G. gallus
atttcccactaaacca

SEQ ID NO: 536086 - DNA, 16 bp, G. gallus
atttcctgaacacctc

SEQ ID NO: 536087 - DNA, 16 bp, G. gallus
atttcctttaaaaaaa

SEQ ID NO: 536088 - DNA, 16 bp, G. gallus
atttctcagaaaaaaa

SEQ ID NO: 536089 - DNA, 16 bp, G. gallus
atttctctgggcagcc

SEQ ID NO: 536090 - DNA, 16 bp, G. gallus
atttgagttggaaagg

SEQ ID NO: 536091 - DNA, 16 bp, G. gallus
atttgcctcccatctc

SEQ ID NO: 536092 - DNA, 16 bp, G. gallus
atttgctctatcaaac

SEQ ID NO: 536093 - DNA, 16 bp, G. gallus
atttggaaagaaaaat

SEQ ID NO: 536094 - DNA, 16 bp, G. gallus
atttggagtactgtgt

SEQ ID NO: 536095 - DNA, 16 bp, G. gallus
atttggataatgccct

SEQ ID NO: 536096 - DNA, 16 bp, G. gallus
atttgttgattgtaca

SEQ ID NO: 536097 - DNA, 16 bp, G. gallus
attttaaaagaaaaac

SEQ ID NO: 536098 - DNA, 16 bp, G. gallus
attttatgattctatg

SEQ ID NO: 536099 - DNA, 16 bp, G. gallus
attttatttcagaaaa

SEQ ID NO: 536100 - DNA, 16 bp, G. gallus
attttctccctgcaca

SEQ ID NO: 536101 - DNA, 16 bp, G. gallus
attttcttttctgaaa

SEQ ID NO: 536102 - DNA, 16 bp, G. gallus
attttgctgctgtgtg

SEQ ID NO: 536103 - DNA, 16 bp, G. gallus
attttgctttaaaaaa

SEQ ID NO: 536104 - DNA, 16 bp, G. gallus
attttgtgaaatccct

SEQ ID NO: 536105 - DNA, 16 bp, G. gallus
attttgtttccagttc

SEQ ID NO: 536106 - DNA, 16 bp, G. gallus
atttttaaaaagcaaa

SEQ ID NO: 536107 - DNA, 16 bp, G. gallus
atttttcagaaaaaaa

SEQ ID NO: 536108 - DNA, 16 bp, G. gallus
atttttggggaaaaaa

SEQ ID NO: 536109 - DNA, 16 bp, G. gallus
atttttgtcagcaatg

SEQ ID NO: 536110 - DNA, 16 bp, G. gallus
atttttttttccaaga

SEQ ID NO: 536111 - DNA, 16 bp, G. gallus
caaaaaagacaaggat

SEQ ID NO: 536112 - DNA, 16 bp, G. gallus
caaaaaagacagagat

SEQ ID NO: 536113 - DNA, 16 bp, G. gallus
caaaaactggaacaca

SEQ ID NO: 536114 - DNA, 16 bp, G. gallus
caaaacacagcaccat

SEQ ID NO: 536115 - DNA, 16 bp, G. gallus
caaaacagattttttt

SEQ ID NO: 536116 - DNA, 16 bp, G. gallus
caaaacctgcctggat

SEQ ID NO: 536117 - DNA, 16 bp, G. gallus
caaaagaaatgcctcc

SEQ ID NO: 536118 - DNA, 16 bp, G. gallus
caaaagagaagaacta

SEQ ID NO: 536119 - DNA, 16 bp, G. gallus
caaaaggaaagtttat

SEQ ID NO: 536120 - DNA, 16 bp, G. gallus
caaaaggttttttttt

SEQ ID NO: 536121 - DNA, 16 bp, G. gallus
caaaatctgcaccagt

SEQ ID NO: 536122 - DNA, 16 bp, G. gallus
caaaatgcaggacctg

SEQ ID NO: 536123 - DNA, 16 bp, G. gallus
caaaatggaacagaat

SEQ ID NO: 536124 - DNA, 16 bp, G. gallus
caaaatgtaatagaat

SEQ ID NO: 536125 - DNA, 16 bp, G. gallus
caaaattcaaaccctg

SEQ ID NO: 536126 - DNA, 16 bp, G. gallus
caaacactccttgaac

SEQ ID NO: 536127 - DNA, 16 bp, G. gallus
caaacagcagcagcag

SEQ ID NO: 536128 - DNA, 16 bp, G. gallus
caaaccactctgtgat

SEQ ID NO: 536129 - DNA, 16 bp, G. gallus
caaaccctacatctga

SEQ ID NO: 536130 - DNA, 16 bp, G. gallus
caaacttgctgagggt

SEQ ID NO: 536131 - DNA, 16 bp, G. gallus
caaagaagtcattgag

SEQ ID NO: 536132 - DNA, 16 bp, G. gallus
caaagatcatccagtc

SEQ ID NO: 536133 - DNA, 16 bp, G. gallus
caaagctggcagctct

SEQ ID NO: 536134 - DNA, 16 bp, G. gallus
caaagctgggaggaat

SEQ ID NO: 536135 - DNA, 16 bp, G. gallus
caaaggaccacaatga

SEQ ID NO: 536136 - DNA, 16 bp, G. gallus
caaaggagaaatgaaa

SEQ ID NO: 536137 - DNA, 16 bp, G. gallus
caaaggcaaaggcaaa

SEQ ID NO: 536138 - DNA, 16 bp, G. gallus
caaagggacctggaca

SEQ ID NO: 536139 - DNA, 16 bp, G. gallus
caaagggatattccat

SEQ ID NO: 536140 - DNA, 16 bp, G. gallus
caaatagcattattgt

SEQ ID NO: 536141 - DNA, 16 bp, G. gallus
caaatgcaacagctgt

SEQ ID NO: 536142 - DNA, 16 bp, G. gallus
caaatgcagcagctgt

SEQ ID NO: 536143 - DNA, 16 bp, G. gallus
caaatggaagaagaaa

SEQ ID NO: 536144 - DNA, 16 bp, G. gallus
caaattctcagttaca

SEQ ID NO: 536145 - DNA, 16 bp, G. gallus
caaattggagggatgt

SEQ ID NO: 536146 - DNA, 16 bp, G. gallus
caaatttgctgagggt

SEQ ID NO: 536147 - DNA, 16 bp, G. gallus
caacaaacaggaggag

SEQ ID NO: 536148 - DNA, 16 bp, G. gallus
caacaaagctgtgaag

SEQ ID NO: 536149 - DNA, 16 bp, G. gallus
caacaacaaaaaagtc

SEQ ID NO: 536150 - DNA, 16 bp, G. gallus
caacaagaccaagtgc

SEQ ID NO: 536151 - DNA, 16 bp, G. gallus
caacaatattccatta

SEQ ID NO: 536152 - DNA, 16 bp, G. gallus
caacacctccctgggc

SEQ ID NO: 536153 - DNA, 16 bp, G. gallus
caacaccttttttttt

SEQ ID NO: 536154 - DNA, 16 bp, G. gallus
caacagatacaatgag

SEQ ID NO: 536155 - DNA, 16 bp, G. gallus
caacagctacaaagag

SEQ ID NO: 536156 - DNA, 16 bp, G. gallus
caacagctcccataca

SEQ ID NO: 536157 - DNA, 16 bp, G. gallus
caacagctctgcatcc

SEQ ID NO: 536158 - DNA, 16 bp, G. gallus
caacagtttccataca

SEQ ID NO: 536159 - DNA, 16 bp, G. gallus
caacatagtcaccatc

SEQ ID NO: 536160 - DNA, 16 bp, G. gallus
caacatccacctctga

SEQ ID NO: 536161 - DNA, 16 bp, G. gallus
caacatgagccagcag

SEQ ID NO: 536162 - DNA, 16 bp, G. gallus
caaccacatcactagg

SEQ ID NO: 536163 - DNA, 16 bp, G. gallus
caaccactttggattc

SEQ ID NO: 536164 - DNA, 16 bp, G. gallus
caacccaagccattct

SEQ ID NO: 536165 - DNA, 16 bp, G. gallus
caacccaggccattct

SEQ ID NO: 536166 - DNA, 16 bp, G. gallus
caacccattaccacca

SEQ ID NO: 536167 - DNA, 16 bp, G. gallus
caaccccgctctgctg

SEQ ID NO: 536168 - DNA, 16 bp, G. gallus
caacccctgccatggg

SEQ ID NO: 536169 - DNA, 16 bp, G. gallus
caaccctctgctatgt

SEQ ID NO: 536170 - DNA, 16 bp, G. gallus
caacctcaaccattct

SEQ ID NO: 536171 - DNA, 16 bp, G. gallus
caacctcagtgattct

SEQ ID NO: 536172 - DNA, 17 bp, G. gallus
caacctccacatttaat

SEQ ID NO: 536173 - DNA, 16 bp, G. gallus
caacctcctgctcaaa

SEQ ID NO: 536174 - DNA, 16 bp, G. gallus
caacctctctgggcag

SEQ ID NO: 536175 - DNA, 16 bp, G. gallus
caacctgaacctcttc

SEQ ID NO: 536176 - DNA, 16 bp, G. gallus
caacctgatctagatg

SEQ ID NO: 536177 - DNA, 16 bp, G. gallus
caacctgatctggctg

SEQ ID NO: 536178 - DNA, 16 bp, G. gallus
caacctgattgagctg

SEQ ID NO: 536179 - DNA, 16 bp, G. gallus
caacctgctggccatg

SEQ ID NO: 536180 - DNA, 16 bp, G. gallus
caacctgctggtcaca

SEQ ID NO: 536181 - DNA, 16 bp, G. gallus
caacctggccctgaac

SEQ ID NO: 536182 - DNA, 16 bp, G. gallus
caacctggctgctggg

SEQ ID NO: 536183 - DNA, 16 bp, G. gallus
caacctgttccagagt

SEQ ID NO: 536184 - DNA, 16 bp, G. gallus
caactcaaacaattct

SEQ ID NO: 536185 - DNA, 16 bp, G. gallus
caactcaagtgattct

SEQ ID NO: 536186 - DNA, 16 bp, G. gallus
caactcagaagattct

SEQ ID NO: 536187 - DNA, 16 bp, G. gallus
caactccactgcaatg

SEQ ID NO: 536188 - DNA, 16 bp, G. gallus
caactcccctgcagtg

SEQ ID NO: 536189 - DNA, 16 bp, G. gallus
caactcctctgcagtg

SEQ ID NO: 536190 - DNA, 16 bp, G. gallus
caactgaacatgagcc

SEQ ID NO: 536191 - DNA, 16 bp, G. gallus
caactgcatcactcag

SEQ ID NO: 536192 - DNA, 16 bp, G. gallus
caactgggggatcagg

SEQ ID NO: 536193 - DNA, 16 bp, G. gallus
caactgtttacaaggg

SEQ ID NO: 536194 - DNA, 16 bp, G. gallus
caacttctctgagcaa

SEQ ID NO: 536195 - DNA, 16 bp, G. gallus
caacttgatgtcatct

SEQ ID NO: 536196 - DNA, 16 bp, G. gallus
caacttggaatattct

SEQ ID NO: 536197 - DNA, 16 bp, G. gallus
caacttgggatattct

SEQ ID NO: 536198 - DNA, 16 bp, G. gallus
caagaaagatgtggaa

SEQ ID NO: 536199 - DNA, 16 bp, G. gallus
caagaaccgtgtggat

SEQ ID NO: 536200 - DNA, 16 bp, G. gallus
caagataaacagcatg

SEQ ID NO: 536201 - DNA, 16 bp, G. gallus
caagatcatcaagtcc

SEQ ID NO: 536202 - DNA, 16 bp, G. gallus
caagattggaaaagac

SEQ ID NO: 536203 - DNA, 17 bp, G. gallus
caagcaagtcctgacca

SEQ ID NO: 536204 - DNA, 16 bp, G. gallus
caagcaagtggaagaa

SEQ ID NO: 536205 - DNA, 16 bp, G. gallus
caagcacagatacaga

SEQ ID NO: 536206 - DNA, 16 bp, G. gallus
caagcactggaacagg

SEQ ID NO: 536207 - DNA, 16 bp, G. gallus
caagcagaggaggcag

SEQ ID NO: 536208 - DNA, 16 bp, G. gallus
caagcagcagaagaga

SEQ ID NO: 536209 - DNA, 16 bp, G. gallus
caagcaggacctgccc

SEQ ID NO: 536210 - DNA, 16 bp, G. gallus
caagcaggatttgccc

SEQ ID NO: 536211 - DNA, 16 bp, G. gallus
caagctctggaaacaa

SEQ ID NO: 536212 - DNA, 16 bp, G. gallus
caagctgagcggtgca

SEQ ID NO: 536213 - DNA, 16 bp, G. gallus
caagctgagggagctg

SEQ ID NO: 536214 - DNA, 16 bp, G. gallus
caagctgctggagctc

SEQ ID NO: 536215 - DNA, 16 bp, G. gallus
caaggaagtgatcatc

SEQ ID NO: 536216 - DNA, 16 bp, G. gallus
caaggaatgtttggac

SEQ ID NO: 536217 - DNA, 16 bp, G. gallus
caaggacacctacagc

SEQ ID NO: 536218 - DNA, 16 bp, G. gallus
caaggagctgggaggg

SEQ ID NO: 536219 - DNA, 16 bp, G. gallus
caaggaggagatccca

SEQ ID NO: 536220 - DNA, 16 bp, G. gallus
caaggaggatgaaggc

SEQ ID NO: 536221 - DNA, 19 bp, G. gallus
caaggatcatgaagctcca

SEQ ID NO: 536222 - DNA, 19 bp, G. gallus
caaggatcatgaatctcca

SEQ ID NO: 536223 - DNA, 16 bp, G. gallus
caaggcacagatggaa

SEQ ID NO: 536224 - DNA, 16 bp, G. gallus
caagggaagtgatcct

SEQ ID NO: 536225 - DNA, 16 bp, G. gallus
caagggatgtgaaaga

SEQ ID NO: 536226 - DNA, 16 bp, G. gallus
caaggggaaatggcca

SEQ ID NO: 536227 - DNA, 16 bp, G. gallus
caaggggaaatggctt

SEQ ID NO: 536228 - DNA, 16 bp, G. gallus
caaggggaaatggttt

SEQ ID NO: 536229 - DNA, 16 bp, G. gallus
caagtcatagaatcat

SEQ ID NO: 536230 - DNA, 16 bp, G. gallus
caagtccagccatcaa

SEQ ID NO: 536231 - DNA, 16 bp, G. gallus
caagtggaaatggttt

SEQ ID NO: 536232 - DNA, 16 bp, G. gallus
caagtgtcaatgaatg

SEQ ID NO: 536233 - DNA, 16 bp, G. gallus
caagttcagctccatc

SEQ ID NO: 536234 - DNA, 16 bp, G. gallus
caagtttgcaggtgac

SEQ ID NO: 536235 - DNA, 16 bp, G. gallus
caatagatacaaagag

SEQ ID NO: 536236 - DNA, 16 bp, G. gallus
caatcaccttcctctc

SEQ ID NO: 536237 - DNA, 16 bp, G. gallus
caatcagtggatgtga

SEQ ID NO: 536238 - DNA, 16 bp, G. gallus
caatccacctcactgt

SEQ ID NO: 536239 - DNA, 16 bp, G. gallus
caatctggagaagagg

SEQ ID NO: 536240 - DNA, 16 bp, G. gallus
caatgaagatattaaa

SEQ ID NO: 536241 - DNA, 16 bp, G. gallus
caatgacacagatgat

SEQ ID NO: 536242 - DNA, 16 bp, G. gallus
caatgacatcctggct

SEQ ID NO: 536243 - DNA, 16 bp, G. gallus
caatgctcatctcatt

SEQ ID NO: 536244 - DNA, 16 bp, G. gallus
caatgctggctcatgt

SEQ ID NO: 536245 - DNA, 16 bp, G. gallus
caatttaaagccattt

SEQ ID NO: 536246 - DNA, 17 bp, G. gallus
caatttcacctgagtga

SEQ ID NO: 536247 - DNA, 16 bp, G. gallus
caatttcttctccaaa

SEQ ID NO: 536248 - DNA, 16 bp, G. gallus
cacaacaaccccatgc

SEQ ID NO: 536249 - DNA, 16 bp, G. gallus
cacaacctcatttcag

SEQ ID NO: 536250 - DNA, 16 bp, G. gallus
cacaatgaggtctctc

SEQ ID NO: 536251 - DNA, 16 bp, G. gallus
cacacacacacactgc

SEQ ID NO: 536252 - DNA, 16 bp, G. gallus
cacacagaaacaaaat

SEQ ID NO: 536253 - DNA, 17 bp, G. gallus
cacacagagggtggtga

SEQ ID NO: 536254 - DNA, 16 bp, G. gallus
cacacagcacagagca

SEQ ID NO: 536255 - DNA, 16 bp, G. gallus
cacacagcagcagcag

SEQ ID NO: 536256 - DNA, 16 bp, G. gallus
cacacatgcacgcaca

SEQ ID NO: 536257 - DNA, 16 bp, G. gallus
cacacctggagtgctg

SEQ ID NO: 536258 - DNA, 16 bp, G. gallus
cacactgccctgccag

SEQ ID NO: 536259 - DNA, 16 bp, G. gallus
cacactgctggctcat

SEQ ID NO: 536260 - DNA, 16 bp, G. gallus
cacactgctggttcat

SEQ ID NO: 536261 - DNA, 16 bp, G. gallus
cacactgcttttgatg

SEQ ID NO: 536262 - DNA, 16 bp, G. gallus
cacagaatcacagaat

SEQ ID NO: 536263 - DNA, 16 bp, G. gallus
cacagaatcatagaat

SEQ ID NO: 536264 - DNA, 16 bp, G. gallus
cacagaatcatagagt

SEQ ID NO: 536265 - DNA, 16 bp, G. gallus
cacagaatgatttggg

SEQ ID NO: 536266 - DNA, 16 bp, G. gallus
cacagaattatagaat

SEQ ID NO: 536267 - DNA, 16 bp, G. gallus
cacagacgatggcatc

SEQ ID NO: 536268 - DNA, 16 bp, G. gallus
cacagagagagagaga

SEQ ID NO: 536269 - DNA, 16 bp, G. gallus
cacagagcagcagcag

SEQ ID NO: 536270 - DNA, 16 bp, G. gallus
cacagagctcttggaa

SEQ ID NO: 536271 - DNA, 16 bp, G. gallus
cacagagggtggtgaa

SEQ ID NO: 536272 - DNA, 16 bp, G. gallus
cacagataggcatcca

SEQ ID NO: 536273 - DNA, 16 bp, G. gallus
cacagatttttttttt

SEQ ID NO: 536274 - DNA, 16 bp, G. gallus
cacagcacagcacagc

SEQ ID NO: 536275 - DNA, 16 bp, G. gallus
cacagcactgctgctg

SEQ ID NO: 536276 - DNA, 16 bp, G. gallus
cacagcagatcctgct

SEQ ID NO: 536277 - DNA, 16 bp, G. gallus
cacagcagcagcagct

SEQ ID NO: 536278 - DNA, 16 bp, G. gallus
cacagcaggggggttg

SEQ ID NO: 536279 - DNA, 16 bp, G. gallus
cacagcattttttttt

SEQ ID NO: 536280 - DNA, 16 bp, G. gallus
cacagccagatcaggt

SEQ ID NO: 536281 - DNA, 16 bp, G. gallus
cacagccctgctgctc

SEQ ID NO: 536282 - DNA, 16 bp, G. gallus
cacagcctcccttcag

SEQ ID NO: 536283 - DNA, 16 bp, G. gallus
cacagctctgctgccc

SEQ ID NO: 536284 - DNA, 16 bp, G. gallus
cacagctctgctgctg

SEQ ID NO: 536285 - DNA, 16 bp, G. gallus
cacagctgcacaggga

SEQ ID NO: 536286 - DNA, 16 bp, G. gallus
cacagctgcagcacag

SEQ ID NO: 536287 - DNA, 16 bp, G. gallus
cacagctgctgctctg

SEQ ID NO: 536288 - DNA, 16 bp, G. gallus
cacagctgtccagaga

SEQ ID NO: 536289 - DNA, 16 bp, G. gallus
cacaggaaaaactcca

SEQ ID NO: 536290 - DNA, 16 bp, G. gallus
cacaggaaagcattca

SEQ ID NO: 536291 - DNA, 16 bp, G. gallus
cacaggagaggtgctt

SEQ ID NO: 536292 - DNA, 16 bp, G. gallus
cacaggcagcagctcc

SEQ ID NO: 536293 - DNA, 16 bp, G. gallus
cacaggctgcccacag

SEQ ID NO: 536294 - DNA, 16 bp, G. gallus
cacagggctgtgggca

SEQ ID NO: 536295 - DNA, 16 bp, G. gallus
cacagtatccttctgg

SEQ ID NO: 536296 - DNA, 16 bp, G. gallus
cacagtgaggcggtgg

SEQ ID NO: 536297 - DNA, 16 bp, G. gallus
cacatacatacacaca

SEQ ID NO: 536298 - DNA, 16 bp, G. gallus
cacatatacacacaca

SEQ ID NO: 536299 - DNA, 16 bp, G. gallus
cacatgcacacatgca

SEQ ID NO: 536300 - DNA, 16 bp, G. gallus
cacatgtacacacaca

SEQ ID NO: 536301 - DNA, 16 bp, G. gallus
cacattcttcaagatc

SEQ ID NO: 536302 - DNA, 16 bp, G. gallus
caccaacatcctcctc

SEQ ID NO: 536303 - DNA, 16 bp, G. gallus
caccaagctgagtggt

SEQ ID NO: 536304 - DNA, 16 bp, G. gallus
caccaagtttggaaaa

SEQ ID NO: 536305 - DNA, 16 bp, G. gallus
caccacaaaatgaaga

SEQ ID NO: 536306 - DNA, 16 bp, G. gallus
caccacaccaggctgc

SEQ ID NO: 536307 - DNA, 16 bp, G. gallus
caccaccaccctctgg

SEQ ID NO: 536308 - DNA, 16 bp, G. gallus
caccaccacctccctg

SEQ ID NO: 536309 - DNA, 16 bp, G. gallus
caccaccctctgagca

SEQ ID NO: 536310 - DNA, 16 bp, G. gallus
caccacctccgtgggc

SEQ ID NO: 536311 - DNA, 16 bp, G. gallus
caccactcatcaccag

SEQ ID NO: 536312 - DNA, 16 bp, G. gallus
caccagagagcagaga

SEQ ID NO: 536313 - DNA, 16 bp, G. gallus
caccagagagcagagc

SEQ ID NO: 536314 - DNA, 16 bp, G. gallus
caccagatcaagctgc

SEQ ID NO: 536315 - DNA, 16 bp, G. gallus
caccagctttgttgct

SEQ ID NO: 536316 - DNA, 16 bp, G. gallus
caccaggaagcacttc

SEQ ID NO: 536317 - DNA, 16 bp, G. gallus
caccaggactcccagg

SEQ ID NO: 536318 - DNA, 16 bp, G. gallus
caccaggagagattca

SEQ ID NO: 536319 - DNA, 16 bp, G. gallus
caccaggccaggctgc

SEQ ID NO: 536320 - DNA, 16 bp, G. gallus
caccaggtgagaaggc

SEQ ID NO: 536321 - DNA, 16 bp, G. gallus
caccatccagagggac

SEQ ID NO: 536322 - DNA, 16 bp, G. gallus
caccatctccctgggc

SEQ ID NO: 536323 - DNA, 16 bp, G. gallus
cacccactggcattca

SEQ ID NO: 536324 - DNA, 16 bp, G. gallus
cacccatttttaagaa

SEQ ID NO: 536325 - DNA, 16 bp, G. gallus
caccccaccgtgccca

SEQ ID NO: 536326 - DNA, 16 bp, G. gallus
cacccctcagtctcct

SEQ ID NO: 536327 - DNA, 16 bp, G. gallus
cacccctcagtgccac

SEQ ID NO: 536328 - DNA, 16 bp, G. gallus
cacccctctgttgatg

SEQ ID NO: 536329 - DNA, 16 bp, G. gallus
caccctcactgtgaaa

SEQ ID NO: 536330 - DNA, 16 bp, G. gallus
caccctcagcaaattt

SEQ ID NO: 536331 - DNA, 16 bp, G. gallus
caccctctggtgaaga

SEQ ID NO: 536332 - DNA, 16 bp, G. gallus
caccctgctattatca

SEQ ID NO: 536333 - DNA, 16 bp, G. gallus
caccctgctggccacc

SEQ ID NO: 536334 - DNA, 16 bp, G. gallus
cacctacagctacatc

SEQ ID NO: 536335 - DNA, 16 bp, G. gallus
cacctcaagcactgtg

SEQ ID NO: 536336 - DNA, 16 bp, G. gallus
cacctcacacagcctc

SEQ ID NO: 536337 - DNA, 16 bp, G. gallus
cacctccagggacagc

SEQ ID NO: 536338 - DNA, 16 bp, G. gallus
cacctcccagggcagc

SEQ ID NO: 536339 - DNA, 16 bp, G. gallus
cacctccccgggcagc

SEQ ID NO: 536340 - DNA, 16 bp, G. gallus
cacctccctcaatctg

SEQ ID NO: 536341 - DNA, 16 bp, G. gallus
cacctccctgctcctg

SEQ ID NO: 536342 - DNA, 16 bp, G. gallus
cacctcctgcagctga

SEQ ID NO: 536343 - DNA, 16 bp, G. gallus
cacctcctgctcctgc

SEQ ID NO: 536344 - DNA, 16 bp, G. gallus
cacctctctgggcagc

SEQ ID NO: 536345 - DNA, 16 bp, G. gallus
cacctgaaaggaggtt

SEQ ID NO: 536346 - DNA, 16 bp, G. gallus
cacctgattgccatga

SEQ ID NO: 536347 - DNA, 16 bp, G. gallus
cacctggactgccaca

SEQ ID NO: 536348 - DNA, 16 bp, G. gallus
cacctggggaaaggac

SEQ ID NO: 536349 - DNA, 16 bp, G. gallus
cacctggtccaactcc

SEQ ID NO: 536350 - DNA, 16 bp, G. gallus
caccttcctgggcagc

SEQ ID NO: 536351 - DNA, 16 bp, G. gallus
caccttctgagtaaaa

SEQ ID NO: 536352 - DNA, 16 bp, G. gallus
cacggaatcatagaat

SEQ ID NO: 536353 - DNA, 16 bp, G. gallus
cacggaggtggtggag

SEQ ID NO: 536354 - DNA, 16 bp, G. gallus
cactatgaagaaaatt

SEQ ID NO: 536355 - DNA, 16 bp, G. gallus
cactcagaaggtggtg

SEQ ID NO: 536356 - DNA, 16 bp, G. gallus
cactcagtcccactgt

SEQ ID NO: 536357 - DNA, 16 bp, G. gallus
cactcatcactggcct

SEQ ID NO: 536358 - DNA, 16 bp, G. gallus
cactctccatcatttt

SEQ ID NO: 536359 - DNA, 16 bp, G. gallus
cactcttcctgagaag

SEQ ID NO: 536360 - DNA, 16 bp, G. gallus
cactgaattccttcat

SEQ ID NO: 536361 - DNA, 16 bp, G. gallus
cactgagcagggacac

SEQ ID NO: 536362 - DNA, 16 bp, G. gallus
cactgatggagcacct

SEQ ID NO: 536363 - DNA, 16 bp, G. gallus
cactgcagcagcactg

SEQ ID NO: 536364 - DNA, 16 bp, G. gallus
cactgcaggaaaaaaa

SEQ ID NO: 536365 - DNA, 16 bp, G. gallus
cactgccccttgttct

SEQ ID NO: 536366 - DNA, 16 bp, G. gallus
cactgccctctggtgc

SEQ ID NO: 536367 - DNA, 16 bp, G. gallus
cactgcccttctctgg

SEQ ID NO: 536368 - DNA, 16 bp, G. gallus
cactgctgaaatgcac

SEQ ID NO: 536369 - DNA, 16 bp, G. gallus
cactgtgctgctgctg

SEQ ID NO: 536370 - DNA, 16 bp, G. gallus
cactgttcagtctcca

SEQ ID NO: 536371 - DNA, 16 bp, G. gallus
cactgtttctgatgca

SEQ ID NO: 536372 - DNA, 16 bp, G. gallus
cactgtttggtctcca

SEQ ID NO: 536373 - DNA, 16 bp, G. gallus
cacttacagtgggagg

SEQ ID NO: 536374 - DNA, 16 bp, G. gallus
cacttccctgagcagc

SEQ ID NO: 536375 - DNA, 16 bp, G. gallus
cacttctttacagaaa

SEQ ID NO: 536376 - DNA, 16 bp, G. gallus
cactttcacagacact

SEQ ID NO: 536377 - DNA, 16 bp, G. gallus
cagaaaagcagcagca

SEQ ID NO: 536378 - DNA, 16 bp, G. gallus
cagaaaaggatctggg

SEQ ID NO: 536379 - DNA, 16 bp, G. gallus
cagaaaatcatagaat

SEQ ID NO: 536380 - DNA, 16 bp, G. gallus
cagaaagaaatccttc

SEQ ID NO: 536381 - DNA, 16 bp, G. gallus
cagaaagcagcagcag

SEQ ID NO: 536382 - DNA, 16 bp, G. gallus
cagaaagctgtgctgc

SEQ ID NO: 536383 - DNA, 16 bp, G. gallus
cagaaaggggaaacag

SEQ ID NO: 536384 - DNA, 16 bp, G. gallus
cagaacaagaggaaat

SEQ ID NO: 536385 - DNA, 16 bp, G. gallus
cagaaccacatccagc

SEQ ID NO: 536386 - DNA, 16 bp, G. gallus
cagaacctctctgggc

SEQ ID NO: 536387 - DNA, 16 bp, G. gallus
cagaactgaacacagt

SEQ ID NO: 536388 - DNA, 16 bp, G. gallus
cagaagcagatggtgg

SEQ ID NO: 536389 - DNA, 16 bp, G. gallus
cagaaggatctggaca

SEQ ID NO: 536390 - DNA, 16 bp, G. gallus
cagaaggctgtgctgc

SEQ ID NO: 536391 - DNA, 16 bp, G. gallus
cagaataaaacaggag

SEQ ID NO: 536392 - DNA, 16 bp, G. gallus
cagaatatcctgagct

SEQ ID NO: 536393 - DNA, 16 bp, G. gallus
cagaatcacagaatca

SEQ ID NO: 536394 - DNA, 16 bp, G. gallus
cagaatcactcaggtt

SEQ ID NO: 536395 - DNA, 16 bp, G. gallus
cagaccaaacagcccc

SEQ ID NO: 536396 - DNA, 16 bp, G. gallus
cagacccctgggggac

SEQ ID NO: 536397 - DNA, 16 bp, G. gallus
cagactcttctcagtg

SEQ ID NO: 536398 - DNA, 16 bp, G. gallus
cagactctttagtagg

SEQ ID NO: 536399 - DNA, 16 bp, G. gallus
cagactgcccagggcc

SEQ ID NO: 536400 - DNA, 16 bp, G. gallus
cagactggaagaagaa

SEQ ID NO: 536401 - DNA, 16 bp, G. gallus
cagactggatggggct

SEQ ID NO: 536402 - DNA, 16 bp, G. gallus
cagactgggagaagag

SEQ ID NO: 536403 - DNA, 16 bp, G. gallus
cagacttcccctctgc

SEQ ID NO: 536404 - DNA, 16 bp, G. gallus
cagagaagaaatattt

SEQ ID NO: 536405 - DNA, 16 bp, G. gallus
cagagaagcagtattt

SEQ ID NO: 536406 - DNA, 16 bp, G. gallus
cagagaaggacaatga

SEQ ID NO: 536407 - DNA, 16 bp, G. gallus
cagagaagggcagtga

SEQ ID NO: 536408 - DNA, 16 bp, G. gallus
cagagaagtatttcct

SEQ ID NO: 536409 - DNA, 16 bp, G. gallus
cagagaagtggtggat

SEQ ID NO: 536410 - DNA, 16 bp, G. gallus
cagagaggagatataa

SEQ ID NO: 536411 - DNA, 16 bp, G. gallus
cagagaggtggtgcag

SEQ ID NO: 536412 - DNA, 16 bp, G. gallus
cagagatcttttccaa

SEQ ID NO: 536413 - DNA, 16 bp, G. gallus
cagagatgaacaagag

SEQ ID NO: 536414 - DNA, 16 bp, G. gallus
cagagcactggaacaa

SEQ ID NO: 536415 - DNA, 16 bp, G. gallus
cagagcagagcaggac

SEQ ID NO: 536416 - DNA, 16 bp, G. gallus
cagagcagagggacag

SEQ ID NO: 536417 - DNA, 16 bp, G. gallus
cagagcagcagcacag

SEQ ID NO: 536418 - DNA, 16 bp, G. gallus
cagagccccttccagc

SEQ ID NO: 536419 - DNA, 16 bp, G. gallus
cagagccctgcccagc

SEQ ID NO: 536420 - DNA, 16 bp, G. gallus
cagagccttctcctct

SEQ ID NO: 536421 - DNA, 16 bp, G. gallus
cagagccttctcttcc

SEQ ID NO: 536422 - DNA, 16 bp, G. gallus
cagagccttgtccagc

SEQ ID NO: 536423 - DNA, 16 bp, G. gallus
cagagctcagcgctgc

SEQ ID NO: 536424 - DNA, 16 bp, G. gallus
cagaggaaaaggatct

SEQ ID NO: 536425 - DNA, 16 bp, G. gallus
cagaggactttgcatt

SEQ ID NO: 536426 - DNA, 16 bp, G. gallus
cagaggagggccagga

SEQ ID NO: 536427 - DNA, 16 bp, G. gallus
cagaggcagatgctgg

SEQ ID NO: 536428 - DNA, 16 bp, G. gallus
cagagggacctcaaca

SEQ ID NO: 536429 - DNA, 16 bp, G. gallus
cagagggcggtgggca

SEQ ID NO: 536430 - DNA, 16 bp, G. gallus
cagagggctgaagcac

SEQ ID NO: 536431 - DNA, 16 bp, G. gallus
cagagggctgtgatca

SEQ ID NO: 536432 - DNA, 16 bp, G. gallus
cagaggggcagcactg

SEQ ID NO: 536433 - DNA, 16 bp, G. gallus
cagaggggcagtgctg

SEQ ID NO: 536434 - DNA, 16 bp, G. gallus
cagagggtgctgaggc

SEQ ID NO: 536435 - DNA, 16 bp, G. gallus
cagagggtggtcaggc

SEQ ID NO: 536436 - DNA, 17 bp, G. gallus
cagagggtggtgacaca

SEQ ID NO: 536437 - DNA, 16 bp, G. gallus
cagagggtggtgatca

SEQ ID NO: 536438 - DNA, 17 bp, G. gallus
cagagggtggtgatgca

SEQ ID NO: 536439 - DNA, 16 bp, G. gallus
cagagtagaggaggag

SEQ ID NO: 536440 - DNA, 16 bp, G. gallus
cagagttcaagaagca

SEQ ID NO: 536441 - DNA, 16 bp, G. gallus
cagatccttctggaag

SEQ ID NO: 536442 - DNA, 16 bp, G. gallus
cagatgacatcagtgg

SEQ ID NO: 536443 - DNA, 16 bp, G. gallus
cagatgagctgatcaa

SEQ ID NO: 536444 - DNA, 16 bp, G. gallus
cagatggaaatcagaa

SEQ ID NO: 536445 - DNA, 16 bp, G. gallus
cagatggaagcagagg

SEQ ID NO: 536446 - DNA, 16 bp, G. gallus
cagatggcagtggagg

SEQ ID NO: 536447 - DNA, 16 bp, G. gallus
cagatggggaaaaaaa

SEQ ID NO: 536448 - DNA, 16 bp, G. gallus
cagattttgaatatct

SEQ ID NO: 536449 - DNA, 16 bp, G. gallus
cagcaacaaaatgtga

SEQ ID NO: 536450 - DNA, 16 bp, G. gallus
cagcaagaaggtgcag

SEQ ID NO: 536451 - DNA, 16 bp, G. gallus
cagcaagcactgatga

SEQ ID NO: 536452 - DNA, 16 bp, G. gallus
cagcaagtgaggattt

SEQ ID NO: 536453 - DNA, 16 bp, G. gallus
cagcaatgaggtctcc

SEQ ID NO: 536454 - DNA, 16 bp, G. gallus
cagcaatgtgtcctca

SEQ ID NO: 536455 - DNA, 16 bp, G. gallus
cagcacaaagcacagc

SEQ ID NO: 536456 - DNA, 16 bp, G. gallus
cagcacagagcagaag

SEQ ID NO: 536457 - DNA, 16 bp, G. gallus
cagcacagagcagaga

SEQ ID NO: 536458 - DNA, 16 bp, G. gallus
cagcacagagcagagg

SEQ ID NO: 536459 - DNA, 16 bp, G. gallus
cagcacagagcagcac

SEQ ID NO: 536460 - DNA, 16 bp, G. gallus
cagcacagagctcagc

SEQ ID NO: 536461 - DNA, 16 bp, G. gallus
cagcacagagtagaag

SEQ ID NO: 536462 - DNA, 16 bp, G. gallus
cagcacagcacacagc

SEQ ID NO: 536463 - DNA, 16 bp, G. gallus
cagcacagcacagctc

SEQ ID NO: 536464 - DNA, 16 bp, G. gallus
cagcacagcactgagc

SEQ ID NO: 536465 - DNA, 16 bp, G. gallus
cagcacagcactgcag

SEQ ID NO: 536466 - DNA, 16 bp, G. gallus
cagcacagcagcacag

SEQ ID NO: 536467 - DNA, 16 bp, G. gallus
cagcacagcagcagca

SEQ ID NO: 536468 - DNA, 16 bp, G. gallus
cagcacagcagctctg

SEQ ID NO: 536469 - DNA, 16 bp, G. gallus
cagcacagccccacag

SEQ ID NO: 536470 - DNA, 16 bp, G. gallus
cagcacagccctgctg

SEQ ID NO: 536471 - DNA, 16 bp, G. gallus
cagcacagctccatgc

SEQ ID NO: 536472 - DNA, 16 bp, G. gallus
cagcacagctcccagc

SEQ ID NO: 536473 - DNA, 16 bp, G. gallus
cagcacagctctgctg

SEQ ID NO: 536474 - DNA, 16 bp, G. gallus
cagcacagcttcacca

SEQ ID NO: 536475 - DNA, 16 bp, G. gallus
cagcacagtcaccacc

SEQ ID NO: 536476 - DNA, 16 bp, G. gallus
cagcaccacccaaaat

SEQ ID NO: 536477 - DNA, 16 bp, G. gallus
cagcaccacggacagc

SEQ ID NO: 536478 - DNA, 16 bp, G. gallus
cagcacctcaccatcc

SEQ ID NO: 536479 - DNA, 16 bp, G. gallus
cagcacctcaccgccc

SEQ ID NO: 536480 - DNA, 16 bp, G. gallus
cagcacctccagcacc

SEQ ID NO: 536481 - DNA, 16 bp, G. gallus
cagcactgcagggctg

SEQ ID NO: 536482 - DNA, 16 bp, G. gallus
cagcactgcccctcca

SEQ ID NO: 536483 - DNA, 16 bp, G. gallus
cagcactgctgctgct

SEQ ID NO: 536484 - DNA, 16 bp, G. gallus
cagcactgctgtgctg

SEQ ID NO: 536485 - DNA, 16 bp, G. gallus
cagcactttttttttt

SEQ ID NO: 536486 - DNA, 16 bp, G. gallus
cagcagaagcagcagc

SEQ ID NO: 536487 - DNA, 16 bp, G. gallus
cagcagaaggaaggga

SEQ ID NO: 536488 - DNA, 16 bp, G. gallus
cagcagagctgcagca

SEQ ID NO: 536489 - DNA, 16 bp, G. gallus
cagcagattgagggag

SEQ ID NO: 536490 - DNA, 16 bp, G. gallus
cagcagcaacaacaac

SEQ ID NO: 536491 - DNA, 16 bp, G. gallus
cagcagcacacagcag

SEQ ID NO: 536492 - DNA, 16 bp, G. gallus
cagcagcacagcagca

SEQ ID NO: 536493 - DNA, 16 bp, G. gallus
cagcagcacagccctg

SEQ ID NO: 536494 - DNA, 16 bp, G. gallus
cagcagcacagctcag

SEQ ID NO: 536495 - DNA, 16 bp, G. gallus
cagcagcactgcagca

SEQ ID NO: 536496 - DNA, 16 bp, G. gallus
cagcagcactgctggg

SEQ ID NO: 536497 - DNA, 16 bp, G. gallus
cagcagcagaagcagc

SEQ ID NO: 536498 - DNA, 16 bp, G. gallus
cagcagcagagaggcc

SEQ ID NO: 536499 - DNA, 16 bp, G. gallus
cagcagcagagctggg

SEQ ID NO: 536500 - DNA, 16 bp, G. gallus
cagcagcagagctgtg

SEQ ID NO: 536501 - DNA, 16 bp, G. gallus
cagcagcagcaacagc

SEQ ID NO: 536502 - DNA, 16 bp, G. gallus
cagcagcagcacagag

SEQ ID NO: 536503 - DNA, 16 bp, G. gallus
cagcagcagcacagcc

SEQ ID NO: 536504 - DNA, 16 bp, G. gallus
cagcagcagcacaggg

SEQ ID NO: 536505 - DNA, 16 bp, G. gallus
cagcagcagcagcacc

SEQ ID NO: 536506 - DNA, 16 bp, G. gallus
cagcagcagcagcatt

SEQ ID NO: 536507 - DNA, 16 bp, G. gallus
cagcagcagcagccac

SEQ ID NO: 536508 - DNA, 16 bp, G. gallus
cagcagcagcagcccc

SEQ ID NO: 536509 - DNA, 16 bp, G. gallus
cagcagcagcagctct

SEQ ID NO: 536510 - DNA, 16 bp, G. gallus
cagcagcagcagctga

SEQ ID NO: 536511 - DNA, 16 bp, G. gallus
cagcagcagcagctgg

SEQ ID NO: 536512 - DNA, 16 bp, G. gallus
cagcagcagcaggagg

SEQ ID NO: 536513 - DNA, 16 bp, G. gallus
cagcagcagcaggctg

SEQ ID NO: 536514 - DNA, 16 bp, G. gallus
cagcagcagccccagc

SEQ ID NO: 536515 - DNA, 16 bp, G. gallus
cagcagcagcctgcag

SEQ ID NO: 536516 - DNA, 16 bp, G. gallus
cagcagcagctcctgc

SEQ ID NO: 536517 - DNA, 16 bp, G. gallus
cagcagcagctctgct

SEQ ID NO: 536518 - DNA, 16 bp, G. gallus
cagcagcagctgcagg

SEQ ID NO: 536519 - DNA, 16 bp, G. gallus
cagcagcagctgctgc

SEQ ID NO: 536520 - DNA, 16 bp, G. gallus
cagcagcaggagctgc

SEQ ID NO: 536521 - DNA, 16 bp, G. gallus
cagcagcaggaggctg

SEQ ID NO: 536522 - DNA, 16 bp, G. gallus
cagcagcaggcacagc

SEQ ID NO: 536523 - DNA, 16 bp, G. gallus
cagcagcaggcagcag

SEQ ID NO: 536524 - DNA, 16 bp, G. gallus
cagcagcagggctggg

SEQ ID NO: 536525 - DNA, 16 bp, G. gallus
cagcagcagtgctggg

SEQ ID NO: 536526 - DNA, 16 bp, G. gallus
cagcagcccagcagca

SEQ ID NO: 536527 - DNA, 16 bp, G. gallus
cagcagcgtgcccagg

SEQ ID NO: 536528 - DNA, 16 bp, G. gallus
cagcagctcagcactg

SEQ ID NO: 536529 - DNA, 16 bp, G. gallus
cagcagctcaggctgc

SEQ ID NO: 536530 - DNA, 16 bp, G. gallus
cagcagctcccccagc

SEQ ID NO: 536531 - DNA, 16 bp, G. gallus
cagcagctcctcctgc

SEQ ID NO: 536532 - DNA, 16 bp, G. gallus
cagcagctcctgctgc

SEQ ID NO: 536533 - DNA, 16 bp, G. gallus
cagcagctgctgcagc

SEQ ID NO: 536534 - DNA, 16 bp, G. gallus
cagcagctgctgctgc

SEQ ID NO: 536535 - DNA, 16 bp, G. gallus
cagcagctgtggagca

SEQ ID NO: 536536 - DNA, 22 bp, G. gallus
cagcaggaacagggaagtaatt

SEQ ID NO: 536537 - DNA, 16 bp, G. gallus
cagcaggacaagggaa

SEQ ID NO: 536538 - DNA, 18 bp, G. gallus
cagcaggacaagggggaa

SEQ ID NO: 536539 - DNA, 16 bp, G. gallus
cagcaggagcaaggag

SEQ ID NO: 536540 - DNA, 16 bp, G. gallus
cagcaggagcaggaag

SEQ ID NO: 536541 - DNA, 16 bp, G. gallus
cagcaggagcaggagg

SEQ ID NO: 536542 - DNA, 16 bp, G. gallus
cagcaggcagcagcag

SEQ ID NO: 536543 - DNA, 16 bp, G. gallus
cagcagggagaaggag

SEQ ID NO: 536544 - DNA, 16 bp, G. gallus
cagcagggagagggaa

SEQ ID NO: 536545 - DNA, 16 bp, G. gallus
cagcagggctgtgctg

SEQ ID NO: 536546 - DNA, 16 bp, G. gallus
cagcagtccatggagt

SEQ ID NO: 536547 - DNA, 16 bp, G. gallus
cagcagtgcagagcag

SEQ ID NO: 536548 - DNA, 16 bp, G. gallus
cagcagtgccagcacc

SEQ ID NO: 536549 - DNA, 16 bp, G. gallus
cagcagtgccagcgcc

SEQ ID NO: 536550 - DNA, 16 bp, G. gallus
cagcagtgctgcagca

SEQ ID NO: 536551 - DNA, 16 bp, G. gallus
cagcagtgctgctgct

SEQ ID NO: 536552 - DNA, 16 bp, G. gallus
cagcagtggcagcagt

SEQ ID NO: 536553 - DNA, 16 bp, G. gallus
cagcagtgtgcttttg

SEQ ID NO: 536554 - DNA, 16 bp, G. gallus
cagcagtttttccctt

SEQ ID NO: 536555 - DNA, 16 bp, G. gallus
cagcatgagccagcag

SEQ ID NO: 536556 - DNA, 16 bp, G. gallus
cagcatggagctgtgc

SEQ ID NO: 536557 - DNA, 16 bp, G. gallus
cagccaaccaattcct

SEQ ID NO: 536558 - DNA, 16 bp, G. gallus
cagccaagaaggccaa

SEQ ID NO: 536559 - DNA, 16 bp, G. gallus
cagccacagccacagc

SEQ ID NO: 536560 - DNA, 16 bp, G. gallus
cagccacagctccagc

SEQ ID NO: 536561 - DNA, 16 bp, G. gallus
cagccagccagccagc

SEQ ID NO: 536562 - DNA, 16 bp, G. gallus
cagccagcccatggca

SEQ ID NO: 536563 - DNA, 16 bp, G. gallus
cagccagtcagccaag

SEQ ID NO: 536564 - DNA, 16 bp, G. gallus
cagccatcagcccatc

SEQ ID NO: 536565 - DNA, 16 bp, G. gallus
cagccatgctggtttc

SEQ ID NO: 536566 - DNA, 16 bp, G. gallus
cagccattcctcctcc

SEQ ID NO: 536567 - DNA, 16 bp, G. gallus
cagcccagaaagccaa

SEQ ID NO: 536568 - DNA, 16 bp, G. gallus
cagcccagagcagagc

SEQ ID NO: 536569 - DNA, 17 bp, G. gallus
cagcccaggctgcccag

SEQ ID NO: 536570 - DNA, 16 bp, G. gallus
cagcccatttctccag

SEQ ID NO: 536571 - DNA, 16 bp, G. gallus
cagccccagcacagca

SEQ ID NO: 536572 - DNA, 16 bp, G. gallus
cagccccagcacagcc

SEQ ID NO: 536573 - DNA, 16 bp, G. gallus
cagccccagcactgct

SEQ ID NO: 536574 - DNA, 16 bp, G. gallus
cagccccagccctgca

SEQ ID NO: 536575 - DNA, 16 bp, G. gallus
cagccccagccctgcc

SEQ ID NO: 536576 - DNA, 16 bp, G. gallus
cagccccagctccttc

SEQ ID NO: 536577 - DNA, 16 bp, G. gallus
cagccccagctctcag

SEQ ID NO: 536578 - DNA, 16 bp, G. gallus
cagccctctggtcatc

SEQ ID NO: 536579 - DNA, 16 bp, G. gallus
cagccctctgttcatc

SEQ ID NO: 536580 - DNA, 16 bp, G. gallus
cagccctgcacacagc

SEQ ID NO: 536581 - DNA, 16 bp, G. gallus
cagccctgcagctctg

SEQ ID NO: 536582 - DNA, 16 bp, G. gallus
cagccctgcaggcacc

SEQ ID NO: 536583 - DNA, 16 bp, G. gallus
cagccctgcaggcagc

SEQ ID NO: 536584 - DNA, 16 bp, G. gallus
cagccctgcctgcagc

SEQ ID NO: 536585 - DNA, 16 bp, G. gallus
cagccctgctcccagc

SEQ ID NO: 536586 - DNA, 16 bp, G. gallus
cagccctgctctgctg

SEQ ID NO: 536587 - DNA, 16 bp, G. gallus
cagccctgctgctgct

SEQ ID NO: 536588 - DNA, 16 bp, G. gallus
cagccctgctgctggg

SEQ ID NO: 536589 - DNA, 16 bp, G. gallus
cagccctgctgtgctg

SEQ ID NO: 536590 - DNA, 16 bp, G. gallus
cagccctggaagcaca

SEQ ID NO: 536591 - DNA, 18 bp, G. gallus
cagccctgggagcacagg

SEQ ID NO: 536592 - DNA, 16 bp, G. gallus
cagcctagaaagccaa

SEQ ID NO: 536593 - DNA, 16 bp, G. gallus
cagcctcacctccagc

SEQ ID NO: 536594 - DNA, 16 bp, G. gallus
cagcctcatctggtgg

SEQ ID NO: 536595 - DNA, 16 bp, G. gallus
cagcctcctgctgctg

SEQ ID NO: 536596 - DNA, 16 bp, G. gallus
cagcctctcctcacag

SEQ ID NO: 536597 - DNA, 16 bp, G. gallus
cagcctctgggcagcc

SEQ ID NO: 536598 - DNA, 16 bp, G. gallus
cagcctcttccagtgc

SEQ ID NO: 536599 - DNA, 16 bp, G. gallus
cagcctgagatggtgg

SEQ ID NO: 536600 - DNA, 16 bp, G. gallus
cagcctgagctggtgg

SEQ ID NO: 536601 - DNA, 16 bp, G. gallus
cagcctgcagctcctc

SEQ ID NO: 536602 - DNA, 16 bp, G. gallus
cagcctgctcctgtgc

SEQ ID NO: 536603 - DNA, 16 bp, G. gallus
cagcctggagaagata

SEQ ID NO: 536604 - DNA, 16 bp, G. gallus
cagcctggagaaggga

SEQ ID NO: 536605 - DNA, 16 bp, G. gallus
cagcctggatggggct

SEQ ID NO: 536606 - DNA, 16 bp, G. gallus
cagcctggtttggtgg

SEQ ID NO: 536607 - DNA, 16 bp, G. gallus
cagcctgttccagctc

SEQ ID NO: 536608 - DNA, 16 bp, G. gallus
cagcctgttccagtgt

SEQ ID NO: 536609 - DNA, 16 bp, G. gallus
cagccttctcctctcc

SEQ ID NO: 536610 - DNA, 16 bp, G. gallus
cagcctttctttgtag

SEQ ID NO: 536611 - DNA, 16 bp, G. gallus
cagcgccccctgccgg

SEQ ID NO: 536612 - DNA, 17 bp, G. gallus
cagcgcctcaccgccct

SEQ ID NO: 536613 - DNA, 16 bp, G. gallus
cagcggtgtgcccagg

SEQ ID NO: 536614 - DNA, 16 bp, G. gallus
cagctaatgatggtga

SEQ ID NO: 536615 - DNA, 16 bp, G. gallus
cagctcagaaagccaa

SEQ ID NO: 536616 - DNA, 16 bp, G. gallus
cagctcagaaggccaa

SEQ ID NO: 536617 - DNA, 16 bp, G. gallus
cagctcagagcagagg

SEQ ID NO: 536618 - DNA, 16 bp, G. gallus
cagctccagctgctcc

SEQ ID NO: 536619 - DNA, 16 bp, G. gallus
cagctccatccagcct

SEQ ID NO: 536620 - DNA, 16 bp, G. gallus
cagctcccagccctgc

SEQ ID NO: 536621 - DNA, 16 bp, G. gallus
cagctcccccagccct

SEQ ID NO: 536622 - DNA, 16 bp, G. gallus
cagctccctcagcacc

SEQ ID NO: 536623 - DNA, 16 bp, G. gallus
cagctccctgcagcag

SEQ ID NO: 536624 - DNA, 16 bp, G. gallus
cagctccctgggcagc

SEQ ID NO: 536625 - DNA, 16 bp, G. gallus
cagctcctctgctctg

SEQ ID NO: 536626 - DNA, 16 bp, G. gallus
cagctcctgctgctgc

SEQ ID NO: 536627 - DNA, 16 bp, G. gallus
cagctccttcagcctg

SEQ ID NO: 536628 - DNA, 16 bp, G. gallus
cagctccttgtgcccc

SEQ ID NO: 536629 - DNA, 16 bp, G. gallus
cagctcggggccgtgc

SEQ ID NO: 536630 - DNA, 16 bp, G. gallus
cagctctctgggcagc

SEQ ID NO: 536631 - DNA, 16 bp, G. gallus
cagctctgccagcagc

SEQ ID NO: 536632 - DNA, 16 bp, G. gallus
cagctctgctcccagc

SEQ ID NO: 536633 - DNA, 16 bp, G. gallus
cagctctgctccctgc

SEQ ID NO: 536634 - DNA, 16 bp, G. gallus
cagctctgctctgctc

SEQ ID NO: 536635 - DNA, 16 bp, G. gallus
cagctctgtgctgctg

SEQ ID NO: 536636 - DNA, 16 bp, G. gallus
cagctgaagtgccttt

SEQ ID NO: 536637 - DNA, 16 bp, G. gallus
cagctgcaggagcaca

SEQ ID NO: 536638 - DNA, 16 bp, G. gallus
cagctgcaggcagcag

SEQ ID NO: 536639 - DNA, 16 bp, G. gallus
cagctgctctgcccca

SEQ ID NO: 536640 - DNA, 16 bp, G. gallus
cagctgctgctcaggg

SEQ ID NO: 536641 - DNA, 16 bp, G. gallus
cagctggagtactgca

SEQ ID NO: 536642 - DNA, 16 bp, G. gallus
cagctggatttgactc

SEQ ID NO: 536643 - DNA, 16 bp, G. gallus
cagctggcagccctgc

SEQ ID NO: 536644 - DNA, 16 bp, G. gallus
cagctggccttctggg

SEQ ID NO: 536645 - DNA, 16 bp, G. gallus
cagctgggggttgggg

SEQ ID NO: 536646 - DNA, 16 bp, G. gallus
cagctggtgaaggagc

SEQ ID NO: 536647 - DNA, 16 bp, G. gallus
cagctgtgctgtgctg

SEQ ID NO: 536648 - DNA, 16 bp, G. gallus
cagcttctctggacaa

SEQ ID NO: 536649 - DNA, 16 bp, G. gallus
cagcttctctgggcag

SEQ ID NO: 536650 - DNA, 16 bp, G. gallus
cagcttgtaattggtt

SEQ ID NO: 536651 - DNA, 16 bp, G. gallus
cagctttgtgtcatca

SEQ ID NO: 536652 - DNA, 16 bp, G. gallus
cagctttgttgccttt

SEQ ID NO: 536653 - DNA, 16 bp, G. gallus
cagcttttgaagatct

SEQ ID NO: 536654 - DNA, 16 bp, G. gallus
caggaaagacattgag

SEQ ID NO: 536655 - DNA, 16 bp, G. gallus
caggaaagcatccaga

SEQ ID NO: 536656 - DNA, 16 bp, G. gallus
caggaaagctgaggag

SEQ ID NO: 536657 - DNA, 16 bp, G. gallus
caggaaagctgggaag

SEQ ID NO: 536658 - DNA, 16 bp, G. gallus
caggaaatccagaaag

SEQ ID NO: 536659 - DNA, 16 bp, G. gallus
caggaagaaattattt

SEQ ID NO: 536660 - DNA, 16 bp, G. gallus
caggaagaacttcttt

SEQ ID NO: 536661 - DNA, 16 bp, G. gallus
caggaaggacatggag

SEQ ID NO: 536662 - DNA, 16 bp, G. gallus
caggaaggatgtggag

SEQ ID NO: 536663 - DNA, 16 bp, G. gallus
caggagaagaggaggc

SEQ ID NO: 536664 - DNA, 16 bp, G. gallus
caggagcctgcatgct

SEQ ID NO: 536665 - DNA, 16 bp, G. gallus
caggagctgcagcagc

SEQ ID NO: 536666 - DNA, 16 bp, G. gallus
caggagctgctgctgc

SEQ ID NO: 536667 - DNA, 16 bp, G. gallus
caggaggagctggagg

SEQ ID NO: 536668 - DNA, 16 bp, G. gallus
caggaggagttggaag

SEQ ID NO: 536669 - DNA, 16 bp, G. gallus
caggaggatctgctct

SEQ ID NO: 536670 - DNA, 16 bp, G. gallus
caggaggcattacttt

SEQ ID NO: 536671 - DNA, 16 bp, G. gallus
caggatattccatgat

SEQ ID NO: 536672 - DNA, 16 bp, G. gallus
caggatgagggaggtg

SEQ ID NO: 536673 - DNA, 16 bp, G. gallus
caggatgccatccaga

SEQ ID NO: 536674 - DNA, 16 bp, G. gallus
caggatgcccagggcc

SEQ ID NO: 536675 - DNA, 16 bp, G. gallus
caggatggcactggcc

SEQ ID NO: 536676 - DNA, 16 bp, G. gallus
caggattgccagccac

SEQ ID NO: 536677 - DNA, 16 bp, G. gallus
caggcccacatccagg

SEQ ID NO: 536678 - DNA, 16 bp, G. gallus
caggcctcatccactg

SEQ ID NO: 536679 - DNA, 16 bp, G. gallus
caggctcctcagggca

SEQ ID NO: 536680 - DNA, 16 bp, G. gallus
caggctctgggcaacc

SEQ ID NO: 536681 - DNA, 16 bp, G. gallus
caggctcttgttcatg

SEQ ID NO: 536682 - DNA, 16 bp, G. gallus
caggctgaaggagctg

SEQ ID NO: 536683 - DNA, 16 bp, G. gallus
caggctgagagagctg

SEQ ID NO: 536684 - DNA, 16 bp, G. gallus
caggctgcacagagaa

SEQ ID NO: 536685 - DNA, 29 bp, G. gallus
caggctgcccagagccacatccagcctgg

SEQ ID NO: 536686 - DNA, 16 bp, G. gallus
caggctgcccaggacc

SEQ ID NO: 536687 - DNA, 16 bp, G. gallus
caggctgcccagggcc

SEQ ID NO: 536688 - DNA, 16 bp, G. gallus
caggctgcctggggag

SEQ ID NO: 536689 - DNA, 16 bp, G. gallus
caggctgcctggggcc

SEQ ID NO: 536690 - DNA, 16 bp, G. gallus
caggctggaaggggct

SEQ ID NO: 536691 - DNA, 16 bp, G. gallus
caggctggatggggct

SEQ ID NO: 536692 - DNA, 16 bp, G. gallus
caggctggatggtgct

SEQ ID NO: 536693 - DNA, 28 bp, G. gallus
caggctggatgtggctctgggcagcctg

SEQ ID NO: 536694 - DNA, 16 bp, G. gallus
caggcttcccagggcc

SEQ ID NO: 536695 - DNA, 16 bp, G. gallus
cagggaaataaatagg

SEQ ID NO: 536696 - DNA, 16 bp, G. gallus
cagggacagctacagc

SEQ ID NO: 536697 - DNA, 16 bp, G. gallus
cagggacatctgcagc

SEQ ID NO: 536698 - DNA, 16 bp, G. gallus
cagggacatgacttag

SEQ ID NO: 536699 - DNA, 16 bp, G. gallus
cagggacatgcacagc

SEQ ID NO: 536700 - DNA, 16 bp, G. gallus
cagggagaaggaggtg

SEQ ID NO: 536701 - DNA, 16 bp, G. gallus
cagggagacctcattg

SEQ ID NO: 536702 - DNA, 16 bp, G. gallus
cagggagcacaggcaa

SEQ ID NO: 536703 - DNA, 16 bp, G. gallus
cagggagcagcagcag

SEQ ID NO: 536704 - DNA, 16 bp, G. gallus
cagggagctgctggag

SEQ ID NO: 536705 - DNA, 16 bp, G. gallus
cagggatggggatggg

SEQ ID NO: 536706 - DNA, 16 bp, G. gallus
cagggatggggcaccc

SEQ ID NO: 536707 - DNA, 18 bp, G. gallus
cagggatggggcatccac

SEQ ID NO: 536708 - DNA, 16 bp, G. gallus
cagggatggggcatct

SEQ ID NO: 536709 - DNA, 16 bp, G. gallus
cagggatgtgagaaat

SEQ ID NO: 536710 - DNA, 16 bp, G. gallus
cagggatgtggtggag

SEQ ID NO: 536711 - DNA, 16 bp, G. gallus
cagggcacactgctgc

SEQ ID NO: 536712 - DNA, 17 bp, G. gallus
cagggccaccaacctcc

SEQ ID NO: 536713 - DNA, 16 bp, G. gallus
cagggcccatccatgg

SEQ ID NO: 536714 - DNA, 16 bp, G. gallus
cagggctactctcaag

SEQ ID NO: 536715 - DNA, 16 bp, G. gallus
cagggctgcagctctg

SEQ ID NO: 536716 - DNA, 16 bp, G. gallus
cagggctgtcacccac

SEQ ID NO: 536717 - DNA, 16 bp, G. gallus
cagggctgtgctgcag

SEQ ID NO: 536718 - DNA, 16 bp, G. gallus
caggggagctcagctg

SEQ ID NO: 536719 - DNA, 16 bp, G. gallus
caggggaggggcagct

SEQ ID NO: 536720 - DNA, 16 bp, G. gallus
cagggtctgggattcc

SEQ ID NO: 536721 - DNA, 16 bp, G. gallus
cagggtgctcagagcc

SEQ ID NO: 536722 - DNA, 16 bp, G. gallus
cagggtggtttttttt

SEQ ID NO: 536723 - DNA, 16 bp, G. gallus
caggtaacagcagtag

SEQ ID NO: 536724 - DNA, 16 bp, G. gallus
caggtcttgttgaatg

SEQ ID NO: 536725 - DNA, 17 bp, G. gallus
caggtgaaggcaattca

SEQ ID NO: 536726 - DNA, 23 bp, G. gallus
caggtgaaggcaattcagctgtg

SEQ ID NO: 536727 - DNA, 16 bp, G. gallus
caggtgagaaggtgtg

SEQ ID NO: 536728 - DNA, 16 bp, G. gallus
caggtggcttctgaag

SEQ ID NO: 536729 - DNA, 16 bp, G. gallus
caggtgtgtgtgtgtg

SEQ ID NO: 536730 - DNA, 16 bp, G. gallus
caggttgaccatgagc

SEQ ID NO: 536731 - DNA, 16 bp, G. gallus
caggttgagggagctg

SEQ ID NO: 536732 - DNA, 16 bp, G. gallus
caggttgcccagggcc

SEQ ID NO: 536733 - DNA, 16 bp, G. gallus
caggttggaaaggacc

SEQ ID NO: 536734 - DNA, 16 bp, G. gallus
caggtttaaaaaaaaa

SEQ ID NO: 536735 - DNA, 16 bp, G. gallus
cagtaaacagtccagt

SEQ ID NO: 536736 - DNA, 16 bp, G. gallus
cagtacaagaaagaca

SEQ ID NO: 536737 - DNA, 16 bp, G. gallus
cagtacaagctggagg

SEQ ID NO: 536738 - DNA, 16 bp, G. gallus
cagtacagaaaggaca

SEQ ID NO: 536739 - DNA, 16 bp, G. gallus
cagtacctcaccaccc

SEQ ID NO: 536740 - DNA, 16 bp, G. gallus
cagtacttgaagggaa

SEQ ID NO: 536741 - DNA, 16 bp, G. gallus
cagtatgagaagctga

SEQ ID NO: 536742 - DNA, 16 bp, G. gallus
cagtcaccagagactt

SEQ ID NO: 536743 - DNA, 16 bp, G. gallus
cagtccatccccacca

SEQ ID NO: 536744 - DNA, 16 bp, G. gallus
cagtccctctcctgct

SEQ ID NO: 536745 - DNA, 16 bp, G. gallus
cagtctcttttctcag

SEQ ID NO: 536746 - DNA, 16 bp, G. gallus
cagtctggaaaaaaaa

SEQ ID NO: 536747 - DNA, 16 bp, G. gallus
cagtctggaggagagg

SEQ ID NO: 536748 - DNA, 16 bp, G. gallus
cagtcttctcttctcc

SEQ ID NO: 536749 - DNA, 16 bp, G. gallus
cagtgaggtgctggaa

SEQ ID NO: 536750 - DNA, 16 bp, G. gallus
cagtgataggacaaag

SEQ ID NO: 536751 - DNA, 16 bp, G. gallus
cagtgatgaacaagaa

SEQ ID NO: 536752 - DNA, 16 bp, G. gallus
cagtgatgaagaagag

SEQ ID NO: 536753 - DNA, 16 bp, G. gallus
cagtgatgagtggtgt

SEQ ID NO: 536754 - DNA, 16 bp, G. gallus
cagtgatggggcatcc

SEQ ID NO: 536755 - DNA, 16 bp, G. gallus
cagtgcagaaggaggg

SEQ ID NO: 536756 - DNA, 16 bp, G. gallus
cagtgcagtgctaact

SEQ ID NO: 536757 - DNA, 16 bp, G. gallus
cagtgccaggacagga

SEQ ID NO: 536758 - DNA, 16 bp, G. gallus
cagtgcctcaccaccc

SEQ ID NO: 536759 - DNA, 16 bp, G. gallus
cagtgctgcagcactg

SEQ ID NO: 536760 - DNA, 16 bp, G. gallus
cagtgctggggctgct

SEQ ID NO: 536761 - DNA, 16 bp, G. gallus
cagtgctgtgcagagc

SEQ ID NO: 536762 - DNA, 16 bp, G. gallus
cagtggacaaagggaa

SEQ ID NO: 536763 - DNA, 16 bp, G. gallus
cagtgggatcctgggg

SEQ ID NO: 536764 - DNA, 16 bp, G. gallus
cagtgggatgaggttc

SEQ ID NO: 536765 - DNA, 16 bp, G. gallus
cagtgggcacagcccc

SEQ ID NO: 536766 - DNA, 16 bp, G. gallus
cagtggtgacagtgac

SEQ ID NO: 536767 - DNA, 16 bp, G. gallus
cagtgtgagaagctga

SEQ ID NO: 536768 - DNA, 16 bp, G. gallus
cagtgtgatttttttt

SEQ ID NO: 536769 - DNA, 16 bp, G. gallus
cagtgtgcccttgcag

SEQ ID NO: 536770 - DNA, 16 bp, G. gallus
cagtgtgttatcagca

SEQ ID NO: 536771 - DNA, 16 bp, G. gallus
cagttaaagaaagaaa

SEQ ID NO: 536772 - DNA, 16 bp, G. gallus
cagttcaaaaaagaca

SEQ ID NO: 536773 - DNA, 16 bp, G. gallus
cagttcaaaaccattc

SEQ ID NO: 536774 - DNA, 16 bp, G. gallus
cagttcccatacaaca

SEQ ID NO: 536775 - DNA, 16 bp, G. gallus
cagttccctcaacctc

SEQ ID NO: 536776 - DNA, 16 bp, G. gallus
cagttctgctgactcc

SEQ ID NO: 536777 - DNA, 16 bp, G. gallus
cagtttaaaaccattc

SEQ ID NO: 536778 - DNA, 16 bp, G. gallus
cagtttccatggaaat

SEQ ID NO: 536779 - DNA, 16 bp, G. gallus
catactaccaacatcc

SEQ ID NO: 536780 - DNA, 16 bp, G. gallus
catagaatcacagaat

SEQ ID NO: 536781 - DNA, 16 bp, G. gallus
catagaatcatagaac

SEQ ID NO: 536782 - DNA, 16 bp, G. gallus
catagaatcatagaat

SEQ ID NO: 536783 - DNA, 16 bp, G. gallus
catagaatcatggaat

SEQ ID NO: 536784 - DNA, 16 bp, G. gallus
catagaatcctagaat

SEQ ID NO: 536785 - DNA, 16 bp, G. gallus
catagaatcgtagaat

SEQ ID NO: 536786 - DNA, 16 bp, G. gallus
catagaattatagaat

SEQ ID NO: 536787 - DNA, 16 bp, G. gallus
catagatatatatata

SEQ ID NO: 536788 - DNA, 16 bp, G. gallus
catatatacatatata

SEQ ID NO: 536789 - DNA, 16 bp, G. gallus
catatatgtacatata

SEQ ID NO: 536790 - DNA, 16 bp, G. gallus
catcaaccacaacact

SEQ ID NO: 536791 - DNA, 16 bp, G. gallus
catcaatcaacacccc

SEQ ID NO: 536792 - DNA, 16 bp, G. gallus
catcaccaccacgccc

SEQ ID NO: 536793 - DNA, 16 bp, G. gallus
catcaccaccctctga

SEQ ID NO: 536794 - DNA, 16 bp, G. gallus
catcaccagtggttct

SEQ ID NO: 536795 - DNA, 16 bp, G. gallus
catcactctttctgag

SEQ ID NO: 536796 - DNA, 16 bp, G. gallus
catcagaagagaggtg

SEQ ID NO: 536797 - DNA, 16 bp, G. gallus
catcagcaaactgctg

SEQ ID NO: 536798 - DNA, 16 bp, G. gallus
catcagcaaacttact

SEQ ID NO: 536799 - DNA, 16 bp, G. gallus
catcagcctgacctac

SEQ ID NO: 536800 - DNA, 16 bp, G. gallus
catcagtagcatgatg

SEQ ID NO: 536801 - DNA, 16 bp, G. gallus
catcagtgaatgtcag

SEQ ID NO: 536802 - DNA, 16 bp, G. gallus
catccaacctggcctt

SEQ ID NO: 536803 - DNA, 16 bp, G. gallus
catccacagcttcttt

SEQ ID NO: 536804 - DNA, 16 bp, G. gallus
catccacagggacctg

SEQ ID NO: 536805 - DNA, 16 bp, G. gallus
catccaccagcacccc

SEQ ID NO: 536806 - DNA, 16 bp, G. gallus
catccaccagtacctc

SEQ ID NO: 536807 - DNA, 16 bp, G. gallus
catccacttccaaccc

SEQ ID NO: 536808 - DNA, 16 bp, G. gallus
catccagaatgtggct

SEQ ID NO: 536809 - DNA, 16 bp, G. gallus
catccagatatggagt

SEQ ID NO: 536810 - DNA, 16 bp, G. gallus
catccagcctggcctc

SEQ ID NO: 536811 - DNA, 16 bp, G. gallus
catccagcctggcctg

SEQ ID NO: 536812 - DNA, 17 bp, G. gallus
catccagcctggccttg

SEQ ID NO: 536813 - DNA, 18 bp, G. gallus
catccagcctggccttga

SEQ ID NO: 536814 - DNA, 16 bp, G. gallus
catccaggcctggggc

SEQ ID NO: 536815 - DNA, 16 bp, G. gallus
catccaggtctggagc

SEQ ID NO: 536816 - DNA, 16 bp, G. gallus
catccagtttcaaccc

SEQ ID NO: 536817 - DNA, 16 bp, G. gallus
catccatccctggagg

SEQ ID NO: 536818 - DNA, 16 bp, G. gallus
catccatttgcctccc

SEQ ID NO: 536819 - DNA, 16 bp, G. gallus
catcccagggttctga

SEQ ID NO: 536820 - DNA, 16 bp, G. gallus
catccccaccatgccc

SEQ ID NO: 536821 - DNA, 16 bp, G. gallus
catccctgaaggcact

SEQ ID NO: 536822 - DNA, 16 bp, G. gallus
catccctggaagtgct

SEQ ID NO: 536823 - DNA, 16 bp, G. gallus
catccctggtggtgtt

SEQ ID NO: 536824 - DNA, 16 bp, G. gallus
catcccttgcatcatt

SEQ ID NO: 536825 - DNA, 16 bp, G. gallus
catcctggcttgtata

SEQ ID NO: 536826 - DNA, 18 bp, G. gallus
catcctggcttgtatcag

SEQ ID NO: 536827 - DNA, 16 bp, G. gallus
catcctgggctgcatc

SEQ ID NO: 536828 - DNA, 18 bp, G. gallus
catcgaggccctggagcg

SEQ ID NO: 536829 - DNA, 16 bp, G. gallus
catctacccttttctt

SEQ ID NO: 536830 - DNA, 16 bp, G. gallus
catctcatctcatctc

SEQ ID NO: 536831 - DNA, 16 bp, G. gallus
catctccacacttctt

SEQ ID NO: 536832 - DNA, 16 bp, G. gallus
catctccacatttctt

SEQ ID NO: 536833 - DNA, 16 bp, G. gallus
catctccatccccatc

SEQ ID NO: 536834 - DNA, 16 bp, G. gallus
catctccatggctctg

SEQ ID NO: 536835 - DNA, 16 bp, G. gallus
catctccctgaatgac

SEQ ID NO: 536836 - DNA, 16 bp, G. gallus
catctcccttgccctg

SEQ ID NO: 536837 - DNA, 16 bp, G. gallus
catctgcctctgatgt

SEQ ID NO: 536838 - DNA, 16 bp, G. gallus
catctggagcactgtg

SEQ ID NO: 536839 - DNA, 16 bp, G. gallus
catctggatgtggtgc

SEQ ID NO: 536840 - DNA, 16 bp, G. gallus
catctggttccaaccc

SEQ ID NO: 536841 - DNA, 16 bp, G. gallus
catctgtcatgcagca

SEQ ID NO: 536842 - DNA, 16 bp, G. gallus
catctgtcccacagca

SEQ ID NO: 536843 - DNA, 16 bp, G. gallus
catctgtgtcattgat

SEQ ID NO: 536844 - DNA, 16 bp, G. gallus
catcttcatcaacaac

SEQ ID NO: 536845 - DNA, 16 bp, G. gallus
catcttcatcaatgac

SEQ ID NO: 536846 - DNA, 16 bp, G. gallus
catcttggtgtcatct

SEQ ID NO: 536847 - DNA, 16 bp, G. gallus
catctttatggccctc

SEQ ID NO: 536848 - DNA, 16 bp, G. gallus
catctttcctgtgctg

SEQ ID NO: 536849 - DNA, 16 bp, G. gallus
catgcaatcatagaat

SEQ ID NO: 536850 - DNA, 16 bp, G. gallus
catgcaatgcaatgca

SEQ ID NO: 536851 - DNA, 16 bp, G. gallus
catgcagaaaaaattg

SEQ ID NO: 536852 - DNA, 16 bp, G. gallus
catgcagattcttgtt

SEQ ID NO: 536853 - DNA, 16 bp, G. gallus
catgcagcagcagcag

SEQ ID NO: 536854 - DNA, 16 bp, G. gallus
catgcaggctcttgct

SEQ ID NO: 536855 - DNA, 16 bp, G. gallus
catgcatgcacacaca

SEQ ID NO: 536856 - DNA, 16 bp, G. gallus
catgcccaccaccctc

SEQ ID NO: 536857 - DNA, 16 bp, G. gallus
catggaaactacaatg

SEQ ID NO: 536858 - DNA, 16 bp, G. gallus
catggaaataagtagg

SEQ ID NO: 536859 - DNA, 16 bp, G. gallus
catggaatcatagaat

SEQ ID NO: 536860 - DNA, 16 bp, G. gallus
catggacctgctggag

SEQ ID NO: 536861 - DNA, 16 bp, G. gallus
catggagaaattcagt

SEQ ID NO: 536862 - DNA, 16 bp, G. gallus
catggagctgctggag

SEQ ID NO: 536863 - DNA, 16 bp, G. gallus
catggccaacctgtca

SEQ ID NO: 536864 - DNA, 16 bp, G. gallus
catggcttcatcaagg

SEQ ID NO: 536865 - DNA, 16 bp, G. gallus
catgggggaaaaaaaa

SEQ ID NO: 536866 - DNA, 16 bp, G. gallus
catggggggaaaaaaa

SEQ ID NO: 536867 - DNA, 16 bp, G. gallus
catgtatgtatgtatg

SEQ ID NO: 536868 - DNA, 16 bp, G. gallus
catgtatgtgtgtgtg

SEQ ID NO: 536869 - DNA, 16 bp, G. gallus
catgtccttcaacaca

SEQ ID NO: 536870 - DNA, 16 bp, G. gallus
catgtggaaaaaaaat

SEQ ID NO: 536871 - DNA, 16 bp, G. gallus
catgtggaaaaaaatt

SEQ ID NO: 536872 - DNA, 16 bp, G. gallus
catgtttgtatggaac

SEQ ID NO: 536873 - DNA, 16 bp, G. gallus
cattacaacaaaggtg

SEQ ID NO: 536874 - DNA, 16 bp, G. gallus
cattatcatagaatca

SEQ ID NO: 536875 - DNA, 16 bp, G. gallus
cattcaggttggaaaa

SEQ ID NO: 536876 - DNA, 16 bp, G. gallus
cattcagtacctcagc

SEQ ID NO: 536877 - DNA, 16 bp, G. gallus
cattccccagaagact

SEQ ID NO: 536878 - DNA, 21 bp, G. gallus
cattctacaaacactcttcaa

SEQ ID NO: 536879 - DNA, 16 bp, G. gallus
cattctatgcttctgt

SEQ ID NO: 536880 - DNA, 16 bp, G. gallus
cattctgggctgcaag

SEQ ID NO: 536881 - DNA, 16 bp, G. gallus
cattgacattcattaa

SEQ ID NO: 536882 - DNA, 16 bp, G. gallus
cattgacttcagtggg

SEQ ID NO: 536883 - DNA, 16 bp, G. gallus
cattgataaagatgtt

SEQ ID NO: 536884 - DNA, 16 bp, G. gallus
cattgatgaagatatt

SEQ ID NO: 536885 - DNA, 16 bp, G. gallus
cattgatgaatgtcag

SEQ ID NO: 536886 - DNA, 16 bp, G. gallus
cattgatggagaccaa

SEQ ID NO: 536887 - DNA, 16 bp, G. gallus
catttaaaaaaatgtt

SEQ ID NO: 536888 - DNA, 16 bp, G. gallus
catttaagggctgact

SEQ ID NO: 536889 - DNA, 16 bp, G. gallus
catttcagcaatggtg

SEQ ID NO: 536890 - DNA, 16 bp, G. gallus
catttcagtttttcag

SEQ ID NO: 536891 - DNA, 16 bp, G. gallus
catttctgtggccctt

SEQ ID NO: 536892 - DNA, 16 bp, G. gallus
catttcttcttgtcct

SEQ ID NO: 536893 - DNA, 16 bp, G. gallus
catttctttggagctg

SEQ ID NO: 536894 - DNA, 16 bp, G. gallus
catttgaaaccatttc

SEQ ID NO: 536895 - DNA, 16 bp, G. gallus
cattttccctagtctt

SEQ ID NO: 536896 - DNA, 16 bp, G. gallus
cattttggtcacagca

SEQ ID NO: 536897 - DNA, 16 bp, G. gallus
cattttgtcagactgc

SEQ ID NO: 536898 - DNA, 16 bp, G. gallus
cattttgtcagactgt

SEQ ID NO: 536899 - DNA, 16 bp, G. gallus
cattttgtccagaagg

SEQ ID NO: 536900 - DNA, 16 bp, G. gallus
cattttgtgattctgt

SEQ ID NO: 536901 - DNA, 16 bp, G. gallus
catttttctttaaaaa

SEQ ID NO: 536902 - DNA, 16 bp, G. gallus
catttttggtggattt

SEQ ID NO: 536903 - DNA, 16 bp, G. gallus
catttttgtcagtgat

SEQ ID NO: 536904 - DNA, 16 bp, G. gallus
catttttgtggctctc

SEQ ID NO: 536905 - DNA, 16 bp, G. gallus
ccaaaactgaacacaa

SEQ ID NO: 536906 - DNA, 16 bp, G. gallus
ccaaaggagggctaca

SEQ ID NO: 536907 - DNA, 16 bp, G. gallus
ccaaatatatatatat

SEQ ID NO: 536908 - DNA, 16 bp, G. gallus
ccaacagcttcatgtc

SEQ ID NO: 536909 - DNA, 16 bp, G. gallus
ccaaccaccggaccag

SEQ ID NO: 536910 - DNA, 16 bp, G. gallus
ccaaccccctgctgca

SEQ ID NO: 536911 - DNA, 17 bp, G. gallus
ccaaccccgctctcgct

SEQ ID NO: 536912 - DNA, 16 bp, G. gallus
ccaacccctgctccag

SEQ ID NO: 536913 - DNA, 16 bp, G. gallus
ccaacctgaacctcct

SEQ ID NO: 536914 - DNA, 16 bp, G. gallus
ccaactcaaacaattt

SEQ ID NO: 536915 - DNA, 16 bp, G. gallus
ccaactccctgcagtg

SEQ ID NO: 536916 - DNA, 16 bp, G. gallus
ccaagatggacccctg

SEQ ID NO: 536917 - DNA, 16 bp, G. gallus
ccaagccatggactgc

SEQ ID NO: 536918 - DNA, 16 bp, G. gallus
ccaagccattccatga

SEQ ID NO: 536919 - DNA, 16 bp, G. gallus
ccaaggaggagacccc

SEQ ID NO: 536920 - DNA, 18 bp, G. gallus
ccaaggaggctgtgggtg

SEQ ID NO: 536921 - DNA, 16 bp, G. gallus
ccaaggcatggtcact

SEQ ID NO: 536922 - DNA, 16 bp, G. gallus
ccaaggccattctcag

SEQ ID NO: 536923 - DNA, 16 bp, G. gallus
ccaaggccccatccaa

SEQ ID NO: 536924 - DNA, 16 bp, G. gallus
ccaaggtcaggctgac

SEQ ID NO: 536925 - DNA, 16 bp, G. gallus
ccaatggcatcctgga

SEQ ID NO: 536926 - DNA, 16 bp, G. gallus
ccacaaactgaagcat

SEQ ID NO: 536927 - DNA, 16 bp, G. gallus
ccacaacccaggtgca

SEQ ID NO: 536928 - DNA, 18 bp, G. gallus
ccacaacctccttggaca

SEQ ID NO: 536929 - DNA, 16 bp, G. gallus
ccacaacctctctgag

SEQ ID NO: 536930 - DNA, 16 bp, G. gallus
ccacaatgaccattga

SEQ ID NO: 536931 - DNA, 16 bp, G. gallus
ccacacagcagctttc

SEQ ID NO: 536932 - DNA, 16 bp, G. gallus
ccacacagctttccag

SEQ ID NO: 536933 - DNA, 16 bp, G. gallus
ccacagcctcactggg

SEQ ID NO: 536934 - DNA, 16 bp, G. gallus
ccacagcctccctggg

SEQ ID NO: 536935 - DNA, 16 bp, G. gallus
ccacagctccatcagg

SEQ ID NO: 536936 - DNA, 16 bp, G. gallus
ccacagctgaaacaca

SEQ ID NO: 536937 - DNA, 16 bp, G. gallus
ccacagcttgatcagg

SEQ ID NO: 536938 - DNA, 16 bp, G. gallus
ccacagttcttgagca

SEQ ID NO: 536939 - DNA, 16 bp, G. gallus
ccacatctcccaccag

SEQ ID NO: 536940 - DNA, 16 bp, G. gallus
ccacatggaaaaaatg

SEQ ID NO: 536941 - DNA, 16 bp, G. gallus
ccacattccagatggc

SEQ ID NO: 536942 - DNA, 16 bp, G. gallus
ccaccaacatctacct

SEQ ID NO: 536943 - DNA, 16 bp, G. gallus
ccaccaacatctgctt

SEQ ID NO: 536944 - DNA, 16 bp, G. gallus
ccaccacaggcagggc

SEQ ID NO: 536945 - DNA, 16 bp, G. gallus
ccaccaccaccctggg

SEQ ID NO: 536946 - DNA, 16 bp, G. gallus
ccaccagagcaggctg

SEQ ID NO: 536947 - DNA, 16 bp, G. gallus
ccaccagatcaggctg

SEQ ID NO: 536948 - DNA, 16 bp, G. gallus
ccaccagctccctggg

SEQ ID NO: 536949 - DNA, 16 bp, G. gallus
ccaccaggacccccag

SEQ ID NO: 536950 - DNA, 16 bp, G. gallus
ccaccagtacccccag

SEQ ID NO: 536951 - DNA, 16 bp, G. gallus
ccaccatctccctggg

SEQ ID NO: 536952 - DNA, 16 bp, G. gallus
ccaccatgcccactaa

SEQ ID NO: 536953 - DNA, 16 bp, G. gallus
ccaccctcacaaacag

SEQ ID NO: 536954 - DNA, 17 bp, G. gallus
ccaccctctgggggaaa

SEQ ID NO: 536955 - DNA, 16 bp, G. gallus
ccaccctggccttgaa

SEQ ID NO: 536956 - DNA, 16 bp, G. gallus
ccaccctgggcagccc

SEQ ID NO: 536957 - DNA, 16 bp, G. gallus
ccaccgctccctgggc

SEQ ID NO: 536958 - DNA, 16 bp, G. gallus
ccacctcagccagctc

SEQ ID NO: 536959 - DNA, 16 bp, G. gallus
ccacctccctgggcag

SEQ ID NO: 536960 - DNA, 16 bp, G. gallus
ccacctccctgtgcag

SEQ ID NO: 536961 - DNA, 16 bp, G. gallus
ccacctgaggtgagtg

SEQ ID NO: 536962 - DNA, 16 bp, G. gallus
ccacctggacacactg

SEQ ID NO: 536963 - DNA, 16 bp, G. gallus
ccactaacccatgtcc

SEQ ID NO: 536964 - DNA, 16 bp, G. gallus
ccactagtcatggaac

SEQ ID NO: 536965 - DNA, 16 bp, G. gallus
ccactcctgagaagaa

SEQ ID NO: 536966 - DNA, 16 bp, G. gallus
ccactctgggcaacct

SEQ ID NO: 536967 - DNA, 16 bp, G. gallus
ccactctttccaagaa

SEQ ID NO: 536968 - DNA, 16 bp, G. gallus
ccactctttctgagga

SEQ ID NO: 536969 - DNA, 16 bp, G. gallus
ccactgaccacatccc

SEQ ID NO: 536970 - DNA, 16 bp, G. gallus
ccactgaggataagga

SEQ ID NO: 536971 - DNA, 16 bp, G. gallus
ccactgctcagcctgt

SEQ ID NO: 536972 - DNA, 16 bp, G. gallus
ccactgctgaaacata

SEQ ID NO: 536973 - DNA, 16 bp, G. gallus
ccactgctgaaatgca

SEQ ID NO: 536974 - DNA, 16 bp, G. gallus
ccactgtccctggagg

SEQ ID NO: 536975 - DNA, 16 bp, G. gallus
ccagaaaagggccaca

SEQ ID NO: 536976 - DNA, 16 bp, G. gallus
ccagaaggacctggac

SEQ ID NO: 536977 - DNA, 16 bp, G. gallus
ccagagaggtggtggt

SEQ ID NO: 536978 - DNA, 16 bp, G. gallus
ccagagagtttgtgga

SEQ ID NO: 536979 - DNA, 16 bp, G. gallus
ccagagccctcacagc

SEQ ID NO: 536980 - DNA, 16 bp, G. gallus
ccagaggacctcacgg

SEQ ID NO: 536981 - DNA, 16 bp, G. gallus
ccagaggagggccaca

SEQ ID NO: 536982 - DNA, 16 bp, G. gallus
ccagaggctgtggagt

SEQ ID NO: 536983 - DNA, 16 bp, G. gallus
ccagagggggaaaaaa

SEQ ID NO: 536984 - DNA, 17 bp, G. gallus
ccagagggtggtgatgc

SEQ ID NO: 536985 - DNA, 16 bp, G. gallus
ccagagttcaaggagc

SEQ ID NO: 536986 - DNA, 16 bp, G. gallus
ccagatgacctccaga

SEQ ID NO: 536987 - DNA, 16 bp, G. gallus
ccagatgatatccatc

SEQ ID NO: 536988 - DNA, 16 bp, G. gallus
ccagatggaggaggag

SEQ ID NO: 536989 - DNA, 16 bp, G. gallus
ccagatggcctttaag

SEQ ID NO: 536990 - DNA, 16 bp, G. gallus
ccagatgtggtctcac

SEQ ID NO: 536991 - DNA, 16 bp, G. gallus
ccagcaatgtgtgctt

SEQ ID NO: 536992 - DNA, 16 bp, G. gallus
ccagcacagcacagca

SEQ ID NO: 536993 - DNA, 16 bp, G. gallus
ccagcacaggaaagat

SEQ ID NO: 536994 - DNA, 16 bp, G. gallus
ccagcacctcactgcc

SEQ ID NO: 536995 - DNA, 16 bp, G. gallus
ccagcacctgaccacc

SEQ ID NO: 536996 - DNA, 16 bp, G. gallus
ccagcactgcctgcag

SEQ ID NO: 536997 - DNA, 16 bp, G. gallus
ccagcactgctgccca

SEQ ID NO: 536998 - DNA, 16 bp, G. gallus
ccagcagagcaaggga

SEQ ID NO: 536999 - DNA, 16 bp, G. gallus
ccagcagatcaggctg

SEQ ID NO: 537000 - DNA, 16 bp, G. gallus
ccagcagcacagccag

SEQ ID NO: 537001 - DNA, 16 bp, G. gallus
ccagcagcagcagcac

SEQ ID NO: 537002 - DNA, 16 bp, G. gallus
ccagcagcagcagcag

SEQ ID NO: 537003 - DNA, 16 bp, G. gallus
ccagcagcagcaggga

SEQ ID NO: 537004 - DNA, 16 bp, G. gallus
ccagcagcagctcagc

SEQ ID NO: 537005 - DNA, 16 bp, G. gallus
ccagcaggagcaagga

SEQ ID NO: 537006 - DNA, 16 bp, G. gallus
ccagcaggagcaggag

SEQ ID NO: 537007 - DNA, 16 bp, G. gallus
ccagcaggttgaagga

SEQ ID NO: 537008 - DNA, 16 bp, G. gallus
ccagcagtgctgctgg

SEQ ID NO: 537009 - DNA, 16 bp, G. gallus
ccagccatcttgtacc

SEQ ID NO: 537010 - DNA, 16 bp, G. gallus
ccagcccacagcaagg

SEQ ID NO: 537011 - DNA, 16 bp, G. gallus
ccagcccacagcaggg

SEQ ID NO: 537012 - DNA, 16 bp, G. gallus
ccagcccagccagctt

SEQ ID NO: 537013 - DNA, 16 bp, G. gallus
ccagccctgctgctgg

SEQ ID NO: 537014 - DNA, 16 bp, G. gallus
ccagcctgcagcaggg

SEQ ID NO: 537015 - DNA, 16 bp, G. gallus
ccagcctggccttgca

SEQ ID NO: 537016 - DNA, 16 bp, G. gallus
ccagccttaatgattc

SEQ ID NO: 537017 - DNA, 16 bp, G. gallus
ccagcctttatgattc

SEQ ID NO: 537018 - DNA, 16 bp, G. gallus
ccagcgcctcaccgcc

SEQ ID NO: 537019 - DNA, 16 bp, G. gallus
ccagctcactcagcct

SEQ ID NO: 537020 - DNA, 16 bp, G. gallus
ccagctcagcctgccc

SEQ ID NO: 537021 - DNA, 16 bp, G. gallus
ccagctcccatctccc

SEQ ID NO: 537022 - DNA, 16 bp, G. gallus
ccagctccctcaacct

SEQ ID NO: 537023 - DNA, 16 bp, G. gallus
ccaggactcccaggtc

SEQ ID NO: 537024 - DNA, 16 bp, G. gallus
ccaggagcagcagcag

SEQ ID NO: 537025 - DNA, 16 bp, G. gallus
ccaggatgctgctggc

SEQ ID NO: 537026 - DNA, 16 bp, G. gallus
ccaggatggcactggc

SEQ ID NO: 537027 - DNA, 16 bp, G. gallus
ccaggcacagagatga

SEQ ID NO: 537028 - DNA, 16 bp, G. gallus
ccaggcctggggccct

SEQ ID NO: 537029 - DNA, 24 bp, G. gallus
ccaggctgcccagagccacatcca

SEQ ID NO: 537030 - DNA, 16 bp, G. gallus
ccaggctgctcacagc

SEQ ID NO: 537031 - DNA, 16 bp, G. gallus
ccaggctggatgcagc

SEQ ID NO: 537032 - DNA, 29 bp, G. gallus
ccaggctggatgtggctctgggcagcctg

SEQ ID NO: 537033 - DNA, 16 bp, G. gallus
ccagggaactacaggc

SEQ ID NO: 537034 - DNA, 16 bp, G. gallus
ccagggaaggttatgg

SEQ ID NO: 537035 - DNA, 16 bp, G. gallus
ccagggaggtggtggt

SEQ ID NO: 537036 - DNA, 16 bp, G. gallus
ccagggagttggtgga

SEQ ID NO: 537037 - DNA, 16 bp, G. gallus
ccagggatggagactc

SEQ ID NO: 537038 - DNA, 16 bp, G. gallus
ccagggatggagcacc

SEQ ID NO: 537039 - DNA, 16 bp, G. gallus
ccagggatgggcaccc

SEQ ID NO: 537040 - DNA, 16 bp, G. gallus
ccagggatggtgactc

SEQ ID NO: 537041 - DNA, 16 bp, G. gallus
ccaggtggccaagaag

SEQ ID NO: 537042 - DNA, 16 bp, G. gallus
ccagtacaagaaagat

SEQ ID NO: 537043 - DNA, 16 bp, G. gallus
ccagtacctgaagggg

SEQ ID NO: 537044 - DNA, 16 bp, G. gallus
ccagtctgtgattctg

SEQ ID NO: 537045 - DNA, 16 bp, G. gallus
ccagtgccaggacaag

SEQ ID NO: 537046 - DNA, 16 bp, G. gallus
ccagtgctgagtatag

SEQ ID NO: 537047 - DNA, 16 bp, G. gallus
ccagtggagggccaca

SEQ ID NO: 537048 - DNA, 16 bp, G. gallus
ccagtggcagtcagcc

SEQ ID NO: 537049 - DNA, 16 bp, G. gallus
ccagtgtctcactgcc

SEQ ID NO: 537050 - DNA, 16 bp, G. gallus
ccataaacattcagca

SEQ ID NO: 537051 - DNA, 17 bp, G. gallus
ccatatcttgtagctcc

SEQ ID NO: 537052 - DNA, 17 bp, G. gallus
ccatcaccagtagttct

SEQ ID NO: 537053 - DNA, 16 bp, G. gallus
ccatcagtggttcagg

SEQ ID NO: 537054 - DNA, 16 bp, G. gallus
ccatcataaaaggcca

SEQ ID NO: 537055 - DNA, 16 bp, G. gallus
ccatccaacctagcct

SEQ ID NO: 537056 - DNA, 16 bp, G. gallus
ccatccatcaaatcca

SEQ ID NO: 537057 - DNA, 16 bp, G. gallus
ccatccgacctggcct

SEQ ID NO: 537058 - DNA, 16 bp, G. gallus
ccatctgcaaggcaga

SEQ ID NO: 537059 - DNA, 16 bp, G. gallus
ccatctgctgccatct

SEQ ID NO: 537060 - DNA, 16 bp, G. gallus
ccatgaatgcctccag

SEQ ID NO: 537061 - DNA, 16 bp, G. gallus
ccatgactcagcagtt

SEQ ID NO: 537062 - DNA, 16 bp, G. gallus
ccatgagcagggctgc

SEQ ID NO: 537063 - DNA, 16 bp, G. gallus
ccatgaggatgatcag

SEQ ID NO: 537064 - DNA, 16 bp, G. gallus
ccatgccagtgcctga

SEQ ID NO: 537065 - DNA, 16 bp, G. gallus
ccatggaaataaagag

SEQ ID NO: 537066 - DNA, 16 bp, G. gallus
ccatggccttgggcac

SEQ ID NO: 537067 - DNA, 16 bp, G. gallus
ccatgtccttcctgtg

SEQ ID NO: 537068 - DNA, 16 bp, G. gallus
ccattccgtgattcta

SEQ ID NO: 537069 - DNA, 16 bp, G. gallus
ccattccttcttgtcc

SEQ ID NO: 537070 - DNA, 16 bp, G. gallus
ccattctgtgattctt

SEQ ID NO: 537071 - DNA, 17 bp, G. gallus
ccattgaccacgactct

SEQ ID NO: 537072 - DNA, 16 bp, G. gallus
ccattgtatgattcta

SEQ ID NO: 537073 - DNA, 16 bp, G. gallus
ccatttgtaaacccat

SEQ ID NO: 537074 - DNA, 16 bp, G. gallus
cccaagtgccagagtt

SEQ ID NO: 537075 - DNA, 16 bp, G. gallus
cccacagctccagcag

SEQ ID NO: 537076 - DNA, 16 bp, G. gallus
cccaccactcctgggc

SEQ ID NO: 537077 - DNA, 16 bp, G. gallus
cccactgctgctgtca

SEQ ID NO: 537078 - DNA, 16 bp, G. gallus
cccactgtctatgtca

SEQ ID NO: 537079 - DNA, 16 bp, G. gallus
cccagaagatgggaac

SEQ ID NO: 537080 - DNA, 16 bp, G. gallus
cccagacaggctgtgg

SEQ ID NO: 537081 - DNA, 16 bp, G. gallus
cccagagaagctgcag

SEQ ID NO: 537082 - DNA, 16 bp, G. gallus
cccagagaggtgttgg

SEQ ID NO: 537083 - DNA, 18 bp, G. gallus
cccagagccacatccagt

SEQ ID NO: 537084 - DNA, 16 bp, G. gallus
cccagcacagcacagc

SEQ ID NO: 537085 - DNA, 16 bp, G. gallus
cccagcactgccagcc

SEQ ID NO: 537086 - DNA, 16 bp, G. gallus
cccagcagcagctcag

SEQ ID NO: 537087 - DNA, 16 bp, G. gallus
cccagcagcagggctg

SEQ ID NO: 537088 - DNA, 16 bp, G. gallus
cccagcaggtccttgc

SEQ ID NO: 537089 - DNA, 16 bp, G. gallus
cccagcccacagcagg

SEQ ID NO: 537090 - DNA, 16 bp, G. gallus
cccagccctgcagcac

SEQ ID NO: 537091 - DNA, 16 bp, G. gallus
cccagccctgctgcag

SEQ ID NO: 537092 - DNA, 16 bp, G. gallus
cccagccctgctgctg

SEQ ID NO: 537093 - DNA, 16 bp, G. gallus
cccagctccttcagcc

SEQ ID NO: 537094 - DNA, 16 bp, G. gallus
cccagctctcagcctg

SEQ ID NO: 537095 - DNA, 16 bp, G. gallus
cccagctctctcagac

SEQ ID NO: 537096 - DNA, 16 bp, G. gallus
cccagctctgctgctg

SEQ ID NO: 537097 - DNA, 22 bp, G. gallus
cccaggaatgtcacgtaggcag

SEQ ID NO: 537098 - DNA, 16 bp, G. gallus
cccaggatacagctgg

SEQ ID NO: 537099 - DNA, 16 bp, G. gallus
cccagggaagtccatc

SEQ ID NO: 537100 - DNA, 16 bp, G. gallus
cccagggagatggtgg

SEQ ID NO: 537101 - DNA, 16 bp, G. gallus
cccagggccccatcct

SEQ ID NO: 537102 - DNA, 16 bp, G. gallus
cccagggctggctgtg

SEQ ID NO: 537103 - DNA, 16 bp, G. gallus
cccaggtctctcagcc

SEQ ID NO: 537104 - DNA, 16 bp, G. gallus
cccagtacaagaaaga

SEQ ID NO: 537105 - DNA, 16 bp, G. gallus
cccagtaccaagccct

SEQ ID NO: 537106 - DNA, 16 bp, G. gallus
cccagtgaggtggtgg

SEQ ID NO: 537107 - DNA, 16 bp, G. gallus
cccagtgctggaggtg

SEQ ID NO: 537108 - DNA, 16 bp, G. gallus
cccagttccttcagcc

SEQ ID NO: 537109 - DNA, 16 bp, G. gallus
cccataacatcctcat

SEQ ID NO: 537110 - DNA, 16 bp, G. gallus
cccatccaacccagcc

SEQ ID NO: 537111 - DNA, 16 bp, G. gallus
cccatccccgccatgc

SEQ ID NO: 537112 - DNA, 16 bp, G. gallus
cccatccctggaggcg

SEQ ID NO: 537113 - DNA, 16 bp, G. gallus
cccatctggagtactg

SEQ ID NO: 537114 - DNA, 16 bp, G. gallus
cccatggaggagcagg

SEQ ID NO: 537115 - DNA, 16 bp, G. gallus
cccatggaggtggatc

SEQ ID NO: 537116 - DNA, 16 bp, G. gallus
cccatggcaggggttg

SEQ ID NO: 537117 - DNA, 16 bp, G. gallus
cccattaaaccatgtc

SEQ ID NO: 537118 - DNA, 16 bp, G. gallus
cccattacaagtggtg

SEQ ID NO: 537119 - DNA, 16 bp, G. gallus
cccattccaacagctc

SEQ ID NO: 537120 - DNA, 16 bp, G. gallus
cccattccagcacctg

SEQ ID NO: 537121 - DNA, 16 bp, G. gallus
cccattgctcagcaac

SEQ ID NO: 537122 - DNA, 16 bp, G. gallus
cccatttaagggctga

SEQ ID NO: 537123 - DNA, 18 bp, G. gallus
ccccaagcctccaggtgg

SEQ ID NO: 537124 - DNA, 16 bp, G. gallus
ccccaagcctgcagca

SEQ ID NO: 537125 - DNA, 16 bp, G. gallus
ccccaccactccctgg

SEQ ID NO: 537126 - DNA, 16 bp, G. gallus
ccccaccatgaccact

SEQ ID NO: 537127 - DNA, 16 bp, G. gallus
ccccagcactgagccc

SEQ ID NO: 537128 - DNA, 16 bp, G. gallus
ccccagccctgcagca

SEQ ID NO: 537129 - DNA, 16 bp, G. gallus
ccccagggggctttgc

SEQ ID NO: 537130 - DNA, 16 bp, G. gallus
ccccatccaacctggt

SEQ ID NO: 537131 - DNA, 16 bp, G. gallus
ccccatccccagaggt

SEQ ID NO: 537132 - DNA, 16 bp, G. gallus
ccccatccctgaaggc

SEQ ID NO: 537133 - DNA, 16 bp, G. gallus
cccccaagtccttctt

SEQ ID NO: 537134 - DNA, 16 bp, G. gallus
cccccacaattcagga

SEQ ID NO: 537135 - DNA, 16 bp, G. gallus
cccccagcagctcagg

SEQ ID NO: 537136 - DNA, 16 bp, G. gallus
ccccccatgcccactg

SEQ ID NO: 537137 - DNA, 16 bp, G. gallus
cccccccagctcaggc

SEQ ID NO: 537138 - DNA, 16 bp, G. gallus
ccccctgctggagcag

SEQ ID NO: 537139 - DNA, 16 bp, G. gallus
ccccgagctgctggag

SEQ ID NO: 537140 - DNA, 16 bp, G. gallus
ccccggagccttctcc

SEQ ID NO: 537141 - DNA, 16 bp, G. gallus
cccctacaattctgtg

SEQ ID NO: 537142 - DNA, 16 bp, G. gallus
cccctctctggaagca

SEQ ID NO: 537143 - DNA, 16 bp, G. gallus
cccctctgggcagcct

SEQ ID NO: 537144 - DNA, 16 bp, G. gallus
cccctgcaatgaatgg

SEQ ID NO: 537145 - DNA, 16 bp, G. gallus
cccctgccatgggctg

SEQ ID NO: 537146 - DNA, 19 bp, G. gallus
cccctgctatgtgcagggt

SEQ ID NO: 537147 - DNA, 16 bp, G. gallus
cccctggcacagctcc

SEQ ID NO: 537148 - DNA, 16 bp, G. gallus
cccctgtgcttttgcc

SEQ ID NO: 537149 - DNA, 16 bp, G. gallus
ccccttcagatactga

SEQ ID NO: 537150 - DNA, 16 bp, G. gallus
cccctttgctgccatc

SEQ ID NO: 537151 - DNA, 16 bp, G. gallus
cccgggagaagaggct

SEQ ID NO: 537152 - DNA, 16 bp, G. gallus
ccctcaccagcttcat

SEQ ID NO: 537153 - DNA, 16 bp, G. gallus
ccctcagcaccacatc

SEQ ID NO: 537154 - DNA, 16 bp, G. gallus
ccctcagtacaacatc

SEQ ID NO: 537155 - DNA, 16 bp, G. gallus
ccctcagtgccacatc

SEQ ID NO: 537156 - DNA, 16 bp, G. gallus
ccctcatcctattgct

SEQ ID NO: 537157 - DNA, 16 bp, G. gallus
ccctccagggatgggg

SEQ ID NO: 537158 - DNA, 16 bp, G. gallus
ccctcctcttgctgtt

SEQ ID NO: 537159 - DNA, 16 bp, G. gallus
ccctcctgctgtgggc

SEQ ID NO: 537160 - DNA, 16 bp, G. gallus
ccctctactctgccct

SEQ ID NO: 537161 - DNA, 16 bp, G. gallus
ccctctgctctgcctt

SEQ ID NO: 537162 - DNA, 16 bp, G. gallus
ccctctgctgccgtct

SEQ ID NO: 537163 - DNA, 16 bp, G. gallus
ccctctggatggcacc

SEQ ID NO: 537164 - DNA, 16 bp, G. gallus
ccctgaaaatgctaca

SEQ ID NO: 537165 - DNA, 16 bp, G. gallus
ccctgagcagcagctg

SEQ ID NO: 537166 - DNA, 16 bp, G. gallus
ccctgagctgctggag

SEQ ID NO: 537167 - DNA, 16 bp, G. gallus
ccctgagtaccacatc

SEQ ID NO: 537168 - DNA, 16 bp, G. gallus
ccctgcagacagccac

SEQ ID NO: 537169 - DNA, 16 bp, G. gallus
ccctgcagacattcaa

SEQ ID NO: 537170 - DNA, 16 bp, G. gallus
ccctgcagcagcagca

SEQ ID NO: 537171 - DNA, 16 bp, G. gallus
ccctgccatgggcaga

SEQ ID NO: 537172 - DNA, 16 bp, G. gallus
ccctgccatgggctgg

SEQ ID NO: 537173 - DNA, 16 bp, G. gallus
ccctgcccatggcagg

SEQ ID NO: 537174 - DNA, 16 bp, G. gallus
ccctgctataggcagg

SEQ ID NO: 537175 - DNA, 16 bp, G. gallus
ccctgctatgtgcagt

SEQ ID NO: 537176 - DNA, 16 bp, G. gallus
ccctgctcacagcagg

SEQ ID NO: 537177 - DNA, 16 bp, G. gallus
ccctgctcctgctggc

SEQ ID NO: 537178 - DNA, 16 bp, G. gallus
ccctgctgcaggctgg

SEQ ID NO: 537179 - DNA, 16 bp, G. gallus
ccctgctggccacact

SEQ ID NO: 537180 - DNA, 16 bp, G. gallus
ccctgctggccacctc

SEQ ID NO: 537181 - DNA, 16 bp, G. gallus
ccctgctggggcaggg

SEQ ID NO: 537182 - DNA, 16 bp, G. gallus
ccctgctttgagcagg

SEQ ID NO: 537183 - DNA, 16 bp, G. gallus
ccctggagccctctct

SEQ ID NO: 537184 - DNA, 16 bp, G. gallus
ccctggaggtgttcag

SEQ ID NO: 537185 - DNA, 16 bp, G. gallus
ccctgggcagcccctt

SEQ ID NO: 537186 - DNA, 16 bp, G. gallus
ccctggtccccacctg

SEQ ID NO: 537187 - DNA, 16 bp, G. gallus
ccctggtgagaccaca

SEQ ID NO: 537188 - DNA, 17 bp, G. gallus
ccctgtggtggaattcg

SEQ ID NO: 537189 - DNA, 16 bp, G. gallus
cccttaaatgaggtct

SEQ ID NO: 537190 - DNA, 16 bp, G. gallus
cccttcccagtgggat

SEQ ID NO: 537191 - DNA, 16 bp, G. gallus
ccctttccctgctggc

SEQ ID NO: 537192 - DNA, 16 bp, G. gallus
ccctttggctgcatcc

SEQ ID NO: 537193 - DNA, 16 bp, G. gallus
ccgagccgagccgtgc

SEQ ID NO: 537194 - DNA, 16 bp, G. gallus
ccgccagggggcgctg

SEQ ID NO: 537195 - DNA, 16 bp, G. gallus
ccgctgctgctgctgc

SEQ ID NO: 537196 - DNA, 16 bp, G. gallus
ccggcagggggcgctg

SEQ ID NO: 537197 - DNA, 16 bp, G. gallus
ccgtgcctcagtttcc

SEQ ID NO: 537198 - DNA, 16 bp, G. gallus
cctaacaaccctctgc

SEQ ID NO: 537199 - DNA, 16 bp, G. gallus
cctacaacaggtcaca

SEQ ID NO: 537200 - DNA, 16 bp, G. gallus
cctacagaaggatctg

SEQ ID NO: 537201 - DNA, 16 bp, G. gallus
cctagagccttctctt

SEQ ID NO: 537202 - DNA, 16 bp, G. gallus
cctcaacctgctggcc

SEQ ID NO: 537203 - DNA, 16 bp, G. gallus
cctcacaaacagccat

SEQ ID NO: 537204 - DNA, 16 bp, G. gallus
cctcaccacccttatt

SEQ ID NO: 537205 - DNA, 16 bp, G. gallus
cctcaccctgctggct

SEQ ID NO: 537206 - DNA, 16 bp, G. gallus
cctcactgcggccttc

SEQ ID NO: 537207 - DNA, 16 bp, G. gallus
cctcactgtgctcaca

SEQ ID NO: 537208 - DNA, 16 bp, G. gallus
cctcactgtgctgaca

SEQ ID NO: 537209 - DNA, 16 bp, G. gallus
cctcagattgttgctg

SEQ ID NO: 537210 - DNA, 16 bp, G. gallus
cctcagcctcctcttc

SEQ ID NO: 537211 - DNA, 16 bp, G. gallus
cctcagcctccttttc

SEQ ID NO: 537212 - DNA, 16 bp, G. gallus
cctcagcctgctggcc

SEQ ID NO: 537213 - DNA, 16 bp, G. gallus
cctcagctgttcctca

SEQ ID NO: 537214 - DNA, 16 bp, G. gallus
cctcaggtggtcatga

SEQ ID NO: 537215 - DNA, 16 bp, G. gallus
cctcagtgccacagcc

SEQ ID NO: 537216 - DNA, 16 bp, G. gallus
cctcagtgtgcccagc

SEQ ID NO: 537217 - DNA, 16 bp, G. gallus
cctcatccaggtcatc

SEQ ID NO: 537218 - DNA, 16 bp, G. gallus
cctcattgtggccttc

SEQ ID NO: 537219 - DNA, 16 bp, G. gallus
cctccagagaaggaga

SEQ ID NO: 537220 - DNA, 16 bp, G. gallus
cctccagctcctcctg

SEQ ID NO: 537221 - DNA, 16 bp, G. gallus
cctccagggaaggtga

SEQ ID NO: 537222 - DNA, 16 bp, G. gallus
cctccatggatggtga

SEQ ID NO: 537223 - DNA, 16 bp, G. gallus
cctccatgggcagctg

SEQ ID NO: 537224 - DNA, 16 bp, G. gallus
cctccccagagccttc

SEQ ID NO: 537225 - DNA, 16 bp, G. gallus
cctcccctggcacagc

SEQ ID NO: 537226 - DNA, 16 bp, G. gallus
cctccctgggcaacct

SEQ ID NO: 537227 - DNA, 16 bp, G. gallus
cctcctaatatctaaa

SEQ ID NO: 537228 - DNA, 16 bp, G. gallus
cctcctccaggctgaa

SEQ ID NO: 537229 - DNA, 16 bp, G. gallus
cctcctcttctccagc

SEQ ID NO: 537230 - DNA, 16 bp, G. gallus
cctcctgctcctgctg

SEQ ID NO: 537231 - DNA, 16 bp, G. gallus
cctcctgctgcaggca

SEQ ID NO: 537232 - DNA, 16 bp, G. gallus
cctcctgctgctgctg

SEQ ID NO: 537233 - DNA, 16 bp, G. gallus
cctcctggaagagatg

SEQ ID NO: 537234 - DNA, 18 bp, G. gallus
cctcctggatgacatgct

SEQ ID NO: 537235 - DNA, 16 bp, G. gallus
cctccttccttgcctg

SEQ ID NO: 537236 - DNA, 16 bp, G. gallus
cctccttggagatctt

SEQ ID NO: 537237 - DNA, 24 bp, G. gallus
cctccttgggcaacctgttcagtg

SEQ ID NO: 537238 - DNA, 16 bp, G. gallus
cctctactgaagagca

SEQ ID NO: 537239 - DNA, 16 bp, G. gallus
cctctcagatccccaa

SEQ ID NO: 537240 - DNA, 16 bp, G. gallus
cctctccctgctgcca

SEQ ID NO: 537241 - DNA, 16 bp, G. gallus
cctctcctacgaggac

SEQ ID NO: 537242 - DNA, 16 bp, G. gallus
cctctctgggcagcag

SEQ ID NO: 537243 - DNA, 16 bp, G. gallus
cctctgacatcatgga

SEQ ID NO: 537244 - DNA, 16 bp, G. gallus
cctctgatcattttag

SEQ ID NO: 537245 - DNA, 16 bp, G. gallus
cctctgcaatgaacag

SEQ ID NO: 537246 - DNA, 16 bp, G. gallus
cctctgctctgctctc

SEQ ID NO: 537247 - DNA, 16 bp, G. gallus
cctctgctgccgtctg

SEQ ID NO: 537248 - DNA, 16 bp, G. gallus
cctctggaagtccaag

SEQ ID NO: 537249 - DNA, 16 bp, G. gallus
cctctggggaaaaaaa

SEQ ID NO: 537250 - DNA, 16 bp, G. gallus
cctctgtgaaaaactt

SEQ ID NO: 537251 - DNA, 16 bp, G. gallus
cctcttcatcctggtt

SEQ ID NO: 537252 - DNA, 16 bp, G. gallus
cctcttctccagcctg

SEQ ID NO: 537253 - DNA, 16 bp, G. gallus
cctcttctcccaggtg

SEQ ID NO: 537254 - DNA, 16 bp, G. gallus
cctcttggagcccttc

SEQ ID NO: 537255 - DNA, 16 bp, G. gallus
cctcttttgatgcagt

SEQ ID NO: 537256 - DNA, 16 bp, G. gallus
cctgaaaggaggctgc

SEQ ID NO: 537257 - DNA, 16 bp, G. gallus
cctgaaaggaggctgt

SEQ ID NO: 537258 - DNA, 16 bp, G. gallus
cctgaacctccccagg

SEQ ID NO: 537259 - DNA, 16 bp, G. gallus
cctgaagggaggttgt

SEQ ID NO: 537260 - DNA, 16 bp, G. gallus
cctgaattccaccaca

SEQ ID NO: 537261 - DNA, 16 bp, G. gallus
cctgacaggaggttgt

SEQ ID NO: 537262 - DNA, 16 bp, G. gallus
cctgactgtgagacag

SEQ ID NO: 537263 - DNA, 16 bp, G. gallus
cctgagcaattccatg

SEQ ID NO: 537264 - DNA, 16 bp, G. gallus
cctgagcaccacatcc

SEQ ID NO: 537265 - DNA, 16 bp, G. gallus
cctgagcagcagcagc

SEQ ID NO: 537266 - DNA, 16 bp, G. gallus
cctgagcagcagctgc

SEQ ID NO: 537267 - DNA, 16 bp, G. gallus
cctgagccattctatg

SEQ ID NO: 537268 - DNA, 16 bp, G. gallus
cctgagctgctggagt

SEQ ID NO: 537269 - DNA, 16 bp, G. gallus
cctgagctggtgagtg

SEQ ID NO: 537270 - DNA, 16 bp, G. gallus
cctgagttggaaggga

SEQ ID NO: 537271 - DNA, 16 bp, G. gallus
cctgatctggtggctg

SEQ ID NO: 537272 - DNA, 16 bp, G. gallus
cctgatggccacccct

SEQ ID NO: 537273 - DNA, 16 bp, G. gallus
cctgatgtagctgtag

SEQ ID NO: 537274 - DNA, 16 bp, G. gallus
cctgcacagccccagc

SEQ ID NO: 537275 - DNA, 16 bp, G. gallus
cctgcagcagcacagc

SEQ ID NO: 537276 - DNA, 16 bp, G. gallus
cctgcagctctgctgc

SEQ ID NO: 537277 - DNA, 16 bp, G. gallus
cctgcaggcagcagca

SEQ ID NO: 537278 - DNA, 16 bp, G. gallus
cctgcagtgaacagag

SEQ ID NO: 537279 - DNA, 16 bp, G. gallus
cctgcagtgaacagga

SEQ ID NO: 537280 - DNA, 16 bp, G. gallus
cctgcagtgggcaggg

SEQ ID NO: 537281 - DNA, 16 bp, G. gallus
cctgcccagggaggtg

SEQ ID NO: 537282 - DNA, 16 bp, G. gallus
cctgccccagcaggga

SEQ ID NO: 537283 - DNA, 16 bp, G. gallus
cctgcctatggcagag

SEQ ID NO: 537284 - DNA, 16 bp, G. gallus
cctgcctgcagcaggg

SEQ ID NO: 537285 - DNA, 16 bp, G. gallus
cctgctaaagagtcta

SEQ ID NO: 537286 - DNA, 16 bp, G. gallus
cctgctatatgcaggg

SEQ ID NO: 537287 - DNA, 16 bp, G. gallus
cctgctgaaaaggact

SEQ ID NO: 537288 - DNA, 16 bp, G. gallus
cctgctgcaggcaggg

SEQ ID NO: 537289 - DNA, 16 bp, G. gallus
cctgctgctgctcctc

SEQ ID NO: 537290 - DNA, 16 bp, G. gallus
cctgctgctgctgctg

SEQ ID NO: 537291 - DNA, 16 bp, G. gallus
cctgctggagttcaag

SEQ ID NO: 537292 - DNA, 16 bp, G. gallus
cctgctggccacattt

SEQ ID NO: 537293 - DNA, 16 bp, G. gallus
cctgctggctgcactg

SEQ ID NO: 537294 - DNA, 16 bp, G. gallus
cctgctggctgtgctg

SEQ ID NO: 537295 - DNA, 16 bp, G. gallus
cctggaacgtgtccag

SEQ ID NO: 537296 - DNA, 16 bp, G. gallus
cctggaagcattcaaa

SEQ ID NO: 537297 - DNA, 16 bp, G. gallus
cctggacacagtactg

SEQ ID NO: 537298 - DNA, 16 bp, G. gallus
cctggagaagactgag

SEQ ID NO: 537299 - DNA, 16 bp, G. gallus
cctggagaaggctcag

SEQ ID NO: 537300 - DNA, 16 bp, G. gallus
cctggagaggctgtgg

SEQ ID NO: 537301 - DNA, 16 bp, G. gallus
cctggagcaacttgag

SEQ ID NO: 537302 - DNA, 16 bp, G. gallus
cctggagcatctccct

SEQ ID NO: 537303 - DNA, 16 bp, G. gallus
cctggagccttctctt

SEQ ID NO: 537304 - DNA, 16 bp, G. gallus
cctggagcgtgttcag

SEQ ID NO: 537305 - DNA, 16 bp, G. gallus
cctggagctgttcaag

SEQ ID NO: 537306 - DNA, 16 bp, G. gallus
cctggaggagttcaag

SEQ ID NO: 537307 - DNA, 16 bp, G. gallus
cctggaggcgctcaag

SEQ ID NO: 537308 - DNA, 16 bp, G. gallus
cctggaggtgtttgag

SEQ ID NO: 537309 - DNA, 16 bp, G. gallus
cctggaggttttcaag

SEQ ID NO: 537310 - DNA, 16 bp, G. gallus
cctggatgctttcctg

SEQ ID NO: 537311 - DNA, 16 bp, G. gallus
cctggcactgggcacc

SEQ ID NO: 537312 - DNA, 16 bp, G. gallus
cctggcagcccattcc

SEQ ID NO: 537313 - DNA, 16 bp, G. gallus
cctggcccaagtgcaa

SEQ ID NO: 537314 - DNA, 16 bp, G. gallus
cctggccttaaacacc

SEQ ID NO: 537315 - DNA, 17 bp, G. gallus
cctggccttgaatgcct

SEQ ID NO: 537316 - DNA, 16 bp, G. gallus
cctggctctgcacagg

SEQ ID NO: 537317 - DNA, 16 bp, G. gallus
cctgggaccttgctgc

SEQ ID NO: 537318 - DNA, 16 bp, G. gallus
cctgggaggtggtgga

SEQ ID NO: 537319 - DNA, 16 bp, G. gallus
cctgggagtcctggtg

SEQ ID NO: 537320 - DNA, 16 bp, G. gallus
cctgggcaacctgagc

SEQ ID NO: 537321 - DNA, 16 bp, G. gallus
cctgggcacgctgctg

SEQ ID NO: 537322 - DNA, 16 bp, G. gallus
cctgggcagcctcagc

SEQ ID NO: 537323 - DNA, 16 bp, G. gallus
cctgggcagcctgaga

SEQ ID NO: 537324 - DNA, 16 bp, G. gallus
cctgggcagtctgatc

SEQ ID NO: 537325 - DNA, 16 bp, G. gallus
cctgggcatcctggtc

SEQ ID NO: 537326 - DNA, 16 bp, G. gallus
cctgggctgcactgag

SEQ ID NO: 537327 - DNA, 16 bp, G. gallus
cctgggctggagctgc

SEQ ID NO: 537328 - DNA, 16 bp, G. gallus
cctgggcttgcagaag

SEQ ID NO: 537329 - DNA, 16 bp, G. gallus
cctggggaacaccact

SEQ ID NO: 537330 - DNA, 16 bp, G. gallus
cctggggaagaggagg

SEQ ID NO: 537331 - DNA, 16 bp, G. gallus
cctgggggacaccact

SEQ ID NO: 537332 - DNA, 22 bp, G. gallus
cctgggttgaaaaggaccacaa

SEQ ID NO: 537333 - DNA, 16 bp, G. gallus
cctgggttgcatcaag

SEQ ID NO: 537334 - DNA, 16 bp, G. gallus
cctgggttggtcctgc

SEQ ID NO: 537335 - DNA, 16 bp, G. gallus
cctggtgaagctgtgc

SEQ ID NO: 537336 - DNA, 18 bp, G. gallus
cctggtggtgttcaaaga

SEQ ID NO: 537337 - DNA, 16 bp, G. gallus
cctggtttggtggttg

SEQ ID NO: 537338 - DNA, 16 bp, G. gallus
cctgtagcagtgacag

SEQ ID NO: 537339 - DNA, 16 bp, G. gallus
cctgtatggagccagg

SEQ ID NO: 537340 - DNA, 16 bp, G. gallus
cctgtccagcctggcc

SEQ ID NO: 537341 - DNA, 16 bp, G. gallus
cctgtccttcttgaac

SEQ ID NO: 537342 - DNA, 16 bp, G. gallus
cctgtctgtggcaggg

SEQ ID NO: 537343 - DNA, 16 bp, G. gallus
cctgtgaagacaggct

SEQ ID NO: 537344 - DNA, 16 bp, G. gallus
cctgtgaggaaaggct

SEQ ID NO: 537345 - DNA, 16 bp, G. gallus
cctgtgcagcctgagc

SEQ ID NO: 537346 - DNA, 16 bp, G. gallus
cctgtgccagcatctc

SEQ ID NO: 537347 - DNA, 16 bp, G. gallus
cctgtgccagtgccca

SEQ ID NO: 537348 - DNA, 16 bp, G. gallus
cctgtgctcagcactg

SEQ ID NO: 537349 - DNA, 16 bp, G. gallus
cctgtggtggattcaa

SEQ ID NO: 537350 - DNA, 16 bp, G. gallus
cctgtgtgacctactg

SEQ ID NO: 537351 - DNA, 16 bp, G. gallus
cctgtgtgacctgctg

SEQ ID NO: 537352 - DNA, 16 bp, G. gallus
cctgttaaagagtctg

SEQ ID NO: 537353 - DNA, 16 bp, G. gallus
cctgttcattgcaagg

SEQ ID NO: 537354 - DNA, 16 bp, G. gallus
ccttacagtaaagaat

SEQ ID NO: 537355 - DNA, 16 bp, G. gallus
ccttagagttggaaag

SEQ ID NO: 537356 - DNA, 16 bp, G. gallus
ccttcaacctgctggc

SEQ ID NO: 537357 - DNA, 16 bp, G. gallus
ccttcaccagctgtgt

SEQ ID NO: 537358 - DNA, 16 bp, G. gallus
ccttcagagggatctg

SEQ ID NO: 537359 - DNA, 16 bp, G. gallus
ccttcagatccttctc

SEQ ID NO: 537360 - DNA, 16 bp, G. gallus
ccttcattctccttgt

SEQ ID NO: 537361 - DNA, 16 bp, G. gallus
ccttccaacctcagct

SEQ ID NO: 537362 - DNA, 16 bp, G. gallus
ccttccaactcgggat

SEQ ID NO: 537363 - DNA, 16 bp, G. gallus
ccttccaactctaagg

SEQ ID NO: 537364 - DNA, 16 bp, G. gallus
ccttccaccaggtgct

SEQ ID NO: 537365 - DNA, 16 bp, G. gallus
ccttccccagcagcag

SEQ ID NO: 537366 - DNA, 16 bp, G. gallus
ccttccccatctttgt

SEQ ID NO: 537367 - DNA, 16 bp, G. gallus
ccttcccctggtgaag

SEQ ID NO: 537368 - DNA, 16 bp, G. gallus
ccttccctgcagagct

SEQ ID NO: 537369 - DNA, 16 bp, G. gallus
ccttctccacagagct

SEQ ID NO: 537370 - DNA, 16 bp, G. gallus
ccttctccaggctgca

SEQ ID NO: 537371 - DNA, 16 bp, G. gallus
ccttctcttctccatg

SEQ ID NO: 537372 - DNA, 16 bp, G. gallus
ccttctgctctgccct

SEQ ID NO: 537373 - DNA, 16 bp, G. gallus
ccttctgtcatcacac

SEQ ID NO: 537374 - DNA, 16 bp, G. gallus
ccttgaatgcctccag

SEQ ID NO: 537375 - DNA, 16 bp, G. gallus
ccttgagccttctctt

SEQ ID NO: 537376 - DNA, 16 bp, G. gallus
ccttgcagaagtccag

SEQ ID NO: 537377 - DNA, 16 bp, G. gallus
ccttgcttgctgcagc

SEQ ID NO: 537378 - DNA, 16 bp, G. gallus
ccttggctctgtacaa

SEQ ID NO: 537379 - DNA, 16 bp, G. gallus
ccttggtgaagccatg

SEQ ID NO: 537380 - DNA, 16 bp, G. gallus
ccttgtcctatctcta

SEQ ID NO: 537381 - DNA, 17 bp, G. gallus
ccttgtgaagctgcttt

SEQ ID NO: 537382 - DNA, 16 bp, G. gallus
cctttaagtactggaa

SEQ ID NO: 537383 - DNA, 16 bp, G. gallus
cctttaggaaaaaaaa

SEQ ID NO: 537384 - DNA, 16 bp, G. gallus
cctttctgtactgaga

SEQ ID NO: 537385 - DNA, 16 bp, G. gallus
cctttctttgccctca

SEQ ID NO: 537386 - DNA, 16 bp, G. gallus
cctttgcttttattct

SEQ ID NO: 537387 - DNA, 16 bp, G. gallus
cctttgtccactgatg

SEQ ID NO: 537388 - DNA, 16 bp, G. gallus
cctttgtctgagggac

SEQ ID NO: 537389 - DNA, 17 bp, G. gallus
ccttttcaacccaggcc

SEQ ID NO: 537390 - DNA, 16 bp, G. gallus
ccttttctccaggctg

SEQ ID NO: 537391 - DNA, 16 bp, G. gallus
ccttttgctaaactaa

SEQ ID NO: 537392 - DNA, 16 bp, G. gallus
cctttttttaaaaaaa

SEQ ID NO: 537393 - DNA, 16 bp, G. gallus
cgagaagctggacatg

SEQ ID NO: 537394 - DNA, 16 bp, G. gallus
cgagccgctctccatc

SEQ ID NO: 537395 - DNA, 16 bp, G. gallus
cgagttggaagggacc

SEQ ID NO: 537396 - DNA, 16 bp, G. gallus
cgcaacctctctgggc

SEQ ID NO: 537397 - DNA, 16 bp, G. gallus
cgcagcgcagcgcagc

SEQ ID NO: 537398 - DNA, 17 bp, G. gallus
cgccactgtggtggaat

SEQ ID NO: 537399 - DNA, 16 bp, G. gallus
cgccactgtggtggat

SEQ ID NO: 537400 - DNA, 17 bp, G. gallus
cgccctgtggtggaatt

SEQ ID NO: 537401 - DNA, 16 bp, G. gallus
cgctgctgctgctgct

SEQ ID NO: 537402 - DNA, 16 bp, G. gallus
cggagcggagcggagc

SEQ ID NO: 537403 - DNA, 16 bp, G. gallus
cggcacaggctgccca

SEQ ID NO: 537404 - DNA, 16 bp, G. gallus
cggcagcagcagcagc

SEQ ID NO: 537405 - DNA, 16 bp, G. gallus
cggtgactccaccacc

SEQ ID NO: 537406 - DNA, 16 bp, G. gallus
cgtccagcctgaatct

SEQ ID NO: 537407 - DNA, 16 bp, G. gallus
cgtggctctgggcagc

SEQ ID NO: 537408 - DNA, 16 bp, G. gallus
cgtgtggatgtggcac

SEQ ID NO: 537409 - DNA, 16 bp, G. gallus
cgtttggatgttgtgt

SEQ ID NO: 537410 - DNA, 21 bp, G. gallus
ctaacacaggtggctaacatc

SEQ ID NO: 537411 - DNA, 16 bp, G. gallus
ctaacatccagcctga

SEQ ID NO: 537412 - DNA, 16 bp, G. gallus
ctaaggcaggttccct

SEQ ID NO: 537413 - DNA, 16 bp, G. gallus
ctaagggggaaaaaaa

SEQ ID NO: 537414 - DNA, 17 bp, G. gallus
ctaaggttggaaaagac

SEQ ID NO: 537415 - DNA, 16 bp, G. gallus
ctacaaaacattgttt

SEQ ID NO: 537416 - DNA, 16 bp, G. gallus
ctacaacagataaaaa

SEQ ID NO: 537417 - DNA, 16 bp, G. gallus
ctacaactacctgaag

SEQ ID NO: 537418 - DNA, 16 bp, G. gallus
ctacaaggacagactg

SEQ ID NO: 537419 - DNA, 16 bp, G. gallus
ctacaaggagcaactg

SEQ ID NO: 537420 - DNA, 16 bp, G. gallus
ctacaattctgtgata

SEQ ID NO: 537421 - DNA, 16 bp, G. gallus
ctacaggatcatccag

SEQ ID NO: 537422 - DNA, 16 bp, G. gallus
ctacaggggaaaaaaa

SEQ ID NO: 537423 - DNA, 17 bp, G. gallus
ctaccacaagccactaa

SEQ ID NO: 537424 - DNA, 16 bp, G. gallus
ctacccaagtaaaaag

SEQ ID NO: 537425 - DNA, 16 bp, G. gallus
ctacccccaggcagat

SEQ ID NO: 537426 - DNA, 16 bp, G. gallus
ctactatgaagaaaat

SEQ ID NO: 537427 - DNA, 16 bp, G. gallus
ctactcccaggcagat

SEQ ID NO: 537428 - DNA, 16 bp, G. gallus
ctactctgccctggtg

SEQ ID NO: 537429 - DNA, 16 bp, G. gallus
ctactgcatttttttt

SEQ ID NO: 537430 - DNA, 16 bp, G. gallus
ctagatgaccttcaag

SEQ ID NO: 537431 - DNA, 16 bp, G. gallus
ctataggcttggggca

SEQ ID NO: 537432 - DNA, 16 bp, G. gallus
ctatgatcctatgatc

SEQ ID NO: 537433 - DNA, 16 bp, G. gallus
ctatgattctatgatg

SEQ ID NO: 537434 - DNA, 16 bp, G. gallus
ctattctgcccttgtg

SEQ ID NO: 537435 - DNA, 16 bp, G. gallus
ctatttatttccttgg

SEQ ID NO: 537436 - DNA, 16 bp, G. gallus
ctatttctgagaagaa

SEQ ID NO: 537437 - DNA, 16 bp, G. gallus
ctatttgataaagcaa

SEQ ID NO: 537438 - DNA, 16 bp, G. gallus
ctattttattacgttg

SEQ ID NO: 537439 - DNA, 16 bp, G. gallus
ctcaaacacctccctg

SEQ ID NO: 537440 - DNA, 16 bp, G. gallus
ctcaaacagttctgtg

SEQ ID NO: 537441 - DNA, 17 bp, G. gallus
ctcaaagcttgctgagg

SEQ ID NO: 537442 - DNA, 16 bp, G. gallus
ctcaaccacctccctg

SEQ ID NO: 537443 - DNA, 16 bp, G. gallus
ctcaacctggctgctg

SEQ ID NO: 537444 - DNA, 16 bp, G. gallus
ctcaagaaggaagtct

SEQ ID NO: 537445 - DNA, 16 bp, G. gallus
ctcaagaatcatcaag

SEQ ID NO: 537446 - DNA, 16 bp, G. gallus
ctcaaggagatcttcc

SEQ ID NO: 537447 - DNA, 16 bp, G. gallus
ctcaaggccaggctga

SEQ ID NO: 537448 - DNA, 16 bp, G. gallus
ctcaagtgctgtgttc

SEQ ID NO: 537449 - DNA, 16 bp, G. gallus
ctcaatcccactgtct

SEQ ID NO: 537450 - DNA, 16 bp, G. gallus
ctcaatcccatcatct

SEQ ID NO: 537451 - DNA, 16 bp, G. gallus
ctcacaagggcagagt

SEQ ID NO: 537452 - DNA, 16 bp, G. gallus
ctcacacaggaacaga

SEQ ID NO: 537453 - DNA, 16 bp, G. gallus
ctcacactgccctgcc

SEQ ID NO: 537454 - DNA, 16 bp, G. gallus
ctcacagccttctctt

SEQ ID NO: 537455 - DNA, 16 bp, G. gallus
ctcacagtgcagagca

SEQ ID NO: 537456 - DNA, 16 bp, G. gallus
ctcaccaccctcactg

SEQ ID NO: 537457 - DNA, 16 bp, G. gallus
ctcaccctgctggcca

SEQ ID NO: 537458 - DNA, 16 bp, G. gallus
ctcacctctgtgcctg

SEQ ID NO: 537459 - DNA, 16 bp, G. gallus
ctcactgagcaacctg

SEQ ID NO: 537460 - DNA, 16 bp, G. gallus
ctcactgtgctcacgt

SEQ ID NO: 537461 - DNA, 16 bp, G. gallus
ctcacttccactgcca

SEQ ID NO: 537462 - DNA, 16 bp, G. gallus
ctcagaaggagtggtg

SEQ ID NO: 537463 - DNA, 16 bp, G. gallus
ctcagaggtcccttcc

SEQ ID NO: 537464 - DNA, 16 bp, G. gallus
ctcagcaacaactgaa

SEQ ID NO: 537465 - DNA, 16 bp, G. gallus
ctcagcactactgtaa

SEQ ID NO: 537466 - DNA, 16 bp, G. gallus
ctcagcagcagcagca

SEQ ID NO: 537467 - DNA, 16 bp, G. gallus
ctcagcatgagccagc

SEQ ID NO: 537468 - DNA, 16 bp, G. gallus
ctcagccaggcgggct

SEQ ID NO: 537469 - DNA, 16 bp, G. gallus
ctcagcctcttctcat

SEQ ID NO: 537470 - DNA, 16 bp, G. gallus
ctcagccttctcctta

SEQ ID NO: 537471 - DNA, 16 bp, G. gallus
ctcagcctttcctcat

SEQ ID NO: 537472 - DNA, 16 bp, G. gallus
ctcagcctttcttcat

SEQ ID NO: 537473 - DNA, 16 bp, G. gallus
ctcagctacaagacac

SEQ ID NO: 537474 - DNA, 16 bp, G. gallus
ctcagctgctcttcat

SEQ ID NO: 537475 - DNA, 16 bp, G. gallus
ctcaggagagacctca

SEQ ID NO: 537476 - DNA, 16 bp, G. gallus
ctcaggagtgtttact

SEQ ID NO: 537477 - DNA, 16 bp, G. gallus
ctcagtacaggaagga

SEQ ID NO: 537478 - DNA, 16 bp, G. gallus
ctcagtctgtcctcat

SEQ ID NO: 537479 - DNA, 16 bp, G. gallus
ctcagtgaaaaacttc

SEQ ID NO: 537480 - DNA, 17 bp, G. gallus
ctcagtgacatccaatg

SEQ ID NO: 537481 - DNA, 16 bp, G. gallus
ctcagtggcagtcagc

SEQ ID NO: 537482 - DNA, 16 bp, G. gallus
ctcagtttaaaaccac

SEQ ID NO: 537483 - DNA, 16 bp, G. gallus
ctcagtttaagaccat

SEQ ID NO: 537484 - DNA, 16 bp, G. gallus
ctcatcaccagcctcc

SEQ ID NO: 537485 - DNA, 16 bp, G. gallus
ctcatccagtaaagaa

SEQ ID NO: 537486 - DNA, 16 bp, G. gallus
ctcatctggagtactg

SEQ ID NO: 537487 - DNA, 23 bp, G. gallus
ctcatgagactggatgagtacaa

SEQ ID NO: 537488 - DNA, 16 bp, G. gallus
ctcattgtggctttcc

SEQ ID NO: 537489 - DNA, 16 bp, G. gallus
ctccaagaggaaggat

SEQ ID NO: 537490 - DNA, 16 bp, G. gallus
ctccaaggtcatccag

SEQ ID NO: 537491 - DNA, 16 bp, G. gallus
ctccaagtccttctcc

SEQ ID NO: 537492 - DNA, 16 bp, G. gallus
ctccaccaccaccctg

SEQ ID NO: 537493 - DNA, 16 bp, G. gallus
ctccaccaggtgctca

SEQ ID NO: 537494 - DNA, 16 bp, G. gallus
ctccagcaagatcccc

SEQ ID NO: 537495 - DNA, 16 bp, G. gallus
ctccagcagggccacc

SEQ ID NO: 537496 - DNA, 16 bp, G. gallus
ctccaggaatgaggca

SEQ ID NO: 537497 - DNA, 16 bp, G. gallus
ctccaggccaggctgg

SEQ ID NO: 537498 - DNA, 16 bp, G. gallus
ctccaggccaggttgg

SEQ ID NO: 537499 - DNA, 16 bp, G. gallus
ctccagggacagggca

SEQ ID NO: 537500 - DNA, 16 bp, G. gallus
ctccagggagacctga

SEQ ID NO: 537501 - DNA, 16 bp, G. gallus
ctccagggagacttca

SEQ ID NO: 537502 - DNA, 16 bp, G. gallus
ctccagggatgaagca

SEQ ID NO: 537503 - DNA, 16 bp, G. gallus
ctccagggatggagca

SEQ ID NO: 537504 - DNA, 16 bp, G. gallus
ctccagtcctcaggca

SEQ ID NO: 537505 - DNA, 16 bp, G. gallus
ctccagtgacagtgac

SEQ ID NO: 537506 - DNA, 16 bp, G. gallus
ctccagttccaggcac

SEQ ID NO: 537507 - DNA, 16 bp, G. gallus
ctccatcaccctcact

SEQ ID NO: 537508 - DNA, 16 bp, G. gallus
ctccatccatccatcc

SEQ ID NO: 537509 - DNA, 16 bp, G. gallus
ctccatggacggtgac

SEQ ID NO: 537510 - DNA, 16 bp, G. gallus
ctccatgggcagctgt

SEQ ID NO: 537511 - DNA, 16 bp, G. gallus
ctcccacagctgactc

SEQ ID NO: 537512 - DNA, 16 bp, G. gallus
ctcccagaagacttca

SEQ ID NO: 537513 - DNA, 16 bp, G. gallus
ctcccagctccacaca

SEQ ID NO: 537514 - DNA, 16 bp, G. gallus
ctcccatctcccttta

SEQ ID NO: 537515 - DNA, 16 bp, G. gallus
ctccccagggcagtgg

SEQ ID NO: 537516 - DNA, 16 bp, G. gallus
ctcccctcttccagtt

SEQ ID NO: 537517 - DNA, 16 bp, G. gallus
ctcccctgagcctccc

SEQ ID NO: 537518 - DNA, 16 bp, G. gallus
ctccctcaccctgctg

SEQ ID NO: 537519 - DNA, 16 bp, G. gallus
ctccctcagcctgtcc

SEQ ID NO: 537520 - DNA, 16 bp, G. gallus
ctccctccttggagat

SEQ ID NO: 537521 - DNA, 16 bp, G. gallus
ctccctgacctggcag

SEQ ID NO: 537522 - DNA, 16 bp, G. gallus
ctccctgcactgaaca

SEQ ID NO: 537523 - DNA, 16 bp, G. gallus
ctccctgctggccatc

SEQ ID NO: 537524 - DNA, 16 bp, G. gallus
ctccctggtcctgctg

SEQ ID NO: 537525 - DNA, 16 bp, G. gallus
ctccctgtccctgctg

SEQ ID NO: 537526 - DNA, 16 bp, G. gallus
ctccctttcttgtaaa

SEQ ID NO: 537527 - DNA, 17 bp, G. gallus
ctccgaaagtaatgcct

SEQ ID NO: 537528 - DNA, 16 bp, G. gallus
ctcctattttattgtg

SEQ ID NO: 537529 - DNA, 16 bp, G. gallus
ctcctcagggagctgc

SEQ ID NO: 537530 - DNA, 16 bp, G. gallus
ctcctccatggctgca

SEQ ID NO: 537531 - DNA, 16 bp, G. gallus
ctcctcctgctcagcc

SEQ ID NO: 537532 - DNA, 16 bp, G. gallus
ctcctcctgctgctgc

SEQ ID NO: 537533 - DNA, 16 bp, G. gallus
ctcctctggacccgct

SEQ ID NO: 537534 - DNA, 16 bp, G. gallus
ctcctctggagatatt

SEQ ID NO: 537535 - DNA, 16 bp, G. gallus
ctcctctggatgcact

SEQ ID NO: 537536 - DNA, 16 bp, G. gallus
ctcctgacttcaccaa

SEQ ID NO: 537537 - DNA, 16 bp, G. gallus
ctcctgcagctgcttt

SEQ ID NO: 537538 - DNA, 16 bp, G. gallus
ctcctgctcaaagcag

SEQ ID NO: 537539 - DNA, 16 bp, G. gallus
ctcctgctgtgggcag

SEQ ID NO: 537540 - DNA, 17 bp, G. gallus
ctcctggacttgctctg

SEQ ID NO: 537541 - DNA, 16 bp, G. gallus
ctcctggattgtctgc

SEQ ID NO: 537542 - DNA, 16 bp, G. gallus
ctcctggcttcacaca

SEQ ID NO: 537543 - DNA, 16 bp, G. gallus
ctcctgtgaagaaagg

SEQ ID NO: 537544 - DNA, 16 bp, G. gallus
ctccttcagcctctcc

SEQ ID NO: 537545 - DNA, 16 bp, G. gallus
ctccttctccctgctg

SEQ ID NO: 537546 - DNA, 16 bp, G. gallus
ctccttggtgaagctt

SEQ ID NO: 537547 - DNA, 16 bp, G. gallus
ctcctttgacctgctg

SEQ ID NO: 537548 - DNA, 16 bp, G. gallus
ctcgattcttggtgga

SEQ ID NO: 537549 - DNA, 17 bp, G. gallus
ctcgctgctcctgccct

SEQ ID NO: 537550 - DNA, 16 bp, G. gallus
ctcgctgggcagcctg

SEQ ID NO: 537551 - DNA, 16 bp, G. gallus
ctcggggccgtgccca

SEQ ID NO: 537552 - DNA, 16 bp, G. gallus
ctctactggtgcagat

SEQ ID NO: 537553 - DNA, 16 bp, G. gallus
ctctatttgatagagc

SEQ ID NO: 537554 - DNA, 16 bp, G. gallus
ctctcaagccattctc

SEQ ID NO: 537555 - DNA, 16 bp, G. gallus
ctctcagcctgtcctg

SEQ ID NO: 537556 - DNA, 16 bp, G. gallus
ctctcaggtctcccca

SEQ ID NO: 537557 - DNA, 16 bp, G. gallus
ctctcagtgccacatc

SEQ ID NO: 537558 - DNA, 16 bp, G. gallus
ctctccaatttagaga

SEQ ID NO: 537559 - DNA, 16 bp, G. gallus
ctctccagcaggtcat

SEQ ID NO: 537560 - DNA, 17 bp, G. gallus
ctctccagggcctgcta

SEQ ID NO: 537561 - DNA, 16 bp, G. gallus
ctctccatctcccaca

SEQ ID NO: 537562 - DNA, 16 bp, G. gallus
ctctcctatgagaaca

SEQ ID NO: 537563 - DNA, 16 bp, G. gallus
ctctcctgggctgcag

SEQ ID NO: 537564 - DNA, 16 bp, G. gallus
ctctctactctgcctt

SEQ ID NO: 537565 - DNA, 16 bp, G. gallus
ctctctcaagcagttc

SEQ ID NO: 537566 - DNA, 16 bp, G. gallus
ctctctctctctccag

SEQ ID NO: 537567 - DNA, 16 bp, G. gallus
ctctctgatcatcttc

SEQ ID NO: 537568 - DNA, 16 bp, G. gallus
ctctctggaaaaaaaa

SEQ ID NO: 537569 - DNA, 16 bp, G. gallus
ctctctggatggcttc

SEQ ID NO: 537570 - DNA, 16 bp, G. gallus
ctctctgggaagcctg

SEQ ID NO: 537571 - DNA, 16 bp, G. gallus
ctctctgggcaacctg

SEQ ID NO: 537572 - DNA, 16 bp, G. gallus
ctctctgggcaggctg

SEQ ID NO: 537573 - DNA, 16 bp, G. gallus
ctctctggtgacagca

SEQ ID NO: 537574 - DNA, 16 bp, G. gallus
ctctcttggagaagaa

SEQ ID NO: 537575 - DNA, 16 bp, G. gallus
ctctgaaactaatgcc

SEQ ID NO: 537576 - DNA, 16 bp, G. gallus
ctctgaatgaaaaact

SEQ ID NO: 537577 - DNA, 16 bp, G. gallus
ctctgatcacctttgt

SEQ ID NO: 537578 - DNA, 16 bp, G. gallus
ctctgcacagctctgc

SEQ ID NO: 537579 - DNA, 16 bp, G. gallus
ctctgcagagctgctc

SEQ ID NO: 537580 - DNA, 16 bp, G. gallus
ctctgcagccttctct

SEQ ID NO: 537581 - DNA, 16 bp, G. gallus
ctctgcagggctgctc

SEQ ID NO: 537582 - DNA, 16 bp, G. gallus
ctctgcattggtgagc

SEQ ID NO: 537583 - DNA, 16 bp, G. gallus
ctctgcattttcacca

SEQ ID NO: 537584 - DNA, 16 bp, G. gallus
ctctgccatgggcagg

SEQ ID NO: 537585 - DNA, 16 bp, G. gallus
ctctgcccttgtgagg

SEQ ID NO: 537586 - DNA, 16 bp, G. gallus
ctctgcctcactgtgc

SEQ ID NO: 537587 - DNA, 16 bp, G. gallus
ctctgctgccacctgt

SEQ ID NO: 537588 - DNA, 16 bp, G. gallus
ctctgctgccatccgt

SEQ ID NO: 537589 - DNA, 16 bp, G. gallus
ctctgctgccatctgt

SEQ ID NO: 537590 - DNA, 16 bp, G. gallus
ctctgctggactctct

SEQ ID NO: 537591 - DNA, 16 bp, G. gallus
ctctgctgtcatacca

SEQ ID NO: 537592 - DNA, 16 bp, G. gallus
ctctgctgtcatctgt

SEQ ID NO: 537593 - DNA, 16 bp, G. gallus
ctctggagagacctga

SEQ ID NO: 537594 - DNA, 16 bp, G. gallus
ctctggcactgctgcc

SEQ ID NO: 537595 - DNA, 16 bp, G. gallus
ctctggctgcagggag

SEQ ID NO: 537596 - DNA, 16 bp, G. gallus
ctctgggcccagccct

SEQ ID NO: 537597 - DNA, 16 bp, G. gallus
ctctgggctgaacaaa

SEQ ID NO: 537598 - DNA, 16 bp, G. gallus
ctctggggaaaaaaaa

SEQ ID NO: 537599 - DNA, 16 bp, G. gallus
ctctggggatggggca

SEQ ID NO: 537600 - DNA, 16 bp, G. gallus
ctctggtgcagaacct

SEQ ID NO: 537601 - DNA, 16 bp, G. gallus
ctctggttggagatcc

SEQ ID NO: 537602 - DNA, 16 bp, G. gallus
ctctgtactcagccct

SEQ ID NO: 537603 - DNA, 16 bp, G. gallus
ctctgtcacctgcaca

SEQ ID NO: 537604 - DNA, 16 bp, G. gallus
ctctgtccttgtgagg

SEQ ID NO: 537605 - DNA, 16 bp, G. gallus
ctctgtgattctgtga

SEQ ID NO: 537606 - DNA, 16 bp, G. gallus
ctctgtgcaacctgtt

SEQ ID NO: 537607 - DNA, 16 bp, G. gallus
ctctgtgctgtgtggc

SEQ ID NO: 537608 - DNA, 16 bp, G. gallus
ctcttcaatatcttta

SEQ ID NO: 537609 - DNA, 16 bp, G. gallus
ctcttcaccatctttg

SEQ ID NO: 537610 - DNA, 16 bp, G. gallus
ctcttcagcatcttta

SEQ ID NO: 537611 - DNA, 16 bp, G. gallus
ctcttccaaagttcag

SEQ ID NO: 537612 - DNA, 16 bp, G. gallus
ctcttccaacccaggc

SEQ ID NO: 537613 - DNA, 16 bp, G. gallus
ctcttccagcacctca

SEQ ID NO: 537614 - DNA, 16 bp, G. gallus
ctcttgcagcttggaa

SEQ ID NO: 537615 - DNA, 16 bp, G. gallus
ctcttggagcccttcc

SEQ ID NO: 537616 - DNA, 16 bp, G. gallus
ctcttgtcctgctgtt

SEQ ID NO: 537617 - DNA, 16 bp, G. gallus
ctcttgtttataagct

SEQ ID NO: 537618 - DNA, 16 bp, G. gallus
ctctttcaaagaagaa

SEQ ID NO: 537619 - DNA, 16 bp, G. gallus
ctctttcccaggctga

SEQ ID NO: 537620 - DNA, 16 bp, G. gallus
ctctttgagagcagcc

SEQ ID NO: 537621 - DNA, 16 bp, G. gallus
ctctttggagaagaaa

SEQ ID NO: 537622 - DNA, 16 bp, G. gallus
ctctttggtctccaga

SEQ ID NO: 537623 - DNA, 16 bp, G. gallus
ctcttttcagtagtgc

SEQ ID NO: 537624 - DNA, 16 bp, G. gallus
ctcttttccctcagtt

SEQ ID NO: 537625 - DNA, 16 bp, G. gallus
ctcttttggagaagta

SEQ ID NO: 537626 - DNA, 16 bp, G. gallus
ctgaaaaaatatatat

SEQ ID NO: 537627 - DNA, 16 bp, G. gallus
ctgaaacacctccagg

SEQ ID NO: 537628 - DNA, 16 bp, G. gallus
ctgaaacagaagaaaa

SEQ ID NO: 537629 - DNA, 16 bp, G. gallus
ctgaaagaactggggc

SEQ ID NO: 537630 - DNA, 16 bp, G. gallus
ctgaaagagcagtcag

SEQ ID NO: 537631 - DNA, 16 bp, G. gallus
ctgaaagcattcaagg

SEQ ID NO: 537632 - DNA, 16 bp, G. gallus
ctgaaaggcaccaccc

SEQ ID NO: 537633 - DNA, 16 bp, G. gallus
ctgaaagtaatgcttc

SEQ ID NO: 537634 - DNA, 16 bp, G. gallus
ctgaacaagaccagct

SEQ ID NO: 537635 - DNA, 16 bp, G. gallus
ctgaaccactgattga

SEQ ID NO: 537636 - DNA, 16 bp, G. gallus
ctgaaccttccctgga

SEQ ID NO: 537637 - DNA, 16 bp, G. gallus
ctgaactgtggaaaga

SEQ ID NO: 537638 - DNA, 16 bp, G. gallus
ctgaagaaaacaattc

SEQ ID NO: 537639 - DNA, 16 bp, G. gallus
ctgaagacattcaagg

SEQ ID NO: 537640 - DNA, 16 bp, G. gallus
ctgaagatattcaaaa

SEQ ID NO: 537641 - DNA, 16 bp, G. gallus
ctgaagatattcaaga

SEQ ID NO: 537642 - DNA, 16 bp, G. gallus
ctgaagcaggttccct

SEQ ID NO: 537643 - DNA, 16 bp, G. gallus
ctgaaggtgacagttt

SEQ ID NO: 537644 - DNA, 16 bp, G. gallus
ctgaaggtgttccaga

SEQ ID NO: 537645 - DNA, 16 bp, G. gallus
ctgaatgtgtacaagt

SEQ ID NO: 537646 - DNA, 16 bp, G. gallus
ctgaattcctccatga

SEQ ID NO: 537647 - DNA, 16 bp, G. gallus
ctgaatttctccatgt

SEQ ID NO: 537648 - DNA, 16 bp, G. gallus
ctgacaaaatggcatc

SEQ ID NO: 537649 - DNA, 16 bp, G. gallus
ctgacagtgtgcccag

SEQ ID NO: 537650 - DNA, 16 bp, G. gallus
ctgacattcattgaca

SEQ ID NO: 537651 - DNA, 16 bp, G. gallus
ctgacattgtgggtca

SEQ ID NO: 537652 - DNA, 16 bp, G. gallus
ctgactgccactgggg

SEQ ID NO: 537653 - DNA, 16 bp, G. gallus
ctgactgccagtgaag

SEQ ID NO: 537654 - DNA, 16 bp, G. gallus
ctgagaacctcagcct

SEQ ID NO: 537655 - DNA, 16 bp, G. gallus
ctgagaataaattttt

SEQ ID NO: 537656 - DNA, 16 bp, G. gallus
ctgagaatttgctctg

SEQ ID NO: 537657 - DNA, 16 bp, G. gallus
ctgagacttttttttt

SEQ ID NO: 537658 - DNA, 16 bp, G. gallus
ctgagagcattgtcca

SEQ ID NO: 537659 - DNA, 16 bp, G. gallus
ctgagagtgttgtcca

SEQ ID NO: 537660 - DNA, 16 bp, G. gallus
ctgagattttttttct

SEQ ID NO: 537661 - DNA, 16 bp, G. gallus
ctgagcaacctgctct

SEQ ID NO: 537662 - DNA, 19 bp, G. gallus
ctgagcacctgatcagctg

SEQ ID NO: 537663 - DNA, 16 bp, G. gallus
ctgagcagctgtgcca

SEQ ID NO: 537664 - DNA, 16 bp, G. gallus
ctgagcctcctctgct

SEQ ID NO: 537665 - DNA, 16 bp, G. gallus
ctgagcctcctcttct

SEQ ID NO: 537666 - DNA, 16 bp, G. gallus
ctgagctgcaggagca

SEQ ID NO: 537667 - DNA, 16 bp, G. gallus
ctgagctgcctgccag

SEQ ID NO: 537668 - DNA, 16 bp, G. gallus
ctgagctgctggagct

SEQ ID NO: 537669 - DNA, 16 bp, G. gallus
ctgagctgtaggtgtc

SEQ ID NO: 537670 - DNA, 16 bp, G. gallus
ctgaggaaaaagaaaa

SEQ ID NO: 537671 - DNA, 16 bp, G. gallus
ctgaggaggaggagga

SEQ ID NO: 537672 - DNA, 16 bp, G. gallus
ctgaggcctcacctgg

SEQ ID NO: 537673 - DNA, 16 bp, G. gallus
ctgagggcattgtcca

SEQ ID NO: 537674 - DNA, 28 bp, G. gallus
ctgagtcagctgcaggggcacaggtgaa

SEQ ID NO: 537675 - DNA, 16 bp, G. gallus
ctgagtgctgctgtgc

SEQ ID NO: 537676 - DNA, 16 bp, G. gallus
ctgataaatgagaagg

SEQ ID NO: 537677 - DNA, 16 bp, G. gallus
ctgatatatatatata

SEQ ID NO: 537678 - DNA, 16 bp, G. gallus
ctgatcatctttatgg

SEQ ID NO: 537679 - DNA, 16 bp, G. gallus
ctgatccagtgggtgg

SEQ ID NO: 537680 - DNA, 16 bp, G. gallus
ctgatctggtggttgg

SEQ ID NO: 537681 - DNA, 16 bp, G. gallus
ctgatgaagatgttaa

SEQ ID NO: 537682 - DNA, 16 bp, G. gallus
ctgatgacaggtgaca

SEQ ID NO: 537683 - DNA, 16 bp, G. gallus
ctgatgaggttcagca

SEQ ID NO: 537684 - DNA, 16 bp, G. gallus
ctgatgatctggatga

SEQ ID NO: 537685 - DNA, 16 bp, G. gallus
ctgatggagctgtggg

SEQ ID NO: 537686 - DNA, 16 bp, G. gallus
ctgatgtggaagtgtg

SEQ ID NO: 537687 - DNA, 16 bp, G. gallus
ctgcaaatggccttgg

SEQ ID NO: 537688 - DNA, 16 bp, G. gallus
ctgcaacaaacaggga

SEQ ID NO: 537689 - DNA, 16 bp, G. gallus
ctgcaacagatacaaa

SEQ ID NO: 537690 - DNA, 16 bp, G. gallus
ctgcaagcacacactg

SEQ ID NO: 537691 - DNA, 16 bp, G. gallus
ctgcaaggacaggctg

SEQ ID NO: 537692 - DNA, 16 bp, G. gallus
ctgcaatgaacaggga

SEQ ID NO: 537693 - DNA, 16 bp, G. gallus
ctgcaatggacaggga

SEQ ID NO: 537694 - DNA, 16 bp, G. gallus
ctgcacagaggaaaag

SEQ ID NO: 537695 - DNA, 16 bp, G. gallus
ctgcacagcactgctc

SEQ ID NO: 537696 - DNA, 16 bp, G. gallus
ctgcacccagtgctgg

SEQ ID NO: 537697 - DNA, 16 bp, G. gallus
ctgcactgaacaggga

SEQ ID NO: 537698 - DNA, 16 bp, G. gallus
ctgcactgctgctgct

SEQ ID NO: 537699 - DNA, 16 bp, G. gallus
ctgcactgtgccctcc

SEQ ID NO: 537700 - DNA, 16 bp, G. gallus
ctgcagaagagaaggc

SEQ ID NO: 537701 - DNA, 16 bp, G. gallus
ctgcagaagctggcag

SEQ ID NO: 537702 - DNA, 16 bp, G. gallus
ctgcagagaaggacct

SEQ ID NO: 537703 - DNA, 16 bp, G. gallus
ctgcagagcagagcag

SEQ ID NO: 537704 - DNA, 16 bp, G. gallus
ctgcagagcagagctg

SEQ ID NO: 537705 - DNA, 16 bp, G. gallus
ctgcagagcagctgtg

SEQ ID NO: 537706 - DNA, 16 bp, G. gallus
ctgcagagctgcagct

SEQ ID NO: 537707 - DNA, 16 bp, G. gallus
ctgcagcacagagcag

SEQ ID NO: 537708 - DNA, 16 bp, G. gallus
ctgcagcacagcacag

SEQ ID NO: 537709 - DNA, 16 bp, G. gallus
ctgcagcacagccctg

SEQ ID NO: 537710 - DNA, 16 bp, G. gallus
ctgcagcacctctcct

SEQ ID NO: 537711 - DNA, 16 bp, G. gallus
ctgcagcactgctgtg

SEQ ID NO: 537712 - DNA, 16 bp, G. gallus
ctgcagcagcacagag

SEQ ID NO: 537713 - DNA, 16 bp, G. gallus
ctgcagcagcactgca

SEQ ID NO: 537714 - DNA, 16 bp, G. gallus
ctgcagcagcactggg

SEQ ID NO: 537715 - DNA, 16 bp, G. gallus
ctgcagcagcagagct

SEQ ID NO: 537716 - DNA, 16 bp, G. gallus
ctgcagcagcagcaca

SEQ ID NO: 537717 - DNA, 16 bp, G. gallus
ctgcagcagccccagc

SEQ ID NO: 537718 - DNA, 16 bp, G. gallus
ctgcagcagctctgct

SEQ ID NO: 537719 - DNA, 16 bp, G. gallus
ctgcagcaggagggtt

SEQ ID NO: 537720 - DNA, 16 bp, G. gallus
ctgcagcagtgctgtg

SEQ ID NO: 537721 - DNA, 16 bp, G. gallus
ctgcagccaaagactt

SEQ ID NO: 537722 - DNA, 16 bp, G. gallus
ctgcagccaaggctgc

SEQ ID NO: 537723 - DNA, 16 bp, G. gallus
ctgcagccagcacagc

SEQ ID NO: 537724 - DNA, 16 bp, G. gallus
ctgcagccagcactgc

SEQ ID NO: 537725 - DNA, 16 bp, G. gallus
ctgcagccccacagcc

SEQ ID NO: 537726 - DNA, 16 bp, G. gallus
ctgcagctcagtgctg

SEQ ID NO: 537727 - DNA, 16 bp, G. gallus
ctgcagctcccagccc

SEQ ID NO: 537728 - DNA, 16 bp, G. gallus
ctgcagctcctgctgc

SEQ ID NO: 537729 - DNA, 16 bp, G. gallus
ctgcagctgctctgct

SEQ ID NO: 537730 - DNA, 16 bp, G. gallus
ctgcagctgctgctgt

SEQ ID NO: 537731 - DNA, 16 bp, G. gallus
ctgcaggactgctctc

SEQ ID NO: 537732 - DNA, 16 bp, G. gallus
ctgcaggcagagctgc

SEQ ID NO: 537733 - DNA, 16 bp, G. gallus
ctgcaggcagtgctgg

SEQ ID NO: 537734 - DNA, 16 bp, G. gallus
ctgcaggctgccatga

SEQ ID NO: 537735 - DNA, 16 bp, G. gallus
ctgcagggagagggag

SEQ ID NO: 537736 - DNA, 16 bp, G. gallus
ctgcagtgcacaggga

SEQ ID NO: 537737 - DNA, 16 bp, G. gallus
ctgcagttctgtggat

SEQ ID NO: 537738 - DNA, 16 bp, G. gallus
ctgcatcaaaagaagc

SEQ ID NO: 537739 - DNA, 16 bp, G. gallus
ctgcatccagatgtgg

SEQ ID NO: 537740 - DNA, 16 bp, G. gallus
ctgcatccagcctggc

SEQ ID NO: 537741 - DNA, 16 bp, G. gallus
ctgcatgacatcctgg

SEQ ID NO: 537742 - DNA, 16 bp, G. gallus
ctgcatgctgatggac

SEQ ID NO: 537743 - DNA, 16 bp, G. gallus
ctgccaacctcagcca

SEQ ID NO: 537744 - DNA, 16 bp, G. gallus
ctgccactccaaggag

SEQ ID NO: 537745 - DNA, 16 bp, G. gallus
ctgccagctgctcata

SEQ ID NO: 537746 - DNA, 16 bp, G. gallus
ctgccagcttctgcag

SEQ ID NO: 537747 - DNA, 16 bp, G. gallus
ctgccagcttctggag

SEQ ID NO: 537748 - DNA, 16 bp, G. gallus
ctgccagggacagcaa

SEQ ID NO: 537749 - DNA, 18 bp, G. gallus
ctgccatcagatccctca

SEQ ID NO: 537750 - DNA, 16 bp, G. gallus
ctgccatctatcacac

SEQ ID NO: 537751 - DNA, 16 bp, G. gallus
ctgccatggactggtt

SEQ ID NO: 537752 - DNA, 16 bp, G. gallus
ctgccatgggcaggga

SEQ ID NO: 537753 - DNA, 16 bp, G. gallus
ctgcccacagcaggga

SEQ ID NO: 537754 - DNA, 16 bp, G. gallus
ctgcccagagagtttg

SEQ ID NO: 537755 - DNA, 16 bp, G. gallus
ctgcccagggacgtgg

SEQ ID NO: 537756 - DNA, 16 bp, G. gallus
ctgcccagggagctgg

SEQ ID NO: 537757 - DNA, 16 bp, G. gallus
ctgcccagggcagcag

SEQ ID NO: 537758 - DNA, 16 bp, G. gallus
ctgccccaaacctgta

SEQ ID NO: 537759 - DNA, 16 bp, G. gallus
ctgccccacaccatca

SEQ ID NO: 537760 - DNA, 16 bp, G. gallus
ctgcccccagcactgc

SEQ ID NO: 537761 - DNA, 16 bp, G. gallus
ctgccccccaccagat

SEQ ID NO: 537762 - DNA, 16 bp, G. gallus
ctgcccggagaggctg

SEQ ID NO: 537763 - DNA, 16 bp, G. gallus
ctgccctctggtgcag

SEQ ID NO: 537764 - DNA, 16 bp, G. gallus
ctgccctgagcctcct

SEQ ID NO: 537765 - DNA, 16 bp, G. gallus
ctgccctgggcagccc

SEQ ID NO: 537766 - DNA, 16 bp, G. gallus
ctgccctgggcagcct

SEQ ID NO: 537767 - DNA, 16 bp, G. gallus
ctgccggatcctggtg

SEQ ID NO: 537768 - DNA, 16 bp, G. gallus
ctgcctcaccgctctt

SEQ ID NO: 537769 - DNA, 16 bp, G. gallus
ctgcctctgatgtcgt

SEQ ID NO: 537770 - DNA, 16 bp, G. gallus
ctgcctgcagcacagc

SEQ ID NO: 537771 - DNA, 16 bp, G. gallus
ctgcctgcagcaggag

SEQ ID NO: 537772 - DNA, 16 bp, G. gallus
ctgcctgcctgcctgc

SEQ ID NO: 537773 - DNA, 16 bp, G. gallus
ctgcctgctgccagca

SEQ ID NO: 537774 - DNA, 16 bp, G. gallus
ctgcctgctgctgctg

SEQ ID NO: 537775 - DNA, 16 bp, G. gallus
ctgcctggagaagaga

SEQ ID NO: 537776 - DNA, 16 bp, G. gallus
ctgcctggggaggtgg

SEQ ID NO: 537777 - DNA, 16 bp, G. gallus
ctgccttcccaccagg

SEQ ID NO: 537778 - DNA, 16 bp, G. gallus
ctgccttcctgccttc

SEQ ID NO: 537779 - DNA, 16 bp, G. gallus
ctgcctttctgctgcc

SEQ ID NO: 537780 - DNA, 21 bp, G. gallus
ctgcgcgctgctaccgggagg

SEQ ID NO: 537781 - DNA, 16 bp, G. gallus
ctgctaaagcaggtac

SEQ ID NO: 537782 - DNA, 16 bp, G. gallus
ctgctaaatcatgtcc

SEQ ID NO: 537783 - DNA, 16 bp, G. gallus
ctgctataagcaggga

SEQ ID NO: 537784 - DNA, 16 bp, G. gallus
ctgctatttgcagggt

SEQ ID NO: 537785 - DNA, 16 bp, G. gallus
ctgctcacagaggcca

SEQ ID NO: 537786 - DNA, 16 bp, G. gallus
ctgctcagcaacagct

SEQ ID NO: 537787 - DNA, 16 bp, G. gallus
ctgctcagcagcagct

SEQ ID NO: 537788 - DNA, 17 bp, G. gallus
ctgctcatcatattggt

SEQ ID NO: 537789 - DNA, 16 bp, G. gallus
ctgctccagcagggac

SEQ ID NO: 537790 - DNA, 16 bp, G. gallus
ctgctccattcttttt

SEQ ID NO: 537791 - DNA, 16 bp, G. gallus
ctgctcccagcactgc

SEQ ID NO: 537792 - DNA, 16 bp, G. gallus
ctgctcccagcccagc

SEQ ID NO: 537793 - DNA, 16 bp, G. gallus
ctgctcctgcccttcg

SEQ ID NO: 537794 - DNA, 16 bp, G. gallus
ctgctcctgctgctgc

SEQ ID NO: 537795 - DNA, 16 bp, G. gallus
ctgctctccagcctct

SEQ ID NO: 537796 - DNA, 16 bp, G. gallus
ctgctctgcactggtg

SEQ ID NO: 537797 - DNA, 16 bp, G. gallus
ctgctctgcactgtgc

SEQ ID NO: 537798 - DNA, 16 bp, G. gallus
ctgctctgctctgctc

SEQ ID NO: 537799 - DNA, 16 bp, G. gallus
ctgctctgctgctgcc

SEQ ID NO: 537800 - DNA, 16 bp, G. gallus
ctgctctggtggttgg

SEQ ID NO: 537801 - DNA, 16 bp, G. gallus
ctgctgaaaagaactt

SEQ ID NO: 537802 - DNA, 16 bp, G. gallus
ctgctgaaaggcacca

SEQ ID NO: 537803 - DNA, 16 bp, G. gallus
ctgctgaaatacacca

SEQ ID NO: 537804 - DNA, 16 bp, G. gallus
ctgctgagctgctctc

SEQ ID NO: 537805 - DNA, 16 bp, G. gallus
ctgctgcagcactgct

SEQ ID NO: 537806 - DNA, 16 bp, G. gallus
ctgctgcaggcaggga

SEQ ID NO: 537807 - DNA, 16 bp, G. gallus
ctgctgccacccctct

SEQ ID NO: 537808 - DNA, 16 bp, G. gallus
ctgctgccagcacagc

SEQ ID NO: 537809 - DNA, 16 bp, G. gallus
ctgctgccctgggcag

SEQ ID NO: 537810 - DNA, 16 bp, G. gallus
ctgctgcctgcagccc

SEQ ID NO: 537811 - DNA, 16 bp, G. gallus
ctgctgcctgcctgcc

SEQ ID NO: 537812 - DNA, 16 bp, G. gallus
ctgctgcctgctgctg

SEQ ID NO: 537813 - DNA, 16 bp, G. gallus
ctgctgccttctgtca

SEQ ID NO: 537814 - DNA, 16 bp, G. gallus
ctgctgctcctcctgc

SEQ ID NO: 537815 - DNA, 16 bp, G. gallus
ctgctgctcctgctgc

SEQ ID NO: 537816 - DNA, 16 bp, G. gallus
ctgctgctctgctgca

SEQ ID NO: 537817 - DNA, 16 bp, G. gallus
ctgctgctgcctgcag

SEQ ID NO: 537818 - DNA, 16 bp, G. gallus
ctgctgctgctctccc

SEQ ID NO: 537819 - DNA, 16 bp, G. gallus
ctgctgctgctctgca

SEQ ID NO: 537820 - DNA, 16 bp, G. gallus
ctgctgctgctctgtg

SEQ ID NO: 537821 - DNA, 16 bp, G. gallus
ctgctgctgctgcagc

SEQ ID NO: 537822 - DNA, 16 bp, G. gallus
ctgctgctgctgcagt

SEQ ID NO: 537823 - DNA, 16 bp, G. gallus
ctgctgctgctgctac

SEQ ID NO: 537824 - DNA, 16 bp, G. gallus
ctgctgctgctggagg

SEQ ID NO: 537825 - DNA, 16 bp, G. gallus
ctgctgctgctgtggg

SEQ ID NO: 537826 - DNA, 16 bp, G. gallus
ctgctgctgctgttct

SEQ ID NO: 537827 - DNA, 16 bp, G. gallus
ctgctgctgcttctgc

SEQ ID NO: 537828 - DNA, 16 bp, G. gallus
ctgctgctggctgcag

SEQ ID NO: 537829 - DNA, 16 bp, G. gallus
ctgctgctggggaagg

SEQ ID NO: 537830 - DNA, 16 bp, G. gallus
ctgctgctgggtgctg

SEQ ID NO: 537831 - DNA, 16 bp, G. gallus
ctgctgctgtcaccac

SEQ ID NO: 537832 - DNA, 16 bp, G. gallus
ctgctgctgtgctgca

SEQ ID NO: 537833 - DNA, 16 bp, G. gallus
ctgctgctgtgctgtg

SEQ ID NO: 537834 - DNA, 16 bp, G. gallus
ctgctgctgttgctgc

SEQ ID NO: 537835 - DNA, 16 bp, G. gallus
ctgctgcttcctccct

SEQ ID NO: 537836 - DNA, 16 bp, G. gallus
ctgctggagcaggaac

SEQ ID NO: 537837 - DNA, 16 bp, G. gallus
ctgctggagctcaagg

SEQ ID NO: 537838 - DNA, 16 bp, G. gallus
ctgctggagctcaggg

SEQ ID NO: 537839 - DNA, 16 bp, G. gallus
ctgctggatcctggtg

SEQ ID NO: 537840 - DNA, 16 bp, G. gallus
ctgctggcaaggcctg

SEQ ID NO: 537841 - DNA, 16 bp, G. gallus
ctgctggcagagcccc

SEQ ID NO: 537842 - DNA, 16 bp, G. gallus
ctgctggccacactgc

SEQ ID NO: 537843 - DNA, 16 bp, G. gallus
ctgctggccacgctct

SEQ ID NO: 537844 - DNA, 16 bp, G. gallus
ctgctggccacgctgc

SEQ ID NO: 537845 - DNA, 16 bp, G. gallus
ctgctgtcactgctgt

SEQ ID NO: 537846 - DNA, 16 bp, G. gallus
ctgctgtgctgcagct

SEQ ID NO: 537847 - DNA, 16 bp, G. gallus
ctgctgtgggcaggga

SEQ ID NO: 537848 - DNA, 16 bp, G. gallus
ctgctgtgggcagggt

SEQ ID NO: 537849 - DNA, 16 bp, G. gallus
ctgcttccctgtgctg

SEQ ID NO: 537850 - DNA, 16 bp, G. gallus
ctgcttcctccccgac

SEQ ID NO: 537851 - DNA, 16 bp, G. gallus
ctgcttggggactggc

SEQ ID NO: 537852 - DNA, 16 bp, G. gallus
ctgctttccatcatct

SEQ ID NO: 537853 - DNA, 16 bp, G. gallus
ctggaaaacaaaacaa

SEQ ID NO: 537854 - DNA, 16 bp, G. gallus
ctggaaagctgcacag

SEQ ID NO: 537855 - DNA, 16 bp, G. gallus
ctggaacacctccagg

SEQ ID NO: 537856 - DNA, 16 bp, G. gallus
ctggaacagattgctc

SEQ ID NO: 537857 - DNA, 16 bp, G. gallus
ctggaagcactcaagg

SEQ ID NO: 537858 - DNA, 16 bp, G. gallus
ctggaagctgtgctaa

SEQ ID NO: 537859 - DNA, 16 bp, G. gallus
ctggaaggctacaatg

SEQ ID NO: 537860 - DNA, 16 bp, G. gallus
ctggaagggacctcca

SEQ ID NO: 537861 - DNA, 16 bp, G. gallus
ctggaattgttcagtc

SEQ ID NO: 537862 - DNA, 16 bp, G. gallus
ctggacaaggggattg

SEQ ID NO: 537863 - DNA, 16 bp, G. gallus
ctggacagcctggtct

SEQ ID NO: 537864 - DNA, 16 bp, G. gallus
ctggacagcctgttct

SEQ ID NO: 537865 - DNA, 16 bp, G. gallus
ctggacagctgtgcca

SEQ ID NO: 537866 - DNA, 16 bp, G. gallus
ctggacaggactctga

SEQ ID NO: 537867 - DNA, 16 bp, G. gallus
ctggacaggctggaga

SEQ ID NO: 537868 - DNA, 16 bp, G. gallus
ctggacatgagccaga

SEQ ID NO: 537869 - DNA, 16 bp, G. gallus
ctggacccagcactcc

SEQ ID NO: 537870 - DNA, 16 bp, G. gallus
ctggacctgctgctca

SEQ ID NO: 537871 - DNA, 16 bp, G. gallus
ctggagaacctctcct

SEQ ID NO: 537872 - DNA, 16 bp, G. gallus
ctggagaagacaaggc

SEQ ID NO: 537873 - DNA, 16 bp, G. gallus
ctggagaagagaaggt

SEQ ID NO: 537874 - DNA, 16 bp, G. gallus
ctggagaagaggaggc

SEQ ID NO: 537875 - DNA, 16 bp, G. gallus
ctggagaagctggcag

SEQ ID NO: 537876 - DNA, 16 bp, G. gallus
ctggagaagctgtgga

SEQ ID NO: 537877 - DNA, 16 bp, G. gallus
ctggagaggaggaggc

SEQ ID NO: 537878 - DNA, 16 bp, G. gallus
ctggagatccctgtgt

SEQ ID NO: 537879 - DNA, 16 bp, G. gallus
ctggagatctccaagg

SEQ ID NO: 537880 - DNA, 16 bp, G. gallus
ctggagatgttcagga

SEQ ID NO: 537881 - DNA, 16 bp, G. gallus
ctggagcacaagcctt

SEQ ID NO: 537882 - DNA, 16 bp, G. gallus
ctggagcacctcctct

SEQ ID NO: 537883 - DNA, 16 bp, G. gallus
ctggagcacctctact

SEQ ID NO: 537884 - DNA, 16 bp, G. gallus
ctggagcacctctcct

SEQ ID NO: 537885 - DNA, 16 bp, G. gallus
ctggagcacctctgct

SEQ ID NO: 537886 - DNA, 16 bp, G. gallus
ctggagcacctcttct

SEQ ID NO: 537887 - DNA, 16 bp, G. gallus
ctggagcacctttcct

SEQ ID NO: 537888 - DNA, 16 bp, G. gallus
ctggagcagctctcct

SEQ ID NO: 537889 - DNA, 16 bp, G. gallus
ctggagcagcttgaag

SEQ ID NO: 537890 - DNA, 16 bp, G. gallus
ctggagcaggggctgg

SEQ ID NO: 537891 - DNA, 16 bp, G. gallus
ctggagccttctctcc

SEQ ID NO: 537892 - DNA, 16 bp, G. gallus
ctggagctgttcagcc

SEQ ID NO: 537893 - DNA, 16 bp, G. gallus
ctggaggagttcaaga

SEQ ID NO: 537894 - DNA, 16 bp, G. gallus
ctggaggcagcctggg

SEQ ID NO: 537895 - DNA, 16 bp, G. gallus
ctggagggaagagggg

SEQ ID NO: 537896 - DNA, 16 bp, G. gallus
ctggaggtattcaaga

SEQ ID NO: 537897 - DNA, 16 bp, G. gallus
ctggaggtcctggtgg

SEQ ID NO: 537898 - DNA, 16 bp, G. gallus
ctggaggtgatcaagg

SEQ ID NO: 537899 - DNA, 16 bp, G. gallus
ctggaggtgcccaagg

SEQ ID NO: 537900 - DNA, 16 bp, G. gallus
ctggaggtgttcaaga

SEQ ID NO: 537901 - DNA, 16 bp, G. gallus
ctggaggtgttcaagg

SEQ ID NO: 537902 - DNA, 16 bp, G. gallus
ctggaggtgttcagga

SEQ ID NO: 537903 - DNA, 16 bp, G. gallus
ctggaggtgttgaagg

SEQ ID NO: 537904 - DNA, 16 bp, G. gallus
ctggagtgctgcaatg

SEQ ID NO: 537905 - DNA, 16 bp, G. gallus
ctggataaggccctgg

SEQ ID NO: 537906 - DNA, 16 bp, G. gallus
ctggatgatctcagag

SEQ ID NO: 537907 - DNA, 16 bp, G. gallus
ctggatgatcttgaag

SEQ ID NO: 537908 - DNA, 16 bp, G. gallus
ctggatgatcttggag

SEQ ID NO: 537909 - DNA, 16 bp, G. gallus
ctggatgcagtacttc

SEQ ID NO: 537910 - DNA, 16 bp, G. gallus
ctggatgcttttctgt

SEQ ID NO: 537911 - DNA, 16 bp, G. gallus
ctggatgtggctctga

SEQ ID NO: 537912 - DNA, 16 bp, G. gallus
ctggatgtggtgctca

SEQ ID NO: 537913 - DNA, 18 bp, G. gallus
ctggcaaagtcacctgat

SEQ ID NO: 537914 - DNA, 16 bp, G. gallus
ctggcaatgtgtgctt

SEQ ID NO: 537915 - DNA, 16 bp, G. gallus
ctggcactgctgctca

SEQ ID NO: 537916 - DNA, 16 bp, G. gallus
ctggcagcagcagcag

SEQ ID NO: 537917 - DNA, 16 bp, G. gallus
ctggcagggcagcaca

SEQ ID NO: 537918 - DNA, 16 bp, G. gallus
ctggcagtgctgccca

SEQ ID NO: 537919 - DNA, 16 bp, G. gallus
ctggccatgggcctgg

SEQ ID NO: 537920 - DNA, 16 bp, G. gallus
ctggccttggatgctt

SEQ ID NO: 537921 - DNA, 16 bp, G. gallus
ctggctccacacagga

SEQ ID NO: 537922 - DNA, 16 bp, G. gallus
ctggctgctgctgctg

SEQ ID NO: 537923 - DNA, 16 bp, G. gallus
ctggctgggatggagt

SEQ ID NO: 537924 - DNA, 16 bp, G. gallus
ctggctgtctcagatc

SEQ ID NO: 537925 - DNA, 16 bp, G. gallus
ctgggagaagtggctg

SEQ ID NO: 537926 - DNA, 16 bp, G. gallus
ctgggagcacaggtgg

SEQ ID NO: 537927 - DNA, 16 bp, G. gallus
ctgggagctgtagttc

SEQ ID NO: 537928 - DNA, 16 bp, G. gallus
ctgggaggaggaggag

SEQ ID NO: 537929 - DNA, 16 bp, G. gallus
ctgggattgccccaac

SEQ ID NO: 537930 - DNA, 16 bp, G. gallus
ctgggcaacctcttcc

SEQ ID NO: 537931 - DNA, 16 bp, G. gallus
ctgggcaacctgctcc

SEQ ID NO: 537932 - DNA, 16 bp, G. gallus
ctgggcagagaatggc

SEQ ID NO: 537933 - DNA, 16 bp, G. gallus
ctgggcagcagtgcca

SEQ ID NO: 537934 - DNA, 16 bp, G. gallus
ctgggcagcccactcc

SEQ ID NO: 537935 - DNA, 16 bp, G. gallus
ctgggcagccccttcc

SEQ ID NO: 537936 - DNA, 16 bp, G. gallus
ctgggcagcctattcc

SEQ ID NO: 537937 - DNA, 16 bp, G. gallus
ctgggcagcctcttcc

SEQ ID NO: 537938 - DNA, 16 bp, G. gallus
ctgggcagcctgatct

SEQ ID NO: 537939 - DNA, 16 bp, G. gallus
ctgggcagcctggtgt

SEQ ID NO: 537940 - DNA, 16 bp, G. gallus
ctgggcagcctgtgcc

SEQ ID NO: 537941 - DNA, 16 bp, G. gallus
ctgggcagctgtgcca

SEQ ID NO: 537942 - DNA, 16 bp, G. gallus
ctgggcagctgttcca

SEQ ID NO: 537943 - DNA, 16 bp, G. gallus
ctgggcaggctggaga

SEQ ID NO: 537944 - DNA, 16 bp, G. gallus
ctgggctctgctcctg

SEQ ID NO: 537945 - DNA, 16 bp, G. gallus
ctgggctgaaaccagg

SEQ ID NO: 537946 - DNA, 16 bp, G. gallus
ctgggctgcattaaaa

SEQ ID NO: 537947 - DNA, 16 bp, G. gallus
ctgggctgcattaaga

SEQ ID NO: 537948 - DNA, 16 bp, G. gallus
ctgggctgcattgagt

SEQ ID NO: 537949 - DNA, 16 bp, G. gallus
ctgggctgcctgtgcc

SEQ ID NO: 537950 - DNA, 16 bp, G. gallus
ctgggcttgtttggct

SEQ ID NO: 537951 - DNA, 16 bp, G. gallus
ctggggaaaaaaaaaa

SEQ ID NO: 537952 - DNA, 16 bp, G. gallus
ctggggaaaaaagaaa

SEQ ID NO: 537953 - DNA, 16 bp, G. gallus
ctggggaacctattcc

SEQ ID NO: 537954 - DNA, 16 bp, G. gallus
ctggggatggagagct

SEQ ID NO: 537955 - DNA, 16 bp, G. gallus
ctggggatggggcatc

SEQ ID NO: 537956 - DNA, 16 bp, G. gallus
ctgggggatggagagc

SEQ ID NO: 537957 - DNA, 16 bp, G. gallus
ctggggttcctccggc

SEQ ID NO: 537958 - DNA, 16 bp, G. gallus
ctgggtgagcactgtg

SEQ ID NO: 537959 - DNA, 16 bp, G. gallus
ctgggtggccctgctg

SEQ ID NO: 537960 - DNA, 24 bp, G. gallus
ctgggttgaaaaggaccacagtga

SEQ ID NO: 537961 - DNA, 16 bp, G. gallus
ctggtccaactcctct

SEQ ID NO: 537962 - DNA, 16 bp, G. gallus
ctggtcccactgcctg

SEQ ID NO: 537963 - DNA, 16 bp, G. gallus
ctggtgagtggcagcc

SEQ ID NO: 537964 - DNA, 16 bp, G. gallus
ctggtgcaccccaggg

SEQ ID NO: 537965 - DNA, 16 bp, G. gallus
ctggtggccaggattc

SEQ ID NO: 537966 - DNA, 16 bp, G. gallus
ctggtgggagggcagg

SEQ ID NO: 537967 - DNA, 16 bp, G. gallus
ctggtgggaggtgtcc

SEQ ID NO: 537968 - DNA, 16 bp, G. gallus
ctggtgggggcagcca

SEQ ID NO: 537969 - DNA, 16 bp, G. gallus
ctggttcaagctgtga

SEQ ID NO: 537970 - DNA, 16 bp, G. gallus
ctgtaaactgttgaca

SEQ ID NO: 537971 - DNA, 16 bp, G. gallus
ctgtacagagccaagg

SEQ ID NO: 537972 - DNA, 16 bp, G. gallus
ctgtaccagtgcctca

SEQ ID NO: 537973 - DNA, 16 bp, G. gallus
ctgtaggcagggctgc

SEQ ID NO: 537974 - DNA, 16 bp, G. gallus
ctgtatttagtaaatt

SEQ ID NO: 537975 - DNA, 16 bp, G. gallus
ctgtcacacagagcag

SEQ ID NO: 537976 - DNA, 18 bp, G. gallus
ctgtcaccagtgagaaga

SEQ ID NO: 537977 - DNA, 16 bp, G. gallus
ctgtcacctgtgagaa

SEQ ID NO: 537978 - DNA, 16 bp, G. gallus
ctgtcatctgtcacca

SEQ ID NO: 537979 - DNA, 16 bp, G. gallus
ctgtccttgctaacga

SEQ ID NO: 537980 - DNA, 16 bp, G. gallus
ctgtccttggagatgt

SEQ ID NO: 537981 - DNA, 16 bp, G. gallus
ctgtcgctgtcacaga

SEQ ID NO: 537982 - DNA, 16 bp, G. gallus
ctgtcttttaaagaca

SEQ ID NO: 537983 - DNA, 16 bp, G. gallus
ctgtgaagaaaattaa

SEQ ID NO: 537984 - DNA, 16 bp, G. gallus
ctgtgaccatccaacc

SEQ ID NO: 537985 - DNA, 16 bp, G. gallus
ctgtgcactgcaggga

SEQ ID NO: 537986 - DNA, 16 bp, G. gallus
ctgtgcagatgtggca

SEQ ID NO: 537987 - DNA, 16 bp, G. gallus
ctgtgcagctgtgcca

SEQ ID NO: 537988 - DNA, 16 bp, G. gallus
ctgtgcagtgctgctg

SEQ ID NO: 537989 - DNA, 16 bp, G. gallus
ctgtgccagcatctca

SEQ ID NO: 537990 - DNA, 16 bp, G. gallus
ctgtgccagtgcctca

SEQ ID NO: 537991 - DNA, 16 bp, G. gallus
ctgtgccatgcccacc

SEQ ID NO: 537992 - DNA, 23 bp, G. gallus
ctgtgcccctgcagctgactcag

SEQ ID NO: 537993 - DNA, 16 bp, G. gallus
ctgtgcccctgcggct

SEQ ID NO: 537994 - DNA, 16 bp, G. gallus
ctgtgctcctgcagct

SEQ ID NO: 537995 - DNA, 16 bp, G. gallus
ctgtgctgctgcagca

SEQ ID NO: 537996 - DNA, 16 bp, G. gallus
ctgtgctgctgctgct

SEQ ID NO: 537997 - DNA, 16 bp, G. gallus
ctgtgctgctgctggg

SEQ ID NO: 537998 - DNA, 16 bp, G. gallus
ctgtgctggctgtctt

SEQ ID NO: 537999 - DNA, 16 bp, G. gallus
ctgtgctggtgaggcc

SEQ ID NO: 538000 - DNA, 16 bp, G. gallus
ctgtggaaaaaaaaaa

SEQ ID NO: 538001 - DNA, 16 bp, G. gallus
ctgtggagaaggacct

SEQ ID NO: 538002 - DNA, 16 bp, G. gallus
ctgtggatgccctatc

SEQ ID NO: 538003 - DNA, 16 bp, G. gallus
ctgtggctgtccctgt

SEQ ID NO: 538004 - DNA, 16 bp, G. gallus
ctgtggtggaattcat

SEQ ID NO: 538005 - DNA, 16 bp, G. gallus
ctgtggtggaattccc

SEQ ID NO: 538006 - DNA, 16 bp, G. gallus
ctgtggtggattcatg

SEQ ID NO: 538007 - DNA, 16 bp, G. gallus
ctgtgtcagggaaggg

SEQ ID NO: 538008 - DNA, 16 bp, G. gallus
ctgtgtccaggcctgg

SEQ ID NO: 538009 - DNA, 16 bp, G. gallus
ctgtgtctgagagcac

SEQ ID NO: 538010 - DNA, 16 bp, G. gallus
ctgtgtgaaaaacatc

SEQ ID NO: 538011 - DNA, 16 bp, G. gallus
ctgtgtgcagttctgg

SEQ ID NO: 538012 - DNA, 16 bp, G. gallus
ctgtgtggagccaaga

SEQ ID NO: 538013 - DNA, 16 bp, G. gallus
ctgtgtggagccagga

SEQ ID NO: 538014 - DNA, 16 bp, G. gallus
ctgtgtggagtcagga

SEQ ID NO: 538015 - DNA, 16 bp, G. gallus
ctgtgtggtgctgagc

SEQ ID NO: 538016 - DNA, 16 bp, G. gallus
ctgtgtgtctgtgtgt

SEQ ID NO: 538017 - DNA, 16 bp, G. gallus
ctgtgtgtgtgtgtgc

SEQ ID NO: 538018 - DNA, 16 bp, G. gallus
ctgtgttccagttttt

SEQ ID NO: 538019 - DNA, 16 bp, G. gallus
ctgtgttctgggctgc

SEQ ID NO: 538020 - DNA, 16 bp, G. gallus
ctgttcagcctggaga

SEQ ID NO: 538021 - DNA, 16 bp, G. gallus
ctgttccactgtgtca

SEQ ID NO: 538022 - DNA, 16 bp, G. gallus
ctgttccagtacctca

SEQ ID NO: 538023 - DNA, 16 bp, G. gallus
ctgttcctgtgtctca

SEQ ID NO: 538024 - DNA, 16 bp, G. gallus
ctgttctgcctggaga

SEQ ID NO: 538025 - DNA, 16 bp, G. gallus
ctgttgccactgctga

SEQ ID NO: 538026 - DNA, 16 bp, G. gallus
ctgttggtgttcaaag

SEQ ID NO: 538027 - DNA, 16 bp, G. gallus
ctgttgtcactgctga

SEQ ID NO: 538028 - DNA, 16 bp, G. gallus
ctgttgtcccttcaga

SEQ ID NO: 538029 - DNA, 16 bp, G. gallus
ctgtttaaaaagaaaa

SEQ ID NO: 538030 - DNA, 16 bp, G. gallus
ctgtttaaatgtagaa

SEQ ID NO: 538031 - DNA, 16 bp, G. gallus
ctgtttcacagctgct

SEQ ID NO: 538032 - DNA, 16 bp, G. gallus
ctgtttcagtgctcca

SEQ ID NO: 538033 - DNA, 16 bp, G. gallus
ctgtttcccctttctg

SEQ ID NO: 538034 - DNA, 16 bp, G. gallus
ctgtttcccttttcca

SEQ ID NO: 538035 - DNA, 16 bp, G. gallus
ctgtttggtctccatg

SEQ ID NO: 538036 - DNA, 16 bp, G. gallus
ctgtttttcaacacag

SEQ ID NO: 538037 - DNA, 16 bp, G. gallus
cttaagttgcaccagg

SEQ ID NO: 538038 - DNA, 16 bp, G. gallus
cttaatgattctatga

SEQ ID NO: 538039 - DNA, 16 bp, G. gallus
cttaccttggcacaac

SEQ ID NO: 538040 - DNA, 16 bp, G. gallus
cttactcagccttgtg

SEQ ID NO: 538041 - DNA, 16 bp, G. gallus
cttactgaatgtttat

SEQ ID NO: 538042 - DNA, 16 bp, G. gallus
cttagaatcataaaat

SEQ ID NO: 538043 - DNA, 16 bp, G. gallus
cttatccaatcagagc

SEQ ID NO: 538044 - DNA, 18 bp, G. gallus
cttatgaggagcggctga

SEQ ID NO: 538045 - DNA, 16 bp, G. gallus
cttcaagtactgaaag

SEQ ID NO: 538046 - DNA, 16 bp, G. gallus
cttcacagtcatccag

SEQ ID NO: 538047 - DNA, 16 bp, G. gallus
cttcactgggcagcct

SEQ ID NO: 538048 - DNA, 16 bp, G. gallus
cttcagaaaaaaaata

SEQ ID NO: 538049 - DNA, 16 bp, G. gallus
cttcagagaagaaatt

SEQ ID NO: 538050 - DNA, 16 bp, G. gallus
cttcagaggagaggtg

SEQ ID NO: 538051 - DNA, 16 bp, G. gallus
cttcagatattgaaag

SEQ ID NO: 538052 - DNA, 16 bp, G. gallus
cttcagcaagtttgct

SEQ ID NO: 538053 - DNA, 16 bp, G. gallus
cttcaggaaaaagaaa

SEQ ID NO: 538054 - DNA, 16 bp, G. gallus
cttcagtggaaaaaaa

SEQ ID NO: 538055 - DNA, 16 bp, G. gallus
cttcatcagtgatctg

SEQ ID NO: 538056 - DNA, 16 bp, G. gallus
cttccaacccaaggca

SEQ ID NO: 538057 - DNA, 16 bp, G. gallus
cttccaacccatgcca

SEQ ID NO: 538058 - DNA, 16 bp, G. gallus
cttccacctgtgctcc

SEQ ID NO: 538059 - DNA, 16 bp, G. gallus
cttccacgtcagatgc

SEQ ID NO: 538060 - DNA, 16 bp, G. gallus
cttccagcccaaacca

SEQ ID NO: 538061 - DNA, 16 bp, G. gallus
cttccccagcacagag

SEQ ID NO: 538062 - DNA, 16 bp, G. gallus
cttccccatcccactg

SEQ ID NO: 538063 - DNA, 16 bp, G. gallus
cttccccctgacatct

SEQ ID NO: 538064 - DNA, 16 bp, G. gallus
cttcccctctgctctg

SEQ ID NO: 538065 - DNA, 16 bp, G. gallus
cttccctggctcagct

SEQ ID NO: 538066 - DNA, 16 bp, G. gallus
cttccctgggcaacct

SEQ ID NO: 538067 - DNA, 16 bp, G. gallus
cttcccttccctccag

SEQ ID NO: 538068 - DNA, 16 bp, G. gallus
cttcctgctcctgctg

SEQ ID NO: 538069 - DNA, 16 bp, G. gallus
cttcctgctgctgctg

SEQ ID NO: 538070 - DNA, 16 bp, G. gallus
cttcctggaccccttt

SEQ ID NO: 538071 - DNA, 16 bp, G. gallus
cttctccaaagagcag

SEQ ID NO: 538072 - DNA, 16 bp, G. gallus
cttctccagcctgtct

SEQ ID NO: 538073 - DNA, 16 bp, G. gallus
cttctctgagcaacct

SEQ ID NO: 538074 - DNA, 16 bp, G. gallus
cttctctggacagctg

SEQ ID NO: 538075 - DNA, 16 bp, G. gallus
cttctgctgccatctg

SEQ ID NO: 538076 - DNA, 16 bp, G. gallus
cttctgctgctgcttt

SEQ ID NO: 538077 - DNA, 16 bp, G. gallus
cttctgctgctgtctg

SEQ ID NO: 538078 - DNA, 16 bp, G. gallus
cttctgtttatttcca

SEQ ID NO: 538079 - DNA, 16 bp, G. gallus
cttcttcagcatgcag

SEQ ID NO: 538080 - DNA, 17 bp, G. gallus
cttcttcctggacctac

SEQ ID NO: 538081 - DNA, 16 bp, G. gallus
cttcttggcagggctg

SEQ ID NO: 538082 - DNA, 16 bp, G. gallus
cttcttggccacctgg

SEQ ID NO: 538083 - DNA, 16 bp, G. gallus
cttgaaaatgggggtt

SEQ ID NO: 538084 - DNA, 16 bp, G. gallus
cttgaaagtctccagg

SEQ ID NO: 538085 - DNA, 16 bp, G. gallus
cttgaacacctccagg

SEQ ID NO: 538086 - DNA, 16 bp, G. gallus
cttgaacagctccagg

SEQ ID NO: 538087 - DNA, 16 bp, G. gallus
cttgaactctggcagc

SEQ ID NO: 538088 - DNA, 16 bp, G. gallus
cttgagcaggggttgg

SEQ ID NO: 538089 - DNA, 16 bp, G. gallus
cttgagcctcctcttc

SEQ ID NO: 538090 - DNA, 16 bp, G. gallus
cttgaggtcccttcca

SEQ ID NO: 538091 - DNA, 16 bp, G. gallus
cttgcagaagagaagg

SEQ ID NO: 538092 - DNA, 16 bp, G. gallus
cttgcagctcagaaag

SEQ ID NO: 538093 - DNA, 16 bp, G. gallus
cttgcaggaccaagct

SEQ ID NO: 538094 - DNA, 16 bp, G. gallus
cttgcattccaacatc

SEQ ID NO: 538095 - DNA, 16 bp, G. gallus
cttgctcagcctggag

SEQ ID NO: 538096 - DNA, 16 bp, G. gallus
cttgctcctgctggca

SEQ ID NO: 538097 - DNA, 16 bp, G. gallus
cttgctgaggatacac

SEQ ID NO: 538098 - DNA, 16 bp, G. gallus
cttgctgggcagcctg

SEQ ID NO: 538099 - DNA, 16 bp, G. gallus
cttggaaaaaaagaaa

SEQ ID NO: 538100 - DNA, 16 bp, G. gallus
cttggagaagaaaagg

SEQ ID NO: 538101 - DNA, 16 bp, G. gallus
cttggcatcatctgca

SEQ ID NO: 538102 - DNA, 16 bp, G. gallus
cttggccttgctgaac

SEQ ID NO: 538103 - DNA, 16 bp, G. gallus
cttggctgcttttgac

SEQ ID NO: 538104 - DNA, 16 bp, G. gallus
cttgggacagagtggc

SEQ ID NO: 538105 - DNA, 16 bp, G. gallus
cttgtagtgagaggcc

SEQ ID NO: 538106 - DNA, 16 bp, G. gallus
cttgtcctgttgctgg

SEQ ID NO: 538107 - DNA, 16 bp, G. gallus
cttgtcttatcactgt

SEQ ID NO: 538108 - DNA, 16 bp, G. gallus
cttgtgcagattttta

SEQ ID NO: 538109 - DNA, 16 bp, G. gallus
cttgtgctttcaggag

SEQ ID NO: 538110 - DNA, 16 bp, G. gallus
cttgtggccatttcct

SEQ ID NO: 538111 - DNA, 16 bp, G. gallus
cttgtggggaaaaaaa

SEQ ID NO: 538112 - DNA, 16 bp, G. gallus
cttgtgtcttggtgaa

SEQ ID NO: 538113 - DNA, 16 bp, G. gallus
cttgttcattgctgga

SEQ ID NO: 538114 - DNA, 16 bp, G. gallus
ctttaaagaaagaaaa

SEQ ID NO: 538115 - DNA, 16 bp, G. gallus
ctttaagatcccttcc

SEQ ID NO: 538116 - DNA, 16 bp, G. gallus
ctttaagggtcccttc

SEQ ID NO: 538117 - DNA, 16 bp, G. gallus
ctttagtttaaaacca

SEQ ID NO: 538118 - DNA, 16 bp, G. gallus
ctttcaaagagttgaa

SEQ ID NO: 538119 - DNA, 16 bp, G. gallus
ctttcaagaaaaaaaa

SEQ ID NO: 538120 - DNA, 16 bp, G. gallus
ctttcagagaagtttt

SEQ ID NO: 538121 - DNA, 16 bp, G. gallus
ctttcagagcaacata

SEQ ID NO: 538122 - DNA, 16 bp, G. gallus
ctttcagagcagcact

SEQ ID NO: 538123 - DNA, 16 bp, G. gallus
ctttcagcctgtcctc

SEQ ID NO: 538124 - DNA, 16 bp, G. gallus
ctttcaggaagttgta

SEQ ID NO: 538125 - DNA, 16 bp, G. gallus
ctttccagtatttaaa

SEQ ID NO: 538126 - DNA, 16 bp, G. gallus
ctttctcttctccagg

SEQ ID NO: 538127 - DNA, 16 bp, G. gallus
ctttctcttgcaacat

SEQ ID NO: 538128 - DNA, 16 bp, G. gallus
ctttctgggaagaaat

SEQ ID NO: 538129 - DNA, 16 bp, G. gallus
ctttctgtgaagaaat

SEQ ID NO: 538130 - DNA, 16 bp, G. gallus
ctttcttacagcctcc

SEQ ID NO: 538131 - DNA, 16 bp, G. gallus
ctttgaaagtctccag

SEQ ID NO: 538132 - DNA, 16 bp, G. gallus
ctttgagcttgaagcc

SEQ ID NO: 538133 - DNA, 16 bp, G. gallus
ctttgcattcagagag

SEQ ID NO: 538134 - DNA, 16 bp, G. gallus
ctttgctgctctgctg

SEQ ID NO: 538135 - DNA, 16 bp, G. gallus
ctttgctgggtaaaaa

SEQ ID NO: 538136 - DNA, 16 bp, G. gallus
ctttgcttcagtcttt

SEQ ID NO: 538137 - DNA, 16 bp, G. gallus
ctttggacacactcca

SEQ ID NO: 538138 - DNA, 16 bp, G. gallus
ctttggcccaagtatt

SEQ ID NO: 538139 - DNA, 16 bp, G. gallus
ctttggccttcttggc

SEQ ID NO: 538140 - DNA, 16 bp, G. gallus
ctttgggagaagaaat

SEQ ID NO: 538141 - DNA, 16 bp, G. gallus
cttttaaaaacaaaac

SEQ ID NO: 538142 - DNA, 16 bp, G. gallus
cttttaaaacaaaaca

SEQ ID NO: 538143 - DNA, 16 bp, G. gallus
cttttagagaagaaat

SEQ ID NO: 538144 - DNA, 16 bp, G. gallus
cttttagtttaaaatc

SEQ ID NO: 538145 - DNA, 16 bp, G. gallus
cttttattgctgagca

SEQ ID NO: 538146 - DNA, 16 bp, G. gallus
cttttcaacccagacc

SEQ ID NO: 538147 - DNA, 16 bp, G. gallus
cttttcagcctggaga

SEQ ID NO: 538148 - DNA, 16 bp, G. gallus
cttttccaacccaagc

SEQ ID NO: 538149 - DNA, 16 bp, G. gallus
cttttccaacctgaat

SEQ ID NO: 538150 - DNA, 16 bp, G. gallus
cttttccaaccttaac

SEQ ID NO: 538151 - DNA, 16 bp, G. gallus
cttttccttatcctca

SEQ ID NO: 538152 - DNA, 16 bp, G. gallus
cttttctgaaggaagg

SEQ ID NO: 538153 - DNA, 16 bp, G. gallus
cttttcttgagcacct

SEQ ID NO: 538154 - DNA, 16 bp, G. gallus
cttttggagcagtcct

SEQ ID NO: 538155 - DNA, 16 bp, G. gallus
cttttttagtttaaaa

SEQ ID NO: 538156 - DNA, 16 bp, G. gallus
cttttttcataggaga

SEQ ID NO: 538157 - DNA, 16 bp, G. gallus
cttttttttccctaaa

SEQ ID NO: 538158 - DNA, 16 bp, G. gallus
gaaaaaaaaatctgga

SEQ ID NO: 538159 - DNA, 16 bp, G. gallus
gaaaaaaaaatgcttt

SEQ ID NO: 538160 - DNA, 16 bp, G. gallus
gaaaaaaatatttctt

SEQ ID NO: 538161 - DNA, 16 bp, G. gallus
gaaaaaaatgcatttt

SEQ ID NO: 538162 - DNA, 16 bp, G. gallus
gaaaaaatacatattt

SEQ ID NO: 538163 - DNA, 16 bp, G. gallus
gaaaaaatggcaccca

SEQ ID NO: 538164 - DNA, 16 bp, G. gallus
gaaaaacttctcagaa

SEQ ID NO: 538165 - DNA, 16 bp, G. gallus
gaaaaacttctccaaa

SEQ ID NO: 538166 - DNA, 16 bp, G. gallus
gaaaaagaaaatactt

SEQ ID NO: 538167 - DNA, 16 bp, G. gallus
gaaaaagcttttcctt

SEQ ID NO: 538168 - DNA, 16 bp, G. gallus
gaaaaagttgcaccca

SEQ ID NO: 538169 - DNA, 16 bp, G. gallus
gaaaaatgcatttgct

SEQ ID NO: 538170 - DNA, 16 bp, G. gallus
gaaaaccttcctccta

SEQ ID NO: 538171 - DNA, 16 bp, G. gallus
gaaaactttttttttt

SEQ ID NO: 538172 - DNA, 16 bp, G. gallus
gaaaagaaaaatgttt

SEQ ID NO: 538173 - DNA, 16 bp, G. gallus
gaaaagaccttaaaga

SEQ ID NO: 538174 - DNA, 16 bp, G. gallus
gaaaagctggacatga

SEQ ID NO: 538175 - DNA, 16 bp, G. gallus
gaaaaggaggctgaga

SEQ ID NO: 538176 - DNA, 16 bp, G. gallus
gaaaagggtagattta

SEQ ID NO: 538177 - DNA, 16 bp, G. gallus
gaaaatgggggttatg

SEQ ID NO: 538178 - DNA, 16 bp, G. gallus
gaaaatgtatagctaa

SEQ ID NO: 538179 - DNA, 16 bp, G. gallus
gaaaatgtatttattt

SEQ ID NO: 538180 - DNA, 16 bp, G. gallus
gaaaatgttgcccaca

SEQ ID NO: 538181 - DNA, 16 bp, G. gallus
gaaaatgttgcccatg

SEQ ID NO: 538182 - DNA, 17 bp, G. gallus
gaaacaaaggtgtgtca

SEQ ID NO: 538183 - DNA, 16 bp, G. gallus
gaaacctgttccagtg

SEQ ID NO: 538184 - DNA, 16 bp, G. gallus
gaaagacaagccacgt

SEQ ID NO: 538185 - DNA, 16 bp, G. gallus
gaaagacagacagaca

SEQ ID NO: 538186 - DNA, 16 bp, G. gallus
gaaagaggaaagattt

SEQ ID NO: 538187 - DNA, 16 bp, G. gallus
gaaagcaaaggtaaga

SEQ ID NO: 538188 - DNA, 16 bp, G. gallus
gaaagcacagcaacaa

SEQ ID NO: 538189 - DNA, 16 bp, G. gallus
gaaaggacctctaaga

SEQ ID NO: 538190 - DNA, 16 bp, G. gallus
gaaaggagagcaaata

SEQ ID NO: 538191 - DNA, 16 bp, G. gallus
gaaaggagctctgtgg

SEQ ID NO: 538192 - DNA, 16 bp, G. gallus
gaaaggcaaaagccca

SEQ ID NO: 538193 - DNA, 16 bp, G. gallus
gaaaggctgctatcag

SEQ ID NO: 538194 - DNA, 18 bp, G. gallus
gaaatacagcctgcatct

SEQ ID NO: 538195 - DNA, 16 bp, G. gallus
gaaatacctcaggaag

SEQ ID NO: 538196 - DNA, 16 bp, G. gallus
gaaatagatgatcttt

SEQ ID NO: 538197 - DNA, 16 bp, G. gallus
gaaatattggtgatag

SEQ ID NO: 538198 - DNA, 16 bp, G. gallus
gaaatcaactttttac

SEQ ID NO: 538199 - DNA, 16 bp, G. gallus
gaaatccaggtagatg

SEQ ID NO: 538200 - DNA, 16 bp, G. gallus
gaaatgaagagtgtct

SEQ ID NO: 538201 - DNA, 16 bp, G. gallus
gaacaacttgttctgg

SEQ ID NO: 538202 - DNA, 16 bp, G. gallus
gaacaaggagcaatgg

SEQ ID NO: 538203 - DNA, 16 bp, G. gallus
gaacaagttgcccaag

SEQ ID NO: 538204 - DNA, 16 bp, G. gallus
gaacaatcccagctcc

SEQ ID NO: 538205 - DNA, 16 bp, G. gallus
gaacacactgctggct

SEQ ID NO: 538206 - DNA, 16 bp, G. gallus
gaacacctccagggac

SEQ ID NO: 538207 - DNA, 16 bp, G. gallus
gaacagaacagaacag

SEQ ID NO: 538208 - DNA, 16 bp, G. gallus
gaacagccccagctct

SEQ ID NO: 538209 - DNA, 16 bp, G. gallus
gaacagctgtgtggtg

SEQ ID NO: 538210 - DNA, 16 bp, G. gallus
gaacagcttgggttgg

SEQ ID NO: 538211 - DNA, 16 bp, G. gallus
gaacaggctgagagag

SEQ ID NO: 538212 - DNA, 16 bp, G. gallus
gaacagtgaaaaaagc

SEQ ID NO: 538213 - DNA, 16 bp, G. gallus
gaacatgaggaagaac

SEQ ID NO: 538214 - DNA, 16 bp, G. gallus
gaaccatgtccctcag

SEQ ID NO: 538215 - DNA, 16 bp, G. gallus
gaacccatggatggat

SEQ ID NO: 538216 - DNA, 16 bp, G. gallus
gaaccttaaagatcac

SEQ ID NO: 538217 - DNA, 17 bp, G. gallus
gaacggtttgggttgga

SEQ ID NO: 538218 - DNA, 16 bp, G. gallus
gaactacagctcccag

SEQ ID NO: 538219 - DNA, 16 bp, G. gallus
gaactgagattgttca

SEQ ID NO: 538220 - DNA, 16 bp, G. gallus
gaactggatgatcttt

SEQ ID NO: 538221 - DNA, 16 bp, G. gallus
gaacttcctatgttca

SEQ ID NO: 538222 - DNA, 16 bp, G. gallus
gaagaatcttttccta

SEQ ID NO: 538223 - DNA, 16 bp, G. gallus
gaagaatttcttctca

SEQ ID NO: 538224 - DNA, 16 bp, G. gallus
gaagacctcattgcag

SEQ ID NO: 538225 - DNA, 16 bp, G. gallus
gaagagaaagctcagg

SEQ ID NO: 538226 - DNA, 16 bp, G. gallus
gaagagaaagctctga

SEQ ID NO: 538227 - DNA, 16 bp, G. gallus
gaagagaaggctcctg

SEQ ID NO: 538228 - DNA, 16 bp, G. gallus
gaagagaaggctttgg

SEQ ID NO: 538229 - DNA, 16 bp, G. gallus
gaagagacctcaagga

SEQ ID NO: 538230 - DNA, 16 bp, G. gallus
gaagagcagcagcagc

SEQ ID NO: 538231 - DNA, 16 bp, G. gallus
gaagagcctggctcca

SEQ ID NO: 538232 - DNA, 16 bp, G. gallus
gaagaggccaaccctc

SEQ ID NO: 538233 - DNA, 16 bp, G. gallus
gaagagtgggcaagct

SEQ ID NO: 538234 - DNA, 20 bp, G. gallus
gaagatacgtcatctggttg

SEQ ID NO: 538235 - DNA, 16 bp, G. gallus
gaagatgataacaaag

SEQ ID NO: 538236 - DNA, 16 bp, G. gallus
gaagcaagagggagat

SEQ ID NO: 538237 - DNA, 16 bp, G. gallus
gaagcaagggatattt

SEQ ID NO: 538238 - DNA, 16 bp, G. gallus
gaagcagcagcagcac

SEQ ID NO: 538239 - DNA, 16 bp, G. gallus
gaagcccttctttcta

SEQ ID NO: 538240 - DNA, 16 bp, G. gallus
gaagctgaggggagac

SEQ ID NO: 538241 - DNA, 16 bp, G. gallus
gaagctgctaggctgt

SEQ ID NO: 538242 - DNA, 16 bp, G. gallus
gaagctgtgcagggag

SEQ ID NO: 538243 - DNA, 16 bp, G. gallus
gaaggaagggatgcca

SEQ ID NO: 538244 - DNA, 16 bp, G. gallus
gaaggagttctgaagg

SEQ ID NO: 538245 - DNA, 16 bp, G. gallus
gaaggatcacctctct

SEQ ID NO: 538246 - DNA, 16 bp, G. gallus
gaaggatgcagagctg

SEQ ID NO: 538247 - DNA, 16 bp, G. gallus
gaaggccaactgtgtt

SEQ ID NO: 538248 - DNA, 16 bp, G. gallus
gaaggccagtggcatc

SEQ ID NO: 538249 - DNA, 16 bp, G. gallus
gaaggccatgaagatg

SEQ ID NO: 538250 - DNA, 16 bp, G. gallus
gaaggcccttcagagg

SEQ ID NO: 538251 - DNA, 16 bp, G. gallus
gaaggctccaaggaga

SEQ ID NO: 538252 - DNA, 16 bp, G. gallus
gaaggctccaggaaga

SEQ ID NO: 538253 - DNA, 16 bp, G. gallus
gaaggctgcagtgagg

SEQ ID NO: 538254 - DNA, 16 bp, G. gallus
gaaggctgtggggaga

SEQ ID NO: 538255 - DNA, 16 bp, G. gallus
gaaggcttcagggaga

SEQ ID NO: 538256 - DNA, 16 bp, G. gallus
gaagggaccttaaagc

SEQ ID NO: 538257 - DNA, 16 bp, G. gallus
gaagggaccttcaaga

SEQ ID NO: 538258 - DNA, 16 bp, G. gallus
gaagggctggatcctg

SEQ ID NO: 538259 - DNA, 16 bp, G. gallus
gaaggggcctttaaga

SEQ ID NO: 538260 - DNA, 16 bp, G. gallus
gaagggtggagccagg

SEQ ID NO: 538261 - DNA, 17 bp, G. gallus
gaagggttacgtcactc

SEQ ID NO: 538262 - DNA, 16 bp, G. gallus
gaaggtcaagggaggt

SEQ ID NO: 538263 - DNA, 16 bp, G. gallus
gaaggtctccaaggag

SEQ ID NO: 538264 - DNA, 16 bp, G. gallus
gaaggtgttcaaggcc

SEQ ID NO: 538265 - DNA, 16 bp, G. gallus
gaagtatttcctaatg

SEQ ID NO: 538266 - DNA, 16 bp, G. gallus
gaagttcaacaaggtc

SEQ ID NO: 538267 - DNA, 16 bp, G. gallus
gaagttctttactcag

SEQ ID NO: 538268 - DNA, 16 bp, G. gallus
gaagtttttcctaaca

SEQ ID NO: 538269 - DNA, 16 bp, G. gallus
gaataaaagcaaaggc

SEQ ID NO: 538270 - DNA, 16 bp, G. gallus
gaataaacaccatttt

SEQ ID NO: 538271 - DNA, 16 bp, G. gallus
gaatagctgctgtaga

SEQ ID NO: 538272 - DNA, 16 bp, G. gallus
gaatatctccaaagaa

SEQ ID NO: 538273 - DNA, 16 bp, G. gallus
gaatattggcaggaag

SEQ ID NO: 538274 - DNA, 16 bp, G. gallus
gaatattggtgggaaa

SEQ ID NO: 538275 - DNA, 16 bp, G. gallus
gaatcacagcatggct

SEQ ID NO: 538276 - DNA, 16 bp, G. gallus
gaatcatagaattgta

SEQ ID NO: 538277 - DNA, 16 bp, G. gallus
gaatcatttaggttgg

SEQ ID NO: 538278 - DNA, 16 bp, G. gallus
gaatcttagaatcatt

SEQ ID NO: 538279 - DNA, 16 bp, G. gallus
gaatcttctgatatgg

SEQ ID NO: 538280 - DNA, 16 bp, G. gallus
gaatggcagcacagct

SEQ ID NO: 538281 - DNA, 16 bp, G. gallus
gaatggctggaagact

SEQ ID NO: 538282 - DNA, 16 bp, G. gallus
gaatgggatgggatgg

SEQ ID NO: 538283 - DNA, 16 bp, G. gallus
gaatgggctgcacagg

SEQ ID NO: 538284 - DNA, 16 bp, G. gallus
gaatggtgttccccag

SEQ ID NO: 538285 - DNA, 16 bp, G. gallus
gaatggttttaaactg

SEQ ID NO: 538286 - DNA, 16 bp, G. gallus
gaatgtcagtgggtgc

SEQ ID NO: 538287 - DNA, 16 bp, G. gallus
gaattatagaattgtt

SEQ ID NO: 538288 - DNA, 17 bp, G. gallus
gaattccaccacatgga

SEQ ID NO: 538289 - DNA, 16 bp, G. gallus
gaattccaccacattg

SEQ ID NO: 538290 - DNA, 16 bp, G. gallus
gaattgttttcttcag

SEQ ID NO: 538291 - DNA, 20 bp, G. gallus
gacaatctttctctcaatta

SEQ ID NO: 538292 - DNA, 16 bp, G. gallus
gacacagatgatggca

SEQ ID NO: 538293 - DNA, 16 bp, G. gallus
gacacccacagctcca

SEQ ID NO: 538294 - DNA, 16 bp, G. gallus
gacacctacagctaca

SEQ ID NO: 538295 - DNA, 16 bp, G. gallus
gacacctcccaccaga

SEQ ID NO: 538296 - DNA, 16 bp, G. gallus
gacacttccagccagc

SEQ ID NO: 538297 - DNA, 16 bp, G. gallus
gacagaatgacatctg

SEQ ID NO: 538298 - DNA, 16 bp, G. gallus
gacagacagacagaca

SEQ ID NO: 538299 - DNA, 16 bp, G. gallus
gacagaccaaccagag

SEQ ID NO: 538300 - DNA, 16 bp, G. gallus
gacagatgaggtgttc

SEQ ID NO: 538301 - DNA, 16 bp, G. gallus
gacagccagcatggct

SEQ ID NO: 538302 - DNA, 16 bp, G. gallus
gacagcctgagctggt

SEQ ID NO: 538303 - DNA, 16 bp, G. gallus
gacaggacaagggaga

SEQ ID NO: 538304 - DNA, 16 bp, G. gallus
gacaggatgaggagaa

SEQ ID NO: 538305 - DNA, 16 bp, G. gallus
gacaggctgagggaga

SEQ ID NO: 538306 - DNA, 16 bp, G. gallus
gacaggctggagagct

SEQ ID NO: 538307 - DNA, 16 bp, G. gallus
gacagtagaggctgaa

SEQ ID NO: 538308 - DNA, 16 bp, G. gallus
gacatagggtttgaat

SEQ ID NO: 538309 - DNA, 16 bp, G. gallus
gacatggatctgttgg

SEQ ID NO: 538310 - DNA, 16 bp, G. gallus
gacatggtgtcaccac

SEQ ID NO: 538311 - DNA, 16 bp, G. gallus
gacattctgtgattct

SEQ ID NO: 538312 - DNA, 16 bp, G. gallus
gaccaaacagcggatg

SEQ ID NO: 538313 - DNA, 16 bp, G. gallus
gaccaacataataaaa

SEQ ID NO: 538314 - DNA, 16 bp, G. gallus
gaccacaccacacagc

SEQ ID NO: 538315 - DNA, 16 bp, G. gallus
gaccagcccgtaaacc

SEQ ID NO: 538316 - DNA, 16 bp, G. gallus
gaccaggggggtaaat

SEQ ID NO: 538317 - DNA, 16 bp, G. gallus
gaccatccaaccaatt

SEQ ID NO: 538318 - DNA, 16 bp, G. gallus
gacccaggtgcaagac

SEQ ID NO: 538319 - DNA, 16 bp, G. gallus
gacccataaggatcat

SEQ ID NO: 538320 - DNA, 16 bp, G. gallus
gacccatccccaccat

SEQ ID NO: 538321 - DNA, 16 bp, G. gallus
gaccctgcccacagca

SEQ ID NO: 538322 - DNA, 16 bp, G. gallus
gacctcaaagatcatc

SEQ ID NO: 538323 - DNA, 16 bp, G. gallus
gacctccagctcacta

SEQ ID NO: 538324 - DNA, 16 bp, G. gallus
gacctctgagggccat

SEQ ID NO: 538325 - DNA, 16 bp, G. gallus
gacctgctccaaaagc

SEQ ID NO: 538326 - DNA, 16 bp, G. gallus
gacctgctgctcacca

SEQ ID NO: 538327 - DNA, 16 bp, G. gallus
gacctggacagactgg

SEQ ID NO: 538328 - DNA, 16 bp, G. gallus
gacctggacaggctga

SEQ ID NO: 538329 - DNA, 16 bp, G. gallus
gaccttccagtacttg

SEQ ID NO: 538330 - DNA, 16 bp, G. gallus
gactacattgaaaaat

SEQ ID NO: 538331 - DNA, 16 bp, G. gallus
gactcaaccacttccc

SEQ ID NO: 538332 - DNA, 16 bp, G. gallus
gactccaccacatccc

SEQ ID NO: 538333 - DNA, 16 bp, G. gallus
gactcggccctcttct

SEQ ID NO: 538334 - DNA, 16 bp, G. gallus
gactgagggagctggg

SEQ ID NO: 538335 - DNA, 16 bp, G. gallus
gactggaaaaaaggca

SEQ ID NO: 538336 - DNA, 16 bp, G. gallus
gactggaaaaaggaaa

SEQ ID NO: 538337 - DNA, 16 bp, G. gallus
gactggaaaaagggaa

SEQ ID NO: 538338 - DNA, 24 bp, G. gallus
gactggaaggagcagtccttgaga

SEQ ID NO: 538339 - DNA, 16 bp, G. gallus
gactggcctgtagttt

SEQ ID NO: 538340 - DNA, 16 bp, G. gallus
gactgtgtggaagaaa

SEQ ID NO: 538341 - DNA, 16 bp, G. gallus
gacttcaacttccctg

SEQ ID NO: 538342 - DNA, 16 bp, G. gallus
gacttgatctttaagg

SEQ ID NO: 538343 - DNA, 16 bp, G. gallus
gacttgtgcaaagcat

SEQ ID NO: 538344 - DNA, 16 bp, G. gallus
gagaaaatcatagaat

SEQ ID NO: 538345 - DNA, 16 bp, G. gallus
gagaaacctgaggata

SEQ ID NO: 538346 - DNA, 33 bp, G. gallus
gagaaagaacatcaagtactggcccaacagaac

SEQ ID NO: 538347 - DNA, 16 bp, G. gallus
gagaagaaatccttga

SEQ ID NO: 538348 - DNA, 16 bp, G. gallus
gagaagaacttgagag

SEQ ID NO: 538349 - DNA, 16 bp, G. gallus
gagaagaagaactacg

SEQ ID NO: 538350 - DNA, 16 bp, G. gallus
gagaagaagtgtttcc

SEQ ID NO: 538351 - DNA, 16 bp, G. gallus
gagaagagaaggctga

SEQ ID NO: 538352 - DNA, 16 bp, G. gallus
gagaagaggaagctca

SEQ ID NO: 538353 - DNA, 16 bp, G. gallus
gagaagaggccgaccc

SEQ ID NO: 538354 - DNA, 16 bp, G. gallus
gagaagatctccttga

SEQ ID NO: 538355 - DNA, 16 bp, G. gallus
gagaagctggcagccc

SEQ ID NO: 538356 - DNA, 16 bp, G. gallus
gagaaggactttgggg

SEQ ID NO: 538357 - DNA, 16 bp, G. gallus
gagaaggatttggggg

SEQ ID NO: 538358 - DNA, 16 bp, G. gallus
gagaaggctccgagga

SEQ ID NO: 538359 - DNA, 16 bp, G. gallus
gagaagtggtggatgc

SEQ ID NO: 538360 - DNA, 16 bp, G. gallus
gagaataaattcttcc

SEQ ID NO: 538361 - DNA, 16 bp, G. gallus
gagaataaatttttcc

SEQ ID NO: 538362 - DNA, 16 bp, G. gallus
gagacactggaacaag

SEQ ID NO: 538363 - DNA, 16 bp, G. gallus
gagacagatggcagca

SEQ ID NO: 538364 - DNA, 16 bp, G. gallus
gagacagtgactccac

SEQ ID NO: 538365 - DNA, 16 bp, G. gallus
gagaccatcaagtcca

SEQ ID NO: 538366 - DNA, 16 bp, G. gallus
gagacccaacagtgga

SEQ ID NO: 538367 - DNA, 16 bp, G. gallus
gagacctcaaagccca

SEQ ID NO: 538368 - DNA, 19 bp, G. gallus
gagacctgctgcttcctcc

SEQ ID NO: 538369 - DNA, 16 bp, G. gallus
gagagagagagaaact

SEQ ID NO: 538370 - DNA, 16 bp, G. gallus
gagagagagagatttg

SEQ ID NO: 538371 - DNA, 16 bp, G. gallus
gagagagatgaactcc

SEQ ID NO: 538372 - DNA, 16 bp, G. gallus
gagagagtgtccaaaa

SEQ ID NO: 538373 - DNA, 16 bp, G. gallus
gagagcactgtccaga

SEQ ID NO: 538374 - DNA, 16 bp, G. gallus
gagagcagcagcagca

SEQ ID NO: 538375 - DNA, 16 bp, G. gallus
gagagcagccccacag

SEQ ID NO: 538376 - DNA, 16 bp, G. gallus
gagagctggggctgtg

SEQ ID NO: 538377 - DNA, 16 bp, G. gallus
gagaggctggagagca

SEQ ID NO: 538378 - DNA, 16 bp, G. gallus
gagaggttgtggatgc

SEQ ID NO: 538379 - DNA, 16 bp, G. gallus
gagagtggtgaagtgc

SEQ ID NO: 538380 - DNA, 16 bp, G. gallus
gagagtggtgaggtgc

SEQ ID NO: 538381 - DNA, 16 bp, G. gallus
gagagttgtggtcagt

SEQ ID NO: 538382 - DNA, 16 bp, G. gallus
gagataatggccttaa

SEQ ID NO: 538383 - DNA, 16 bp, G. gallus
gagatcatagaatcat

SEQ ID NO: 538384 - DNA, 16 bp, G. gallus
gagatcatctagtcca

SEQ ID NO: 538385 - DNA, 16 bp, G. gallus
gagatcccttccaact

SEQ ID NO: 538386 - DNA, 16 bp, G. gallus
gagatccttcctcctt

SEQ ID NO: 538387 - DNA, 16 bp, G. gallus
gagatccttcctcttg

SEQ ID NO: 538388 - DNA, 16 bp, G. gallus
gagatgatcattgtgg

SEQ ID NO: 538389 - DNA, 16 bp, G. gallus
gagatgctccaggacc

SEQ ID NO: 538390 - DNA, 16 bp, G. gallus
gagatggctgatgtgg

SEQ ID NO: 538391 - DNA, 16 bp, G. gallus
gagatgtggcacagag

SEQ ID NO: 538392 - DNA, 16 bp, G. gallus
gagatgtggcactgag

SEQ ID NO: 538393 - DNA, 16 bp, G. gallus
gagatgttcaagaaac

SEQ ID NO: 538394 - DNA, 16 bp, G. gallus
gagattggaaaagacc

SEQ ID NO: 538395 - DNA, 16 bp, G. gallus
gagcaacctgatcaag

SEQ ID NO: 538396 - DNA, 16 bp, G. gallus
gagcacactgaggcag

SEQ ID NO: 538397 - DNA, 16 bp, G. gallus
gagcacagccctgctg

SEQ ID NO: 538398 - DNA, 16 bp, G. gallus
gagcacaggtgcaagc

SEQ ID NO: 538399 - DNA, 16 bp, G. gallus
gagcacagtgaagtgg

SEQ ID NO: 538400 - DNA, 16 bp, G. gallus
gagcacagtgagacag

SEQ ID NO: 538401 - DNA, 16 bp, G. gallus
gagcacctcagctttc

SEQ ID NO: 538402 - DNA, 16 bp, G. gallus
gagcagagaggcagga

SEQ ID NO: 538403 - DNA, 16 bp, G. gallus
gagcagagcagagagg

SEQ ID NO: 538404 - DNA, 16 bp, G. gallus
gagcagagcagggctg

SEQ ID NO: 538405 - DNA, 16 bp, G. gallus
gagcagagcccagcag

SEQ ID NO: 538406 - DNA, 16 bp, G. gallus
gagcagagtgggacaa

SEQ ID NO: 538407 - DNA, 16 bp, G. gallus
gagcagcagcacagca

SEQ ID NO: 538408 - DNA, 16 bp, G. gallus
gagcagcagcagagtg

SEQ ID NO: 538409 - DNA, 16 bp, G. gallus
gagcagcagcagcacc

SEQ ID NO: 538410 - DNA, 16 bp, G. gallus
gagcagcagcagtgtg

SEQ ID NO: 538411 - DNA, 16 bp, G. gallus
gagcagccctgaggag

SEQ ID NO: 538412 - DNA, 16 bp, G. gallus
gagcagctcagcaacc

SEQ ID NO: 538413 - DNA, 17 bp, G. gallus
gagcagctgaaggagct

SEQ ID NO: 538414 - DNA, 16 bp, G. gallus
gagcaggctgctcagg

SEQ ID NO: 538415 - DNA, 16 bp, G. gallus
gagcatccaccacctc

SEQ ID NO: 538416 - DNA, 16 bp, G. gallus
gagcatctctcttatg

SEQ ID NO: 538417 - DNA, 16 bp, G. gallus
gagcatgaatcagaag

SEQ ID NO: 538418 - DNA, 16 bp, G. gallus
gagcatggccagcagg

SEQ ID NO: 538419 - DNA, 16 bp, G. gallus
gagccacatgcagcct

SEQ ID NO: 538420 - DNA, 16 bp, G. gallus
gagccgtgccgagccg

SEQ ID NO: 538421 - DNA, 16 bp, G. gallus
gagcctcctcatctcc

SEQ ID NO: 538422 - DNA, 16 bp, G. gallus
gagcggagggcagcgc

SEQ ID NO: 538423 - DNA, 16 bp, G. gallus
gagcgtggccagcagg

SEQ ID NO: 538424 - DNA, 16 bp, G. gallus
gagctccagcagctca

SEQ ID NO: 538425 - DNA, 16 bp, G. gallus
gagctctgggcagcct

SEQ ID NO: 538426 - DNA, 16 bp, G. gallus
gagctctgtgctgctg

SEQ ID NO: 538427 - DNA, 16 bp, G. gallus
gagctcttttccaacc

SEQ ID NO: 538428 - DNA, 16 bp, G. gallus
gagctgagctgagctg

SEQ ID NO: 538429 - DNA, 16 bp, G. gallus
gagctgaggctcttca

SEQ ID NO: 538430 - DNA, 16 bp, G. gallus
gagctgattttttttt

SEQ ID NO: 538431 - DNA, 16 bp, G. gallus
gagctgcaggagcaca

SEQ ID NO: 538432 - DNA, 16 bp, G. gallus
gagctgctctgctctg

SEQ ID NO: 538433 - DNA, 16 bp, G. gallus
gagctgctggagaggg

SEQ ID NO: 538434 - DNA, 16 bp, G. gallus
gagctgctggagctca

SEQ ID NO: 538435 - DNA, 16 bp, G. gallus
gagctgctggagttca

SEQ ID NO: 538436 - DNA, 16 bp, G. gallus
gagctggaagagacct

SEQ ID NO: 538437 - DNA, 16 bp, G. gallus
gagctggcaggacttg

SEQ ID NO: 538438 - DNA, 16 bp, G. gallus
gagctgggattgttca

SEQ ID NO: 538439 - DNA, 16 bp, G. gallus
gagctggggagcccag

SEQ ID NO: 538440 - DNA, 16 bp, G. gallus
gagctggtggaggtga

SEQ ID NO: 538441 - DNA, 16 bp, G. gallus
gagctgtgccagggga

SEQ ID NO: 538442 - DNA, 16 bp, G. gallus
gagctgtgctgtgctg

SEQ ID NO: 538443 - DNA, 16 bp, G. gallus
gagctgtgtcaggaga

SEQ ID NO: 538444 - DNA, 16 bp, G. gallus
gagctgttggagaggg

SEQ ID NO: 538445 - DNA, 16 bp, G. gallus
gaggaaaggctgagag

SEQ ID NO: 538446 - DNA, 16 bp, G. gallus
gaggaacaagtccagg

SEQ ID NO: 538447 - DNA, 22 bp, G. gallus
gaggaaccccaggcatctatac

SEQ ID NO: 538448 - DNA, 16 bp, G. gallus
gaggaagactacgagc

SEQ ID NO: 538449 - DNA, 16 bp, G. gallus
gaggaaggccatgaag

SEQ ID NO: 538450 - DNA, 16 bp, G. gallus
gaggaaggtgatcctg

SEQ ID NO: 538451 - DNA, 16 bp, G. gallus
gaggaattcaatggca

SEQ ID NO: 538452 - DNA, 16 bp, G. gallus
gaggaattcagtgaca

SEQ ID NO: 538453 - DNA, 16 bp, G. gallus
gaggaattcattgaca

SEQ ID NO: 538454 - DNA, 16 bp, G. gallus
gaggaccacagagatg

SEQ ID NO: 538455 - DNA, 16 bp, G. gallus
gaggagactccacaac

SEQ ID NO: 538456 - DNA, 16 bp, G. gallus
gaggagaggctgaagg

SEQ ID NO: 538457 - DNA, 16 bp, G. gallus
gaggagcagctgagga

SEQ ID NO: 538458 - DNA, 16 bp, G. gallus
gaggagcccaaaactg

SEQ ID NO: 538459 - DNA, 16 bp, G. gallus
gaggagcggctgaggc

SEQ ID NO: 538460 - DNA, 16 bp, G. gallus
gaggagctgcagccac

SEQ ID NO: 538461 - DNA, 16 bp, G. gallus
gaggagctgcagctgc

SEQ ID NO: 538462 - DNA, 16 bp, G. gallus
gaggagctgcaggcca

SEQ ID NO: 538463 - DNA, 16 bp, G. gallus
gaggaggactcggact

SEQ ID NO: 538464 - DNA, 16 bp, G. gallus
gaggatgatgaggcac

SEQ ID NO: 538465 - DNA, 16 bp, G. gallus
gaggatgtgagcacag

SEQ ID NO: 538466 - DNA, 16 bp, G. gallus
gaggattccacatctg

SEQ ID NO: 538467 - DNA, 16 bp, G. gallus
gaggcacaggaacagg

SEQ ID NO: 538468 - DNA, 16 bp, G. gallus
gaggcactggcacggg

SEQ ID NO: 538469 - DNA, 16 bp, G. gallus
gaggcagatattggtg

SEQ ID NO: 538470 - DNA, 16 bp, G. gallus
gaggcagcagcagcag

SEQ ID NO: 538471 - DNA, 16 bp, G. gallus
gaggcaggcaggcagg

SEQ ID NO: 538472 - DNA, 16 bp, G. gallus
gaggccctggcactgc

SEQ ID NO: 538473 - DNA, 16 bp, G. gallus
gaggcgctcaaggcca

SEQ ID NO: 538474 - DNA, 16 bp, G. gallus
gaggctgaaggagctg

SEQ ID NO: 538475 - DNA, 16 bp, G. gallus
gaggctgagagagctg

SEQ ID NO: 538476 - DNA, 16 bp, G. gallus
gaggctgagggagctg

SEQ ID NO: 538477 - DNA, 21 bp, G. gallus
gagggaagatttaggttggat

SEQ ID NO: 538478 - DNA, 16 bp, G. gallus
gagggatctccaacca

SEQ ID NO: 538479 - DNA, 16 bp, G. gallus
gagggatggagacctc

SEQ ID NO: 538480 - DNA, 17 bp, G. gallus
gagggatgtgggcagtg

SEQ ID NO: 538481 - DNA, 16 bp, G. gallus
gagggcagagtagaga

SEQ ID NO: 538482 - DNA, 16 bp, G. gallus
gagggcattgagtgca

SEQ ID NO: 538483 - DNA, 16 bp, G. gallus
gagggccacagaaatg

SEQ ID NO: 538484 - DNA, 16 bp, G. gallus
gagggctacagagatg

SEQ ID NO: 538485 - DNA, 16 bp, G. gallus
gagggctgcagagatg

SEQ ID NO: 538486 - DNA, 16 bp, G. gallus
gagggctggagaacct

SEQ ID NO: 538487 - DNA, 16 bp, G. gallus
gagggtctggagcaca

SEQ ID NO: 538488 - DNA, 16 bp, G. gallus
gagggtgcaaagagga

SEQ ID NO: 538489 - DNA, 16 bp, G. gallus
gagggtggtgacgcac

SEQ ID NO: 538490 - DNA, 16 bp, G. gallus
gaggtactgaatgagt

SEQ ID NO: 538491 - DNA, 16 bp, G. gallus
gaggtcctttccaacc

SEQ ID NO: 538492 - DNA, 16 bp, G. gallus
gaggtgctccagccct

SEQ ID NO: 538493 - DNA, 16 bp, G. gallus
gaggtgctggagcagg

SEQ ID NO: 538494 - DNA, 16 bp, G. gallus
gaggtggtggagtcac

SEQ ID NO: 538495 - DNA, 16 bp, G. gallus
gaggtggtggagttgc

SEQ ID NO: 538496 - DNA, 16 bp, G. gallus
gaggtggtggatgcct

SEQ ID NO: 538497 - DNA, 16 bp, G. gallus
gaggtgttcaaagcca

SEQ ID NO: 538498 - DNA, 16 bp, G. gallus
gaggtgttccagaacc

SEQ ID NO: 538499 - DNA, 16 bp, G. gallus
gaggttcaggttggat

SEQ ID NO: 538500 - DNA, 16 bp, G. gallus
gaggttccttccaacc

SEQ ID NO: 538501 - DNA, 16 bp, G. gallus
gaggttctccagccct

SEQ ID NO: 538502 - DNA, 16 bp, G. gallus
gaggttgaaactcgat

SEQ ID NO: 538503 - DNA, 16 bp, G. gallus
gaggttggaagggact

SEQ ID NO: 538504 - DNA, 16 bp, G. gallus
gaggttttcaagaaga

SEQ ID NO: 538505 - DNA, 16 bp, G. gallus
gagtacaaagaagttg

SEQ ID NO: 538506 - DNA, 16 bp, G. gallus
gagtactgcattcagg

SEQ ID NO: 538507 - DNA, 16 bp, G. gallus
gagtgaaaaatttcct

SEQ ID NO: 538508 - DNA, 16 bp, G. gallus
gagtgacagctttggt

SEQ ID NO: 538509 - DNA, 16 bp, G. gallus
gagtgaccagaagggg

SEQ ID NO: 538510 - DNA, 16 bp, G. gallus
gagtgcgtccagagga

SEQ ID NO: 538511 - DNA, 16 bp, G. gallus
gagtggctggaagact

SEQ ID NO: 538512 - DNA, 16 bp, G. gallus
gagtgtatgggaactg

SEQ ID NO: 538513 - DNA, 16 bp, G. gallus
gagttcaagaagtgtt

SEQ ID NO: 538514 - DNA, 17 bp, G. gallus
gagttccaaccccctgc

SEQ ID NO: 538515 - DNA, 16 bp, G. gallus
gagttcctccatgcag

SEQ ID NO: 538516 - DNA, 16 bp, G. gallus
gagttcctgctgagat

SEQ ID NO: 538517 - DNA, 16 bp, G. gallus
gagttgcagtcaatgg

SEQ ID NO: 538518 - DNA, 16 bp, G. gallus
gagttggaagagatcc

SEQ ID NO: 538519 - DNA, 16 bp, G. gallus
gagttggaagggaccc

SEQ ID NO: 538520 - DNA, 16 bp, G. gallus
gagtttgtggagtctc

SEQ ID NO: 538521 - DNA, 16 bp, G. gallus
gagttttgaagggggt

SEQ ID NO: 538522 - DNA, 16 bp, G. gallus
gataaggacagggaga

SEQ ID NO: 538523 - DNA, 16 bp, G. gallus
gatacaaggaagaagt

SEQ ID NO: 538524 - DNA, 16 bp, G. gallus
gatagatgatggaaag

SEQ ID NO: 538525 - DNA, 16 bp, G. gallus
gatatcaggaaaaaaa

SEQ ID NO: 538526 - DNA, 16 bp, G. gallus
gatattaggaaaaaat

SEQ ID NO: 538527 - DNA, 17 bp, G. gallus
gatcacaaactccacca

SEQ ID NO: 538528 - DNA, 16 bp, G. gallus
gatcacagaatggttt

SEQ ID NO: 538529 - DNA, 16 bp, G. gallus
gatcaccaagtccaac

SEQ ID NO: 538530 - DNA, 16 bp, G. gallus
gatcacctccctcaac

SEQ ID NO: 538531 - DNA, 16 bp, G. gallus
gatcactgagtccaac

SEQ ID NO: 538532 - DNA, 16 bp, G. gallus
gatcagccagtccaac

SEQ ID NO: 538533 - DNA, 16 bp, G. gallus
gatcaggaaagccaag

SEQ ID NO: 538534 - DNA, 16 bp, G. gallus
gatcatcaaactccaa

SEQ ID NO: 538535 - DNA, 16 bp, G. gallus
gatcatcaaatccaac

SEQ ID NO: 538536 - DNA, 16 bp, G. gallus
gatcatcaagtccaac

SEQ ID NO: 538537 - DNA, 16 bp, G. gallus
gatcatcaagtccagc

SEQ ID NO: 538538 - DNA, 16 bp, G. gallus
gatcatcaggtccaac

SEQ ID NO: 538539 - DNA, 16 bp, G. gallus
gatcatccagtccaac

SEQ ID NO: 538540 - DNA, 16 bp, G. gallus
gatcatgaagtccaac

SEQ ID NO: 538541 - DNA, 16 bp, G. gallus
gatcatgaatctccaa

SEQ ID NO: 538542 - DNA, 16 bp, G. gallus
gatcatgcagttccaa

SEQ ID NO: 538543 - DNA, 16 bp, G. gallus
gatcatgttgctcaga

SEQ ID NO: 538544 - DNA, 16 bp, G. gallus
gatcattgagtccaac

SEQ ID NO: 538545 - DNA, 16 bp, G. gallus
gatcctgggcagcctg

SEQ ID NO: 538546 - DNA, 16 bp, G. gallus
gatcctgtccctctgc

SEQ ID NO: 538547 - DNA, 16 bp, G. gallus
gatcgtcaagtccaac

SEQ ID NO: 538548 - DNA, 16 bp, G. gallus
gatcgtctcgctgctg

SEQ ID NO: 538549 - DNA, 16 bp, G. gallus
gatctcatcactgttt

SEQ ID NO: 538550 - DNA, 16 bp, G. gallus
gatctccatccagaca

SEQ ID NO: 538551 - DNA, 16 bp, G. gallus
gatctctctgcaaggc

SEQ ID NO: 538552 - DNA, 16 bp, G. gallus
gatctctggttggaga

SEQ ID NO: 538553 - DNA, 16 bp, G. gallus
gatctttaagatccct

SEQ ID NO: 538554 - DNA, 16 bp, G. gallus
gatgaacaccttgaga

SEQ ID NO: 538555 - DNA, 16 bp, G. gallus
gatgaactgattgaga

SEQ ID NO: 538556 - DNA, 16 bp, G. gallus
gatgaagatgctgaag

SEQ ID NO: 538557 - DNA, 16 bp, G. gallus
gatgaagatgttaaac

SEQ ID NO: 538558 - DNA, 16 bp, G. gallus
gatgaagatgttaaag

SEQ ID NO: 538559 - DNA, 16 bp, G. gallus
gatgagagcacagtga

SEQ ID NO: 538560 - DNA, 16 bp, G. gallus
gatgagctgattgaga

SEQ ID NO: 538561 - DNA, 16 bp, G. gallus
gatgaggagaaatggc

SEQ ID NO: 538562 - DNA, 16 bp, G. gallus
gatgagggaaaggctg

SEQ ID NO: 538563 - DNA, 16 bp, G. gallus
gatgaggggaaggcga

SEQ ID NO: 538564 - DNA, 16 bp, G. gallus
gatgataccaagctga

SEQ ID NO: 538565 - DNA, 16 bp, G. gallus
gatgatgataataata

SEQ ID NO: 538566 - DNA, 16 bp, G. gallus
gatgatgatgatgatt

SEQ ID NO: 538567 - DNA, 16 bp, G. gallus
gatgatgatgattatt

SEQ ID NO: 538568 - DNA, 16 bp, G. gallus
gatgcagtattccaga

SEQ ID NO: 538569 - DNA, 16 bp, G. gallus
gatgctcagagggctg

SEQ ID NO: 538570 - DNA, 16 bp, G. gallus
gatgctcagctgaaca

SEQ ID NO: 538571 - DNA, 16 bp, G. gallus
gatgctcttcaacatc

SEQ ID NO: 538572 - DNA, 16 bp, G. gallus
gatggagatggagatg

SEQ ID NO: 538573 - DNA, 16 bp, G. gallus
gatggagattctcctt

SEQ ID NO: 538574 - DNA, 16 bp, G. gallus
gatggagctctgagca

SEQ ID NO: 538575 - DNA, 16 bp, G. gallus
gatggcaactccacca

SEQ ID NO: 538576 - DNA, 16 bp, G. gallus
gatggcagcagtgggg

SEQ ID NO: 538577 - DNA, 16 bp, G. gallus
gatggccacaaagatg

SEQ ID NO: 538578 - DNA, 16 bp, G. gallus
gatggccaggcccaaa

SEQ ID NO: 538579 - DNA, 16 bp, G. gallus
gatggcctttaagggt

SEQ ID NO: 538580 - DNA, 16 bp, G. gallus
gatgggcatccctgct

SEQ ID NO: 538581 - DNA, 16 bp, G. gallus
gatgggctgcccaggg

SEQ ID NO: 538582 - DNA, 16 bp, G. gallus
gatggggccgtgggca

SEQ ID NO: 538583 - DNA, 16 bp, G. gallus
gatggtaggtggatgg

SEQ ID NO: 538584 - DNA, 16 bp, G. gallus
gatggtggtgactatg

SEQ ID NO: 538585 - DNA, 16 bp, G. gallus
gatggtttgatggttg

SEQ ID NO: 538586 - DNA, 16 bp, G. gallus
gatgtagtgctcaggg

SEQ ID NO: 538587 - DNA, 16 bp, G. gallus
gatgtcattgatgaag

SEQ ID NO: 538588 - DNA, 16 bp, G. gallus
gatgtcccattcctgg

SEQ ID NO: 538589 - DNA, 16 bp, G. gallus
gatgtgaaaaataaca

SEQ ID NO: 538590 - DNA, 16 bp, G. gallus
gatgtggagctgctgg

SEQ ID NO: 538591 - DNA, 16 bp, G. gallus
gatgtggcactgaagg

SEQ ID NO: 538592 - DNA, 16 bp, G. gallus
gatgtggcactgaggg

SEQ ID NO: 538593 - DNA, 16 bp, G. gallus
gatgtggtactaaggg

SEQ ID NO: 538594 - DNA, 16 bp, G. gallus
gatgtggtgctgaggg

SEQ ID NO: 538595 - DNA, 16 bp, G. gallus
gatgttaggaagaaat

SEQ ID NO: 538596 - DNA, 16 bp, G. gallus
gattaagaaacaacag

SEQ ID NO: 538597 - DNA, 16 bp, G. gallus
gattccatgattctac

SEQ ID NO: 538598 - DNA, 16 bp, G. gallus
gattctatgaaaaaca

SEQ ID NO: 538599 - DNA, 16 bp, G. gallus
gattctatgataagaa

SEQ ID NO: 538600 - DNA, 16 bp, G. gallus
gattgattgattgatt

SEQ ID NO: 538601 - DNA, 16 bp, G. gallus
gattggactggatgat

SEQ ID NO: 538602 - DNA, 16 bp, G. gallus
gatttaaaacaaacaa

SEQ ID NO: 538603 - DNA, 16 bp, G. gallus
gatttagattagatgt

SEQ ID NO: 538604 - DNA, 16 bp, G. gallus
gatttctttctggaga

SEQ ID NO: 538605 - DNA, 16 bp, G. gallus
gattttttttctccct

SEQ ID NO: 538606 - DNA, 16 bp, G. gallus
gcaaactgttccagtg

SEQ ID NO: 538607 - DNA, 16 bp, G. gallus
gcaaaggaatgaggag

SEQ ID NO: 538608 - DNA, 16 bp, G. gallus
gcaaagtcttgcacct

SEQ ID NO: 538609 - DNA, 16 bp, G. gallus
gcaaatgatttttttt

SEQ ID NO: 538610 - DNA, 16 bp, G. gallus
gcaacaacatgtaatg

SEQ ID NO: 538611 - DNA, 16 bp, G. gallus
gcaacaggacaaggga

SEQ ID NO: 538612 - DNA, 16 bp, G. gallus
gcaacaggctgcccag

SEQ ID NO: 538613 - DNA, 16 bp, G. gallus
gcaacagtgacagtgg

SEQ ID NO: 538614 - DNA, 16 bp, G. gallus
gcaacctgaggccatt

SEQ ID NO: 538615 - DNA, 16 bp, G. gallus
gcaacctgatccagtg

SEQ ID NO: 538616 - DNA, 16 bp, G. gallus
gcaacctgatctggct

SEQ ID NO: 538617 - DNA, 16 bp, G. gallus
gcaactggaggccatt

SEQ ID NO: 538618 - DNA, 16 bp, G. gallus
gcaacttgaggccatt

SEQ ID NO: 538619 - DNA, 16 bp, G. gallus
gcaagatcccaggctg

SEQ ID NO: 538620 - DNA, 18 bp, G. gallus
gcaaggacctgctgggca

SEQ ID NO: 538621 - DNA, 16 bp, G. gallus
gcaagtcctgcctgac

SEQ ID NO: 538622 - DNA, 16 bp, G. gallus
gcaagtttgctgataa

SEQ ID NO: 538623 - DNA, 16 bp, G. gallus
gcaagtttgctgatgg

SEQ ID NO: 538624 - DNA, 16 bp, G. gallus
gcaatccaggaggctc

SEQ ID NO: 538625 - DNA, 16 bp, G. gallus
gcaatgacagcagagt

SEQ ID NO: 538626 - DNA, 16 bp, G. gallus
gcacaacaacactatt

SEQ ID NO: 538627 - DNA, 16 bp, G. gallus
gcacaacttgaggctg

SEQ ID NO: 538628 - DNA, 16 bp, G. gallus
gcacaaggagctggga

SEQ ID NO: 538629 - DNA, 16 bp, G. gallus
gcacacagctggctca

SEQ ID NO: 538630 - DNA, 16 bp, G. gallus
gcacagaatcacagaa

SEQ ID NO: 538631 - DNA, 16 bp, G. gallus
gcacagaccttatgaa

SEQ ID NO: 538632 - DNA, 16 bp, G. gallus
gcacagactgcccaga

SEQ ID NO: 538633 - DNA, 16 bp, G. gallus
gcacagagcagagcag

SEQ ID NO: 538634 - DNA, 16 bp, G. gallus
gcacagagcagagggg

SEQ ID NO: 538635 - DNA, 16 bp, G. gallus
gcacagagcagctctg

SEQ ID NO: 538636 - DNA, 16 bp, G. gallus
gcacagagcagtgctg

SEQ ID NO: 538637 - DNA, 16 bp, G. gallus
gcacagcacagagcag

SEQ ID NO: 538638 - DNA, 16 bp, G. gallus
gcacagccccgagctg

SEQ ID NO: 538639 - DNA, 16 bp, G. gallus
gcacagccctgctcac

SEQ ID NO: 538640 - DNA, 16 bp, G. gallus
gcacagctccatgctg

SEQ ID NO: 538641 - DNA, 16 bp, G. gallus
gcacagctgcccagag

SEQ ID NO: 538642 - DNA, 16 bp, G. gallus
gcacaggtgaatgcaa

SEQ ID NO: 538643 - DNA, 16 bp, G. gallus
gcacagtgctggctca

SEQ ID NO: 538644 - DNA, 16 bp, G. gallus
gcaccactctttctga

SEQ ID NO: 538645 - DNA, 16 bp, G. gallus
gcacccagtgctggag

SEQ ID NO: 538646 - DNA, 16 bp, G. gallus
gcacctctcttagacc

SEQ ID NO: 538647 - DNA, 16 bp, G. gallus
gcacctggtgaagggg

SEQ ID NO: 538648 - DNA, 17 bp, G. gallus
gcacggcacggcacggc

SEQ ID NO: 538649 - DNA, 16 bp, G. gallus
gcacggggttggaact

SEQ ID NO: 538650 - DNA, 16 bp, G. gallus
gcactgctgggtgctg

SEQ ID NO: 538651 - DNA, 16 bp, G. gallus
gcactggaacaagctg

SEQ ID NO: 538652 - DNA, 16 bp, G. gallus
gcactggaacgggctg

SEQ ID NO: 538653 - DNA, 16 bp, G. gallus
gcactggcacagctgc

SEQ ID NO: 538654 - DNA, 16 bp, G. gallus
gcactgggagttaaag

SEQ ID NO: 538655 - DNA, 16 bp, G. gallus
gcacttccacgtcaga

SEQ ID NO: 538656 - DNA, 16 bp, G. gallus
gcacttccatgtcaga

SEQ ID NO: 538657 - DNA, 16 bp, G. gallus
gcagaaaaggacctgg

SEQ ID NO: 538658 - DNA, 16 bp, G. gallus
gcagaagctggcagtc

SEQ ID NO: 538659 - DNA, 16 bp, G. gallus
gcagaaggagttttga

SEQ ID NO: 538660 - DNA, 16 bp, G. gallus
gcagaaggcacacagg

SEQ ID NO: 538661 - DNA, 16 bp, G. gallus
gcagacacacacacac

SEQ ID NO: 538662 - DNA, 16 bp, G. gallus
gcagacatcctggtgg

SEQ ID NO: 538663 - DNA, 16 bp, G. gallus
gcagacctcaggccag

SEQ ID NO: 538664 - DNA, 16 bp, G. gallus
gcagagagcagagctc

SEQ ID NO: 538665 - DNA, 16 bp, G. gallus
gcagagcagaggagga

SEQ ID NO: 538666 - DNA, 16 bp, G. gallus
gcagagcagcagcagc

SEQ ID NO: 538667 - DNA, 16 bp, G. gallus
gcagagcaggacaatc

SEQ ID NO: 538668 - DNA, 16 bp, G. gallus
gcagagcagggcaggg

SEQ ID NO: 538669 - DNA, 16 bp, G. gallus
gcagagccacatccag

SEQ ID NO: 538670 - DNA, 16 bp, G. gallus
gcagagctcagtgctg

SEQ ID NO: 538671 - DNA, 16 bp, G. gallus
gcagagctgagctctg

SEQ ID NO: 538672 - DNA, 16 bp, G. gallus
gcagagctggagctgc

SEQ ID NO: 538673 - DNA, 16 bp, G. gallus
gcagaggagctgagag

SEQ ID NO: 538674 - DNA, 16 bp, G. gallus
gcagagggacagcctg

SEQ ID NO: 538675 - DNA, 16 bp, G. gallus
gcagatcaacacttcc

SEQ ID NO: 538676 - DNA, 16 bp, G. gallus
gcagatgaagcaaagg

SEQ ID NO: 538677 - DNA, 16 bp, G. gallus
gcagatgacaccaaga

SEQ ID NO: 538678 - DNA, 16 bp, G. gallus
gcagcaaagctggtga

SEQ ID NO: 538679 - DNA, 16 bp, G. gallus
gcagcacagcacagca

SEQ ID NO: 538680 - DNA, 16 bp, G. gallus
gcagcacagcagcagc

SEQ ID NO: 538681 - DNA, 16 bp, G. gallus
gcagcacagctttctg

SEQ ID NO: 538682 - DNA, 17 bp, G. gallus
gcagcaccctgcacttg

SEQ ID NO: 538683 - DNA, 16 bp, G. gallus
gcagcagaaaagatag

SEQ ID NO: 538684 - DNA, 16 bp, G. gallus
gcagcagaagggcagt

SEQ ID NO: 538685 - DNA, 16 bp, G. gallus
gcagcagagctgcagg

SEQ ID NO: 538686 - DNA, 16 bp, G. gallus
gcagcagaggctgaac

SEQ ID NO: 538687 - DNA, 16 bp, G. gallus
gcagcagaggggcact

SEQ ID NO: 538688 - DNA, 16 bp, G. gallus
gcagcagcacagagct

SEQ ID NO: 538689 - DNA, 16 bp, G. gallus
gcagcagcacaggcag

SEQ ID NO: 538690 - DNA, 16 bp, G. gallus
gcagcagcagagcagc

SEQ ID NO: 538691 - DNA, 16 bp, G. gallus
gcagcagcagaggtga

SEQ ID NO: 538692 - DNA, 16 bp, G. gallus
gcagcagcagcaaagc

SEQ ID NO: 538693 - DNA, 16 bp, G. gallus
gcagcagcagcacagc

SEQ ID NO: 538694 - DNA, 16 bp, G. gallus
gcagcagcagcagccc

SEQ ID NO: 538695 - DNA, 16 bp, G. gallus
gcagcagcagcagccg

SEQ ID NO: 538696 - DNA, 16 bp, G. gallus
gcagcagcagcagcgg

SEQ ID NO: 538697 - DNA, 16 bp, G. gallus
gcagcagcagcagctt

SEQ ID NO: 538698 - DNA, 16 bp, G. gallus
gcagcagcagcagggc

SEQ ID NO: 538699 - DNA, 16 bp, G. gallus
gcagcagcagctcctg

SEQ ID NO: 538700 - DNA, 16 bp, G. gallus
gcagcagcagctgctg

SEQ ID NO: 538701 - DNA, 16 bp, G. gallus
gcagcagcaggaggag

SEQ ID NO: 538702 - DNA, 16 bp, G. gallus
gcagcagcagggctgg

SEQ ID NO: 538703 - DNA, 16 bp, G. gallus
gcagcagcagtgctgg

SEQ ID NO: 538704 - DNA, 16 bp, G. gallus
gcagcagctctgcccc

SEQ ID NO: 538705 - DNA, 16 bp, G. gallus
gcagcaggagcagcag

SEQ ID NO: 538706 - DNA, 16 bp, G. gallus
gcagcaggagctgcag

SEQ ID NO: 538707 - DNA, 16 bp, G. gallus
gcagcaggagctgctg

SEQ ID NO: 538708 - DNA, 16 bp, G. gallus
gcagcaggcagggctg

SEQ ID NO: 538709 - DNA, 16 bp, G. gallus
gcagcagggcagggag

SEQ ID NO: 538710 - DNA, 16 bp, G. gallus
gcagcagggctggggg

SEQ ID NO: 538711 - DNA, 16 bp, G. gallus
gcagcagtgccagcac

SEQ ID NO: 538712 - DNA, 16 bp, G. gallus
gcagcagtgctggggc

SEQ ID NO: 538713 - DNA, 16 bp, G. gallus
gcagcagtgctgtgct

SEQ ID NO: 538714 - DNA, 16 bp, G. gallus
gcagcagtggaggtga

SEQ ID NO: 538715 - DNA, 16 bp, G. gallus
gcagcagtgtgccctg

SEQ ID NO: 538716 - DNA, 16 bp, G. gallus
gcagccaataactgtt

SEQ ID NO: 538717 - DNA, 16 bp, G. gallus
gcagccagcagcagca

SEQ ID NO: 538718 - DNA, 16 bp, G. gallus
gcagccagcccagggc

SEQ ID NO: 538719 - DNA, 16 bp, G. gallus
gcagccatggaggagc

SEQ ID NO: 538720 - DNA, 16 bp, G. gallus
gcagcccagcagcacc

SEQ ID NO: 538721 - DNA, 16 bp, G. gallus
gcagcccaggatatag

SEQ ID NO: 538722 - DNA, 16 bp, G. gallus
gcagcccagggtatgg

SEQ ID NO: 538723 - DNA, 16 bp, G. gallus
gcagccccagcagcac

SEQ ID NO: 538724 - DNA, 16 bp, G. gallus
gcagcccccagccctg

SEQ ID NO: 538725 - DNA, 16 bp, G. gallus
gcagccctgaagagaa

SEQ ID NO: 538726 - DNA, 16 bp, G. gallus
gcagccctgcctgcag

SEQ ID NO: 538727 - DNA, 16 bp, G. gallus
gcagcctgctccagca

SEQ ID NO: 538728 - DNA, 16 bp, G. gallus
gcagcctgctccagtg

SEQ ID NO: 538729 - DNA, 16 bp, G. gallus
gcagcctgttccagaa

SEQ ID NO: 538730 - DNA, 16 bp, G. gallus
gcagccttccaatact

SEQ ID NO: 538731 - DNA, 16 bp, G. gallus
gcagccttctccaggc

SEQ ID NO: 538732 - DNA, 17 bp, G. gallus
gcagcctttcagtacct

SEQ ID NO: 538733 - DNA, 16 bp, G. gallus
gcagctcagcagaaag

SEQ ID NO: 538734 - DNA, 16 bp, G. gallus
gcagctccagctgctc

SEQ ID NO: 538735 - DNA, 16 bp, G. gallus
gcagctctccaagcac

SEQ ID NO: 538736 - DNA, 16 bp, G. gallus
gcagctctgtggagaa

SEQ ID NO: 538737 - DNA, 17 bp, G. gallus
gcagctgaaggagctgg

SEQ ID NO: 538738 - DNA, 16 bp, G. gallus
gcagctgagctgctgg

SEQ ID NO: 538739 - DNA, 16 bp, G. gallus
gcagctgatggagctg

SEQ ID NO: 538740 - DNA, 16 bp, G. gallus
gcagctggagcagagc

SEQ ID NO: 538741 - DNA, 16 bp, G. gallus
gcagctgggagagagg

SEQ ID NO: 538742 - DNA, 16 bp, G. gallus
gcagctgtgccagcac

SEQ ID NO: 538743 - DNA, 18 bp, G. gallus
gcagctgtgccagcgcct

SEQ ID NO: 538744 - DNA, 16 bp, G. gallus
gcagctgttcagcacc

SEQ ID NO: 538745 - DNA, 16 bp, G. gallus
gcagctttctcttctc

SEQ ID NO: 538746 - DNA, 16 bp, G. gallus
gcaggacaaccagggg

SEQ ID NO: 538747 - DNA, 16 bp, G. gallus
gcaggagagcagcagc

SEQ ID NO: 538748 - DNA, 23 bp, G. gallus
gcaggagcaacatcactcaaaca

SEQ ID NO: 538749 - DNA, 16 bp, G. gallus
gcaggagctgaccatc

SEQ ID NO: 538750 - DNA, 16 bp, G. gallus
gcaggaggagcagcag

SEQ ID NO: 538751 - DNA, 16 bp, G. gallus
gcaggaggagttggaa

SEQ ID NO: 538752 - DNA, 16 bp, G. gallus
gcaggatcacctccct

SEQ ID NO: 538753 - DNA, 16 bp, G. gallus
gcaggcactcaaggcc

SEQ ID NO: 538754 - DNA, 16 bp, G. gallus
gcaggcaggcaggcag

SEQ ID NO: 538755 - DNA, 16 bp, G. gallus
gcaggcatggtggtga

SEQ ID NO: 538756 - DNA, 16 bp, G. gallus
gcagggacaccacagc

SEQ ID NO: 538757 - DNA, 16 bp, G. gallus
gcagggagcagagctg

SEQ ID NO: 538758 - DNA, 16 bp, G. gallus
gcagggagctgggctg

SEQ ID NO: 538759 - DNA, 16 bp, G. gallus
gcagggagctgtgctg

SEQ ID NO: 538760 - DNA, 16 bp, G. gallus
gcagggaggagagctg

SEQ ID NO: 538761 - DNA, 16 bp, G. gallus
gcagggcagagcagag

SEQ ID NO: 538762 - DNA, 16 bp, G. gallus
gcagggccagcccagg

SEQ ID NO: 538763 - DNA, 16 bp, G. gallus
gcagggctgggagctg

SEQ ID NO: 538764 - DNA, 16 bp, G. gallus
gcagggctgggggctg

SEQ ID NO: 538765 - DNA, 16 bp, G. gallus
gcagggctgtgctgca

SEQ ID NO: 538766 - DNA, 16 bp, G. gallus
gcaggggggttggaac

SEQ ID NO: 538767 - DNA, 16 bp, G. gallus
gcagggggttggagct

SEQ ID NO: 538768 - DNA, 17 bp, G. gallus
gcagggtcgccaaccac

SEQ ID NO: 538769 - DNA, 16 bp, G. gallus
gcagggttgccaacca

SEQ ID NO: 538770 - DNA, 16 bp, G. gallus
gcagtcaggagcagca

SEQ ID NO: 538771 - DNA, 16 bp, G. gallus
gcagtctggcaaaatg

SEQ ID NO: 538772 - DNA, 16 bp, G. gallus
gcagtctgtgccagtg

SEQ ID NO: 538773 - DNA, 16 bp, G. gallus
gcagtgaagctggtga

SEQ ID NO: 538774 - DNA, 16 bp, G. gallus
gcagtgactgagcacc

SEQ ID NO: 538775 - DNA, 16 bp, G. gallus
gcagtgctggcagcag

SEQ ID NO: 538776 - DNA, 16 bp, G. gallus
gcagtgctggctgcag

SEQ ID NO: 538777 - DNA, 16 bp, G. gallus
gcagtgctgggagcag

SEQ ID NO: 538778 - DNA, 16 bp, G. gallus
gcagtgctggggctgc

SEQ ID NO: 538779 - DNA, 16 bp, G. gallus
gcagtgctgtgcagtg

SEQ ID NO: 538780 - DNA, 16 bp, G. gallus
gcagtgctgtgctgtg

SEQ ID NO: 538781 - DNA, 16 bp, G. gallus
gcagtgctgtgtgctg

SEQ ID NO: 538782 - DNA, 16 bp, G. gallus
gcagtgggcacagccc

SEQ ID NO: 538783 - DNA, 16 bp, G. gallus
gcagtgggcatggcac

SEQ ID NO: 538784 - DNA, 16 bp, G. gallus
gcagtggtgacagaga

SEQ ID NO: 538785 - DNA, 16 bp, G. gallus
gcagtgtgaaagacaa

SEQ ID NO: 538786 - DNA, 16 bp, G. gallus
gcagtgtgtgtgtgtg

SEQ ID NO: 538787 - DNA, 16 bp, G. gallus
gcatatatgtatatat

SEQ ID NO: 538788 - DNA, 16 bp, G. gallus
gcatatttcttttcat

SEQ ID NO: 538789 - DNA, 16 bp, G. gallus
gcatccctgctccctc

SEQ ID NO: 538790 - DNA, 16 bp, G. gallus
gcatgcaggctgttgt

SEQ ID NO: 538791 - DNA, 16 bp, G. gallus
gcatgcatgcacacac

SEQ ID NO: 538792 - DNA, 18 bp, G. gallus
gcatggactcagatgtga

SEQ ID NO: 538793 - DNA, 16 bp, G. gallus
gcatggccatccagaa

SEQ ID NO: 538794 - DNA, 32 bp, G. gallus
gcattcaaggccaggctggatgtggctctggg

SEQ ID NO: 538795 - DNA, 16 bp, G. gallus
gcattcattgatgctt

SEQ ID NO: 538796 - DNA, 16 bp, G. gallus
gcatttcagcagtgga

SEQ ID NO: 538797 - DNA, 16 bp, G. gallus
gcatttttgccagtga

SEQ ID NO: 538798 - DNA, 16 bp, G. gallus
gccaaaaaggacctgg

SEQ ID NO: 538799 - DNA, 16 bp, G. gallus
gccaaagccatcctga

SEQ ID NO: 538800 - DNA, 27 bp, G. gallus
gccaaataaggcacaatgttatctggt

SEQ ID NO: 538801 - DNA, 16 bp, G. gallus
gccaaccactacatca

SEQ ID NO: 538802 - DNA, 16 bp, G. gallus
gccaacctgctgtcca

SEQ ID NO: 538803 - DNA, 16 bp, G. gallus
gccaagtgcaaggtct

SEQ ID NO: 538804 - DNA, 16 bp, G. gallus
gccaagtgcaaggtgt

SEQ ID NO: 538805 - DNA, 16 bp, G. gallus
gccaatggcatcctga

SEQ ID NO: 538806 - DNA, 16 bp, G. gallus
gccaatgtaataaaat

SEQ ID NO: 538807 - DNA, 16 bp, G. gallus
gccacaacgaggtctc

SEQ ID NO: 538808 - DNA, 16 bp, G. gallus
gccacaatgagttctc

SEQ ID NO: 538809 - DNA, 16 bp, G. gallus
gccacatctctgtggt

SEQ ID NO: 538810 - DNA, 16 bp, G. gallus
gccacgctgctgctgc

SEQ ID NO: 538811 - DNA, 16 bp, G. gallus
gccacgtccagcctgg

SEQ ID NO: 538812 - DNA, 16 bp, G. gallus
gccactctatgattct

SEQ ID NO: 538813 - DNA, 16 bp, G. gallus
gccactgcctcaccac

SEQ ID NO: 538814 - DNA, 16 bp, G. gallus
gccactgtggtggatc

SEQ ID NO: 538815 - DNA, 16 bp, G. gallus
gccagattggatgggg

SEQ ID NO: 538816 - DNA, 16 bp, G. gallus
gccagcagcagcagca

SEQ ID NO: 538817 - DNA, 16 bp, G. gallus
gccagcaggagcaggg

SEQ ID NO: 538818 - DNA, 16 bp, G. gallus
gccagcagtgtgcccc

SEQ ID NO: 538819 - DNA, 16 bp, G. gallus
gccagcagtgtgctca

SEQ ID NO: 538820 - DNA, 16 bp, G. gallus
gccagcagtgtgtcct

SEQ ID NO: 538821 - DNA, 16 bp, G. gallus
gccaggctcttctcag

SEQ ID NO: 538822 - DNA, 16 bp, G. gallus
gccatcaaggaagaga

SEQ ID NO: 538823 - DNA, 16 bp, G. gallus
gccatgaaaatgatca

SEQ ID NO: 538824 - DNA, 16 bp, G. gallus
gccatgctgactgtct

SEQ ID NO: 538825 - DNA, 16 bp, G. gallus
gccatgctggttctcc

SEQ ID NO: 538826 - DNA, 16 bp, G. gallus
gccatgggagcacagg

SEQ ID NO: 538827 - DNA, 16 bp, G. gallus
gccattccagcacctg

SEQ ID NO: 538828 - DNA, 16 bp, G. gallus
gccattctacgattct

SEQ ID NO: 538829 - DNA, 16 bp, G. gallus
gccattctgtgattct

SEQ ID NO: 538830 - DNA, 16 bp, G. gallus
gcccacggaggtggtg

SEQ ID NO: 538831 - DNA, 16 bp, G. gallus
gcccagaaaagctgtg

SEQ ID NO: 538832 - DNA, 16 bp, G. gallus
gcccagagagctggtg

SEQ ID NO: 538833 - DNA, 16 bp, G. gallus
gcccagcacagcacag

SEQ ID NO: 538834 - DNA, 16 bp, G. gallus
gcccagcactgccacc

SEQ ID NO: 538835 - DNA, 16 bp, G. gallus
gcccagcactgccagc

SEQ ID NO: 538836 - DNA, 16 bp, G. gallus
gcccagcccagcccag

SEQ ID NO: 538837 - DNA, 16 bp, G. gallus
gcccaggactccatcc

SEQ ID NO: 538838 - DNA, 16 bp, G. gallus
gcccagggcaccatcc

SEQ ID NO: 538839 - DNA, 17 bp, G. gallus
gcccagggccacatcca

SEQ ID NO: 538840 - DNA, 16 bp, G. gallus
gcccagggcccatcca

SEQ ID NO: 538841 - DNA, 16 bp, G. gallus
gcccatgccaacctca

SEQ ID NO: 538842 - DNA, 16 bp, G. gallus
gccccaagctgctgga

SEQ ID NO: 538843 - DNA, 16 bp, G. gallus
gccccacctggagtac

SEQ ID NO: 538844 - DNA, 16 bp, G. gallus
gccccagccctggagg

SEQ ID NO: 538845 - DNA, 16 bp, G. gallus
gccccaggtctggaca

SEQ ID NO: 538846 - DNA, 16 bp, G. gallus
gccccatccaagctgg

SEQ ID NO: 538847 - DNA, 16 bp, G. gallus
gccccatccagcctag

SEQ ID NO: 538848 - DNA, 16 bp, G. gallus
gccccttccaacctgg

SEQ ID NO: 538849 - DNA, 16 bp, G. gallus
gccctctgagcatcct

SEQ ID NO: 538850 - DNA, 16 bp, G. gallus
gccctctggggcagag

SEQ ID NO: 538851 - DNA, 16 bp, G. gallus
gccctgagctgccaga

SEQ ID NO: 538852 - DNA, 16 bp, G. gallus
gccctgcatgcagcag

SEQ ID NO: 538853 - DNA, 16 bp, G. gallus
gccctgccagctcctg

SEQ ID NO: 538854 - DNA, 16 bp, G. gallus
gccctgcccggcaggg

SEQ ID NO: 538855 - DNA, 16 bp, G. gallus
gccctgctccagcagg

SEQ ID NO: 538856 - DNA, 16 bp, G. gallus
gccctgctttgagcag

SEQ ID NO: 538857 - DNA, 16 bp, G. gallus
gccctggcactgctgc

SEQ ID NO: 538858 - DNA, 17 bp, G. gallus
gccctgggcaacctggt

SEQ ID NO: 538859 - DNA, 17 bp, G. gallus
gccctgggcagctgagc

SEQ ID NO: 538860 - DNA, 16 bp, G. gallus
gccctgtccagcctgg

SEQ ID NO: 538861 - DNA, 16 bp, G. gallus
gccctgtccctggagg

SEQ ID NO: 538862 - DNA, 18 bp, G. gallus
gccctgtggtggaattct

SEQ ID NO: 538863 - DNA, 16 bp, G. gallus
gccctgtggtggattc

SEQ ID NO: 538864 - DNA, 16 bp, G. gallus
gccctttgggctgcca

SEQ ID NO: 538865 - DNA, 16 bp, G. gallus
gccgccaaccaccaga

SEQ ID NO: 538866 - DNA, 16 bp, G. gallus
gccgggcagggccacc

SEQ ID NO: 538867 - DNA, 16 bp, G. gallus
gccgtgggctggctgc

SEQ ID NO: 538868 - DNA, 16 bp, G. gallus
gcctacagcttcctca

SEQ ID NO: 538869 - DNA, 16 bp, G. gallus
gcctcactgccctcac

SEQ ID NO: 538870 - DNA, 16 bp, G. gallus
gcctcagcaccctctg

SEQ ID NO: 538871 - DNA, 16 bp, G. gallus
gcctcatccagcctgg

SEQ ID NO: 538872 - DNA, 16 bp, G. gallus
gcctccactgccaacc

SEQ ID NO: 538873 - DNA, 16 bp, G. gallus
gcctccacttggacat

SEQ ID NO: 538874 - DNA, 16 bp, G. gallus
gcctcccttcaggaag

SEQ ID NO: 538875 - DNA, 16 bp, G. gallus
gcctctcctcacagga

SEQ ID NO: 538876 - DNA, 16 bp, G. gallus
gcctctctgggcaacc

SEQ ID NO: 538877 - DNA, 16 bp, G. gallus
gcctctctgggcagct

SEQ ID NO: 538878 - DNA, 18 bp, G. gallus
gcctgaacctctgattga

SEQ ID NO: 538879 - DNA, 16 bp, G. gallus
gcctgcaggaaagctg

SEQ ID NO: 538880 - DNA, 16 bp, G. gallus
gcctgcctgcctgcct

SEQ ID NO: 538881 - DNA, 16 bp, G. gallus
gcctggacacagtact

SEQ ID NO: 538882 - DNA, 16 bp, G. gallus
gcctgggcacactgct

SEQ ID NO: 538883 - DNA, 16 bp, G. gallus
gcctggggtccccagt

SEQ ID NO: 538884 - DNA, 16 bp, G. gallus
gcctgtagttccccag

SEQ ID NO: 538885 - DNA, 16 bp, G. gallus
gcctgtcccagcacct

SEQ ID NO: 538886 - DNA, 16 bp, G. gallus
gcctgttccagtgctg

SEQ ID NO: 538887 - DNA, 16 bp, G. gallus
gccttcacctgtgctc

SEQ ID NO: 538888 - DNA, 16 bp, G. gallus
gccttcagggatgggg

SEQ ID NO: 538889 - DNA, 16 bp, G. gallus
gccttccaggctgcaa

SEQ ID NO: 538890 - DNA, 16 bp, G. gallus
gccttctgttctccag

SEQ ID NO: 538891 - DNA, 16 bp, G. gallus
gccttgaacacttcca

SEQ ID NO: 538892 - DNA, 16 bp, G. gallus
gccttgaatgcatcca

SEQ ID NO: 538893 - DNA, 16 bp, G. gallus
gccttgaatgccttca

SEQ ID NO: 538894 - DNA, 16 bp, G. gallus
gccttgagcacctcca

SEQ ID NO: 538895 - DNA, 16 bp, G. gallus
gccttgcacaagtcca

SEQ ID NO: 538896 - DNA, 16 bp, G. gallus
gccttgggcagcctgg

SEQ ID NO: 538897 - DNA, 16 bp, G. gallus
gcctttatttatttat

SEQ ID NO: 538898 - DNA, 16 bp, G. gallus
gcggctgagggagctg

SEQ ID NO: 538899 - DNA, 16 bp, G. gallus
gctataggaaagaagg

SEQ ID NO: 538900 - DNA, 16 bp, G. gallus
gctatgagatatggtt

SEQ ID NO: 538901 - DNA, 23 bp, G. gallus
gctatgtgcagggtcgccaacca

SEQ ID NO: 538902 - DNA, 16 bp, G. gallus
gctcacagccactgtt

SEQ ID NO: 538903 - DNA, 16 bp, G. gallus
gctcacagccctgtcc

SEQ ID NO: 538904 - DNA, 16 bp, G. gallus
gctcagagccccgtcc

SEQ ID NO: 538905 - DNA, 16 bp, G. gallus
gctcagcagcagcagc

SEQ ID NO: 538906 - DNA, 16 bp, G. gallus
gctcagcgcagagcag

SEQ ID NO: 538907 - DNA, 16 bp, G. gallus
gctcagctgcatgcag

SEQ ID NO: 538908 - DNA, 17 bp, G. gallus
gctcatcatattggtgt

SEQ ID NO: 538909 - DNA, 17 bp, G. gallus
gctcatccagttccaac

SEQ ID NO: 538910 - DNA, 16 bp, G. gallus
gctcatgcagttccaa

SEQ ID NO: 538911 - DNA, 16 bp, G. gallus
gctccaagaggaagga

SEQ ID NO: 538912 - DNA, 16 bp, G. gallus
gctccatccagcctgg

SEQ ID NO: 538913 - DNA, 16 bp, G. gallus
gctcctgctggctgca

SEQ ID NO: 538914 - DNA, 16 bp, G. gallus
gctccttcagctgctc

SEQ ID NO: 538915 - DNA, 16 bp, G. gallus
gctctgagcacctgat

SEQ ID NO: 538916 - DNA, 18 bp, G. gallus
gctctgagcactgatgga

SEQ ID NO: 538917 - DNA, 16 bp, G. gallus
gctctgagctcctgat

SEQ ID NO: 538918 - DNA, 16 bp, G. gallus
gctctgcgcatgcgcc

SEQ ID NO: 538919 - DNA, 16 bp, G. gallus
gctctgctgctgctgc

SEQ ID NO: 538920 - DNA, 16 bp, G. gallus
gctctggaggaaggtg

SEQ ID NO: 538921 - DNA, 16 bp, G. gallus
gctctgggcagtctgg

SEQ ID NO: 538922 - DNA, 16 bp, G. gallus
gctctgggcagtgcca

SEQ ID NO: 538923 - DNA, 16 bp, G. gallus
gctctgtgctgctgcc

SEQ ID NO: 538924 - DNA, 16 bp, G. gallus
gctctgtgctgctgct

SEQ ID NO: 538925 - DNA, 16 bp, G. gallus
gctcttcagcatcttc

SEQ ID NO: 538926 - DNA, 17 bp, G. gallus
gctcttgtgaggcccca

SEQ ID NO: 538927 - DNA, 16 bp, G. gallus
gctctttttaatgcat

SEQ ID NO: 538928 - DNA, 16 bp, G. gallus
gctgaaaaacagtgtt

SEQ ID NO: 538929 - DNA, 16 bp, G. gallus
gctgaaaaactgaaat

SEQ ID NO: 538930 - DNA, 16 bp, G. gallus
gctgaaaggcaccacc

SEQ ID NO: 538931 - DNA, 16 bp, G. gallus
gctgaacatgaaccag

SEQ ID NO: 538932 - DNA, 16 bp, G. gallus
gctgaacatttacaga

SEQ ID NO: 538933 - DNA, 16 bp, G. gallus
gctgaaggagctgaga

SEQ ID NO: 538934 - DNA, 16 bp, G. gallus
gctgaagtcaatggga

SEQ ID NO: 538935 - DNA, 16 bp, G. gallus
gctgacacacctgaag

SEQ ID NO: 538936 - DNA, 16 bp, G. gallus
gctgagagagctggga

SEQ ID NO: 538937 - DNA, 16 bp, G. gallus
gctgagctctgtgctg

SEQ ID NO: 538938 - DNA, 16 bp, G. gallus
gctgagctgcctgctg

SEQ ID NO: 538939 - DNA, 16 bp, G. gallus
gctgagctgctgcagg

SEQ ID NO: 538940 - DNA, 16 bp, G. gallus
gctgagctgctgggtg

SEQ ID NO: 538941 - DNA, 16 bp, G. gallus
gctgagctgggggcag

SEQ ID NO: 538942 - DNA, 16 bp, G. gallus
gctgaggctgcccagg

SEQ ID NO: 538943 - DNA, 16 bp, G. gallus
gctgcacagggaggtg

SEQ ID NO: 538944 - DNA, 16 bp, G. gallus
gctgcagcacagcagc

SEQ ID NO: 538945 - DNA, 16 bp, G. gallus
gctgcagcagcagcag

SEQ ID NO: 538946 - DNA, 16 bp, G. gallus
gctgcagcagctgctg

SEQ ID NO: 538947 - DNA, 16 bp, G. gallus
gctgcagcaggagctg

SEQ ID NO: 538948 - DNA, 16 bp, G. gallus
gctgcagccctctgac

SEQ ID NO: 538949 - DNA, 16 bp, G. gallus
gctgcagctctcacag

SEQ ID NO: 538950 - DNA, 16 bp, G. gallus
gctgcagctgctgctg

SEQ ID NO: 538951 - DNA, 16 bp, G. gallus
gctgcaggagctgctg

SEQ ID NO: 538952 - DNA, 16 bp, G. gallus
gctgcaggcacacact

SEQ ID NO: 538953 - DNA, 16 bp, G. gallus
gctgcaggcagagctg

SEQ ID NO: 538954 - DNA, 16 bp, G. gallus
gctgcaggcgcacact

SEQ ID NO: 538955 - DNA, 16 bp, G. gallus
gctgcatcaaaagcag

SEQ ID NO: 538956 - DNA, 16 bp, G. gallus
gctgcatcttgaactt

SEQ ID NO: 538957 - DNA, 16 bp, G. gallus
gctgcatgcagggctg

SEQ ID NO: 538958 - DNA, 16 bp, G. gallus
gctgcatggaggaaaa

SEQ ID NO: 538959 - DNA, 16 bp, G. gallus
gctgccagcagcagca

SEQ ID NO: 538960 - DNA, 16 bp, G. gallus
gctgccagcaggagca

SEQ ID NO: 538961 - DNA, 16 bp, G. gallus
gctgccattcagcaag

SEQ ID NO: 538962 - DNA, 16 bp, G. gallus
gctgcccagagaggct

SEQ ID NO: 538963 - DNA, 16 bp, G. gallus
gctgcccagagatgtg

SEQ ID NO: 538964 - DNA, 16 bp, G. gallus
gctgcccagggaaatg

SEQ ID NO: 538965 - DNA, 16 bp, G. gallus
gctgcccagggaccca

SEQ ID NO: 538966 - DNA, 16 bp, G. gallus
gctgcccagggaggtg

SEQ ID NO: 538967 - DNA, 16 bp, G. gallus
gctgcccagggcagtg

SEQ ID NO: 538968 - DNA, 16 bp, G. gallus
gctgcccagtgcccca

SEQ ID NO: 538969 - DNA, 16 bp, G. gallus
gctgcccccaccagct

SEQ ID NO: 538970 - DNA, 16 bp, G. gallus
gctgcccggggaggtg

SEQ ID NO: 538971 - DNA, 16 bp, G. gallus
gctgcctagagaagct

SEQ ID NO: 538972 - DNA, 16 bp, G. gallus
gctgcgctgcgctgcg

SEQ ID NO: 538973 - DNA, 16 bp, G. gallus
gctgctcagcctggag

SEQ ID NO: 538974 - DNA, 16 bp, G. gallus
gctgctcctctgctgc

SEQ ID NO: 538975 - DNA, 16 bp, G. gallus
gctgctctcaagtcat

SEQ ID NO: 538976 - DNA, 16 bp, G. gallus
gctgctctgaaaataa

SEQ ID NO: 538977 - DNA, 16 bp, G. gallus
gctgctgccactgctg

SEQ ID NO: 538978 - DNA, 16 bp, G. gallus
gctgctgctactgctg

SEQ ID NO: 538979 - DNA, 16 bp, G. gallus
gctgctgctcctgctg

SEQ ID NO: 538980 - DNA, 16 bp, G. gallus
gctgctgctgcagcag

SEQ ID NO: 538981 - DNA, 16 bp, G. gallus
gctgctgctgctcctc

SEQ ID NO: 538982 - DNA, 16 bp, G. gallus
gctgctgctgctcctg

SEQ ID NO: 538983 - DNA, 16 bp, G. gallus
gctgctgctgctctgc

SEQ ID NO: 538984 - DNA, 16 bp, G. gallus
gctgctgctgctgaag

SEQ ID NO: 538985 - DNA, 16 bp, G. gallus
gctgctgctgctgccg

SEQ ID NO: 538986 - DNA, 16 bp, G. gallus
gctgctgctgctgcct

SEQ ID NO: 538987 - DNA, 16 bp, G. gallus
gctgctgctgctgctt

SEQ ID NO: 538988 - DNA, 16 bp, G. gallus
gctgctgctgctggag

SEQ ID NO: 538989 - DNA, 16 bp, G. gallus
gctgctgctgctgggg

SEQ ID NO: 538990 - DNA, 16 bp, G. gallus
gctgctgctgctgttg

SEQ ID NO: 538991 - DNA, 16 bp, G. gallus
gctgctgctgcttctt

SEQ ID NO: 538992 - DNA, 16 bp, G. gallus
gctgctgctggctgtg

SEQ ID NO: 538993 - DNA, 16 bp, G. gallus
gctgctgctgtgctgc

SEQ ID NO: 538994 - DNA, 16 bp, G. gallus
gctgctggagcaggtc

SEQ ID NO: 538995 - DNA, 16 bp, G. gallus
gctgctggcagagctg

SEQ ID NO: 538996 - DNA, 16 bp, G. gallus
gctgctgtgggcaggg

SEQ ID NO: 538997 - DNA, 16 bp, G. gallus
gctgctgttgctgctg

SEQ ID NO: 538998 - DNA, 16 bp, G. gallus
gctgcttctgctgctg

SEQ ID NO: 538999 - DNA, 16 bp, G. gallus
gctggaaaagagctct

SEQ ID NO: 539000 - DNA, 16 bp, G. gallus
gctggaaagctgcaca

SEQ ID NO: 539001 - DNA, 16 bp, G. gallus
gctggacaaggctctg

SEQ ID NO: 539002 - DNA, 16 bp, G. gallus
gctggacatgagccaa

SEQ ID NO: 539003 - DNA, 16 bp, G. gallus
gctggaccaggccctg

SEQ ID NO: 539004 - DNA, 16 bp, G. gallus
gctggactgggtgatc

SEQ ID NO: 539005 - DNA, 16 bp, G. gallus
gctggagaagagaagg

SEQ ID NO: 539006 - DNA, 16 bp, G. gallus
gctggagatccctgca

SEQ ID NO: 539007 - DNA, 16 bp, G. gallus
gctggagcacctctac

SEQ ID NO: 539008 - DNA, 16 bp, G. gallus
gctggagcacctctct

SEQ ID NO: 539009 - DNA, 16 bp, G. gallus
gctggagcaggctgcc

SEQ ID NO: 539010 - DNA, 16 bp, G. gallus
gctggagcaggggctg

SEQ ID NO: 539011 - DNA, 16 bp, G. gallus
gctggagctcttcagc

SEQ ID NO: 539012 - DNA, 16 bp, G. gallus
gctggagctgctgctg

SEQ ID NO: 539013 - DNA, 16 bp, G. gallus
gctggagctgtgggtg

SEQ ID NO: 539014 - DNA, 16 bp, G. gallus
gctggaggaggaggag

SEQ ID NO: 539015 - DNA, 16 bp, G. gallus
gctggatgggaccctg

SEQ ID NO: 539016 - DNA, 16 bp, G. gallus
gctggatggggctttg

SEQ ID NO: 539017 - DNA, 16 bp, G. gallus
gctggatgtggctgtg

SEQ ID NO: 539018 - DNA, 16 bp, G. gallus
gctggcaaccctgcac

SEQ ID NO: 539019 - DNA, 16 bp, G. gallus
gctggcagatctttaa

SEQ ID NO: 539020 - DNA, 16 bp, G. gallus
gctggcagtgctgggc

SEQ ID NO: 539021 - DNA, 16 bp, G. gallus
gctggccacactcttt

SEQ ID NO: 539022 - DNA, 16 bp, G. gallus
gctggctgcccccacc

SEQ ID NO: 539023 - DNA, 16 bp, G. gallus
gctgggagagctgcag

SEQ ID NO: 539024 - DNA, 16 bp, G. gallus
gctgggagccccaggc

SEQ ID NO: 539025 - DNA, 16 bp, G. gallus
gctgggagctgtgctg

SEQ ID NO: 539026 - DNA, 16 bp, G. gallus
gctgggctggatgtgg

SEQ ID NO: 539027 - DNA, 16 bp, G. gallus
gctgggctgggagcag

SEQ ID NO: 539028 - DNA, 16 bp, G. gallus
gctggggctgctgcag

SEQ ID NO: 539029 - DNA, 16 bp, G. gallus
gctggggctggagctg

SEQ ID NO: 539030 - DNA, 16 bp, G. gallus
gctggggctgtgctgg

SEQ ID NO: 539031 - DNA, 16 bp, G. gallus
gctgggggaaaaaaaa

SEQ ID NO: 539032 - DNA, 16 bp, G. gallus
gctgggggagctgctg

SEQ ID NO: 539033 - DNA, 16 bp, G. gallus
gctgggtaaggaactg

SEQ ID NO: 539034 - DNA, 16 bp, G. gallus
gctgggtgctgtgctg

SEQ ID NO: 539035 - DNA, 16 bp, G. gallus
gctggtgagggatctg

SEQ ID NO: 539036 - DNA, 16 bp, G. gallus
gctggtgggggacagc

SEQ ID NO: 539037 - DNA, 16 bp, G. gallus
gctggtggggggcagc

SEQ ID NO: 539038 - DNA, 16 bp, G. gallus
gctggtggttggactg

SEQ ID NO: 539039 - DNA, 16 bp, G. gallus
gctggtggttggtgac

SEQ ID NO: 539040 - DNA, 16 bp, G. gallus
gctgtcacatcacaaa

SEQ ID NO: 539041 - DNA, 16 bp, G. gallus
gctgtcactgctgctg

SEQ ID NO: 539042 - DNA, 16 bp, G. gallus
gctgtcatcactgctg

SEQ ID NO: 539043 - DNA, 16 bp, G. gallus
gctgtctggtgaagtc

SEQ ID NO: 539044 - DNA, 16 bp, G. gallus
gctgtgaaagtaatgc

SEQ ID NO: 539045 - DNA, 16 bp, G. gallus
gctgtgagtgccccat

SEQ ID NO: 539046 - DNA, 16 bp, G. gallus
gctgtgccagcacctc

SEQ ID NO: 539047 - DNA, 16 bp, G. gallus
gctgtgccagggaaga

SEQ ID NO: 539048 - DNA, 16 bp, G. gallus
gctgtgccaggggagg

SEQ ID NO: 539049 - DNA, 16 bp, G. gallus
gctgtgccatgctgtg

SEQ ID NO: 539050 - DNA, 16 bp, G. gallus
gctgtgcccgctgccc

SEQ ID NO: 539051 - DNA, 16 bp, G. gallus
gctgtgctcagccctg

SEQ ID NO: 539052 - DNA, 16 bp, G. gallus
gctgtgctctgtgctg

SEQ ID NO: 539053 - DNA, 16 bp, G. gallus
gctgtgctgctgcagg

SEQ ID NO: 539054 - DNA, 16 bp, G. gallus
gctgtgctgctgctgt

SEQ ID NO: 539055 - DNA, 16 bp, G. gallus
gctgtgctggctgcag

SEQ ID NO: 539056 - DNA, 16 bp, G. gallus
gctgtgctgggctgca

SEQ ID NO: 539057 - DNA, 16 bp, G. gallus
gctgtgctgggctgtg

SEQ ID NO: 539058 - DNA, 16 bp, G. gallus
gctgtgctgtgctggg

SEQ ID NO: 539059 - DNA, 16 bp, G. gallus
gctgtgctgtgctgtg

SEQ ID NO: 539060 - DNA, 16 bp, G. gallus
gctgtgcttgtaaaaa

SEQ ID NO: 539061 - DNA, 16 bp, G. gallus
gctgtggatgctctgt

SEQ ID NO: 539062 - DNA, 16 bp, G. gallus
gctgtggatgtccctg

SEQ ID NO: 539063 - DNA, 16 bp, G. gallus
gctgtggctgtccctg

SEQ ID NO: 539064 - DNA, 16 bp, G. gallus
gctgtggctgtggctg

SEQ ID NO: 539065 - DNA, 16 bp, G. gallus
gctgtgggcagagctg

SEQ ID NO: 539066 - DNA, 16 bp, G. gallus
gctgtggggctgcagc

SEQ ID NO: 539067 - DNA, 16 bp, G. gallus
gctgtgggtgccccgt

SEQ ID NO: 539068 - DNA, 16 bp, G. gallus
gctgtgggtgtccctg

SEQ ID NO: 539069 - DNA, 16 bp, G. gallus
gctgtgtggtgcagtc

SEQ ID NO: 539070 - DNA, 16 bp, G. gallus
gctgttcctcagacac

SEQ ID NO: 539071 - DNA, 16 bp, G. gallus
gctgttgctgctgctg

SEQ ID NO: 539072 - DNA, 16 bp, G. gallus
gcttacagtgagagca

SEQ ID NO: 539073 - DNA, 16 bp, G. gallus
gcttatgaggaaacat

SEQ ID NO: 539074 - DNA, 16 bp, G. gallus
gcttcagtgcattgga

SEQ ID NO: 539075 - DNA, 16 bp, G. gallus
gcttcagtgtgttgga

SEQ ID NO: 539076 - DNA, 16 bp, G. gallus
gcttcccagggcagtg

SEQ ID NO: 539077 - DNA, 16 bp, G. gallus
gcttcctcagcctgtc

SEQ ID NO: 539078 - DNA, 16 bp, G. gallus
gcttgaagcagtgatt

SEQ ID NO: 539079 - DNA, 16 bp, G. gallus
gcttgggctggaaggg

SEQ ID NO: 539080 - DNA, 16 bp, G. gallus
gctttaaaaaaataaa

SEQ ID NO: 539081 - DNA, 16 bp, G. gallus
gctttcctgatcccat

SEQ ID NO: 539082 - DNA, 16 bp, G. gallus
gctttcctgtgcaacc

SEQ ID NO: 539083 - DNA, 16 bp, G. gallus
gctttctcttctccag

SEQ ID NO: 539084 - DNA, 16 bp, G. gallus
gctttttaaaaataaa

SEQ ID NO: 539085 - DNA, 16 bp, G. gallus
ggaaaaacttctccaa

SEQ ID NO: 539086 - DNA, 16 bp, G. gallus
ggaaaaagagaaacat

SEQ ID NO: 539087 - DNA, 16 bp, G. gallus
ggaaaagagaaggctc

SEQ ID NO: 539088 - DNA, 16 bp, G. gallus
ggaaaccagcatggct

SEQ ID NO: 539089 - DNA, 16 bp, G. gallus
ggaaactgaggcactg

SEQ ID NO: 539090 - DNA, 16 bp, G. gallus
ggaaactgaggcagag

SEQ ID NO: 539091 - DNA, 16 bp, G. gallus
ggaaagccaaggccca

SEQ ID NO: 539092 - DNA, 16 bp, G. gallus
ggaaaggggtgatcct

SEQ ID NO: 539093 - DNA, 16 bp, G. gallus
ggaaataaacaggagg

SEQ ID NO: 539094 - DNA, 16 bp, G. gallus
ggaaatattggtggta

SEQ ID NO: 539095 - DNA, 16 bp, G. gallus
ggaaatggaaatggaa

SEQ ID NO: 539096 - DNA, 16 bp, G. gallus
ggaacaagctgcccag

SEQ ID NO: 539097 - DNA, 16 bp, G. gallus
ggaacaatttcttctc

SEQ ID NO: 539098 - DNA, 16 bp, G. gallus
ggaacagcctgcccag

SEQ ID NO: 539099 - DNA, 16 bp, G. gallus
ggaacagcctgttctt

SEQ ID NO: 539100 - DNA, 16 bp, G. gallus
ggaacaggttgcccag

SEQ ID NO: 539101 - DNA, 22 bp, G. gallus
ggaaccccaggcatctatacag

SEQ ID NO: 539102 - DNA, 16 bp, G. gallus
ggaactggcagatgaa

SEQ ID NO: 539103 - DNA, 16 bp, G. gallus
ggaacttgatgatctt

SEQ ID NO: 539104 - DNA, 16 bp, G. gallus
ggaagaagaggctgag

SEQ ID NO: 539105 - DNA, 16 bp, G. gallus
ggaagaattcagtgac

SEQ ID NO: 539106 - DNA, 16 bp, G. gallus
ggaagaattttttttt

SEQ ID NO: 539107 - DNA, 16 bp, G. gallus
ggaagagcagcagcag

SEQ ID NO: 539108 - DNA, 16 bp, G. gallus
ggaagaggaggctgag

SEQ ID NO: 539109 - DNA, 16 bp, G. gallus
ggaagatacatcacag

SEQ ID NO: 539110 - DNA, 16 bp, G. gallus
ggaagcagcagcagca

SEQ ID NO: 539111 - DNA, 16 bp, G. gallus
ggaagccccatccttg

SEQ ID NO: 539112 - DNA, 16 bp, G. gallus
ggaaggacgtggagct

SEQ ID NO: 539113 - DNA, 16 bp, G. gallus
ggaaggcaagagacca

SEQ ID NO: 539114 - DNA, 16 bp, G. gallus
ggaagggacccatgag

SEQ ID NO: 539115 - DNA, 16 bp, G. gallus
ggaaggggaacagctg

SEQ ID NO: 539116 - DNA, 16 bp, G. gallus
ggaaggggacagactc

SEQ ID NO: 539117 - DNA, 16 bp, G. gallus
ggaagggtgatggatg

SEQ ID NO: 539118 - DNA, 16 bp, G. gallus
ggaagtcatcctgccc

SEQ ID NO: 539119 - DNA, 16 bp, G. gallus
ggaatcatagaatcac

SEQ ID NO: 539120 - DNA, 16 bp, G. gallus
ggaatctgctttagca

SEQ ID NO: 539121 - DNA, 16 bp, G. gallus
ggaatgccatccagag

SEQ ID NO: 539122 - DNA, 16 bp, G. gallus
ggaatggttttgaact

SEQ ID NO: 539123 - DNA, 16 bp, G. gallus
ggaatgtgctgcccag

SEQ ID NO: 539124 - DNA, 17 bp, G. gallus
ggaattccaccacaggg

SEQ ID NO: 539125 - DNA, 17 bp, G. gallus
ggaattccaccacagtg

SEQ ID NO: 539126 - DNA, 16 bp, G. gallus
ggaattggaccagatg

SEQ ID NO: 539127 - DNA, 16 bp, G. gallus
ggacaagagggaacag

SEQ ID NO: 539128 - DNA, 16 bp, G. gallus
ggacaagtacctggaa

SEQ ID NO: 539129 - DNA, 16 bp, G. gallus
ggacactttcctgtgc

SEQ ID NO: 539130 - DNA, 16 bp, G. gallus
ggacagactctttagc

SEQ ID NO: 539131 - DNA, 16 bp, G. gallus
ggacaggctggagaag

SEQ ID NO: 539132 - DNA, 16 bp, G. gallus
ggacagtctgagagag

SEQ ID NO: 539133 - DNA, 16 bp, G. gallus
ggacatagtactccag

SEQ ID NO: 539134 - DNA, 16 bp, G. gallus
ggacatccacagcctc

SEQ ID NO: 539135 - DNA, 16 bp, G. gallus
ggacatggttagtggg

SEQ ID NO: 539136 - DNA, 16 bp, G. gallus
ggaccagagagattat

SEQ ID NO: 539137 - DNA, 16 bp, G. gallus
ggacccacagggatca

SEQ ID NO: 539138 - DNA, 16 bp, G. gallus
ggacctcaaagatcat

SEQ ID NO: 539139 - DNA, 16 bp, G. gallus
ggacctcacagcccac

SEQ ID NO: 539140 - DNA, 16 bp, G. gallus
ggacctcagccactcc

SEQ ID NO: 539141 - DNA, 16 bp, G. gallus
ggacctcagctgctcc

SEQ ID NO: 539142 - DNA, 16 bp, G. gallus
ggacggacggacggac

SEQ ID NO: 539143 - DNA, 16 bp, G. gallus
ggactacaatgatcat

SEQ ID NO: 539144 - DNA, 16 bp, G. gallus
ggagaactcattgaga

SEQ ID NO: 539145 - DNA, 16 bp, G. gallus
ggagaactggcttcaa

SEQ ID NO: 539146 - DNA, 16 bp, G. gallus
ggagaagaaatttttc

SEQ ID NO: 539147 - DNA, 16 bp, G. gallus
ggagaagaccttcaag

SEQ ID NO: 539148 - DNA, 16 bp, G. gallus
ggagaagaggctgacc

SEQ ID NO: 539149 - DNA, 16 bp, G. gallus
ggagaagaggctgatc

SEQ ID NO: 539150 - DNA, 16 bp, G. gallus
ggagaaggaagatctg

SEQ ID NO: 539151 - DNA, 16 bp, G. gallus
ggagaaggacttggag

SEQ ID NO: 539152 - DNA, 16 bp, G. gallus
ggagaaggaggctgag

SEQ ID NO: 539153 - DNA, 16 bp, G. gallus
ggagaagggaaggctg

SEQ ID NO: 539154 - DNA, 16 bp, G. gallus
ggagacagacttttta

SEQ ID NO: 539155 - DNA, 19 bp, G. gallus
ggagaccttattgctctct

SEQ ID NO: 539156 - DNA, 16 bp, G. gallus
ggagactgggggatga

SEQ ID NO: 539157 - DNA, 16 bp, G. gallus
ggagagaatcagaaaa

SEQ ID NO: 539158 - DNA, 16 bp, G. gallus
ggagaggatccagagg

SEQ ID NO: 539159 - DNA, 16 bp, G. gallus
ggagaggctgaaggaa

SEQ ID NO: 539160 - DNA, 16 bp, G. gallus
ggagaggctgaaggag

SEQ ID NO: 539161 - DNA, 16 bp, G. gallus
ggagaggctgagagct

SEQ ID NO: 539162 - DNA, 16 bp, G. gallus
ggagaggttgcccaag

SEQ ID NO: 539163 - DNA, 16 bp, G. gallus
ggagatccctgcctac

SEQ ID NO: 539164 - DNA, 16 bp, G. gallus
ggagatgtggcaccga

SEQ ID NO: 539165 - DNA, 16 bp, G. gallus
ggagattcagattgga

SEQ ID NO: 539166 - DNA, 16 bp, G. gallus
ggagcaacttgaggcc

SEQ ID NO: 539167 - DNA, 16 bp, G. gallus
ggagcacagccctgcc

SEQ ID NO: 539168 - DNA, 16 bp, G. gallus
ggagcacaggtgaaga

SEQ ID NO: 539169 - DNA, 16 bp, G. gallus
ggagcacctctgctgt

SEQ ID NO: 539170 - DNA, 16 bp, G. gallus
ggagcagaggctgacc

SEQ ID NO: 539171 - DNA, 16 bp, G. gallus
ggagcagatccagagg

SEQ ID NO: 539172 - DNA, 16 bp, G. gallus
ggagcagcagcaagac

SEQ ID NO: 539173 - DNA, 16 bp, G. gallus
ggagcagccctgccca

SEQ ID NO: 539174 - DNA, 16 bp, G. gallus
ggagcagctggagctg

SEQ ID NO: 539175 - DNA, 16 bp, G. gallus
ggagcctggctgcacc

SEQ ID NO: 539176 - DNA, 16 bp, G. gallus
ggagctacagaaaaga

SEQ ID NO: 539177 - DNA, 16 bp, G. gallus
ggagctcagctgcatg

SEQ ID NO: 539178 - DNA, 16 bp, G. gallus
ggagctcaggtgtatg

SEQ ID NO: 539179 - DNA, 16 bp, G. gallus
ggagctctgagcacct

SEQ ID NO: 539180 - DNA, 16 bp, G. gallus
ggagctgcaggctgcc

SEQ ID NO: 539181 - DNA, 16 bp, G. gallus
ggagctggggctgttt

SEQ ID NO: 539182 - DNA, 16 bp, G. gallus
ggagcttttggagagg

SEQ ID NO: 539183 - DNA, 16 bp, G. gallus
ggaggaaggatctcta

SEQ ID NO: 539184 - DNA, 17 bp, G. gallus
ggaggccttattgctct

SEQ ID NO: 539185 - DNA, 16 bp, G. gallus
ggaggctgcagtgagg

SEQ ID NO: 539186 - DNA, 16 bp, G. gallus
ggagggatgtggagct

SEQ ID NO: 539187 - DNA, 16 bp, G. gallus
ggagggctagggagaa

SEQ ID NO: 539188 - DNA, 16 bp, G. gallus
ggaggtgatcctctcc

SEQ ID NO: 539189 - DNA, 16 bp, G. gallus
ggaggtgctcaaggaa

SEQ ID NO: 539190 - DNA, 16 bp, G. gallus
ggaggtgctccatccc

SEQ ID NO: 539191 - DNA, 16 bp, G. gallus
ggaggtgctggagcag

SEQ ID NO: 539192 - DNA, 16 bp, G. gallus
ggaggtggtggtgtca

SEQ ID NO: 539193 - DNA, 16 bp, G. gallus
ggaggtgttccagagc

SEQ ID NO: 539194 - DNA, 16 bp, G. gallus
ggaggtttctggaatg

SEQ ID NO: 539195 - DNA, 16 bp, G. gallus
ggagtactgtgtccaa

SEQ ID NO: 539196 - DNA, 16 bp, G. gallus
ggagtcactgtccctg

SEQ ID NO: 539197 - DNA, 16 bp, G. gallus
ggagtggatccagagg

SEQ ID NO: 539198 - DNA, 16 bp, G. gallus
ggagtgtagtggaatt

SEQ ID NO: 539199 - DNA, 16 bp, G. gallus
ggagtgtttggacaat

SEQ ID NO: 539200 - DNA, 16 bp, G. gallus
ggagttctgcatccag

SEQ ID NO: 539201 - DNA, 16 bp, G. gallus
ggagttggaactggat

SEQ ID NO: 539202 - DNA, 16 bp, G. gallus
ggagttgttggagcag

SEQ ID NO: 539203 - DNA, 16 bp, G. gallus
ggatatcaggaaaaaa

SEQ ID NO: 539204 - DNA, 16 bp, G. gallus
ggatctctggttggag

SEQ ID NO: 539205 - DNA, 16 bp, G. gallus
ggatctcttcctggag

SEQ ID NO: 539206 - DNA, 16 bp, G. gallus
ggatctgctctgtgat

SEQ ID NO: 539207 - DNA, 16 bp, G. gallus
ggatgaagcacaggaa

SEQ ID NO: 539208 - DNA, 16 bp, G. gallus
ggatgaagttgccaag

SEQ ID NO: 539209 - DNA, 16 bp, G. gallus
ggatgacaccaagctg

SEQ ID NO: 539210 - DNA, 16 bp, G. gallus
ggatgaggccagactc

SEQ ID NO: 539211 - DNA, 16 bp, G. gallus
ggatgccccattgctg

SEQ ID NO: 539212 - DNA, 16 bp, G. gallus
ggatgccccctccttg

SEQ ID NO: 539213 - DNA, 16 bp, G. gallus
ggatggagcattcaca

SEQ ID NO: 539214 - DNA, 16 bp, G. gallus
ggatggctacaaactc

SEQ ID NO: 539215 - DNA, 16 bp, G. gallus
ggatgggctctgggca

SEQ ID NO: 539216 - DNA, 18 bp, G. gallus
ggatggggccctgggcag

SEQ ID NO: 539217 - DNA, 16 bp, G. gallus
ggatggtgactccatc

SEQ ID NO: 539218 - DNA, 16 bp, G. gallus
ggatgtggccctgggc

SEQ ID NO: 539219 - DNA, 16 bp, G. gallus
ggattggactagatga

SEQ ID NO: 539220 - DNA, 16 bp, G. gallus
ggatttgatgggtgga

SEQ ID NO: 539221 - DNA, 16 bp, G. gallus
ggcaaaaactggaaca

SEQ ID NO: 539222 - DNA, 16 bp, G. gallus
ggcaaaaatgcagagc

SEQ ID NO: 539223 - DNA, 16 bp, G. gallus
ggcaacaacatggaat

SEQ ID NO: 539224 - DNA, 16 bp, G. gallus
ggcaacagcaacagtg

SEQ ID NO: 539225 - DNA, 16 bp, G. gallus
ggcaacctgctccagt

SEQ ID NO: 539226 - DNA, 16 bp, G. gallus
ggcaagaaggaggatc

SEQ ID NO: 539227 - DNA, 16 bp, G. gallus
ggcaatggggagctgg

SEQ ID NO: 539228 - DNA, 16 bp, G. gallus
ggcacaaactgaaaca

SEQ ID NO: 539229 - DNA, 16 bp, G. gallus
ggcacaaactggaaca

SEQ ID NO: 539230 - DNA, 16 bp, G. gallus
ggcacagctgcccaag

SEQ ID NO: 539231 - DNA, 16 bp, G. gallus
ggcacaggcagcccag

SEQ ID NO: 539232 - DNA, 16 bp, G. gallus
ggcacagtggggtggg

SEQ ID NO: 539233 - DNA, 16 bp, G. gallus
ggcacctactgacatt

SEQ ID NO: 539234 - DNA, 16 bp, G. gallus
ggcactgaaacaggtt

SEQ ID NO: 539235 - DNA, 16 bp, G. gallus
ggcactggaatggact

SEQ ID NO: 539236 - DNA, 16 bp, G. gallus
ggcagaaactggaaca

SEQ ID NO: 539237 - DNA, 16 bp, G. gallus
ggcagaatcacttccc

SEQ ID NO: 539238 - DNA, 16 bp, G. gallus
ggcagagtggctgaaa

SEQ ID NO: 539239 - DNA, 16 bp, G. gallus
ggcagatctttaagga

SEQ ID NO: 539240 - DNA, 16 bp, G. gallus
ggcagcagcagagcag

SEQ ID NO: 539241 - DNA, 16 bp, G. gallus
ggcagcagcagcactg

SEQ ID NO: 539242 - DNA, 16 bp, G. gallus
ggcagcagcagggctg

SEQ ID NO: 539243 - DNA, 16 bp, G. gallus
ggcagcagctgctgct

SEQ ID NO: 539244 - DNA, 16 bp, G. gallus
ggcagcagtgccagca

SEQ ID NO: 539245 - DNA, 16 bp, G. gallus
ggcagcagtgctgggg

SEQ ID NO: 539246 - DNA, 16 bp, G. gallus
ggcagcagtggggcag

SEQ ID NO: 539247 - DNA, 17 bp, G. gallus
ggcagcccattccagtg

SEQ ID NO: 539248 - DNA, 16 bp, G. gallus
ggcagcctcttccagt

SEQ ID NO: 539249 - DNA, 16 bp, G. gallus
ggcagcctgttccatg

SEQ ID NO: 539250 - DNA, 16 bp, G. gallus
ggcagctcagcaccat

SEQ ID NO: 539251 - DNA, 16 bp, G. gallus
ggcagctgggggtcag

SEQ ID NO: 539252 - DNA, 16 bp, G. gallus
ggcagctgtgccagag

SEQ ID NO: 539253 - DNA, 16 bp, G. gallus
ggcagcttttgaagat

SEQ ID NO: 539254 - DNA, 16 bp, G. gallus
ggcaggaccaacccag

SEQ ID NO: 539255 - DNA, 16 bp, G. gallus
ggcagggacacctccc

SEQ ID NO: 539256 - DNA, 16 bp, G. gallus
ggcagggacacctctc

SEQ ID NO: 539257 - DNA, 16 bp, G. gallus
ggcagggctgcactca

SEQ ID NO: 539258 - DNA, 16 bp, G. gallus
ggcagggctgccagcc

SEQ ID NO: 539259 - DNA, 16 bp, G. gallus
ggcagggctgtgctca

SEQ ID NO: 539260 - DNA, 16 bp, G. gallus
ggcatccacaacctcc

SEQ ID NO: 539261 - DNA, 16 bp, G. gallus
ggcatggagctgtcag

SEQ ID NO: 539262 - DNA, 16 bp, G. gallus
ggccaaatgactgcag

SEQ ID NO: 539263 - DNA, 16 bp, G. gallus
ggccagcaggtcgagg

SEQ ID NO: 539264 - DNA, 16 bp, G. gallus
ggccatgaaccagcag

SEQ ID NO: 539265 - DNA, 16 bp, G. gallus
ggccatgcccactgcc

SEQ ID NO: 539266 - DNA, 16 bp, G. gallus
ggccatgggcagcctg

SEQ ID NO: 539267 - DNA, 16 bp, G. gallus
ggccctggacaacctg

SEQ ID NO: 539268 - DNA, 16 bp, G. gallus
ggccctgggcaacctg

SEQ ID NO: 539269 - DNA, 16 bp, G. gallus
ggccctgggctgcctg

SEQ ID NO: 539270 - DNA, 16 bp, G. gallus
ggccctgtgcagcctg

SEQ ID NO: 539271 - DNA, 16 bp, G. gallus
ggcctcaagctgtgcc

SEQ ID NO: 539272 - DNA, 16 bp, G. gallus
ggcctgatccagcctc

SEQ ID NO: 539273 - DNA, 16 bp, G. gallus
ggcctggagcatctcc

SEQ ID NO: 539274 - DNA, 16 bp, G. gallus
ggcctggcctggcctg

SEQ ID NO: 539275 - DNA, 16 bp, G. gallus
ggcctgggttgcaaag

SEQ ID NO: 539276 - DNA, 16 bp, G. gallus
ggccttgatgtctttc

SEQ ID NO: 539277 - DNA, 16 bp, G. gallus
ggccttgcagagagat

SEQ ID NO: 539278 - DNA, 16 bp, G. gallus
ggcggtgggcacagcc

SEQ ID NO: 539279 - DNA, 16 bp, G. gallus
ggctcaggggaaacct

SEQ ID NO: 539280 - DNA, 16 bp, G. gallus
ggctccagggggacct

SEQ ID NO: 539281 - DNA, 16 bp, G. gallus
ggctctgagcatcctg

SEQ ID NO: 539282 - DNA, 16 bp, G. gallus
ggctctgcgcatgcgc

SEQ ID NO: 539283 - DNA, 16 bp, G. gallus
ggctctggcacagctg

SEQ ID NO: 539284 - DNA, 16 bp, G. gallus
ggctctgggaagactt

SEQ ID NO: 539285 - DNA, 16 bp, G. gallus
ggctctgggcagccag

SEQ ID NO: 539286 - DNA, 16 bp, G. gallus
ggctctgggcagcctg

SEQ ID NO: 539287 - DNA, 16 bp, G. gallus
ggctctgggctgcctg

SEQ ID NO: 539288 - DNA, 16 bp, G. gallus
ggctgaacaaacccag

SEQ ID NO: 539289 - DNA, 16 bp, G. gallus
ggctgaacagccccag

SEQ ID NO: 539290 - DNA, 19 bp, G. gallus
ggctgaccgggtcctttcc

SEQ ID NO: 539291 - DNA, 16 bp, G. gallus
ggctgagcaggaggag

SEQ ID NO: 539292 - DNA, 16 bp, G. gallus
ggctgagcagtgggcc

SEQ ID NO: 539293 - DNA, 16 bp, G. gallus
ggctgagggagctgag

SEQ ID NO: 539294 - DNA, 16 bp, G. gallus
ggctgagggagctggg

SEQ ID NO: 539295 - DNA, 16 bp, G. gallus
ggctgcagacagaggg

SEQ ID NO: 539296 - DNA, 16 bp, G. gallus
ggctgcagcaaatgag

SEQ ID NO: 539297 - DNA, 16 bp, G. gallus
ggctgcagcacagagc

SEQ ID NO: 539298 - DNA, 16 bp, G. gallus
ggctgcagcacagcag

SEQ ID NO: 539299 - DNA, 16 bp, G. gallus
ggctgcagcagggctg

SEQ ID NO: 539300 - DNA, 16 bp, G. gallus
ggctgcagtgctgcag

SEQ ID NO: 539301 - DNA, 16 bp, G. gallus
ggctgcccagcgaggt

SEQ ID NO: 539302 - DNA, 16 bp, G. gallus
ggctgcccagggcctt

SEQ ID NO: 539303 - DNA, 16 bp, G. gallus
ggctgcccggagccac

SEQ ID NO: 539304 - DNA, 16 bp, G. gallus
ggctgctgcagagctg

SEQ ID NO: 539305 - DNA, 16 bp, G. gallus
ggctgctgctgctgct

SEQ ID NO: 539306 - DNA, 16 bp, G. gallus
ggctggaaaagccctc

SEQ ID NO: 539307 - DNA, 16 bp, G. gallus
ggctggaaagctgcat

SEQ ID NO: 539308 - DNA, 16 bp, G. gallus
ggctggacggggctct

SEQ ID NO: 539309 - DNA, 16 bp, G. gallus
ggctggagagcagctc

SEQ ID NO: 539310 - DNA, 16 bp, G. gallus
ggctggagggccaggc

SEQ ID NO: 539311 - DNA, 16 bp, G. gallus
ggctggatggggcctt

SEQ ID NO: 539312 - DNA, 16 bp, G. gallus
ggctggatggggtcct

SEQ ID NO: 539313 - DNA, 16 bp, G. gallus
ggctggctgcccccca

SEQ ID NO: 539314 - DNA, 16 bp, G. gallus
ggctgggcattggtca

SEQ ID NO: 539315 - DNA, 16 bp, G. gallus
ggctgggggagctgcc

SEQ ID NO: 539316 - DNA, 16 bp, G. gallus
ggctgtgagcaacctg

SEQ ID NO: 539317 - DNA, 16 bp, G. gallus
ggctgtgctggggctg

SEQ ID NO: 539318 - DNA, 16 bp, G. gallus
ggctgtggaatctcct

SEQ ID NO: 539319 - DNA, 16 bp, G. gallus
ggctgtgggcagcctg

SEQ ID NO: 539320 - DNA, 16 bp, G. gallus
ggctgtgggtggtgca

SEQ ID NO: 539321 - DNA, 16 bp, G. gallus
ggctgttcagcctgga

SEQ ID NO: 539322 - DNA, 16 bp, G. gallus
ggctttgagcaacctg

SEQ ID NO: 539323 - DNA, 16 bp, G. gallus
gggaaaaaaaaattac

SEQ ID NO: 539324 - DNA, 16 bp, G. gallus
gggaaaaaatatatat

SEQ ID NO: 539325 - DNA, 16 bp, G. gallus
gggaaaatggctttaa

SEQ ID NO: 539326 - DNA, 16 bp, G. gallus
gggaaatggctttaag

SEQ ID NO: 539327 - DNA, 16 bp, G. gallus
gggaacttctggagag

SEQ ID NO: 539328 - DNA, 16 bp, G. gallus
gggaagctacaggaaa

SEQ ID NO: 539329 - DNA, 16 bp, G. gallus
gggaaggcaggaccaa

SEQ ID NO: 539330 - DNA, 16 bp, G. gallus
gggaaggcagggtcaa

SEQ ID NO: 539331 - DNA, 16 bp, G. gallus
gggaagtgatggagtc

SEQ ID NO: 539332 - DNA, 16 bp, G. gallus
gggaatccaccacagg

SEQ ID NO: 539333 - DNA, 16 bp, G. gallus
gggaattggaactaga

SEQ ID NO: 539334 - DNA, 16 bp, G. gallus
gggacacccacagccc

SEQ ID NO: 539335 - DNA, 16 bp, G. gallus
gggacagactcttcag

SEQ ID NO: 539336 - DNA, 16 bp, G. gallus
gggaccagatggcctt

SEQ ID NO: 539337 - DNA, 16 bp, G. gallus
gggacccacagaccca

SEQ ID NO: 539338 - DNA, 16 bp, G. gallus
gggaccggtgctcttt

SEQ ID NO: 539339 - DNA, 16 bp, G. gallus
gggacctcaaggacca

SEQ ID NO: 539340 - DNA, 16 bp, G. gallus
gggacctccagagatc

SEQ ID NO: 539341 - DNA, 16 bp, G. gallus
gggaccttaaagccca

SEQ ID NO: 539342 - DNA, 16 bp, G. gallus
gggactgctcagcctg

SEQ ID NO: 539343 - DNA, 16 bp, G. gallus
gggactggctgggcat

SEQ ID NO: 539344 - DNA, 16 bp, G. gallus
gggagacctcgttgtg

SEQ ID NO: 539345 - DNA, 16 bp, G. gallus
gggagagaactggaaa

SEQ ID NO: 539346 - DNA, 16 bp, G. gallus
gggagatggtggagtc

SEQ ID NO: 539347 - DNA, 16 bp, G. gallus
gggagcagaggccaac

SEQ ID NO: 539348 - DNA, 16 bp, G. gallus
gggagcagcagcagca

SEQ ID NO: 539349 - DNA, 16 bp, G. gallus
gggagcagcagtgaga

SEQ ID NO: 539350 - DNA, 16 bp, G. gallus
gggagcagctctgcag

SEQ ID NO: 539351 - DNA, 16 bp, G. gallus
gggagctgctgcctgt

SEQ ID NO: 539352 - DNA, 16 bp, G. gallus
gggagctgggcttgct

SEQ ID NO: 539353 - DNA, 16 bp, G. gallus
gggagctggtggaggt

SEQ ID NO: 539354 - DNA, 16 bp, G. gallus
gggaggaagtgttgat

SEQ ID NO: 539355 - DNA, 16 bp, G. gallus
gggaggaataaccgca

SEQ ID NO: 539356 - DNA, 16 bp, G. gallus
gggaggaggtggagtc

SEQ ID NO: 539357 - DNA, 16 bp, G. gallus
gggaggtgtccctgcc

SEQ ID NO: 539358 - DNA, 16 bp, G. gallus
gggaggtgttccagcc

SEQ ID NO: 539359 - DNA, 16 bp, G. gallus
gggatcctggggtgca

SEQ ID NO: 539360 - DNA, 16 bp, G. gallus
gggatgagacatccac

SEQ ID NO: 539361 - DNA, 16 bp, G. gallus
gggatggagcacctct

SEQ ID NO: 539362 - DNA, 16 bp, G. gallus
gggatggggcatccgc

SEQ ID NO: 539363 - DNA, 16 bp, G. gallus
gggatggttttaaact

SEQ ID NO: 539364 - DNA, 16 bp, G. gallus
gggcaccaccacctct

SEQ ID NO: 539365 - DNA, 16 bp, G. gallus
gggcacggccccgagt

SEQ ID NO: 539366 - DNA, 16 bp, G. gallus
gggcagagctgctgcc

SEQ ID NO: 539367 - DNA, 16 bp, G. gallus
gggcagcactgagctc

SEQ ID NO: 539368 - DNA, 16 bp, G. gallus
gggcagcagcagcagc

SEQ ID NO: 539369 - DNA, 16 bp, G. gallus
gggcagccacaacctc

SEQ ID NO: 539370 - DNA, 16 bp, G. gallus
gggcagcccgtgccag

SEQ ID NO: 539371 - DNA, 16 bp, G. gallus
gggcagcctgagctgg

SEQ ID NO: 539372 - DNA, 16 bp, G. gallus
gggcagcctgatcttg

SEQ ID NO: 539373 - DNA, 16 bp, G. gallus
gggcagcctgtgcctc

SEQ ID NO: 539374 - DNA, 16 bp, G. gallus
gggcagcctgtgtcag

SEQ ID NO: 539375 - DNA, 16 bp, G. gallus
gggcagcgctgagctc

SEQ ID NO: 539376 - DNA, 16 bp, G. gallus
gggcaggatgacttcc

SEQ ID NO: 539377 - DNA, 16 bp, G. gallus
gggcaggctgtgccag

SEQ ID NO: 539378 - DNA, 16 bp, G. gallus
gggcagtctgacacaa

SEQ ID NO: 539379 - DNA, 16 bp, G. gallus
gggcatcacagcttct

SEQ ID NO: 539380 - DNA, 16 bp, G. gallus
gggcctcaccgccctc

SEQ ID NO: 539381 - DNA, 16 bp, G. gallus
gggcctggagcatctc

SEQ ID NO: 539382 - DNA, 16 bp, G. gallus
gggctgcagggctgtg

SEQ ID NO: 539383 - DNA, 16 bp, G. gallus
gggctgcccagagcca

SEQ ID NO: 539384 - DNA, 16 bp, G. gallus
gggctgcccagggctg

SEQ ID NO: 539385 - DNA, 16 bp, G. gallus
gggctgccccatccca

SEQ ID NO: 539386 - DNA, 16 bp, G. gallus
gggctgcccctcacca

SEQ ID NO: 539387 - DNA, 16 bp, G. gallus
gggctggagcacctcc

SEQ ID NO: 539388 - DNA, 16 bp, G. gallus
gggctggagcacttcc

SEQ ID NO: 539389 - DNA, 16 bp, G. gallus
gggctgggagcagagc

SEQ ID NO: 539390 - DNA, 16 bp, G. gallus
gggctgggagctgcag

SEQ ID NO: 539391 - DNA, 16 bp, G. gallus
gggctgtgctgtgctg

SEQ ID NO: 539392 - DNA, 16 bp, G. gallus
gggctttgcagtcaga

SEQ ID NO: 539393 - DNA, 16 bp, G. gallus
gggcttttggagaatg

SEQ ID NO: 539394 - DNA, 16 bp, G. gallus
ggggaaagttctttac

SEQ ID NO: 539395 - DNA, 16 bp, G. gallus
ggggaacctgctttag

SEQ ID NO: 539396 - DNA, 16 bp, G. gallus
ggggaagttcttcact

SEQ ID NO: 539397 - DNA, 16 bp, G. gallus
ggggaagttctttaca

SEQ ID NO: 539398 - DNA, 16 bp, G. gallus
ggggaatgattttaaa

SEQ ID NO: 539399 - DNA, 16 bp, G. gallus
ggggacagcaggccca

SEQ ID NO: 539400 - DNA, 16 bp, G. gallus
ggggagacctcattgc

SEQ ID NO: 539401 - DNA, 16 bp, G. gallus
ggggagacctcattgt

SEQ ID NO: 539402 - DNA, 16 bp, G. gallus
ggggaggtgctgcagc

SEQ ID NO: 539403 - DNA, 16 bp, G. gallus
ggggaggttcaggttg

SEQ ID NO: 539404 - DNA, 16 bp, G. gallus
ggggatcttattaatg

SEQ ID NO: 539405 - DNA, 16 bp, G. gallus
ggggatgaagtcagaa

SEQ ID NO: 539406 - DNA, 16 bp, G. gallus
ggggatggagagctct

SEQ ID NO: 539407 - DNA, 16 bp, G. gallus
ggggatgggctctgag

SEQ ID NO: 539408 - DNA, 16 bp, G. gallus
ggggcacccagcccac

SEQ ID NO: 539409 - DNA, 16 bp, G. gallus
ggggcagagctgctgc

SEQ ID NO: 539410 - DNA, 16 bp, G. gallus
ggggcagccctgctca

SEQ ID NO: 539411 - DNA, 16 bp, G. gallus
ggggcagtttgacaga

SEQ ID NO: 539412 - DNA, 16 bp, G. gallus
ggggccctgggaagcc

SEQ ID NO: 539413 - DNA, 16 bp, G. gallus
ggggctctgagcaact

SEQ ID NO: 539414 - DNA, 16 bp, G. gallus
ggggctctgagctcct

SEQ ID NO: 539415 - DNA, 16 bp, G. gallus
ggggctctgggcagcc

SEQ ID NO: 539416 - DNA, 16 bp, G. gallus
ggggctgcaccagagg

SEQ ID NO: 539417 - DNA, 16 bp, G. gallus
ggggctgctgctgctg

SEQ ID NO: 539418 - DNA, 16 bp, G. gallus
ggggctgtgggcagcc

SEQ ID NO: 539419 - DNA, 16 bp, G. gallus
gggggaaaaaaagcac

SEQ ID NO: 539420 - DNA, 16 bp, G. gallus
gggggaaactgaggca

SEQ ID NO: 539421 - DNA, 16 bp, G. gallus
gggggaagttctttac

SEQ ID NO: 539422 - DNA, 17 bp, G. gallus
gggggatagctcctcct

SEQ ID NO: 539423 - DNA, 16 bp, G. gallus
gggggggaaaaaaacc

SEQ ID NO: 539424 - DNA, 16 bp, G. gallus
ggggggggttgaaact

SEQ ID NO: 539425 - DNA, 16 bp, G. gallus
ggggtctacaggaaag

SEQ ID NO: 539426 - DNA, 16 bp, G. gallus
ggggtggagcctggct

SEQ ID NO: 539427 - DNA, 16 bp, G. gallus
ggggtggcagcaggga

SEQ ID NO: 539428 - DNA, 16 bp, G. gallus
ggggttgaaagtagat

SEQ ID NO: 539429 - DNA, 16 bp, G. gallus
gggtagtgaggcactg

SEQ ID NO: 539430 - DNA, 16 bp, G. gallus
gggtcagcctcttctc

SEQ ID NO: 539431 - DNA, 16 bp, G. gallus
gggtccagagaagggc

SEQ ID NO: 539432 - DNA, 16 bp, G. gallus
gggtcccttccagctc

SEQ ID NO: 539433 - DNA, 16 bp, G. gallus
gggtcctgatggatga

SEQ ID NO: 539434 - DNA, 16 bp, G. gallus
gggtctcctccttgga

SEQ ID NO: 539435 - DNA, 16 bp, G. gallus
gggtgatctccagagg

SEQ ID NO: 539436 - DNA, 16 bp, G. gallus
gggttcagcctcttct

SEQ ID NO: 539437 - DNA, 16 bp, G. gallus
gggttggaaccggatg

SEQ ID NO: 539438 - DNA, 16 bp, G. gallus
gggttggaagagacct

SEQ ID NO: 539439 - DNA, 16 bp, G. gallus
gggttggaagggaccc

SEQ ID NO: 539440 - DNA, 16 bp, G. gallus
gggttggaagggacct

SEQ ID NO: 539441 - DNA, 16 bp, G. gallus
gggttggaagggactt

SEQ ID NO: 539442 - DNA, 16 bp, G. gallus
gggttggaaggggcct

SEQ ID NO: 539443 - DNA, 16 bp, G. gallus
gggttggagctggatg

SEQ ID NO: 539444 - DNA, 16 bp, G. gallus
gggttggagctgggtg

SEQ ID NO: 539445 - DNA, 18 bp, G. gallus
gggttggatggggccctg

SEQ ID NO: 539446 - DNA, 16 bp, G. gallus
gggtttttttcctcct

SEQ ID NO: 539447 - DNA, 16 bp, G. gallus
ggtaaaggacaacaat

SEQ ID NO: 539448 - DNA, 16 bp, G. gallus
ggtaaatgacattggt

SEQ ID NO: 539449 - DNA, 16 bp, G. gallus
ggtacaaagagcacaa

SEQ ID NO: 539450 - DNA, 16 bp, G. gallus
ggtattaggaagaaat

SEQ ID NO: 539451 - DNA, 16 bp, G. gallus
ggtcacctccactggt

SEQ ID NO: 539452 - DNA, 16 bp, G. gallus
ggtcagcctcttcttc

SEQ ID NO: 539453 - DNA, 16 bp, G. gallus
ggtcaggcagttggac

SEQ ID NO: 539454 - DNA, 16 bp, G. gallus
ggtcaggctggacggg

SEQ ID NO: 539455 - DNA, 16 bp, G. gallus
ggtcatgatgatgaag

SEQ ID NO: 539456 - DNA, 16 bp, G. gallus
ggtccccagtacagga

SEQ ID NO: 539457 - DNA, 16 bp, G. gallus
ggtcccttccaactca

SEQ ID NO: 539458 - DNA, 16 bp, G. gallus
ggtccttctgtcatca

SEQ ID NO: 539459 - DNA, 16 bp, G. gallus
ggtccttgcacagcca

SEQ ID NO: 539460 - DNA, 20 bp, G. gallus
ggtccttttcaacccaggcc

SEQ ID NO: 539461 - DNA, 16 bp, G. gallus
ggtctccatggagcct

SEQ ID NO: 539462 - DNA, 16 bp, G. gallus
ggtctggagccacccc

SEQ ID NO: 539463 - DNA, 16 bp, G. gallus
ggtctgtcttgggacc

SEQ ID NO: 539464 - DNA, 16 bp, G. gallus
ggtcttttccaacctt

SEQ ID NO: 539465 - DNA, 16 bp, G. gallus
ggtgaaagcaattcac

SEQ ID NO: 539466 - DNA, 16 bp, G. gallus
ggtgacagtgacaggg

SEQ ID NO: 539467 - DNA, 16 bp, G. gallus
ggtgacagtgatagga

SEQ ID NO: 539468 - DNA, 16 bp, G. gallus
ggtgaccaagaaggcc

SEQ ID NO: 539469 - DNA, 16 bp, G. gallus
ggtgaggctgcacagc

SEQ ID NO: 539470 - DNA, 16 bp, G. gallus
ggtgatcattgtggtc

SEQ ID NO: 539471 - DNA, 16 bp, G. gallus
ggtgatcctcctcctc

SEQ ID NO: 539472 - DNA, 16 bp, G. gallus
ggtgatcctgcccttc

SEQ ID NO: 539473 - DNA, 16 bp, G. gallus
ggtgatgaggccctgg

SEQ ID NO: 539474 - DNA, 16 bp, G. gallus
ggtgattatgttgaaa

SEQ ID NO: 539475 - DNA, 16 bp, G. gallus
ggtgcagatggagctg

SEQ ID NO: 539476 - DNA, 16 bp, G. gallus
ggtgcagcagtggatg

SEQ ID NO: 539477 - DNA, 16 bp, G. gallus
ggtgcatttcagcagc

SEQ ID NO: 539478 - DNA, 16 bp, G. gallus
ggtgccattttttctg

SEQ ID NO: 539479 - DNA, 16 bp, G. gallus
ggtgccctgggcagcc

SEQ ID NO: 539480 - DNA, 16 bp, G. gallus
ggtgctcagagcccct

SEQ ID NO: 539481 - DNA, 16 bp, G. gallus
ggtgctcagggacgtg

SEQ ID NO: 539482 - DNA, 16 bp, G. gallus
ggtgctgaggcactgg

SEQ ID NO: 539483 - DNA, 16 bp, G. gallus
ggtgctgagggagctg

SEQ ID NO: 539484 - DNA, 16 bp, G. gallus
ggtgctgcatttcagc

SEQ ID NO: 539485 - DNA, 16 bp, G. gallus
ggtgctggcacagctg

SEQ ID NO: 539486 - DNA, 16 bp, G. gallus
ggtgctggcactgctg

SEQ ID NO: 539487 - DNA, 16 bp, G. gallus
ggtgctgggcagcctg

SEQ ID NO: 539488 - DNA, 16 bp, G. gallus
ggtggactgtttgatg

SEQ ID NO: 539489 - DNA, 16 bp, G. gallus
ggtggagctgtgggtg

SEQ ID NO: 539490 - DNA, 16 bp, G. gallus
ggtggatgagaagctg

SEQ ID NO: 539491 - DNA, 16 bp, G. gallus
ggtggatggttggact

SEQ ID NO: 539492 - DNA, 16 bp, G. gallus
ggtggcagccctgccc

SEQ ID NO: 539493 - DNA, 16 bp, G. gallus
ggtggccaggaaggcc

SEQ ID NO: 539494 - DNA, 16 bp, G. gallus
ggtgggaagggacctt

SEQ ID NO: 539495 - DNA, 16 bp, G. gallus
ggtgggggcagccagc

SEQ ID NO: 539496 - DNA, 16 bp, G. gallus
ggtggggtcaccatcc

SEQ ID NO: 539497 - DNA, 16 bp, G. gallus
ggtggtgaagcactgg

SEQ ID NO: 539498 - DNA, 16 bp, G. gallus
ggtggtgaagtcacca

SEQ ID NO: 539499 - DNA, 16 bp, G. gallus
ggtggtgaggcattgg

SEQ ID NO: 539500 - DNA, 16 bp, G. gallus
ggtggtggtgtcacca

SEQ ID NO: 539501 - DNA, 16 bp, G. gallus
ggtggtggtgtcactg

SEQ ID NO: 539502 - DNA, 16 bp, G. gallus
ggtggtggtgtggcag

SEQ ID NO: 539503 - DNA, 16 bp, G. gallus
ggtggtgtggcagtag

SEQ ID NO: 539504 - DNA, 16 bp, G. gallus
ggtggtgttcaaagaa

SEQ ID NO: 539505 - DNA, 16 bp, G. gallus
ggtggttacagcagtg

SEQ ID NO: 539506 - DNA, 23 bp, G. gallus
ggtgttgtgtatgcgtcgcgatg

SEQ ID NO: 539507 - DNA, 16 bp, G. gallus
ggtgttttccaacctg

SEQ ID NO: 539508 - DNA, 16 bp, G. gallus
ggttagtgggcatggt

SEQ ID NO: 539509 - DNA, 16 bp, G. gallus
ggttcaggctggatat

SEQ ID NO: 539510 - DNA, 26 bp, G. gallus
ggttgaaaggccgcagacagagggtg

SEQ ID NO: 539511 - DNA, 16 bp, G. gallus
ggttgctcagggcttt

SEQ ID NO: 539512 - DNA, 16 bp, G. gallus
ggttggaaaagacccc

SEQ ID NO: 539513 - DNA, 16 bp, G. gallus
ggttggaagagacctc

SEQ ID NO: 539514 - DNA, 16 bp, G. gallus
ggttggaagagacttc

SEQ ID NO: 539515 - DNA, 16 bp, G. gallus
ggttggacattaggaa

SEQ ID NO: 539516 - DNA, 16 bp, G. gallus
ggttggaccagatgac

SEQ ID NO: 539517 - DNA, 16 bp, G. gallus
ggttggacttgatgat

SEQ ID NO: 539518 - DNA, 16 bp, G. gallus
ggttggaggagacctc

SEQ ID NO: 539519 - DNA, 16 bp, G. gallus
ggttggaggggacttt

SEQ ID NO: 539520 - DNA, 16 bp, G. gallus
ggttggcagtggaagc

SEQ ID NO: 539521 - DNA, 16 bp, G. gallus
ggtttagtggggaaat

SEQ ID NO: 539522 - DNA, 16 bp, G. gallus
ggtttggaagggacct

SEQ ID NO: 539523 - DNA, 16 bp, G. gallus
ggtttggcccagttct

SEQ ID NO: 539524 - DNA, 16 bp, G. gallus
ggtttgggctggaagg

SEQ ID NO: 539525 - DNA, 16 bp, G. gallus
gtaaaacagatgttta

SEQ ID NO: 539526 - DNA, 16 bp, G. gallus
gtaacagcaaagggac

SEQ ID NO: 539527 - DNA, 16 bp, G. gallus
gtaatgcctcctatgt

SEQ ID NO: 539528 - DNA, 16 bp, G. gallus
gtaatggccttaaatt

SEQ ID NO: 539529 - DNA, 16 bp, G. gallus
gtacacactgctggct

SEQ ID NO: 539530 - DNA, 16 bp, G. gallus
gtacaggaaggatgtg

SEQ ID NO: 539531 - DNA, 16 bp, G. gallus
gtacaggaagtggaag

SEQ ID NO: 539532 - DNA, 16 bp, G. gallus
gtacatatatatatat

SEQ ID NO: 539533 - DNA, 16 bp, G. gallus
gtacctgtagaagcct

SEQ ID NO: 539534 - DNA, 16 bp, G. gallus
gtactggaaagctgca

SEQ ID NO: 539535 - DNA, 16 bp, G. gallus
gtaggacagtccagcc

SEQ ID NO: 539536 - DNA, 16 bp, G. gallus
gtagtgcactggaagt

SEQ ID NO: 539537 - DNA, 16 bp, G. gallus
gtatgcacaggactct

SEQ ID NO: 539538 - DNA, 16 bp, G. gallus
gtatggaatatccctt

SEQ ID NO: 539539 - DNA, 16 bp, G. gallus
gtatgtatatatacac

SEQ ID NO: 539540 - DNA, 16 bp, G. gallus
gtatgtgtgtgtgtgc

SEQ ID NO: 539541 - DNA, 18 bp, G. gallus
gtattccaccacagtggc

SEQ ID NO: 539542 - DNA, 16 bp, G. gallus
gtattggaaggctgca

SEQ ID NO: 539543 - DNA, 16 bp, G. gallus
gtatttaagagatgtg

SEQ ID NO: 539544 - DNA, 16 bp, G. gallus
gtatttggaaaaaaaa

SEQ ID NO: 539545 - DNA, 16 bp, G. gallus
gtcacagaatcacaga

SEQ ID NO: 539546 - DNA, 16 bp, G. gallus
gtcacagcctgaacca

SEQ ID NO: 539547 - DNA, 16 bp, G. gallus
gtcacagtccctggag

SEQ ID NO: 539548 - DNA, 16 bp, G. gallus
gtcaccagagagcaga

SEQ ID NO: 539549 - DNA, 16 bp, G. gallus
gtcactgatctccatc

SEQ ID NO: 539550 - DNA, 16 bp, G. gallus
gtcactgatgaagatg

SEQ ID NO: 539551 - DNA, 16 bp, G. gallus
gtcactgcccctggag

SEQ ID NO: 539552 - DNA, 16 bp, G. gallus
gtcactgttgccactg

SEQ ID NO: 539553 - DNA, 16 bp, G. gallus
gtcagaggcagatggt

SEQ ID NO: 539554 - DNA, 16 bp, G. gallus
gtcagcagggagaggg

SEQ ID NO: 539555 - DNA, 16 bp, G. gallus
gtcagcatggcttcac

SEQ ID NO: 539556 - DNA, 16 bp, G. gallus
gtcagcctcttctccc

SEQ ID NO: 539557 - DNA, 16 bp, G. gallus
gtcagggcttgaagca

SEQ ID NO: 539558 - DNA, 16 bp, G. gallus
gtcatctttgtggccc

SEQ ID NO: 539559 - DNA, 16 bp, G. gallus
gtcatgtcccaccctg

SEQ ID NO: 539560 - DNA, 16 bp, G. gallus
gtccaaccccaaccca

SEQ ID NO: 539561 - DNA, 16 bp, G. gallus
gtccaactccaaccca

SEQ ID NO: 539562 - DNA, 16 bp, G. gallus
gtccaactcctggctg

SEQ ID NO: 539563 - DNA, 16 bp, G. gallus
gtccagaggaggacca

SEQ ID NO: 539564 - DNA, 16 bp, G. gallus
gtccagaggagggcca

SEQ ID NO: 539565 - DNA, 16 bp, G. gallus
gtccagatgagggcca

SEQ ID NO: 539566 - DNA, 16 bp, G. gallus
gtccagcctgatcttg

SEQ ID NO: 539567 - DNA, 16 bp, G. gallus
gtccagctcccctgca

SEQ ID NO: 539568 - DNA, 16 bp, G. gallus
gtcccaagatggaccc

SEQ ID NO: 539569 - DNA, 16 bp, G. gallus
gtcccagatgactgga

SEQ ID NO: 539570 - DNA, 16 bp, G. gallus
gtcccaggcctggatg

SEQ ID NO: 539571 - DNA, 16 bp, G. gallus
gtccctcagtacaaca

SEQ ID NO: 539572 - DNA, 16 bp, G. gallus
gtccctgagccctgca

SEQ ID NO: 539573 - DNA, 16 bp, G. gallus
gtccctgctggagcag

SEQ ID NO: 539574 - DNA, 16 bp, G. gallus
gtcccttccaacccaa

SEQ ID NO: 539575 - DNA, 16 bp, G. gallus
gtcccttccaacctct

SEQ ID NO: 539576 - DNA, 16 bp, G. gallus
gtcccttccaactcta

SEQ ID NO: 539577 - DNA, 16 bp, G. gallus
gtcccttcccacccaa

SEQ ID NO: 539578 - DNA, 16 bp, G. gallus
gtccgtccgtccgtcc

SEQ ID NO: 539579 - DNA, 16 bp, G. gallus
gtcctccccttcccca

SEQ ID NO: 539580 - DNA, 16 bp, G. gallus
gtcctccttgctccct

SEQ ID NO: 539581 - DNA, 16 bp, G. gallus
gtcctcttcaacccag

SEQ ID NO: 539582 - DNA, 16 bp, G. gallus
gtcctgctctgctctg

SEQ ID NO: 539583 - DNA, 16 bp, G. gallus
gtcctggcttgtatca

SEQ ID NO: 539584 - DNA, 16 bp, G. gallus
gtcctggtggacaaca

SEQ ID NO: 539585 - DNA, 16 bp, G. gallus
gtccttcagtgccaca

SEQ ID NO: 539586 - DNA, 16 bp, G. gallus
gtctccagagaaggag

SEQ ID NO: 539587 - DNA, 16 bp, G. gallus
gtctcctcctggtggt

SEQ ID NO: 539588 - DNA, 16 bp, G. gallus
gtctctcacagtattc

SEQ ID NO: 539589 - DNA, 16 bp, G. gallus
gtctctcctcagcctc

SEQ ID NO: 539590 - DNA, 16 bp, G. gallus
gtctcttctcactgat

SEQ ID NO: 539591 - DNA, 16 bp, G. gallus
gtctcttctccctggt

SEQ ID NO: 539592 - DNA, 16 bp, G. gallus
gtctgaggaaaaggag

SEQ ID NO: 539593 - DNA, 16 bp, G. gallus
gtctgatttttggatg

SEQ ID NO: 539594 - DNA, 16 bp, G. gallus
gtctgatttttgggtg

SEQ ID NO: 539595 - DNA, 16 bp, G. gallus
gtctgcagggacgggg

SEQ ID NO: 539596 - DNA, 16 bp, G. gallus
gtctggaggagggcca

SEQ ID NO: 539597 - DNA, 16 bp, G. gallus
gtcttgaaaacctcca

SEQ ID NO: 539598 - DNA, 16 bp, G. gallus
gtcttgggctgcatat

SEQ ID NO: 539599 - DNA, 16 bp, G. gallus
gtcttttccaacttca

SEQ ID NO: 539600 - DNA, 17 bp, G. gallus
gtgaaaaacttcctcct

SEQ ID NO: 539601 - DNA, 16 bp, G. gallus
gtgaaaatgcagagct

SEQ ID NO: 539602 - DNA, 16 bp, G. gallus
gtgaaagacaagccac

SEQ ID NO: 539603 - DNA, 16 bp, G. gallus
gtgaacacagtgaggt

SEQ ID NO: 539604 - DNA, 16 bp, G. gallus
gtgaacagggacacca

SEQ ID NO: 539605 - DNA, 16 bp, G. gallus
gtgaacagggacaccc

SEQ ID NO: 539606 - DNA, 16 bp, G. gallus
gtgaagaatttcttct

SEQ ID NO: 539607 - DNA, 16 bp, G. gallus
gtgaagcagtggaaca

SEQ ID NO: 539608 - DNA, 16 bp, G. gallus
gtgaagctttcccctg

SEQ ID NO: 539609 - DNA, 33 bp, G. gallus
gtgaaggggactgccactgattgcctttattgt

SEQ ID NO: 539610 - DNA, 16 bp, G. gallus
gtgaatccaccacctc

SEQ ID NO: 539611 - DNA, 16 bp, G. gallus
gtgaatgtcagtggat

SEQ ID NO: 539612 - DNA, 16 bp, G. gallus
gtgacaggatgaggag

SEQ ID NO: 539613 - DNA, 16 bp, G. gallus
gtgacatagacagtgg

SEQ ID NO: 539614 - DNA, 16 bp, G. gallus
gtgaccagcagggaga

SEQ ID NO: 539615 - DNA, 16 bp, G. gallus
gtgactctaccacctc

SEQ ID NO: 539616 - DNA, 16 bp, G. gallus
gtgactgtgttaaaaa

SEQ ID NO: 539617 - DNA, 16 bp, G. gallus
gtgagacactggaaca

SEQ ID NO: 539618 - DNA, 16 bp, G. gallus
gtgagggtggtgagat

SEQ ID NO: 539619 - DNA, 16 bp, G. gallus
gtgataggacaagggg

SEQ ID NO: 539620 - DNA, 16 bp, G. gallus
gtgatgacacactgga

SEQ ID NO: 539621 - DNA, 16 bp, G. gallus
gtgatggagcacctgg

SEQ ID NO: 539622 - DNA, 16 bp, G. gallus
gtgatggatggctaca

SEQ ID NO: 539623 - DNA, 16 bp, G. gallus
gtgatgttagcctcct

SEQ ID NO: 539624 - DNA, 16 bp, G. gallus
gtgatgttgccttttt

SEQ ID NO: 539625 - DNA, 16 bp, G. gallus
gtgattctatgatcct

SEQ ID NO: 539626 - DNA, 16 bp, G. gallus
gtgattctgtgatctt

SEQ ID NO: 539627 - DNA, 16 bp, G. gallus
gtgattgcccagccct

SEQ ID NO: 539628 - DNA, 16 bp, G. gallus
gtgcaaatgaagcaaa

SEQ ID NO: 539629 - DNA, 16 bp, G. gallus
gtgcaaggccttgcac

SEQ ID NO: 539630 - DNA, 16 bp, G. gallus
gtgcactcaatcccat

SEQ ID NO: 539631 - DNA, 16 bp, G. gallus
gtgcagaatctggcac

SEQ ID NO: 539632 - DNA, 16 bp, G. gallus
gtgcagagcagagcag

SEQ ID NO: 539633 - DNA, 16 bp, G. gallus
gtgcagagcagagtgg

SEQ ID NO: 539634 - DNA, 16 bp, G. gallus
gtgcagaggaaatgga

SEQ ID NO: 539635 - DNA, 16 bp, G. gallus
gtgcagattttgacaa

SEQ ID NO: 539636 - DNA, 16 bp, G. gallus
gtgcagcaccttgcac

SEQ ID NO: 539637 - DNA, 16 bp, G. gallus
gtgcagccatggagga

SEQ ID NO: 539638 - DNA, 16 bp, G. gallus
gtgcagcctgttccag

SEQ ID NO: 539639 - DNA, 16 bp, G. gallus
gtgcatatgaagtaaa

SEQ ID NO: 539640 - DNA, 16 bp, G. gallus
gtgccacatccataca

SEQ ID NO: 539641 - DNA, 16 bp, G. gallus
gtgccactgcctcatc

SEQ ID NO: 539642 - DNA, 16 bp, G. gallus
gtgccagtgcctcacc

SEQ ID NO: 539643 - DNA, 16 bp, G. gallus
gtgccagtgcctcatc

SEQ ID NO: 539644 - DNA, 16 bp, G. gallus
gtgccatttttctgca

SEQ ID NO: 539645 - DNA, 16 bp, G. gallus
gtgcccagaactggag

SEQ ID NO: 539646 - DNA, 17 bp, G. gallus
gtgcccaggtgtccaag

SEQ ID NO: 539647 - DNA, 16 bp, G. gallus
gtgcctcagtttcccc

SEQ ID NO: 539648 - DNA, 16 bp, G. gallus
gtgcctccaccacctc

SEQ ID NO: 539649 - DNA, 16 bp, G. gallus
gtgcctccagagatgg

SEQ ID NO: 539650 - DNA, 16 bp, G. gallus
gtgcctgcagggatgg

SEQ ID NO: 539651 - DNA, 16 bp, G. gallus
gtgccttaccaccctc

SEQ ID NO: 539652 - DNA, 18 bp, G. gallus
gtgcgtcaccaccctctg

SEQ ID NO: 539653 - DNA, 16 bp, G. gallus
gtgctcagcgcagagc

SEQ ID NO: 539654 - DNA, 16 bp, G. gallus
gtgctcggggacatga

SEQ ID NO: 539655 - DNA, 16 bp, G. gallus
gtgctgactcaagtga

SEQ ID NO: 539656 - DNA, 16 bp, G. gallus
gtgctgagagagctgg

SEQ ID NO: 539657 - DNA, 16 bp, G. gallus
gtgctgcagagctgtg

SEQ ID NO: 539658 - DNA, 16 bp, G. gallus
gtgctgccctgccagc

SEQ ID NO: 539659 - DNA, 16 bp, G. gallus
gtgctgctgctgctcc

SEQ ID NO: 539660 - DNA, 16 bp, G. gallus
gtgctgctgctgtgct

SEQ ID NO: 539661 - DNA, 16 bp, G. gallus
gtgctgctggcagctg

SEQ ID NO: 539662 - DNA, 16 bp, G. gallus
gtgctgctggggctgc

SEQ ID NO: 539663 - DNA, 16 bp, G. gallus
gtgctgctgggtgctg

SEQ ID NO: 539664 - DNA, 16 bp, G. gallus
gtgctgctgtgctgct

SEQ ID NO: 539665 - DNA, 16 bp, G. gallus
gtgctggagcaggtcc

SEQ ID NO: 539666 - DNA, 16 bp, G. gallus
gtgctgggcctggtgc

SEQ ID NO: 539667 - DNA, 16 bp, G. gallus
gtgctggtgacagcag

SEQ ID NO: 539668 - DNA, 16 bp, G. gallus
gtgctgtgcagtgctg

SEQ ID NO: 539669 - DNA, 16 bp, G. gallus
gtgctgtgctgtgcca

SEQ ID NO: 539670 - DNA, 16 bp, G. gallus
gtgctgtgctgtgctg

SEQ ID NO: 539671 - DNA, 16 bp, G. gallus
gtgctgtgttcagttc

SEQ ID NO: 539672 - DNA, 16 bp, G. gallus
gtggaacctggctcca

SEQ ID NO: 539673 - DNA, 16 bp, G. gallus
gtggagaaggacctgg

SEQ ID NO: 539674 - DNA, 16 bp, G. gallus
gtggagcagatcctcc

SEQ ID NO: 539675 - DNA, 16 bp, G. gallus
gtggagtcaccatcca

SEQ ID NO: 539676 - DNA, 16 bp, G. gallus
gtggatatggcactga

SEQ ID NO: 539677 - DNA, 16 bp, G. gallus
gtggatccacctccat

SEQ ID NO: 539678 - DNA, 18 bp, G. gallus
gtggatgccccatccctg

SEQ ID NO: 539679 - DNA, 16 bp, G. gallus
gtggatgtgaacacag

SEQ ID NO: 539680 - DNA, 16 bp, G. gallus
gtggcacagctgctca

SEQ ID NO: 539681 - DNA, 16 bp, G. gallus
gtggcactgaggaatg

SEQ ID NO: 539682 - DNA, 16 bp, G. gallus
gtggcactgagggacg

SEQ ID NO: 539683 - DNA, 16 bp, G. gallus
gtggccaagaaggcca

SEQ ID NO: 539684 - DNA, 16 bp, G. gallus
gtggccaggcactgga

SEQ ID NO: 539685 - DNA, 16 bp, G. gallus
gtggcccaggcaagcc

SEQ ID NO: 539686 - DNA, 16 bp, G. gallus
gtggccctcctctgga

SEQ ID NO: 539687 - DNA, 16 bp, G. gallus
gtggccctgcctgtga

SEQ ID NO: 539688 - DNA, 16 bp, G. gallus
gtggctctgggcagct

SEQ ID NO: 539689 - DNA, 16 bp, G. gallus
gtgggaaggcagagcc

SEQ ID NO: 539690 - DNA, 16 bp, G. gallus
gtgggaggcaaaggga

SEQ ID NO: 539691 - DNA, 16 bp, G. gallus
gtgggcccacttctcc

SEQ ID NO: 539692 - DNA, 16 bp, G. gallus
gtggggagacctcatt

SEQ ID NO: 539693 - DNA, 16 bp, G. gallus
gtggggatgggctggc

SEQ ID NO: 539694 - DNA, 16 bp, G. gallus
gtggggggcagccctg

SEQ ID NO: 539695 - DNA, 16 bp, G. gallus
gtgggtgccccatccc

SEQ ID NO: 539696 - DNA, 16 bp, G. gallus
gtgggtggcaatcctg

SEQ ID NO: 539697 - DNA, 16 bp, G. gallus
gtggtaaagcactgga

SEQ ID NO: 539698 - DNA, 16 bp, G. gallus
gtggtgacagcagcag

SEQ ID NO: 539699 - DNA, 16 bp, G. gallus
gtggtgcatttcagca

SEQ ID NO: 539700 - DNA, 16 bp, G. gallus
gtggtgctcaggaaca

SEQ ID NO: 539701 - DNA, 16 bp, G. gallus
gtggtgctgctgctgc

SEQ ID NO: 539702 - DNA, 16 bp, G. gallus
gtggtggaattccttc

SEQ ID NO: 539703 - DNA, 16 bp, G. gallus
gtggttggactcagtg

SEQ ID NO: 539704 - DNA, 17 bp, G. gallus
gtgtaccttctttagta

SEQ ID NO: 539705 - DNA, 16 bp, G. gallus
gtgtatatatatatat

SEQ ID NO: 539706 - DNA, 16 bp, G. gallus
gtgtatgtatatgtat

SEQ ID NO: 539707 - DNA, 16 bp, G. gallus
gtgtcatcagcaaact

SEQ ID NO: 539708 - DNA, 16 bp, G. gallus
gtgtccaggcctgggg

SEQ ID NO: 539709 - DNA, 16 bp, G. gallus
gtgtccctgttctttg

SEQ ID NO: 539710 - DNA, 16 bp, G. gallus
gtgtctctgttcattg

SEQ ID NO: 539711 - DNA, 16 bp, G. gallus
gtgtctgcagggatgg

SEQ ID NO: 539712 - DNA, 16 bp, G. gallus
gtgtggccagcaggga

SEQ ID NO: 539713 - DNA, 16 bp, G. gallus
gtgtgtgaaaaacttc

SEQ ID NO: 539714 - DNA, 16 bp, G. gallus
gtgtgtgtgcatgcac

SEQ ID NO: 539715 - DNA, 16 bp, G. gallus
gtgtgtgtgtgtaaaa

SEQ ID NO: 539716 - DNA, 16 bp, G. gallus
gtgtgtgtgtgtataa

SEQ ID NO: 539717 - DNA, 16 bp, G. gallus
gtgtgtgtgtgtgaat

SEQ ID NO: 539718 - DNA, 16 bp, G. gallus
gtgtgtgtgtgtgaga

SEQ ID NO: 539719 - DNA, 16 bp, G. gallus
gtgtgtgtgtgtgcct

SEQ ID NO: 539720 - DNA, 16 bp, G. gallus
gtgttatcaacactgt

SEQ ID NO: 539721 - DNA, 16 bp, G. gallus
gtgttcagtgttgggc

SEQ ID NO: 539722 - DNA, 16 bp, G. gallus
gtgttgactatgttga

SEQ ID NO: 539723 - DNA, 16 bp, G. gallus
gttaaggctggaaaag

SEQ ID NO: 539724 - DNA, 16 bp, G. gallus
gttaatgctccagttc

SEQ ID NO: 539725 - DNA, 16 bp, G. gallus
gttagtaaaataagtt

SEQ ID NO: 539726 - DNA, 16 bp, G. gallus
gttatggagcaaatca

SEQ ID NO: 539727 - DNA, 16 bp, G. gallus
gttcaacctccactgc

SEQ ID NO: 539728 - DNA, 16 bp, G. gallus
gttcaacctctgctgc

SEQ ID NO: 539729 - DNA, 16 bp, G. gallus
gttcaacctggagaag

SEQ ID NO: 539730 - DNA, 16 bp, G. gallus
gttcaaggaatgtttg

SEQ ID NO: 539731 - DNA, 16 bp, G. gallus
gttcagagaaggacaa

SEQ ID NO: 539732 - DNA, 16 bp, G. gallus
gttcagggtcaccaac

SEQ ID NO: 539733 - DNA, 16 bp, G. gallus
gttcatatggaacttc
